United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 184

SEQ ID NO: 7669444 - DNA, 23 bp, Homo sapiens
gcctgccatatacctggaaacag

SEQ ID NO: 7669445 - DNA, 23 bp, Homo sapiens
gcctctggagccccagtgctcag

SEQ ID NO: 7669446 - DNA, 19 bp, Homo sapiens
gcctgccagatagtaatga

SEQ ID NO: 7669447 - DNA, 22 bp, Homo sapiens
gcctgccacgcatgcagagtca

SEQ ID NO: 7669448 - DNA, 22 bp, Homo sapiens
gcctgccacgcatgcagagtca

SEQ ID NO: 7669449 - DNA, 22 bp, Homo sapiens
gcctgccacgcatgcagagtca

SEQ ID NO: 7669450 - DNA, 18 bp, Homo sapiens
gcctgccaactcctgatc

SEQ ID NO: 7669451 - DNA, 18 bp, Homo sapiens
gcctgccaactcctgatc

SEQ ID NO: 7669452 - DNA, 22 bp, Homo sapiens
gcctgcctgaaggctgtaccag

SEQ ID NO: 7669453 - DNA, 20 bp, Homo sapiens
gcctgcctcagctagctgag

SEQ ID NO: 7669454 - DNA, 20 bp, Homo sapiens
gcctgcctcagctagctgag

SEQ ID NO: 7669455 - DNA, 22 bp, Homo sapiens
gcctgcctgaaggctgtaccag

SEQ ID NO: 7669456 - DNA, 22 bp, Homo sapiens
gcctgcctgaaggctgtaccag

SEQ ID NO: 7669457 - DNA, 22 bp, Homo sapiens
gcctgcctgaaggctgtaccag

SEQ ID NO: 7669458 - DNA, 22 bp, Homo sapiens
gcctgcctgaaggctgtaccag

SEQ ID NO: 7669459 - DNA, 21 bp, Homo sapiens
gcctgcctgcgtgaccctctt

SEQ ID NO: 7669460 - DNA, 23 bp, Homo sapiens
gcctgcctgacctgtgcaaagtc

SEQ ID NO: 7669461 - DNA, 22 bp, Homo sapiens
gcctgcctgaaggctgtaccag

SEQ ID NO: 7669462 - DNA, 22 bp, Homo sapiens
gcctgcctgaaggctgtaccag

SEQ ID NO: 7669463 - DNA, 23 bp, Homo sapiens
gcctgcctgacctgtgcaaagtc

SEQ ID NO: 7669464 - DNA, 23 bp, Homo sapiens
gcctgcctgacctgtgcaaagtc

SEQ ID NO: 7669465 - DNA, 23 bp, Homo sapiens
gcctgcctgacctgtgcaaagtc

SEQ ID NO: 7669466 - DNA, 23 bp, Homo sapiens
gcctgcctgacctgtgcaaagtc

SEQ ID NO: 7669467 - DNA, 22 bp, Homo sapiens
gcctgcctcaaaatcccagttc

SEQ ID NO: 7669468 - DNA, 22 bp, Homo sapiens
gcctgcctcaaaatcccagttc

SEQ ID NO: 7669469 - DNA, 18 bp, Homo sapiens
gcctgcctagagcttgcc

SEQ ID NO: 7669470 - DNA, 22 bp, Homo sapiens
gcctgcctcaaaatcccagttc

SEQ ID NO: 7669471 - DNA, 22 bp, Homo sapiens
gcctgcctcaaaatcccagttc

SEQ ID NO: 7669472 - DNA, 22 bp, Homo sapiens
gcctgcctcaaaatcccagttc

SEQ ID NO: 7669473 - DNA, 22 bp, Homo sapiens
gcctgcctcaaaatcccagttc

SEQ ID NO: 7669474 - DNA, 22 bp, Homo sapiens
gcctgcctcaaaatcccagttc

SEQ ID NO: 7669475 - DNA, 22 bp, Homo sapiens
gcctgcctcaaaatcccagttc

SEQ ID NO: 7669476 - DNA, 20 bp, Homo sapiens
gcctgcctcagctagctgag

SEQ ID NO: 7669477 - DNA, 20 bp, Homo sapiens
gcctgcctcagctagctgag

SEQ ID NO: 7669478 - DNA, 20 bp, Homo sapiens
gcctgcctcagctagctgag

SEQ ID NO: 7669479 - DNA, 20 bp, Homo sapiens
gcctgcctcagctagctgag

SEQ ID NO: 7669480 - DNA, 20 bp, Homo sapiens
gcctgcctcagctagctgag

SEQ ID NO: 7669481 - DNA, 20 bp, Homo sapiens
gcctgcctcagctagctgag

SEQ ID NO: 7669482 - DNA, 20 bp, Homo sapiens
gcctgcctcagctagctgag

SEQ ID NO: 7669483 - DNA, 22 bp, Homo sapiens
gcctgcctcaaaatcccagttc

SEQ ID NO: 7669484 - DNA, 22 bp, Homo sapiens
gctggcctgcgagggcaggctg

SEQ ID NO: 7669485 - DNA, 22 bp, Homo sapiens
gctggcctgcgagggcaggctg

SEQ ID NO: 7669486 - DNA, 22 bp, Homo sapiens
gctggcctgcgagggcaggctg

SEQ ID NO: 7669487 - DNA, 22 bp, Homo sapiens
gctggcctgctgggcaccaccg

SEQ ID NO: 7669488 - DNA, 22 bp, Homo sapiens
gctggcctgctgggcaccaccg

SEQ ID NO: 7669489 - DNA, 22 bp, Homo sapiens
gctggcctgctgggcaccaccg

SEQ ID NO: 7669490 - DNA, 22 bp, Homo sapiens
gctggcctgggcagaggctatg

SEQ ID NO: 7669491 - DNA, 22 bp, Homo sapiens
gctggcctgggcagaggctatg

SEQ ID NO: 7669492 - DNA, 22 bp, Homo sapiens
gctggcctgggcagaggctatg

SEQ ID NO: 7669493 - DNA, 22 bp, Homo sapiens
gctggcctgctgggcaccaccg

SEQ ID NO: 7669494 - DNA, 22 bp, Homo sapiens
gctggcctgggcagaggctatg

SEQ ID NO: 7669495 - DNA, 22 bp, Homo sapiens
gctggcctgggcagaggctatg

SEQ ID NO: 7669496 - DNA, 22 bp, Homo sapiens
gctggcctgggcagaggctatg

SEQ ID NO: 7669497 - DNA, 22 bp, Homo sapiens
gctggcctgggcagaggctatg

SEQ ID NO: 7669498 - DNA, 22 bp, Homo sapiens
gctggcctgggcagaggctatg

SEQ ID NO: 7669499 - DNA, 22 bp, Homo sapiens
gctggcctgggcagcctgtcgg

SEQ ID NO: 7669500 - DNA, 22 bp, Homo sapiens
gctggcctgggcagcctgtcgg

SEQ ID NO: 7669501 - DNA, 22 bp, Homo sapiens
gctggcctgggcagcctgtcgg

SEQ ID NO: 7669502 - DNA, 22 bp, Homo sapiens
gctggcctgggcagcctgtcgg

SEQ ID NO: 7669503 - DNA, 22 bp, Homo sapiens
gctggcctgggcagcctgtcgg

SEQ ID NO: 7669504 - DNA, 22 bp, Homo sapiens
gctggcctgggctcaagaccag

SEQ ID NO: 7669505 - DNA, 22 bp, Homo sapiens
gctggcctgggctcaagaccag

SEQ ID NO: 7669506 - DNA, 22 bp, Homo sapiens
gctggcctgggctcaagaccag

SEQ ID NO: 7669507 - DNA, 22 bp, Homo sapiens
gctggcctgggctcaagaccag

SEQ ID NO: 7669508 - DNA, 22 bp, Homo sapiens
gctggccttgaggtgtctttat

SEQ ID NO: 7669509 - DNA, 22 bp, Homo sapiens
gctggcctgtctagagccttac

SEQ ID NO: 7669510 - DNA, 22 bp, Homo sapiens
gctggcctgtctagagccttac

SEQ ID NO: 7669511 - DNA, 22 bp, Homo sapiens
gctggcctttgaggaagctgcg

SEQ ID NO: 7669512 - DNA, 22 bp, Homo sapiens
gctggccttgtgtctgaggaag

SEQ ID NO: 7669513 - DNA, 22 bp, Homo sapiens
gctggccttgtgtctgaggaag

SEQ ID NO: 7669514 - DNA, 22 bp, Homo sapiens
gctggccttgtgtctgaggaag

SEQ ID NO: 7669515 - DNA, 22 bp, Homo sapiens
gctggccttgtgtctgaggaag

SEQ ID NO: 7669516 - DNA, 22 bp, Homo sapiens
gctggccttgtgtctgaggaag

SEQ ID NO: 7669517 - DNA, 22 bp, Homo sapiens
gctggccttgtgtctgaggaag

SEQ ID NO: 7669518 - DNA, 22 bp, Homo sapiens
gctggccttgtgtctgaggaag

SEQ ID NO: 7669519 - DNA, 22 bp, Homo sapiens
gctggccttgaggtgtctttat

SEQ ID NO: 7669520 - DNA, 22 bp, Homo sapiens
gctggccttgaggtgtctttat

SEQ ID NO: 7669521 - DNA, 22 bp, Homo sapiens
gctggccttgtgtctgaggaag

SEQ ID NO: 7669522 - DNA, 22 bp, Homo sapiens
gctggccttgtgtctgaggaag

SEQ ID NO: 7669523 - DNA, 22 bp, Homo sapiens
gctgggatgcgtcttcccaggc

SEQ ID NO: 7669524 - DNA, 22 bp, Homo sapiens
gctgggatgcgtcttcccaggc

SEQ ID NO: 7669525 - DNA, 22 bp, Homo sapiens
gctgggatgcgtcttcccaggc

SEQ ID NO: 7669526 - DNA, 22 bp, Homo sapiens
gctgggatgcgtcttcccaggc

SEQ ID NO: 7669527 - DNA, 22 bp, Homo sapiens
gctgggatgcgtcttcccaggc

SEQ ID NO: 7669528 - DNA, 22 bp, Homo sapiens
gctgggatgcgtcttcccaggc

SEQ ID NO: 7669529 - DNA, 22 bp, Homo sapiens
gctgggcaacggaagagagaaa

SEQ ID NO: 7669530 - DNA, 22 bp, Homo sapiens
gctgggcaacggaagagagaaa

SEQ ID NO: 7669531 - DNA, 22 bp, Homo sapiens
gctgggatggagactgcagtga

SEQ ID NO: 7669532 - DNA, 22 bp, Homo sapiens
gctgggatggagactgcagtga

SEQ ID NO: 7669533 - DNA, 22 bp, Homo sapiens
gctgggatggagactgcagtga

SEQ ID NO: 7669534 - DNA, 22 bp, Homo sapiens
gctgggcaacggaagagagaaa

SEQ ID NO: 7669535 - DNA, 22 bp, Homo sapiens
gctgggagtttgatttgactgg

SEQ ID NO: 7669536 - DNA, 22 bp, Homo sapiens
gctgggagtttgatttgactgg

SEQ ID NO: 7669537 - DNA, 22 bp, Homo sapiens
gctgggagttactgtctccttt

SEQ ID NO: 7669538 - DNA, 22 bp, Homo sapiens
gctgggagttactgtctccttt

SEQ ID NO: 7669539 - DNA, 22 bp, Homo sapiens
gctgggagttactgtctccttt

SEQ ID NO: 7669540 - DNA, 22 bp, Homo sapiens
gctgggagttactgtctccttt

SEQ ID NO: 7669541 - DNA, 22 bp, Homo sapiens
gctggcggcagtggtgtctctg

SEQ ID NO: 7669542 - DNA, 22 bp, Homo sapiens
gctggcggcagtggtgtctctg

SEQ ID NO: 7669543 - DNA, 22 bp, Homo sapiens
gctgggagtgggcaagatgaga

SEQ ID NO: 7669544 - DNA, 22 bp, Homo sapiens
gctgggagtgggcaagatgaga

SEQ ID NO: 7669545 - DNA, 21 bp, Homo sapiens
gctggctcaaatgcttgtgtc

SEQ ID NO: 7669546 - DNA, 22 bp, Homo sapiens
gctgggagtgggcaagatgaga

SEQ ID NO: 7669547 - DNA, 22 bp, Homo sapiens
gctggcctttgaggaagctgcg

SEQ ID NO: 7669548 - DNA, 22 bp, Homo sapiens
gctggcctttgaggaagctgcg

SEQ ID NO: 7669549 - DNA, 22 bp, Homo sapiens
gctggcctttgaggaagctgcg

SEQ ID NO: 7669550 - DNA, 22 bp, Homo sapiens
gctggcctttgaggaagctgcg

SEQ ID NO: 7669551 - DNA, 22 bp, Homo sapiens
gctggcggcagtggtgtctctg

SEQ ID NO: 7669552 - DNA, 22 bp, Homo sapiens
gctggcctttgaggaagctgcg

SEQ ID NO: 7669553 - DNA, 22 bp, Homo sapiens
gctgggagttactgtctccttt

SEQ ID NO: 7669554 - DNA, 22 bp, Homo sapiens
gctgggagtgggcaagatgaga

SEQ ID NO: 7669555 - DNA, 22 bp, Homo sapiens
gctgggagtgggcaagatgaga

SEQ ID NO: 7669556 - DNA, 22 bp, Homo sapiens
gctgggagtgggcaagatgaga

SEQ ID NO: 7669557 - DNA, 22 bp, Homo sapiens
gctgggagtgggcaagatgaga

SEQ ID NO: 7669558 - DNA, 22 bp, Homo sapiens
gctgggagtgggcaagatgaga

SEQ ID NO: 7669559 - DNA, 22 bp, Homo sapiens
gctgggagtgggcaagatgaga

SEQ ID NO: 7669560 - DNA, 22 bp, Homo sapiens
gctgggcaaggctgaagctacc

SEQ ID NO: 7669561 - DNA, 22 bp, Homo sapiens
gctgggcaacgggcagaaagat

SEQ ID NO: 7669562 - DNA, 22 bp, Homo sapiens
gctgggcaacgggcagaaagat

SEQ ID NO: 7669563 - DNA, 22 bp, Homo sapiens
gctgggcaacgggcagaaagat

SEQ ID NO: 7669564 - DNA, 22 bp, Homo sapiens
gctgggcaagtgccttgggttt

SEQ ID NO: 7669565 - DNA, 22 bp, Homo sapiens
gctgggcaagtgccttgggttt

SEQ ID NO: 7669566 - DNA, 22 bp, Homo sapiens
gctgggcaagtgccttgggttt

SEQ ID NO: 7669567 - DNA, 22 bp, Homo sapiens
gctgggcaagtgccttgggttt

SEQ ID NO: 7669568 - DNA, 22 bp, Homo sapiens
gctgggcaagtgccttgggttt

SEQ ID NO: 7669569 - DNA, 22 bp, Homo sapiens
gctgggcaatgccagagaggag

SEQ ID NO: 7669570 - DNA, 22 bp, Homo sapiens
gctgggcaatgccagagaggag

SEQ ID NO: 7669571 - DNA, 22 bp, Homo sapiens
gctgggcaatgccagagaggag

SEQ ID NO: 7669572 - DNA, 22 bp, Homo sapiens
gctgggcaatgccagagaggag

SEQ ID NO: 7669573 - DNA, 22 bp, Homo sapiens
gctgggcaatgccagagaggag

SEQ ID NO: 7669574 - DNA, 22 bp, Homo sapiens
gctgggcacctctcccagattg

SEQ ID NO: 7669575 - DNA, 22 bp, Homo sapiens
gctgggcacctctcccagattg

SEQ ID NO: 7669576 - DNA, 22 bp, Homo sapiens
gctgggcactgtcccataggct

SEQ ID NO: 7669577 - DNA, 22 bp, Homo sapiens
gctgggcactgtcccataggct

SEQ ID NO: 7669578 - DNA, 22 bp, Homo sapiens
gctgggcactgtcccataggct

SEQ ID NO: 7669579 - DNA, 22 bp, Homo sapiens
gctgggcaccggagagacccca

SEQ ID NO: 7669580 - DNA, 22 bp, Homo sapiens
gctgggcaccggagagacccca

SEQ ID NO: 7669581 - DNA, 22 bp, Homo sapiens
gctgggcaccggagagacccca

SEQ ID NO: 7669582 - DNA, 22 bp, Homo sapiens
gctgggcaccggagagacccca

SEQ ID NO: 7669583 - DNA, 22 bp, Homo sapiens
gctgggcaccggagagacccca

SEQ ID NO: 7669584 - DNA, 22 bp, Homo sapiens
gctgggcaatgccagagaggag

SEQ ID NO: 7669585 - DNA, 22 bp, Homo sapiens
gctgggcaatgccagagaggag

SEQ ID NO: 7669586 - DNA, 22 bp, Homo sapiens
gctgggcaatgccagagaggag

SEQ ID NO: 7669587 - DNA, 22 bp, Homo sapiens
gctgggcagcctggccgctgcc

SEQ ID NO: 7669588 - DNA, 22 bp, Homo sapiens
gctgggcagcctggccgctgcc

SEQ ID NO: 7669589 - DNA, 22 bp, Homo sapiens
gctgggcagcctggccgctgcc

SEQ ID NO: 7669590 - DNA, 22 bp, Homo sapiens
gctgggcagcctggccgctgcc

SEQ ID NO: 7669591 - DNA, 22 bp, Homo sapiens
gctgggcagcctggccgctgcc

SEQ ID NO: 7669592 - DNA, 22 bp, Homo sapiens
gctgggcagcccctacagagag

SEQ ID NO: 7669593 - DNA, 22 bp, Homo sapiens
gctgggcagcccctacagagag

SEQ ID NO: 7669594 - DNA, 22 bp, Homo sapiens
gctgggcagcaggctctccggg

SEQ ID NO: 7669595 - DNA, 22 bp, Homo sapiens
gctgggcagcaggctctccggg

SEQ ID NO: 7669596 - DNA, 22 bp, Homo sapiens
gctgggcagcaggctctccggg

SEQ ID NO: 7669597 - DNA, 22 bp, Homo sapiens
gctgggcagcaggctctccggg

SEQ ID NO: 7669598 - DNA, 22 bp, Homo sapiens
gctgggcagcaggctctccggg

SEQ ID NO: 7669599 - DNA, 22 bp, Homo sapiens
gctgggcagcaggctctccggg

SEQ ID NO: 7669600 - DNA, 22 bp, Homo sapiens
gctgggcagcccctacagagag

SEQ ID NO: 7669601 - DNA, 22 bp, Homo sapiens
gctgggcagcccctacagagag

SEQ ID NO: 7669602 - DNA, 22 bp, Homo sapiens
gctgggcagcccctacagagag

SEQ ID NO: 7669603 - DNA, 22 bp, Homo sapiens
gctgggcagtgagtgagtcctt

SEQ ID NO: 7669604 - DNA, 22 bp, Homo sapiens
gctgggcagtgagtgagtcctt

SEQ ID NO: 7669605 - DNA, 22 bp, Homo sapiens
gctgggcagtgagtgagtcctt

SEQ ID NO: 7669606 - DNA, 22 bp, Homo sapiens
gctgggcagtgagtgagtcctt

SEQ ID NO: 7669607 - DNA, 22 bp, Homo sapiens
gctgggcaggcctcgtgagggc

SEQ ID NO: 7669608 - DNA, 22 bp, Homo sapiens
gctgggcaggcctcgtgagggc

SEQ ID NO: 7669609 - DNA, 22 bp, Homo sapiens
gctgggcaggcctcgtgagggc

SEQ ID NO: 7669610 - DNA, 22 bp, Homo sapiens
gctgggcaggcctcgtgagggc

SEQ ID NO: 7669611 - DNA, 22 bp, Homo sapiens
gctgggcagctgaggcctctca

SEQ ID NO: 7669612 - DNA, 22 bp, Homo sapiens
gctgggcagctgaggcctctca

SEQ ID NO: 7669613 - DNA, 22 bp, Homo sapiens
gctgggcaggcctcgtgagggc

SEQ ID NO: 7669614 - DNA, 22 bp, Homo sapiens
gctgggcaggcctcgtgagggc

SEQ ID NO: 7669615 - DNA, 22 bp, Homo sapiens
gctgggcaggcctcgtgagggc

SEQ ID NO: 7669616 - DNA, 22 bp, Homo sapiens
gctgggcagctgaggcctctca

SEQ ID NO: 7669617 - DNA, 22 bp, Homo sapiens
gctgggcagctgaggcctctca

SEQ ID NO: 7669618 - DNA, 22 bp, Homo sapiens
gctgggcagctgaggcctctca

SEQ ID NO: 7669619 - DNA, 22 bp, Homo sapiens
gctgggcagctgaggcctctca

SEQ ID NO: 7669620 - DNA, 22 bp, Homo sapiens
gctgggcagctgaggcctctca

SEQ ID NO: 7669621 - DNA, 22 bp, Homo sapiens
gctgggcagctgaggcctctca

SEQ ID NO: 7669622 - DNA, 22 bp, Homo sapiens
gctgggcagctgaggcctctca

SEQ ID NO: 7669623 - DNA, 22 bp, Homo sapiens
gctggagatgctatgcagaggg

SEQ ID NO: 7669624 - DNA, 22 bp, Homo sapiens
gctggagatgctatgcagaggg

SEQ ID NO: 7669625 - DNA, 22 bp, Homo sapiens
gctggagatgctatgcagaggg

SEQ ID NO: 7669626 - DNA, 22 bp, Homo sapiens
gctggagatgctatgcagaggg

SEQ ID NO: 7669627 - DNA, 22 bp, Homo sapiens
gctggagatgctatgcagaggg

SEQ ID NO: 7669628 - DNA, 22 bp, Homo sapiens
gctggagatgctatgcagaggg

SEQ ID NO: 7669629 - DNA, 22 bp, Homo sapiens
gctggagatgctatgcagaggg

SEQ ID NO: 7669630 - DNA, 22 bp, Homo sapiens
gctggagccattggcttggcct

SEQ ID NO: 7669631 - DNA, 22 bp, Homo sapiens
gctggagccttctgctctgttg

SEQ ID NO: 7669632 - DNA, 22 bp, Homo sapiens
gctggagccattggcttggcct

SEQ ID NO: 7669633 - DNA, 22 bp, Homo sapiens
gctggagccaagctgctcttgg

SEQ ID NO: 7669634 - DNA, 22 bp, Homo sapiens
gctggagccattggcttggcct

SEQ ID NO: 7669635 - DNA, 22 bp, Homo sapiens
gctggagcgggttcgggccgct

SEQ ID NO: 7669636 - DNA, 22 bp, Homo sapiens
gctggagccttctgctctgttg

SEQ ID NO: 7669637 - DNA, 22 bp, Homo sapiens
gctggagcgggttcgggccgct

SEQ ID NO: 7669638 - DNA, 22 bp, Homo sapiens
gctggagccttctgctctgttg

SEQ ID NO: 7669639 - DNA, 22 bp, Homo sapiens
gctggagccttctgctctgttg

SEQ ID NO: 7669640 - DNA, 22 bp, Homo sapiens
gctggagctgagttccctgggc

SEQ ID NO: 7669641 - DNA, 22 bp, Homo sapiens
gctggagctgcagcctgggcct

SEQ ID NO: 7669642 - DNA, 22 bp, Homo sapiens
gctggagctgagttccctgggc

SEQ ID NO: 7669643 - DNA, 22 bp, Homo sapiens
gctggagctgagttccctgggc

SEQ ID NO: 7669644 - DNA, 22 bp, Homo sapiens
gctggagatagtaggatccata

SEQ ID NO: 7669645 - DNA, 22 bp, Homo sapiens
gctggagatagtaggatccata

SEQ ID NO: 7669646 - DNA, 22 bp, Homo sapiens
gctggagatagtaggatccata

SEQ ID NO: 7669647 - DNA, 22 bp, Homo sapiens
gctggagatagtaggatccata

SEQ ID NO: 7669648 - DNA, 22 bp, Homo sapiens
gctggagatgctatgcagaggg

SEQ ID NO: 7669649 - DNA, 22 bp, Homo sapiens
gctggagatgctatgcagaggg

SEQ ID NO: 7669650 - DNA, 22 bp, Homo sapiens
gctggagatagtaggatccata

SEQ ID NO: 7669651 - DNA, 22 bp, Homo sapiens
gctggagatgctatgcagaggg

SEQ ID NO: 7669652 - DNA, 22 bp, Homo sapiens
gctggagatagaatggccactg

SEQ ID NO: 7669653 - DNA, 22 bp, Homo sapiens
gctggagatagaatggccactg

SEQ ID NO: 7669654 - DNA, 22 bp, Homo sapiens
gctggagatagaatggccactg

SEQ ID NO: 7669655 - DNA, 22 bp, Homo sapiens
gctggagatagaatggccactg

SEQ ID NO: 7669656 - DNA, 22 bp, Homo sapiens
gctggagatagaatggccactg

SEQ ID NO: 7669657 - DNA, 22 bp, Homo sapiens
gctggagatagaatggccactg

SEQ ID NO: 7669658 - DNA, 22 bp, Homo sapiens
gctggagatagaatggccactg

SEQ ID NO: 7669659 - DNA, 22 bp, Homo sapiens
gctggagatactgctcagtatc

SEQ ID NO: 7669660 - DNA, 22 bp, Homo sapiens
gctggagatactgctcagtatc

SEQ ID NO: 7669661 - DNA, 22 bp, Homo sapiens
gctggagatactgctcagtatc

SEQ ID NO: 7669662 - DNA, 22 bp, Homo sapiens
gctggagatagaatggccactg

SEQ ID NO: 7669663 - DNA, 22 bp, Homo sapiens
gctggagatagaatggccactg

SEQ ID NO: 7669664 - DNA, 22 bp, Homo sapiens
gctggagaggggtcactctgag

SEQ ID NO: 7669665 - DNA, 22 bp, Homo sapiens
gctggagaggggtcactctgag

SEQ ID NO: 7669666 - DNA, 22 bp, Homo sapiens
gctggagagtagtaagcagtta

SEQ ID NO: 7669667 - DNA, 22 bp, Homo sapiens
gctggagagtagtaagcagtta

SEQ ID NO: 7669668 - DNA, 22 bp, Homo sapiens
gctggagagtagtaagcagtta

SEQ ID NO: 7669669 - DNA, 22 bp, Homo sapiens
gctggagagtgaggggagcaag

SEQ ID NO: 7669670 - DNA, 22 bp, Homo sapiens
gctggagagtgaggggagcaag

SEQ ID NO: 7669671 - DNA, 22 bp, Homo sapiens
gctggagagtagtaagcagtta

SEQ ID NO: 7669672 - DNA, 22 bp, Homo sapiens
gctggagagtgaggggagcaag

SEQ ID NO: 7669673 - DNA, 22 bp, Homo sapiens
gctggagagtagtaagcagtta

SEQ ID NO: 7669674 - DNA, 22 bp, Homo sapiens
gctggagagtgaggggagcaag

SEQ ID NO: 7669675 - DNA, 22 bp, Homo sapiens
gctggagagtgaggggagcaag

SEQ ID NO: 7669676 - DNA, 22 bp, Homo sapiens
gctggagagtgaggggagcaag

SEQ ID NO: 7669677 - DNA, 22 bp, Homo sapiens
gctggagagtgaggggagcaag

SEQ ID NO: 7669678 - DNA, 22 bp, Homo sapiens
gctggagagtgaggggagcaag

SEQ ID NO: 7669679 - DNA, 22 bp, Homo sapiens
gctggagatactgctcagtatc

SEQ ID NO: 7669680 - DNA, 22 bp, Homo sapiens
gctggagatactgctcagtatc

SEQ ID NO: 7669681 - DNA, 22 bp, Homo sapiens
gctggagatactgctcagtatc

SEQ ID NO: 7669682 - DNA, 22 bp, Homo sapiens
gctggagatactgctcagtatc

SEQ ID NO: 7669683 - DNA, 22 bp, Homo sapiens
gctggcctctggagaagggctt

SEQ ID NO: 7669684 - DNA, 22 bp, Homo sapiens
gctggcctctggagaagggctt

SEQ ID NO: 7669685 - DNA, 22 bp, Homo sapiens
gctggcctctggagaagggctt

SEQ ID NO: 7669686 - DNA, 22 bp, Homo sapiens
gctggcctctggagaagggctt

SEQ ID NO: 7669687 - DNA, 22 bp, Homo sapiens
gctggcctctggagaagggctt

SEQ ID NO: 7669688 - DNA, 22 bp, Homo sapiens
gctggcctctggagaagggctt

SEQ ID NO: 7669689 - DNA, 22 bp, Homo sapiens
gctggcctgaccagccacaggc

SEQ ID NO: 7669690 - DNA, 22 bp, Homo sapiens
gctggcctgaccagccacaggc

SEQ ID NO: 7669691 - DNA, 22 bp, Homo sapiens
gctggcctctggagaagggctt

SEQ ID NO: 7669692 - DNA, 22 bp, Homo sapiens
gctggcctgaccagccacaggc

SEQ ID NO: 7669693 - DNA, 22 bp, Homo sapiens
gctggcctgaccagccacaggc

SEQ ID NO: 7669694 - DNA, 22 bp, Homo sapiens
gctggcctcgcaggcaggatgt

SEQ ID NO: 7669695 - DNA, 22 bp, Homo sapiens
gctggcctcgcaggcaggatgt

SEQ ID NO: 7669696 - DNA, 22 bp, Homo sapiens
gctggcctcgcaggcaggatgt

SEQ ID NO: 7669697 - DNA, 22 bp, Homo sapiens
gctggcctctacaggccggcca

SEQ ID NO: 7669698 - DNA, 22 bp, Homo sapiens
gctggcctctacaggccggcca

SEQ ID NO: 7669699 - DNA, 22 bp, Homo sapiens
gctggcctctacaggccggcca

SEQ ID NO: 7669700 - DNA, 22 bp, Homo sapiens
gctggcctctacaggccggcca

SEQ ID NO: 7669701 - DNA, 22 bp, Homo sapiens
gctggcctctacaggccggcca

SEQ ID NO: 7669702 - DNA, 22 bp, Homo sapiens
gctggcctgacctgaggctggg

SEQ ID NO: 7669703 - DNA, 22 bp, Homo sapiens
gctggcctgacctgaggctggg

SEQ ID NO: 7669704 - DNA, 22 bp, Homo sapiens
gctggcctgagggccgaggctc

SEQ ID NO: 7669705 - DNA, 22 bp, Homo sapiens
gctggcctgagggccgaggctc

SEQ ID NO: 7669706 - DNA, 22 bp, Homo sapiens
gctggcctgcaaagcccggctg

SEQ ID NO: 7669707 - DNA, 22 bp, Homo sapiens
gctggcctgcgagggcaggctg

SEQ ID NO: 7669708 - DNA, 22 bp, Homo sapiens
gctggcctgcgagggcaggctg

SEQ ID NO: 7669709 - DNA, 22 bp, Homo sapiens
gctggcctgcaaagcccggctg

SEQ ID NO: 7669710 - DNA, 22 bp, Homo sapiens
gctggcctgcaaagcccggctg

SEQ ID NO: 7669711 - DNA, 22 bp, Homo sapiens
gctggcctgaccagccacaggc

SEQ ID NO: 7669712 - DNA, 22 bp, Homo sapiens
gctggcctgacctgaggctggg

SEQ ID NO: 7669713 - DNA, 22 bp, Homo sapiens
gctggcctgacctgaggctggg

SEQ ID NO: 7669714 - DNA, 22 bp, Homo sapiens
gctggcctgacctgaggctggg

SEQ ID NO: 7669715 - DNA, 22 bp, Homo sapiens
gctggcctgacctgaggctggg

SEQ ID NO: 7669716 - DNA, 22 bp, Homo sapiens
gctggcctgacctgaggctggg

SEQ ID NO: 7669717 - DNA, 22 bp, Homo sapiens
gctggcctgacctgaggctggg

SEQ ID NO: 7669718 - DNA, 22 bp, Homo sapiens
gctggcctgacctgaggctggg

SEQ ID NO: 7669719 - DNA, 22 bp, Homo sapiens
gctggcctgacctgaggctggg

SEQ ID NO: 7669720 - DNA, 22 bp, Homo sapiens
gctggcctcctgctagatggaa

SEQ ID NO: 7669721 - DNA, 22 bp, Homo sapiens
gctggcctcctgctagatggaa

SEQ ID NO: 7669722 - DNA, 22 bp, Homo sapiens
gctggcctcctgctagatggaa

SEQ ID NO: 7669723 - DNA, 22 bp, Homo sapiens
gctggcctcgcaggcaggatgt

SEQ ID NO: 7669724 - DNA, 22 bp, Homo sapiens
gctggcctcgcaggcaggatgt

SEQ ID NO: 7669725 - DNA, 22 bp, Homo sapiens
gctggcctcgcaggcaggatgt

SEQ ID NO: 7669726 - DNA, 19 bp, Homo sapiens
gctggcccctgggatccag

SEQ ID NO: 7669727 - DNA, 19 bp, Homo sapiens
gctggcccctgggatccag

SEQ ID NO: 7669728 - DNA, 22 bp, Homo sapiens
gctggcctcatcactgacttct

SEQ ID NO: 7669729 - DNA, 22 bp, Homo sapiens
gctggcctcatcactgacttct

SEQ ID NO: 7669730 - DNA, 22 bp, Homo sapiens
gctggcctcatcactgacttct

SEQ ID NO: 7669731 - DNA, 22 bp, Homo sapiens
gctggcccagtgacccacagtg

SEQ ID NO: 7669732 - DNA, 22 bp, Homo sapiens
gctggcccagtgacccacagtg

SEQ ID NO: 7669733 - DNA, 22 bp, Homo sapiens
gctggcccagtgacccacagtg

SEQ ID NO: 7669734 - DNA, 22 bp, Homo sapiens
gctggcccagtgacccacagtg

SEQ ID NO: 7669735 - DNA, 22 bp, Homo sapiens
gctggcccagggtcacctagga

SEQ ID NO: 7669736 - DNA, 22 bp, Homo sapiens
gctggcccagggtcacctagga

SEQ ID NO: 7669737 - DNA, 22 bp, Homo sapiens
gctggccccgagtgctacgctc

SEQ ID NO: 7669738 - DNA, 22 bp, Homo sapiens
gctggccccgagtgctacgctc

SEQ ID NO: 7669739 - DNA, 22 bp, Homo sapiens
gctggccccgagtgctacgctc

SEQ ID NO: 7669740 - DNA, 19 bp, Homo sapiens
gctggcccctgggatccag

SEQ ID NO: 7669741 - DNA, 22 bp, Homo sapiens
gctggccccgagtgctacgctc

SEQ ID NO: 7669742 - DNA, 22 bp, Homo sapiens
gctggccagggctgctcgcgga

SEQ ID NO: 7669743 - DNA, 22 bp, Homo sapiens
gctggccaggtgctttggttct

SEQ ID NO: 7669744 - DNA, 22 bp, Homo sapiens
gctggccagtgtcccagggatc

SEQ ID NO: 7669745 - DNA, 22 bp, Homo sapiens
gctggccagtgtcccagggatc

SEQ ID NO: 7669746 - DNA, 22 bp, Homo sapiens
gctggccagtgtcccagggatc

SEQ ID NO: 7669747 - DNA, 22 bp, Homo sapiens
gctggccagtgtcccagggatc

SEQ ID NO: 7669748 - DNA, 22 bp, Homo sapiens
gctggccagtgtcccagggatc

SEQ ID NO: 7669749 - DNA, 22 bp, Homo sapiens
gctggccagtgtcccagggatc

SEQ ID NO: 7669750 - DNA, 22 bp, Homo sapiens
gctggcccagggtcacctagga

SEQ ID NO: 7669751 - DNA, 22 bp, Homo sapiens
gctggccagtgtcccagggatc

SEQ ID NO: 7669752 - DNA, 22 bp, Homo sapiens
gctggccagtgtcccagggatc

SEQ ID NO: 7669753 - DNA, 22 bp, Homo sapiens
gctggagctgcagcctgggcct

SEQ ID NO: 7669754 - DNA, 22 bp, Homo sapiens
gctggagctgcagcctgggcct

SEQ ID NO: 7669755 - DNA, 22 bp, Homo sapiens
gctggagctgcagcctgggcct

SEQ ID NO: 7669756 - DNA, 22 bp, Homo sapiens
gctgctctctccctaagttggg

SEQ ID NO: 7669757 - DNA, 22 bp, Homo sapiens
gctgctctccatggccgtgagt

SEQ ID NO: 7669758 - DNA, 20 bp, Homo sapiens
gctgctctccacggtctgca

SEQ ID NO: 7669759 - DNA, 22 bp, Homo sapiens
gctgctctccatggccgtgagt

SEQ ID NO: 7669760 - DNA, 22 bp, Homo sapiens
gctgctctccaagcctccttga

SEQ ID NO: 7669761 - DNA, 22 bp, Homo sapiens
gctgctctccaagcctccttga

SEQ ID NO: 7669762 - DNA, 22 bp, Homo sapiens
gctgctctcagagctcatgctg

SEQ ID NO: 7669763 - DNA, 22 bp, Homo sapiens
gctgctctcatagatggcttca

SEQ ID NO: 7669764 - DNA, 22 bp, Homo sapiens
gctgctctcagagctcatgctg

SEQ ID NO: 7669765 - DNA, 22 bp, Homo sapiens
gctgctctcatagatggcttca

SEQ ID NO: 7669766 - DNA, 22 bp, Homo sapiens
gctgctctcatagatggcttca

SEQ ID NO: 7669767 - DNA, 22 bp, Homo sapiens
gctgctctccaagcctccttga

SEQ ID NO: 7669768 - DNA, 22 bp, Homo sapiens
gctgctctccaagcctccttga

SEQ ID NO: 7669769 - DNA, 22 bp, Homo sapiens
gctgctctggctctgcagtgtc

SEQ ID NO: 7669770 - DNA, 22 bp, Homo sapiens
gctgctctggctctgcagtgtc

SEQ ID NO: 7669771 - DNA, 19 bp, Homo sapiens
gctgctctgggtctcatct

SEQ ID NO: 7669772 - DNA, 22 bp, Homo sapiens
gctgctctggctctgcagtgtc

SEQ ID NO: 7669773 - DNA, 19 bp, Homo sapiens
gctgctctgggtctcatct

SEQ ID NO: 7669774 - DNA, 19 bp, Homo sapiens
gctgctctgggtctcatct

SEQ ID NO: 7669775 - DNA, 22 bp, Homo sapiens
gctgctctctccctaagttggg

SEQ ID NO: 7669776 - DNA, 22 bp, Homo sapiens
gctgctctctccctaagttggg

SEQ ID NO: 7669777 - DNA, 22 bp, Homo sapiens
gctgctctgaaaatgactgttg

SEQ ID NO: 7669778 - DNA, 22 bp, Homo sapiens
gctgctctggctctgcagtgtc

SEQ ID NO: 7669779 - DNA, 22 bp, Homo sapiens
gctgctctggctctgcagtgtc

SEQ ID NO: 7669780 - DNA, 22 bp, Homo sapiens
gctgctctggctctgcagtgtc

SEQ ID NO: 7669781 - DNA, 22 bp, Homo sapiens
gctgctctgctgtgtaagcagg

SEQ ID NO: 7669782 - DNA, 22 bp, Homo sapiens
gctgctctgaaaatgactgttg

SEQ ID NO: 7669783 - DNA, 22 bp, Homo sapiens
gctgctctgctgtgtaagcagg

SEQ ID NO: 7669784 - DNA, 22 bp, Homo sapiens
gctgcctgggcaggaggcgctg

SEQ ID NO: 7669785 - DNA, 22 bp, Homo sapiens
gctgcctgggcaggaggcgctg

SEQ ID NO: 7669786 - DNA, 22 bp, Homo sapiens
gctgcctgggcaggaggcgctg

SEQ ID NO: 7669787 - DNA, 22 bp, Homo sapiens
gctgcctgggcaggaggcgctg

SEQ ID NO: 7669788 - DNA, 22 bp, Homo sapiens
gctgcctggtttctcagctgca

SEQ ID NO: 7669789 - DNA, 22 bp, Homo sapiens
gctgcctggtttctcagctgca

SEQ ID NO: 7669790 - DNA, 22 bp, Homo sapiens
gctgcctggtttctcagctgca

SEQ ID NO: 7669791 - DNA, 22 bp, Homo sapiens
gctgcctggtttctcagctgca

SEQ ID NO: 7669792 - DNA, 22 bp, Homo sapiens
gctgcctggtttctcagctgca

SEQ ID NO: 7669793 - DNA, 22 bp, Homo sapiens
gctgcctgggctggcattccca

SEQ ID NO: 7669794 - DNA, 22 bp, Homo sapiens
gctgcctgggctggcattccca

SEQ ID NO: 7669795 - DNA, 22 bp, Homo sapiens
gctgcctgtcccaggatgagga

SEQ ID NO: 7669796 - DNA, 22 bp, Homo sapiens
gctgcctgtcccaggatgagga

SEQ ID NO: 7669797 - DNA, 22 bp, Homo sapiens
gctgcctgtcccaggatgagga

SEQ ID NO: 7669798 - DNA, 22 bp, Homo sapiens
gctgcctggtttctcagctgca

SEQ ID NO: 7669799 - DNA, 22 bp, Homo sapiens
gctgcctggtttctcagctgca

SEQ ID NO: 7669800 - DNA, 22 bp, Homo sapiens
gctgcctggtttctcagctgca

SEQ ID NO: 7669801 - DNA, 22 bp, Homo sapiens
gctgcctggtttctcagctgca

SEQ ID NO: 7669802 - DNA, 22 bp, Homo sapiens
gctgcctggtttctcagctgca

SEQ ID NO: 7669803 - DNA, 22 bp, Homo sapiens
gctgcctggtttctcagctgca

SEQ ID NO: 7669804 - DNA, 21 bp, Homo sapiens
gctgctcgagatccagtgctt

SEQ ID NO: 7669805 - DNA, 22 bp, Homo sapiens
gctgcctgtcccaggatgagga

SEQ ID NO: 7669806 - DNA, 22 bp, Homo sapiens
gctgcctgtcccaggatgagga

SEQ ID NO: 7669807 - DNA, 22 bp, Homo sapiens
gctgcctgtcccaggatgagga

SEQ ID NO: 7669808 - DNA, 22 bp, Homo sapiens
gctgctctacccatgcatctgt

SEQ ID NO: 7669809 - DNA, 22 bp, Homo sapiens
gctgctctacccatgcatctgt

SEQ ID NO: 7669810 - DNA, 22 bp, Homo sapiens
gctgctctcagagctcatgctg

SEQ ID NO: 7669811 - DNA, 22 bp, Homo sapiens
gctgctctacccatgcatctgt

SEQ ID NO: 7669812 - DNA, 22 bp, Homo sapiens
gctgctctacccatgcatctgt

SEQ ID NO: 7669813 - DNA, 20 bp, Homo sapiens
gctgctcgctgcagtcactc

SEQ ID NO: 7669814 - DNA, 20 bp, Homo sapiens
gctgctcgctgcagtcactc

SEQ ID NO: 7669815 - DNA, 22 bp, Homo sapiens
gctgctcttgaggggctcactg

SEQ ID NO: 7669816 - DNA, 22 bp, Homo sapiens
gctgctcttgaggggctcactg

SEQ ID NO: 7669817 - DNA, 22 bp, Homo sapiens
gctgctcttgaggggctcactg

SEQ ID NO: 7669818 - DNA, 22 bp, Homo sapiens
gctgctcttgaggggctcactg

SEQ ID NO: 7669819 - DNA, 22 bp, Homo sapiens
gctgctctgttaattgctgtaa

SEQ ID NO: 7669820 - DNA, 22 bp, Homo sapiens
gctgctctgttaattgctgtaa

SEQ ID NO: 7669821 - DNA, 22 bp, Homo sapiens
gctgctctgtgacagcctccgg

SEQ ID NO: 7669822 - DNA, 22 bp, Homo sapiens
gctgctctgtgacagcctccgg

SEQ ID NO: 7669823 - DNA, 22 bp, Homo sapiens
gctgctctgtgacagcctccgg

SEQ ID NO: 7669824 - DNA, 22 bp, Homo sapiens
gctgctctgggtctgcccagct

SEQ ID NO: 7669825 - DNA, 22 bp, Homo sapiens
gctgctctgggtctgcccagct

SEQ ID NO: 7669826 - DNA, 22 bp, Homo sapiens
gctgctctgggtctgcccagct

SEQ ID NO: 7669827 - DNA, 22 bp, Homo sapiens
gctgctctgggtctgcccagct

SEQ ID NO: 7669828 - DNA, 22 bp, Homo sapiens
gctgctgatgggcagggagtcg

SEQ ID NO: 7669829 - DNA, 22 bp, Homo sapiens
gctgctgcaagagccagctctt

SEQ ID NO: 7669830 - DNA, 22 bp, Homo sapiens
gctgctgcaagagccagctctt

SEQ ID NO: 7669831 - DNA, 20 bp, Homo sapiens
gctgctgagcttccctgggg

SEQ ID NO: 7669832 - DNA, 20 bp, Homo sapiens
gctgctgagcttccctgggg

SEQ ID NO: 7669833 - DNA, 22 bp, Homo sapiens
gctgctgagaattgcaggcaag

SEQ ID NO: 7669834 - DNA, 22 bp, Homo sapiens
gctgctcttttcagagatgaga

SEQ ID NO: 7669835 - DNA, 22 bp, Homo sapiens
gctgctcttttcagagatgaga

SEQ ID NO: 7669836 - DNA, 22 bp, Homo sapiens
gctgctgcaagagccagctctt

SEQ ID NO: 7669837 - DNA, 22 bp, Homo sapiens
gctgctgcatgaacagcggtca

SEQ ID NO: 7669838 - DNA, 21 bp, Homo sapiens
gctgctgcccctagtgaggcc

SEQ ID NO: 7669839 - DNA, 21 bp, Homo sapiens
gctgctgcccctagtgaggcc

SEQ ID NO: 7669840 - DNA, 21 bp, Homo sapiens
gctgctgcccctagtgaggcc

SEQ ID NO: 7669841 - DNA, 22 bp, Homo sapiens
gctgctgcaagagccagctctt

SEQ ID NO: 7669842 - DNA, 22 bp, Homo sapiens
gctgctgccgcggccgctggga

SEQ ID NO: 7669843 - DNA, 22 bp, Homo sapiens
gctgctgccgcggccgctggga

SEQ ID NO: 7669844 - DNA, 22 bp, Homo sapiens
gctgctgccgcggccgctggga

SEQ ID NO: 7669845 - DNA, 22 bp, Homo sapiens
gctgctgccgcggccgctggga

SEQ ID NO: 7669846 - DNA, 21 bp, Homo sapiens
gctgctgcccctagtgaggcc

SEQ ID NO: 7669847 - DNA, 22 bp, Homo sapiens
gctgctgctggtctggggccac

SEQ ID NO: 7669848 - DNA, 22 bp, Homo sapiens
gctgctgctggtctggggccac

SEQ ID NO: 7669849 - DNA, 22 bp, Homo sapiens
gctgctgctggtctggggccac

SEQ ID NO: 7669850 - DNA, 22 bp, Homo sapiens
gctgctgctggtctggggccac

SEQ ID NO: 7669851 - DNA, 22 bp, Homo sapiens
gctgctgctggtctggggccac

SEQ ID NO: 7669852 - DNA, 22 bp, Homo sapiens
gctgctgctggtctggggccac

SEQ ID NO: 7669853 - DNA, 22 bp, Homo sapiens
gctgctgctgaggatgcacctg

SEQ ID NO: 7669854 - DNA, 19 bp, Homo sapiens
gctgctgctcctccctcgc

SEQ ID NO: 7669855 - DNA, 22 bp, Homo sapiens
gctgctgcgcttgtctactgtt

SEQ ID NO: 7669856 - DNA, 22 bp, Homo sapiens
gctgctgcgcttgtctactgtt

SEQ ID NO: 7669857 - DNA, 19 bp, Homo sapiens
gctgctgctcctccctcgc

SEQ ID NO: 7669858 - DNA, 19 bp, Homo sapiens
gctgctgctcctccctcgc

SEQ ID NO: 7669859 - DNA, 22 bp, Homo sapiens
gctgctgcctgtagccagggtg

SEQ ID NO: 7669860 - DNA, 22 bp, Homo sapiens
gctgctgcctgtagccagggtg

SEQ ID NO: 7669861 - DNA, 22 bp, Homo sapiens
gctgctgcgcttgtctactgtt

SEQ ID NO: 7669862 - DNA, 22 bp, Homo sapiens
gctgctgcgcttgtctactgtt

SEQ ID NO: 7669863 - DNA, 22 bp, Homo sapiens
gctgctgcctgtagccagggtg

SEQ ID NO: 7669864 - DNA, 22 bp, Homo sapiens
gctgctgccgcggccgctggga

SEQ ID NO: 7669865 - DNA, 22 bp, Homo sapiens
gctgctgcctgtagccagggtg

SEQ ID NO: 7669866 - DNA, 22 bp, Homo sapiens
gctgctgcctgtagccagggtg

SEQ ID NO: 7669867 - DNA, 22 bp, Homo sapiens
gctgctgcctgtagccagggtg

SEQ ID NO: 7669868 - DNA, 21 bp, Homo sapiens
gctggagagccaggcaggggc

SEQ ID NO: 7669869 - DNA, 22 bp, Homo sapiens
gctggagaggatcccaaagcca

SEQ ID NO: 7669870 - DNA, 22 bp, Homo sapiens
gctggagaggatcccaaagcca

SEQ ID NO: 7669871 - DNA, 21 bp, Homo sapiens
gctggagagccaggcaggggc

SEQ ID NO: 7669872 - DNA, 21 bp, Homo sapiens
gctggagagccaggcaggggc

SEQ ID NO: 7669873 - DNA, 22 bp, Homo sapiens
gctggagaggggtcactctgag

SEQ ID NO: 7669874 - DNA, 22 bp, Homo sapiens
gctggagaggggtcactctgag

SEQ ID NO: 7669875 - DNA, 22 bp, Homo sapiens
gctggagaggggtcactctgag

SEQ ID NO: 7669876 - DNA, 22 bp, Homo sapiens
gctggagaggatcccaaagcca

SEQ ID NO: 7669877 - DNA, 22 bp, Homo sapiens
gctggagaggatcccaaagcca

SEQ ID NO: 7669878 - DNA, 22 bp, Homo sapiens
gctggagaggggtcactctgag

SEQ ID NO: 7669879 - DNA, 22 bp, Homo sapiens
gctggagaggggtcactctgag

SEQ ID NO: 7669880 - DNA, 16 bp, Homo sapiens
gctgctgcttcctgct

SEQ ID NO: 7669881 - DNA, 22 bp, Homo sapiens
gctgctgcttgaaggctcggag

SEQ ID NO: 7669882 - DNA, 21 bp, Homo sapiens
gctggagagccaggcaggggc

SEQ ID NO: 7669883 - DNA, 22 bp, Homo sapiens
gctgctgcttgaaggctcggag

SEQ ID NO: 7669884 - DNA, 21 bp, Homo sapiens
gctggagagccaggcaggggc

SEQ ID NO: 7669885 - DNA, 21 bp, Homo sapiens
gctggagagccaggcaggggc

SEQ ID NO: 7669886 - DNA, 21 bp, Homo sapiens
gctggagagccaggcaggggc

SEQ ID NO: 7669887 - DNA, 21 bp, Homo sapiens
gctggagagccaggcaggggc

SEQ ID NO: 7669888 - DNA, 21 bp, Homo sapiens
gctggagagccaggcaggggc

SEQ ID NO: 7669889 - DNA, 22 bp, Homo sapiens
gctgcctgctcggctcctggga

SEQ ID NO: 7669890 - DNA, 22 bp, Homo sapiens
gctgcctgctcggctcctggga

SEQ ID NO: 7669891 - DNA, 22 bp, Homo sapiens
gctgcctgctcggctcctggga

SEQ ID NO: 7669892 - DNA, 22 bp, Homo sapiens
gctgcctgctcggctcctggga

SEQ ID NO: 7669893 - DNA, 22 bp, Homo sapiens
gctgcctgctcggctcctggga

SEQ ID NO: 7669894 - DNA, 22 bp, Homo sapiens
gctgcctgctcggctcctggga

SEQ ID NO: 7669895 - DNA, 22 bp, Homo sapiens
gctgcctgctcggctcctggga

SEQ ID NO: 7669896 - DNA, 22 bp, Homo sapiens
gctgcctgctcggctcctggga

SEQ ID NO: 7669897 - DNA, 22 bp, Homo sapiens
gctgcctgctcacccggcctgg

SEQ ID NO: 7669898 - DNA, 22 bp, Homo sapiens
gctgcctgctcggctcctggga

SEQ ID NO: 7669899 - DNA, 22 bp, Homo sapiens
gctgcctgctcggctcctggga

SEQ ID NO: 7669900 - DNA, 22 bp, Homo sapiens
gctgcctgctcggctcctggga

SEQ ID NO: 7669901 - DNA, 22 bp, Homo sapiens
gctgcctgctcggctcctggga

SEQ ID NO: 7669902 - DNA, 22 bp, Homo sapiens
gctgcctggaataacggctggc

SEQ ID NO: 7669903 - DNA, 22 bp, Homo sapiens
gctgcctggaataacggctggc

SEQ ID NO: 7669904 - DNA, 22 bp, Homo sapiens
gctgcctggaataacggctggc

SEQ ID NO: 7669905 - DNA, 22 bp, Homo sapiens
gctgcctggaataacggctggc

SEQ ID NO: 7669906 - DNA, 22 bp, Homo sapiens
gctgcctggaataacggctggc

SEQ ID NO: 7669907 - DNA, 22 bp, Homo sapiens
gctgcctggaataacggctggc

SEQ ID NO: 7669908 - DNA, 22 bp, Homo sapiens
gctgcctgcttcatgtgggaga

SEQ ID NO: 7669909 - DNA, 22 bp, Homo sapiens
gctgcctgcttcatgtgggaga

SEQ ID NO: 7669910 - DNA, 22 bp, Homo sapiens
gctgcctgcttcatgtgggaga

SEQ ID NO: 7669911 - DNA, 22 bp, Homo sapiens
gctgcctgcttcatgtgggaga

SEQ ID NO: 7669912 - DNA, 22 bp, Homo sapiens
gctgcctgcttcatgtgggaga

SEQ ID NO: 7669913 - DNA, 22 bp, Homo sapiens
gctgcctgcttcatgtgggaga

SEQ ID NO: 7669914 - DNA, 22 bp, Homo sapiens
gctgcctgcttcatgtgggaga

SEQ ID NO: 7669915 - DNA, 22 bp, Homo sapiens
gctgcctgctcggctcctggga

SEQ ID NO: 7669916 - DNA, 22 bp, Homo sapiens
gctgcctgatgtccagcaggac

SEQ ID NO: 7669917 - DNA, 22 bp, Homo sapiens
gctgcctgatgtccagcaggac

SEQ ID NO: 7669918 - DNA, 22 bp, Homo sapiens
gctgcctgatgtccagcaggac

SEQ ID NO: 7669919 - DNA, 22 bp, Homo sapiens
gctgcctgatgtccagcaggac

SEQ ID NO: 7669920 - DNA, 22 bp, Homo sapiens
gctgcctgatgtccagcaggac

SEQ ID NO: 7669921 - DNA, 22 bp, Homo sapiens
gctgcctgatgtccagcaggac

SEQ ID NO: 7669922 - DNA, 22 bp, Homo sapiens
gctgcctgatgtccagcaggac

SEQ ID NO: 7669923 - DNA, 22 bp, Homo sapiens
gctgcctgatcatacaccaggg

SEQ ID NO: 7669924 - DNA, 22 bp, Homo sapiens
gctgcctgatcatacaccaggg

SEQ ID NO: 7669925 - DNA, 22 bp, Homo sapiens
gctgcctgatcatacaccaggg

SEQ ID NO: 7669926 - DNA, 22 bp, Homo sapiens
gctgcctgatgtccagcaggac

SEQ ID NO: 7669927 - DNA, 22 bp, Homo sapiens
gctgcctgctcacccggcctgg

SEQ ID NO: 7669928 - DNA, 22 bp, Homo sapiens
gctgcctgccttgcctggagga

SEQ ID NO: 7669929 - DNA, 22 bp, Homo sapiens
gctgcctgccttgcctggagga

SEQ ID NO: 7669930 - DNA, 22 bp, Homo sapiens
gctgcctgccttgcctggagga

SEQ ID NO: 7669931 - DNA, 22 bp, Homo sapiens
gctgcctgccttgcctggagga

SEQ ID NO: 7669932 - DNA, 22 bp, Homo sapiens
gctgcctgctcacccggcctgg

SEQ ID NO: 7669933 - DNA, 22 bp, Homo sapiens
gctgcctgctcacccggcctgg

SEQ ID NO: 7669934 - DNA, 22 bp, Homo sapiens
gctgcctgctcacccggcctgg

SEQ ID NO: 7669935 - DNA, 22 bp, Homo sapiens
gctgcctgctcacccggcctgg

SEQ ID NO: 7669936 - DNA, 22 bp, Homo sapiens
gctgcctgctcacccggcctgg

SEQ ID NO: 7669937 - DNA, 22 bp, Homo sapiens
gctgcctggctttagtccactt

SEQ ID NO: 7669938 - DNA, 22 bp, Homo sapiens
gctgcctggctttagtccactt

SEQ ID NO: 7669939 - DNA, 22 bp, Homo sapiens
gctgcctggctttagtccactt

SEQ ID NO: 7669940 - DNA, 22 bp, Homo sapiens
gctgcctggctttagtccactt

SEQ ID NO: 7669941 - DNA, 22 bp, Homo sapiens
gctgcctggctttagtccactt

SEQ ID NO: 7669942 - DNA, 22 bp, Homo sapiens
gctgcctggctttagtccactt

SEQ ID NO: 7669943 - DNA, 22 bp, Homo sapiens
gctgcctggctttagtccactt

SEQ ID NO: 7669944 - DNA, 22 bp, Homo sapiens
gctgcctgggcaggaggcgctg

SEQ ID NO: 7669945 - DNA, 22 bp, Homo sapiens
gctgcctgggcaggaggcgctg

SEQ ID NO: 7669946 - DNA, 22 bp, Homo sapiens
gctgcctgggcaggaggcgctg

SEQ ID NO: 7669947 - DNA, 22 bp, Homo sapiens
gctgcctgggcaggaggcgctg

SEQ ID NO: 7669948 - DNA, 22 bp, Homo sapiens
gctgcctggatttgcaatcctc

SEQ ID NO: 7669949 - DNA, 22 bp, Homo sapiens
gctgcctggagctcagcctgcc

SEQ ID NO: 7669950 - DNA, 22 bp, Homo sapiens
gctgcctggatttgcaatcctc

SEQ ID NO: 7669951 - DNA, 22 bp, Homo sapiens
gctgcctggctgatgaaaattc

SEQ ID NO: 7669952 - DNA, 22 bp, Homo sapiens
gctgcctggctgatgaaaattc

SEQ ID NO: 7669953 - DNA, 22 bp, Homo sapiens
gctgcctggatttgcaatcctc

SEQ ID NO: 7669954 - DNA, 22 bp, Homo sapiens
gctgcctggagctcagcctgcc

SEQ ID NO: 7669955 - DNA, 22 bp, Homo sapiens
gctgcctggagctcagcctgcc

SEQ ID NO: 7669956 - DNA, 22 bp, Homo sapiens
gctgcctggagctcagcctgcc

SEQ ID NO: 7669957 - DNA, 22 bp, Homo sapiens
gctgcctggagctcagcctgcc

SEQ ID NO: 7669958 - DNA, 22 bp, Homo sapiens
gctgcctggagctcagcctgcc

SEQ ID NO: 7669959 - DNA, 22 bp, Homo sapiens
gctgcctggagaggcagggatg

SEQ ID NO: 7669960 - DNA, 22 bp, Homo sapiens
gctgcctggagaggcagggatg

SEQ ID NO: 7669961 - DNA, 22 bp, Homo sapiens
gctgcctggagaggcagggatg

SEQ ID NO: 7669962 - DNA, 22 bp, Homo sapiens
gctgcctggagctcagcctgcc

SEQ ID NO: 7669963 - DNA, 22 bp, Homo sapiens
gctgcctggagctcagcctgcc

SEQ ID NO: 7669964 - DNA, 22 bp, Homo sapiens
gctgcctggagctcagcctgcc

SEQ ID NO: 7669965 - DNA, 22 bp, Homo sapiens
gctgcctggagctcagcctgcc

SEQ ID NO: 7669966 - DNA, 22 bp, Homo sapiens
gctgcctggagctcagcctgcc

SEQ ID NO: 7669967 - DNA, 22 bp, Homo sapiens
gctgcctggaataacggctggc

SEQ ID NO: 7669968 - DNA, 22 bp, Homo sapiens
gctgcctggagaggcagggatg

SEQ ID NO: 7669969 - DNA, 22 bp, Homo sapiens
gctgcctggagaggcagggatg

SEQ ID NO: 7669970 - DNA, 22 bp, Homo sapiens
gctgcctggagaggcagggatg

SEQ ID NO: 7669971 - DNA, 22 bp, Homo sapiens
gctgcctggagaggcagggatg

SEQ ID NO: 7669972 - DNA, 22 bp, Homo sapiens
gctgcctggagaggcagggatg

SEQ ID NO: 7669973 - DNA, 22 bp, Homo sapiens
gctgcctggaataacggctggc

SEQ ID NO: 7669974 - DNA, 22 bp, Homo sapiens
gctgcctggagaggcagggatg

SEQ ID NO: 7669975 - DNA, 22 bp, Homo sapiens
gctgcctggaataacggctggc

SEQ ID NO: 7669976 - DNA, 22 bp, Homo sapiens
gctgcctgatcatacaccaggg

SEQ ID NO: 7669977 - DNA, 22 bp, Homo sapiens
gctgcctgaatgaaccttgttc

SEQ ID NO: 7669978 - DNA, 22 bp, Homo sapiens
gctgcctgatcatacaccaggg

SEQ ID NO: 7669979 - DNA, 22 bp, Homo sapiens
gctgcctgatcatacaccaggg

SEQ ID NO: 7669980 - DNA, 22 bp, Homo sapiens
gctgcctgatcatacaccaggg

SEQ ID NO: 7669981 - DNA, 22 bp, Homo sapiens
gctgcctgatcatacaccaggg

SEQ ID NO: 7669982 - DNA, 22 bp, Homo sapiens
gctgcctgatcatacaccaggg

SEQ ID NO: 7669983 - DNA, 22 bp, Homo sapiens
gctgaggcaagatttgaaccca

SEQ ID NO: 7669984 - DNA, 22 bp, Homo sapiens
gctgaggcagtccacccttgtg

SEQ ID NO: 7669985 - DNA, 22 bp, Homo sapiens
gctgaggcagtccacccttgtg

SEQ ID NO: 7669986 - DNA, 22 bp, Homo sapiens
gctgaggcaaatagttttaagt

SEQ ID NO: 7669987 - DNA, 22 bp, Homo sapiens
gctgaggcaagatttgaaccca

SEQ ID NO: 7669988 - DNA, 22 bp, Homo sapiens
gctgaggcaaatagttttaagt

SEQ ID NO: 7669989 - DNA, 22 bp, Homo sapiens
gctgaggcaaaccaagaatgta

SEQ ID NO: 7669990 - DNA, 22 bp, Homo sapiens
gctgaggcaaaccaagaatgta

SEQ ID NO: 7669991 - DNA, 22 bp, Homo sapiens
gctgaggattgaagagttgcca

SEQ ID NO: 7669992 - DNA, 22 bp, Homo sapiens
gctgaggatatagcaggaacaa

SEQ ID NO: 7669993 - DNA, 22 bp, Homo sapiens
gctgaggatatagcaggaacaa

SEQ ID NO: 7669994 - DNA, 22 bp, Homo sapiens
gctgaggatatagcaggaacaa

SEQ ID NO: 7669995 - DNA, 22 bp, Homo sapiens
gctgaggatatagcaggaacaa

SEQ ID NO: 7669996 - DNA, 22 bp, Homo sapiens
gctgaggatatagcaggaacaa

SEQ ID NO: 7669997 - DNA, 22 bp, Homo sapiens
gctgaggattacttgaagtcag

SEQ ID NO: 7669998 - DNA, 22 bp, Homo sapiens
gctgaggattacttgaagtcag

SEQ ID NO: 7669999 - DNA, 22 bp, Homo sapiens
gctgaggattacttgaagtcag

SEQ ID NO: 7670000 - DNA, 22 bp, Homo sapiens
gctgaggattacttgaagtcag

SEQ ID NO: 7670001 - DNA, 22 bp, Homo sapiens
gctgaggattacttgaagtcag

SEQ ID NO: 7670002 - DNA, 20 bp, Homo sapiens
gctgaggattcctggcccct

SEQ ID NO: 7670003 - DNA, 20 bp, Homo sapiens
gctgaggattcctggcccct

SEQ ID NO: 7670004 - DNA, 20 bp, Homo sapiens
gctgaggattcctggcccct

SEQ ID NO: 7670005 - DNA, 20 bp, Homo sapiens
gctgaggattcctggcccct

SEQ ID NO: 7670006 - DNA, 22 bp, Homo sapiens
gctgaggattgaagagttgcca

SEQ ID NO: 7670007 - DNA, 22 bp, Homo sapiens
gctgaggattgaagagttgcca

SEQ ID NO: 7670008 - DNA, 22 bp, Homo sapiens
gctgaggatatagcaggaacaa

SEQ ID NO: 7670009 - DNA, 22 bp, Homo sapiens
gctgaggaggtgtggttaggtg

SEQ ID NO: 7670010 - DNA, 22 bp, Homo sapiens
gctgaggatatagcaggaacaa

SEQ ID NO: 7670011 - DNA, 22 bp, Homo sapiens
gctgagctcccagcagtatctg

SEQ ID NO: 7670012 - DNA, 22 bp, Homo sapiens
gctgagctagctatctcagtct

SEQ ID NO: 7670013 - DNA, 22 bp, Homo sapiens
gctgagctagaaaaggaccaca

SEQ ID NO: 7670014 - DNA, 22 bp, Homo sapiens
gctgagctagaaaaggaccaca

SEQ ID NO: 7670015 - DNA, 22 bp, Homo sapiens
gctgagcctagctgtctcctgt

SEQ ID NO: 7670016 - DNA, 22 bp, Homo sapiens
gctgagctagaaaaggaccaca

SEQ ID NO: 7670017 - DNA, 22 bp, Homo sapiens
gctgagcaggtgtaaggaaggc

SEQ ID NO: 7670018 - DNA, 22 bp, Homo sapiens
gctgagcaggtgtaaggaaggc

SEQ ID NO: 7670019 - DNA, 22 bp, Homo sapiens
gctgagcaggtttgatgctttt

SEQ ID NO: 7670020 - DNA, 22 bp, Homo sapiens
gctgagccacaggcagtgcact

SEQ ID NO: 7670021 - DNA, 22 bp, Homo sapiens
gctgagccacaggcagtgcact

SEQ ID NO: 7670022 - DNA, 22 bp, Homo sapiens
gctgagccacaggcagtgcact

SEQ ID NO: 7670023 - DNA, 22 bp, Homo sapiens
gctgagccacaggcagtgcact

SEQ ID NO: 7670024 - DNA, 22 bp, Homo sapiens
gctgagccacaggcagtgcact

SEQ ID NO: 7670025 - DNA, 22 bp, Homo sapiens
gctgagccacaggcagtgcact

SEQ ID NO: 7670026 - DNA, 22 bp, Homo sapiens
gctgagccacaggcagtgcact

SEQ ID NO: 7670027 - DNA, 22 bp, Homo sapiens
gctgagccatgaggcctcttgc

SEQ ID NO: 7670028 - DNA, 22 bp, Homo sapiens
gctgagccatgaggcctcttgc

SEQ ID NO: 7670029 - DNA, 22 bp, Homo sapiens
gctgagcccccctgcgtgggtc

SEQ ID NO: 7670030 - DNA, 22 bp, Homo sapiens
gctgagcccccctgcgtgggtc

SEQ ID NO: 7670031 - DNA, 22 bp, Homo sapiens
gctgagccatgaggcctcttgc

SEQ ID NO: 7670032 - DNA, 22 bp, Homo sapiens
gctgagccatgaggcctcttgc

SEQ ID NO: 7670033 - DNA, 22 bp, Homo sapiens
gctgagcccccctgcgtgggtc

SEQ ID NO: 7670034 - DNA, 22 bp, Homo sapiens
gctgagccctcatccctagttt

SEQ ID NO: 7670035 - DNA, 22 bp, Homo sapiens
gctgagcccccctgcgtgggtc

SEQ ID NO: 7670036 - DNA, 22 bp, Homo sapiens
gctgagcctagctgtctcctgt

SEQ ID NO: 7670037 - DNA, 22 bp, Homo sapiens
gctgagcctagctgtctcctgt

SEQ ID NO: 7670038 - DNA, 22 bp, Homo sapiens
gctgagccctcatccctagttt

SEQ ID NO: 7670039 - DNA, 22 bp, Homo sapiens
gctgagccctcatccctagttt

SEQ ID NO: 7670040 - DNA, 22 bp, Homo sapiens
gctctctttccatgtggaggat

SEQ ID NO: 7670041 - DNA, 22 bp, Homo sapiens
gctctgaaaaatggaggttggc

SEQ ID NO: 7670042 - DNA, 22 bp, Homo sapiens
gctctgaaaaatggaggttggc

SEQ ID NO: 7670043 - DNA, 22 bp, Homo sapiens
gctctgaaaaagaaaccatggt

SEQ ID NO: 7670044 - DNA, 22 bp, Homo sapiens
gctctgaaaaagaaaccatggt

SEQ ID NO: 7670045 - DNA, 22 bp, Homo sapiens
gctctgagattgagcctttggt

SEQ ID NO: 7670046 - DNA, 22 bp, Homo sapiens
gctctgagcactgtgcggctgg

SEQ ID NO: 7670047 - DNA, 22 bp, Homo sapiens
gctctgagcactgtgcggctgg

SEQ ID NO: 7670048 - DNA, 22 bp, Homo sapiens
gctctgagcagggagaaacagg

SEQ ID NO: 7670049 - DNA, 22 bp, Homo sapiens
gctctgagcagggagaaacagg

SEQ ID NO: 7670050 - DNA, 22 bp, Homo sapiens
gctctgagcagggagaaacagg

SEQ ID NO: 7670051 - DNA, 22 bp, Homo sapiens
gctctgagcccccagaagcaga

SEQ ID NO: 7670052 - DNA, 22 bp, Homo sapiens
gctctgagcccccagaagcaga

SEQ ID NO: 7670053 - DNA, 22 bp, Homo sapiens
gctctgagcagggagaaacagg

SEQ ID NO: 7670054 - DNA, 22 bp, Homo sapiens
gctctgagcagggagaaacagg

SEQ ID NO: 7670055 - DNA, 22 bp, Homo sapiens
gctctgagcagggagaaacagg

SEQ ID NO: 7670056 - DNA, 22 bp, Homo sapiens
gctcctgggtgtggctgcccct

SEQ ID NO: 7670057 - DNA, 22 bp, Homo sapiens
gctcctggtctggagcttcaag

SEQ ID NO: 7670058 - DNA, 22 bp, Homo sapiens
gctcctggtctggagcttcaag

SEQ ID NO: 7670059 - DNA, 22 bp, Homo sapiens
gctcctggtctggagcttcaag

SEQ ID NO: 7670060 - DNA, 22 bp, Homo sapiens
gctcctggtctggagcttcaag

SEQ ID NO: 7670061 - DNA, 22 bp, Homo sapiens
gctctctttaaactgcatggct

SEQ ID NO: 7670062 - DNA, 22 bp, Homo sapiens
gctctctttaaactgcatggct

SEQ ID NO: 7670063 - DNA, 22 bp, Homo sapiens
gctctcttggtggctgtcctgg

SEQ ID NO: 7670064 - DNA, 22 bp, Homo sapiens
gctcctgggtgtggctgcccct

SEQ ID NO: 7670065 - DNA, 22 bp, Homo sapiens
gctcctgggtgtggctgcccct

SEQ ID NO: 7670066 - DNA, 22 bp, Homo sapiens
gctcctgggtgtggctgcccct

SEQ ID NO: 7670067 - DNA, 22 bp, Homo sapiens
gctcctgggtgtggctgcccct

SEQ ID NO: 7670068 - DNA, 22 bp, Homo sapiens
gctcctgggctctaccttgcta

SEQ ID NO: 7670069 - DNA, 22 bp, Homo sapiens
gctcctgggctctaccttgcta

SEQ ID NO: 7670070 - DNA, 22 bp, Homo sapiens
gctcctgggctctaccttgcta

SEQ ID NO: 7670071 - DNA, 22 bp, Homo sapiens
gctcctggctctctgagggctg

SEQ ID NO: 7670072 - DNA, 22 bp, Homo sapiens
gctcctggctctctgagggctg

SEQ ID NO: 7670073 - DNA, 22 bp, Homo sapiens
gctcctggctctggccaaggga

SEQ ID NO: 7670074 - DNA, 22 bp, Homo sapiens
gctcctggctctggccaaggga

SEQ ID NO: 7670075 - DNA, 22 bp, Homo sapiens
gctcctggctctggccaaggga

SEQ ID NO: 7670076 - DNA, 22 bp, Homo sapiens
gctcctggctctggccaaggga

SEQ ID NO: 7670077 - DNA, 22 bp, Homo sapiens
gctcctggctctggccaaggga

SEQ ID NO: 7670078 - DNA, 22 bp, Homo sapiens
gctcctggctctggccaaggga

SEQ ID NO: 7670079 - DNA, 22 bp, Homo sapiens
gctcctggctctggccaaggga

SEQ ID NO: 7670080 - DNA, 22 bp, Homo sapiens
gctcctggctctggccaaggga

SEQ ID NO: 7670081 - DNA, 22 bp, Homo sapiens
gctcctggctctggccaaggga

SEQ ID NO: 7670082 - DNA, 22 bp, Homo sapiens
gctcctggcttcactgacatca

SEQ ID NO: 7670083 - DNA, 22 bp, Homo sapiens
gctcctggcttcactgacatca

SEQ ID NO: 7670084 - DNA, 22 bp, Homo sapiens
gctcctggctctggccaaggga

SEQ ID NO: 7670085 - DNA, 22 bp, Homo sapiens
gctcctggctctggccaaggga

SEQ ID NO: 7670086 - DNA, 22 bp, Homo sapiens
gctcctggcttcactgacatca

SEQ ID NO: 7670087 - DNA, 22 bp, Homo sapiens
gctcctggcttcactgacatca

SEQ ID NO: 7670088 - DNA, 16 bp, Homo sapiens
gctcctgggccctcga

SEQ ID NO: 7670089 - DNA, 22 bp, Homo sapiens
gctcctggcttcactgacatca

SEQ ID NO: 7670090 - DNA, 16 bp, Homo sapiens
gctcctgggccctcga

SEQ ID NO: 7670091 - DNA, 16 bp, Homo sapiens
gctcctgggccctcga

SEQ ID NO: 7670092 - DNA, 22 bp, Homo sapiens
gctcctgggccctgggctaact

SEQ ID NO: 7670093 - DNA, 22 bp, Homo sapiens
gctcctgggccctgggctaact

SEQ ID NO: 7670094 - DNA, 19 bp, Homo sapiens
gctcctgggcctcactcat

SEQ ID NO: 7670095 - DNA, 22 bp, Homo sapiens
gctcctgggccctgggctaact

SEQ ID NO: 7670096 - DNA, 19 bp, Homo sapiens
gctcctgggcctcactcat

SEQ ID NO: 7670097 - DNA, 19 bp, Homo sapiens
gctcctgggcctcactcat

SEQ ID NO: 7670098 - DNA, 19 bp, Homo sapiens
gctcctgggcctcactcat

SEQ ID NO: 7670099 - DNA, 22 bp, Homo sapiens
gctcctgggccctgggctaact

SEQ ID NO: 7670100 - DNA, 19 bp, Homo sapiens
gctcctgggcctcactcat

SEQ ID NO: 7670101 - DNA, 22 bp, Homo sapiens
gctctgccaaggacccattctc

SEQ ID NO: 7670102 - DNA, 21 bp, Homo sapiens
gctctgccacttaccagattt

SEQ ID NO: 7670103 - DNA, 23 bp, Homo sapiens
gctctgccacttaatagctgtgt

SEQ ID NO: 7670104 - DNA, 21 bp, Homo sapiens
gctctgccacttaccagattt

SEQ ID NO: 7670105 - DNA, 21 bp, Homo sapiens
gctctgccacttaccagattt

SEQ ID NO: 7670106 - DNA, 22 bp, Homo sapiens
gctctgccaaggacccattctc

SEQ ID NO: 7670107 - DNA, 23 bp, Homo sapiens
gctctgccacttaatagctgtgt

SEQ ID NO: 7670108 - DNA, 23 bp, Homo sapiens
gctctgccacttaatagctgtgt

SEQ ID NO: 7670109 - DNA, 23 bp, Homo sapiens
gctctgccacttaatagctgtgt

SEQ ID NO: 7670110 - DNA, 22 bp, Homo sapiens
gctctgccaacagtttgggcaa

SEQ ID NO: 7670111 - DNA, 22 bp, Homo sapiens
gctctgccaaggacccattctc

SEQ ID NO: 7670112 - DNA, 22 bp, Homo sapiens
gctctgccaacagtttgggcaa

SEQ ID NO: 7670113 - DNA, 18 bp, Homo sapiens
gctctgcagctgaggctt

SEQ ID NO: 7670114 - DNA, 22 bp, Homo sapiens
gctctgagtgcatgcttttggg

SEQ ID NO: 7670115 - DNA, 22 bp, Homo sapiens
gctctgagtgcatgcttttggg

SEQ ID NO: 7670116 - DNA, 22 bp, Homo sapiens
gctctgagtgcacatttacaca

SEQ ID NO: 7670117 - DNA, 22 bp, Homo sapiens
gctctgagtgcacatttacaca

SEQ ID NO: 7670118 - DNA, 22 bp, Homo sapiens
gctctgagtgcacatttacaca

SEQ ID NO: 7670119 - DNA, 22 bp, Homo sapiens
gctctgagtgattaaggagctt

SEQ ID NO: 7670120 - DNA, 22 bp, Homo sapiens
gctctgagtgattaaggagctt

SEQ ID NO: 7670121 - DNA, 22 bp, Homo sapiens
gctctgagtgattaaggagctt

SEQ ID NO: 7670122 - DNA, 22 bp, Homo sapiens
gctctgagtgagactagattta

SEQ ID NO: 7670123 - DNA, 22 bp, Homo sapiens
gctctgagtgatcagctgggaa

SEQ ID NO: 7670124 - DNA, 22 bp, Homo sapiens
gctctgagtgattaaggagctt

SEQ ID NO: 7670125 - DNA, 22 bp, Homo sapiens
gctctgagtgattaaggagctt

SEQ ID NO: 7670126 - DNA, 22 bp, Homo sapiens
gctctgagtcacactgccctgt

SEQ ID NO: 7670127 - DNA, 22 bp, Homo sapiens
gctctgagtcacactgccctgt

SEQ ID NO: 7670128 - DNA, 22 bp, Homo sapiens
gctctgagtcacactgccctgt

SEQ ID NO: 7670129 - DNA, 22 bp, Homo sapiens
gctctgagtcacactgccctgt

SEQ ID NO: 7670130 - DNA, 22 bp, Homo sapiens
gctctgagtctcagctaccaca

SEQ ID NO: 7670131 - DNA, 22 bp, Homo sapiens
gctctgagtctcagctaccaca

SEQ ID NO: 7670132 - DNA, 22 bp, Homo sapiens
gctctgagtgatcagctgggaa

SEQ ID NO: 7670133 - DNA, 22 bp, Homo sapiens
gctctgagtgagactagattta

SEQ ID NO: 7670134 - DNA, 22 bp, Homo sapiens
gctctgagtgagactagattta

SEQ ID NO: 7670135 - DNA, 22 bp, Homo sapiens
gctctgagtgatcagctgggaa

SEQ ID NO: 7670136 - DNA, 22 bp, Homo sapiens
gctctgagtgatcagctgggaa

SEQ ID NO: 7670137 - DNA, 22 bp, Homo sapiens
gctctgaggaatatataattgg

SEQ ID NO: 7670138 - DNA, 22 bp, Homo sapiens
gctctgaggaatatataattgg

SEQ ID NO: 7670139 - DNA, 22 bp, Homo sapiens
gctctgaggaccaattcctgtg

SEQ ID NO: 7670140 - DNA, 22 bp, Homo sapiens
gctctgaggaccaattcctgtg

SEQ ID NO: 7670141 - DNA, 22 bp, Homo sapiens
gctctgaggaccaattcctgtg

SEQ ID NO: 7670142 - DNA, 22 bp, Homo sapiens
gctctgagctgtcttgcaggtc

SEQ ID NO: 7670143 - DNA, 22 bp, Homo sapiens
gctctgagctcagcgtcagagt

SEQ ID NO: 7670144 - DNA, 22 bp, Homo sapiens
gctctgagctgtcttgcaggtc

SEQ ID NO: 7670145 - DNA, 23 bp, Homo sapiens
gctctgaggaagttgggcacggg

SEQ ID NO: 7670146 - DNA, 23 bp, Homo sapiens
gctctgaggaagttgggcacggg

SEQ ID NO: 7670147 - DNA, 22 bp, Homo sapiens
gctctgagccgggggcctgtcc

SEQ ID NO: 7670148 - DNA, 22 bp, Homo sapiens
gctctgagccgggggcctgtcc

SEQ ID NO: 7670149 - DNA, 22 bp, Homo sapiens
gctctgagccgggggcctgtcc

SEQ ID NO: 7670150 - DNA, 22 bp, Homo sapiens
gctctgagcccccagaagcaga

SEQ ID NO: 7670151 - DNA, 22 bp, Homo sapiens
gctctgagcccccagaagcaga

SEQ ID NO: 7670152 - DNA, 22 bp, Homo sapiens
gctctgagcccccagaagcaga

SEQ ID NO: 7670153 - DNA, 22 bp, Homo sapiens
gctctgagctcagcgtcagagt

SEQ ID NO: 7670154 - DNA, 22 bp, Homo sapiens
gctctgagccgggggcctgtcc

SEQ ID NO: 7670155 - DNA, 22 bp, Homo sapiens
gctctgagccgggggcctgtcc

SEQ ID NO: 7670156 - DNA, 23 bp, Homo sapiens
gctctgagggcttatccctccca

SEQ ID NO: 7670157 - DNA, 22 bp, Homo sapiens
gctctgagtaaatgaaagcatt

SEQ ID NO: 7670158 - DNA, 22 bp, Homo sapiens
gctctgagtaaatgaaagcatt

SEQ ID NO: 7670159 - DNA, 22 bp, Homo sapiens
gctctgagtaaatgaaagcatt

SEQ ID NO: 7670160 - DNA, 22 bp, Homo sapiens
gctctgagtaaatgaaagcatt

SEQ ID NO: 7670161 - DNA, 22 bp, Homo sapiens
gctctgagtaaatgaaagcatt

SEQ ID NO: 7670162 - DNA, 22 bp, Homo sapiens
gctctgaggctgtgaggtgctg

SEQ ID NO: 7670163 - DNA, 22 bp, Homo sapiens
gctctgaggctgtgaggtgctg

SEQ ID NO: 7670164 - DNA, 22 bp, Homo sapiens
gctctgaggctgtgaggtgctg

SEQ ID NO: 7670165 - DNA, 23 bp, Homo sapiens
gctctgagggcttatccctccca

SEQ ID NO: 7670166 - DNA, 23 bp, Homo sapiens
gctctgagggcttatccctccca

SEQ ID NO: 7670167 - DNA, 23 bp, Homo sapiens
gctctgagggcttatccctccca

SEQ ID NO: 7670168 - DNA, 22 bp, Homo sapiens
gctctgaggctgggagcactct

SEQ ID NO: 7670169 - DNA, 22 bp, Homo sapiens
gctctgaggagccaagaatgtg

SEQ ID NO: 7670170 - DNA, 22 bp, Homo sapiens
gctctgaggagccaagaatgtg

SEQ ID NO: 7670171 - DNA, 22 bp, Homo sapiens
gctctgaggaccaattcctgtg

SEQ ID NO: 7670172 - DNA, 22 bp, Homo sapiens
gctctgaggctgtgaggtgctg

SEQ ID NO: 7670173 - DNA, 22 bp, Homo sapiens
gctctgaggctgtgaggtgctg

SEQ ID NO: 7670174 - DNA, 22 bp, Homo sapiens
gctctgaggctgtgaggtgctg

SEQ ID NO: 7670175 - DNA, 22 bp, Homo sapiens
gctctgaggctgggagcactct

SEQ ID NO: 7670176 - DNA, 22 bp, Homo sapiens
gctctgaggctgggagcactct

SEQ ID NO: 7670177 - DNA, 22 bp, Homo sapiens
gctctgaggctgggagcactct

SEQ ID NO: 7670178 - DNA, 22 bp, Homo sapiens
gctctgaggctgggagcactct

SEQ ID NO: 7670179 - DNA, 21 bp, Homo sapiens
gctgaagaactctttattttc

SEQ ID NO: 7670180 - DNA, 22 bp, Homo sapiens
gctgaactacatgaagttgccg

SEQ ID NO: 7670181 - DNA, 19 bp, Homo sapiens
gctgaacaagtcagcaacc

SEQ ID NO: 7670182 - DNA, 17 bp, Homo sapiens
gctgaacaaggaaaata

SEQ ID NO: 7670183 - DNA, 22 bp, Homo sapiens
gctgaaattcagattcctaggc

SEQ ID NO: 7670184 - DNA, 18 bp, Homo sapiens
gctgaaattctaaacaaa

SEQ ID NO: 7670185 - DNA, 18 bp, Homo sapiens
gctgaaattctaaacaaa

SEQ ID NO: 7670186 - DNA, 22 bp, Homo sapiens
gctgaaattggaacctgggcct

SEQ ID NO: 7670187 - DNA, 22 bp, Homo sapiens
gctgaaattggaacctgggcct

SEQ ID NO: 7670188 - DNA, 22 bp, Homo sapiens
gctgaaatgtctttagcagtgt

SEQ ID NO: 7670189 - DNA, 22 bp, Homo sapiens
gctgaaatgtctttagcagtgt

SEQ ID NO: 7670190 - DNA, 22 bp, Homo sapiens
gctgaaatgtttaatttgggag

SEQ ID NO: 7670191 - DNA, 22 bp, Homo sapiens
gctgaaatgtttaatttgggag

SEQ ID NO: 7670192 - DNA, 22 bp, Homo sapiens
gctgaaattagactgcagaagt

SEQ ID NO: 7670193 - DNA, 22 bp, Homo sapiens
gctgaaatgtctttagcagtgt

SEQ ID NO: 7670194 - DNA, 22 bp, Homo sapiens
gctgaaattcagattcctaggc

SEQ ID NO: 7670195 - DNA, 22 bp, Homo sapiens
gctgaaattagactgcagaagt

SEQ ID NO: 7670196 - DNA, 22 bp, Homo sapiens
gctgaaattcagattcctaggc

SEQ ID NO: 7670197 - DNA, 22 bp, Homo sapiens
gctgaaattagactgcagaagt

SEQ ID NO: 7670198 - DNA, 22 bp, Homo sapiens
gctgaaattcagattcctaggc

SEQ ID NO: 7670199 - DNA, 22 bp, Homo sapiens
gctgaaatgggcactgaaggcc

SEQ ID NO: 7670200 - DNA, 22 bp, Homo sapiens
gctgaaatgggcactgaaggcc

SEQ ID NO: 7670201 - DNA, 22 bp, Homo sapiens
gctgaaatgggcactgaaggcc

SEQ ID NO: 7670202 - DNA, 22 bp, Homo sapiens
gctgaaatgccttgtaaatatt

SEQ ID NO: 7670203 - DNA, 22 bp, Homo sapiens
gctgaaatgggcactgaaggcc

SEQ ID NO: 7670204 - DNA, 22 bp, Homo sapiens
gctcttgatttccaggagctag

SEQ ID NO: 7670205 - DNA, 22 bp, Homo sapiens
gctcttgatgttcattgacttg

SEQ ID NO: 7670206 - DNA, 22 bp, Homo sapiens
gctcttgatgttcattgacttg

SEQ ID NO: 7670207 - DNA, 22 bp, Homo sapiens
gctcttggaagacaggatgtgt

SEQ ID NO: 7670208 - DNA, 22 bp, Homo sapiens
gctcttgatttccaggagctag

SEQ ID NO: 7670209 - DNA, 22 bp, Homo sapiens
gctcttgatacatcaagaactt

SEQ ID NO: 7670210 - DNA, 22 bp, Homo sapiens
gctcttgaggaagtgcagggca

SEQ ID NO: 7670211 - DNA, 22 bp, Homo sapiens
gctcttgaggaagtgcagggca

SEQ ID NO: 7670212 - DNA, 22 bp, Homo sapiens
gctcttgaccttggagaactcg

SEQ ID NO: 7670213 - DNA, 22 bp, Homo sapiens
gctcttgactcccagttctgtg

SEQ ID NO: 7670214 - DNA, 22 bp, Homo sapiens
gctcttgactcccagttctgtg

SEQ ID NO: 7670215 - DNA, 22 bp, Homo sapiens
gctcttgactcccagttctgtg

SEQ ID NO: 7670216 - DNA, 22 bp, Homo sapiens
gctcttgacagctacatctggc

SEQ ID NO: 7670217 - DNA, 22 bp, Homo sapiens
gctcttgacagctacatctggc

SEQ ID NO: 7670218 - DNA, 22 bp, Homo sapiens
gctcttgaatatgggtttcatg

SEQ ID NO: 7670219 - DNA, 22 bp, Homo sapiens
gctcttgacagctacatctggc

SEQ ID NO: 7670220 - DNA, 22 bp, Homo sapiens
gctcttgaagtactgggtgttg

SEQ ID NO: 7670221 - DNA, 21 bp, Homo sapiens
gctcttgaataagcataataa

SEQ ID NO: 7670222 - DNA, 21 bp, Homo sapiens
gctcttgaataagcataataa

SEQ ID NO: 7670223 - DNA, 22 bp, Homo sapiens
gctcttgaatatgggtttcatg

SEQ ID NO: 7670224 - DNA, 22 bp, Homo sapiens
gctgaagaccccagctccccag

SEQ ID NO: 7670225 - DNA, 22 bp, Homo sapiens
gctgagagtgggtgcagtgctt

SEQ ID NO: 7670226 - DNA, 21 bp, Homo sapiens
gctgaagacaaattctcttag

SEQ ID NO: 7670227 - DNA, 22 bp, Homo sapiens
gctgaagacaatggaattgact

SEQ ID NO: 7670228 - DNA, 22 bp, Homo sapiens
gctgaagacaatggaattgact

SEQ ID NO: 7670229 - DNA, 20 bp, Homo sapiens
gctgaagaagtagcatgtac

SEQ ID NO: 7670230 - DNA, 21 bp, Homo sapiens
gctgaagaactctttattttc

SEQ ID NO: 7670231 - DNA, 20 bp, Homo sapiens
gctgaagaagtagcatgtac

SEQ ID NO: 7670232 - DNA, 20 bp, Homo sapiens
gctgaagaagtagcatgtac

SEQ ID NO: 7670233 - DNA, 22 bp, Homo sapiens
gctgagagtgggtgcagtgctt

SEQ ID NO: 7670234 - DNA, 22 bp, Homo sapiens
gctgagagtgggtgcagtgctt

SEQ ID NO: 7670235 - DNA, 22 bp, Homo sapiens
gctgagagtgggtgcagtgctt

SEQ ID NO: 7670236 - DNA, 22 bp, Homo sapiens
gctgaagaccccagctccccag

SEQ ID NO: 7670237 - DNA, 22 bp, Homo sapiens
gctgagagtgggtgcagtgctt

SEQ ID NO: 7670238 - DNA, 22 bp, Homo sapiens
gctgagagtgtaggatgtttac

SEQ ID NO: 7670239 - DNA, 22 bp, Homo sapiens
gctgagagtgtgagatcagatt

SEQ ID NO: 7670240 - DNA, 22 bp, Homo sapiens
gctgagagtgtgagatcagatt

SEQ ID NO: 7670241 - DNA, 22 bp, Homo sapiens
gctgagcacacctagggtagag

SEQ ID NO: 7670242 - DNA, 22 bp, Homo sapiens
gctgagcacagcaaagagacaa

SEQ ID NO: 7670243 - DNA, 22 bp, Homo sapiens
gctgagcagggtggggaaaggc

SEQ ID NO: 7670244 - DNA, 22 bp, Homo sapiens
gctgagcacacctagggtagag

SEQ ID NO: 7670245 - DNA, 22 bp, Homo sapiens
gctgagcaacgtggagagtttt

SEQ ID NO: 7670246 - DNA, 22 bp, Homo sapiens
gctgagcacacctagggtagag

SEQ ID NO: 7670247 - DNA, 22 bp, Homo sapiens
gctgagattacgggcatgagcc

SEQ ID NO: 7670248 - DNA, 22 bp, Homo sapiens
gctgagattggttattccatta

SEQ ID NO: 7670249 - DNA, 18 bp, Homo sapiens
gctgagcaaattcctccc

SEQ ID NO: 7670250 - DNA, 22 bp, Homo sapiens
gctgagattacgggcatgagcc

SEQ ID NO: 7670251 - DNA, 22 bp, Homo sapiens
gctgagagtgtgagatcagatt

SEQ ID NO: 7670252 - DNA, 22 bp, Homo sapiens
gctgagagtgtgagatcagatt

SEQ ID NO: 7670253 - DNA, 22 bp, Homo sapiens
gctcttctcagattgtacactc

SEQ ID NO: 7670254 - DNA, 22 bp, Homo sapiens
gctcttctaaagaatgtacagg

SEQ ID NO: 7670255 - DNA, 22 bp, Homo sapiens
gctcttctaaagaatgtacagg

SEQ ID NO: 7670256 - DNA, 22 bp, Homo sapiens
gctcttctcagattgtacactc

SEQ ID NO: 7670257 - DNA, 22 bp, Homo sapiens
gctcttgaaaatcaaaagggaa

SEQ ID NO: 7670258 - DNA, 22 bp, Homo sapiens
gctcttgaaactggggtttcca

SEQ ID NO: 7670259 - DNA, 22 bp, Homo sapiens
gctcttgaaataatggctaatg

SEQ ID NO: 7670260 - DNA, 22 bp, Homo sapiens
gctcttgaaataatggctaatg

SEQ ID NO: 7670261 - DNA, 22 bp, Homo sapiens
gctcttctaaagaatgtacagg

SEQ ID NO: 7670262 - DNA, 22 bp, Homo sapiens
gctcttccatttctcttgaact

SEQ ID NO: 7670263 - DNA, 22 bp, Homo sapiens
gctcttccatttctcttgaact

SEQ ID NO: 7670264 - DNA, 22 bp, Homo sapiens
gctcttcagacaacgactccat

SEQ ID NO: 7670265 - DNA, 22 bp, Homo sapiens
gctcttatgtatgtatacgatg

SEQ ID NO: 7670266 - DNA, 22 bp, Homo sapiens
gctcttatgtatgtatacgatg

SEQ ID NO: 7670267 - DNA, 22 bp, Homo sapiens
gctctgtttctccatgctgtgg

SEQ ID NO: 7670268 - DNA, 22 bp, Homo sapiens
gctctgtttctccatgctgtgg

SEQ ID NO: 7670269 - DNA, 22 bp, Homo sapiens
gctctgtttctccatgctgtgg

SEQ ID NO: 7670270 - DNA, 22 bp, Homo sapiens
gctctgtttatccctgacaatt

SEQ ID NO: 7670271 - DNA, 22 bp, Homo sapiens
gctctgtttatccctgacaatt

SEQ ID NO: 7670272 - DNA, 22 bp, Homo sapiens
gctctgtttatccctgacaatt

SEQ ID NO: 7670273 - DNA, 22 bp, Homo sapiens
gctctgtttatccctgacaatt

SEQ ID NO: 7670274 - DNA, 22 bp, Homo sapiens
gctctgtttatccctgacaatt

SEQ ID NO: 7670275 - DNA, 22 bp, Homo sapiens
gctctgttcatcagtttgttgg

SEQ ID NO: 7670276 - DNA, 22 bp, Homo sapiens
gctctgttgtctctgaattgca

SEQ ID NO: 7670277 - DNA, 22 bp, Homo sapiens
gctctgttgtctctgaattgca

SEQ ID NO: 7670278 - DNA, 22 bp, Homo sapiens
gctctgttaacagtccagcttt

SEQ ID NO: 7670279 - DNA, 22 bp, Homo sapiens
gctctgttagtcattttcatct

SEQ ID NO: 7670280 - DNA, 22 bp, Homo sapiens
gctctgttagtcattttcatct

SEQ ID NO: 7670281 - DNA, 22 bp, Homo sapiens
gctctgttatcctctatatcct

SEQ ID NO: 7670282 - DNA, 21 bp, Homo sapiens
gctctgttattttctatgcag

SEQ ID NO: 7670283 - DNA, 21 bp, Homo sapiens
gctctgttattttctatgcag

SEQ ID NO: 7670284 - DNA, 22 bp, Homo sapiens
gctctgtgttccctccaggctc

SEQ ID NO: 7670285 - DNA, 22 bp, Homo sapiens
gctctgtgttcctctggattgc

SEQ ID NO: 7670286 - DNA, 22 bp, Homo sapiens
gctctgtgttgtcagaggcacc

SEQ ID NO: 7670287 - DNA, 22 bp, Homo sapiens
gctctgtgttgtcagaggcacc

SEQ ID NO: 7670288 - DNA, 22 bp, Homo sapiens
gctctgtgttgtcagaggcacc

SEQ ID NO: 7670289 - DNA, 22 bp, Homo sapiens
gctctgtgttgtcagaggcacc

SEQ ID NO: 7670290 - DNA, 22 bp, Homo sapiens
gctctgtgttttgcccaggaga

SEQ ID NO: 7670291 - DNA, 22 bp, Homo sapiens
gctctgtgttgtcagaggcacc

SEQ ID NO: 7670292 - DNA, 22 bp, Homo sapiens
gctctgtgtccacagctggaaa

SEQ ID NO: 7670293 - DNA, 22 bp, Homo sapiens
gctctgtgttccctccaggctc

SEQ ID NO: 7670294 - DNA, 22 bp, Homo sapiens
gctctgtgttccctccaggctc

SEQ ID NO: 7670295 - DNA, 22 bp, Homo sapiens
gctctgtgttccctccaggctc

SEQ ID NO: 7670296 - DNA, 22 bp, Homo sapiens
gctctgcccaaagctgtggctg

SEQ ID NO: 7670297 - DNA, 22 bp, Homo sapiens
gctctgcccaaagctgtggctg

SEQ ID NO: 7670298 - DNA, 22 bp, Homo sapiens
gctctgcccaaagctgtggctg

SEQ ID NO: 7670299 - DNA, 22 bp, Homo sapiens
gctctgcccaaagctgtggctg

SEQ ID NO: 7670300 - DNA, 22 bp, Homo sapiens
gctctgcccaaagctgtggctg

SEQ ID NO: 7670301 - DNA, 22 bp, Homo sapiens
gctctgcccaatgtccctacac

SEQ ID NO: 7670302 - DNA, 22 bp, Homo sapiens
gctctgcccaatgtccctacac

SEQ ID NO: 7670303 - DNA, 22 bp, Homo sapiens
gctctgcccaatgtccctacac

SEQ ID NO: 7670304 - DNA, 22 bp, Homo sapiens
gctctgcccaggaccgtccttg

SEQ ID NO: 7670305 - DNA, 21 bp, Homo sapiens
gctctgccacttaccagattt

SEQ ID NO: 7670306 - DNA, 21 bp, Homo sapiens
gctctgccacttaccagattt

SEQ ID NO: 7670307 - DNA, 20 bp, Homo sapiens
gctctgccacttagaagctg

SEQ ID NO: 7670308 - DNA, 20 bp, Homo sapiens
gctctgccacttagaagctg

SEQ ID NO: 7670309 - DNA, 20 bp, Homo sapiens
gctctgccacttagaagctg

SEQ ID NO: 7670310 - DNA, 20 bp, Homo sapiens
gctctgccacttagaagctg

SEQ ID NO: 7670311 - DNA, 22 bp, Homo sapiens
gctctgccagacactgtggcca

SEQ ID NO: 7670312 - DNA, 22 bp, Homo sapiens
gctctgccagacactgtggcca

SEQ ID NO: 7670313 - DNA, 22 bp, Homo sapiens
gctctgccagacactgtggcca

SEQ ID NO: 7670314 - DNA, 22 bp, Homo sapiens
gctctgccagacactgtggcca

SEQ ID NO: 7670315 - DNA, 22 bp, Homo sapiens
gctctgccagacactgtggcca

SEQ ID NO: 7670316 - DNA, 19 bp, Homo sapiens
gctctgccagtggtaacat

SEQ ID NO: 7670317 - DNA, 22 bp, Homo sapiens
gctctgccagcccaaggcgcag

SEQ ID NO: 7670318 - DNA, 17 bp, Homo sapiens
gctctgccaggaaagag

SEQ ID NO: 7670319 - DNA, 22 bp, Homo sapiens
gctctgccagcccaaggcgcag

SEQ ID NO: 7670320 - DNA, 17 bp, Homo sapiens
gctctgccaggaaagag

SEQ ID NO: 7670321 - DNA, 17 bp, Homo sapiens
gctctgccaggaaagag

SEQ ID NO: 7670322 - DNA, 22 bp, Homo sapiens
gccttactgagggcaattttga

SEQ ID NO: 7670323 - DNA, 22 bp, Homo sapiens
gccttaattgcagagcaatata

SEQ ID NO: 7670324 - DNA, 22 bp, Homo sapiens
gctcactgcaacctccgccttc

SEQ ID NO: 7670325 - DNA, 22 bp, Homo sapiens
gctcactgcaacctctgcctcc

SEQ ID NO: 7670326 - DNA, 22 bp, Homo sapiens
gctcactgcaacctctgcctcc

SEQ ID NO: 7670327 - DNA, 22 bp, Homo sapiens
gctcactgcaacctctgcctcc

SEQ ID NO: 7670328 - DNA, 22 bp, Homo sapiens
gctcactgcaacctctgcctcc

SEQ ID NO: 7670329 - DNA, 22 bp, Homo sapiens
gctcactgcaacctctgcctcc

SEQ ID NO: 7670330 - DNA, 22 bp, Homo sapiens
gctcactgcaacctctgcttcc

SEQ ID NO: 7670331 - DNA, 22 bp, Homo sapiens
gctcactgcaacctctgcttcc

SEQ ID NO: 7670332 - DNA, 22 bp, Homo sapiens
gctcactgcaacctctgcttcc

SEQ ID NO: 7670333 - DNA, 22 bp, Homo sapiens
gctcactgcaacctctgcttcc

SEQ ID NO: 7670334 - DNA, 22 bp, Homo sapiens
gctcactgcaagctccgcctcc

SEQ ID NO: 7670335 - DNA, 22 bp, Homo sapiens
gctcactgcaagctccgcctcc

SEQ ID NO: 7670336 - DNA, 22 bp, Homo sapiens
gctcactgcaagctctgcctcc

SEQ ID NO: 7670337 - DNA, 22 bp, Homo sapiens
gctcactgcaagctctgcctcc

SEQ ID NO: 7670338 - DNA, 22 bp, Homo sapiens
gctcactgcaacctccgccttc

SEQ ID NO: 7670339 - DNA, 22 bp, Homo sapiens
gctcactgcaagctccgcctcc

SEQ ID NO: 7670340 - DNA, 22 bp, Homo sapiens
gctcactgcaagctctgcctcc

SEQ ID NO: 7670341 - DNA, 22 bp, Homo sapiens
gctcactgcaagctctgcctcc

SEQ ID NO: 7670342 - DNA, 22 bp, Homo sapiens
gctcactgccattctctagatg

SEQ ID NO: 7670343 - DNA, 22 bp, Homo sapiens
gctcactgcaagctctgcctcc

SEQ ID NO: 7670344 - DNA, 22 bp, Homo sapiens
gctcactgccattctctagatg

SEQ ID NO: 7670345 - DNA, 22 bp, Homo sapiens
gctcactgcctgggcaacaaga

SEQ ID NO: 7670346 - DNA, 22 bp, Homo sapiens
gctcactgccattctctagatg

SEQ ID NO: 7670347 - DNA, 22 bp, Homo sapiens
gctcactggcctgaagaggacg

SEQ ID NO: 7670348 - DNA, 22 bp, Homo sapiens
gctcactggcctgaagaggacg

SEQ ID NO: 7670349 - DNA, 22 bp, Homo sapiens
gccttaatacagatgggtggtg

SEQ ID NO: 7670350 - DNA, 19 bp, Homo sapiens
gccttaacctgttaagggg

SEQ ID NO: 7670351 - DNA, 22 bp, Homo sapiens
gccttaaacaattgcctgttaa

SEQ ID NO: 7670352 - DNA, 22 bp, Homo sapiens
gcctgtttttgcttcgtttaag

SEQ ID NO: 7670353 - DNA, 22 bp, Homo sapiens
gcctgtttttgcttcgtttaag

SEQ ID NO: 7670354 - DNA, 22 bp, Homo sapiens
gcctgttttcctgctgtggttg

SEQ ID NO: 7670355 - DNA, 22 bp, Homo sapiens
gcctgtttgtttgcaaaggagc

SEQ ID NO: 7670356 - DNA, 22 bp, Homo sapiens
gcctgttttagatgcattgatg

SEQ ID NO: 7670357 - DNA, 22 bp, Homo sapiens
gcctgtttgtttgcaaaggagc

SEQ ID NO: 7670358 - DNA, 22 bp, Homo sapiens
gcctgtttgtttgcaaaggagc

SEQ ID NO: 7670359 - DNA, 22 bp, Homo sapiens
gcctgttttagatgcattgatg

SEQ ID NO: 7670360 - DNA, 22 bp, Homo sapiens
gcctgttttagatgcattgatg

SEQ ID NO: 7670361 - DNA, 22 bp, Homo sapiens
gcctgtttgttatgtcatggta

SEQ ID NO: 7670362 - DNA, 22 bp, Homo sapiens
gcctgtttgtttgcaaaggagc

SEQ ID NO: 7670363 - DNA, 22 bp, Homo sapiens
gcctgtttggctgctgacattg

SEQ ID NO: 7670364 - DNA, 22 bp, Homo sapiens
gcctgtttgttatgtcatggta

SEQ ID NO: 7670365 - DNA, 22 bp, Homo sapiens
gcctgtttggcatcattggttg

SEQ ID NO: 7670366 - DNA, 22 bp, Homo sapiens
gcctgtttggaatctgtttaat

SEQ ID NO: 7670367 - DNA, 22 bp, Homo sapiens
gcctgtttggaatctgtttaat

SEQ ID NO: 7670368 - DNA, 22 bp, Homo sapiens
gcctgtttggctgctgacattg

SEQ ID NO: 7670369 - DNA, 22 bp, Homo sapiens
gcctgtttggcatcattggttg

SEQ ID NO: 7670370 - DNA, 22 bp, Homo sapiens
gcctgtttgactggtctctgct

SEQ ID NO: 7670371 - DNA, 22 bp, Homo sapiens
gcctgtttgactggtctctgct

SEQ ID NO: 7670372 - DNA, 22 bp, Homo sapiens
gcctgtttgagaatagtcaggg

SEQ ID NO: 7670373 - DNA, 22 bp, Homo sapiens
gcctgtttgagaatagtcaggg

SEQ ID NO: 7670374 - DNA, 22 bp, Homo sapiens
gcctgtttctaatctcatttct

SEQ ID NO: 7670375 - DNA, 22 bp, Homo sapiens
gcctgtttctcctccttggccc

SEQ ID NO: 7670376 - DNA, 22 bp, Homo sapiens
gcctgtttctcctccttggccc

SEQ ID NO: 7670377 - DNA, 22 bp, Homo sapiens
gcctgtttctcctccttggccc

SEQ ID NO: 7670378 - DNA, 22 bp, Homo sapiens
gcctgtttctaatctcatttct

SEQ ID NO: 7670379 - DNA, 22 bp, Homo sapiens
gcctgtttctaatctcatttct

SEQ ID NO: 7670380 - DNA, 22 bp, Homo sapiens
gcctgtttccatcaacacatgc

SEQ ID NO: 7670381 - DNA, 22 bp, Homo sapiens
gcctgtttccctgacgcttaca

SEQ ID NO: 7670382 - DNA, 22 bp, Homo sapiens
gcctgtttccatcaacacatgc

SEQ ID NO: 7670383 - DNA, 22 bp, Homo sapiens
gcctgtttatctatcatgaact

SEQ ID NO: 7670384 - DNA, 22 bp, Homo sapiens
gcctgtttactttgccgcagga

SEQ ID NO: 7670385 - DNA, 22 bp, Homo sapiens
gcctgtttactttgccgcagga

SEQ ID NO: 7670386 - DNA, 22 bp, Homo sapiens
gcctgtttatctatcatgaact

SEQ ID NO: 7670387 - DNA, 22 bp, Homo sapiens
gcctgtttactttgccgcagga

SEQ ID NO: 7670388 - DNA, 22 bp, Homo sapiens
gcctgtttatctatcatgaact

SEQ ID NO: 7670389 - DNA, 22 bp, Homo sapiens
gctcagacagatatttcgagat

SEQ ID NO: 7670390 - DNA, 19 bp, Homo sapiens
gctcagacattaagcagct

SEQ ID NO: 7670391 - DNA, 22 bp, Homo sapiens
gctcagaccccaccctggcaga

SEQ ID NO: 7670392 - DNA, 19 bp, Homo sapiens
gctcagacattaagcagct

SEQ ID NO: 7670393 - DNA, 22 bp, Homo sapiens
gctcagaccccaccctggcaga

SEQ ID NO: 7670394 - DNA, 22 bp, Homo sapiens
gctcagactctggcctgatgat

SEQ ID NO: 7670395 - DNA, 22 bp, Homo sapiens
gctcagactctggcctgatgat

SEQ ID NO: 7670396 - DNA, 22 bp, Homo sapiens
gctcagacctgtaatcttagca

SEQ ID NO: 7670397 - DNA, 22 bp, Homo sapiens
gctcagaagatatttgatgctg

SEQ ID NO: 7670398 - DNA, 22 bp, Homo sapiens
gctcagaagatatttgatgctg

SEQ ID NO: 7670399 - DNA, 22 bp, Homo sapiens
gctcagaaatggcagatggaga

SEQ ID NO: 7670400 - DNA, 22 bp, Homo sapiens
gctcagaaaagtgaggctcagt

SEQ ID NO: 7670401 - DNA, 19 bp, Homo sapiens
gctcacttcaggttttcac

SEQ ID NO: 7670402 - DNA, 22 bp, Homo sapiens
gctcacttaatttcatgctaca

SEQ ID NO: 7670403 - DNA, 22 bp, Homo sapiens
gctcactggcctgaagaggacg

SEQ ID NO: 7670404 - DNA, 22 bp, Homo sapiens
gctcagagataaaactgatcag

SEQ ID NO: 7670405 - DNA, 22 bp, Homo sapiens
gctcagagatggggaatgaaaa

SEQ ID NO: 7670406 - DNA, 22 bp, Homo sapiens
gctcagagatggggaatgaaaa

SEQ ID NO: 7670407 - DNA, 22 bp, Homo sapiens
gctcagactctggcctgatgat

SEQ ID NO: 7670408 - DNA, 22 bp, Homo sapiens
gctcagagatgtctgctgcctt

SEQ ID NO: 7670409 - DNA, 22 bp, Homo sapiens
gctcagagatgtctgctgcctt

SEQ ID NO: 7670410 - DNA, 22 bp, Homo sapiens
gctcagagatggggaatgaaaa

SEQ ID NO: 7670411 - DNA, 22 bp, Homo sapiens
gctcagagatgttcagtagctt

SEQ ID NO: 7670412 - DNA, 22 bp, Homo sapiens
gctcagagatgttcagtagctt

SEQ ID NO: 7670413 - DNA, 22 bp, Homo sapiens
gctcagagatgttcagtagctt

SEQ ID NO: 7670414 - DNA, 22 bp, Homo sapiens
gctcagagatgttcagtagctt

SEQ ID NO: 7670415 - DNA, 22 bp, Homo sapiens
gctcagagatgtctgctgcctt

SEQ ID NO: 7670416 - DNA, 22 bp, Homo sapiens
gctcagagatgtctgctgcctt

SEQ ID NO: 7670417 - DNA, 22 bp, Homo sapiens
gctcagagatgtctgctgcctt

SEQ ID NO: 7670418 - DNA, 22 bp, Homo sapiens
gctcagagcactcagactcagc

SEQ ID NO: 7670419 - DNA, 22 bp, Homo sapiens
gctcagagcactcagactcagc

SEQ ID NO: 7670420 - DNA, 22 bp, Homo sapiens
gctcagagcactcagactcagc

SEQ ID NO: 7670421 - DNA, 22 bp, Homo sapiens
gctcagagatgttcagtagctt

SEQ ID NO: 7670422 - DNA, 22 bp, Homo sapiens
gctcagagatgttcagtagctt

SEQ ID NO: 7670423 - DNA, 22 bp, Homo sapiens
gctcagagatgttcagtagctt

SEQ ID NO: 7670424 - DNA, 22 bp, Homo sapiens
gctcagagcatcccagtgaatg

SEQ ID NO: 7670425 - DNA, 22 bp, Homo sapiens
gctcagagcatcccagtgaatg

SEQ ID NO: 7670426 - DNA, 22 bp, Homo sapiens
gctcagagcatcccagtgaatg

SEQ ID NO: 7670427 - DNA, 22 bp, Homo sapiens
gctcagagcatcccagtgaatg

SEQ ID NO: 7670428 - DNA, 22 bp, Homo sapiens
gctcagagcatcccagtgaatg

SEQ ID NO: 7670429 - DNA, 22 bp, Homo sapiens
gctcagagcatcccagtgaatg

SEQ ID NO: 7670430 - DNA, 22 bp, Homo sapiens
gctcagagcactcagactcagc

SEQ ID NO: 7670431 - DNA, 22 bp, Homo sapiens
gctcagagcagatggtactcag

SEQ ID NO: 7670432 - DNA, 22 bp, Homo sapiens
gctcagagcagatggtactcag

SEQ ID NO: 7670433 - DNA, 22 bp, Homo sapiens
gctcagagcactcagactcagc

SEQ ID NO: 7670434 - DNA, 20 bp, Homo sapiens
gctcagagcctgaacttcat

SEQ ID NO: 7670435 - DNA, 20 bp, Homo sapiens
gctcagagcctgaacttcat

SEQ ID NO: 7670436 - DNA, 22 bp, Homo sapiens
gctcagagcccgaggcttgcat

SEQ ID NO: 7670437 - DNA, 22 bp, Homo sapiens
gctcagagcccgaggcttgcat

SEQ ID NO: 7670438 - DNA, 22 bp, Homo sapiens
gctcagagcccgaggcttgcat

SEQ ID NO: 7670439 - DNA, 22 bp, Homo sapiens
gctcagagcccgaggcttgcat

SEQ ID NO: 7670440 - DNA, 19 bp, Homo sapiens
gctcagagccatgggggct

SEQ ID NO: 7670441 - DNA, 19 bp, Homo sapiens
gctcagagccatgggggct

SEQ ID NO: 7670442 - DNA, 22 bp, Homo sapiens
gctcatctgccccaggagatcc

SEQ ID NO: 7670443 - DNA, 22 bp, Homo sapiens
gctcatctgccccaggagatcc

SEQ ID NO: 7670444 - DNA, 22 bp, Homo sapiens
gctcatctgccccaggagatcc

SEQ ID NO: 7670445 - DNA, 22 bp, Homo sapiens
gctcatctggggctttcagctt

SEQ ID NO: 7670446 - DNA, 22 bp, Homo sapiens
gctcatctgccatgatgagttt

SEQ ID NO: 7670447 - DNA, 22 bp, Homo sapiens
gctcatctcccttttgaagctg

SEQ ID NO: 7670448 - DNA, 22 bp, Homo sapiens
gctcatctgccatgatgagttt

SEQ ID NO: 7670449 - DNA, 22 bp, Homo sapiens
gctcatctcccttttgaagctg

SEQ ID NO: 7670450 - DNA, 22 bp, Homo sapiens
gctcatctgttttaactgtatt

SEQ ID NO: 7670451 - DNA, 22 bp, Homo sapiens
gctcatctgtaaaacaggatta

SEQ ID NO: 7670452 - DNA, 22 bp, Homo sapiens
gctcatctggggctttcagctt

SEQ ID NO: 7670453 - DNA, 22 bp, Homo sapiens
gctcatctgtaaaacaggatta

SEQ ID NO: 7670454 - DNA, 22 bp, Homo sapiens
gctcatctgttttaactgtatt

SEQ ID NO: 7670455 - DNA, 22 bp, Homo sapiens
gctcatctgttttaactgtatt

SEQ ID NO: 7670456 - DNA, 22 bp, Homo sapiens
gctcatgactgtaatcccagca

SEQ ID NO: 7670457 - DNA, 22 bp, Homo sapiens
gctcatgactgtaatcccagca

SEQ ID NO: 7670458 - DNA, 22 bp, Homo sapiens
gctcatgactgtaatcccagca

SEQ ID NO: 7670459 - DNA, 22 bp, Homo sapiens
gctcatgactgtaatcccagca

SEQ ID NO: 7670460 - DNA, 22 bp, Homo sapiens
gctcatgactgtaatcccagca

SEQ ID NO: 7670461 - DNA, 22 bp, Homo sapiens
gctcatgactgtaatcccagca

SEQ ID NO: 7670462 - DNA, 22 bp, Homo sapiens
gctcatgactgtaatcccagca

SEQ ID NO: 7670463 - DNA, 22 bp, Homo sapiens
gctcatgactgtaatcccagca

SEQ ID NO: 7670464 - DNA, 22 bp, Homo sapiens
gctcatgactgtaatcccagca

SEQ ID NO: 7670465 - DNA, 22 bp, Homo sapiens
gctcatgactgtaatcccagca

SEQ ID NO: 7670466 - DNA, 22 bp, Homo sapiens
gctcatgggcccagagcagccc

SEQ ID NO: 7670467 - DNA, 22 bp, Homo sapiens
gctcatgggcccagagcagccc

SEQ ID NO: 7670468 - DNA, 22 bp, Homo sapiens
gctcctctcccagagctgcagg

SEQ ID NO: 7670469 - DNA, 22 bp, Homo sapiens
gctcctctgtcaaatgagagtg

SEQ ID NO: 7670470 - DNA, 22 bp, Homo sapiens
gctcctctgtcaaatgagagtg

SEQ ID NO: 7670471 - DNA, 22 bp, Homo sapiens
gctcctcttatttcatcagggc

SEQ ID NO: 7670472 - DNA, 22 bp, Homo sapiens
gctcctcttatttcatcagggc

SEQ ID NO: 7670473 - DNA, 22 bp, Homo sapiens
gctcctcttatttcatcagggc

SEQ ID NO: 7670474 - DNA, 22 bp, Homo sapiens
gctcctggcaggcagtgtgtgt

SEQ ID NO: 7670475 - DNA, 22 bp, Homo sapiens
gctcctcttatttcatcagggc

SEQ ID NO: 7670476 - DNA, 22 bp, Homo sapiens
gctcctcttatttcatcagggc

SEQ ID NO: 7670477 - DNA, 22 bp, Homo sapiens
gctcctggcaggcagtgtgtgt

SEQ ID NO: 7670478 - DNA, 22 bp, Homo sapiens
gctccaggagctcacagctcgc

SEQ ID NO: 7670479 - DNA, 22 bp, Homo sapiens
gctccaggaggatgaccttcct

SEQ ID NO: 7670480 - DNA, 22 bp, Homo sapiens
gctccaggaggatgaccttcct

SEQ ID NO: 7670481 - DNA, 22 bp, Homo sapiens
gctccaggaggatgaccttcct

SEQ ID NO: 7670482 - DNA, 22 bp, Homo sapiens
gctccaggagctcacagctcgc

SEQ ID NO: 7670483 - DNA, 22 bp, Homo sapiens
gctccaggagctcacagctcgc

SEQ ID NO: 7670484 - DNA, 22 bp, Homo sapiens
gctccaggagagggaagcagat

SEQ ID NO: 7670485 - DNA, 22 bp, Homo sapiens
gctccaggagctcacagctcgc

SEQ ID NO: 7670486 - DNA, 22 bp, Homo sapiens
gctccaggagctcacagctcgc

SEQ ID NO: 7670487 - DNA, 22 bp, Homo sapiens
gctccaggagagggaagcagat

SEQ ID NO: 7670488 - DNA, 22 bp, Homo sapiens
gctccaggagagggaagcagat

SEQ ID NO: 7670489 - DNA, 22 bp, Homo sapiens
gctcctggctctctgagggctg

SEQ ID NO: 7670490 - DNA, 22 bp, Homo sapiens
gctcctggctctctgagggctg

SEQ ID NO: 7670491 - DNA, 22 bp, Homo sapiens
gctcctggctctctgagggctg

SEQ ID NO: 7670492 - DNA, 22 bp, Homo sapiens
gctcctggctctctgagggctg

SEQ ID NO: 7670493 - DNA, 22 bp, Homo sapiens
gctcctggctctctgagggctg

SEQ ID NO: 7670494 - DNA, 22 bp, Homo sapiens
gctcctggctctctgagggctg

SEQ ID NO: 7670495 - DNA, 22 bp, Homo sapiens
gctcctggctctctgagggctg

SEQ ID NO: 7670496 - DNA, 22 bp, Homo sapiens
gctcctggctctctgagggctg

SEQ ID NO: 7670497 - DNA, 22 bp, Homo sapiens
gctcctggctctctgagggctg

SEQ ID NO: 7670498 - DNA, 22 bp, Homo sapiens
gctcctggctctctgagggctg

SEQ ID NO: 7670499 - DNA, 22 bp, Homo sapiens
gctcctggctccaggcagccaa

SEQ ID NO: 7670500 - DNA, 22 bp, Homo sapiens
gctcctggctccaggcagccaa

SEQ ID NO: 7670501 - DNA, 22 bp, Homo sapiens
gctcctggctccaggcagccaa

SEQ ID NO: 7670502 - DNA, 22 bp, Homo sapiens
gctcctggctccaggcagccaa

SEQ ID NO: 7670503 - DNA, 22 bp, Homo sapiens
gctcctggctccaggcagccaa

SEQ ID NO: 7670504 - DNA, 22 bp, Homo sapiens
gctcctggctccaggcagccaa

SEQ ID NO: 7670505 - DNA, 22 bp, Homo sapiens
gctcctggcaggcagtgtgtgt

SEQ ID NO: 7670506 - DNA, 22 bp, Homo sapiens
gctcctggcatcctgcttttaa

SEQ ID NO: 7670507 - DNA, 22 bp, Homo sapiens
gctcctggccagcacagggccc

SEQ ID NO: 7670508 - DNA, 22 bp, Homo sapiens
gctcctggccagcacagggccc

SEQ ID NO: 7670509 - DNA, 22 bp, Homo sapiens
gctcctggccagcacagggccc

SEQ ID NO: 7670510 - DNA, 22 bp, Homo sapiens
gctcctggccagcacagggccc

SEQ ID NO: 7670511 - DNA, 22 bp, Homo sapiens
gctcctggctccaggcagccaa

SEQ ID NO: 7670512 - DNA, 22 bp, Homo sapiens
gctcctggctccaggcagccaa

SEQ ID NO: 7670513 - DNA, 22 bp, Homo sapiens
gctcctggccagcacagggccc

SEQ ID NO: 7670514 - DNA, 22 bp, Homo sapiens
gctcctggccagcacagggccc

SEQ ID NO: 7670515 - DNA, 22 bp, Homo sapiens
gctcctggccagcacagggccc

SEQ ID NO: 7670516 - DNA, 22 bp, Homo sapiens
gctcctggccagcacagggccc

SEQ ID NO: 7670517 - DNA, 22 bp, Homo sapiens
gctcctggccagcacagggccc

SEQ ID NO: 7670518 - DNA, 22 bp, Homo sapiens
gctcctggccagcacagggccc

SEQ ID NO: 7670519 - DNA, 22 bp, Homo sapiens
gctcctggccagcacagggccc

SEQ ID NO: 7670520 - DNA, 22 bp, Homo sapiens
gctccaggagagggaagcagat

SEQ ID NO: 7670521 - DNA, 22 bp, Homo sapiens
gctccaggaagggaaatctcca

SEQ ID NO: 7670522 - DNA, 22 bp, Homo sapiens
gctccaggagagggaagcagat

SEQ ID NO: 7670523 - DNA, 22 bp, Homo sapiens
gctccaggagagggaagcagat

SEQ ID NO: 7670524 - DNA, 22 bp, Homo sapiens
gctccaggagagggaagcagat

SEQ ID NO: 7670525 - DNA, 22 bp, Homo sapiens
gctccaggagagggaagcagat

SEQ ID NO: 7670526 - DNA, 22 bp, Homo sapiens
gctccaggagagggaagcagat

SEQ ID NO: 7670527 - DNA, 22 bp, Homo sapiens
gctccaggagagggaagcagat

SEQ ID NO: 7670528 - DNA, 22 bp, Homo sapiens
gctccagctcgtggctcccagc

SEQ ID NO: 7670529 - DNA, 22 bp, Homo sapiens
gctccagctcgtggctcccagc

SEQ ID NO: 7670530 - DNA, 22 bp, Homo sapiens
gctccagctccggctccgaagc

SEQ ID NO: 7670531 - DNA, 22 bp, Homo sapiens
gctccagctccggctccgaagc

SEQ ID NO: 7670532 - DNA, 22 bp, Homo sapiens
gctccagctcgtggctcccagc

SEQ ID NO: 7670533 - DNA, 22 bp, Homo sapiens
gctccaggaagggaaatctcca

SEQ ID NO: 7670534 - DNA, 22 bp, Homo sapiens
gctccagctcgtggctcccagc

SEQ ID NO: 7670535 - DNA, 22 bp, Homo sapiens
gctccagctcgtggctcccagc

SEQ ID NO: 7670536 - DNA, 22 bp, Homo sapiens
gctccagctccggctccgaagc

SEQ ID NO: 7670537 - DNA, 22 bp, Homo sapiens
gctccagctccggctccgaagc

SEQ ID NO: 7670538 - DNA, 22 bp, Homo sapiens
gctccagccacatggtagaagg

SEQ ID NO: 7670539 - DNA, 22 bp, Homo sapiens
gctccagccacatggtagaagg

SEQ ID NO: 7670540 - DNA, 22 bp, Homo sapiens
gctccagcacctagagcaggtc

SEQ ID NO: 7670541 - DNA, 22 bp, Homo sapiens
gctccagcacctagagcaggtc

SEQ ID NO: 7670542 - DNA, 22 bp, Homo sapiens
gctccagcacctagagcaggtc

SEQ ID NO: 7670543 - DNA, 22 bp, Homo sapiens
gctccagcacctagagcaggtc

SEQ ID NO: 7670544 - DNA, 22 bp, Homo sapiens
gctccagatgaatgcacttgtt

SEQ ID NO: 7670545 - DNA, 22 bp, Homo sapiens
gctccagatgaatgcacttgtt

SEQ ID NO: 7670546 - DNA, 22 bp, Homo sapiens
gctccagcacctagagcaggtc

SEQ ID NO: 7670547 - DNA, 22 bp, Homo sapiens
gctccagagtgtggcatctggg

SEQ ID NO: 7670548 - DNA, 22 bp, Homo sapiens
gctccagagtgtggcatctggg

SEQ ID NO: 7670549 - DNA, 22 bp, Homo sapiens
gctccagagtgtggcatctggg

SEQ ID NO: 7670550 - DNA, 22 bp, Homo sapiens
gctccagagtgtggcatctggg

SEQ ID NO: 7670551 - DNA, 22 bp, Homo sapiens
gctccagatgaaaggccagagg

SEQ ID NO: 7670552 - DNA, 22 bp, Homo sapiens
gctccagatgaaaggccagagg

SEQ ID NO: 7670553 - DNA, 22 bp, Homo sapiens
gctccagatgaaaggccagagg

SEQ ID NO: 7670554 - DNA, 22 bp, Homo sapiens
gctccagatgaatgcacttgtt

SEQ ID NO: 7670555 - DNA, 22 bp, Homo sapiens
gctccagatgaatgcacttgtt

SEQ ID NO: 7670556 - DNA, 22 bp, Homo sapiens
gctccagatgaatgcacttgtt

SEQ ID NO: 7670557 - DNA, 22 bp, Homo sapiens
gctccagatgaatgcacttgtt

SEQ ID NO: 7670558 - DNA, 21 bp, Homo sapiens
gctccagaactctatgctaac

SEQ ID NO: 7670559 - DNA, 17 bp, Homo sapiens
gctccagaattctagtc

SEQ ID NO: 7670560 - DNA, 17 bp, Homo sapiens
gctccagaattctagtc

SEQ ID NO: 7670561 - DNA, 22 bp, Homo sapiens
gctccagagcagagactaggtt

SEQ ID NO: 7670562 - DNA, 22 bp, Homo sapiens
gctccacttgcagctaggcttg

SEQ ID NO: 7670563 - DNA, 22 bp, Homo sapiens
gctccagaaatgccgtgatcct

SEQ ID NO: 7670564 - DNA, 21 bp, Homo sapiens
gctccagaactctatgctaac

SEQ ID NO: 7670565 - DNA, 22 bp, Homo sapiens
gctccagagcagagactaggtt

SEQ ID NO: 7670566 - DNA, 22 bp, Homo sapiens
gctccagagcagagactaggtt

SEQ ID NO: 7670567 - DNA, 22 bp, Homo sapiens
gctccagagtgtggcatctggg

SEQ ID NO: 7670568 - DNA, 22 bp, Homo sapiens
gctccagagtgtggcatctggg

SEQ ID NO: 7670569 - DNA, 22 bp, Homo sapiens
gctccagagtgtggcatctggg

SEQ ID NO: 7670570 - DNA, 22 bp, Homo sapiens
gctccagagcagagactaggtt

SEQ ID NO: 7670571 - DNA, 22 bp, Homo sapiens
gctccagagcagagactaggtt

SEQ ID NO: 7670572 - DNA, 22 bp, Homo sapiens
gctccacttccttctgccctca

SEQ ID NO: 7670573 - DNA, 22 bp, Homo sapiens
gctccactgtttattggcagaa

SEQ ID NO: 7670574 - DNA, 22 bp, Homo sapiens
gctccactgtttattggcagaa

SEQ ID NO: 7670575 - DNA, 22 bp, Homo sapiens
gctccactgtcccatgggactt

SEQ ID NO: 7670576 - DNA, 22 bp, Homo sapiens
gctccactgtcccatgggactt

SEQ ID NO: 7670577 - DNA, 22 bp, Homo sapiens
gctccacttgcagctaggcttg

SEQ ID NO: 7670578 - DNA, 22 bp, Homo sapiens
gctccacttccttctgccctca

SEQ ID NO: 7670579 - DNA, 22 bp, Homo sapiens
gctccacttccttctgccctca

SEQ ID NO: 7670580 - DNA, 22 bp, Homo sapiens
gctcatttctgtttcttgcaac

SEQ ID NO: 7670581 - DNA, 22 bp, Homo sapiens
gctcattcagccagggcccggt

SEQ ID NO: 7670582 - DNA, 21 bp, Homo sapiens
gctcatggtggagaaaagcag

SEQ ID NO: 7670583 - DNA, 22 bp, Homo sapiens
gctccaaagtccagctgtttcc

SEQ ID NO: 7670584 - DNA, 22 bp, Homo sapiens
gctccaaagtacagtgacttac

SEQ ID NO: 7670585 - DNA, 22 bp, Homo sapiens
gctcatttcttctttccacaat

SEQ ID NO: 7670586 - DNA, 22 bp, Homo sapiens
gctcatttcttctttccacaat

SEQ ID NO: 7670587 - DNA, 22 bp, Homo sapiens
gctccaaggtatccaccagggt

SEQ ID NO: 7670588 - DNA, 22 bp, Homo sapiens
gctccaaggtatccaccagggt

SEQ ID NO: 7670589 - DNA, 22 bp, Homo sapiens
gctccaagccttctttgttact

SEQ ID NO: 7670590 - DNA, 22 bp, Homo sapiens
gctccaaggtatccaccagggt

SEQ ID NO: 7670591 - DNA, 22 bp, Homo sapiens
gctccactaggaatctgctctt

SEQ ID NO: 7670592 - DNA, 22 bp, Homo sapiens
gctccacaaataatggaacctg

SEQ ID NO: 7670593 - DNA, 22 bp, Homo sapiens
gctccactaggaatctgctctt

SEQ ID NO: 7670594 - DNA, 22 bp, Homo sapiens
gctccactaggaatctgctctt

SEQ ID NO: 7670595 - DNA, 22 bp, Homo sapiens
gctccactgcccctgggcaccg

SEQ ID NO: 7670596 - DNA, 22 bp, Homo sapiens
gctccactgcccctgggcaccg

SEQ ID NO: 7670597 - DNA, 22 bp, Homo sapiens
gctccactgcccctgggcaccg

SEQ ID NO: 7670598 - DNA, 22 bp, Homo sapiens
gcagtagagcttcttttgatga

SEQ ID NO: 7670599 - DNA, 20 bp, Homo sapiens
gcagtagaccatgcttggaa

SEQ ID NO: 7670600 - DNA, 22 bp, Homo sapiens
gcagtagagaagccaggctgta

SEQ ID NO: 7670601 - DNA, 22 bp, Homo sapiens
gcagtagagaagccaggctgta

SEQ ID NO: 7670602 - DNA, 22 bp, Homo sapiens
gcagtagaaatttcattgctct

SEQ ID NO: 7670603 - DNA, 22 bp, Homo sapiens
gcagtagaaggtgctttctgga

SEQ ID NO: 7670604 - DNA, 22 bp, Homo sapiens
gcagtagaactgtcatgatgtt

SEQ ID NO: 7670605 - DNA, 22 bp, Homo sapiens
gcagtagaactgtcatgatgtt

SEQ ID NO: 7670606 - DNA, 22 bp, Homo sapiens
gcagtaatctcatatcaatttc

SEQ ID NO: 7670607 - DNA, 22 bp, Homo sapiens
gcagtaatctcatatcaatttc

SEQ ID NO: 7670608 - DNA, 22 bp, Homo sapiens
gcagtacacacatatgtattcg

SEQ ID NO: 7670609 - DNA, 22 bp, Homo sapiens
gcagtaagttaatagtgctggt

SEQ ID NO: 7670610 - DNA, 22 bp, Homo sapiens
gcagtaagttaatagtgctggt

SEQ ID NO: 7670611 - DNA, 22 bp, Homo sapiens
gcagtagaaatttcattgctct

SEQ ID NO: 7670612 - DNA, 22 bp, Homo sapiens
gcagtactttaagggatgaagc

SEQ ID NO: 7670613 - DNA, 22 bp, Homo sapiens
gcagtactttatcacatggaat

SEQ ID NO: 7670614 - DNA, 22 bp, Homo sapiens
gcaggtgtcttcatggaactct

SEQ ID NO: 7670615 - DNA, 19 bp, Homo sapiens
gcaggtgtgaatccgtaga

SEQ ID NO: 7670616 - DNA, 23 bp, Homo sapiens
gcaggtggttcgaacagaagttt

SEQ ID NO: 7670617 - DNA, 23 bp, Homo sapiens
gcaggtggttcgaacagaagttt

SEQ ID NO: 7670618 - DNA, 22 bp, Homo sapiens
gcagtgggcaacaagagctgga

SEQ ID NO: 7670619 - DNA, 22 bp, Homo sapiens
gcagtgggcaacaagagctgga

SEQ ID NO: 7670620 - DNA, 22 bp, Homo sapiens
gcagtgggcaacaagagctgga

SEQ ID NO: 7670621 - DNA, 22 bp, Homo sapiens
gcagtgggcaacaagagctgga

SEQ ID NO: 7670622 - DNA, 22 bp, Homo sapiens
gcagtgggcaacaagagctgga

SEQ ID NO: 7670623 - DNA, 22 bp, Homo sapiens
gcagtgggcaacaagagctgga

SEQ ID NO: 7670624 - DNA, 22 bp, Homo sapiens
gcagtgggagcttaggcagtgc

SEQ ID NO: 7670625 - DNA, 22 bp, Homo sapiens
gcagtatatccattacttcata

SEQ ID NO: 7670626 - DNA, 22 bp, Homo sapiens
gcagtagtcgctggagatgagg

SEQ ID NO: 7670627 - DNA, 22 bp, Homo sapiens
gcagtagtcgctggagatgagg

SEQ ID NO: 7670628 - DNA, 22 bp, Homo sapiens
gcagtagtgataaaaatgtatc

SEQ ID NO: 7670629 - DNA, 22 bp, Homo sapiens
gcagtagtgtcagtacagcaaa

SEQ ID NO: 7670630 - DNA, 22 bp, Homo sapiens
gcagtagtgtcagtacagcaaa

SEQ ID NO: 7670631 - DNA, 22 bp, Homo sapiens
gcagtagttctgattggaactt

SEQ ID NO: 7670632 - DNA, 22 bp, Homo sapiens
gcagtagttgaaactcctgtag

SEQ ID NO: 7670633 - DNA, 22 bp, Homo sapiens
gcagtagttatagggaaatata

SEQ ID NO: 7670634 - DNA, 22 bp, Homo sapiens
gcagtagttcgtctgtgttccc

SEQ ID NO: 7670635 - DNA, 22 bp, Homo sapiens
gcagtagtgtcagtacagcaaa

SEQ ID NO: 7670636 - DNA, 22 bp, Homo sapiens
gcagtagtttatggctaaacct

SEQ ID NO: 7670637 - DNA, 22 bp, Homo sapiens
gcagtagtttcaaaacaagaaa

SEQ ID NO: 7670638 - DNA, 22 bp, Homo sapiens
gcagtataagtggattatgtcc

SEQ ID NO: 7670639 - DNA, 22 bp, Homo sapiens
gcagtaggagggacaactacct

SEQ ID NO: 7670640 - DNA, 22 bp, Homo sapiens
gcagtaggagaagaggatgctt

SEQ ID NO: 7670641 - DNA, 22 bp, Homo sapiens
gcagtagcagtatccagaagca

SEQ ID NO: 7670642 - DNA, 22 bp, Homo sapiens
gcagtaggagggacaactacct

SEQ ID NO: 7670643 - DNA, 22 bp, Homo sapiens
gcagtaggagtttccagggtgg

SEQ ID NO: 7670644 - DNA, 22 bp, Homo sapiens
gcagtaggagaagaggatgctt

SEQ ID NO: 7670645 - DNA, 22 bp, Homo sapiens
gcagtagagcagagattttcct

SEQ ID NO: 7670646 - DNA, 22 bp, Homo sapiens
gcagtagatctggaagagaatt

SEQ ID NO: 7670647 - DNA, 22 bp, Homo sapiens
gcagtaggagaagaggatgctt

SEQ ID NO: 7670648 - DNA, 18 bp, Homo sapiens
gcagtaggcgcgcaggac

SEQ ID NO: 7670649 - DNA, 18 bp, Homo sapiens
gcagtaggcgcgcaggac

SEQ ID NO: 7670650 - DNA, 18 bp, Homo sapiens
gcagtaggcgcgcaggac

SEQ ID NO: 7670651 - DNA, 18 bp, Homo sapiens
gcagtaggcgcgcaggac

SEQ ID NO: 7670652 - DNA, 22 bp, Homo sapiens
gcagtaggggctggagggctgt

SEQ ID NO: 7670653 - DNA, 22 bp, Homo sapiens
gcagtagtccataagtactctg

SEQ ID NO: 7670654 - DNA, 22 bp, Homo sapiens
gcagtagtccataagtactctg

SEQ ID NO: 7670655 - DNA, 22 bp, Homo sapiens
gcagtaggggctggagggctgt

SEQ ID NO: 7670656 - DNA, 22 bp, Homo sapiens
gcagtaggggctggagggctgt

SEQ ID NO: 7670657 - DNA, 22 bp, Homo sapiens
gcagtaggggctggagggctgt

SEQ ID NO: 7670658 - DNA, 22 bp, Homo sapiens
gcagtgtagactttagttgatg

SEQ ID NO: 7670659 - DNA, 22 bp, Homo sapiens
gcagtgtcagtgcctgggtggt

SEQ ID NO: 7670660 - DNA, 22 bp, Homo sapiens
gcagtggtgggacagtggaaaa

SEQ ID NO: 7670661 - DNA, 22 bp, Homo sapiens
gcagtggtggtgtttcagtgac

SEQ ID NO: 7670662 - DNA, 22 bp, Homo sapiens
gcagtggtggagcttacatatc

SEQ ID NO: 7670663 - DNA, 19 bp, Homo sapiens
gcagtgtcatggtaggagc

SEQ ID NO: 7670664 - DNA, 19 bp, Homo sapiens
gcagtgtcatggtaggagc

SEQ ID NO: 7670665 - DNA, 22 bp, Homo sapiens
gcagtgtcagtgcctgggtggt

SEQ ID NO: 7670666 - DNA, 22 bp, Homo sapiens
gcagtgtcagtgcctgggtggt

SEQ ID NO: 7670667 - DNA, 22 bp, Homo sapiens
gcagtgtcagtgcctgggtggt

SEQ ID NO: 7670668 - DNA, 22 bp, Homo sapiens
gcagtgtctttgacctccaccc

SEQ ID NO: 7670669 - DNA, 22 bp, Homo sapiens
gcagtgtctttgacctccaccc

SEQ ID NO: 7670670 - DNA, 22 bp, Homo sapiens
gcagtgtccagggtggtctgca

SEQ ID NO: 7670671 - DNA, 22 bp, Homo sapiens
gcagtgtccagggtggtctgca

SEQ ID NO: 7670672 - DNA, 21 bp, Homo sapiens
gcagtgtcatggtttcaagtt

SEQ ID NO: 7670673 - DNA, 21 bp, Homo sapiens
gcagtgtcatggtttcaagtt

SEQ ID NO: 7670674 - DNA, 23 bp, Homo sapiens
gcagtgtgaatccagtgtttcag

SEQ ID NO: 7670675 - DNA, 22 bp, Homo sapiens
gcagtgtctttgacctccaccc

SEQ ID NO: 7670676 - DNA, 22 bp, Homo sapiens
gcagtgtctttgacctccaccc

SEQ ID NO: 7670677 - DNA, 22 bp, Homo sapiens
gcagtgttcagtgaagcaggag

SEQ ID NO: 7670678 - DNA, 22 bp, Homo sapiens
gcagtgttatgttttctataat

SEQ ID NO: 7670679 - DNA, 22 bp, Homo sapiens
gcagtgttaggaataaaaatga

SEQ ID NO: 7670680 - DNA, 22 bp, Homo sapiens
gcagtggggaatgctggggaga

SEQ ID NO: 7670681 - DNA, 22 bp, Homo sapiens
gcagtggggaatgctggggaga

SEQ ID NO: 7670682 - DNA, 22 bp, Homo sapiens
gcagtggggaatgctggggaga

SEQ ID NO: 7670683 - DNA, 22 bp, Homo sapiens
gcagtgggcctgaggaagggtg

SEQ ID NO: 7670684 - DNA, 22 bp, Homo sapiens
gcagtgggcctgaggaagggtg

SEQ ID NO: 7670685 - DNA, 22 bp, Homo sapiens
gcagtgggcctgaggaagggtg

SEQ ID NO: 7670686 - DNA, 22 bp, Homo sapiens
gcagtgggcctgaggaagggtg

SEQ ID NO: 7670687 - DNA, 22 bp, Homo sapiens
gcagtgggcctgaggaagggtg

SEQ ID NO: 7670688 - DNA, 22 bp, Homo sapiens
gcagtgggcaacaagagctgga

SEQ ID NO: 7670689 - DNA, 22 bp, Homo sapiens
gcagtgggcaacaagagctgga

SEQ ID NO: 7670690 - DNA, 22 bp, Homo sapiens
gcagtgggcaacaagagctgga

SEQ ID NO: 7670691 - DNA, 22 bp, Homo sapiens
gcagtgggcaacaagagctgga

SEQ ID NO: 7670692 - DNA, 22 bp, Homo sapiens
gcagtgggcaacaagagctgga

SEQ ID NO: 7670693 - DNA, 22 bp, Homo sapiens
gcagtgggcctgaggaagggtg

SEQ ID NO: 7670694 - DNA, 22 bp, Homo sapiens
gcagtggggaatgctggggaga

SEQ ID NO: 7670695 - DNA, 22 bp, Homo sapiens
gcagtggggcaatcatagctca

SEQ ID NO: 7670696 - DNA, 22 bp, Homo sapiens
gcagtggggaatgctggggaga

SEQ ID NO: 7670697 - DNA, 22 bp, Homo sapiens
gcagtggggaatgctggggaga

SEQ ID NO: 7670698 - DNA, 22 bp, Homo sapiens
gcagtggggcgctgggagttgg

SEQ ID NO: 7670699 - DNA, 22 bp, Homo sapiens
gcagtggggcgctgggagttgg

SEQ ID NO: 7670700 - DNA, 22 bp, Homo sapiens
gcagtggggcgctgggagttgg

SEQ ID NO: 7670701 - DNA, 22 bp, Homo sapiens
gcagtggtccagctaagatttg

SEQ ID NO: 7670702 - DNA, 22 bp, Homo sapiens
gcaggtggtccccgtggagtgg

SEQ ID NO: 7670703 - DNA, 22 bp, Homo sapiens
gcaggtggtccccgtggagtgg

SEQ ID NO: 7670704 - DNA, 22 bp, Homo sapiens
gcaggtggtccccgtggagtgg

SEQ ID NO: 7670705 - DNA, 22 bp, Homo sapiens
gcaggtggtccccgtggagtgg

SEQ ID NO: 7670706 - DNA, 22 bp, Homo sapiens
gcaggtggtccccgtggagtgg

SEQ ID NO: 7670707 - DNA, 22 bp, Homo sapiens
gcaggtggtccccgtggagtgg

SEQ ID NO: 7670708 - DNA, 22 bp, Homo sapiens
gcaggtggtggcgcgcgccctg

SEQ ID NO: 7670709 - DNA, 22 bp, Homo sapiens
gcaggtggtggcgcgcgccctg

SEQ ID NO: 7670710 - DNA, 22 bp, Homo sapiens
gcaggtggtggcgcgcgccctg

SEQ ID NO: 7670711 - DNA, 22 bp, Homo sapiens
gcaggtggtggcgcgcgccctg

SEQ ID NO: 7670712 - DNA, 22 bp, Homo sapiens
gcaggtggtgggggagccgttc

SEQ ID NO: 7670713 - DNA, 22 bp, Homo sapiens
gcaggtggtggggctatgatct

SEQ ID NO: 7670714 - DNA, 22 bp, Homo sapiens
gcaggtggtggggctatgatct

SEQ ID NO: 7670715 - DNA, 22 bp, Homo sapiens
gcaggtggtggggctatgatct

SEQ ID NO: 7670716 - DNA, 22 bp, Homo sapiens
gcaggtggttaaggtcccatgt

SEQ ID NO: 7670717 - DNA, 22 bp, Homo sapiens
gcaggtggttaaggtcccatgt

SEQ ID NO: 7670718 - DNA, 22 bp, Homo sapiens
gcaggtggttaaggtcccatgt

SEQ ID NO: 7670719 - DNA, 22 bp, Homo sapiens
gcaggtggttaaggtcccatgt

SEQ ID NO: 7670720 - DNA, 23 bp, Homo sapiens
gcaggtggttcgaacagaagttt

SEQ ID NO: 7670721 - DNA, 23 bp, Homo sapiens
gcaggtggttcgaacagaagttt

SEQ ID NO: 7670722 - DNA, 23 bp, Homo sapiens
gcaggtggttcgaacagaagttt

SEQ ID NO: 7670723 - DNA, 22 bp, Homo sapiens
gcaggtggttaaggtcccatgt

SEQ ID NO: 7670724 - DNA, 22 bp, Homo sapiens
gcaggtggtgggggagccgttc

SEQ ID NO: 7670725 - DNA, 22 bp, Homo sapiens
gcaggtggtgggggagccgttc

SEQ ID NO: 7670726 - DNA, 22 bp, Homo sapiens
gcaggtggttaaggtcccatgt

SEQ ID NO: 7670727 - DNA, 22 bp, Homo sapiens
gcaggtggtgggggagccgttc

SEQ ID NO: 7670728 - DNA, 22 bp, Homo sapiens
gcaggtggtgggggagccgttc

SEQ ID NO: 7670729 - DNA, 22 bp, Homo sapiens
gcaggtggtgggggagccgttc

SEQ ID NO: 7670730 - DNA, 22 bp, Homo sapiens
gcaggtggtgggggagccgttc

SEQ ID NO: 7670731 - DNA, 22 bp, Homo sapiens
gcaggtgggagccgctgcctga

SEQ ID NO: 7670732 - DNA, 22 bp, Homo sapiens
gcaggtgggagccgctgcctga

SEQ ID NO: 7670733 - DNA, 22 bp, Homo sapiens
gcaggtggcagaggtgggatct

SEQ ID NO: 7670734 - DNA, 22 bp, Homo sapiens
gcaggtgggagccgctgcctga

SEQ ID NO: 7670735 - DNA, 22 bp, Homo sapiens
gcaggtgggagccgctgcctga

SEQ ID NO: 7670736 - DNA, 16 bp, Homo sapiens
gcaggtggggcgcgca

SEQ ID NO: 7670737 - DNA, 22 bp, Homo sapiens
gcaggtggggctgctaccagaa

SEQ ID NO: 7670738 - DNA, 22 bp, Homo sapiens
gcaggtggggctgctaccagaa

SEQ ID NO: 7670739 - DNA, 22 bp, Homo sapiens
gcaggtgggggagaagttgtga

SEQ ID NO: 7670740 - DNA, 22 bp, Homo sapiens
gcaggtggggctgctaccagaa

SEQ ID NO: 7670741 - DNA, 22 bp, Homo sapiens
gcaggtggggctgctaccagaa

SEQ ID NO: 7670742 - DNA, 22 bp, Homo sapiens
gcaggtggggctgctaccagaa

SEQ ID NO: 7670743 - DNA, 22 bp, Homo sapiens
gcaggtggggctgctaccagaa

SEQ ID NO: 7670744 - DNA, 22 bp, Homo sapiens
gcaggtgggggtcggtgcatct

SEQ ID NO: 7670745 - DNA, 22 bp, Homo sapiens
gcaggtgggggtcggtgcatct

SEQ ID NO: 7670746 - DNA, 22 bp, Homo sapiens
gcaggtgggggtcggtgcatct

SEQ ID NO: 7670747 - DNA, 22 bp, Homo sapiens
gcaggtgggggtcggtgcatct

SEQ ID NO: 7670748 - DNA, 22 bp, Homo sapiens
gcaggtgggggagaagttgtga

SEQ ID NO: 7670749 - DNA, 22 bp, Homo sapiens
gcaggtgggggtcggtgcatct

SEQ ID NO: 7670750 - DNA, 22 bp, Homo sapiens
gcaggtgggggtcggtgcatct

SEQ ID NO: 7670751 - DNA, 22 bp, Homo sapiens
gcaggtggtcactcatccccag

SEQ ID NO: 7670752 - DNA, 22 bp, Homo sapiens
gcaggtgggggtcggtgcatct

SEQ ID NO: 7670753 - DNA, 22 bp, Homo sapiens
gcaggtggtccccgtggagtgg

SEQ ID NO: 7670754 - DNA, 22 bp, Homo sapiens
gcaggtggtcactcatccccag

SEQ ID NO: 7670755 - DNA, 22 bp, Homo sapiens
gcaggtgggggtcggtgcatct

SEQ ID NO: 7670756 - DNA, 22 bp, Homo sapiens
gcaggtgggggtcggtgcatct

SEQ ID NO: 7670757 - DNA, 22 bp, Homo sapiens
gcaggtgggggtcggtgcatct

SEQ ID NO: 7670758 - DNA, 22 bp, Homo sapiens
gcaggtgggggtcggtgcatct

SEQ ID NO: 7670759 - DNA, 19 bp, Homo sapiens
gcagggtggcagagctctt

SEQ ID NO: 7670760 - DNA, 19 bp, Homo sapiens
gcagggtggcagagctctt

SEQ ID NO: 7670761 - DNA, 22 bp, Homo sapiens
gcaggtggaagcagcagactca

SEQ ID NO: 7670762 - DNA, 22 bp, Homo sapiens
gcaggtggaagcagcagactca

SEQ ID NO: 7670763 - DNA, 22 bp, Homo sapiens
gcaggtggaagcagcagactca

SEQ ID NO: 7670764 - DNA, 19 bp, Homo sapiens
gcagggtggcagagctctt

SEQ ID NO: 7670765 - DNA, 22 bp, Homo sapiens
gcagggtgccgacttcagggat

SEQ ID NO: 7670766 - DNA, 22 bp, Homo sapiens
gcagggtggatggcagggccag

SEQ ID NO: 7670767 - DNA, 22 bp, Homo sapiens
gcagggtggatggcagggccag

SEQ ID NO: 7670768 - DNA, 22 bp, Homo sapiens
gcagggtggatggcagggccag

SEQ ID NO: 7670769 - DNA, 22 bp, Homo sapiens
gcagggtggatggcagggccag

SEQ ID NO: 7670770 - DNA, 22 bp, Homo sapiens
gcagggtggatggcagggccag

SEQ ID NO: 7670771 - DNA, 22 bp, Homo sapiens
gcagggtgccgacttcagggat

SEQ ID NO: 7670772 - DNA, 22 bp, Homo sapiens
gcagggtgatagtgaggctcag

SEQ ID NO: 7670773 - DNA, 22 bp, Homo sapiens
gcagggtgatagtgaggctcag

SEQ ID NO: 7670774 - DNA, 22 bp, Homo sapiens
gcagggtgatagtgaggctcag

SEQ ID NO: 7670775 - DNA, 22 bp, Homo sapiens
gcagggtgacgttgcccacctc

SEQ ID NO: 7670776 - DNA, 22 bp, Homo sapiens
gcagggtgacgttgcccacctc

SEQ ID NO: 7670777 - DNA, 22 bp, Homo sapiens
gcagggtgacgttgcccacctc

SEQ ID NO: 7670778 - DNA, 22 bp, Homo sapiens
gcagggtgacgttgcccacctc

SEQ ID NO: 7670779 - DNA, 22 bp, Homo sapiens
gcagggtgatagtgaggctcag

SEQ ID NO: 7670780 - DNA, 22 bp, Homo sapiens
gcaggtggagcagtagtctggt

SEQ ID NO: 7670781 - DNA, 22 bp, Homo sapiens
gcaggtggagcagtagtctggt

SEQ ID NO: 7670782 - DNA, 22 bp, Homo sapiens
gcaggtggaagcagcagactca

SEQ ID NO: 7670783 - DNA, 19 bp, Homo sapiens
gcaggtggatgtggtcagc

SEQ ID NO: 7670784 - DNA, 22 bp, Homo sapiens
gcaggtggagcagtagtctggt

SEQ ID NO: 7670785 - DNA, 22 bp, Homo sapiens
gcaggtggagcagtagtctggt

SEQ ID NO: 7670786 - DNA, 22 bp, Homo sapiens
gcaggtggattatcagaagtgc

SEQ ID NO: 7670787 - DNA, 22 bp, Homo sapiens
gcaggtggattatcagaagtgc

SEQ ID NO: 7670788 - DNA, 19 bp, Homo sapiens
gcaggtggatgtggtcagc

SEQ ID NO: 7670789 - DNA, 19 bp, Homo sapiens
gcaggtggatgtggtcagc

SEQ ID NO: 7670790 - DNA, 19 bp, Homo sapiens
gcaggtggatgtggtcagc

SEQ ID NO: 7670791 - DNA, 19 bp, Homo sapiens
gcaggtggatgtggtcagc

SEQ ID NO: 7670792 - DNA, 22 bp, Homo sapiens
gcaggtgggagccgctgcctga

SEQ ID NO: 7670793 - DNA, 22 bp, Homo sapiens
gcaggtgggagccgctgcctga

SEQ ID NO: 7670794 - DNA, 22 bp, Homo sapiens
gcaggtgggagccgctgcctga

SEQ ID NO: 7670795 - DNA, 22 bp, Homo sapiens
gcaggtgggagccgctgcctga

SEQ ID NO: 7670796 - DNA, 22 bp, Homo sapiens
gcaggtggcagaggtgggatct

SEQ ID NO: 7670797 - DNA, 22 bp, Homo sapiens
gcaggtggcagaggtgggatct

SEQ ID NO: 7670798 - DNA, 22 bp, Homo sapiens
gcaggtggcagaggtgggatct

SEQ ID NO: 7670799 - DNA, 22 bp, Homo sapiens
gcaggtggcagaggtgggatct

SEQ ID NO: 7670800 - DNA, 22 bp, Homo sapiens
gcaggtggcagaggtgggatct

SEQ ID NO: 7670801 - DNA, 22 bp, Homo sapiens
gcaggtggattatcagaagtgc

SEQ ID NO: 7670802 - DNA, 22 bp, Homo sapiens
gcaggtggcagaggtgggatct

SEQ ID NO: 7670803 - DNA, 22 bp, Homo sapiens
gcaggtggattatcagaagtgc

SEQ ID NO: 7670804 - DNA, 22 bp, Homo sapiens
gcaggtggattatcagaagtgc

SEQ ID NO: 7670805 - DNA, 22 bp, Homo sapiens
gcaggtggcagaggtgggatct

SEQ ID NO: 7670806 - DNA, 22 bp, Homo sapiens
gccaataactggttccaaattt

SEQ ID NO: 7670807 - DNA, 22 bp, Homo sapiens
gccaatgacagtctcagttctg

SEQ ID NO: 7670808 - DNA, 21 bp, Homo sapiens
gcattaaaagcagttgttggt

SEQ ID NO: 7670809 - DNA, 21 bp, Homo sapiens
gcattaaaagcagttgttggt

SEQ ID NO: 7670810 - DNA, 21 bp, Homo sapiens
gcattaaaagcagttgttggt

SEQ ID NO: 7670811 - DNA, 22 bp, Homo sapiens
gccaataaatggaaaagatgga

SEQ ID NO: 7670812 - DNA, 22 bp, Homo sapiens
gccaatgacagtctcagttctg

SEQ ID NO: 7670813 - DNA, 22 bp, Homo sapiens
gccaatgacagtctcagttctg

SEQ ID NO: 7670814 - DNA, 22 bp, Homo sapiens
gccaatgacagtctcagttctg

SEQ ID NO: 7670815 - DNA, 22 bp, Homo sapiens
gccaatgccttctagaggagtc

SEQ ID NO: 7670816 - DNA, 22 bp, Homo sapiens
gccaatgccttctagaggagtc

SEQ ID NO: 7670817 - DNA, 22 bp, Homo sapiens
gccaatttagggtttattgatt

SEQ ID NO: 7670818 - DNA, 20 bp, Homo sapiens
gccaattgtgtggtgggctg

SEQ ID NO: 7670819 - DNA, 23 bp, Homo sapiens
gccaatttagtaaaggcagtggg

SEQ ID NO: 7670820 - DNA, 23 bp, Homo sapiens
gccaatttagtaaaggcagtggg

SEQ ID NO: 7670821 - DNA, 22 bp, Homo sapiens
gccaatttatagccaaaaatca

SEQ ID NO: 7670822 - DNA, 22 bp, Homo sapiens
gccaatttatagccaaaaatca

SEQ ID NO: 7670823 - DNA, 22 bp, Homo sapiens
gccaatttatagccaaaaatca

SEQ ID NO: 7670824 - DNA, 23 bp, Homo sapiens
gccaatttagtaaaggcagtggg

SEQ ID NO: 7670825 - DNA, 22 bp, Homo sapiens
gccaatttagggtttattgatt

SEQ ID NO: 7670826 - DNA, 22 bp, Homo sapiens
gcatgtgttattttatgtatga

SEQ ID NO: 7670827 - DNA, 22 bp, Homo sapiens
gcatgtgttagagtgtgcatgc

SEQ ID NO: 7670828 - DNA, 22 bp, Homo sapiens
gcatgtgttatttctctgtggg

SEQ ID NO: 7670829 - DNA, 22 bp, Homo sapiens
gcatgtgttagagtgtgcatgc

SEQ ID NO: 7670830 - DNA, 22 bp, Homo sapiens
gcatgttttgcaacaagtgacc

SEQ ID NO: 7670831 - DNA, 22 bp, Homo sapiens
gcatgttttgcaacaagtgacc

SEQ ID NO: 7670832 - DNA, 22 bp, Homo sapiens
gcatgttttgcaacaagtgacc

SEQ ID NO: 7670833 - DNA, 22 bp, Homo sapiens
gcatgtgttggtttatgcatgt

SEQ ID NO: 7670834 - DNA, 22 bp, Homo sapiens
gcatgtttcttaagattgcatt

SEQ ID NO: 7670835 - DNA, 22 bp, Homo sapiens
gcatgtgttattttatgtatga

SEQ ID NO: 7670836 - DNA, 22 bp, Homo sapiens
gcatgtgttattttatgtatga

SEQ ID NO: 7670837 - DNA, 22 bp, Homo sapiens
gccacagcagggccctctcagg

SEQ ID NO: 7670838 - DNA, 22 bp, Homo sapiens
gccacagcagggccctctcagg

SEQ ID NO: 7670839 - DNA, 22 bp, Homo sapiens
gccacagcagggccctctcagg

SEQ ID NO: 7670840 - DNA, 22 bp, Homo sapiens
gccacagcagggccctctcagg

SEQ ID NO: 7670841 - DNA, 22 bp, Homo sapiens
gccacagcagggccctctcagg

SEQ ID NO: 7670842 - DNA, 22 bp, Homo sapiens
gccacagcccgagcaccatgag

SEQ ID NO: 7670843 - DNA, 22 bp, Homo sapiens
gccacagcccgagcaccatgag

SEQ ID NO: 7670844 - DNA, 16 bp, Homo sapiens
gccacagcccctgtct

SEQ ID NO: 7670845 - DNA, 16 bp, Homo sapiens
gccacagcccctgtct

SEQ ID NO: 7670846 - DNA, 22 bp, Homo sapiens
gccacagcccgagcaccatgag

SEQ ID NO: 7670847 - DNA, 22 bp, Homo sapiens
gccacagcccgagcaccatgag

SEQ ID NO: 7670848 - DNA, 22 bp, Homo sapiens
gccacagcccgagcaccatgag

SEQ ID NO: 7670849 - DNA, 22 bp, Homo sapiens
gccacagcccgagcaccatgag

SEQ ID NO: 7670850 - DNA, 22 bp, Homo sapiens
gccacagcccgagcaccatgag

SEQ ID NO: 7670851 - DNA, 22 bp, Homo sapiens
gccacagccgaacccttgggcc

SEQ ID NO: 7670852 - DNA, 22 bp, Homo sapiens
gccacagccgaacccttgggcc

SEQ ID NO: 7670853 - DNA, 22 bp, Homo sapiens
gccacagcccgagcaccatgag

SEQ ID NO: 7670854 - DNA, 22 bp, Homo sapiens
gccacagccgaacccttgggcc

SEQ ID NO: 7670855 - DNA, 22 bp, Homo sapiens
gccacagccgaacccttgggcc

SEQ ID NO: 7670856 - DNA, 22 bp, Homo sapiens
gccacagccgaacccttgggcc

SEQ ID NO: 7670857 - DNA, 22 bp, Homo sapiens
gccacagcctctgggaaaactc

SEQ ID NO: 7670858 - DNA, 22 bp, Homo sapiens
gccacagccgaacccttgggcc

SEQ ID NO: 7670859 - DNA, 22 bp, Homo sapiens
gccacagacagagagtctagtg

SEQ ID NO: 7670860 - DNA, 22 bp, Homo sapiens
gccacagacagagagtctagtg

SEQ ID NO: 7670861 - DNA, 22 bp, Homo sapiens
gccacagacagagagtctagtg

SEQ ID NO: 7670862 - DNA, 22 bp, Homo sapiens
gccacacttattctcatgcaca

SEQ ID NO: 7670863 - DNA, 22 bp, Homo sapiens
gccacacttattctcatgcaca

SEQ ID NO: 7670864 - DNA, 22 bp, Homo sapiens
gccacagcagggccctctcagg

SEQ ID NO: 7670865 - DNA, 22 bp, Homo sapiens
gccacagcaacaataatgcagc

SEQ ID NO: 7670866 - DNA, 22 bp, Homo sapiens
gccacagcaacaataatgcagc

SEQ ID NO: 7670867 - DNA, 22 bp, Homo sapiens
gccacagacagagagtctagtg

SEQ ID NO: 7670868 - DNA, 22 bp, Homo sapiens
gccacagacagagagtctagtg

SEQ ID NO: 7670869 - DNA, 22 bp, Homo sapiens
gccacagacagagagtctagtg

SEQ ID NO: 7670870 - DNA, 22 bp, Homo sapiens
gccaatttatcttactcgtgct

SEQ ID NO: 7670871 - DNA, 22 bp, Homo sapiens
gccaatttcctgaggtaaagct

SEQ ID NO: 7670872 - DNA, 22 bp, Homo sapiens
gccaatttgaattggttttctg

SEQ ID NO: 7670873 - DNA, 22 bp, Homo sapiens
gccaatttcctgaggtaaagct

SEQ ID NO: 7670874 - DNA, 22 bp, Homo sapiens
gccaatttatcttactcgtgct

SEQ ID NO: 7670875 - DNA, 22 bp, Homo sapiens
gccaatttgactagacctcttg

SEQ ID NO: 7670876 - DNA, 22 bp, Homo sapiens
gccaatttggggagccgtggtg

SEQ ID NO: 7670877 - DNA, 22 bp, Homo sapiens
gccaatttggggagccgtggtg

SEQ ID NO: 7670878 - DNA, 23 bp, Homo sapiens
gccaatttttgactgtcagtagg

SEQ ID NO: 7670879 - DNA, 20 bp, Homo sapiens
gccaatttttctatgtatac

SEQ ID NO: 7670880 - DNA, 23 bp, Homo sapiens
gccaatttttgactgtcagtagg

SEQ ID NO: 7670881 - DNA, 23 bp, Homo sapiens
gccaatttttgactgtcagtagg

SEQ ID NO: 7670882 - DNA, 22 bp, Homo sapiens
gccacactgcttctttgagcct

SEQ ID NO: 7670883 - DNA, 22 bp, Homo sapiens
gccacactgcttctttgagcct

SEQ ID NO: 7670884 - DNA, 22 bp, Homo sapiens
gccacacttattctcatgcaca

SEQ ID NO: 7670885 - DNA, 22 bp, Homo sapiens
gcatgtactcaggggaaaggtg

SEQ ID NO: 7670886 - DNA, 22 bp, Homo sapiens
gcatggttagacatcaatgtga

SEQ ID NO: 7670887 - DNA, 22 bp, Homo sapiens
gcatgtaatcactctaggaagg

SEQ ID NO: 7670888 - DNA, 22 bp, Homo sapiens
gcatgtggaatctctccatggt

SEQ ID NO: 7670889 - DNA, 22 bp, Homo sapiens
gcatgtctttgtctcaatataa

SEQ ID NO: 7670890 - DNA, 20 bp, Homo sapiens
gcatgtcagaaatcaatggg

SEQ ID NO: 7670891 - DNA, 22 bp, Homo sapiens
gcatggtggccttagggtagcc

SEQ ID NO: 7670892 - DNA, 22 bp, Homo sapiens
gcatggtggccttagggtagcc

SEQ ID NO: 7670893 - DNA, 22 bp, Homo sapiens
gcatggcttcggggtgctgcct

SEQ ID NO: 7670894 - DNA, 22 bp, Homo sapiens
gcatggcttcggggtgctgcct

SEQ ID NO: 7670895 - DNA, 22 bp, Homo sapiens
gcatggcttctgccaggcacct

SEQ ID NO: 7670896 - DNA, 22 bp, Homo sapiens
gcatggcttctgccaggcacct

SEQ ID NO: 7670897 - DNA, 22 bp, Homo sapiens
gcatggcttctgccaggcacct

SEQ ID NO: 7670898 - DNA, 22 bp, Homo sapiens
gcatgggaggacagtctgggct

SEQ ID NO: 7670899 - DNA, 22 bp, Homo sapiens
gcatgggcaagaggactggggg

SEQ ID NO: 7670900 - DNA, 22 bp, Homo sapiens
gcatgggcaccagtctctaggt

SEQ ID NO: 7670901 - DNA, 22 bp, Homo sapiens
gcatgggcaccagtctctaggt

SEQ ID NO: 7670902 - DNA, 22 bp, Homo sapiens
gcatgggcaagaggactggggg

SEQ ID NO: 7670903 - DNA, 22 bp, Homo sapiens
gcatgggcaagaggactggggg

SEQ ID NO: 7670904 - DNA, 22 bp, Homo sapiens
gcatgtggccttcaggctggaa

SEQ ID NO: 7670905 - DNA, 22 bp, Homo sapiens
gcatgtggccttcaggctggaa

SEQ ID NO: 7670906 - DNA, 22 bp, Homo sapiens
gcatgtggccttcaggctggaa

SEQ ID NO: 7670907 - DNA, 22 bp, Homo sapiens
gcatgtggccttcaggctggaa

SEQ ID NO: 7670908 - DNA, 22 bp, Homo sapiens
gcatgtgggaacacttaggcac

SEQ ID NO: 7670909 - DNA, 22 bp, Homo sapiens
gcatgtgggaacacttaggcac

SEQ ID NO: 7670910 - DNA, 22 bp, Homo sapiens
gcatgtggcccaaggaggctgt

SEQ ID NO: 7670911 - DNA, 22 bp, Homo sapiens
gcatgtggatggagctaaataa

SEQ ID NO: 7670912 - DNA, 22 bp, Homo sapiens
gcatgtggccttcaggctggaa

SEQ ID NO: 7670913 - DNA, 22 bp, Homo sapiens
gcatgtggcccaaggaggctgt

SEQ ID NO: 7670914 - DNA, 22 bp, Homo sapiens
gcatgtggcccaaggaggctgt

SEQ ID NO: 7670915 - DNA, 22 bp, Homo sapiens
gcatgtggaatctctccatggt

SEQ ID NO: 7670916 - DNA, 22 bp, Homo sapiens
gcatgtggatatgttagggtga

SEQ ID NO: 7670917 - DNA, 22 bp, Homo sapiens
gcatgtggtgggctggccactc

SEQ ID NO: 7670918 - DNA, 22 bp, Homo sapiens
gcatgtggtgggctggccactc

SEQ ID NO: 7670919 - DNA, 22 bp, Homo sapiens
gcatgtggtgctgaggctgtcg

SEQ ID NO: 7670920 - DNA, 22 bp, Homo sapiens
gcatgtggtgctgaggctgtcg

SEQ ID NO: 7670921 - DNA, 22 bp, Homo sapiens
gcatgtggtgctgaggctgtcg

SEQ ID NO: 7670922 - DNA, 22 bp, Homo sapiens
gcatgtgtcatctgcctttcgt

SEQ ID NO: 7670923 - DNA, 22 bp, Homo sapiens
gcatgtgtccctcagtctgtgc

SEQ ID NO: 7670924 - DNA, 22 bp, Homo sapiens
gcatgtgtgagaccttttagca

SEQ ID NO: 7670925 - DNA, 22 bp, Homo sapiens
gcatgtgtggaggagatgtgct

SEQ ID NO: 7670926 - DNA, 22 bp, Homo sapiens
gccagcagccacagaagtcact

SEQ ID NO: 7670927 - DNA, 19 bp, Homo sapiens
gccagcagaatgatgaggc

SEQ ID NO: 7670928 - DNA, 22 bp, Homo sapiens
gccagcagccacagaagtcact

SEQ ID NO: 7670929 - DNA, 22 bp, Homo sapiens
gccagcagccacagaagtcact

SEQ ID NO: 7670930 - DNA, 22 bp, Homo sapiens
gccagcagccacagaagtcact

SEQ ID NO: 7670931 - DNA, 22 bp, Homo sapiens
gccagcagccacagaagtcact

SEQ ID NO: 7670932 - DNA, 22 bp, Homo sapiens
gccagcagccacagaagtcact

SEQ ID NO: 7670933 - DNA, 19 bp, Homo sapiens
gccagcagaatgatgaggc

SEQ ID NO: 7670934 - DNA, 19 bp, Homo sapiens
gccagcagaatgatgaggc

SEQ ID NO: 7670935 - DNA, 19 bp, Homo sapiens
gccagcagaatgatgaggc

SEQ ID NO: 7670936 - DNA, 19 bp, Homo sapiens
gccagcagaatgatgaggc

SEQ ID NO: 7670937 - DNA, 19 bp, Homo sapiens
gccagcagaatgatgaggc

SEQ ID NO: 7670938 - DNA, 19 bp, Homo sapiens
gccagcagaatgatgaggc

SEQ ID NO: 7670939 - DNA, 19 bp, Homo sapiens
gccagcagaatgatgaggc

SEQ ID NO: 7670940 - DNA, 19 bp, Homo sapiens
gccagcacatgtcttctag

SEQ ID NO: 7670941 - DNA, 20 bp, Homo sapiens
gccagcacagggagcagttc

SEQ ID NO: 7670942 - DNA, 20 bp, Homo sapiens
gccagcacagggagcagttc

SEQ ID NO: 7670943 - DNA, 22 bp, Homo sapiens
gccagcaagggtccactgtcac

SEQ ID NO: 7670944 - DNA, 22 bp, Homo sapiens
gccagcaagggtccactgtcac

SEQ ID NO: 7670945 - DNA, 22 bp, Homo sapiens
gccagcaagggtccactgtcac

SEQ ID NO: 7670946 - DNA, 22 bp, Homo sapiens
gccagcaaggaggggaaaaatg

SEQ ID NO: 7670947 - DNA, 22 bp, Homo sapiens
gccagcaaagcaagttgtcagc

SEQ ID NO: 7670948 - DNA, 22 bp, Homo sapiens
gccagcaaagcaagttgtcagc

SEQ ID NO: 7670949 - DNA, 19 bp, Homo sapiens
gccagcacccagctgtgtc

SEQ ID NO: 7670950 - DNA, 22 bp, Homo sapiens
gccagcaccagctactagtcac

SEQ ID NO: 7670951 - DNA, 22 bp, Homo sapiens
gccagcaccagctactagtcac

SEQ ID NO: 7670952 - DNA, 22 bp, Homo sapiens
gccagcaccagctactagtcac

SEQ ID NO: 7670953 - DNA, 19 bp, Homo sapiens
gccagcacatgtcttctag

SEQ ID NO: 7670954 - DNA, 19 bp, Homo sapiens
gccagcacatgtcttctag

SEQ ID NO: 7670955 - DNA, 22 bp, Homo sapiens
gccagcaccttagcatgaatca

SEQ ID NO: 7670956 - DNA, 22 bp, Homo sapiens
gccagcaccttagcatgaatca

SEQ ID NO: 7670957 - DNA, 22 bp, Homo sapiens
gccagcaccagctactagtcac

SEQ ID NO: 7670958 - DNA, 19 bp, Homo sapiens
gccagcacccagctgtgtc

SEQ ID NO: 7670959 - DNA, 22 bp, Homo sapiens
gccagcaccttctcatatgttt

SEQ ID NO: 7670960 - DNA, 22 bp, Homo sapiens
gccagcaccttctcatatgttt

SEQ ID NO: 7670961 - DNA, 22 bp, Homo sapiens
gccagcaccttagcatgaatca

SEQ ID NO: 7670962 - DNA, 22 bp, Homo sapiens
gccagcaccttctcatatgttt

SEQ ID NO: 7670963 - DNA, 22 bp, Homo sapiens
gccagcagcccagaaggacttt

SEQ ID NO: 7670964 - DNA, 22 bp, Homo sapiens
gccagcagcccagaaggacttt

SEQ ID NO: 7670965 - DNA, 22 bp, Homo sapiens
gccagcagcccagaaggacttt

SEQ ID NO: 7670966 - DNA, 22 bp, Homo sapiens
gccagcagcccagaaggacttt

SEQ ID NO: 7670967 - DNA, 22 bp, Homo sapiens
gccagcagcgagagtttaacct

SEQ ID NO: 7670968 - DNA, 22 bp, Homo sapiens
gccagcagcgagagtttaacct

SEQ ID NO: 7670969 - DNA, 22 bp, Homo sapiens
gccagcagcccagaaggacttt

SEQ ID NO: 7670970 - DNA, 22 bp, Homo sapiens
gccagcagctgtggggtggcca

SEQ ID NO: 7670971 - DNA, 22 bp, Homo sapiens
gccagcagctcttgggcgggca

SEQ ID NO: 7670972 - DNA, 22 bp, Homo sapiens
gccagcagctcttgggcgggca

SEQ ID NO: 7670973 - DNA, 22 bp, Homo sapiens
gccagcagctcttgggcgggca

SEQ ID NO: 7670974 - DNA, 22 bp, Homo sapiens
gccagcagctcttgggcgggca

SEQ ID NO: 7670975 - DNA, 22 bp, Homo sapiens
gccagcagctcttgggcgggca

SEQ ID NO: 7670976 - DNA, 22 bp, Homo sapiens
gccagcagcgagagtttaacct

SEQ ID NO: 7670977 - DNA, 22 bp, Homo sapiens
gccagcagctcttgggcgggca

SEQ ID NO: 7670978 - DNA, 22 bp, Homo sapiens
gccagcagctcttgggcgggca

SEQ ID NO: 7670979 - DNA, 22 bp, Homo sapiens
gccagcagctgtggggtggcca

SEQ ID NO: 7670980 - DNA, 22 bp, Homo sapiens
gccagcagctgtggggtggcca

SEQ ID NO: 7670981 - DNA, 22 bp, Homo sapiens
gccagcagctgtggggtggcca

SEQ ID NO: 7670982 - DNA, 22 bp, Homo sapiens
gccagcagctgtggggtggcca

SEQ ID NO: 7670983 - DNA, 22 bp, Homo sapiens
gccagcagctgtggggtggcca

SEQ ID NO: 7670984 - DNA, 22 bp, Homo sapiens
gccagcagctgtggggtggcca

SEQ ID NO: 7670985 - DNA, 22 bp, Homo sapiens
gccagcagctgtggggtggcca

SEQ ID NO: 7670986 - DNA, 22 bp, Homo sapiens
gccagcagctgtggggtggcca

SEQ ID NO: 7670987 - DNA, 22 bp, Homo sapiens
gccagcagctgtggggtggcca

SEQ ID NO: 7670988 - DNA, 22 bp, Homo sapiens
gccagcagctgtggggtggcca

SEQ ID NO: 7670989 - DNA, 22 bp, Homo sapiens
gccagcagggaagccttgggct

SEQ ID NO: 7670990 - DNA, 22 bp, Homo sapiens
gccagcagggaagccttgggct

SEQ ID NO: 7670991 - DNA, 22 bp, Homo sapiens
gccagcagcttcttctcatcct

SEQ ID NO: 7670992 - DNA, 22 bp, Homo sapiens
gccagcagcttcttctcatcct

SEQ ID NO: 7670993 - DNA, 22 bp, Homo sapiens
gccagcagcttcttctcatcct

SEQ ID NO: 7670994 - DNA, 22 bp, Homo sapiens
gccagcagcttcttctcatcct

SEQ ID NO: 7670995 - DNA, 22 bp, Homo sapiens
gccagcagcttcttctcatcct

SEQ ID NO: 7670996 - DNA, 22 bp, Homo sapiens
gccagcagggaagccttgggct

SEQ ID NO: 7670997 - DNA, 22 bp, Homo sapiens
gccagcagggaagccttgggct

SEQ ID NO: 7670998 - DNA, 22 bp, Homo sapiens
gccagcagggaagccttgggct

SEQ ID NO: 7670999 - DNA, 22 bp, Homo sapiens
gccagcagggaagccttgggct

SEQ ID NO: 7671000 - DNA, 22 bp, Homo sapiens
gccagcagggaagccttgggct

SEQ ID NO: 7671001 - DNA, 19 bp, Homo sapiens
gccacaggatgaagtttgg

SEQ ID NO: 7671002 - DNA, 22 bp, Homo sapiens
gccacaggaaagcaccctggag

SEQ ID NO: 7671003 - DNA, 19 bp, Homo sapiens
gccacaggatgaagtttgg

SEQ ID NO: 7671004 - DNA, 22 bp, Homo sapiens
gccacaggaaagcaccctggag

SEQ ID NO: 7671005 - DNA, 22 bp, Homo sapiens
gccacaggaaagcaccctggag

SEQ ID NO: 7671006 - DNA, 22 bp, Homo sapiens
gccacaggaaagcaccctggag

SEQ ID NO: 7671007 - DNA, 22 bp, Homo sapiens
gccacaggcacttaagggctgg

SEQ ID NO: 7671008 - DNA, 22 bp, Homo sapiens
gccacaggcacttaagggctgg

SEQ ID NO: 7671009 - DNA, 22 bp, Homo sapiens
gccacaggcacttaagggctgg

SEQ ID NO: 7671010 - DNA, 19 bp, Homo sapiens
gccacaggatgaagtttgg

SEQ ID NO: 7671011 - DNA, 19 bp, Homo sapiens
gccacaggatgaagtttgg

SEQ ID NO: 7671012 - DNA, 22 bp, Homo sapiens
gccacaggaaagcaccctggag

SEQ ID NO: 7671013 - DNA, 22 bp, Homo sapiens
gccacaggaaagcaccctggag

SEQ ID NO: 7671014 - DNA, 22 bp, Homo sapiens
gccacagcttttaacctcgggg

SEQ ID NO: 7671015 - DNA, 22 bp, Homo sapiens
gccacagcttttaacctcgggg

SEQ ID NO: 7671016 - DNA, 22 bp, Homo sapiens
gccacagcttagatcacagcct

SEQ ID NO: 7671017 - DNA, 22 bp, Homo sapiens
gccacagcttagatcacagcct

SEQ ID NO: 7671018 - DNA, 22 bp, Homo sapiens
gccacagcttttaacctcgggg

SEQ ID NO: 7671019 - DNA, 22 bp, Homo sapiens
gccacagcttttaacctcgggg

SEQ ID NO: 7671020 - DNA, 22 bp, Homo sapiens
gccacagcttttaacctcgggg

SEQ ID NO: 7671021 - DNA, 22 bp, Homo sapiens
gccacagcggggccgctagagc

SEQ ID NO: 7671022 - DNA, 22 bp, Homo sapiens
gccacagcggggccgctagagc

SEQ ID NO: 7671023 - DNA, 22 bp, Homo sapiens
gccacagcctctgggaaaactc

SEQ ID NO: 7671024 - DNA, 22 bp, Homo sapiens
gccacagcggggccgctagagc

SEQ ID NO: 7671025 - DNA, 22 bp, Homo sapiens
gccacagcggggccgctagagc

SEQ ID NO: 7671026 - DNA, 22 bp, Homo sapiens
gccacagcggggccgctagagc

SEQ ID NO: 7671027 - DNA, 22 bp, Homo sapiens
gccacagctcacgttccccatt

SEQ ID NO: 7671028 - DNA, 22 bp, Homo sapiens
gccacagcggggccgctagagc

SEQ ID NO: 7671029 - DNA, 22 bp, Homo sapiens
gccacagcggggccgctagagc

SEQ ID NO: 7671030 - DNA, 22 bp, Homo sapiens
gccacagctcacgttccccatt

SEQ ID NO: 7671031 - DNA, 22 bp, Homo sapiens
gccacagctcacgttccccatt

SEQ ID NO: 7671032 - DNA, 22 bp, Homo sapiens
gccacagcttagatcacagcct

SEQ ID NO: 7671033 - DNA, 22 bp, Homo sapiens
gccacagcttagatcacagcct

SEQ ID NO: 7671034 - DNA, 22 bp, Homo sapiens
gccacagcttagatcacagcct

SEQ ID NO: 7671035 - DNA, 22 bp, Homo sapiens
gccacagcttagatcacagcct

SEQ ID NO: 7671036 - DNA, 22 bp, Homo sapiens
gccacagcttagatcacagcct

SEQ ID NO: 7671037 - DNA, 22 bp, Homo sapiens
gccacagcttagatcacagcct

SEQ ID NO: 7671038 - DNA, 22 bp, Homo sapiens
gccacagctccagtcaggtgac

SEQ ID NO: 7671039 - DNA, 22 bp, Homo sapiens
gccacagctccagtcaggtgac

SEQ ID NO: 7671040 - DNA, 22 bp, Homo sapiens
gccacagctccagtcaggtgac

SEQ ID NO: 7671041 - DNA, 22 bp, Homo sapiens
gccacagctccagtcaggtgac

SEQ ID NO: 7671042 - DNA, 22 bp, Homo sapiens
gccacagctccagtcaggtgac

SEQ ID NO: 7671043 - DNA, 20 bp, Homo sapiens
gccagaggccggcaggggct

SEQ ID NO: 7671044 - DNA, 22 bp, Homo sapiens
gccacaggctccagcatcagta

SEQ ID NO: 7671045 - DNA, 22 bp, Homo sapiens
gccacaggctccagcatcagta

SEQ ID NO: 7671046 - DNA, 20 bp, Homo sapiens
gccagaggccggcaggggct

SEQ ID NO: 7671047 - DNA, 20 bp, Homo sapiens
gccagaggccggcaggggct

SEQ ID NO: 7671048 - DNA, 20 bp, Homo sapiens
gccagaggccggcaggggct

SEQ ID NO: 7671049 - DNA, 20 bp, Homo sapiens
gccagaggccggcaggggct

SEQ ID NO: 7671050 - DNA, 20 bp, Homo sapiens
gccagaggccggcaggggct

SEQ ID NO: 7671051 - DNA, 20 bp, Homo sapiens
gccagaggccggcaggggct

SEQ ID NO: 7671052 - DNA, 20 bp, Homo sapiens
gccagaggccggcaggggct

SEQ ID NO: 7671053 - DNA, 22 bp, Homo sapiens
gccacaggctccagcatcagta

SEQ ID NO: 7671054 - DNA, 22 bp, Homo sapiens
gccacaggctccagcatcagta

SEQ ID NO: 7671055 - DNA, 22 bp, Homo sapiens
gccacaggctccagcatcagta

SEQ ID NO: 7671056 - DNA, 22 bp, Homo sapiens
gccacaggctccagcatcagta

SEQ ID NO: 7671057 - DNA, 22 bp, Homo sapiens
gccacaggcacttaagggctgg

SEQ ID NO: 7671058 - DNA, 22 bp, Homo sapiens
gccacaggctccagcatcagta

SEQ ID NO: 7671059 - DNA, 22 bp, Homo sapiens
gccacaggctccagcatcagta

SEQ ID NO: 7671060 - DNA, 22 bp, Homo sapiens
gccacaggcacttaagggctgg

SEQ ID NO: 7671061 - DNA, 22 bp, Homo sapiens
gccacaggcacttaagggctgg

SEQ ID NO: 7671062 - DNA, 22 bp, Homo sapiens
gccacaggcacttaagggctgg

SEQ ID NO: 7671063 - DNA, 22 bp, Homo sapiens
gccagaggctcaggttgccatg

SEQ ID NO: 7671064 - DNA, 22 bp, Homo sapiens
gccagaggctcaggttgccatg

SEQ ID NO: 7671065 - DNA, 22 bp, Homo sapiens
gccagaggctcaggttgccatg

SEQ ID NO: 7671066 - DNA, 22 bp, Homo sapiens
gccagatgccgtaaagatgggc

SEQ ID NO: 7671067 - DNA, 20 bp, Homo sapiens
gccagaggccggcaggggct

SEQ ID NO: 7671068 - DNA, 20 bp, Homo sapiens
gccagaggccggcaggggct

SEQ ID NO: 7671069 - DNA, 22 bp, Homo sapiens
gccagatttacagatttgccct

SEQ ID NO: 7671070 - DNA, 22 bp, Homo sapiens
gccagatttacagatttgccct

SEQ ID NO: 7671071 - DNA, 22 bp, Homo sapiens
gccagatttacagatttgccct

SEQ ID NO: 7671072 - DNA, 22 bp, Homo sapiens
gccagcaaagcaagttgtcagc

SEQ ID NO: 7671073 - DNA, 18 bp, Homo sapiens
gccagagggaagcaggtg

SEQ ID NO: 7671074 - DNA, 22 bp, Homo sapiens
gccagaggctcaggttgccatg

SEQ ID NO: 7671075 - DNA, 22 bp, Homo sapiens
gccagatgccgtaaagatgggc

SEQ ID NO: 7671076 - DNA, 22 bp, Homo sapiens
gccagatgtagatagcaaggta

SEQ ID NO: 7671077 - DNA, 22 bp, Homo sapiens
gccagatgtagatagcaaggta

SEQ ID NO: 7671078 - DNA, 22 bp, Homo sapiens
gccagatgtagatagcaaggta

SEQ ID NO: 7671079 - DNA, 22 bp, Homo sapiens
gcaggagctcgtttccaggctg

SEQ ID NO: 7671080 - DNA, 22 bp, Homo sapiens
gcaggagctcgtttccaggctg

SEQ ID NO: 7671081 - DNA, 22 bp, Homo sapiens
gcaggagctcgtttccaggctg

SEQ ID NO: 7671082 - DNA, 22 bp, Homo sapiens
gcaggagctcgtttccaggctg

SEQ ID NO: 7671083 - DNA, 22 bp, Homo sapiens
gcaggagctcgtttccaggctg

SEQ ID NO: 7671084 - DNA, 22 bp, Homo sapiens
gcaggagctcgtttccaggctg

SEQ ID NO: 7671085 - DNA, 22 bp, Homo sapiens
gcaggagctcgtttccaggctg

SEQ ID NO: 7671086 - DNA, 22 bp, Homo sapiens
gcaggagctcgtttccaggctg

SEQ ID NO: 7671087 - DNA, 22 bp, Homo sapiens
gcaggagctcgtttccaggctg

SEQ ID NO: 7671088 - DNA, 22 bp, Homo sapiens
gcaggagctcgtttccaggctg

SEQ ID NO: 7671089 - DNA, 22 bp, Homo sapiens
gcaggagctgctctcctgacga

SEQ ID NO: 7671090 - DNA, 22 bp, Homo sapiens
gcaggagctgctctcctgacga

SEQ ID NO: 7671091 - DNA, 22 bp, Homo sapiens
gcaggagctgctctcctgacga

SEQ ID NO: 7671092 - DNA, 22 bp, Homo sapiens
gcaggagctgctctcctgacga

SEQ ID NO: 7671093 - DNA, 22 bp, Homo sapiens
gcaggagctgctctcctgacga

SEQ ID NO: 7671094 - DNA, 22 bp, Homo sapiens
gcaggagccacttcagggatgc

SEQ ID NO: 7671095 - DNA, 22 bp, Homo sapiens
gcaggagccacttcagggatgc

SEQ ID NO: 7671096 - DNA, 22 bp, Homo sapiens
gcaggagccacttcagggatgc

SEQ ID NO: 7671097 - DNA, 22 bp, Homo sapiens
gcaggagccaggccgagctggt

SEQ ID NO: 7671098 - DNA, 22 bp, Homo sapiens
gcaggagccaggccgagctggt

SEQ ID NO: 7671099 - DNA, 22 bp, Homo sapiens
gcaggagccaggccgagctggt

SEQ ID NO: 7671100 - DNA, 22 bp, Homo sapiens
gcaggagccaggccgagctggt

SEQ ID NO: 7671101 - DNA, 22 bp, Homo sapiens
gcaggagccaggccgagctggt

SEQ ID NO: 7671102 - DNA, 22 bp, Homo sapiens
gcaggagccagggattccagga

SEQ ID NO: 7671103 - DNA, 22 bp, Homo sapiens
gcaggagccagggattccagga

SEQ ID NO: 7671104 - DNA, 22 bp, Homo sapiens
gcaggagccagggattccagga

SEQ ID NO: 7671105 - DNA, 22 bp, Homo sapiens
gcaggagccctggcatgttctt

SEQ ID NO: 7671106 - DNA, 22 bp, Homo sapiens
gcaggagccctggcatgttctt

SEQ ID NO: 7671107 - DNA, 19 bp, Homo sapiens
gcaggcacagccctgggtg

SEQ ID NO: 7671108 - DNA, 19 bp, Homo sapiens
gcaggcacagccctgggtg

SEQ ID NO: 7671109 - DNA, 19 bp, Homo sapiens
gcaggcacagccctgggtg

SEQ ID NO: 7671110 - DNA, 22 bp, Homo sapiens
gcaggcacatgggcgggtctgg

SEQ ID NO: 7671111 - DNA, 22 bp, Homo sapiens
gcaggcacatgggcgggtctgg

SEQ ID NO: 7671112 - DNA, 22 bp, Homo sapiens
gcaggcaccacggctcaggtct

SEQ ID NO: 7671113 - DNA, 22 bp, Homo sapiens
gcaggcaccacggctcaggtct

SEQ ID NO: 7671114 - DNA, 22 bp, Homo sapiens
gcaggagttagggtaaaaatga

SEQ ID NO: 7671115 - DNA, 22 bp, Homo sapiens
gcaggagttcaattgcccatga

SEQ ID NO: 7671116 - DNA, 23 bp, Homo sapiens
gcaggagttcctggactccagga

SEQ ID NO: 7671117 - DNA, 23 bp, Homo sapiens
gcaggagttcctggactccagga

SEQ ID NO: 7671118 - DNA, 22 bp, Homo sapiens
gcaggcaattttggaaggtcag

SEQ ID NO: 7671119 - DNA, 19 bp, Homo sapiens
gcaggcacagccctgggtg

SEQ ID NO: 7671120 - DNA, 23 bp, Homo sapiens
gcaggagttcctggactccagga

SEQ ID NO: 7671121 - DNA, 22 bp, Homo sapiens
gcaggcaccgcggcggcaggtt

SEQ ID NO: 7671122 - DNA, 22 bp, Homo sapiens
gcaggcaccgcggcggcaggtt

SEQ ID NO: 7671123 - DNA, 22 bp, Homo sapiens
gcaggcaccgcggcggcaggtt

SEQ ID NO: 7671124 - DNA, 22 bp, Homo sapiens
gcaggcaccacggctcaggtct

SEQ ID NO: 7671125 - DNA, 22 bp, Homo sapiens
gcaggcaccacggctcaggtct

SEQ ID NO: 7671126 - DNA, 22 bp, Homo sapiens
gcaggcaccgcggcggcaggtt

SEQ ID NO: 7671127 - DNA, 22 bp, Homo sapiens
gcaggcacctcgtggagtggaa

SEQ ID NO: 7671128 - DNA, 22 bp, Homo sapiens
gcaggcacctcgtggagtggaa

SEQ ID NO: 7671129 - DNA, 22 bp, Homo sapiens
gcaggcacctcgtggagtggaa

SEQ ID NO: 7671130 - DNA, 22 bp, Homo sapiens
gcaggcactcctaggaccatca

SEQ ID NO: 7671131 - DNA, 22 bp, Homo sapiens
gcaggcaccgggttgctcccct

SEQ ID NO: 7671132 - DNA, 22 bp, Homo sapiens
gcaggcaccgggttgctcccct

SEQ ID NO: 7671133 - DNA, 22 bp, Homo sapiens
gcaggcaccgcggcggcaggtt

SEQ ID NO: 7671134 - DNA, 22 bp, Homo sapiens
gcagctgacatctggctgggcc

SEQ ID NO: 7671135 - DNA, 22 bp, Homo sapiens
gcagctgacatctggctgggcc

SEQ ID NO: 7671136 - DNA, 22 bp, Homo sapiens
gcagctgagagaagaacagggc

SEQ ID NO: 7671137 - DNA, 22 bp, Homo sapiens
gcagctgagagaagaacagggc

SEQ ID NO: 7671138 - DNA, 22 bp, Homo sapiens
gcagctgagcgtgaggaagagt

SEQ ID NO: 7671139 - DNA, 22 bp, Homo sapiens
gcagctgagagaagaacagggc

SEQ ID NO: 7671140 - DNA, 22 bp, Homo sapiens
gcagctgagagaagaacagggc

SEQ ID NO: 7671141 - DNA, 22 bp, Homo sapiens
gcagctgagagaagaacagggc

SEQ ID NO: 7671142 - DNA, 22 bp, Homo sapiens
gcaggacaggcgttggtccagt

SEQ ID NO: 7671143 - DNA, 22 bp, Homo sapiens
gcaggacagcaggatgcttaga

SEQ ID NO: 7671144 - DNA, 22 bp, Homo sapiens
gcaggacagcaggatgcttaga

SEQ ID NO: 7671145 - DNA, 22 bp, Homo sapiens
gcaggacagcaggatgcttaga

SEQ ID NO: 7671146 - DNA, 22 bp, Homo sapiens
gcaggacagcaggatgcttaga

SEQ ID NO: 7671147 - DNA, 22 bp, Homo sapiens
gcaggacagacccaagcagtct

SEQ ID NO: 7671148 - DNA, 22 bp, Homo sapiens
gcaggacagacccaagcagtct

SEQ ID NO: 7671149 - DNA, 22 bp, Homo sapiens
gcagctgatggaagtcctattg

SEQ ID NO: 7671150 - DNA, 22 bp, Homo sapiens
gcagctgagcgtgaggaagagt

SEQ ID NO: 7671151 - DNA, 22 bp, Homo sapiens
gcaggacaggcgttggtccagt

SEQ ID NO: 7671152 - DNA, 22 bp, Homo sapiens
gcaggacaggcgttggtccagt

SEQ ID NO: 7671153 - DNA, 22 bp, Homo sapiens
gcaggacaggcgttggtccagt

SEQ ID NO: 7671154 - DNA, 22 bp, Homo sapiens
gcaggacaggcgttggtccagt

SEQ ID NO: 7671155 - DNA, 22 bp, Homo sapiens
gcaggacaggcgttggtccagt

SEQ ID NO: 7671156 - DNA, 22 bp, Homo sapiens
gcaggacaggcgttggtccagt

SEQ ID NO: 7671157 - DNA, 22 bp, Homo sapiens
gcaggacattcagtgaatgggc

SEQ ID NO: 7671158 - DNA, 22 bp, Homo sapiens
gcaggacattcagtgaatgggc

SEQ ID NO: 7671159 - DNA, 22 bp, Homo sapiens
gcaggacattcagtgaatgggc

SEQ ID NO: 7671160 - DNA, 22 bp, Homo sapiens
gcaggacattcagtgaatgggc

SEQ ID NO: 7671161 - DNA, 22 bp, Homo sapiens
gcaggacattcagtgaatgggc

SEQ ID NO: 7671162 - DNA, 22 bp, Homo sapiens
gcaggaccaggcacgagggcca

SEQ ID NO: 7671163 - DNA, 22 bp, Homo sapiens
gcaggactcaaatctgaaggca

SEQ ID NO: 7671164 - DNA, 22 bp, Homo sapiens
gcaggactcaaatctgaaggca

SEQ ID NO: 7671165 - DNA, 22 bp, Homo sapiens
gcaggactcaaatctgaaggca

SEQ ID NO: 7671166 - DNA, 22 bp, Homo sapiens
gcaggacctggcagatggggca

SEQ ID NO: 7671167 - DNA, 22 bp, Homo sapiens
gcaggacttgaatccaggcagt

SEQ ID NO: 7671168 - DNA, 22 bp, Homo sapiens
gcaggacttgaatccaggcagt

SEQ ID NO: 7671169 - DNA, 19 bp, Homo sapiens
gcaggactcccagctcctc

SEQ ID NO: 7671170 - DNA, 19 bp, Homo sapiens
gcaggactcccagctcctc

SEQ ID NO: 7671171 - DNA, 22 bp, Homo sapiens
gcaggacttgaatccaggcagt

SEQ ID NO: 7671172 - DNA, 22 bp, Homo sapiens
gcaggagacaactgtaaggaga

SEQ ID NO: 7671173 - DNA, 22 bp, Homo sapiens
gcaggagaacaaagcaagctgc

SEQ ID NO: 7671174 - DNA, 22 bp, Homo sapiens
gcaggagacaactgtaaggaga

SEQ ID NO: 7671175 - DNA, 22 bp, Homo sapiens
gcaggagacaactgtaaggaga

SEQ ID NO: 7671176 - DNA, 22 bp, Homo sapiens
gcaggagactggctgtggtagt

SEQ ID NO: 7671177 - DNA, 22 bp, Homo sapiens
gcaggagactggctgtggtagt

SEQ ID NO: 7671178 - DNA, 22 bp, Homo sapiens
gcaggagactggctgtggtagt

SEQ ID NO: 7671179 - DNA, 22 bp, Homo sapiens
gcaggagagccagcaggcttcc

SEQ ID NO: 7671180 - DNA, 22 bp, Homo sapiens
gcaggagagccagcaggcttcc

SEQ ID NO: 7671181 - DNA, 22 bp, Homo sapiens
gcaggagagccagcaggcttcc

SEQ ID NO: 7671182 - DNA, 22 bp, Homo sapiens
gcaggagagccagcaggcttcc

SEQ ID NO: 7671183 - DNA, 22 bp, Homo sapiens
gcaggagactggctgtggtagt

SEQ ID NO: 7671184 - DNA, 22 bp, Homo sapiens
gcaggagactggctgtggtagt

SEQ ID NO: 7671185 - DNA, 22 bp, Homo sapiens
gcaggagagccagcaggcttcc

SEQ ID NO: 7671186 - DNA, 22 bp, Homo sapiens
gcaggagagccagcaggcttcc

SEQ ID NO: 7671187 - DNA, 22 bp, Homo sapiens
gcaggagaacaaagcaagctgc

SEQ ID NO: 7671188 - DNA, 22 bp, Homo sapiens
gcaggagaacaaagcaagctgc

SEQ ID NO: 7671189 - DNA, 22 bp, Homo sapiens
gcaggagaacaaagcaagctgc

SEQ ID NO: 7671190 - DNA, 22 bp, Homo sapiens
gcaggagaacaaagcaagctgc

SEQ ID NO: 7671191 - DNA, 22 bp, Homo sapiens
gcaggagaacaaagcaagctgc

SEQ ID NO: 7671192 - DNA, 22 bp, Homo sapiens
gcaggagaacaaagcaagctgc

SEQ ID NO: 7671193 - DNA, 22 bp, Homo sapiens
gcaggagaaatgaagattgggt

SEQ ID NO: 7671194 - DNA, 22 bp, Homo sapiens
gcaggactttgtggatgatgga

SEQ ID NO: 7671195 - DNA, 22 bp, Homo sapiens
gcaggagaaatgaagattgggt

SEQ ID NO: 7671196 - DNA, 22 bp, Homo sapiens
gcaggagaaatgaagattgggt

SEQ ID NO: 7671197 - DNA, 22 bp, Homo sapiens
gcaggacctggcagatggggca

SEQ ID NO: 7671198 - DNA, 22 bp, Homo sapiens
gcaggagaaatgaagattgggt

SEQ ID NO: 7671199 - DNA, 22 bp, Homo sapiens
gcaggagaaatgaagattgggt

SEQ ID NO: 7671200 - DNA, 22 bp, Homo sapiens
gcaggagaaatgaagattgggt

SEQ ID NO: 7671201 - DNA, 22 bp, Homo sapiens
gcaggagaaatgaagattgggt

SEQ ID NO: 7671202 - DNA, 22 bp, Homo sapiens
gcaggagaaatgaagattgggt

SEQ ID NO: 7671203 - DNA, 22 bp, Homo sapiens
gcaggagaaatgaagattgggt

SEQ ID NO: 7671204 - DNA, 18 bp, Homo sapiens
gcagctgacactggagtt

SEQ ID NO: 7671205 - DNA, 18 bp, Homo sapiens
gcagctgacactggagtt

SEQ ID NO: 7671206 - DNA, 18 bp, Homo sapiens
gcagctgacactggagtt

SEQ ID NO: 7671207 - DNA, 22 bp, Homo sapiens
gcagctgacatctggctgggcc

SEQ ID NO: 7671208 - DNA, 18 bp, Homo sapiens
gcagctgacactggagtt

SEQ ID NO: 7671209 - DNA, 18 bp, Homo sapiens
gcagctgacactggagtt

SEQ ID NO: 7671210 - DNA, 22 bp, Homo sapiens
gcagctgaatgtccattgctgc

SEQ ID NO: 7671211 - DNA, 22 bp, Homo sapiens
gcagctgaagctgcagttccag

SEQ ID NO: 7671212 - DNA, 22 bp, Homo sapiens
gcagctgaatgtccattgctgc

SEQ ID NO: 7671213 - DNA, 22 bp, Homo sapiens
gcagctgaatgtccattgctgc

SEQ ID NO: 7671214 - DNA, 22 bp, Homo sapiens
gcagctgaaagggatctctaca

SEQ ID NO: 7671215 - DNA, 22 bp, Homo sapiens
gcagctgaaagggatctctaca

SEQ ID NO: 7671216 - DNA, 22 bp, Homo sapiens
gcagctgaaagggatctctaca

SEQ ID NO: 7671217 - DNA, 22 bp, Homo sapiens
gcagctgaaagggatctctaca

SEQ ID NO: 7671218 - DNA, 20 bp, Homo sapiens
gcagctgaaagtatgacacc

SEQ ID NO: 7671219 - DNA, 20 bp, Homo sapiens
gcagctgaaagtatgacacc

SEQ ID NO: 7671220 - DNA, 22 bp, Homo sapiens
gcagctgaagctgcagttccag

SEQ ID NO: 7671221 - DNA, 22 bp, Homo sapiens
gcagctgaagctgcagttccag

SEQ ID NO: 7671222 - DNA, 22 bp, Homo sapiens
gcagctcttcacttactccttt

SEQ ID NO: 7671223 - DNA, 22 bp, Homo sapiens
gcagctcttttcttaaagagat

SEQ ID NO: 7671224 - DNA, 22 bp, Homo sapiens
gcagctcttttcttaaagagat

SEQ ID NO: 7671225 - DNA, 22 bp, Homo sapiens
gcagctctgtctttcttaaagt

SEQ ID NO: 7671226 - DNA, 22 bp, Homo sapiens
gcagctctggggcaggcctgag

SEQ ID NO: 7671227 - DNA, 22 bp, Homo sapiens
gcagctctgagactctacagaa

SEQ ID NO: 7671228 - DNA, 22 bp, Homo sapiens
gcagctctggggcaggcctgag

SEQ ID NO: 7671229 - DNA, 22 bp, Homo sapiens
gcagctctggggcaggcctgag

SEQ ID NO: 7671230 - DNA, 22 bp, Homo sapiens
gcagctctggggcaggcctgag

SEQ ID NO: 7671231 - DNA, 22 bp, Homo sapiens
gcagctctgagactctacagaa

SEQ ID NO: 7671232 - DNA, 22 bp, Homo sapiens
gcagctctgagactctacagaa

SEQ ID NO: 7671233 - DNA, 22 bp, Homo sapiens
gcagctctgattggttcagcct

SEQ ID NO: 7671234 - DNA, 22 bp, Homo sapiens
gcagctctgattggttcagcct

SEQ ID NO: 7671235 - DNA, 22 bp, Homo sapiens
gcagctctgacaatgcctggaa

SEQ ID NO: 7671236 - DNA, 22 bp, Homo sapiens
gcagctctgacaatgcctggaa

SEQ ID NO: 7671237 - DNA, 22 bp, Homo sapiens
gcagctctgacaatgcctggaa

SEQ ID NO: 7671238 - DNA, 22 bp, Homo sapiens
gcagctctctggcctgccctgg

SEQ ID NO: 7671239 - DNA, 22 bp, Homo sapiens
gcagctctctggcctgccctgg

SEQ ID NO: 7671240 - DNA, 22 bp, Homo sapiens
gcagctctctggcctgccctgg

SEQ ID NO: 7671241 - DNA, 22 bp, Homo sapiens
gcagctctcctctgtgaggaac

SEQ ID NO: 7671242 - DNA, 22 bp, Homo sapiens
gcagctctcctctgtgaggaac

SEQ ID NO: 7671243 - DNA, 22 bp, Homo sapiens
gcagctctcctctgtgaggaac

SEQ ID NO: 7671244 - DNA, 22 bp, Homo sapiens
gcagctctatgtgatggtaaat

SEQ ID NO: 7671245 - DNA, 22 bp, Homo sapiens
gcagctcctttaggctgcaaag

SEQ ID NO: 7671246 - DNA, 22 bp, Homo sapiens
gcagctcgcacattagtcactc

SEQ ID NO: 7671247 - DNA, 22 bp, Homo sapiens
gcagctcctttaggctgcaaag

SEQ ID NO: 7671248 - DNA, 22 bp, Homo sapiens
gcagctagtccagttatgtggc

SEQ ID NO: 7671249 - DNA, 22 bp, Homo sapiens
gcagctagtccagttatgtggc

SEQ ID NO: 7671250 - DNA, 22 bp, Homo sapiens
gcagctattgtctcctgggccc

SEQ ID NO: 7671251 - DNA, 22 bp, Homo sapiens
gcagctattgtctcctgggccc

SEQ ID NO: 7671252 - DNA, 22 bp, Homo sapiens
gcagctattgtctcctgggccc

SEQ ID NO: 7671253 - DNA, 22 bp, Homo sapiens
gcagctattgtctcctgggccc

SEQ ID NO: 7671254 - DNA, 22 bp, Homo sapiens
gcagctattgtctcctgggccc

SEQ ID NO: 7671255 - DNA, 22 bp, Homo sapiens
gcagctattgtctcctgggccc

SEQ ID NO: 7671256 - DNA, 22 bp, Homo sapiens
gcagctattgtctcctgggccc

SEQ ID NO: 7671257 - DNA, 22 bp, Homo sapiens
gcagctcaaaggccacggacgg

SEQ ID NO: 7671258 - DNA, 22 bp, Homo sapiens
gcagctcaaaggccacggacgg

SEQ ID NO: 7671259 - DNA, 22 bp, Homo sapiens
gcagctcaagagaggtgctatg

SEQ ID NO: 7671260 - DNA, 22 bp, Homo sapiens
gcagctcccatcagggcacaga

SEQ ID NO: 7671261 - DNA, 22 bp, Homo sapiens
gcagctcccagcttgaaaggtc

SEQ ID NO: 7671262 - DNA, 22 bp, Homo sapiens
gcagctcccagcttgaaaggtc

SEQ ID NO: 7671263 - DNA, 22 bp, Homo sapiens
gcagctcccagcttgaaaggtc

SEQ ID NO: 7671264 - DNA, 22 bp, Homo sapiens
gcagctcagggagagggcacca

SEQ ID NO: 7671265 - DNA, 22 bp, Homo sapiens
gcagctcagtaaaagaggagca

SEQ ID NO: 7671266 - DNA, 22 bp, Homo sapiens
gcagctcagggagagggcacca

SEQ ID NO: 7671267 - DNA, 22 bp, Homo sapiens
gcagctcacagtctccgccatc

SEQ ID NO: 7671268 - DNA, 22 bp, Homo sapiens
gcagctcaaaggccacggacgg

SEQ ID NO: 7671269 - DNA, 22 bp, Homo sapiens
gcagctcaagagaggtgctatg

SEQ ID NO: 7671270 - DNA, 22 bp, Homo sapiens
gcagctcccatcagggcacaga

SEQ ID NO: 7671271 - DNA, 22 bp, Homo sapiens
gcagctcccatcagggcacaga

SEQ ID NO: 7671272 - DNA, 22 bp, Homo sapiens
gcagctcccatcagggcacaga

SEQ ID NO: 7671273 - DNA, 22 bp, Homo sapiens
gcagctcccttgaacttctcct

SEQ ID NO: 7671274 - DNA, 22 bp, Homo sapiens
gcagctcccttgaacttctcct

SEQ ID NO: 7671275 - DNA, 22 bp, Homo sapiens
gcagctccctggctgcaaatga

SEQ ID NO: 7671276 - DNA, 22 bp, Homo sapiens
gcagctccctggctgcaaatga

SEQ ID NO: 7671277 - DNA, 22 bp, Homo sapiens
gcagctcctcctgggctggaga

SEQ ID NO: 7671278 - DNA, 22 bp, Homo sapiens
gcagctcctcctgggctggaga

SEQ ID NO: 7671279 - DNA, 22 bp, Homo sapiens
gcagctcctcctgggctggaga

SEQ ID NO: 7671280 - DNA, 22 bp, Homo sapiens
gcagctcccttgaacttctcct

SEQ ID NO: 7671281 - DNA, 22 bp, Homo sapiens
gcagctcccttgaacttctcct

SEQ ID NO: 7671282 - DNA, 22 bp, Homo sapiens
gcagctcctttaggctgcaaag

SEQ ID NO: 7671283 - DNA, 22 bp, Homo sapiens
gcagctcctttaggctgcaaag

SEQ ID NO: 7671284 - DNA, 22 bp, Homo sapiens
gcagctccttcaatctcaccat

SEQ ID NO: 7671285 - DNA, 22 bp, Homo sapiens
gcagctccttcaatctcaccat

SEQ ID NO: 7671286 - DNA, 22 bp, Homo sapiens
gcagctcctggcacagtttttt

SEQ ID NO: 7671287 - DNA, 22 bp, Homo sapiens
gcagctccttcaatctcaccat

SEQ ID NO: 7671288 - DNA, 22 bp, Homo sapiens
gcagctcctggcacagtttttt

SEQ ID NO: 7671289 - DNA, 22 bp, Homo sapiens
gcagctcctggcacagtttttt

SEQ ID NO: 7671290 - DNA, 22 bp, Homo sapiens
gcagctcctcctgggctggaga

SEQ ID NO: 7671291 - DNA, 22 bp, Homo sapiens
gcagctcctcctgggctggaga

SEQ ID NO: 7671292 - DNA, 22 bp, Homo sapiens
gcagagctcaaggtgttcagct

SEQ ID NO: 7671293 - DNA, 22 bp, Homo sapiens
gcagagctatcttctggatttg

SEQ ID NO: 7671294 - DNA, 22 bp, Homo sapiens
gcagagcggtgatcaggcgcag

SEQ ID NO: 7671295 - DNA, 22 bp, Homo sapiens
gcagagctcatgcctgcacctc

SEQ ID NO: 7671296 - DNA, 16 bp, Homo sapiens
gcagagctcagggact

SEQ ID NO: 7671297 - DNA, 16 bp, Homo sapiens
gcagagctcagggact

SEQ ID NO: 7671298 - DNA, 22 bp, Homo sapiens
gcagagctcaaggtgttcagct

SEQ ID NO: 7671299 - DNA, 22 bp, Homo sapiens
gcagcctctgcagttcaggagg

SEQ ID NO: 7671300 - DNA, 22 bp, Homo sapiens
gcagcctctgatgatggccgta

SEQ ID NO: 7671301 - DNA, 22 bp, Homo sapiens
gcagcctctgatgatggccgta

SEQ ID NO: 7671302 - DNA, 22 bp, Homo sapiens
gcagagctccccaagacaccaa

SEQ ID NO: 7671303 - DNA, 22 bp, Homo sapiens
gcagagctcatgcctgcacctc

SEQ ID NO: 7671304 - DNA, 22 bp, Homo sapiens
gcagagctcatgcctgcacctc

SEQ ID NO: 7671305 - DNA, 22 bp, Homo sapiens
gcagagctcatgcctgcacctc

SEQ ID NO: 7671306 - DNA, 18 bp, Homo sapiens
gcagctagccaggggggc

SEQ ID NO: 7671307 - DNA, 18 bp, Homo sapiens
gcagctagccaggggggc

SEQ ID NO: 7671308 - DNA, 18 bp, Homo sapiens
gcagctagccaggggggc

SEQ ID NO: 7671309 - DNA, 18 bp, Homo sapiens
gcagctagccaggggggc

SEQ ID NO: 7671310 - DNA, 18 bp, Homo sapiens
gcagctagccaggggggc

SEQ ID NO: 7671311 - DNA, 20 bp, Homo sapiens
gcagctactctgtctcgctc

SEQ ID NO: 7671312 - DNA, 22 bp, Homo sapiens
gcagctaccacccaggaaggac

SEQ ID NO: 7671313 - DNA, 22 bp, Homo sapiens
gcagcgtggggctgagtcagct

SEQ ID NO: 7671314 - DNA, 22 bp, Homo sapiens
gcagcgtggggctgagtcagct

SEQ ID NO: 7671315 - DNA, 22 bp, Homo sapiens
gcagcgtggggctgagtcagct

SEQ ID NO: 7671316 - DNA, 22 bp, Homo sapiens
gcagcgtggggacaggagctca

SEQ ID NO: 7671317 - DNA, 22 bp, Homo sapiens
gcagcgtggggacaggagctca

SEQ ID NO: 7671318 - DNA, 22 bp, Homo sapiens
gcagcgtgatcccgcatttagg

SEQ ID NO: 7671319 - DNA, 22 bp, Homo sapiens
gcagcgtggggacaggagctca

SEQ ID NO: 7671320 - DNA, 22 bp, Homo sapiens
gcagcgtggggacaggagctca

SEQ ID NO: 7671321 - DNA, 17 bp, Homo sapiens
gcagcctcttggtagtg

SEQ ID NO: 7671322 - DNA, 22 bp, Homo sapiens
gcagcctctgcagttcaggagg

SEQ ID NO: 7671323 - DNA, 22 bp, Homo sapiens
gcagcctctgcagttcaggagg

SEQ ID NO: 7671324 - DNA, 22 bp, Homo sapiens
gcagagctccccaagacaccaa

SEQ ID NO: 7671325 - DNA, 22 bp, Homo sapiens
gcagcctctgcagttcaggagg

SEQ ID NO: 7671326 - DNA, 22 bp, Homo sapiens
gcagcctctgcagttcaggagg

SEQ ID NO: 7671327 - DNA, 21 bp, Homo sapiens
gcagagcctgaggttcttgag

SEQ ID NO: 7671328 - DNA, 22 bp, Homo sapiens
gcagagcctgggggtctgcgga

SEQ ID NO: 7671329 - DNA, 22 bp, Homo sapiens
gcagagcctgggggtctgcgga

SEQ ID NO: 7671330 - DNA, 22 bp, Homo sapiens
gcagagcctgtgtctgagcaaa

SEQ ID NO: 7671331 - DNA, 22 bp, Homo sapiens
gcagagcctgtgtctgagcaaa

SEQ ID NO: 7671332 - DNA, 22 bp, Homo sapiens
gcagagcctgtgtctgagcaaa

SEQ ID NO: 7671333 - DNA, 22 bp, Homo sapiens
gcagagccttgcgtcatgtgcc

SEQ ID NO: 7671334 - DNA, 22 bp, Homo sapiens
gcagagccttgcgtcatgtgcc

SEQ ID NO: 7671335 - DNA, 22 bp, Homo sapiens
gcagagcggtgatcaggcgcag

SEQ ID NO: 7671336 - DNA, 22 bp, Homo sapiens
gcagagccttgcgtcatgtgcc

SEQ ID NO: 7671337 - DNA, 22 bp, Homo sapiens
gcagagcggtgatcaggcgcag

SEQ ID NO: 7671338 - DNA, 22 bp, Homo sapiens
gcagagccttgcgtcatgtgcc

SEQ ID NO: 7671339 - DNA, 22 bp, Homo sapiens
gcagagcctgtgtctgagcaaa

SEQ ID NO: 7671340 - DNA, 22 bp, Homo sapiens
gcagagcctgtgtctgagcaaa

SEQ ID NO: 7671341 - DNA, 22 bp, Homo sapiens
gcagagccgtgaatggatttca

SEQ ID NO: 7671342 - DNA, 20 bp, Homo sapiens
gcagagcctcactgcaaggg

SEQ ID NO: 7671343 - DNA, 20 bp, Homo sapiens
gcagagcctcactgcaaggg

SEQ ID NO: 7671344 - DNA, 20 bp, Homo sapiens
gcagagcctcactgcaaggg

SEQ ID NO: 7671345 - DNA, 21 bp, Homo sapiens
gcagagcctgaggttcttgag

SEQ ID NO: 7671346 - DNA, 20 bp, Homo sapiens
gcagagcctcactgcaaggg

SEQ ID NO: 7671347 - DNA, 21 bp, Homo sapiens
gcagagccggggcgagaaggc

SEQ ID NO: 7671348 - DNA, 22 bp, Homo sapiens
gcagagccctgggggtatggtg

SEQ ID NO: 7671349 - DNA, 22 bp, Homo sapiens
gcagagcccctcaagccagcct

SEQ ID NO: 7671350 - DNA, 21 bp, Homo sapiens
gcagagccggggcgagaaggc

SEQ ID NO: 7671351 - DNA, 21 bp, Homo sapiens
gcagagccggggcgagaaggc

SEQ ID NO: 7671352 - DNA, 21 bp, Homo sapiens
gcagagccggggcgagaaggc

SEQ ID NO: 7671353 - DNA, 21 bp, Homo sapiens
gcagagccggggcgagaaggc

SEQ ID NO: 7671354 - DNA, 22 bp, Homo sapiens
gcaggcagaggtggaggagaca

SEQ ID NO: 7671355 - DNA, 22 bp, Homo sapiens
gcaggcagaggtggaggagaca

SEQ ID NO: 7671356 - DNA, 22 bp, Homo sapiens
gcaggcagaggtggaggagaca

SEQ ID NO: 7671357 - DNA, 22 bp, Homo sapiens
gcaggcagaggtggaggagaca

SEQ ID NO: 7671358 - DNA, 22 bp, Homo sapiens
gcaggcagaggtggaggagaca

SEQ ID NO: 7671359 - DNA, 22 bp, Homo sapiens
gcaggcagaggtggaggagaca

SEQ ID NO: 7671360 - DNA, 22 bp, Homo sapiens
gcaggcagaggtggaggagaca

SEQ ID NO: 7671361 - DNA, 22 bp, Homo sapiens
gcaggcagaggtggaggagaca

SEQ ID NO: 7671362 - DNA, 22 bp, Homo sapiens
gcaggcagagaggggtttccag

SEQ ID NO: 7671363 - DNA, 22 bp, Homo sapiens
gcaggcagaggtggaggagaca

SEQ ID NO: 7671364 - DNA, 22 bp, Homo sapiens
gcaggcagaggtggaggagaca

SEQ ID NO: 7671365 - DNA, 22 bp, Homo sapiens
gcaggcagaggtggaggagaca

SEQ ID NO: 7671366 - DNA, 22 bp, Homo sapiens
gcaggctgccctcttgtgttga

SEQ ID NO: 7671367 - DNA, 22 bp, Homo sapiens
gcaggctgccctcttgtgttga

SEQ ID NO: 7671368 - DNA, 22 bp, Homo sapiens
gcaggctgccctcttgtgttga

SEQ ID NO: 7671369 - DNA, 22 bp, Homo sapiens
gcaggctgccaccttctgagtt

SEQ ID NO: 7671370 - DNA, 22 bp, Homo sapiens
gcaggctgccaccttctgagtt

SEQ ID NO: 7671371 - DNA, 22 bp, Homo sapiens
gcaggcagaggtggaggagaca

SEQ ID NO: 7671372 - DNA, 22 bp, Homo sapiens
gcaggctgctgagatccttagg

SEQ ID NO: 7671373 - DNA, 22 bp, Homo sapiens
gcaggctgctgagatccttagg

SEQ ID NO: 7671374 - DNA, 22 bp, Homo sapiens
gcaggctgccctcttgtgttga

SEQ ID NO: 7671375 - DNA, 22 bp, Homo sapiens
gcaggctgctgagatccttagg

SEQ ID NO: 7671376 - DNA, 22 bp, Homo sapiens
gcaggctgctgagatccttagg

SEQ ID NO: 7671377 - DNA, 22 bp, Homo sapiens
gcaggctgctgagatccttagg

SEQ ID NO: 7671378 - DNA, 22 bp, Homo sapiens
gcaggctgctgagatccttagg

SEQ ID NO: 7671379 - DNA, 22 bp, Homo sapiens
gcaggctggaggctgttctggg

SEQ ID NO: 7671380 - DNA, 22 bp, Homo sapiens
gcaggctggaggctgttctggg

SEQ ID NO: 7671381 - DNA, 22 bp, Homo sapiens
gcaggctggaggctgttctggg

SEQ ID NO: 7671382 - DNA, 22 bp, Homo sapiens
gcaggctggaggctgttctggg

SEQ ID NO: 7671383 - DNA, 22 bp, Homo sapiens
gcaggctggaggctgttctggg

SEQ ID NO: 7671384 - DNA, 22 bp, Homo sapiens
gcaggctggaggctgttctggg

SEQ ID NO: 7671385 - DNA, 22 bp, Homo sapiens
gcaggctggaggctgttctggg

SEQ ID NO: 7671386 - DNA, 22 bp, Homo sapiens
gcaggctggaggctgttctggg

SEQ ID NO: 7671387 - DNA, 22 bp, Homo sapiens
gcaggcagagaggggtttccag

SEQ ID NO: 7671388 - DNA, 22 bp, Homo sapiens
gcaggcagagaggggtttccag

SEQ ID NO: 7671389 - DNA, 22 bp, Homo sapiens
gcaggcagagaaggaacattta

SEQ ID NO: 7671390 - DNA, 22 bp, Homo sapiens
gcaggcagagaggggtttccag

SEQ ID NO: 7671391 - DNA, 22 bp, Homo sapiens
gcaggcagagaaggaacattta

SEQ ID NO: 7671392 - DNA, 22 bp, Homo sapiens
gcaggcagaggtggaggagaca

SEQ ID NO: 7671393 - DNA, 22 bp, Homo sapiens
gcaggcagagaggggtttccag

SEQ ID NO: 7671394 - DNA, 22 bp, Homo sapiens
gcaggcagagaaggaacattta

SEQ ID NO: 7671395 - DNA, 22 bp, Homo sapiens
gcaggcagagaaggaacattta

SEQ ID NO: 7671396 - DNA, 22 bp, Homo sapiens
gcaggcagagaaggaacattta

SEQ ID NO: 7671397 - DNA, 22 bp, Homo sapiens
gcaggcagagaaggaacattta

SEQ ID NO: 7671398 - DNA, 22 bp, Homo sapiens
gcaggcagagaaggaacattta

SEQ ID NO: 7671399 - DNA, 14 bp, Homo sapiens
gcaggcagaccacc

SEQ ID NO: 7671400 - DNA, 17 bp, Homo sapiens
gcaggcactgctgcctg

SEQ ID NO: 7671401 - DNA, 14 bp, Homo sapiens
gcaggcagaccacc

SEQ ID NO: 7671402 - DNA, 21 bp, Homo sapiens
gcaggcactctagaggagctg

SEQ ID NO: 7671403 - DNA, 21 bp, Homo sapiens
gcaggcactctagaggagctg

SEQ ID NO: 7671404 - DNA, 17 bp, Homo sapiens
gcaggcactgctgcctg

SEQ ID NO: 7671405 - DNA, 17 bp, Homo sapiens
gcaggcactgctgcctg

SEQ ID NO: 7671406 - DNA, 17 bp, Homo sapiens
gcaggcactgctgcctg

SEQ ID NO: 7671407 - DNA, 17 bp, Homo sapiens
gcaggcactgctgcctg

SEQ ID NO: 7671408 - DNA, 17 bp, Homo sapiens
gcaggcactgctgcctg

SEQ ID NO: 7671409 - DNA, 21 bp, Homo sapiens
gcaggcactctagaggagctg

SEQ ID NO: 7671410 - DNA, 21 bp, Homo sapiens
gcaggcactctagaggagctg

SEQ ID NO: 7671411 - DNA, 21 bp, Homo sapiens
gcaggcactctagaggagctg

SEQ ID NO: 7671412 - DNA, 21 bp, Homo sapiens
gcaggcactctagaggagctg

SEQ ID NO: 7671413 - DNA, 22 bp, Homo sapiens
gcaggcactcctaggaccatca

SEQ ID NO: 7671414 - DNA, 22 bp, Homo sapiens
gcaggcactcctaggaccatca

SEQ ID NO: 7671415 - DNA, 22 bp, Homo sapiens
gcaggcactcctaggaccatca

SEQ ID NO: 7671416 - DNA, 22 bp, Homo sapiens
gcaggcactcctaggaccatca

SEQ ID NO: 7671417 - DNA, 22 bp, Homo sapiens
gcaggcactcctaggaccatca

SEQ ID NO: 7671418 - DNA, 22 bp, Homo sapiens
gcagggacgccagggacagcaa

SEQ ID NO: 7671419 - DNA, 22 bp, Homo sapiens
gcagggacgccagggacagcaa

SEQ ID NO: 7671420 - DNA, 22 bp, Homo sapiens
gcagggacgccagggacagcaa

SEQ ID NO: 7671421 - DNA, 22 bp, Homo sapiens
gcagggacgcagcactctccgt

SEQ ID NO: 7671422 - DNA, 22 bp, Homo sapiens
gcagggacgcagcactctccgt

SEQ ID NO: 7671423 - DNA, 22 bp, Homo sapiens
gcagggacgccagggacagcaa

SEQ ID NO: 7671424 - DNA, 22 bp, Homo sapiens
gcagggacgccagggacagcaa

SEQ ID NO: 7671425 - DNA, 22 bp, Homo sapiens
gcagggcaaacccaggtgttca

SEQ ID NO: 7671426 - DNA, 22 bp, Homo sapiens
gcagggaagacccggagcagcg

SEQ ID NO: 7671427 - DNA, 22 bp, Homo sapiens
gcagggaagacccggagcagcg

SEQ ID NO: 7671428 - DNA, 22 bp, Homo sapiens
gcagggaccttgcccaccctcc

SEQ ID NO: 7671429 - DNA, 22 bp, Homo sapiens
gcagggacgcagcactctccgt

SEQ ID NO: 7671430 - DNA, 22 bp, Homo sapiens
gcagggacgcagcactctccgt

SEQ ID NO: 7671431 - DNA, 22 bp, Homo sapiens
gcagggaccttgcccaccctcc

SEQ ID NO: 7671432 - DNA, 22 bp, Homo sapiens
gcagggaaacaggtgctaagga

SEQ ID NO: 7671433 - DNA, 22 bp, Homo sapiens
gcagggaaacaggtgctaagga

SEQ ID NO: 7671434 - DNA, 18 bp, Homo sapiens
gcaggcttttcctgggtc

SEQ ID NO: 7671435 - DNA, 22 bp, Homo sapiens
gcagggaagacccggagcagcg

SEQ ID NO: 7671436 - DNA, 22 bp, Homo sapiens
gcagggaaacaggtgctaagga

SEQ ID NO: 7671437 - DNA, 22 bp, Homo sapiens
gcaggctttgacttggggcagc

SEQ ID NO: 7671438 - DNA, 22 bp, Homo sapiens
gcaggctttgacttggggcaac

SEQ ID NO: 7671439 - DNA, 22 bp, Homo sapiens
gcaggcttgcccggcctccttc

SEQ ID NO: 7671440 - DNA, 22 bp, Homo sapiens
gcaggcttgggacgagctggag

SEQ ID NO: 7671441 - DNA, 22 bp, Homo sapiens
gcaggcttgggacgagctggag

SEQ ID NO: 7671442 - DNA, 22 bp, Homo sapiens
gcaggcttgggacgagctggag

SEQ ID NO: 7671443 - DNA, 22 bp, Homo sapiens
gcaggcttgggacgagctggag

SEQ ID NO: 7671444 - DNA, 22 bp, Homo sapiens
gcaggcttgggacgagctggag

SEQ ID NO: 7671445 - DNA, 22 bp, Homo sapiens
gcaggcttgggacgagctggag

SEQ ID NO: 7671446 - DNA, 19 bp, Homo sapiens
gcaggcttgggtctcccca

SEQ ID NO: 7671447 - DNA, 19 bp, Homo sapiens
gcaggcttgggtctcccca

SEQ ID NO: 7671448 - DNA, 21 bp, Homo sapiens
gcaggctggtcaaacctcagt

SEQ ID NO: 7671449 - DNA, 22 bp, Homo sapiens
gcaggctggggtagccccactt

SEQ ID NO: 7671450 - DNA, 21 bp, Homo sapiens
gcaggctggtcaaacctcagt

SEQ ID NO: 7671451 - DNA, 21 bp, Homo sapiens
gcaggctggtcaaacctcagt

SEQ ID NO: 7671452 - DNA, 21 bp, Homo sapiens
gcaggctggtcaaacctcagt

SEQ ID NO: 7671453 - DNA, 21 bp, Homo sapiens
gcaggctggtcaaacctcagt

SEQ ID NO: 7671454 - DNA, 21 bp, Homo sapiens
gcaggctggtcaaacctcagt

SEQ ID NO: 7671455 - DNA, 22 bp, Homo sapiens
gcaggctggggtagccccactt

SEQ ID NO: 7671456 - DNA, 22 bp, Homo sapiens
gcaggctggggtagccccactt

SEQ ID NO: 7671457 - DNA, 22 bp, Homo sapiens
gcaggctggggtagccccactt

SEQ ID NO: 7671458 - DNA, 22 bp, Homo sapiens
gcaggctggggtagccccactt

SEQ ID NO: 7671459 - DNA, 22 bp, Homo sapiens
gcaggctggggtagccccactt

SEQ ID NO: 7671460 - DNA, 22 bp, Homo sapiens
gcaggctggggtagccccactt

SEQ ID NO: 7671461 - DNA, 22 bp, Homo sapiens
gcaggctggtctgaccatccct

SEQ ID NO: 7671462 - DNA, 22 bp, Homo sapiens
gcaggctggtctgaccatccct

SEQ ID NO: 7671463 - DNA, 22 bp, Homo sapiens
gcaggctggtctgaccatccct

SEQ ID NO: 7671464 - DNA, 22 bp, Homo sapiens
gcaggctgtggtatgttgggca

SEQ ID NO: 7671465 - DNA, 22 bp, Homo sapiens
gcaggctggtctgaccatccct

SEQ ID NO: 7671466 - DNA, 21 bp, Homo sapiens
gcaggctggtcaaacctcagt

SEQ ID NO: 7671467 - DNA, 21 bp, Homo sapiens
gcaggctggtcaaacctcagt

SEQ ID NO: 7671468 - DNA, 22 bp, Homo sapiens
gcaggctggtctgaccatccct

SEQ ID NO: 7671469 - DNA, 22 bp, Homo sapiens
gcaggctggtctgaccatccct

SEQ ID NO: 7671470 - DNA, 22 bp, Homo sapiens
gcaggcttatggggagacagag

SEQ ID NO: 7671471 - DNA, 22 bp, Homo sapiens
gcaggcttatggggagacagag

SEQ ID NO: 7671472 - DNA, 22 bp, Homo sapiens
gcaggcttcaagcacagctttt

SEQ ID NO: 7671473 - DNA, 22 bp, Homo sapiens
gcaggcttcaagcacagctttt

SEQ ID NO: 7671474 - DNA, 22 bp, Homo sapiens
gcaggcttatggggagacagag

SEQ ID NO: 7671475 - DNA, 22 bp, Homo sapiens
gcaggctgtggtatgttgggca

SEQ ID NO: 7671476 - DNA, 22 bp, Homo sapiens
gcaggcttgagagatcagatgg

SEQ ID NO: 7671477 - DNA, 22 bp, Homo sapiens
gcaggcttgcccggcctccttc

SEQ ID NO: 7671478 - DNA, 22 bp, Homo sapiens
gcaggcttcccccacacctacg

SEQ ID NO: 7671479 - DNA, 22 bp, Homo sapiens
gcaggcttcccccacacctacg

SEQ ID NO: 7671480 - DNA, 22 bp, Homo sapiens
gcagggcaaatgtggaaaggag

SEQ ID NO: 7671481 - DNA, 22 bp, Homo sapiens
gcagggcaaatgtggaaaggag

SEQ ID NO: 7671482 - DNA, 20 bp, Homo sapiens
gcagggcaagggatatgaaa

SEQ ID NO: 7671483 - DNA, 20 bp, Homo sapiens
gcagggcaagggatatgaaa

SEQ ID NO: 7671484 - DNA, 22 bp, Homo sapiens
gcagggcaaatgtggaaaggag

SEQ ID NO: 7671485 - DNA, 20 bp, Homo sapiens
gcagggcaagggatatgaaa

SEQ ID NO: 7671486 - DNA, 20 bp, Homo sapiens
gcagggcaagggatatgaaa

SEQ ID NO: 7671487 - DNA, 22 bp, Homo sapiens
gcagggcaaatgtggaaaggag

SEQ ID NO: 7671488 - DNA, 22 bp, Homo sapiens
gcagggcaaatgtggaaaggag

SEQ ID NO: 7671489 - DNA, 22 bp, Homo sapiens
gcagggcaaatgtggaaaggag

SEQ ID NO: 7671490 - DNA, 22 bp, Homo sapiens
gcagggcaaatgtggaaaggag

SEQ ID NO: 7671491 - DNA, 22 bp, Homo sapiens
gcagggcaaatgtggaaaggag

SEQ ID NO: 7671492 - DNA, 22 bp, Homo sapiens
gcagggcaaatgtggaaaggag

SEQ ID NO: 7671493 - DNA, 22 bp, Homo sapiens
gcagggcaaacccaggtgttca

SEQ ID NO: 7671494 - DNA, 22 bp, Homo sapiens
gcagggcaaatgtggaaaggag

SEQ ID NO: 7671495 - DNA, 22 bp, Homo sapiens
gcagggcaaatgtggaaaggag

SEQ ID NO: 7671496 - DNA, 22 bp, Homo sapiens
gcagggcacaaggacgcacagg

SEQ ID NO: 7671497 - DNA, 22 bp, Homo sapiens
gcagggcacaaggacgcacagg

SEQ ID NO: 7671498 - DNA, 22 bp, Homo sapiens
gcagggcacaaggacgcacagg

SEQ ID NO: 7671499 - DNA, 22 bp, Homo sapiens
gcagggcacagacagtgccaag

SEQ ID NO: 7671500 - DNA, 22 bp, Homo sapiens
gcagggcacacaagaatgataa

SEQ ID NO: 7671501 - DNA, 22 bp, Homo sapiens
gcagggcacacaagaatgataa

SEQ ID NO: 7671502 - DNA, 22 bp, Homo sapiens
gcagggcacacaagaatgataa

SEQ ID NO: 7671503 - DNA, 20 bp, Homo sapiens
gcagggcaagggatatgaaa

SEQ ID NO: 7671504 - DNA, 22 bp, Homo sapiens
gcagggcaatgatcccgagagg

SEQ ID NO: 7671505 - DNA, 22 bp, Homo sapiens
gcagggcaatgatcccgagagg

SEQ ID NO: 7671506 - DNA, 22 bp, Homo sapiens
gcagggcaatgatcccgagagg

SEQ ID NO: 7671507 - DNA, 22 bp, Homo sapiens
gcagggcacaaggacgcacagg

SEQ ID NO: 7671508 - DNA, 22 bp, Homo sapiens
gcagggcacaaggacgcacagg

SEQ ID NO: 7671509 - DNA, 22 bp, Homo sapiens
gcagggcacaaggacgcacagg

SEQ ID NO: 7671510 - DNA, 22 bp, Homo sapiens
gcagggcacaaggacgcacagg

SEQ ID NO: 7671511 - DNA, 22 bp, Homo sapiens
gcagggcacaaggacgcacagg

SEQ ID NO: 7671512 - DNA, 22 bp, Homo sapiens
gcagggcacagacagtgccaag

SEQ ID NO: 7671513 - DNA, 22 bp, Homo sapiens
gcagggcacagacagtgccaag

SEQ ID NO: 7671514 - DNA, 22 bp, Homo sapiens
gcagggcacagacagtgccaag

SEQ ID NO: 7671515 - DNA, 22 bp, Homo sapiens
gcagggcacagacagtgccaag

SEQ ID NO: 7671516 - DNA, 22 bp, Homo sapiens
gcagggcacagacagtgccaag

SEQ ID NO: 7671517 - DNA, 22 bp, Homo sapiens
gcagggcacagacagtgccaag

SEQ ID NO: 7671518 - DNA, 22 bp, Homo sapiens
gcagggcacagacagtgccaag

SEQ ID NO: 7671519 - DNA, 22 bp, Homo sapiens
gcagggcacagacagtgccaag

SEQ ID NO: 7671520 - DNA, 22 bp, Homo sapiens
gcagggcagaaggtgctgagga

SEQ ID NO: 7671521 - DNA, 22 bp, Homo sapiens
gcagggcagaaggtgctgagga

SEQ ID NO: 7671522 - DNA, 22 bp, Homo sapiens
gcagggcagaaggtgctgagga

SEQ ID NO: 7671523 - DNA, 22 bp, Homo sapiens
gcagggcagaaggtgctgagga

SEQ ID NO: 7671524 - DNA, 22 bp, Homo sapiens
gcagggcagaaggtgctgagga

SEQ ID NO: 7671525 - DNA, 22 bp, Homo sapiens
gcagggcagaaggtgctgagga

SEQ ID NO: 7671526 - DNA, 22 bp, Homo sapiens
gcagggcagaaggtgctgagga

SEQ ID NO: 7671527 - DNA, 22 bp, Homo sapiens
gcagggcagaaggtgctgagga

SEQ ID NO: 7671528 - DNA, 22 bp, Homo sapiens
gcagggcacagacagtgccaag

SEQ ID NO: 7671529 - DNA, 22 bp, Homo sapiens
gcagggcagaaggtgctgagga

SEQ ID NO: 7671530 - DNA, 22 bp, Homo sapiens
gcagggcagaaggtgctgagga

SEQ ID NO: 7671531 - DNA, 22 bp, Homo sapiens
gcagggcagacctccagcctat

SEQ ID NO: 7671532 - DNA, 22 bp, Homo sapiens
gcagggcagacctccagcctat

SEQ ID NO: 7671533 - DNA, 22 bp, Homo sapiens
gcagggcagacctccagcctat

SEQ ID NO: 7671534 - DNA, 22 bp, Homo sapiens
gcagggcagagggagaatctct

SEQ ID NO: 7671535 - DNA, 22 bp, Homo sapiens
gcagggcagagggagaatctct

SEQ ID NO: 7671536 - DNA, 22 bp, Homo sapiens
gcagggcagagggagaatctct

SEQ ID NO: 7671537 - DNA, 22 bp, Homo sapiens
gcagggcagagggagaatctct

SEQ ID NO: 7671538 - DNA, 22 bp, Homo sapiens
gcagggcagacctccagcctat

SEQ ID NO: 7671539 - DNA, 22 bp, Homo sapiens
gcagggcagacctccagcctat

SEQ ID NO: 7671540 - DNA, 22 bp, Homo sapiens
gcagggcagacctccagcctat

SEQ ID NO: 7671541 - DNA, 22 bp, Homo sapiens
gcagggcagacctccagcctat

SEQ ID NO: 7671542 - DNA, 22 bp, Homo sapiens
gcagggcagacctccagcctat

SEQ ID NO: 7671543 - DNA, 22 bp, Homo sapiens
gcagggcagaaggtgctgagga

SEQ ID NO: 7671544 - DNA, 22 bp, Homo sapiens
gcagggcagacctccagcctat

SEQ ID NO: 7671545 - DNA, 22 bp, Homo sapiens
gcagggcagaaggtgctgagga

SEQ ID NO: 7671546 - DNA, 22 bp, Homo sapiens
gcagggcagaaggtgctgagga

SEQ ID NO: 7671547 - DNA, 22 bp, Homo sapiens
gcagggggatggagttgaaatg

SEQ ID NO: 7671548 - DNA, 22 bp, Homo sapiens
gcaggggctgctgggaactcgg

SEQ ID NO: 7671549 - DNA, 22 bp, Homo sapiens
gcagggggtcattcacgctggc

SEQ ID NO: 7671550 - DNA, 22 bp, Homo sapiens
gcagggggatggagttgaaatg

SEQ ID NO: 7671551 - DNA, 22 bp, Homo sapiens
gcagggggtcattcacgctggc

SEQ ID NO: 7671552 - DNA, 22 bp, Homo sapiens
gcagggggtcattcacgctggc

SEQ ID NO: 7671553 - DNA, 22 bp, Homo sapiens
gcagggggtcattcacgctggc

SEQ ID NO: 7671554 - DNA, 22 bp, Homo sapiens
gcagggggatggagttgaaatg

SEQ ID NO: 7671555 - DNA, 22 bp, Homo sapiens
gcagggggtcattcacgctggc

SEQ ID NO: 7671556 - DNA, 22 bp, Homo sapiens
gcagggtgacgttgcccacctc

SEQ ID NO: 7671557 - DNA, 22 bp, Homo sapiens
gcagggtgaaggtcacatagaa

SEQ ID NO: 7671558 - DNA, 22 bp, Homo sapiens
gcagggtgaaggtcacatagaa

SEQ ID NO: 7671559 - DNA, 22 bp, Homo sapiens
gcagggggtcattcacgctggc

SEQ ID NO: 7671560 - DNA, 22 bp, Homo sapiens
gcagggggtcattcacgctggc

SEQ ID NO: 7671561 - DNA, 22 bp, Homo sapiens
gcagggggtcattcacgctggc

SEQ ID NO: 7671562 - DNA, 22 bp, Homo sapiens
gcaggggctgctgggaactcgg

SEQ ID NO: 7671563 - DNA, 22 bp, Homo sapiens
gcaggggctgctgggaactcgg

SEQ ID NO: 7671564 - DNA, 22 bp, Homo sapiens
gcaggggctgagcaccagcggg

SEQ ID NO: 7671565 - DNA, 22 bp, Homo sapiens
gcaggggctgagcaccagcggg

SEQ ID NO: 7671566 - DNA, 22 bp, Homo sapiens
gcaggggctgagcaccagcggg

SEQ ID NO: 7671567 - DNA, 22 bp, Homo sapiens
gcaggggctgctgggaactcgg

SEQ ID NO: 7671568 - DNA, 22 bp, Homo sapiens
gcaggggctgctgggaactcgg

SEQ ID NO: 7671569 - DNA, 22 bp, Homo sapiens
gcaggggctgctgggaactcgg

SEQ ID NO: 7671570 - DNA, 22 bp, Homo sapiens
gcaggggctgagcaccagcggg

SEQ ID NO: 7671571 - DNA, 22 bp, Homo sapiens
gcaggggctgagcaccagcggg

SEQ ID NO: 7671572 - DNA, 22 bp, Homo sapiens
gcaggggctgagcaccagcggg

SEQ ID NO: 7671573 - DNA, 22 bp, Homo sapiens
gcaggggctactctgagcttcc

SEQ ID NO: 7671574 - DNA, 22 bp, Homo sapiens
gcaggggctgagcaccagcggg

SEQ ID NO: 7671575 - DNA, 22 bp, Homo sapiens
gcaggggctgagcaccagcggg

SEQ ID NO: 7671576 - DNA, 22 bp, Homo sapiens
gcaggggctgagcaccagcggg

SEQ ID NO: 7671577 - DNA, 22 bp, Homo sapiens
gcaggggctgagcaccagcggg

SEQ ID NO: 7671578 - DNA, 22 bp, Homo sapiens
gcaggggctgagcaccagcggg

SEQ ID NO: 7671579 - DNA, 22 bp, Homo sapiens
gcaggggctactctgagcttcc

SEQ ID NO: 7671580 - DNA, 22 bp, Homo sapiens
gcaggggctactctgagcttcc

SEQ ID NO: 7671581 - DNA, 22 bp, Homo sapiens
gcaggggctactctgagcttcc

SEQ ID NO: 7671582 - DNA, 22 bp, Homo sapiens
gcaggggctactctgagcttcc

SEQ ID NO: 7671583 - DNA, 22 bp, Homo sapiens
gcaggggctactctgagcttcc

SEQ ID NO: 7671584 - DNA, 22 bp, Homo sapiens
gcaggggctactctgagcttcc

SEQ ID NO: 7671585 - DNA, 22 bp, Homo sapiens
gcaggggctactctgagcttcc

SEQ ID NO: 7671586 - DNA, 22 bp, Homo sapiens
gcaggggctactctgagcttcc

SEQ ID NO: 7671587 - DNA, 22 bp, Homo sapiens
gcaggggctactctgagcttcc

SEQ ID NO: 7671588 - DNA, 22 bp, Homo sapiens
gcaggggcggctgggtttccag

SEQ ID NO: 7671589 - DNA, 22 bp, Homo sapiens
gcaggggcggctgggtttccag

SEQ ID NO: 7671590 - DNA, 22 bp, Homo sapiens
gcaggggcggctgggtttccag

SEQ ID NO: 7671591 - DNA, 22 bp, Homo sapiens
gcaggggcggctgggtttccag

SEQ ID NO: 7671592 - DNA, 22 bp, Homo sapiens
gcaggggctaaggacacagaga

SEQ ID NO: 7671593 - DNA, 22 bp, Homo sapiens
gcaggggctaaggacacagaga

SEQ ID NO: 7671594 - DNA, 22 bp, Homo sapiens
gcaggggctaaggacacagaga

SEQ ID NO: 7671595 - DNA, 22 bp, Homo sapiens
gcaggggctaaggacacagaga

SEQ ID NO: 7671596 - DNA, 22 bp, Homo sapiens
gcaggggcaggagatctcaggc

SEQ ID NO: 7671597 - DNA, 22 bp, Homo sapiens
gcaggggcaggagatctcaggc

SEQ ID NO: 7671598 - DNA, 22 bp, Homo sapiens
gcaggggcaggagatctcaggc

SEQ ID NO: 7671599 - DNA, 22 bp, Homo sapiens
gcaggggcaggagatctcaggc

SEQ ID NO: 7671600 - DNA, 22 bp, Homo sapiens
gcaggggcaggagatctcaggc

SEQ ID NO: 7671601 - DNA, 22 bp, Homo sapiens
gcaggggcaggagatctcaggc

SEQ ID NO: 7671602 - DNA, 22 bp, Homo sapiens
gcaggggcaggagatctcaggc

SEQ ID NO: 7671603 - DNA, 21 bp, Homo sapiens
gcaggggatagaaatggtctg

SEQ ID NO: 7671604 - DNA, 21 bp, Homo sapiens
gcaggggatagaaatggtctg

SEQ ID NO: 7671605 - DNA, 22 bp, Homo sapiens
gcagggcagccacaggccccct

SEQ ID NO: 7671606 - DNA, 22 bp, Homo sapiens
gcagggcagccacaggccccct

SEQ ID NO: 7671607 - DNA, 22 bp, Homo sapiens
gcagggcagccacaggccccct

SEQ ID NO: 7671608 - DNA, 22 bp, Homo sapiens
gcagggcagccacaggccccct

SEQ ID NO: 7671609 - DNA, 22 bp, Homo sapiens
gcagggcagccacaggccccct

SEQ ID NO: 7671610 - DNA, 22 bp, Homo sapiens
gcagggcagccacaggccccct

SEQ ID NO: 7671611 - DNA, 22 bp, Homo sapiens
gcagggcagagggagaatctct

SEQ ID NO: 7671612 - DNA, 22 bp, Homo sapiens
gatttattgtccctgtcctgct

SEQ ID NO: 7671613 - DNA, 22 bp, Homo sapiens
gatttattggtctttcattggt

SEQ ID NO: 7671614 - DNA, 22 bp, Homo sapiens
gatttattgtccctgtcctgct

SEQ ID NO: 7671615 - DNA, 22 bp, Homo sapiens
gatttattgtccctgtcctgct

SEQ ID NO: 7671616 - DNA, 22 bp, Homo sapiens
gatttattgtccctgtcctgct

SEQ ID NO: 7671617 - DNA, 22 bp, Homo sapiens
gatttattgtccctgtcctgct

SEQ ID NO: 7671618 - DNA, 22 bp, Homo sapiens
gatttattgtccctgtcctgct

SEQ ID NO: 7671619 - DNA, 22 bp, Homo sapiens
gatttattgtccctgtcctgct

SEQ ID NO: 7671620 - DNA, 22 bp, Homo sapiens
gatttattggtctttcattggt

SEQ ID NO: 7671621 - DNA, 22 bp, Homo sapiens
gatttattggtctttcattggt

SEQ ID NO: 7671622 - DNA, 22 bp, Homo sapiens
gatttattggtctttcattggt

SEQ ID NO: 7671623 - DNA, 22 bp, Homo sapiens
gatttattggtctttcattggt

SEQ ID NO: 7671624 - DNA, 22 bp, Homo sapiens
gatttattggtctttcattggt

SEQ ID NO: 7671625 - DNA, 22 bp, Homo sapiens
gatttattggtctttcattggt

SEQ ID NO: 7671626 - DNA, 22 bp, Homo sapiens
gatttattggtctttcattggt

SEQ ID NO: 7671627 - DNA, 22 bp, Homo sapiens
gatttattggtctttcattggt

SEQ ID NO: 7671628 - DNA, 22 bp, Homo sapiens
gatttatttttaatcagcaggg

SEQ ID NO: 7671629 - DNA, 22 bp, Homo sapiens
gatttattgtccctgtcctgct

SEQ ID NO: 7671630 - DNA, 22 bp, Homo sapiens
gatttatttttaatcagcaggg

SEQ ID NO: 7671631 - DNA, 22 bp, Homo sapiens
gatttattgtccctgtcctgct

SEQ ID NO: 7671632 - DNA, 22 bp, Homo sapiens
gatttatttttaatcagcaggg

SEQ ID NO: 7671633 - DNA, 22 bp, Homo sapiens
gatttatttttaatcagcaggg

SEQ ID NO: 7671634 - DNA, 22 bp, Homo sapiens
gatttatttttaatcagcaggg

SEQ ID NO: 7671635 - DNA, 22 bp, Homo sapiens
gatttatttttaatcagcaggg

SEQ ID NO: 7671636 - DNA, 22 bp, Homo sapiens
gatttcaaaggttctgcatgcc

SEQ ID NO: 7671637 - DNA, 20 bp, Homo sapiens
gatttcaaagcagagtggcc

SEQ ID NO: 7671638 - DNA, 22 bp, Homo sapiens
gatttcaacctaacagtatgac

SEQ ID NO: 7671639 - DNA, 22 bp, Homo sapiens
gatttcaaaagtagatccatca

SEQ ID NO: 7671640 - DNA, 22 bp, Homo sapiens
gatttatttttaatcagcaggg

SEQ ID NO: 7671641 - DNA, 22 bp, Homo sapiens
gatttatttttaatcagcaggg

SEQ ID NO: 7671642 - DNA, 21 bp, Homo sapiens
gatttataagccttaagccta

SEQ ID NO: 7671643 - DNA, 22 bp, Homo sapiens
gatttataaaggttgcactgga

SEQ ID NO: 7671644 - DNA, 22 bp, Homo sapiens
gatttataaaggttgcactgga

SEQ ID NO: 7671645 - DNA, 22 bp, Homo sapiens
gatttataaaggttgcactgga

SEQ ID NO: 7671646 - DNA, 22 bp, Homo sapiens
gatttatagtatgtgctttcag

SEQ ID NO: 7671647 - DNA, 21 bp, Homo sapiens
gatttataagccttaagccta

SEQ ID NO: 7671648 - DNA, 21 bp, Homo sapiens
gatttataagccttaagccta

SEQ ID NO: 7671649 - DNA, 22 bp, Homo sapiens
gatttataaaggttgcactgga

SEQ ID NO: 7671650 - DNA, 21 bp, Homo sapiens
gatttagtggctgttctacct

SEQ ID NO: 7671651 - DNA, 22 bp, Homo sapiens
gatttacaggttaggtcctgta

SEQ ID NO: 7671652 - DNA, 22 bp, Homo sapiens
gatttagagaatgttttgtaag

SEQ ID NO: 7671653 - DNA, 22 bp, Homo sapiens
gatttagagaatgttttgtaag

SEQ ID NO: 7671654 - DNA, 22 bp, Homo sapiens
gatttagagcaggaatgcatgg

SEQ ID NO: 7671655 - DNA, 22 bp, Homo sapiens
gatttagtggcccttggtacac

SEQ ID NO: 7671656 - DNA, 22 bp, Homo sapiens
gatttagtggcccttggtacac

SEQ ID NO: 7671657 - DNA, 22 bp, Homo sapiens
gatttagtggcccttggtacac

SEQ ID NO: 7671658 - DNA, 22 bp, Homo sapiens
gatttagtggcccttggtacac

SEQ ID NO: 7671659 - DNA, 22 bp, Homo sapiens
gatttacaggttaggtcctgta

SEQ ID NO: 7671660 - DNA, 22 bp, Homo sapiens
gatttacaggttaggtcctgta

SEQ ID NO: 7671661 - DNA, 22 bp, Homo sapiens
gatttacaggttaggtcctgta

SEQ ID NO: 7671662 - DNA, 22 bp, Homo sapiens
gatttacagctatacccaatgg

SEQ ID NO: 7671663 - DNA, 22 bp, Homo sapiens
gatttacagctatacccaatgg

SEQ ID NO: 7671664 - DNA, 22 bp, Homo sapiens
gatttacaggttaggtcctgta

SEQ ID NO: 7671665 - DNA, 22 bp, Homo sapiens
gatttacaggttaggtcctgta

SEQ ID NO: 7671666 - DNA, 22 bp, Homo sapiens
gatttacaggttaggtcctgta

SEQ ID NO: 7671667 - DNA, 22 bp, Homo sapiens
gatttacaggttaggtcctgta

SEQ ID NO: 7671668 - DNA, 22 bp, Homo sapiens
gatttacttgtgctgtttctgg

SEQ ID NO: 7671669 - DNA, 22 bp, Homo sapiens
gatttacttgtgctgtttctgg

SEQ ID NO: 7671670 - DNA, 22 bp, Homo sapiens
gatttacaggttaggtcctgta

SEQ ID NO: 7671671 - DNA, 22 bp, Homo sapiens
gatttacaggttaggtcctgta

SEQ ID NO: 7671672 - DNA, 22 bp, Homo sapiens
gatttacaggttaggtcctgta

SEQ ID NO: 7671673 - DNA, 22 bp, Homo sapiens
gatttacagctatacccaatgg

SEQ ID NO: 7671674 - DNA, 22 bp, Homo sapiens
gatttacagctatacccaatgg

SEQ ID NO: 7671675 - DNA, 22 bp, Homo sapiens
gatttacagctatacccaatgg

SEQ ID NO: 7671676 - DNA, 22 bp, Homo sapiens
gatttacagctatacccaatgg

SEQ ID NO: 7671677 - DNA, 22 bp, Homo sapiens
gatttacagatctaagggtcac

SEQ ID NO: 7671678 - DNA, 22 bp, Homo sapiens
gatttacagatctaagggtcac

SEQ ID NO: 7671679 - DNA, 22 bp, Homo sapiens
gatttacagatctaagggtcac

SEQ ID NO: 7671680 - DNA, 22 bp, Homo sapiens
gatttacagatctaagggtcac

SEQ ID NO: 7671681 - DNA, 22 bp, Homo sapiens
gatttacagctatacccaatgg

SEQ ID NO: 7671682 - DNA, 22 bp, Homo sapiens
gatttacagctatacccaatgg

SEQ ID NO: 7671683 - DNA, 22 bp, Homo sapiens
gatttacagctatacccaatgg

SEQ ID NO: 7671684 - DNA, 22 bp, Homo sapiens
gatttacagctatacccaatgg

SEQ ID NO: 7671685 - DNA, 22 bp, Homo sapiens
gatttacagctatacccaatgg

SEQ ID NO: 7671686 - DNA, 22 bp, Homo sapiens
gatttacagctatacccaatgg

SEQ ID NO: 7671687 - DNA, 22 bp, Homo sapiens
gattggggaaggttttactgac

SEQ ID NO: 7671688 - DNA, 22 bp, Homo sapiens
gattggggaaggttttactgac

SEQ ID NO: 7671689 - DNA, 22 bp, Homo sapiens
gattggggggcaggagaagtgt

SEQ ID NO: 7671690 - DNA, 22 bp, Homo sapiens
gattggggggcaggagaagtgt

SEQ ID NO: 7671691 - DNA, 22 bp, Homo sapiens
gattgggggtcaggctcaggtc

SEQ ID NO: 7671692 - DNA, 22 bp, Homo sapiens
gattgggggtcaggctcaggtc

SEQ ID NO: 7671693 - DNA, 22 bp, Homo sapiens
gattggtctactcaacagcaga

SEQ ID NO: 7671694 - DNA, 22 bp, Homo sapiens
gattggggggcaggagaagtgt

SEQ ID NO: 7671695 - DNA, 22 bp, Homo sapiens
gattgggggtcaggctcaggtc

SEQ ID NO: 7671696 - DNA, 22 bp, Homo sapiens
gattggagagtggaacatgctg

SEQ ID NO: 7671697 - DNA, 22 bp, Homo sapiens
gattgggccaaggggttagtag

SEQ ID NO: 7671698 - DNA, 22 bp, Homo sapiens
gattgtacttattgagctaaac

SEQ ID NO: 7671699 - DNA, 22 bp, Homo sapiens
gattgtacacatctggtgcctt

SEQ ID NO: 7671700 - DNA, 22 bp, Homo sapiens
gattgtacttattgagctaaac

SEQ ID NO: 7671701 - DNA, 22 bp, Homo sapiens
gattgtacttattgagctaaac

SEQ ID NO: 7671702 - DNA, 22 bp, Homo sapiens
gattgtaattttcaagaggtaa

SEQ ID NO: 7671703 - DNA, 22 bp, Homo sapiens
gattgtacacatctggtgcctt

SEQ ID NO: 7671704 - DNA, 22 bp, Homo sapiens
gattgtacacatctggtgcctt

SEQ ID NO: 7671705 - DNA, 22 bp, Homo sapiens
gattgtaattctactttccgct

SEQ ID NO: 7671706 - DNA, 22 bp, Homo sapiens
gattgtaattttcaagaggtaa

SEQ ID NO: 7671707 - DNA, 22 bp, Homo sapiens
gattgtaattttcaagaggtaa

SEQ ID NO: 7671708 - DNA, 22 bp, Homo sapiens
gattgtaaaacagatcattatc

SEQ ID NO: 7671709 - DNA, 22 bp, Homo sapiens
gattgtaattctactttccgct

SEQ ID NO: 7671710 - DNA, 22 bp, Homo sapiens
gattgtaaaacagatcattatc

SEQ ID NO: 7671711 - DNA, 22 bp, Homo sapiens
gattggttgaaagtagaatact

SEQ ID NO: 7671712 - DNA, 21 bp, Homo sapiens
gattggttcactcatgttgac

SEQ ID NO: 7671713 - DNA, 22 bp, Homo sapiens
gattgggggtcaggctcaggtc

SEQ ID NO: 7671714 - DNA, 22 bp, Homo sapiens
gattgtaaaacagatcattatc

SEQ ID NO: 7671715 - DNA, 22 bp, Homo sapiens
gattgagtctgaggatgctgca

SEQ ID NO: 7671716 - DNA, 22 bp, Homo sapiens
gattgagtctgaggatgctgca

SEQ ID NO: 7671717 - DNA, 22 bp, Homo sapiens
gattgaatcatatgaaattgtg

SEQ ID NO: 7671718 - DNA, 22 bp, Homo sapiens
gattgagtctgaggatgctgca

SEQ ID NO: 7671719 - DNA, 22 bp, Homo sapiens
gattgagtctgaggatgctgca

SEQ ID NO: 7671720 - DNA, 22 bp, Homo sapiens
gattgagtctgaggatgctgca

SEQ ID NO: 7671721 - DNA, 22 bp, Homo sapiens
gattgcaaatcattacaaagga

SEQ ID NO: 7671722 - DNA, 22 bp, Homo sapiens
gattgagtctgaggatgctgca

SEQ ID NO: 7671723 - DNA, 22 bp, Homo sapiens
gattgagtctgaggatgctgca

SEQ ID NO: 7671724 - DNA, 22 bp, Homo sapiens
gattgagtctgaggatgctgca

SEQ ID NO: 7671725 - DNA, 22 bp, Homo sapiens
gattgagtctgaggatgctgca

SEQ ID NO: 7671726 - DNA, 22 bp, Homo sapiens
gattgcttatacacaagatgaa

SEQ ID NO: 7671727 - DNA, 22 bp, Homo sapiens
gattgcttatacacaagatgaa

SEQ ID NO: 7671728 - DNA, 22 bp, Homo sapiens
gattgcttctggaaagcagttt

SEQ ID NO: 7671729 - DNA, 22 bp, Homo sapiens
gattgctgggtcccactcccag

SEQ ID NO: 7671730 - DNA, 22 bp, Homo sapiens
gattgctgtgcgccccaggtgt

SEQ ID NO: 7671731 - DNA, 23 bp, Homo sapiens
gattgctgtatgcaggagcattc

SEQ ID NO: 7671732 - DNA, 22 bp, Homo sapiens
gattgctgttcccagggggctg

SEQ ID NO: 7671733 - DNA, 22 bp, Homo sapiens
gattgcccagaatattctcatt

SEQ ID NO: 7671734 - DNA, 22 bp, Homo sapiens
gattgcgtctgtgtcaccttca

SEQ ID NO: 7671735 - DNA, 22 bp, Homo sapiens
gattgctaatgtggggatttgg

SEQ ID NO: 7671736 - DNA, 22 bp, Homo sapiens
gattgctgaagaaagtgagtga

SEQ ID NO: 7671737 - DNA, 22 bp, Homo sapiens
gattgctgccagcgtgtccgtg

SEQ ID NO: 7671738 - DNA, 22 bp, Homo sapiens
gattgctggggcaggctgtagc

SEQ ID NO: 7671739 - DNA, 22 bp, Homo sapiens
gatttaaagtagacctttgttt

SEQ ID NO: 7671740 - DNA, 22 bp, Homo sapiens
gatttacaaagctctctagtgt

SEQ ID NO: 7671741 - DNA, 22 bp, Homo sapiens
gatttacaaagctctctagtgt

SEQ ID NO: 7671742 - DNA, 22 bp, Homo sapiens
gatttaaagtagacctttgttt

SEQ ID NO: 7671743 - DNA, 22 bp, Homo sapiens
gatttacaaagctctctagtgt

SEQ ID NO: 7671744 - DNA, 22 bp, Homo sapiens
gatttacaaagctctctagtgt

SEQ ID NO: 7671745 - DNA, 22 bp, Homo sapiens
gatttacaaagctctctagtgt

SEQ ID NO: 7671746 - DNA, 22 bp, Homo sapiens
gatttacaaagctctctagtgt

SEQ ID NO: 7671747 - DNA, 22 bp, Homo sapiens
gatttacaaagctctctagtgt

SEQ ID NO: 7671748 - DNA, 22 bp, Homo sapiens
gatttacaaagctctctagtgt

SEQ ID NO: 7671749 - DNA, 22 bp, Homo sapiens
gatttacagatctaagggtcac

SEQ ID NO: 7671750 - DNA, 22 bp, Homo sapiens
gatttacagatctaagggtcac

SEQ ID NO: 7671751 - DNA, 22 bp, Homo sapiens
gatttacagatctaagggtcac

SEQ ID NO: 7671752 - DNA, 22 bp, Homo sapiens
gatttacagatctaagggtcac

SEQ ID NO: 7671753 - DNA, 22 bp, Homo sapiens
gatttacagatctaagggtcac

SEQ ID NO: 7671754 - DNA, 22 bp, Homo sapiens
gatttacagatctaagggtcac

SEQ ID NO: 7671755 - DNA, 22 bp, Homo sapiens
gatttacagatctaagggtcac

SEQ ID NO: 7671756 - DNA, 22 bp, Homo sapiens
gatttacaaagctctctagtgt

SEQ ID NO: 7671757 - DNA, 22 bp, Homo sapiens
gatttacaaagctctctagtgt

SEQ ID NO: 7671758 - DNA, 22 bp, Homo sapiens
gatttacaaagctctctagtgt

SEQ ID NO: 7671759 - DNA, 19 bp, Homo sapiens
gatttaaacgtggctctat

SEQ ID NO: 7671760 - DNA, 19 bp, Homo sapiens
gatttaaacgtggctctat

SEQ ID NO: 7671761 - DNA, 22 bp, Homo sapiens
gatttaaagtagacctttgttt

SEQ ID NO: 7671762 - DNA, 22 bp, Homo sapiens
gatttaaagtagacctttgttt

SEQ ID NO: 7671763 - DNA, 22 bp, Homo sapiens
gatttaaagtagacctttgttt

SEQ ID NO: 7671764 - DNA, 19 bp, Homo sapiens
gatttaaacgtggctctat

SEQ ID NO: 7671765 - DNA, 19 bp, Homo sapiens
gatttaaacgtggctctat

SEQ ID NO: 7671766 - DNA, 19 bp, Homo sapiens
gatttaaacgtggctctat

SEQ ID NO: 7671767 - DNA, 19 bp, Homo sapiens
gatttaaacgtggctctat

SEQ ID NO: 7671768 - DNA, 22 bp, Homo sapiens
gattgtctttattttatggcta

SEQ ID NO: 7671769 - DNA, 22 bp, Homo sapiens
gattgtctgtgatcatgagcaa

SEQ ID NO: 7671770 - DNA, 22 bp, Homo sapiens
gattgtggaagtcagtggttct

SEQ ID NO: 7671771 - DNA, 22 bp, Homo sapiens
gattgtggaagtcagtggttct

SEQ ID NO: 7671772 - DNA, 22 bp, Homo sapiens
gattgtggaagtcagtggttct

SEQ ID NO: 7671773 - DNA, 22 bp, Homo sapiens
gattgttgcctggctttgacct

SEQ ID NO: 7671774 - DNA, 22 bp, Homo sapiens
gattgtgttcataggcatgtta

SEQ ID NO: 7671775 - DNA, 22 bp, Homo sapiens
gattgtgtctcactgtgatgct

SEQ ID NO: 7671776 - DNA, 22 bp, Homo sapiens
gattgaaacataggcagtcgag

SEQ ID NO: 7671777 - DNA, 22 bp, Homo sapiens
gattgaaacataggcagtcgag

SEQ ID NO: 7671778 - DNA, 22 bp, Homo sapiens
gattctttggcctttattgaca

SEQ ID NO: 7671779 - DNA, 22 bp, Homo sapiens
gattctttggcctttattgaca

SEQ ID NO: 7671780 - DNA, 22 bp, Homo sapiens
gattctttggcctttattgaca

SEQ ID NO: 7671781 - DNA, 22 bp, Homo sapiens
gattctttacatctctgctgac

SEQ ID NO: 7671782 - DNA, 22 bp, Homo sapiens
gattctttactcagattttgtt

SEQ ID NO: 7671783 - DNA, 22 bp, Homo sapiens
gattctttactcagattttgtt

SEQ ID NO: 7671784 - DNA, 22 bp, Homo sapiens
gattctttgacagggtgttggg

SEQ ID NO: 7671785 - DNA, 22 bp, Homo sapiens
gattctttgacagggtgttggg

SEQ ID NO: 7671786 - DNA, 21 bp, Homo sapiens
gattgaaaccatggcagtgag

SEQ ID NO: 7671787 - DNA, 21 bp, Homo sapiens
gattgaaaccatggcagtgag

SEQ ID NO: 7671788 - DNA, 21 bp, Homo sapiens
gattgaaaccatggcagtgag

SEQ ID NO: 7671789 - DNA, 22 bp, Homo sapiens
gattgaaagactgtttgggaga

SEQ ID NO: 7671790 - DNA, 22 bp, Homo sapiens
gattgaaaggaaaaccagagtg

SEQ ID NO: 7671791 - DNA, 22 bp, Homo sapiens
gattgaaaggaaaaccagagtg

SEQ ID NO: 7671792 - DNA, 22 bp, Homo sapiens
gattgaaaggaaaaccagagtg

SEQ ID NO: 7671793 - DNA, 22 bp, Homo sapiens
gattgaaaggtctttaaattgg

SEQ ID NO: 7671794 - DNA, 22 bp, Homo sapiens
gattgaaaggtctttaaattgg

SEQ ID NO: 7671795 - DNA, 22 bp, Homo sapiens
gattgaaaggtctttaaattgg

SEQ ID NO: 7671796 - DNA, 22 bp, Homo sapiens
gattgaaatataaatatgtgtt

SEQ ID NO: 7671797 - DNA, 22 bp, Homo sapiens
gattgaaatataaatatgtgtt

SEQ ID NO: 7671798 - DNA, 22 bp, Homo sapiens
gattgaaaggtctttaaattgg

SEQ ID NO: 7671799 - DNA, 22 bp, Homo sapiens
gattcactcatattttacgttt

SEQ ID NO: 7671800 - DNA, 22 bp, Homo sapiens
gattcactcatattttacgttt

SEQ ID NO: 7671801 - DNA, 22 bp, Homo sapiens
gattcactcatattttacgttt

SEQ ID NO: 7671802 - DNA, 22 bp, Homo sapiens
gattctttacatctctgctgac

SEQ ID NO: 7671803 - DNA, 22 bp, Homo sapiens
gattcacctttatttcattggg

SEQ ID NO: 7671804 - DNA, 22 bp, Homo sapiens
gattcactcatattttacgttt

SEQ ID NO: 7671805 - DNA, 23 bp, Homo sapiens
gattcacagggtggtttatgggg

SEQ ID NO: 7671806 - DNA, 22 bp, Homo sapiens
gattcacagtttaggctgggct

SEQ ID NO: 7671807 - DNA, 22 bp, Homo sapiens
gattcactcatattttacgttt

SEQ ID NO: 7671808 - DNA, 22 bp, Homo sapiens
gattcacagtttaggctgggct

SEQ ID NO: 7671809 - DNA, 22 bp, Homo sapiens
gattcacctgaagcacttgtta

SEQ ID NO: 7671810 - DNA, 22 bp, Homo sapiens
gattcaatgttgcagatggaat

SEQ ID NO: 7671811 - DNA, 22 bp, Homo sapiens
gattcaatgttgcagatggaat

SEQ ID NO: 7671812 - DNA, 22 bp, Homo sapiens
gattcaagacctagctcagcca

SEQ ID NO: 7671813 - DNA, 23 bp, Homo sapiens
gattcacagggtggtttatgggg

SEQ ID NO: 7671814 - DNA, 23 bp, Homo sapiens
gattcacagggtggtttatgggg

SEQ ID NO: 7671815 - DNA, 22 bp, Homo sapiens
gattcacaactgccctgaaggg

SEQ ID NO: 7671816 - DNA, 22 bp, Homo sapiens
gattcacagaacttagtcaagc

SEQ ID NO: 7671817 - DNA, 22 bp, Homo sapiens
gattcacagaacttagtcaagc

SEQ ID NO: 7671818 - DNA, 22 bp, Homo sapiens
gattcaaagacagactcatttc

SEQ ID NO: 7671819 - DNA, 22 bp, Homo sapiens
gattcaaaagtttgagctccaa

SEQ ID NO: 7671820 - DNA, 22 bp, Homo sapiens
gattcaaaaataagctcctatt

SEQ ID NO: 7671821 - DNA, 22 bp, Homo sapiens
gattcaaagttaatgaagatgc

SEQ ID NO: 7671822 - DNA, 22 bp, Homo sapiens
gattcaaagttaatgaagatgc

SEQ ID NO: 7671823 - DNA, 22 bp, Homo sapiens
gattcaaagttaatgaagatgc

SEQ ID NO: 7671824 - DNA, 22 bp, Homo sapiens
gattatgttcgactttagaaat

SEQ ID NO: 7671825 - DNA, 22 bp, Homo sapiens
gattatggtagaaacaagaagt

SEQ ID NO: 7671826 - DNA, 22 bp, Homo sapiens
gattattttgtgcaataatcgg

SEQ ID NO: 7671827 - DNA, 22 bp, Homo sapiens
gattatggtaacaatgattaaa

SEQ ID NO: 7671828 - DNA, 22 bp, Homo sapiens
gattatggatggacagtggagc

SEQ ID NO: 7671829 - DNA, 22 bp, Homo sapiens
gattatggagaagaacaatgaa

SEQ ID NO: 7671830 - DNA, 22 bp, Homo sapiens
gattagtatccttattaagaga

SEQ ID NO: 7671831 - DNA, 22 bp, Homo sapiens
gattatataatggaagctcttg

SEQ ID NO: 7671832 - DNA, 22 bp, Homo sapiens
gattagttgattaagagtcaga

SEQ ID NO: 7671833 - DNA, 22 bp, Homo sapiens
gattatcactgggtgtcttgag

SEQ ID NO: 7671834 - DNA, 22 bp, Homo sapiens
gattatcactgggtgtcttgag

SEQ ID NO: 7671835 - DNA, 22 bp, Homo sapiens
gattatggagaaataattagaa

SEQ ID NO: 7671836 - DNA, 17 bp, Homo sapiens
gattagaaaacacatga

SEQ ID NO: 7671837 - DNA, 22 bp, Homo sapiens
gattagaaatgttaccatacag

SEQ ID NO: 7671838 - DNA, 22 bp, Homo sapiens
gattagaagaacttgttagcct

SEQ ID NO: 7671839 - DNA, 22 bp, Homo sapiens
gattagaatgggaagatacaag

SEQ ID NO: 7671840 - DNA, 22 bp, Homo sapiens
gattaggagggagaggcaagta

SEQ ID NO: 7671841 - DNA, 22 bp, Homo sapiens
gattagatgactaatgagctgt

SEQ ID NO: 7671842 - DNA, 22 bp, Homo sapiens
gattacattctccttgtattag

SEQ ID NO: 7671843 - DNA, 22 bp, Homo sapiens
gattacattctccttgtattag

SEQ ID NO: 7671844 - DNA, 22 bp, Homo sapiens
gattacattctccttgtattag

SEQ ID NO: 7671845 - DNA, 20 bp, Homo sapiens
gattacaaaatgaaatgcat

SEQ ID NO: 7671846 - DNA, 22 bp, Homo sapiens
gattaatagacacaaccaagct

SEQ ID NO: 7671847 - DNA, 22 bp, Homo sapiens
gattacaaaactcatctatgac

SEQ ID NO: 7671848 - DNA, 22 bp, Homo sapiens
gattaatagacacaaccaagct

SEQ ID NO: 7671849 - DNA, 22 bp, Homo sapiens
gattaatagacacaaccaagct

SEQ ID NO: 7671850 - DNA, 22 bp, Homo sapiens
gattaatagacacaaccaagct

SEQ ID NO: 7671851 - DNA, 22 bp, Homo sapiens
gattaagtaactgaacactttg

SEQ ID NO: 7671852 - DNA, 22 bp, Homo sapiens
gattaattcaggatcaggaaat

SEQ ID NO: 7671853 - DNA, 22 bp, Homo sapiens
gattaatagtacaggttcttag

SEQ ID NO: 7671854 - DNA, 22 bp, Homo sapiens
gattaatagacacaaccaagct

SEQ ID NO: 7671855 - DNA, 22 bp, Homo sapiens
gattaatagtacaggttcttag

SEQ ID NO: 7671856 - DNA, 22 bp, Homo sapiens
gattaatagtacaggttcttag

SEQ ID NO: 7671857 - DNA, 22 bp, Homo sapiens
gattaaaaataacccatgctga

SEQ ID NO: 7671858 - DNA, 22 bp, Homo sapiens
gattaaaaataacccatgctga

SEQ ID NO: 7671859 - DNA, 22 bp, Homo sapiens
gattaaaaataacccatgctga

SEQ ID NO: 7671860 - DNA, 22 bp, Homo sapiens
gattaaaaataacccatgctga

SEQ ID NO: 7671861 - DNA, 22 bp, Homo sapiens
gatgttttttaggatctcagca

SEQ ID NO: 7671862 - DNA, 22 bp, Homo sapiens
gatgttttttaggatctcagca

SEQ ID NO: 7671863 - DNA, 22 bp, Homo sapiens
gattaaaaataacccatgctga

SEQ ID NO: 7671864 - DNA, 22 bp, Homo sapiens
gattaaaaataacccatgctga

SEQ ID NO: 7671865 - DNA, 22 bp, Homo sapiens
gattaaaaataacccatgctga

SEQ ID NO: 7671866 - DNA, 22 bp, Homo sapiens
gattaaaaataacccatgctga

SEQ ID NO: 7671867 - DNA, 21 bp, Homo sapiens
gattaaatttaagctacatgc

SEQ ID NO: 7671868 - DNA, 21 bp, Homo sapiens
gattaaatttaagctacatgc

SEQ ID NO: 7671869 - DNA, 22 bp, Homo sapiens
gattaaaaataacccatgctga

SEQ ID NO: 7671870 - DNA, 22 bp, Homo sapiens
gattaaaaataacccatgctga

SEQ ID NO: 7671871 - DNA, 22 bp, Homo sapiens
gattaacaaatttcatatccaa

SEQ ID NO: 7671872 - DNA, 21 bp, Homo sapiens
gattaaatttaagctacatgc

SEQ ID NO: 7671873 - DNA, 21 bp, Homo sapiens
gattaaatttaagctacatgc

SEQ ID NO: 7671874 - DNA, 22 bp, Homo sapiens
gattaagagaagtttcttatcg

SEQ ID NO: 7671875 - DNA, 22 bp, Homo sapiens
gattaagattacatatttaagt

SEQ ID NO: 7671876 - DNA, 22 bp, Homo sapiens
gattaagagaagtttcttatcg

SEQ ID NO: 7671877 - DNA, 22 bp, Homo sapiens
gatgttgctcagcgttcttggg

SEQ ID NO: 7671878 - DNA, 22 bp, Homo sapiens
gatgttcttcgatgatctgttt

SEQ ID NO: 7671879 - DNA, 22 bp, Homo sapiens
gatgtttatatctaacttaagt

SEQ ID NO: 7671880 - DNA, 22 bp, Homo sapiens
gatgtttatatctaacttaagt

SEQ ID NO: 7671881 - DNA, 22 bp, Homo sapiens
gatgtttatgctgggacaggaa

SEQ ID NO: 7671882 - DNA, 22 bp, Homo sapiens
gatgtttcatgctagcatgtgt

SEQ ID NO: 7671883 - DNA, 22 bp, Homo sapiens
gatgtttatatctaacttaagt

SEQ ID NO: 7671884 - DNA, 21 bp, Homo sapiens
gatgttggaggctggggtctg

SEQ ID NO: 7671885 - DNA, 22 bp, Homo sapiens
gatgtttctgggaaggaaaagt

SEQ ID NO: 7671886 - DNA, 22 bp, Homo sapiens
gatgtttggctcaaacgagtgt

SEQ ID NO: 7671887 - DNA, 22 bp, Homo sapiens
gatgtttctgggaaggaaaagt

SEQ ID NO: 7671888 - DNA, 22 bp, Homo sapiens
gatgttttaggtccctgtagct

SEQ ID NO: 7671889 - DNA, 22 bp, Homo sapiens
gatgttttctggaaaatgaatg

SEQ ID NO: 7671890 - DNA, 22 bp, Homo sapiens
gatgttttctggaaaatgaatg

SEQ ID NO: 7671891 - DNA, 22 bp, Homo sapiens
gatgttttctggaaaatgaatg

SEQ ID NO: 7671892 - DNA, 22 bp, Homo sapiens
gatgttaaaggttggtaagtca

SEQ ID NO: 7671893 - DNA, 22 bp, Homo sapiens
gatgttaacttgttctgcctct

SEQ ID NO: 7671894 - DNA, 22 bp, Homo sapiens
gatgttaaatgtaaatagctgc

SEQ ID NO: 7671895 - DNA, 22 bp, Homo sapiens
gatgtgtttccaggatttgttt

SEQ ID NO: 7671896 - DNA, 22 bp, Homo sapiens
gatgtgtttccaggatttgttt

SEQ ID NO: 7671897 - DNA, 22 bp, Homo sapiens
gatgtgtttccaggatttgttt

SEQ ID NO: 7671898 - DNA, 22 bp, Homo sapiens
gatgtgtttccaggatttgttt

SEQ ID NO: 7671899 - DNA, 22 bp, Homo sapiens
gatgtgtttccaggatttgttt

SEQ ID NO: 7671900 - DNA, 22 bp, Homo sapiens
gatgttaagaaggaattgaagt

SEQ ID NO: 7671901 - DNA, 22 bp, Homo sapiens
gatgtgtctccgtttcaaggca

SEQ ID NO: 7671902 - DNA, 22 bp, Homo sapiens
gatgttcagactctaggtcaga

SEQ ID NO: 7671903 - DNA, 22 bp, Homo sapiens
gatgttcagtggttgaccataa

SEQ ID NO: 7671904 - DNA, 22 bp, Homo sapiens
gatgttcagtggttgaccataa

SEQ ID NO: 7671905 - DNA, 22 bp, Homo sapiens
gatgttcagtggttgaccataa

SEQ ID NO: 7671906 - DNA, 22 bp, Homo sapiens
gatgttcttataccattgtggg

SEQ ID NO: 7671907 - DNA, 22 bp, Homo sapiens
gatgttctctgattggtggtag

SEQ ID NO: 7671908 - DNA, 22 bp, Homo sapiens
gatgttctagaagtgtggtgtt

SEQ ID NO: 7671909 - DNA, 22 bp, Homo sapiens
gatgttctagaagtgtggtgtt

SEQ ID NO: 7671910 - DNA, 17 bp, Homo sapiens
gatggggctgacatcag

SEQ ID NO: 7671911 - DNA, 22 bp, Homo sapiens
gatggggctggctttgagggtt

SEQ ID NO: 7671912 - DNA, 22 bp, Homo sapiens
gatgggggccagggcctgcttt

SEQ ID NO: 7671913 - DNA, 22 bp, Homo sapiens
gatgggggccagggcctgcttt

SEQ ID NO: 7671914 - DNA, 22 bp, Homo sapiens
gatggggctggctttgagggtt

SEQ ID NO: 7671915 - DNA, 22 bp, Homo sapiens
gatgggggccagggcctgcttt

SEQ ID NO: 7671916 - DNA, 22 bp, Homo sapiens
gatgggggccagggcctgcttt

SEQ ID NO: 7671917 - DNA, 22 bp, Homo sapiens
gatgggggccagggcctgcttt

SEQ ID NO: 7671918 - DNA, 22 bp, Homo sapiens
gatggggtccttgacctggcca

SEQ ID NO: 7671919 - DNA, 22 bp, Homo sapiens
gatggggtccttgacctggcca

SEQ ID NO: 7671920 - DNA, 18 bp, Homo sapiens
gatggggtccaggcatag

SEQ ID NO: 7671921 - DNA, 18 bp, Homo sapiens
gatggggtccaggcatag

SEQ ID NO: 7671922 - DNA, 22 bp, Homo sapiens
gatggggatgagaagtgagcag

SEQ ID NO: 7671923 - DNA, 22 bp, Homo sapiens
gatggggatgagaagtgagcag

SEQ ID NO: 7671924 - DNA, 22 bp, Homo sapiens
gatggggatgagaagtgagcag

SEQ ID NO: 7671925 - DNA, 22 bp, Homo sapiens
gatggggatgagaagtgagcag

SEQ ID NO: 7671926 - DNA, 22 bp, Homo sapiens
gatgggcttcttccatgaagaa

SEQ ID NO: 7671927 - DNA, 22 bp, Homo sapiens
gatgggctgtctgagcgctgtg

SEQ ID NO: 7671928 - DNA, 22 bp, Homo sapiens
gatgggcttcttccatgaagaa

SEQ ID NO: 7671929 - DNA, 22 bp, Homo sapiens
gatggggatgagaagtgagcag

SEQ ID NO: 7671930 - DNA, 22 bp, Homo sapiens
gatggggatgagaagtgagcag

SEQ ID NO: 7671931 - DNA, 22 bp, Homo sapiens
gatgggcttcttccatgaagaa

SEQ ID NO: 7671932 - DNA, 22 bp, Homo sapiens
gatgggtactcgttggactgag

SEQ ID NO: 7671933 - DNA, 22 bp, Homo sapiens
gatgggtagaagtggaagaggt

SEQ ID NO: 7671934 - DNA, 22 bp, Homo sapiens
gatggggttttgccaggctggt

SEQ ID NO: 7671935 - DNA, 22 bp, Homo sapiens
gatggggttttgccaggctggt

SEQ ID NO: 7671936 - DNA, 22 bp, Homo sapiens
gatggggttttgccaggctggt

SEQ ID NO: 7671937 - DNA, 22 bp, Homo sapiens
gatgggtagaagtggaagaggt

SEQ ID NO: 7671938 - DNA, 22 bp, Homo sapiens
gatgggtgccccagacaagctg

SEQ ID NO: 7671939 - DNA, 22 bp, Homo sapiens
gatgggtgccccagacaagctg

SEQ ID NO: 7671940 - DNA, 22 bp, Homo sapiens
gatggtcaggtcatctcatgga

SEQ ID NO: 7671941 - DNA, 22 bp, Homo sapiens
gatggtcctcctgctgcctctc

SEQ ID NO: 7671942 - DNA, 22 bp, Homo sapiens
gatggtctttgtctctgataag

SEQ ID NO: 7671943 - DNA, 22 bp, Homo sapiens
gatgggtggtctcagacttgcc

SEQ ID NO: 7671944 - DNA, 22 bp, Homo sapiens
gatgggtgggttctgtgagagg

SEQ ID NO: 7671945 - DNA, 21 bp, Homo sapiens
gatggtagcctcatagaagta

SEQ ID NO: 7671946 - DNA, 22 bp, Homo sapiens
gatgggtggtctcagacttgcc

SEQ ID NO: 7671947 - DNA, 21 bp, Homo sapiens
gatggtagcctcatagaagta

SEQ ID NO: 7671948 - DNA, 22 bp, Homo sapiens
gatgtacaaagagaggatttca

SEQ ID NO: 7671949 - DNA, 22 bp, Homo sapiens
gatgtacaaagagaggatttca

SEQ ID NO: 7671950 - DNA, 22 bp, Homo sapiens
gatgtacaagattgtaggaatg

SEQ ID NO: 7671951 - DNA, 22 bp, Homo sapiens
gatgtaatagatatagattgct

SEQ ID NO: 7671952 - DNA, 18 bp, Homo sapiens
gatgtaaaatagtagctt

SEQ ID NO: 7671953 - DNA, 22 bp, Homo sapiens
gatgtaaaattcttggttgtca

SEQ ID NO: 7671954 - DNA, 22 bp, Homo sapiens
gatgtaaactgggacttcctag

SEQ ID NO: 7671955 - DNA, 22 bp, Homo sapiens
gatgtacaagtaaaatatgtgt

SEQ ID NO: 7671956 - DNA, 22 bp, Homo sapiens
gatgtacaagtaaaatatgtgt

SEQ ID NO: 7671957 - DNA, 22 bp, Homo sapiens
gatgtacaagtaaaatatgtgt

SEQ ID NO: 7671958 - DNA, 22 bp, Homo sapiens
gatgtacaagattgtaggaatg

SEQ ID NO: 7671959 - DNA, 22 bp, Homo sapiens
gatgtacaagattgtaggaatg

SEQ ID NO: 7671960 - DNA, 22 bp, Homo sapiens
gatgtacaatgtcactatgacc

SEQ ID NO: 7671961 - DNA, 22 bp, Homo sapiens
gatgtacaatgtcactatgacc

SEQ ID NO: 7671962 - DNA, 22 bp, Homo sapiens
gatgtacactcagaaaagtcat

SEQ ID NO: 7671963 - DNA, 22 bp, Homo sapiens
gatgtacactcagaaaagtcat

SEQ ID NO: 7671964 - DNA, 22 bp, Homo sapiens
gatggtgcaattatcgtgcatg

SEQ ID NO: 7671965 - DNA, 22 bp, Homo sapiens
gatggtgcaggtgaagtgctgg

SEQ ID NO: 7671966 - DNA, 22 bp, Homo sapiens
gatggtgcaggtgaagtgctgg

SEQ ID NO: 7671967 - DNA, 22 bp, Homo sapiens
gatggtgtcccaggctcaggct

SEQ ID NO: 7671968 - DNA, 22 bp, Homo sapiens
gatggtggcaagagccaagtct

SEQ ID NO: 7671969 - DNA, 22 bp, Homo sapiens
gatggtggagtaacattgccta

SEQ ID NO: 7671970 - DNA, 22 bp, Homo sapiens
gatggtggagtaacattgccta

SEQ ID NO: 7671971 - DNA, 22 bp, Homo sapiens
gatggtggcaagagccaagtct

SEQ ID NO: 7671972 - DNA, 22 bp, Homo sapiens
gatggtggcaagagccaagtct

SEQ ID NO: 7671973 - DNA, 22 bp, Homo sapiens
gatgtaaaacctatggagctga

SEQ ID NO: 7671974 - DNA, 22 bp, Homo sapiens
gatgtacaggagtttttcaagg

SEQ ID NO: 7671975 - DNA, 22 bp, Homo sapiens
gatgtacactcagaaaagtcat

SEQ ID NO: 7671976 - DNA, 21 bp, Homo sapiens
gatgtacatcaagcactttgc

SEQ ID NO: 7671977 - DNA, 21 bp, Homo sapiens
gatgtacatcaagcactttgc

SEQ ID NO: 7671978 - DNA, 22 bp, Homo sapiens
gatgtacaggagtttttcaagg

SEQ ID NO: 7671979 - DNA, 22 bp, Homo sapiens
gatgtacaggagtttttcaagg

SEQ ID NO: 7671980 - DNA, 22 bp, Homo sapiens
gatgtacatgcaagcacttaga

SEQ ID NO: 7671981 - DNA, 22 bp, Homo sapiens
gatgtacatgcaagcacttaga

SEQ ID NO: 7671982 - DNA, 22 bp, Homo sapiens
gatgtacatggattcctttcct

SEQ ID NO: 7671983 - DNA, 22 bp, Homo sapiens
gatgtacatggattcctttcct

SEQ ID NO: 7671984 - DNA, 22 bp, Homo sapiens
gatgtataacctggctatgtta

SEQ ID NO: 7671985 - DNA, 22 bp, Homo sapiens
gatgtagattcatatgtggtgt

SEQ ID NO: 7671986 - DNA, 22 bp, Homo sapiens
gatgtagacacttggaggctta

SEQ ID NO: 7671987 - DNA, 22 bp, Homo sapiens
gatgtagacacttggaggctta

SEQ ID NO: 7671988 - DNA, 22 bp, Homo sapiens
gatgtacttgccttatctatcc

SEQ ID NO: 7671989 - DNA, 22 bp, Homo sapiens
gatgtactttaaaatacttcag

SEQ ID NO: 7671990 - DNA, 22 bp, Homo sapiens
gatgtacaatgtcactatgacc

SEQ ID NO: 7671991 - DNA, 22 bp, Homo sapiens
gatgtataacctggctatgtta

SEQ ID NO: 7671992 - DNA, 22 bp, Homo sapiens
gatgtatagggccatgacacca

SEQ ID NO: 7671993 - DNA, 22 bp, Homo sapiens
gatgtatagctttaactgaccc

SEQ ID NO: 7671994 - DNA, 22 bp, Homo sapiens
gatgtatagggccatgacacca

SEQ ID NO: 7671995 - DNA, 18 bp, Homo sapiens
gatgtcaaggactggaca

SEQ ID NO: 7671996 - DNA, 17 bp, Homo sapiens
gatgtcctctggactac

SEQ ID NO: 7671997 - DNA, 22 bp, Homo sapiens
gatgtccatttcaaacctcatt

SEQ ID NO: 7671998 - DNA, 22 bp, Homo sapiens
gatgtccagcgtctggctgcct

SEQ ID NO: 7671999 - DNA, 22 bp, Homo sapiens
gatgtcatcaggctaagacact

SEQ ID NO: 7672000 - DNA, 18 bp, Homo sapiens
gatgtctcgaggagacta

SEQ ID NO: 7672001 - DNA, 22 bp, Homo sapiens
gatgtctctcacatagaaggta

SEQ ID NO: 7672002 - DNA, 19 bp, Homo sapiens
gatgtctcctttcattgag

SEQ ID NO: 7672003 - DNA, 22 bp, Homo sapiens
gatgtctcaagtatccaagccc

SEQ ID NO: 7672004 - DNA, 18 bp, Homo sapiens
gatgtctcgaggagacta

SEQ ID NO: 7672005 - DNA, 22 bp, Homo sapiens
gatgtcttactaactagccttt

SEQ ID NO: 7672006 - DNA, 22 bp, Homo sapiens
gatgtcttactaactagccttt

SEQ ID NO: 7672007 - DNA, 22 bp, Homo sapiens
gatgtcttaggtaacattctat

SEQ ID NO: 7672008 - DNA, 22 bp, Homo sapiens
gatgtcttaagcccagaagttc

SEQ ID NO: 7672009 - DNA, 22 bp, Homo sapiens
gatgtcttaagcccagaagttc

SEQ ID NO: 7672010 - DNA, 22 bp, Homo sapiens
gatgtctgtgagatcaaactaa

SEQ ID NO: 7672011 - DNA, 22 bp, Homo sapiens
gatgtctgtctgagccgctgga

SEQ ID NO: 7672012 - DNA, 22 bp, Homo sapiens
gatgtctgtctgagccgctgga

SEQ ID NO: 7672013 - DNA, 22 bp, Homo sapiens
gatgtctgccaaagaatcaagc

SEQ ID NO: 7672014 - DNA, 22 bp, Homo sapiens
gatgtctggctaccactcgcac

SEQ ID NO: 7672015 - DNA, 22 bp, Homo sapiens
gatgtctctcacatagaaggta

SEQ ID NO: 7672016 - DNA, 22 bp, Homo sapiens
gatgtctctgactaaggcagtg

SEQ ID NO: 7672017 - DNA, 22 bp, Homo sapiens
gatgtctctgactaaggcagtg

SEQ ID NO: 7672018 - DNA, 22 bp, Homo sapiens
gatgtctgggtcttcctggctt

SEQ ID NO: 7672019 - DNA, 22 bp, Homo sapiens
gatgtgtgcttttcgcagtgtc

SEQ ID NO: 7672020 - DNA, 22 bp, Homo sapiens
gatgtgtgtgccctgggcctgc

SEQ ID NO: 7672021 - DNA, 22 bp, Homo sapiens
gatgtgtgctgcatagtatatt

SEQ ID NO: 7672022 - DNA, 22 bp, Homo sapiens
gatgtgtccctttcaactcaga

SEQ ID NO: 7672023 - DNA, 20 bp, Homo sapiens
gatgtgtcctcagcagtggt

SEQ ID NO: 7672024 - DNA, 22 bp, Homo sapiens
gatgtgtccttttctccatcca

SEQ ID NO: 7672025 - DNA, 22 bp, Homo sapiens
gatggcccagtcttgggacagt

SEQ ID NO: 7672026 - DNA, 22 bp, Homo sapiens
gatggaggagatggcagggtgc

SEQ ID NO: 7672027 - DNA, 22 bp, Homo sapiens
gatggaggagatggcagggtgc

SEQ ID NO: 7672028 - DNA, 22 bp, Homo sapiens
gatggaggagatggcagggtgc

SEQ ID NO: 7672029 - DNA, 22 bp, Homo sapiens
gatggaggagatggcagggtgc

SEQ ID NO: 7672030 - DNA, 22 bp, Homo sapiens
gatggaggagatggcagggtgc

SEQ ID NO: 7672031 - DNA, 22 bp, Homo sapiens
gatggaggagatggcagggtgc

SEQ ID NO: 7672032 - DNA, 22 bp, Homo sapiens
gatggaggagatggcagggtgc

SEQ ID NO: 7672033 - DNA, 22 bp, Homo sapiens
gatggaggagatggcagggtgc

SEQ ID NO: 7672034 - DNA, 22 bp, Homo sapiens
gatggaggaaaagttggaatgc

SEQ ID NO: 7672035 - DNA, 22 bp, Homo sapiens
gatggaggaaaagttggaatgc

SEQ ID NO: 7672036 - DNA, 22 bp, Homo sapiens
gatggaggaaaagttggaatgc

SEQ ID NO: 7672037 - DNA, 22 bp, Homo sapiens
gatggaagaaaaatgcatgtct

SEQ ID NO: 7672038 - DNA, 22 bp, Homo sapiens
gatggaagaaaaatgcatgtct

SEQ ID NO: 7672039 - DNA, 22 bp, Homo sapiens
gatggaatgaatggcagataca

SEQ ID NO: 7672040 - DNA, 22 bp, Homo sapiens
gatggaatgtcacttctgtggt

SEQ ID NO: 7672041 - DNA, 22 bp, Homo sapiens
gatggacagcctggaaggaaag

SEQ ID NO: 7672042 - DNA, 22 bp, Homo sapiens
gatggacagcctggaaggaaag

SEQ ID NO: 7672043 - DNA, 22 bp, Homo sapiens
gatggacacctcctgaggttct

SEQ ID NO: 7672044 - DNA, 22 bp, Homo sapiens
gatggacacctcctgaggttct

SEQ ID NO: 7672045 - DNA, 22 bp, Homo sapiens
gatggctcaagagcttttgaga

SEQ ID NO: 7672046 - DNA, 22 bp, Homo sapiens
gatggctgcctcctgcggtcct

SEQ ID NO: 7672047 - DNA, 22 bp, Homo sapiens
gatggctgcctcctgcggtcct

SEQ ID NO: 7672048 - DNA, 22 bp, Homo sapiens
gatggctgcctcctgcggtcct

SEQ ID NO: 7672049 - DNA, 22 bp, Homo sapiens
gatggcggtcgtcgacggtcct

SEQ ID NO: 7672050 - DNA, 22 bp, Homo sapiens
gatggcggtggccacctccttg

SEQ ID NO: 7672051 - DNA, 22 bp, Homo sapiens
gatggcggtggccacctccttg

SEQ ID NO: 7672052 - DNA, 22 bp, Homo sapiens
gatggctgccttctccctgtgt

SEQ ID NO: 7672053 - DNA, 22 bp, Homo sapiens
gatggctgccttctccctgtgt

SEQ ID NO: 7672054 - DNA, 22 bp, Homo sapiens
gatggctggagccagtgctttg

SEQ ID NO: 7672055 - DNA, 22 bp, Homo sapiens
gatggctggctatatcagggga

SEQ ID NO: 7672056 - DNA, 22 bp, Homo sapiens
gatggctgtcttctccctgtgt

SEQ ID NO: 7672057 - DNA, 22 bp, Homo sapiens
gatggctgtcttctccctgtgt

SEQ ID NO: 7672058 - DNA, 22 bp, Homo sapiens
gatggcctcatggctgcaggcc

SEQ ID NO: 7672059 - DNA, 22 bp, Homo sapiens
gatggcctcagtgcccaaagga

SEQ ID NO: 7672060 - DNA, 22 bp, Homo sapiens
gatggcctcatggctgcaggcc

SEQ ID NO: 7672061 - DNA, 22 bp, Homo sapiens
gatggcccgctagctggcctct

SEQ ID NO: 7672062 - DNA, 18 bp, Homo sapiens
gatggccatttcaatgtt

SEQ ID NO: 7672063 - DNA, 22 bp, Homo sapiens
gatggcccgctagctggcctct

SEQ ID NO: 7672064 - DNA, 22 bp, Homo sapiens
gatgggcacggcagtctgagag

SEQ ID NO: 7672065 - DNA, 22 bp, Homo sapiens
gatgggaggaacctgggtccct

SEQ ID NO: 7672066 - DNA, 22 bp, Homo sapiens
gatgggcacggcagtctgagag

SEQ ID NO: 7672067 - DNA, 22 bp, Homo sapiens
gatgggaggaacctgggtccct

SEQ ID NO: 7672068 - DNA, 22 bp, Homo sapiens
gatgggaggaacctgggtccct

SEQ ID NO: 7672069 - DNA, 18 bp, Homo sapiens
gatgggagcaagagaaga

SEQ ID NO: 7672070 - DNA, 18 bp, Homo sapiens
gatgggagcaagagaaga

SEQ ID NO: 7672071 - DNA, 18 bp, Homo sapiens
gatgggagcaagagaaga

SEQ ID NO: 7672072 - DNA, 18 bp, Homo sapiens
gatgggagcaagagaaga

SEQ ID NO: 7672073 - DNA, 22 bp, Homo sapiens
gatgggctggggagaaagcatg

SEQ ID NO: 7672074 - DNA, 22 bp, Homo sapiens
gatgggcatcaaacatgacgtg

SEQ ID NO: 7672075 - DNA, 22 bp, Homo sapiens
gatgggcatcaaacatgacgtg

SEQ ID NO: 7672076 - DNA, 22 bp, Homo sapiens
gatgggcatcaaacatgacgtg

SEQ ID NO: 7672077 - DNA, 22 bp, Homo sapiens
gatgggcgtggcgcgtttggtg

SEQ ID NO: 7672078 - DNA, 22 bp, Homo sapiens
gatgggcacggcagtctgagag

SEQ ID NO: 7672079 - DNA, 22 bp, Homo sapiens
gatgggcacggcagtctgagag

SEQ ID NO: 7672080 - DNA, 22 bp, Homo sapiens
gatgggcagcacagctggccaa

SEQ ID NO: 7672081 - DNA, 22 bp, Homo sapiens
gatgggctgtctgagcgctgtg

SEQ ID NO: 7672082 - DNA, 22 bp, Homo sapiens
gatgggctgtctgagcgctgtg

SEQ ID NO: 7672083 - DNA, 22 bp, Homo sapiens
gatgggctgtctgagcgctgtg

SEQ ID NO: 7672084 - DNA, 22 bp, Homo sapiens
gatgggctggggagaaagcatg

SEQ ID NO: 7672085 - DNA, 22 bp, Homo sapiens
gatgggctgtctgagcgctgtg

SEQ ID NO: 7672086 - DNA, 18 bp, Homo sapiens
gatgggagcaagagaaga

SEQ ID NO: 7672087 - DNA, 18 bp, Homo sapiens
gatgggagcaagagaaga

SEQ ID NO: 7672088 - DNA, 20 bp, Homo sapiens
gatgggaatcggagctggta

SEQ ID NO: 7672089 - DNA, 20 bp, Homo sapiens
gatgggaatcggagctggta

SEQ ID NO: 7672090 - DNA, 20 bp, Homo sapiens
gatgggaatcggagctggta

SEQ ID NO: 7672091 - DNA, 22 bp, Homo sapiens
gatggctttgaggaatttgaat

SEQ ID NO: 7672092 - DNA, 22 bp, Homo sapiens
gatggctttgcctgctgtgagg

SEQ ID NO: 7672093 - DNA, 22 bp, Homo sapiens
gatggctttgcctgctgtgagg

SEQ ID NO: 7672094 - DNA, 20 bp, Homo sapiens
gatggctttagaagctggta

SEQ ID NO: 7672095 - DNA, 20 bp, Homo sapiens
gatggctttagaagctggta

SEQ ID NO: 7672096 - DNA, 22 bp, Homo sapiens
gatggctttgtgcaccatgatt

SEQ ID NO: 7672097 - DNA, 20 bp, Homo sapiens
gatgggaatcggagctggta

SEQ ID NO: 7672098 - DNA, 22 bp, Homo sapiens
gatggcttacagacagttagga

SEQ ID NO: 7672099 - DNA, 22 bp, Homo sapiens
gatggcttacagacagttagga

SEQ ID NO: 7672100 - DNA, 22 bp, Homo sapiens
gatggcttaagagtaaaaggca

SEQ ID NO: 7672101 - DNA, 22 bp, Homo sapiens
gatggcttaagagtaaaaggca

SEQ ID NO: 7672102 - DNA, 22 bp, Homo sapiens
gatggcttacagacagttagga

SEQ ID NO: 7672103 - DNA, 22 bp, Homo sapiens
gatggcttcacttacatggctg

SEQ ID NO: 7672104 - DNA, 22 bp, Homo sapiens
gatggcttcacttacatggctg

SEQ ID NO: 7672105 - DNA, 22 bp, Homo sapiens
gatggcttcagtctccttgggt

SEQ ID NO: 7672106 - DNA, 22 bp, Homo sapiens
gatggcttgttttctggctgaa

SEQ ID NO: 7672107 - DNA, 22 bp, Homo sapiens
gatggcttgcttagtgacagca

SEQ ID NO: 7672108 - DNA, 22 bp, Homo sapiens
gatggcttgcttagtgacagca

SEQ ID NO: 7672109 - DNA, 22 bp, Homo sapiens
gatggcttgcttagtgacagca

SEQ ID NO: 7672110 - DNA, 22 bp, Homo sapiens
gatggcttccttctcactgtgt

SEQ ID NO: 7672111 - DNA, 22 bp, Homo sapiens
gatggcttctctctagcttggt

SEQ ID NO: 7672112 - DNA, 22 bp, Homo sapiens
gatggcttctctctagcttggt

SEQ ID NO: 7672113 - DNA, 22 bp, Homo sapiens
gatggcttctgaatcagggcct

SEQ ID NO: 7672114 - DNA, 22 bp, Homo sapiens
gatggcttctgaatcagggcct

SEQ ID NO: 7672115 - DNA, 22 bp, Homo sapiens
gatgctggaagtgctgatcttg

SEQ ID NO: 7672116 - DNA, 22 bp, Homo sapiens
gatgctggcctggccatctggg

SEQ ID NO: 7672117 - DNA, 22 bp, Homo sapiens
gatgctgggaccacagagtgtt

SEQ ID NO: 7672118 - DNA, 22 bp, Homo sapiens
gatgctgggaccacagagtgtt

SEQ ID NO: 7672119 - DNA, 22 bp, Homo sapiens
gatgctgggaccacagagtgtt

SEQ ID NO: 7672120 - DNA, 22 bp, Homo sapiens
gatgctgggaccacagagtgtt

SEQ ID NO: 7672121 - DNA, 22 bp, Homo sapiens
gatgctgtagatgagaacattg

SEQ ID NO: 7672122 - DNA, 22 bp, Homo sapiens
gatgctgtaaaatgctaaacat

SEQ ID NO: 7672123 - DNA, 22 bp, Homo sapiens
gatgctggaagtgctgatcttg

SEQ ID NO: 7672124 - DNA, 22 bp, Homo sapiens
gatgctggaagtgctgatcttg

SEQ ID NO: 7672125 - DNA, 22 bp, Homo sapiens
gatgctggcctggccatctggg

SEQ ID NO: 7672126 - DNA, 22 bp, Homo sapiens
gatgctggcctggccatctggg

SEQ ID NO: 7672127 - DNA, 22 bp, Homo sapiens
gatgctgctcgggtgcctggga

SEQ ID NO: 7672128 - DNA, 22 bp, Homo sapiens
gatgctgctcgggtgcctggga

SEQ ID NO: 7672129 - DNA, 22 bp, Homo sapiens
gatgctgataattcatgagaag

SEQ ID NO: 7672130 - DNA, 22 bp, Homo sapiens
gatgcttaccgacttacagtgc

SEQ ID NO: 7672131 - DNA, 22 bp, Homo sapiens
gatgctttccaagaaatcctca

SEQ ID NO: 7672132 - DNA, 22 bp, Homo sapiens
gatgctttccaagaaatcctca

SEQ ID NO: 7672133 - DNA, 22 bp, Homo sapiens
gatgcttcctgttttaaatagg

SEQ ID NO: 7672134 - DNA, 22 bp, Homo sapiens
gatgctttccaagaaatcctca

SEQ ID NO: 7672135 - DNA, 22 bp, Homo sapiens
gatgctgtggtaagccccaccg

SEQ ID NO: 7672136 - DNA, 22 bp, Homo sapiens
gatgcttacatagcccaagtgt

SEQ ID NO: 7672137 - DNA, 22 bp, Homo sapiens
gatgcttaagatgttggtggca

SEQ ID NO: 7672138 - DNA, 22 bp, Homo sapiens
gatgctgtgctatgtctacaga

SEQ ID NO: 7672139 - DNA, 22 bp, Homo sapiens
gatgctgtggggttgaccctgg

SEQ ID NO: 7672140 - DNA, 18 bp, Homo sapiens
gatggaaagtgtatgagt

SEQ ID NO: 7672141 - DNA, 22 bp, Homo sapiens
gatggaagaaaaatgcatgtct

SEQ ID NO: 7672142 - DNA, 22 bp, Homo sapiens
gatggaagaaaaatgcatgtct

SEQ ID NO: 7672143 - DNA, 22 bp, Homo sapiens
gatgctttctcctttctccacc

SEQ ID NO: 7672144 - DNA, 22 bp, Homo sapiens
gatgctttctcctttctccacc

SEQ ID NO: 7672145 - DNA, 22 bp, Homo sapiens
gatgctttggccccatcatgag

SEQ ID NO: 7672146 - DNA, 22 bp, Homo sapiens
gatgctttggccccatcatgag

SEQ ID NO: 7672147 - DNA, 22 bp, Homo sapiens
gatgcttttccagtatgagagt

SEQ ID NO: 7672148 - DNA, 22 bp, Homo sapiens
gatgcttttccagtatgagagt

SEQ ID NO: 7672149 - DNA, 22 bp, Homo sapiens
gatgcttttcttttcagcaaga

SEQ ID NO: 7672150 - DNA, 22 bp, Homo sapiens
gatgccttccaggattttggct

SEQ ID NO: 7672151 - DNA, 22 bp, Homo sapiens
gatgccttccaggattttggct

SEQ ID NO: 7672152 - DNA, 22 bp, Homo sapiens
gatgcctgtggtgagcacacat

SEQ ID NO: 7672153 - DNA, 22 bp, Homo sapiens
gatgcctgcatttcaggagagt

SEQ ID NO: 7672154 - DNA, 22 bp, Homo sapiens
gatgccctgcatgagtcctgct

SEQ ID NO: 7672155 - DNA, 22 bp, Homo sapiens
gatgcccaggcccaaccatgga

SEQ ID NO: 7672156 - DNA, 22 bp, Homo sapiens
gatgcccctgtgctctttttcc

SEQ ID NO: 7672157 - DNA, 22 bp, Homo sapiens
gatgcctccaaatgagggcaga

SEQ ID NO: 7672158 - DNA, 22 bp, Homo sapiens
gatgcattacaaaagtgattat

SEQ ID NO: 7672159 - DNA, 20 bp, Homo sapiens
gatgcgcagccctggagggc

SEQ ID NO: 7672160 - DNA, 22 bp, Homo sapiens
gatgcgggcccgctccactgcc

SEQ ID NO: 7672161 - DNA, 22 bp, Homo sapiens
gatgcgggcccgctccactgcc

SEQ ID NO: 7672162 - DNA, 22 bp, Homo sapiens
gatgcgggcccgctccactgcc

SEQ ID NO: 7672163 - DNA, 19 bp, Homo sapiens
gatgctcattcaggtggaa

SEQ ID NO: 7672164 - DNA, 22 bp, Homo sapiens
gatgcgggcccgctccactgcc

SEQ ID NO: 7672165 - DNA, 22 bp, Homo sapiens
gatgcgggcccgctccactgcc

SEQ ID NO: 7672166 - DNA, 22 bp, Homo sapiens
gatgcgggcccgctccactgcc

SEQ ID NO: 7672167 - DNA, 22 bp, Homo sapiens
gatgctgactttccgctgccac

SEQ ID NO: 7672168 - DNA, 22 bp, Homo sapiens
gatgctgagagattggagacta

SEQ ID NO: 7672169 - DNA, 22 bp, Homo sapiens
gatgctgagagattggagacta

SEQ ID NO: 7672170 - DNA, 22 bp, Homo sapiens
gatgctgactggtgtttgcctt

SEQ ID NO: 7672171 - DNA, 22 bp, Homo sapiens
gatgctgaccagctgtttcctt

SEQ ID NO: 7672172 - DNA, 22 bp, Homo sapiens
gcaatgagcacccagagggcag

SEQ ID NO: 7672173 - DNA, 22 bp, Homo sapiens
gcaatgagcacccagagggcag

SEQ ID NO: 7672174 - DNA, 19 bp, Homo sapiens
gcaatccacccacctcagc

SEQ ID NO: 7672175 - DNA, 22 bp, Homo sapiens
gcaatctgggcaagcaggtagt

SEQ ID NO: 7672176 - DNA, 22 bp, Homo sapiens
gcaatgaataaataatgtttag

SEQ ID NO: 7672177 - DNA, 22 bp, Homo sapiens
gcaatgcaatctttattatatt

SEQ ID NO: 7672178 - DNA, 22 bp, Homo sapiens
gcaatgcaatctttattatatt

SEQ ID NO: 7672179 - DNA, 22 bp, Homo sapiens
gcaatgattgcattagaagatg

SEQ ID NO: 7672180 - DNA, 22 bp, Homo sapiens
gcaatgattgcattagaagatg

SEQ ID NO: 7672181 - DNA, 22 bp, Homo sapiens
gcaatcattttgtatctccagc

SEQ ID NO: 7672182 - DNA, 22 bp, Homo sapiens
gcaatcattttgtatctccagc

SEQ ID NO: 7672183 - DNA, 22 bp, Homo sapiens
gcaatcaatttaaaatgaggtc

SEQ ID NO: 7672184 - DNA, 22 bp, Homo sapiens
gcaatcaatttaaaatgaggtc

SEQ ID NO: 7672185 - DNA, 17 bp, Homo sapiens
gcaatctcagtctcctt

SEQ ID NO: 7672186 - DNA, 22 bp, Homo sapiens
gcaatcaatgatttatatttgt

SEQ ID NO: 7672187 - DNA, 22 bp, Homo sapiens
gcaatcaatgatttatatttgt

SEQ ID NO: 7672188 - DNA, 22 bp, Homo sapiens
gcaatataaccagttgtcatgc

SEQ ID NO: 7672189 - DNA, 22 bp, Homo sapiens
gcaatataatttgtgggatatc

SEQ ID NO: 7672190 - DNA, 22 bp, Homo sapiens
gcaattattatgtgacttttac

SEQ ID NO: 7672191 - DNA, 17 bp, Homo sapiens
gcaattattgggcattt

SEQ ID NO: 7672192 - DNA, 17 bp, Homo sapiens
gcaattattgggcattt

SEQ ID NO: 7672193 - DNA, 19 bp, Homo sapiens
gcaattcagtagtacaaaa

SEQ ID NO: 7672194 - DNA, 19 bp, Homo sapiens
gcaattcagtagtacaaaa

SEQ ID NO: 7672195 - DNA, 19 bp, Homo sapiens
gcaattcagaagcacctgt

SEQ ID NO: 7672196 - DNA, 22 bp, Homo sapiens
gcaattatatcaccagagatct

SEQ ID NO: 7672197 - DNA, 22 bp, Homo sapiens
gcaattatatcaccagagatct

SEQ ID NO: 7672198 - DNA, 22 bp, Homo sapiens
gcaatgggcacagcccagccca

SEQ ID NO: 7672199 - DNA, 22 bp, Homo sapiens
gcaatgcatatgtgggtagcat

SEQ ID NO: 7672200 - DNA, 20 bp, Homo sapiens
gcaatggcgtgctagttctg

SEQ ID NO: 7672201 - DNA, 22 bp, Homo sapiens
gcaatgcataacagagtgggcc

SEQ ID NO: 7672202 - DNA, 22 bp, Homo sapiens
gcaatgtgcacgcccttgggga

SEQ ID NO: 7672203 - DNA, 22 bp, Homo sapiens
gcaatgttaagatcacacctgg

SEQ ID NO: 7672204 - DNA, 22 bp, Homo sapiens
gcaatgtgcacgcccttgggga

SEQ ID NO: 7672205 - DNA, 20 bp, Homo sapiens
gcaatgttggttcctgtcac

SEQ ID NO: 7672206 - DNA, 22 bp, Homo sapiens
gcaatgtttttccttccatatt

SEQ ID NO: 7672207 - DNA, 22 bp, Homo sapiens
gcaatgtttttccttccatatt

SEQ ID NO: 7672208 - DNA, 22 bp, Homo sapiens
gcaatgttgtgttggcattcta

SEQ ID NO: 7672209 - DNA, 20 bp, Homo sapiens
gcaatgttggttcctgtcac

SEQ ID NO: 7672210 - DNA, 22 bp, Homo sapiens
gcacaagaataaccatatttaa

SEQ ID NO: 7672211 - DNA, 22 bp, Homo sapiens
gcacaagaaatcatggactgaa

SEQ ID NO: 7672212 - DNA, 22 bp, Homo sapiens
gcacaagaataaccatatttaa

SEQ ID NO: 7672213 - DNA, 21 bp, Homo sapiens
gcacaactctcacattcttct

SEQ ID NO: 7672214 - DNA, 22 bp, Homo sapiens
gcacaagaaatcatggactgaa

SEQ ID NO: 7672215 - DNA, 22 bp, Homo sapiens
gcacaacaccaagggaggtatc

SEQ ID NO: 7672216 - DNA, 17 bp, Homo sapiens
gcacaaatcaattacta

SEQ ID NO: 7672217 - DNA, 17 bp, Homo sapiens
gcacaaatcaattacta

SEQ ID NO: 7672218 - DNA, 17 bp, Homo sapiens
gcacaaatcaattacta

SEQ ID NO: 7672219 - DNA, 22 bp, Homo sapiens
gcacaaaggtggaaggaggaag

SEQ ID NO: 7672220 - DNA, 22 bp, Homo sapiens
gcacaagggtggtctctggagc

SEQ ID NO: 7672221 - DNA, 22 bp, Homo sapiens
gcacaaggagaattcattagtg

SEQ ID NO: 7672222 - DNA, 22 bp, Homo sapiens
gcacaaggagaattcattagtg

SEQ ID NO: 7672223 - DNA, 22 bp, Homo sapiens
gcacaagcagcccactgacatt

SEQ ID NO: 7672224 - DNA, 22 bp, Homo sapiens
gcacaagcagcccactgacatt

SEQ ID NO: 7672225 - DNA, 22 bp, Homo sapiens
gcacaagcacgagcagcgtgcg

SEQ ID NO: 7672226 - DNA, 23 bp, Homo sapiens
gcacaagacctggcagcttccat

SEQ ID NO: 7672227 - DNA, 22 bp, Homo sapiens
gcacaaagatgaatacagaatg

SEQ ID NO: 7672228 - DNA, 22 bp, Homo sapiens
gcacaaaggtggaaggaggaag

SEQ ID NO: 7672229 - DNA, 22 bp, Homo sapiens
gcacaaactgcaattacttttg

SEQ ID NO: 7672230 - DNA, 22 bp, Homo sapiens
gcacaaactgcaattacttttg

SEQ ID NO: 7672231 - DNA, 22 bp, Homo sapiens
gcacaaaaggtacttcatgtag

SEQ ID NO: 7672232 - DNA, 22 bp, Homo sapiens
gcacaaaacacattttgacaat

SEQ ID NO: 7672233 - DNA, 22 bp, Homo sapiens
gcacaaaaggtacttcatgtag

SEQ ID NO: 7672234 - DNA, 22 bp, Homo sapiens
gcacaaaaggtacttcatgtag

SEQ ID NO: 7672235 - DNA, 22 bp, Homo sapiens
gcacaaaaggtacttcatgtag

SEQ ID NO: 7672236 - DNA, 22 bp, Homo sapiens
gcacaaaaggtacttcatgtag

SEQ ID NO: 7672237 - DNA, 22 bp, Homo sapiens
gcacaaaacacattttgacaat

SEQ ID NO: 7672238 - DNA, 22 bp, Homo sapiens
gcacaaaacacattttgacaat

SEQ ID NO: 7672239 - DNA, 22 bp, Homo sapiens
gcacaaaacacattttgacaat

SEQ ID NO: 7672240 - DNA, 21 bp, Homo sapiens
gcaatttcataagttttagtt

SEQ ID NO: 7672241 - DNA, 22 bp, Homo sapiens
gcaatttctgaggctgtccttc

SEQ ID NO: 7672242 - DNA, 21 bp, Homo sapiens
gcaattcgctatgatggtggc

SEQ ID NO: 7672243 - DNA, 21 bp, Homo sapiens
gcaattcgctatgatggtggc

SEQ ID NO: 7672244 - DNA, 22 bp, Homo sapiens
gcaaactgatttccaagtccgt

SEQ ID NO: 7672245 - DNA, 22 bp, Homo sapiens
gcaaacatttggtctagtgtgt

SEQ ID NO: 7672246 - DNA, 22 bp, Homo sapiens
gcaaactgcattctatagcttg

SEQ ID NO: 7672247 - DNA, 22 bp, Homo sapiens
gcaaactgatttccaagtccgt

SEQ ID NO: 7672248 - DNA, 18 bp, Homo sapiens
gcaaacattcttccagtc

SEQ ID NO: 7672249 - DNA, 18 bp, Homo sapiens
gcaaacattcttccagtc

SEQ ID NO: 7672250 - DNA, 22 bp, Homo sapiens
gcaaacattccacagaaggaag

SEQ ID NO: 7672251 - DNA, 22 bp, Homo sapiens
gcaaacattccacagaaggaag

SEQ ID NO: 7672252 - DNA, 22 bp, Homo sapiens
gcaaactggcaaacctgtctgt

SEQ ID NO: 7672253 - DNA, 22 bp, Homo sapiens
gcaaactgcattctatagcttg

SEQ ID NO: 7672254 - DNA, 22 bp, Homo sapiens
gcaaactggcaaacctgtctgt

SEQ ID NO: 7672255 - DNA, 22 bp, Homo sapiens
gcaaactggcaaacctgtctgt

SEQ ID NO: 7672256 - DNA, 22 bp, Homo sapiens
gcaatagtgcctattctcttga

SEQ ID NO: 7672257 - DNA, 22 bp, Homo sapiens
gcaatagtgcctattctcttga

SEQ ID NO: 7672258 - DNA, 22 bp, Homo sapiens
gcaatagtatttattaaagtag

SEQ ID NO: 7672259 - DNA, 22 bp, Homo sapiens
gcaataggcaatagtagatgct

SEQ ID NO: 7672260 - DNA, 22 bp, Homo sapiens
gcaatagtatttattaaagtag

SEQ ID NO: 7672261 - DNA, 22 bp, Homo sapiens
gcaatataaccagttgtcatgc

SEQ ID NO: 7672262 - DNA, 22 bp, Homo sapiens
gcaaacatcttagccatagagt

SEQ ID NO: 7672263 - DNA, 22 bp, Homo sapiens
gcaaacatcttagccatagagt

SEQ ID NO: 7672264 - DNA, 22 bp, Homo sapiens
gcaaacatctttatttggcaag

SEQ ID NO: 7672265 - DNA, 22 bp, Homo sapiens
gcaaacatctttatttggcaag

SEQ ID NO: 7672266 - DNA, 22 bp, Homo sapiens
gcaaacatctttatttggcaag

SEQ ID NO: 7672267 - DNA, 22 bp, Homo sapiens
gcaaacatgctgagaaataaga

SEQ ID NO: 7672268 - DNA, 22 bp, Homo sapiens
gcaaacatgctgagaaataaga

SEQ ID NO: 7672269 - DNA, 22 bp, Homo sapiens
gcaaacatgctgagaaataaga

SEQ ID NO: 7672270 - DNA, 22 bp, Homo sapiens
gcaaacatgctgagaaataaga

SEQ ID NO: 7672271 - DNA, 22 bp, Homo sapiens
gcaaacatgttgtgagatacca

SEQ ID NO: 7672272 - DNA, 22 bp, Homo sapiens
gcaaacatgttgtgagatacca

SEQ ID NO: 7672273 - DNA, 22 bp, Homo sapiens
gcaaacatgttgtgagatacca

SEQ ID NO: 7672274 - DNA, 22 bp, Homo sapiens
gcaaacatgtgctcattttgtg

SEQ ID NO: 7672275 - DNA, 22 bp, Homo sapiens
gcaaacatgtgctcattttgtg

SEQ ID NO: 7672276 - DNA, 22 bp, Homo sapiens
gcaaacatgtgctcattttgtg

SEQ ID NO: 7672277 - DNA, 22 bp, Homo sapiens
gcaaacattcaggagtacagga

SEQ ID NO: 7672278 - DNA, 22 bp, Homo sapiens
gcaaacattcaggagtacagga

SEQ ID NO: 7672279 - DNA, 22 bp, Homo sapiens
gcaaacattcaggagtacagga

SEQ ID NO: 7672280 - DNA, 22 bp, Homo sapiens
gcaaacattcaggagtacagga

SEQ ID NO: 7672281 - DNA, 22 bp, Homo sapiens
gattttcttgggaaacaatgag

SEQ ID NO: 7672282 - DNA, 22 bp, Homo sapiens
gattttcttgggaaacaatgag

SEQ ID NO: 7672283 - DNA, 22 bp, Homo sapiens
gattttcttgggaaacaatgag

SEQ ID NO: 7672284 - DNA, 22 bp, Homo sapiens
gattttcttgggaaacaatgag

SEQ ID NO: 7672285 - DNA, 22 bp, Homo sapiens
gattttcttgggaaacaatgag

SEQ ID NO: 7672286 - DNA, 22 bp, Homo sapiens
gattttcttgggaaacaatgag

SEQ ID NO: 7672287 - DNA, 22 bp, Homo sapiens
gattttctgagccttcaaattt

SEQ ID NO: 7672288 - DNA, 22 bp, Homo sapiens
gattttctgagccttcaaattt

SEQ ID NO: 7672289 - DNA, 22 bp, Homo sapiens
gattttctgagccttcaaattt

SEQ ID NO: 7672290 - DNA, 22 bp, Homo sapiens
gattttctgagccttcaaattt

SEQ ID NO: 7672291 - DNA, 22 bp, Homo sapiens
gattttctgagccttcaaattt

SEQ ID NO: 7672292 - DNA, 22 bp, Homo sapiens
gattttgtcaaattccaaatgt

SEQ ID NO: 7672293 - DNA, 22 bp, Homo sapiens
gattttgtcaaattccaaatgt

SEQ ID NO: 7672294 - DNA, 22 bp, Homo sapiens
gattttgtcaaattccaaatgt

SEQ ID NO: 7672295 - DNA, 22 bp, Homo sapiens
gatttttatataaagtgagaaa

SEQ ID NO: 7672296 - DNA, 22 bp, Homo sapiens
gatttttatataaagtgagaaa

SEQ ID NO: 7672297 - DNA, 22 bp, Homo sapiens
gatttttatataaagtgagaaa

SEQ ID NO: 7672298 - DNA, 22 bp, Homo sapiens
gcaaacataatatgaagacact

SEQ ID NO: 7672299 - DNA, 22 bp, Homo sapiens
gcaaacataatatgaagacact

SEQ ID NO: 7672300 - DNA, 22 bp, Homo sapiens
gcaaacatccactgcccttgta

SEQ ID NO: 7672301 - DNA, 22 bp, Homo sapiens
gcaaacatccactgcccttgta

SEQ ID NO: 7672302 - DNA, 22 bp, Homo sapiens
gcaaacagaaatgcaggacgct

SEQ ID NO: 7672303 - DNA, 22 bp, Homo sapiens
gcaaacagaaatgcaggacgct

SEQ ID NO: 7672304 - DNA, 22 bp, Homo sapiens
gcaaaaaatgcttgttgcttag

SEQ ID NO: 7672305 - DNA, 22 bp, Homo sapiens
gcaaacagaaatgcaggacgct

SEQ ID NO: 7672306 - DNA, 22 bp, Homo sapiens
gcaaaaaatgcttgttgcttag

SEQ ID NO: 7672307 - DNA, 22 bp, Homo sapiens
gcaaaaaatgcttgttgcttag

SEQ ID NO: 7672308 - DNA, 22 bp, Homo sapiens
gcaaaaaatgcttgttgcttag

SEQ ID NO: 7672309 - DNA, 22 bp, Homo sapiens
gatttttcagtataaaatatat

SEQ ID NO: 7672310 - DNA, 22 bp, Homo sapiens
gcaaaaaatgcttgttgcttag

SEQ ID NO: 7672311 - DNA, 22 bp, Homo sapiens
gcaaaaaatgcttgttgcttag

SEQ ID NO: 7672312 - DNA, 22 bp, Homo sapiens
gcaaaaaatgcttgttgcttag

SEQ ID NO: 7672313 - DNA, 22 bp, Homo sapiens
gcaaaaaatgcttgttgcttag

SEQ ID NO: 7672314 - DNA, 22 bp, Homo sapiens
gcaaaaaatgcttgttgcttag

SEQ ID NO: 7672315 - DNA, 22 bp, Homo sapiens
gcaaaaaatgcttgttgcttag

SEQ ID NO: 7672316 - DNA, 22 bp, Homo sapiens
gatttttatataaagtgagaaa

SEQ ID NO: 7672317 - DNA, 22 bp, Homo sapiens
gatttttcagtataaaatatat

SEQ ID NO: 7672318 - DNA, 22 bp, Homo sapiens
gatttttatataaagtgagaaa

SEQ ID NO: 7672319 - DNA, 22 bp, Homo sapiens
gatttctgtggcttgtacatat

SEQ ID NO: 7672320 - DNA, 22 bp, Homo sapiens
gatttcttcaggagcagaggag

SEQ ID NO: 7672321 - DNA, 22 bp, Homo sapiens
gatttcttcattcattagatgg

SEQ ID NO: 7672322 - DNA, 22 bp, Homo sapiens
gatttctgttgagaaacatggg

SEQ ID NO: 7672323 - DNA, 22 bp, Homo sapiens
gatttcttcaggagcagaggag

SEQ ID NO: 7672324 - DNA, 22 bp, Homo sapiens
gatttcttcaggagcagaggag

SEQ ID NO: 7672325 - DNA, 22 bp, Homo sapiens
gatttcttcaggagcagaggag

SEQ ID NO: 7672326 - DNA, 22 bp, Homo sapiens
gatttcttcaggagcagaggag

SEQ ID NO: 7672327 - DNA, 22 bp, Homo sapiens
gatttcaaggagttttcacagt

SEQ ID NO: 7672328 - DNA, 22 bp, Homo sapiens
gatttcaagcccccagagattc

SEQ ID NO: 7672329 - DNA, 22 bp, Homo sapiens
gatttcaagcccccagagattc

SEQ ID NO: 7672330 - DNA, 22 bp, Homo sapiens
gatttcaagcccccagagattc

SEQ ID NO: 7672331 - DNA, 22 bp, Homo sapiens
gatttcaagtatcttgggcgag

SEQ ID NO: 7672332 - DNA, 22 bp, Homo sapiens
gatttcaaggatgttagaggtg

SEQ ID NO: 7672333 - DNA, 22 bp, Homo sapiens
gatttcaatccagctttcttct

SEQ ID NO: 7672334 - DNA, 22 bp, Homo sapiens
gatttcttgacccctgtctcag

SEQ ID NO: 7672335 - DNA, 22 bp, Homo sapiens
gatttcttgacccctgtctcag

SEQ ID NO: 7672336 - DNA, 22 bp, Homo sapiens
gatttcttctctcccaagagga

SEQ ID NO: 7672337 - DNA, 22 bp, Homo sapiens
gatttcttctctcccaagagga

SEQ ID NO: 7672338 - DNA, 22 bp, Homo sapiens
gatttcttctctcccaagagga

SEQ ID NO: 7672339 - DNA, 22 bp, Homo sapiens
gatttcttctctcccaagagga

SEQ ID NO: 7672340 - DNA, 22 bp, Homo sapiens
gatttcttctctcccaagagga

SEQ ID NO: 7672341 - DNA, 22 bp, Homo sapiens
gatttcttcattcattagatgg

SEQ ID NO: 7672342 - DNA, 22 bp, Homo sapiens
gatttcttcattcattagatgg

SEQ ID NO: 7672343 - DNA, 22 bp, Homo sapiens
gatttcttcattcattagatgg

SEQ ID NO: 7672344 - DNA, 22 bp, Homo sapiens
gatttcttcattcattagatgg

SEQ ID NO: 7672345 - DNA, 22 bp, Homo sapiens
gatttcttcatttgtggtgaat

SEQ ID NO: 7672346 - DNA, 22 bp, Homo sapiens
gatttcttcatttgtggtgaat

SEQ ID NO: 7672347 - DNA, 22 bp, Homo sapiens
gatttcttgagcaagttgctta

SEQ ID NO: 7672348 - DNA, 22 bp, Homo sapiens
gatttcttgacccctgtctcag

SEQ ID NO: 7672349 - DNA, 22 bp, Homo sapiens
gatttcttgagcaagttgctta

SEQ ID NO: 7672350 - DNA, 22 bp, Homo sapiens
gatttcttgagcaagttgctta

SEQ ID NO: 7672351 - DNA, 22 bp, Homo sapiens
gatttcttgagcaagttgctta

SEQ ID NO: 7672352 - DNA, 22 bp, Homo sapiens
gatttcttgagcaagttgctta

SEQ ID NO: 7672353 - DNA, 22 bp, Homo sapiens
gatttcttgagcaagttgctta

SEQ ID NO: 7672354 - DNA, 22 bp, Homo sapiens
gatttcttgagcaagttgctta

SEQ ID NO: 7672355 - DNA, 22 bp, Homo sapiens
gatttcttgataagtagtgtga

SEQ ID NO: 7672356 - DNA, 22 bp, Homo sapiens
gatttcttgataagtagtgtga

SEQ ID NO: 7672357 - DNA, 22 bp, Homo sapiens
gatttcttgataagtagtgtga

SEQ ID NO: 7672358 - DNA, 22 bp, Homo sapiens
gatttcttgataagtagtgtga

SEQ ID NO: 7672359 - DNA, 22 bp, Homo sapiens
gatttcttgataagtagtgtga

SEQ ID NO: 7672360 - DNA, 22 bp, Homo sapiens
gatttcttgataattcaaatcc

SEQ ID NO: 7672361 - DNA, 22 bp, Homo sapiens
gatttcttgataattcaaatcc

SEQ ID NO: 7672362 - DNA, 22 bp, Homo sapiens
gatttcttgataattcaaatcc

SEQ ID NO: 7672363 - DNA, 22 bp, Homo sapiens
gatttcttgataattcaaatcc

SEQ ID NO: 7672364 - DNA, 22 bp, Homo sapiens
gatttcttgataattcaaatcc

SEQ ID NO: 7672365 - DNA, 22 bp, Homo sapiens
gatttcttgataattcaaatcc

SEQ ID NO: 7672366 - DNA, 22 bp, Homo sapiens
gatttcttggcccactctcaga

SEQ ID NO: 7672367 - DNA, 22 bp, Homo sapiens
gatttcttggcccactctcaga

SEQ ID NO: 7672368 - DNA, 22 bp, Homo sapiens
gatttcttggcccactctcaga

SEQ ID NO: 7672369 - DNA, 22 bp, Homo sapiens
gatttcttggcccactctcaga

SEQ ID NO: 7672370 - DNA, 22 bp, Homo sapiens
gatttctttagctcatcagatc

SEQ ID NO: 7672371 - DNA, 22 bp, Homo sapiens
gatttctttagctcatcagatc

SEQ ID NO: 7672372 - DNA, 22 bp, Homo sapiens
gatttctttagctcatcagatc

SEQ ID NO: 7672373 - DNA, 22 bp, Homo sapiens
gatttctttatgaagtacagaa

SEQ ID NO: 7672374 - DNA, 22 bp, Homo sapiens
gatttctttgaattagagaggt

SEQ ID NO: 7672375 - DNA, 22 bp, Homo sapiens
gatttctttaggtgtaatagtg

SEQ ID NO: 7672376 - DNA, 22 bp, Homo sapiens
gatttctttatgaagtacagaa

SEQ ID NO: 7672377 - DNA, 22 bp, Homo sapiens
gatttctttatgaagtacagaa

SEQ ID NO: 7672378 - DNA, 22 bp, Homo sapiens
gatttctttatgaagtacagaa

SEQ ID NO: 7672379 - DNA, 22 bp, Homo sapiens
gatttctttatgaagtacagaa

SEQ ID NO: 7672380 - DNA, 22 bp, Homo sapiens
gatttctttaggtgtaatagtg

SEQ ID NO: 7672381 - DNA, 22 bp, Homo sapiens
gatttctttagctcatcagatc

SEQ ID NO: 7672382 - DNA, 22 bp, Homo sapiens
gatttctttaggtgtaatagtg

SEQ ID NO: 7672383 - DNA, 22 bp, Homo sapiens
gatttggtggctacatttgtaa

SEQ ID NO: 7672384 - DNA, 22 bp, Homo sapiens
gatttgtagcttttcagtctgt

SEQ ID NO: 7672385 - DNA, 22 bp, Homo sapiens
gatttgcattctgaaagctacc

SEQ ID NO: 7672386 - DNA, 20 bp, Homo sapiens
gatttgctgaacttttatga

SEQ ID NO: 7672387 - DNA, 20 bp, Homo sapiens
gatttgctgaacttttatga

SEQ ID NO: 7672388 - DNA, 22 bp, Homo sapiens
gatttctttgcaagctgtgttc

SEQ ID NO: 7672389 - DNA, 22 bp, Homo sapiens
gatttctttgcaagctgtgttc

SEQ ID NO: 7672390 - DNA, 22 bp, Homo sapiens
gatttctttgcaagctgtgttc

SEQ ID NO: 7672391 - DNA, 22 bp, Homo sapiens
gatttctttgaattagagaggt

SEQ ID NO: 7672392 - DNA, 22 bp, Homo sapiens
gatttctttgaattagagaggt

SEQ ID NO: 7672393 - DNA, 22 bp, Homo sapiens
gatttctttgaattagagaggt

SEQ ID NO: 7672394 - DNA, 22 bp, Homo sapiens
gatttctttgcaagctgtgttc

SEQ ID NO: 7672395 - DNA, 22 bp, Homo sapiens
gatttctttgcaagctgtgttc

SEQ ID NO: 7672396 - DNA, 22 bp, Homo sapiens
gatttctttgtacccacaatcc

SEQ ID NO: 7672397 - DNA, 22 bp, Homo sapiens
gatttctttgtacccacaatcc

SEQ ID NO: 7672398 - DNA, 22 bp, Homo sapiens
gatttgacacctggggcatata

SEQ ID NO: 7672399 - DNA, 22 bp, Homo sapiens
gatttgtctatattcaaatatg

SEQ ID NO: 7672400 - DNA, 22 bp, Homo sapiens
gatttgtctatattcaaatatg

SEQ ID NO: 7672401 - DNA, 22 bp, Homo sapiens
gatttgtcacggttgagagcca

SEQ ID NO: 7672402 - DNA, 22 bp, Homo sapiens
gatttgtccacagagtgatgaa

SEQ ID NO: 7672403 - DNA, 22 bp, Homo sapiens
gatttgtccacagagtgatgaa

SEQ ID NO: 7672404 - DNA, 22 bp, Homo sapiens
gatttgtctaggtcatgacttt

SEQ ID NO: 7672405 - DNA, 22 bp, Homo sapiens
gatttgtttcaagttagcatct

SEQ ID NO: 7672406 - DNA, 22 bp, Homo sapiens
gatttgtttcaagttagcatct

SEQ ID NO: 7672407 - DNA, 22 bp, Homo sapiens
gatttgtttcaagttagcatct

SEQ ID NO: 7672408 - DNA, 22 bp, Homo sapiens
gatttgtttcaagttagcatct

SEQ ID NO: 7672409 - DNA, 21 bp, Homo sapiens
gattttaaagagactgccaca

SEQ ID NO: 7672410 - DNA, 21 bp, Homo sapiens
gattttaaagagactgccaca

SEQ ID NO: 7672411 - DNA, 21 bp, Homo sapiens
gattttaaagagactgccaca

SEQ ID NO: 7672412 - DNA, 21 bp, Homo sapiens
gattttaaagagactgccaca

SEQ ID NO: 7672413 - DNA, 21 bp, Homo sapiens
gattttaaagagactgccaca

SEQ ID NO: 7672414 - DNA, 21 bp, Homo sapiens
gattttaaagagactgccaca

SEQ ID NO: 7672415 - DNA, 22 bp, Homo sapiens
gattttaattataggaggtcct

SEQ ID NO: 7672416 - DNA, 22 bp, Homo sapiens
gattttaattataggaggtcct

SEQ ID NO: 7672417 - DNA, 22 bp, Homo sapiens
gattttaattataggaggtcct

SEQ ID NO: 7672418 - DNA, 22 bp, Homo sapiens
gattttaattataggaggtcct

SEQ ID NO: 7672419 - DNA, 21 bp, Homo sapiens
gattttaaagagactgccaca

SEQ ID NO: 7672420 - DNA, 21 bp, Homo sapiens
gattttaaagagactgccaca

SEQ ID NO: 7672421 - DNA, 22 bp, Homo sapiens
gattttaattataggaggtcct

SEQ ID NO: 7672422 - DNA, 22 bp, Homo sapiens
gattttatagtcaggaaaaaga

SEQ ID NO: 7672423 - DNA, 22 bp, Homo sapiens
gattttatatggcatactgtgg

SEQ ID NO: 7672424 - DNA, 22 bp, Homo sapiens
gattttatatggcatactgtgg

SEQ ID NO: 7672425 - DNA, 22 bp, Homo sapiens
gattttatatggcatactgtgg

SEQ ID NO: 7672426 - DNA, 22 bp, Homo sapiens
gattttatatggcatactgtgg

SEQ ID NO: 7672427 - DNA, 22 bp, Homo sapiens
gattttatatggcatactgtgg

SEQ ID NO: 7672428 - DNA, 22 bp, Homo sapiens
gattttatagtcaggaaaaaga

SEQ ID NO: 7672429 - DNA, 22 bp, Homo sapiens
gattttatagtcaggaaaaaga

SEQ ID NO: 7672430 - DNA, 22 bp, Homo sapiens
gattttattagcccaaactttg

SEQ ID NO: 7672431 - DNA, 22 bp, Homo sapiens
gattttattagcccaaactttg

SEQ ID NO: 7672432 - DNA, 22 bp, Homo sapiens
gattttatctttgtgtgcagta

SEQ ID NO: 7672433 - DNA, 22 bp, Homo sapiens
gattttatctttgtgtgcagta

SEQ ID NO: 7672434 - DNA, 22 bp, Homo sapiens
gattttatctttgtgtgcagta

SEQ ID NO: 7672435 - DNA, 22 bp, Homo sapiens
gattttatcgtcatccttctgg

SEQ ID NO: 7672436 - DNA, 22 bp, Homo sapiens
gattttatatggcatactgtgg

SEQ ID NO: 7672437 - DNA, 22 bp, Homo sapiens
gattttatctttgtgtgcagta

SEQ ID NO: 7672438 - DNA, 22 bp, Homo sapiens
gattttatctttgtgtgcagta

SEQ ID NO: 7672439 - DNA, 22 bp, Homo sapiens
gattttatcgtcatccttctgg

SEQ ID NO: 7672440 - DNA, 22 bp, Homo sapiens
gattttcatgataaacttgtga

SEQ ID NO: 7672441 - DNA, 22 bp, Homo sapiens
gattttcatgataaacttgtga

SEQ ID NO: 7672442 - DNA, 22 bp, Homo sapiens
gattttcatgataaacttgtga

SEQ ID NO: 7672443 - DNA, 22 bp, Homo sapiens
gattttattagcccaaactttg

SEQ ID NO: 7672444 - DNA, 22 bp, Homo sapiens
gattttcatgataaacttgtga

SEQ ID NO: 7672445 - DNA, 22 bp, Homo sapiens
gattttcattatagctagtttc

SEQ ID NO: 7672446 - DNA, 22 bp, Homo sapiens
gattttcattatagctagtttc

SEQ ID NO: 7672447 - DNA, 22 bp, Homo sapiens
gattttcattatagctagtttc

SEQ ID NO: 7672448 - DNA, 22 bp, Homo sapiens
gattttcattatagctagtttc

SEQ ID NO: 7672449 - DNA, 22 bp, Homo sapiens
gattttcattatagctagtttc

SEQ ID NO: 7672450 - DNA, 22 bp, Homo sapiens
gattttctgagccttcaaattt

SEQ ID NO: 7672451 - DNA, 22 bp, Homo sapiens
gattttctgagccttcaaattt

SEQ ID NO: 7672452 - DNA, 22 bp, Homo sapiens
gattttcatttgcactctagaa

SEQ ID NO: 7672453 - DNA, 22 bp, Homo sapiens
gcagagcatttcggttgcttcc

SEQ ID NO: 7672454 - DNA, 22 bp, Homo sapiens
gcagagccagaatggccaggac

SEQ ID NO: 7672455 - DNA, 22 bp, Homo sapiens
gcagagccagaatggccaggac

SEQ ID NO: 7672456 - DNA, 22 bp, Homo sapiens
gcagagccagaatggccaggac

SEQ ID NO: 7672457 - DNA, 22 bp, Homo sapiens
gcagagccagaatggccaggac

SEQ ID NO: 7672458 - DNA, 22 bp, Homo sapiens
gcagagcatttcggttgcttcc

SEQ ID NO: 7672459 - DNA, 22 bp, Homo sapiens
gcagagcatttcggttgcttcc

SEQ ID NO: 7672460 - DNA, 22 bp, Homo sapiens
gcagagcattggagggaccctg

SEQ ID NO: 7672461 - DNA, 22 bp, Homo sapiens
gcagagcattggagggaccctg

SEQ ID NO: 7672462 - DNA, 22 bp, Homo sapiens
gcagagcattggagggaccctg

SEQ ID NO: 7672463 - DNA, 22 bp, Homo sapiens
gcagagcattggagggaccctg

SEQ ID NO: 7672464 - DNA, 22 bp, Homo sapiens
gcagagcattggagggaccctg

SEQ ID NO: 7672465 - DNA, 22 bp, Homo sapiens
gcagagcattggagggaccctg

SEQ ID NO: 7672466 - DNA, 22 bp, Homo sapiens
gcagagcatgtcctcaggacag

SEQ ID NO: 7672467 - DNA, 22 bp, Homo sapiens
gcagagcatgtcctcaggacag

SEQ ID NO: 7672468 - DNA, 18 bp, Homo sapiens
gcagagcatcaagggtta

SEQ ID NO: 7672469 - DNA, 18 bp, Homo sapiens
gcagagcatcaagggtta

SEQ ID NO: 7672470 - DNA, 22 bp, Homo sapiens
gcagagcagtgcttgcccagcg

SEQ ID NO: 7672471 - DNA, 22 bp, Homo sapiens
gcagagcatgtcctcaggacag

SEQ ID NO: 7672472 - DNA, 22 bp, Homo sapiens
gcagagcatgtcctcaggacag

SEQ ID NO: 7672473 - DNA, 22 bp, Homo sapiens
gcagagcatgtcctcaggacag

SEQ ID NO: 7672474 - DNA, 22 bp, Homo sapiens
gcagagcatgtcctcaggacag

SEQ ID NO: 7672475 - DNA, 22 bp, Homo sapiens
gcagagcatgtcctcaggacag

SEQ ID NO: 7672476 - DNA, 22 bp, Homo sapiens
gcagaaggatccgcaggtgcaa

SEQ ID NO: 7672477 - DNA, 22 bp, Homo sapiens
gcagaaggatccgcaggtgcaa

SEQ ID NO: 7672478 - DNA, 22 bp, Homo sapiens
gcagaaggatccgcaggtgcaa

SEQ ID NO: 7672479 - DNA, 22 bp, Homo sapiens
gcagaaggatccgcaggtgcaa

SEQ ID NO: 7672480 - DNA, 22 bp, Homo sapiens
gcagaaggatccgcaggtgcaa

SEQ ID NO: 7672481 - DNA, 22 bp, Homo sapiens
gcagaaggatccgcaggtgcaa

SEQ ID NO: 7672482 - DNA, 22 bp, Homo sapiens
gcagaaggatccgcaggtgcaa

SEQ ID NO: 7672483 - DNA, 22 bp, Homo sapiens
gcagagcagtgcttgcccagcg

SEQ ID NO: 7672484 - DNA, 22 bp, Homo sapiens
gcagagcagtgcttgcccagcg

SEQ ID NO: 7672485 - DNA, 22 bp, Homo sapiens
gcagagcagtgcttgcccagcg

SEQ ID NO: 7672486 - DNA, 22 bp, Homo sapiens
gcagagcagtgcttgcccagcg

SEQ ID NO: 7672487 - DNA, 22 bp, Homo sapiens
gcagagcagtgcttgcccagcg

SEQ ID NO: 7672488 - DNA, 22 bp, Homo sapiens
gcagagcagtactctcttgact

SEQ ID NO: 7672489 - DNA, 22 bp, Homo sapiens
gcagagcagtactctcttgact

SEQ ID NO: 7672490 - DNA, 22 bp, Homo sapiens
gcagaagctgttcgaaggccgc

SEQ ID NO: 7672491 - DNA, 22 bp, Homo sapiens
gcagaagctgttcgaaggccgc

SEQ ID NO: 7672492 - DNA, 22 bp, Homo sapiens
gcagaaggatccgcaggtgcaa

SEQ ID NO: 7672493 - DNA, 22 bp, Homo sapiens
gcagaagctgggcagcgaggtg

SEQ ID NO: 7672494 - DNA, 22 bp, Homo sapiens
gcagaagctgggcagcgaggtg

SEQ ID NO: 7672495 - DNA, 22 bp, Homo sapiens
gcagaagctgggcagcgaggtg

SEQ ID NO: 7672496 - DNA, 22 bp, Homo sapiens
gcagaagctgggcagcgaggtg

SEQ ID NO: 7672497 - DNA, 22 bp, Homo sapiens
gcagagcccctcaagccagcct

SEQ ID NO: 7672498 - DNA, 22 bp, Homo sapiens
gcagagcccctcaagccagcct

SEQ ID NO: 7672499 - DNA, 22 bp, Homo sapiens
gcagagccccattgctggcggg

SEQ ID NO: 7672500 - DNA, 22 bp, Homo sapiens
gcagagccccattgctggcggg

SEQ ID NO: 7672501 - DNA, 22 bp, Homo sapiens
gcagagcccctcaagccagcct

SEQ ID NO: 7672502 - DNA, 22 bp, Homo sapiens
gcagagccccattgctggcggg

SEQ ID NO: 7672503 - DNA, 22 bp, Homo sapiens
gcagagccccattgctggcggg

SEQ ID NO: 7672504 - DNA, 22 bp, Homo sapiens
gcagagccaggctggggcaggt

SEQ ID NO: 7672505 - DNA, 22 bp, Homo sapiens
gcagagccaggctggggcaggt

SEQ ID NO: 7672506 - DNA, 22 bp, Homo sapiens
gcagagccaggctggggcaggt

SEQ ID NO: 7672507 - DNA, 22 bp, Homo sapiens
gcagagccaggagcccaggatc

SEQ ID NO: 7672508 - DNA, 22 bp, Homo sapiens
gcagagccaggagcccaggatc

SEQ ID NO: 7672509 - DNA, 22 bp, Homo sapiens
gcagagccaggagcccaggatc

SEQ ID NO: 7672510 - DNA, 22 bp, Homo sapiens
gcagagccaggctggggcaggt

SEQ ID NO: 7672511 - DNA, 22 bp, Homo sapiens
gcagagccaggctggggcaggt

SEQ ID NO: 7672512 - DNA, 22 bp, Homo sapiens
gcagagccaggagcccaggatc

SEQ ID NO: 7672513 - DNA, 22 bp, Homo sapiens
gcagagccaggagcccaggatc

SEQ ID NO: 7672514 - DNA, 22 bp, Homo sapiens
gcagagccagaatggccaggac

SEQ ID NO: 7672515 - DNA, 22 bp, Homo sapiens
gcagagccagaatggccaggac

SEQ ID NO: 7672516 - DNA, 22 bp, Homo sapiens
gcagagccagaatggccaggac

SEQ ID NO: 7672517 - DNA, 22 bp, Homo sapiens
gcagagccaggagagacccttg

SEQ ID NO: 7672518 - DNA, 22 bp, Homo sapiens
gcagagccaggagagacccttg

SEQ ID NO: 7672519 - DNA, 22 bp, Homo sapiens
gcagaagaccatggtggaaaga

SEQ ID NO: 7672520 - DNA, 22 bp, Homo sapiens
gcagaagcacaggtgacgggcc

SEQ ID NO: 7672521 - DNA, 22 bp, Homo sapiens
gcagaagaccatggtggaaaga

SEQ ID NO: 7672522 - DNA, 22 bp, Homo sapiens
gcagaagaccatggtggaaaga

SEQ ID NO: 7672523 - DNA, 22 bp, Homo sapiens
gcagaagaccatggtggaaaga

SEQ ID NO: 7672524 - DNA, 22 bp, Homo sapiens
gcagaacctgaattgaacattg

SEQ ID NO: 7672525 - DNA, 22 bp, Homo sapiens
gcagaacatggaaagagaacta

SEQ ID NO: 7672526 - DNA, 22 bp, Homo sapiens
gcagaacaacgtaggagtggag

SEQ ID NO: 7672527 - DNA, 22 bp, Homo sapiens
gcagaacagtctgtcggttcta

SEQ ID NO: 7672528 - DNA, 22 bp, Homo sapiens
gcagaacagtctgtcggttcta

SEQ ID NO: 7672529 - DNA, 22 bp, Homo sapiens
gcagaacatttcacagtatctt

SEQ ID NO: 7672530 - DNA, 22 bp, Homo sapiens
gcagaacatttcacagtatctt

SEQ ID NO: 7672531 - DNA, 22 bp, Homo sapiens
gcagaacatttcacagtatctt

SEQ ID NO: 7672532 - DNA, 22 bp, Homo sapiens
gcagaagcccggtcagcgcacg

SEQ ID NO: 7672533 - DNA, 22 bp, Homo sapiens
gcagaagctgggagaagggatt

SEQ ID NO: 7672534 - DNA, 22 bp, Homo sapiens
gcagaagctgggcagcgaggtg

SEQ ID NO: 7672535 - DNA, 22 bp, Homo sapiens
gcagaagctgggagaagggatt

SEQ ID NO: 7672536 - DNA, 22 bp, Homo sapiens
gcagaagctgggagaagggatt

SEQ ID NO: 7672537 - DNA, 22 bp, Homo sapiens
gcagaagctgggagaagggatt

SEQ ID NO: 7672538 - DNA, 22 bp, Homo sapiens
gcagaagctgggcagcgaggtg

SEQ ID NO: 7672539 - DNA, 22 bp, Homo sapiens
gcagaagcagggcaggggcaaa

SEQ ID NO: 7672540 - DNA, 22 bp, Homo sapiens
gcagaagcccggtcagcgcacg

SEQ ID NO: 7672541 - DNA, 22 bp, Homo sapiens
gcagaagcagggcaggggcaaa

SEQ ID NO: 7672542 - DNA, 22 bp, Homo sapiens
gcagaagcccggtcagcgcacg

SEQ ID NO: 7672543 - DNA, 22 bp, Homo sapiens
gcagaagcagaggagcctatga

SEQ ID NO: 7672544 - DNA, 22 bp, Homo sapiens
gcagaagcagaggagcctatga

SEQ ID NO: 7672545 - DNA, 22 bp, Homo sapiens
gcagaagcagcagatgggcgca

SEQ ID NO: 7672546 - DNA, 22 bp, Homo sapiens
gcagaagcagcagatgggcgca

SEQ ID NO: 7672547 - DNA, 22 bp, Homo sapiens
gcagaagcagggcaggggcaaa

SEQ ID NO: 7672548 - DNA, 22 bp, Homo sapiens
gcagaagcagggcaggggcaaa

SEQ ID NO: 7672549 - DNA, 17 bp, Homo sapiens
gcagaaaagtcaaggga

SEQ ID NO: 7672550 - DNA, 17 bp, Homo sapiens
gcagaaaagtcaaggga

SEQ ID NO: 7672551 - DNA, 17 bp, Homo sapiens
gcagaaaagtcaaggga

SEQ ID NO: 7672552 - DNA, 17 bp, Homo sapiens
gcagaaaagtcaaggga

SEQ ID NO: 7672553 - DNA, 17 bp, Homo sapiens
gcagaaaagtcaaggga

SEQ ID NO: 7672554 - DNA, 23 bp, Homo sapiens
gcacttttataggtggggaaaca

SEQ ID NO: 7672555 - DNA, 17 bp, Homo sapiens
gcagaaaagtcaaggga

SEQ ID NO: 7672556 - DNA, 22 bp, Homo sapiens
gcacttttcaaagcttcctgtg

SEQ ID NO: 7672557 - DNA, 22 bp, Homo sapiens
gcacttttcaaagcttcctgtg

SEQ ID NO: 7672558 - DNA, 22 bp, Homo sapiens
gcacttttcaaagcttcctgtg

SEQ ID NO: 7672559 - DNA, 22 bp, Homo sapiens
gcactttaaatgttcacggaaa

SEQ ID NO: 7672560 - DNA, 22 bp, Homo sapiens
gcactttagcattggtttacac

SEQ ID NO: 7672561 - DNA, 22 bp, Homo sapiens
gcactttatagtagaaagagca

SEQ ID NO: 7672562 - DNA, 22 bp, Homo sapiens
gcactttcagcaggcagacaga

SEQ ID NO: 7672563 - DNA, 22 bp, Homo sapiens
gcactttgcccctcctttggca

SEQ ID NO: 7672564 - DNA, 22 bp, Homo sapiens
gcactttggaaaattttgagtt

SEQ ID NO: 7672565 - DNA, 22 bp, Homo sapiens
gcactttgtggattgtatttcc

SEQ ID NO: 7672566 - DNA, 22 bp, Homo sapiens
gcactttgtggattgtatttcc

SEQ ID NO: 7672567 - DNA, 22 bp, Homo sapiens
gcagaaaccacagtgtctttta

SEQ ID NO: 7672568 - DNA, 22 bp, Homo sapiens
gcagaaacttggagaagccagg

SEQ ID NO: 7672569 - DNA, 22 bp, Homo sapiens
gcagaaacttggagaagccagg

SEQ ID NO: 7672570 - DNA, 22 bp, Homo sapiens
gcagaaagctccttgcgatctg

SEQ ID NO: 7672571 - DNA, 22 bp, Homo sapiens
gcagaaagcttagagggtttgc

SEQ ID NO: 7672572 - DNA, 22 bp, Homo sapiens
gcagaaagcttagagggtttgc

SEQ ID NO: 7672573 - DNA, 22 bp, Homo sapiens
gcagaaagcttagagggtttgc

SEQ ID NO: 7672574 - DNA, 22 bp, Homo sapiens
gcagaaagcttagagggtttgc

SEQ ID NO: 7672575 - DNA, 21 bp, Homo sapiens
gcagaaaggaatcttaggtcc

SEQ ID NO: 7672576 - DNA, 21 bp, Homo sapiens
gcagaaaggaatcttaggtcc

SEQ ID NO: 7672577 - DNA, 21 bp, Homo sapiens
gcagaaaggaatcttaggtcc

SEQ ID NO: 7672578 - DNA, 22 bp, Homo sapiens
gcagaaagctccttgcgatctg

SEQ ID NO: 7672579 - DNA, 22 bp, Homo sapiens
gcagaaagctccttgcgatctg

SEQ ID NO: 7672580 - DNA, 22 bp, Homo sapiens
gcagaaagcttagagggtttgc

SEQ ID NO: 7672581 - DNA, 22 bp, Homo sapiens
gcagaaatatgatgcataaagg

SEQ ID NO: 7672582 - DNA, 22 bp, Homo sapiens
gcagaaatatgatgcataaagg

SEQ ID NO: 7672583 - DNA, 22 bp, Homo sapiens
gcagaaatatgatgcataaagg

SEQ ID NO: 7672584 - DNA, 21 bp, Homo sapiens
gcagaaaggaatcttaggtcc

SEQ ID NO: 7672585 - DNA, 21 bp, Homo sapiens
gcagaaaggaatcttaggtcc

SEQ ID NO: 7672586 - DNA, 21 bp, Homo sapiens
gcagaaaggaatcttaggtcc

SEQ ID NO: 7672587 - DNA, 22 bp, Homo sapiens
gcagaacaacgtaggagtggag

SEQ ID NO: 7672588 - DNA, 22 bp, Homo sapiens
gcagaacaacgtaggagtggag

SEQ ID NO: 7672589 - DNA, 23 bp, Homo sapiens
gcagaaattctcacactgaggcc

SEQ ID NO: 7672590 - DNA, 23 bp, Homo sapiens
gcagaaattctcacactgaggcc

SEQ ID NO: 7672591 - DNA, 23 bp, Homo sapiens
gcaccccagatgtgattagttag

SEQ ID NO: 7672592 - DNA, 19 bp, Homo sapiens
gcaccccatcttcctcctg

SEQ ID NO: 7672593 - DNA, 19 bp, Homo sapiens
gcaccccatcttcctcctg

SEQ ID NO: 7672594 - DNA, 19 bp, Homo sapiens
gcaccccatcttcctcctg

SEQ ID NO: 7672595 - DNA, 22 bp, Homo sapiens
gcacccctgcgtgccttccctt

SEQ ID NO: 7672596 - DNA, 22 bp, Homo sapiens
gcacccctcagcttgtttacta

SEQ ID NO: 7672597 - DNA, 22 bp, Homo sapiens
gcacccctgcgtgccttccctt

SEQ ID NO: 7672598 - DNA, 19 bp, Homo sapiens
gcaccccatcttcctcctg

SEQ ID NO: 7672599 - DNA, 22 bp, Homo sapiens
gcacccctgcgtgccttccctt

SEQ ID NO: 7672600 - DNA, 22 bp, Homo sapiens
gcacccctggacggtagggcca

SEQ ID NO: 7672601 - DNA, 22 bp, Homo sapiens
gcacccctggacggtagggcca

SEQ ID NO: 7672602 - DNA, 22 bp, Homo sapiens
gcaccctctgagctccgctccg

SEQ ID NO: 7672603 - DNA, 22 bp, Homo sapiens
gcaccctctgagctccgctccg

SEQ ID NO: 7672604 - DNA, 22 bp, Homo sapiens
gcaccctagagttgcctgagga

SEQ ID NO: 7672605 - DNA, 22 bp, Homo sapiens
gcacccctggacggtagggcca

SEQ ID NO: 7672606 - DNA, 19 bp, Homo sapiens
gcaccctgaggtcatggcc

SEQ ID NO: 7672607 - DNA, 19 bp, Homo sapiens
gcaccctgaggtcatggcc

SEQ ID NO: 7672608 - DNA, 19 bp, Homo sapiens
gcaccctgaggtcatggcc

SEQ ID NO: 7672609 - DNA, 19 bp, Homo sapiens
gcaccctgaggtcatggcc

SEQ ID NO: 7672610 - DNA, 19 bp, Homo sapiens
gcaccctgaggtcatggcc

SEQ ID NO: 7672611 - DNA, 19 bp, Homo sapiens
gcaccctgaggtcatggcc

SEQ ID NO: 7672612 - DNA, 19 bp, Homo sapiens
gcaccctgaggtcatggcc

SEQ ID NO: 7672613 - DNA, 22 bp, Homo sapiens
gcaccctgctctatccttgcta

SEQ ID NO: 7672614 - DNA, 22 bp, Homo sapiens
gcaccctgctctatccttgcta

SEQ ID NO: 7672615 - DNA, 22 bp, Homo sapiens
gcaccctgctctatccttgcta

SEQ ID NO: 7672616 - DNA, 22 bp, Homo sapiens
gcaccctgagtgttcagctcca

SEQ ID NO: 7672617 - DNA, 22 bp, Homo sapiens
gcaccctgagtgttcagctcca

SEQ ID NO: 7672618 - DNA, 19 bp, Homo sapiens
gcaccctggccactcccac

SEQ ID NO: 7672619 - DNA, 22 bp, Homo sapiens
gcaccctggctctctggaatgg

SEQ ID NO: 7672620 - DNA, 22 bp, Homo sapiens
gcaccctgtcaaaatggaccaa

SEQ ID NO: 7672621 - DNA, 19 bp, Homo sapiens
gcaccctggccactcccac

SEQ ID NO: 7672622 - DNA, 22 bp, Homo sapiens
gcaccctggctctctggaatgg

SEQ ID NO: 7672623 - DNA, 22 bp, Homo sapiens
gcaccctggctctctggaatgg

SEQ ID NO: 7672624 - DNA, 22 bp, Homo sapiens
gcaccctgtcaaaatggaccaa

SEQ ID NO: 7672625 - DNA, 22 bp, Homo sapiens
gcaccgagaaggaagcatgcct

SEQ ID NO: 7672626 - DNA, 22 bp, Homo sapiens
gcacccttgctgccaagtggat

SEQ ID NO: 7672627 - DNA, 22 bp, Homo sapiens
gcaccgagaaggaagcatgcct

SEQ ID NO: 7672628 - DNA, 22 bp, Homo sapiens
gcaccgccttggaccgcccgct

SEQ ID NO: 7672629 - DNA, 22 bp, Homo sapiens
gcaccgccttggaccgcccgct

SEQ ID NO: 7672630 - DNA, 22 bp, Homo sapiens
gcaccctgtttatcctgagttc

SEQ ID NO: 7672631 - DNA, 22 bp, Homo sapiens
gcaccctgtcaaaatggaccaa

SEQ ID NO: 7672632 - DNA, 22 bp, Homo sapiens
gcaccctgtttatcctgagttc

SEQ ID NO: 7672633 - DNA, 22 bp, Homo sapiens
gcaccctgtttatcctgagttc

SEQ ID NO: 7672634 - DNA, 22 bp, Homo sapiens
gcaccctgtttatcctgagttc

SEQ ID NO: 7672635 - DNA, 22 bp, Homo sapiens
gcaccgccttggaccgcccgct

SEQ ID NO: 7672636 - DNA, 22 bp, Homo sapiens
gcaccgccttggaccgcccgct

SEQ ID NO: 7672637 - DNA, 22 bp, Homo sapiens
gcaccgccttggaccgcccgct

SEQ ID NO: 7672638 - DNA, 22 bp, Homo sapiens
gcaccgccttggaccgcccgct

SEQ ID NO: 7672639 - DNA, 22 bp, Homo sapiens
gcacctgaacgacctgctccag

SEQ ID NO: 7672640 - DNA, 20 bp, Homo sapiens
gcacctgaatgcatcttgga

SEQ ID NO: 7672641 - DNA, 22 bp, Homo sapiens
gcacctccaggggccgcccacc

SEQ ID NO: 7672642 - DNA, 22 bp, Homo sapiens
gcacctccaggggccgcccacc

SEQ ID NO: 7672643 - DNA, 22 bp, Homo sapiens
gcacctgaacgacctgctccag

SEQ ID NO: 7672644 - DNA, 22 bp, Homo sapiens
gcacctgattgatttcactgct

SEQ ID NO: 7672645 - DNA, 22 bp, Homo sapiens
gcacctgaacgacctgctccag

SEQ ID NO: 7672646 - DNA, 22 bp, Homo sapiens
gcacctgaggaggcatctggag

SEQ ID NO: 7672647 - DNA, 22 bp, Homo sapiens
gcacctccaggggccgcccacc

SEQ ID NO: 7672648 - DNA, 22 bp, Homo sapiens
gcacctccaggggccgcccacc

SEQ ID NO: 7672649 - DNA, 22 bp, Homo sapiens
gcacctccaggggccgcccacc

SEQ ID NO: 7672650 - DNA, 17 bp, Homo sapiens
gcaccgtgggcacactc

SEQ ID NO: 7672651 - DNA, 17 bp, Homo sapiens
gcaccgtgggcacactc

SEQ ID NO: 7672652 - DNA, 22 bp, Homo sapiens
gcaccgttcactctccgccaga

SEQ ID NO: 7672653 - DNA, 22 bp, Homo sapiens
gcacctcattttgcaggtagaa

SEQ ID NO: 7672654 - DNA, 22 bp, Homo sapiens
gcacctcattttgcaggtagaa

SEQ ID NO: 7672655 - DNA, 22 bp, Homo sapiens
gcacctgcaggatgagccaggg

SEQ ID NO: 7672656 - DNA, 22 bp, Homo sapiens
gcacctgcaggatgagccaggg

SEQ ID NO: 7672657 - DNA, 22 bp, Homo sapiens
gcacctgagcaactatacattg

SEQ ID NO: 7672658 - DNA, 22 bp, Homo sapiens
gcacctgattgatttcactgct

SEQ ID NO: 7672659 - DNA, 22 bp, Homo sapiens
gcacctgcctgggactgaagat

SEQ ID NO: 7672660 - DNA, 22 bp, Homo sapiens
gcacctgctcacacatgtgact

SEQ ID NO: 7672661 - DNA, 22 bp, Homo sapiens
gcacctgctggaatcagtctgt

SEQ ID NO: 7672662 - DNA, 22 bp, Homo sapiens
gcacctgctggaatcagtctgt

SEQ ID NO: 7672663 - DNA, 22 bp, Homo sapiens
gcactttaaagtttggtggcat

SEQ ID NO: 7672664 - DNA, 22 bp, Homo sapiens
gcacttggtaggacttcagtga

SEQ ID NO: 7672665 - DNA, 22 bp, Homo sapiens
gcacttgtggatttgatataca

SEQ ID NO: 7672666 - DNA, 22 bp, Homo sapiens
gcacttggcctttatctgggga

SEQ ID NO: 7672667 - DNA, 20 bp, Homo sapiens
gcacttggctgctgcttctc

SEQ ID NO: 7672668 - DNA, 20 bp, Homo sapiens
gcacttggctgctgcttctc

SEQ ID NO: 7672669 - DNA, 20 bp, Homo sapiens
gcacttggctgctgcttctc

SEQ ID NO: 7672670 - DNA, 22 bp, Homo sapiens
gcacttgggcagagacgcacag

SEQ ID NO: 7672671 - DNA, 22 bp, Homo sapiens
gcacttgggcagagacgcacag

SEQ ID NO: 7672672 - DNA, 21 bp, Homo sapiens
gcacttggggattcagggagg

SEQ ID NO: 7672673 - DNA, 21 bp, Homo sapiens
gcacttggggattcagggagg

SEQ ID NO: 7672674 - DNA, 21 bp, Homo sapiens
gcacttggggattcagggagg

SEQ ID NO: 7672675 - DNA, 22 bp, Homo sapiens
gcacctgctgggtgtagaggct

SEQ ID NO: 7672676 - DNA, 22 bp, Homo sapiens
gcacctgctgggtgtagaggct

SEQ ID NO: 7672677 - DNA, 22 bp, Homo sapiens
gcacctgctggaatcagtctgt

SEQ ID NO: 7672678 - DNA, 22 bp, Homo sapiens
gcacctgctggggctgatgaga

SEQ ID NO: 7672679 - DNA, 22 bp, Homo sapiens
gcacctggacagtgaccctagc

SEQ ID NO: 7672680 - DNA, 22 bp, Homo sapiens
gcacttggcctttatctgggga

SEQ ID NO: 7672681 - DNA, 22 bp, Homo sapiens
gcacctggctgcccaggtggag

SEQ ID NO: 7672682 - DNA, 22 bp, Homo sapiens
gcacctggctgcccaggtggag

SEQ ID NO: 7672683 - DNA, 22 bp, Homo sapiens
gcacctggctgcccaggtggag

SEQ ID NO: 7672684 - DNA, 22 bp, Homo sapiens
gcacctggacagtgaccctagc

SEQ ID NO: 7672685 - DNA, 22 bp, Homo sapiens
gcacacacatgtgagtacatgc

SEQ ID NO: 7672686 - DNA, 22 bp, Homo sapiens
gcacacacatgtgagtacatgc

SEQ ID NO: 7672687 - DNA, 22 bp, Homo sapiens
gcacacacatgtgagtacatgc

SEQ ID NO: 7672688 - DNA, 22 bp, Homo sapiens
gcacacactgttttcctcacat

SEQ ID NO: 7672689 - DNA, 22 bp, Homo sapiens
gcacacactgttttcctcacat

SEQ ID NO: 7672690 - DNA, 22 bp, Homo sapiens
gcacacactgttttcctcacat

SEQ ID NO: 7672691 - DNA, 22 bp, Homo sapiens
gcacccaggccggcgactgcag

SEQ ID NO: 7672692 - DNA, 22 bp, Homo sapiens
gcacccaggccggcgactgcag

SEQ ID NO: 7672693 - DNA, 22 bp, Homo sapiens
gcacccaggcactttcctttct

SEQ ID NO: 7672694 - DNA, 22 bp, Homo sapiens
gcacacactgttttcctcacat

SEQ ID NO: 7672695 - DNA, 22 bp, Homo sapiens
gcacacactgttttcctcacat

SEQ ID NO: 7672696 - DNA, 22 bp, Homo sapiens
gcacccaggcactttcctttct

SEQ ID NO: 7672697 - DNA, 22 bp, Homo sapiens
gcacaataacagccaaggttat

SEQ ID NO: 7672698 - DNA, 22 bp, Homo sapiens
gcacaagtttcttcattgttca

SEQ ID NO: 7672699 - DNA, 22 bp, Homo sapiens
gcacaattatttatgcagtatg

SEQ ID NO: 7672700 - DNA, 22 bp, Homo sapiens
gcacaatggaccgtgtgctctg

SEQ ID NO: 7672701 - DNA, 22 bp, Homo sapiens
gcacaataatttttttaagagg

SEQ ID NO: 7672702 - DNA, 22 bp, Homo sapiens
gcacaataatttttttaagagg

SEQ ID NO: 7672703 - DNA, 22 bp, Homo sapiens
gcacaatggaccgtgtgctctg

SEQ ID NO: 7672704 - DNA, 22 bp, Homo sapiens
gcacaatggaccgtgtgctctg

SEQ ID NO: 7672705 - DNA, 16 bp, Homo sapiens
gcacacacatcaatga

SEQ ID NO: 7672706 - DNA, 22 bp, Homo sapiens
gcacacacatgtgagtacatgc

SEQ ID NO: 7672707 - DNA, 22 bp, Homo sapiens
gcacacacatgtgagtacatgc

SEQ ID NO: 7672708 - DNA, 22 bp, Homo sapiens
gcacaattccatgggacagccc

SEQ ID NO: 7672709 - DNA, 22 bp, Homo sapiens
gcacaattccatgggacagccc

SEQ ID NO: 7672710 - DNA, 16 bp, Homo sapiens
gcacacacatcaatga

SEQ ID NO: 7672711 - DNA, 22 bp, Homo sapiens
gcacaatttgactctattcata

SEQ ID NO: 7672712 - DNA, 16 bp, Homo sapiens
gcacacacatcaatga

SEQ ID NO: 7672713 - DNA, 22 bp, Homo sapiens
gcacccaggccggcgactgcag

SEQ ID NO: 7672714 - DNA, 22 bp, Homo sapiens
gcacccaggccggcgactgcag

SEQ ID NO: 7672715 - DNA, 22 bp, Homo sapiens
gcacccaggcttgggcagcaac

SEQ ID NO: 7672716 - DNA, 22 bp, Homo sapiens
gcacccaggcttgggcagcaac

SEQ ID NO: 7672717 - DNA, 22 bp, Homo sapiens
gcacccaggcttgggcagcaac

SEQ ID NO: 7672718 - DNA, 22 bp, Homo sapiens
gcacccaggcttgggcagcaac

SEQ ID NO: 7672719 - DNA, 22 bp, Homo sapiens
gcacccagggcaggaagtgagg

SEQ ID NO: 7672720 - DNA, 22 bp, Homo sapiens
gcacccagggcaggaagtgagg

SEQ ID NO: 7672721 - DNA, 22 bp, Homo sapiens
gcacccagggacttggctggcc

SEQ ID NO: 7672722 - DNA, 22 bp, Homo sapiens
gcacccagggacttggctggcc

SEQ ID NO: 7672723 - DNA, 22 bp, Homo sapiens
gcacccaggcttgggcagcaac

SEQ ID NO: 7672724 - DNA, 22 bp, Homo sapiens
gcacccaggcttgggcagcaac

SEQ ID NO: 7672725 - DNA, 22 bp, Homo sapiens
gcacccagggacttggctggcc

SEQ ID NO: 7672726 - DNA, 22 bp, Homo sapiens
gcacccagggacttggctggcc

SEQ ID NO: 7672727 - DNA, 22 bp, Homo sapiens
gcacccagggacttggctggcc

SEQ ID NO: 7672728 - DNA, 22 bp, Homo sapiens
gcacccagggcaggaagtgagg

SEQ ID NO: 7672729 - DNA, 22 bp, Homo sapiens
gcacccagggcaggaagtgagg

SEQ ID NO: 7672730 - DNA, 22 bp, Homo sapiens
gcacccagggcaggaagtgagg

SEQ ID NO: 7672731 - DNA, 22 bp, Homo sapiens
gcacccagtttgtctcagggtt

SEQ ID NO: 7672732 - DNA, 22 bp, Homo sapiens
gcacccagtgggatgcttagca

SEQ ID NO: 7672733 - DNA, 22 bp, Homo sapiens
gcacccagtgggatgcttagca

SEQ ID NO: 7672734 - DNA, 22 bp, Homo sapiens
gcacccagtttgtctcagggtt

SEQ ID NO: 7672735 - DNA, 22 bp, Homo sapiens
gcacccagtttgtctcagggtt

SEQ ID NO: 7672736 - DNA, 22 bp, Homo sapiens
gcacccatgctcttgtctcagg

SEQ ID NO: 7672737 - DNA, 23 bp, Homo sapiens
gcaccccagatgtgattagttag

SEQ ID NO: 7672738 - DNA, 23 bp, Homo sapiens
gcaccccagatgtgattagttag

SEQ ID NO: 7672739 - DNA, 22 bp, Homo sapiens
gcacccagtttgtctcagggtt

SEQ ID NO: 7672740 - DNA, 22 bp, Homo sapiens
gcacccagtttgtctcagggtt

SEQ ID NO: 7672741 - DNA, 22 bp, Homo sapiens
gcacccagtttgtctcagggtt

SEQ ID NO: 7672742 - DNA, 22 bp, Homo sapiens
gagtctatctcactcccccagg

SEQ ID NO: 7672743 - DNA, 22 bp, Homo sapiens
gagtctaagtagaatgtgaaaa

SEQ ID NO: 7672744 - DNA, 22 bp, Homo sapiens
gagtctaagtagaatgtgaaaa

SEQ ID NO: 7672745 - DNA, 22 bp, Homo sapiens
gagtctagctgcagaggaccct

SEQ ID NO: 7672746 - DNA, 22 bp, Homo sapiens
gagtcgagcagaaagccgtcgg

SEQ ID NO: 7672747 - DNA, 22 bp, Homo sapiens
gagtctcctactggctgtcctt

SEQ ID NO: 7672748 - DNA, 22 bp, Homo sapiens
gagtcggaggcaggagacctgg

SEQ ID NO: 7672749 - DNA, 18 bp, Homo sapiens
gagtcgtcggagagtctg

SEQ ID NO: 7672750 - DNA, 22 bp, Homo sapiens
gagtcgagcagaaagccgtcgg

SEQ ID NO: 7672751 - DNA, 22 bp, Homo sapiens
gagtctaaggaaaaatagagta

SEQ ID NO: 7672752 - DNA, 22 bp, Homo sapiens
gagtctaagtagaatgtgaaaa

SEQ ID NO: 7672753 - DNA, 22 bp, Homo sapiens
gagtctctgaccagggtgccaa

SEQ ID NO: 7672754 - DNA, 22 bp, Homo sapiens
gagtctctggaggggtcagacc

SEQ ID NO: 7672755 - DNA, 22 bp, Homo sapiens
gagtctccaatccatgcctgtc

SEQ ID NO: 7672756 - DNA, 22 bp, Homo sapiens
gagtccttctggctggcaggat

SEQ ID NO: 7672757 - DNA, 22 bp, Homo sapiens
gagtccttgacacatagtaggt

SEQ ID NO: 7672758 - DNA, 22 bp, Homo sapiens
gagtccttccagcaggcattta

SEQ ID NO: 7672759 - DNA, 22 bp, Homo sapiens
gagtccttccagcaggcattta

SEQ ID NO: 7672760 - DNA, 22 bp, Homo sapiens
gagtccttgtcataattcagtg

SEQ ID NO: 7672761 - DNA, 22 bp, Homo sapiens
gagtcctttgttccttgccaca

SEQ ID NO: 7672762 - DNA, 22 bp, Homo sapiens
gagtccttttgtgccacaggga

SEQ ID NO: 7672763 - DNA, 22 bp, Homo sapiens
gagtccttttctctgtccactg

SEQ ID NO: 7672764 - DNA, 22 bp, Homo sapiens
gagtcgagcagaaagccgtcgg

SEQ ID NO: 7672765 - DNA, 22 bp, Homo sapiens
gagtcgagcagaaagccgtcgg

SEQ ID NO: 7672766 - DNA, 22 bp, Homo sapiens
gagtcgagcagaaagccgtcgg

SEQ ID NO: 7672767 - DNA, 22 bp, Homo sapiens
gagtcctgttgtcccagatggg

SEQ ID NO: 7672768 - DNA, 22 bp, Homo sapiens
gagtcctgttgtcccagatggg

SEQ ID NO: 7672769 - DNA, 22 bp, Homo sapiens
gagtcctgttgtcccagatggg

SEQ ID NO: 7672770 - DNA, 22 bp, Homo sapiens
gagtcctgttttgaggacttga

SEQ ID NO: 7672771 - DNA, 22 bp, Homo sapiens
gagtcctgttttgaggacttga

SEQ ID NO: 7672772 - DNA, 22 bp, Homo sapiens
gagtcctgttttgaggacttga

SEQ ID NO: 7672773 - DNA, 20 bp, Homo sapiens
gagtccttatgggctgaggt

SEQ ID NO: 7672774 - DNA, 20 bp, Homo sapiens
gagtccttatgggctgaggt

SEQ ID NO: 7672775 - DNA, 22 bp, Homo sapiens
gagtccttaatacactggtgga

SEQ ID NO: 7672776 - DNA, 21 bp, Homo sapiens
gagtccttccaatgtcctcag

SEQ ID NO: 7672777 - DNA, 21 bp, Homo sapiens
gagtccttccaatgtcctcag

SEQ ID NO: 7672778 - DNA, 22 bp, Homo sapiens
gagtcctgtaactttcttccta

SEQ ID NO: 7672779 - DNA, 22 bp, Homo sapiens
gagtcctgtaactttcttccta

SEQ ID NO: 7672780 - DNA, 22 bp, Homo sapiens
gagtcctgtaactttcttccta

SEQ ID NO: 7672781 - DNA, 22 bp, Homo sapiens
gagtcctgggtcacggcctctt

SEQ ID NO: 7672782 - DNA, 22 bp, Homo sapiens
gagtcctgggtcacggcctctt

SEQ ID NO: 7672783 - DNA, 21 bp, Homo sapiens
gagtcctggctagggtggcag

SEQ ID NO: 7672784 - DNA, 21 bp, Homo sapiens
gagtcctggctagggtggcag

SEQ ID NO: 7672785 - DNA, 22 bp, Homo sapiens
gagtcctgggtcacggcctctt

SEQ ID NO: 7672786 - DNA, 19 bp, Homo sapiens
gagtcctgtgctccttgtt

SEQ ID NO: 7672787 - DNA, 19 bp, Homo sapiens
gagtcctgtgctccttgtt

SEQ ID NO: 7672788 - DNA, 19 bp, Homo sapiens
gagtcctgtgctccttgtt

SEQ ID NO: 7672789 - DNA, 19 bp, Homo sapiens
gagtcctgtgctccttgtt

SEQ ID NO: 7672790 - DNA, 19 bp, Homo sapiens
gagtcctgtgctccttgtt

SEQ ID NO: 7672791 - DNA, 22 bp, Homo sapiens
gagtcctgatccttagctctcc

SEQ ID NO: 7672792 - DNA, 22 bp, Homo sapiens
gagtcctgatccttagctctcc

SEQ ID NO: 7672793 - DNA, 22 bp, Homo sapiens
gagtcctgatccttagctctcc

SEQ ID NO: 7672794 - DNA, 22 bp, Homo sapiens
gagtcctgcccttgtgtagtcc

SEQ ID NO: 7672795 - DNA, 22 bp, Homo sapiens
gagtcctgcccttgtgtagtcc

SEQ ID NO: 7672796 - DNA, 22 bp, Homo sapiens
gagtcctgcccttgtgtagtcc

SEQ ID NO: 7672797 - DNA, 22 bp, Homo sapiens
gagtcctgctttcaattctttt

SEQ ID NO: 7672798 - DNA, 22 bp, Homo sapiens
gagtcctggaaccctgaatgct

SEQ ID NO: 7672799 - DNA, 22 bp, Homo sapiens
gagtcctggaaccctgaatgct

SEQ ID NO: 7672800 - DNA, 22 bp, Homo sapiens
gagtcctggagaaacgcaggtg

SEQ ID NO: 7672801 - DNA, 22 bp, Homo sapiens
gagtcctggagaaacgcaggtg

SEQ ID NO: 7672802 - DNA, 22 bp, Homo sapiens
gagtcctggagaaacgcaggtg

SEQ ID NO: 7672803 - DNA, 22 bp, Homo sapiens
gagtcctggaaccctgaatgct

SEQ ID NO: 7672804 - DNA, 22 bp, Homo sapiens
gagtcctggaaccctgaatgct

SEQ ID NO: 7672805 - DNA, 22 bp, Homo sapiens
gagtcctggagaaacgcaggtg

SEQ ID NO: 7672806 - DNA, 22 bp, Homo sapiens
gagtcctggagagcccgagcgc

SEQ ID NO: 7672807 - DNA, 22 bp, Homo sapiens
gagtcctggagagcccgagcgc

SEQ ID NO: 7672808 - DNA, 22 bp, Homo sapiens
gagtcctggcgtccaatttcct

SEQ ID NO: 7672809 - DNA, 21 bp, Homo sapiens
gagtcctggctagggtggcag

SEQ ID NO: 7672810 - DNA, 18 bp, Homo sapiens
gagtctttgttactgctg

SEQ ID NO: 7672811 - DNA, 22 bp, Homo sapiens
gagtgaaaaaggaagggccata

SEQ ID NO: 7672812 - DNA, 22 bp, Homo sapiens
gagtgacggctcatctctggaa

SEQ ID NO: 7672813 - DNA, 22 bp, Homo sapiens
gagtgactctagaaagtttctt

SEQ ID NO: 7672814 - DNA, 22 bp, Homo sapiens
gagtctttggtaaagtctgctg

SEQ ID NO: 7672815 - DNA, 18 bp, Homo sapiens
gagtctttgttactgctg

SEQ ID NO: 7672816 - DNA, 22 bp, Homo sapiens
gagtcttaggcaaaaataatgg

SEQ ID NO: 7672817 - DNA, 22 bp, Homo sapiens
gagtctggtgatggtcattgtc

SEQ ID NO: 7672818 - DNA, 22 bp, Homo sapiens
gagtctgtatgtcttccatgca

SEQ ID NO: 7672819 - DNA, 22 bp, Homo sapiens
gagtcttctacgctcacacaaa

SEQ ID NO: 7672820 - DNA, 22 bp, Homo sapiens
gagtcttctacgctcacacaaa

SEQ ID NO: 7672821 - DNA, 22 bp, Homo sapiens
gagtcttctgagttattggata

SEQ ID NO: 7672822 - DNA, 22 bp, Homo sapiens
gagtcttctgagttattggata

SEQ ID NO: 7672823 - DNA, 22 bp, Homo sapiens
gagtctttctgggcttgttctt

SEQ ID NO: 7672824 - DNA, 22 bp, Homo sapiens
gagtctttctgggcttgttctt

SEQ ID NO: 7672825 - DNA, 22 bp, Homo sapiens
gagtctggtgatggtcattgtc

SEQ ID NO: 7672826 - DNA, 22 bp, Homo sapiens
gagtctggtcattttctctccc

SEQ ID NO: 7672827 - DNA, 22 bp, Homo sapiens
gagtctggtcattttctctccc

SEQ ID NO: 7672828 - DNA, 22 bp, Homo sapiens
gagtctggccctgatgcatcat

SEQ ID NO: 7672829 - DNA, 22 bp, Homo sapiens
gagtctggccctgatgcatcat

SEQ ID NO: 7672830 - DNA, 22 bp, Homo sapiens
gagtctggccctgatgcatcat

SEQ ID NO: 7672831 - DNA, 22 bp, Homo sapiens
gagtctggccctgatgcatcat

SEQ ID NO: 7672832 - DNA, 22 bp, Homo sapiens
gagtctggactattctggtctt

SEQ ID NO: 7672833 - DNA, 22 bp, Homo sapiens
gagtctggactattctggtctt

SEQ ID NO: 7672834 - DNA, 22 bp, Homo sapiens
gagtctggaatgatgaagacct

SEQ ID NO: 7672835 - DNA, 22 bp, Homo sapiens
gagtctggccctgatgcatcat

SEQ ID NO: 7672836 - DNA, 22 bp, Homo sapiens
gagtctggccctgatgcatcat

SEQ ID NO: 7672837 - DNA, 22 bp, Homo sapiens
gagtctggactattctggtctt

SEQ ID NO: 7672838 - DNA, 22 bp, Homo sapiens
gagtctggccctgatgcatcat

SEQ ID NO: 7672839 - DNA, 22 bp, Homo sapiens
gagtctgagagcctaatgacct

SEQ ID NO: 7672840 - DNA, 22 bp, Homo sapiens
gagtctgagaactgggctcagt

SEQ ID NO: 7672841 - DNA, 22 bp, Homo sapiens
gagtctggaatgatgaagacct

SEQ ID NO: 7672842 - DNA, 22 bp, Homo sapiens
gagtctggaatgatgaagacct

SEQ ID NO: 7672843 - DNA, 22 bp, Homo sapiens
gagtctggaatgatgaagacct

SEQ ID NO: 7672844 - DNA, 22 bp, Homo sapiens
gagtctgatgtcccccaggcca

SEQ ID NO: 7672845 - DNA, 22 bp, Homo sapiens
gagtctggaaactttgacaaaa

SEQ ID NO: 7672846 - DNA, 22 bp, Homo sapiens
gagtctgagtctaatggcccca

SEQ ID NO: 7672847 - DNA, 22 bp, Homo sapiens
gagtgagggcagcaggggctgc

SEQ ID NO: 7672848 - DNA, 22 bp, Homo sapiens
gagtgagggccaacatccagct

SEQ ID NO: 7672849 - DNA, 22 bp, Homo sapiens
gagtgagggccaacatccagct

SEQ ID NO: 7672850 - DNA, 22 bp, Homo sapiens
gagtgagggccaacatccagct

SEQ ID NO: 7672851 - DNA, 22 bp, Homo sapiens
gagtgagggccaacatccagct

SEQ ID NO: 7672852 - DNA, 22 bp, Homo sapiens
gagtgagggccaacatccagct

SEQ ID NO: 7672853 - DNA, 22 bp, Homo sapiens
gagtgagggcagcaggggctgc

SEQ ID NO: 7672854 - DNA, 22 bp, Homo sapiens
gagtgagggcagcaggggctgc

SEQ ID NO: 7672855 - DNA, 22 bp, Homo sapiens
gagtgagggcagcaggggctgc

SEQ ID NO: 7672856 - DNA, 22 bp, Homo sapiens
gagtgagggcagcaggggctgc

SEQ ID NO: 7672857 - DNA, 22 bp, Homo sapiens
gagtgagggcagcaggggctgc

SEQ ID NO: 7672858 - DNA, 22 bp, Homo sapiens
gagtgagggcagcaggggctgc

SEQ ID NO: 7672859 - DNA, 22 bp, Homo sapiens
gagtgaggctggaatcatggct

SEQ ID NO: 7672860 - DNA, 22 bp, Homo sapiens
gagtgaggctggaatcatggct

SEQ ID NO: 7672861 - DNA, 22 bp, Homo sapiens
gagtgaggctggaatcatggct

SEQ ID NO: 7672862 - DNA, 22 bp, Homo sapiens
gagtgaggctggaatcatggct

SEQ ID NO: 7672863 - DNA, 22 bp, Homo sapiens
gagtgaggctggaatcatggct

SEQ ID NO: 7672864 - DNA, 22 bp, Homo sapiens
gagtgagtgctgggctgaggct

SEQ ID NO: 7672865 - DNA, 22 bp, Homo sapiens
gagtgagtagctacagttttta

SEQ ID NO: 7672866 - DNA, 22 bp, Homo sapiens
gagtgagtgctgggctgaggct

SEQ ID NO: 7672867 - DNA, 22 bp, Homo sapiens
gagtgagtggccaggaggcaga

SEQ ID NO: 7672868 - DNA, 22 bp, Homo sapiens
gagtgagtggccaggaggcaga

SEQ ID NO: 7672869 - DNA, 22 bp, Homo sapiens
gagtgagttggaaaacagacac

SEQ ID NO: 7672870 - DNA, 22 bp, Homo sapiens
gagtgatgcttctatggaacca

SEQ ID NO: 7672871 - DNA, 18 bp, Homo sapiens
gagtgatgaccgtgccag

SEQ ID NO: 7672872 - DNA, 22 bp, Homo sapiens
gagtgatgcttctatggaacca

SEQ ID NO: 7672873 - DNA, 22 bp, Homo sapiens
gagtgatgtctgtagtgaagaa

SEQ ID NO: 7672874 - DNA, 19 bp, Homo sapiens
gagtgattgcagggaccct

SEQ ID NO: 7672875 - DNA, 22 bp, Homo sapiens
gagtgcaatgtagacatcaggg

SEQ ID NO: 7672876 - DNA, 22 bp, Homo sapiens
gagtgcaatgtagacatcaggg

SEQ ID NO: 7672877 - DNA, 22 bp, Homo sapiens
gagtgcaatgtagacatcaggg

SEQ ID NO: 7672878 - DNA, 22 bp, Homo sapiens
gagtgcagaaattcccttcctg

SEQ ID NO: 7672879 - DNA, 22 bp, Homo sapiens
gagtgcaataaactgttttcta

SEQ ID NO: 7672880 - DNA, 22 bp, Homo sapiens
gagtgcaagttttgggtttctt

SEQ ID NO: 7672881 - DNA, 22 bp, Homo sapiens
gagtgcaataaactgttttcta

SEQ ID NO: 7672882 - DNA, 22 bp, Homo sapiens
gagtgcaatggcatgatctggg

SEQ ID NO: 7672883 - DNA, 22 bp, Homo sapiens
gagtgattgctcctttaaactt

SEQ ID NO: 7672884 - DNA, 22 bp, Homo sapiens
gagtgattgctcctttaaactt

SEQ ID NO: 7672885 - DNA, 22 bp, Homo sapiens
gagtgattggagttagcattct

SEQ ID NO: 7672886 - DNA, 22 bp, Homo sapiens
gagtgattggagttagcattct

SEQ ID NO: 7672887 - DNA, 22 bp, Homo sapiens
gagtgatttaagctatttttaa

SEQ ID NO: 7672888 - DNA, 22 bp, Homo sapiens
gagtgatttaagctatttttaa

SEQ ID NO: 7672889 - DNA, 22 bp, Homo sapiens
gagtgatttccagagagacgtt

SEQ ID NO: 7672890 - DNA, 22 bp, Homo sapiens
gagtgccagatggacctcttgg

SEQ ID NO: 7672891 - DNA, 22 bp, Homo sapiens
gagtgccaagagaagaggctgg

SEQ ID NO: 7672892 - DNA, 22 bp, Homo sapiens
gagtgccaagagaagaggctgg

SEQ ID NO: 7672893 - DNA, 22 bp, Homo sapiens
gagtgcagttggggtgagggga

SEQ ID NO: 7672894 - DNA, 22 bp, Homo sapiens
gagtgcagttggggtgagggga

SEQ ID NO: 7672895 - DNA, 22 bp, Homo sapiens
gagtgcagttggggtgagggga

SEQ ID NO: 7672896 - DNA, 22 bp, Homo sapiens
gagtgcagttggggtgagggga

SEQ ID NO: 7672897 - DNA, 21 bp, Homo sapiens
gagtgctcagttaagtggaga

SEQ ID NO: 7672898 - DNA, 22 bp, Homo sapiens
gagtgctccgtcttggacaggg

SEQ ID NO: 7672899 - DNA, 22 bp, Homo sapiens
gagtgctcgggcctctgcctgc

SEQ ID NO: 7672900 - DNA, 22 bp, Homo sapiens
gagtgctgaatgcgagaacaga

SEQ ID NO: 7672901 - DNA, 22 bp, Homo sapiens
gagtgcgtgtttggggatgtgg

SEQ ID NO: 7672902 - DNA, 16 bp, Homo sapiens
gagtgctagaatcggg

SEQ ID NO: 7672903 - DNA, 22 bp, Homo sapiens
gagtgctagcattagtatataa

SEQ ID NO: 7672904 - DNA, 22 bp, Homo sapiens
gagtgcctggggcatctcctgc

SEQ ID NO: 7672905 - DNA, 18 bp, Homo sapiens
gagtgcggtggtgcacac

SEQ ID NO: 7672906 - DNA, 22 bp, Homo sapiens
gagtgccttccccatgctttgg

SEQ ID NO: 7672907 - DNA, 22 bp, Homo sapiens
gagtgcagtatgagaggctgct

SEQ ID NO: 7672908 - DNA, 22 bp, Homo sapiens
gagtgcagtatgagaggctgct

SEQ ID NO: 7672909 - DNA, 22 bp, Homo sapiens
gagtgcagtatgagaggctgct

SEQ ID NO: 7672910 - DNA, 22 bp, Homo sapiens
gagtgcagtatgagaggctgct

SEQ ID NO: 7672911 - DNA, 22 bp, Homo sapiens
gagtgcagtatgagaggctgct

SEQ ID NO: 7672912 - DNA, 22 bp, Homo sapiens
gagtgcagttggggtgagggga

SEQ ID NO: 7672913 - DNA, 22 bp, Homo sapiens
gagtgcagtggcgtgatctctg

SEQ ID NO: 7672914 - DNA, 22 bp, Homo sapiens
gagtgcagtatgagaggctgct

SEQ ID NO: 7672915 - DNA, 22 bp, Homo sapiens
gagtgcagtggcgtgatctctg

SEQ ID NO: 7672916 - DNA, 22 bp, Homo sapiens
gagtgcagtatgagaggctgct

SEQ ID NO: 7672917 - DNA, 22 bp, Homo sapiens
gagtgcagtatgagaggctgct

SEQ ID NO: 7672918 - DNA, 22 bp, Homo sapiens
gagtgcagtatgagaggctgct

SEQ ID NO: 7672919 - DNA, 22 bp, Homo sapiens
gagtgcagtatgagaggctgct

SEQ ID NO: 7672920 - DNA, 22 bp, Homo sapiens
gagtgcagtatgagaggctgct

SEQ ID NO: 7672921 - DNA, 22 bp, Homo sapiens
gagtgcagtatgagaggctgct

SEQ ID NO: 7672922 - DNA, 22 bp, Homo sapiens
gagtgcagtatgagaggctgct

SEQ ID NO: 7672923 - DNA, 22 bp, Homo sapiens
gagtgcagtatgagaggctgct

SEQ ID NO: 7672924 - DNA, 23 bp, Homo sapiens
gagtgcagaatagacatgcagtg

SEQ ID NO: 7672925 - DNA, 23 bp, Homo sapiens
gagtgcagaatagacatgcagtg

SEQ ID NO: 7672926 - DNA, 23 bp, Homo sapiens
gagtgcagaatagacatgcagtg

SEQ ID NO: 7672927 - DNA, 23 bp, Homo sapiens
gagtgcagaatagacatgcagtg

SEQ ID NO: 7672928 - DNA, 17 bp, Homo sapiens
gagtgctggtggagctc

SEQ ID NO: 7672929 - DNA, 17 bp, Homo sapiens
gagtgctggtggagctc

SEQ ID NO: 7672930 - DNA, 22 bp, Homo sapiens
gagtgctgtatctgagaaagca

SEQ ID NO: 7672931 - DNA, 22 bp, Homo sapiens
gagtgctgtaggactgagccct

SEQ ID NO: 7672932 - DNA, 22 bp, Homo sapiens
gagtgctgtaggactgagccct

SEQ ID NO: 7672933 - DNA, 22 bp, Homo sapiens
gagtgctgtaggactgagccct

SEQ ID NO: 7672934 - DNA, 22 bp, Homo sapiens
gagtgctggggtgcagagaggt

SEQ ID NO: 7672935 - DNA, 22 bp, Homo sapiens
gagtgctggggtgcagagaggt

SEQ ID NO: 7672936 - DNA, 22 bp, Homo sapiens
gagtgctggggtgcagagaggt

SEQ ID NO: 7672937 - DNA, 17 bp, Homo sapiens
gagtgctggtggagctc

SEQ ID NO: 7672938 - DNA, 17 bp, Homo sapiens
gagtgctggtggagctc

SEQ ID NO: 7672939 - DNA, 17 bp, Homo sapiens
gagtgctggtggagctc

SEQ ID NO: 7672940 - DNA, 22 bp, Homo sapiens
gagtgctggggtgcagagaggt

SEQ ID NO: 7672941 - DNA, 22 bp, Homo sapiens
gagtgctggggtgcagagaggt

SEQ ID NO: 7672942 - DNA, 22 bp, Homo sapiens
gagtgctggggtgcagagaggt

SEQ ID NO: 7672943 - DNA, 22 bp, Homo sapiens
gagtgctggggtgcagagaggt

SEQ ID NO: 7672944 - DNA, 22 bp, Homo sapiens
gagtgctggaggtgtgagtggg

SEQ ID NO: 7672945 - DNA, 22 bp, Homo sapiens
gagtgctggaggtgtgagtggg

SEQ ID NO: 7672946 - DNA, 22 bp, Homo sapiens
gagtgctggaggtgtgagtggg

SEQ ID NO: 7672947 - DNA, 22 bp, Homo sapiens
gagtgctgcttgggatagtgag

SEQ ID NO: 7672948 - DNA, 22 bp, Homo sapiens
gagtgctggaggtgtgagtggg

SEQ ID NO: 7672949 - DNA, 22 bp, Homo sapiens
gagtgctggaggtgtgagtggg

SEQ ID NO: 7672950 - DNA, 22 bp, Homo sapiens
gagtgctggaggtgtgagtggg

SEQ ID NO: 7672951 - DNA, 22 bp, Homo sapiens
gagtgctgagcccacttccttg

SEQ ID NO: 7672952 - DNA, 22 bp, Homo sapiens
gagtgctgctaatgcaagggtg

SEQ ID NO: 7672953 - DNA, 22 bp, Homo sapiens
gagtgctgctaatgcaagggtg

SEQ ID NO: 7672954 - DNA, 22 bp, Homo sapiens
gagtgctgctaatgcaagggtg

SEQ ID NO: 7672955 - DNA, 22 bp, Homo sapiens
gagtgctgctaatgcaagggtg

SEQ ID NO: 7672956 - DNA, 22 bp, Homo sapiens
gagtgctgcttgggatagtgag

SEQ ID NO: 7672957 - DNA, 22 bp, Homo sapiens
gagtgctgcttgggatagtgag

SEQ ID NO: 7672958 - DNA, 22 bp, Homo sapiens
gagtggggctttaaaggctcag

SEQ ID NO: 7672959 - DNA, 22 bp, Homo sapiens
gagtggggctttaaaggctcag

SEQ ID NO: 7672960 - DNA, 22 bp, Homo sapiens
gagtgggcaaaagaaagtaggc

SEQ ID NO: 7672961 - DNA, 22 bp, Homo sapiens
gagtggggctttaaaggctcag

SEQ ID NO: 7672962 - DNA, 22 bp, Homo sapiens
gagtggggctttaaaggctcag

SEQ ID NO: 7672963 - DNA, 22 bp, Homo sapiens
gagtggggctttaaaggctcag

SEQ ID NO: 7672964 - DNA, 22 bp, Homo sapiens
gagtgggcaccgtgggcacact

SEQ ID NO: 7672965 - DNA, 22 bp, Homo sapiens
gagtggggctttaaaggctcag

SEQ ID NO: 7672966 - DNA, 22 bp, Homo sapiens
gagtggggctttaaaggctcag

SEQ ID NO: 7672967 - DNA, 21 bp, Homo sapiens
gagtgggacatgggagtggtt

SEQ ID NO: 7672968 - DNA, 21 bp, Homo sapiens
gagtgggacatgggagtggtt

SEQ ID NO: 7672969 - DNA, 21 bp, Homo sapiens
gagtgggacatgggagtggtt

SEQ ID NO: 7672970 - DNA, 21 bp, Homo sapiens
gagtgggacatgggagtggtt

SEQ ID NO: 7672971 - DNA, 22 bp, Homo sapiens
gagtggcttttttatggtaatg

SEQ ID NO: 7672972 - DNA, 21 bp, Homo sapiens
gagtgggacatgggagtggtt

SEQ ID NO: 7672973 - DNA, 21 bp, Homo sapiens
gagtgggacatgggagtggtt

SEQ ID NO: 7672974 - DNA, 21 bp, Homo sapiens
gagtgggacatgggagtggtt

SEQ ID NO: 7672975 - DNA, 21 bp, Homo sapiens
gagtgggacatgggagtggtt

SEQ ID NO: 7672976 - DNA, 22 bp, Homo sapiens
gagtggctccttacaagttcca

SEQ ID NO: 7672977 - DNA, 22 bp, Homo sapiens
gagtggctccctgggtttggca

SEQ ID NO: 7672978 - DNA, 22 bp, Homo sapiens
gagtggctccaatttggtccta

SEQ ID NO: 7672979 - DNA, 22 bp, Homo sapiens
gagtggctacaggcagcttaca

SEQ ID NO: 7672980 - DNA, 22 bp, Homo sapiens
gagtggctattgatccgtgatg

SEQ ID NO: 7672981 - DNA, 22 bp, Homo sapiens
gagtggctacaggcagcttaca

SEQ ID NO: 7672982 - DNA, 22 bp, Homo sapiens
gagtggctaaagtatgtcatgg

SEQ ID NO: 7672983 - DNA, 22 bp, Homo sapiens
gagtggccagtggtggcatgtc

SEQ ID NO: 7672984 - DNA, 22 bp, Homo sapiens
gagtggccagtggtggcatgtc

SEQ ID NO: 7672985 - DNA, 22 bp, Homo sapiens
gagtggcatatgtgcctgtgaa

SEQ ID NO: 7672986 - DNA, 22 bp, Homo sapiens
gagtggcatatgtgcctgtgaa

SEQ ID NO: 7672987 - DNA, 22 bp, Homo sapiens
gagtggcatatgtgcctgtgaa

SEQ ID NO: 7672988 - DNA, 22 bp, Homo sapiens
gagtggctttggagaagtaggg

SEQ ID NO: 7672989 - DNA, 15 bp, Homo sapiens
gagtggctttcagaa

SEQ ID NO: 7672990 - DNA, 22 bp, Homo sapiens
gagtggctgtgtacatgcccag

SEQ ID NO: 7672991 - DNA, 22 bp, Homo sapiens
gagtggctgtgtacatgcccag

SEQ ID NO: 7672992 - DNA, 22 bp, Homo sapiens
gagtggctgtgtacatgcccag

SEQ ID NO: 7672993 - DNA, 15 bp, Homo sapiens
gagtggctggtgaaa

SEQ ID NO: 7672994 - DNA, 22 bp, Homo sapiens
gagtggctgggtgtttgaatcc

SEQ ID NO: 7672995 - DNA, 22 bp, Homo sapiens
gagtggctgagtaagaggggag

SEQ ID NO: 7672996 - DNA, 22 bp, Homo sapiens
gagtggctccttacaagttcca

SEQ ID NO: 7672997 - DNA, 22 bp, Homo sapiens
gagtggagcaaaagaggtagat

SEQ ID NO: 7672998 - DNA, 22 bp, Homo sapiens
gagtggagcaaaagaggtagat

SEQ ID NO: 7672999 - DNA, 22 bp, Homo sapiens
gagtggagcaaaagaggtagat

SEQ ID NO: 7673000 - DNA, 22 bp, Homo sapiens
gagtggagcaaaagaggtagat

SEQ ID NO: 7673001 - DNA, 22 bp, Homo sapiens
gagtggagcaaaagaggtagat

SEQ ID NO: 7673002 - DNA, 22 bp, Homo sapiens
gagtggagcaaaagaggtagat

SEQ ID NO: 7673003 - DNA, 22 bp, Homo sapiens
gagtggagcaaaagaggtagat

SEQ ID NO: 7673004 - DNA, 22 bp, Homo sapiens
gagtggagcaaaagaggtagat

SEQ ID NO: 7673005 - DNA, 22 bp, Homo sapiens
gagtggagcaaaagaggtagat

SEQ ID NO: 7673006 - DNA, 22 bp, Homo sapiens
gagtggagcaaaagaggtagat

SEQ ID NO: 7673007 - DNA, 22 bp, Homo sapiens
gagtggagcaaaagaggtagat

SEQ ID NO: 7673008 - DNA, 22 bp, Homo sapiens
gagtggagcaaaagaggtagat

SEQ ID NO: 7673009 - DNA, 22 bp, Homo sapiens
gagtggcagaactgggggtcct

SEQ ID NO: 7673010 - DNA, 22 bp, Homo sapiens
gagtggcaggcactgtgacgga

SEQ ID NO: 7673011 - DNA, 22 bp, Homo sapiens
gagtggcaggcactgtgacgga

SEQ ID NO: 7673012 - DNA, 22 bp, Homo sapiens
gagtggcaggcactgtgacgga

SEQ ID NO: 7673013 - DNA, 22 bp, Homo sapiens
gagtggcatagaagcatataga

SEQ ID NO: 7673014 - DNA, 22 bp, Homo sapiens
gagtggcaggcactgtgacgga

SEQ ID NO: 7673015 - DNA, 22 bp, Homo sapiens
gagtggcatagaagcatataga

SEQ ID NO: 7673016 - DNA, 22 bp, Homo sapiens
gagtggcatatgtgcctgtgaa

SEQ ID NO: 7673017 - DNA, 22 bp, Homo sapiens
gagtggcatatgtgcctgtgaa

SEQ ID NO: 7673018 - DNA, 22 bp, Homo sapiens
gagtggcatatgtgcctgtgaa

SEQ ID NO: 7673019 - DNA, 22 bp, Homo sapiens
gagtggagatcgtgccactgca

SEQ ID NO: 7673020 - DNA, 22 bp, Homo sapiens
gagtggagatcgtgccactgca

SEQ ID NO: 7673021 - DNA, 22 bp, Homo sapiens
gagtggagatcgtgccactgca

SEQ ID NO: 7673022 - DNA, 22 bp, Homo sapiens
gagtggagatcgtgccactgca

SEQ ID NO: 7673023 - DNA, 22 bp, Homo sapiens
gagtggagatcgtgccactgca

SEQ ID NO: 7673024 - DNA, 22 bp, Homo sapiens
gagtggagatcgtgccactgca

SEQ ID NO: 7673025 - DNA, 22 bp, Homo sapiens
gagtggagatcgtgccactgca

SEQ ID NO: 7673026 - DNA, 22 bp, Homo sapiens
gagtggagatcgtgccactgca

SEQ ID NO: 7673027 - DNA, 22 bp, Homo sapiens
gagtggagatcgtgccactgca

SEQ ID NO: 7673028 - DNA, 22 bp, Homo sapiens
gagtggagatcgtgccactgca

SEQ ID NO: 7673029 - DNA, 22 bp, Homo sapiens
gagtggagatcgtgccactgca

SEQ ID NO: 7673030 - DNA, 22 bp, Homo sapiens
gagtggagatcgtgccactgca

SEQ ID NO: 7673031 - DNA, 20 bp, Homo sapiens
gagtgctttggcttgctctc

SEQ ID NO: 7673032 - DNA, 22 bp, Homo sapiens
gagtgcttgcatatttattgtc

SEQ ID NO: 7673033 - DNA, 22 bp, Homo sapiens
gagtgctgtatctgagaaagca

SEQ ID NO: 7673034 - DNA, 22 bp, Homo sapiens
gagtgcttgcatatttattgtc

SEQ ID NO: 7673035 - DNA, 22 bp, Homo sapiens
gagtgctgtatctgagaaagca

SEQ ID NO: 7673036 - DNA, 22 bp, Homo sapiens
gagtggagatcgtgccactgca

SEQ ID NO: 7673037 - DNA, 22 bp, Homo sapiens
gagtgctttgtcttgtaattct

SEQ ID NO: 7673038 - DNA, 21 bp, Homo sapiens
gagtggaacgctcttcacacc

SEQ ID NO: 7673039 - DNA, 21 bp, Homo sapiens
gagtggaacgctcttcacacc

SEQ ID NO: 7673040 - DNA, 21 bp, Homo sapiens
gagtggaacgctcttcacacc

SEQ ID NO: 7673041 - DNA, 22 bp, Homo sapiens
gataaagcaaggatgactgaag

SEQ ID NO: 7673042 - DNA, 22 bp, Homo sapiens
gataaagcaaggatgactgaag

SEQ ID NO: 7673043 - DNA, 22 bp, Homo sapiens
gataaacttgtggagttttggt

SEQ ID NO: 7673044 - DNA, 22 bp, Homo sapiens
gataaacttgtggagttttggt

SEQ ID NO: 7673045 - DNA, 22 bp, Homo sapiens
gataaacttgtggagttttggt

SEQ ID NO: 7673046 - DNA, 22 bp, Homo sapiens
gataaacttgtggagttttggt

SEQ ID NO: 7673047 - DNA, 22 bp, Homo sapiens
gataaagcaaggatgactgaag

SEQ ID NO: 7673048 - DNA, 21 bp, Homo sapiens
gataaagcagcttgcctaagg

SEQ ID NO: 7673049 - DNA, 22 bp, Homo sapiens
gataaagcaggtaggagaagat

SEQ ID NO: 7673050 - DNA, 22 bp, Homo sapiens
gataaagggggaccaaatgact

SEQ ID NO: 7673051 - DNA, 22 bp, Homo sapiens
gataaagtagatttgttctaga

SEQ ID NO: 7673052 - DNA, 22 bp, Homo sapiens
gataaagtagatttgttctaga

SEQ ID NO: 7673053 - DNA, 22 bp, Homo sapiens
gataaatggctgaagaaatagt

SEQ ID NO: 7673054 - DNA, 22 bp, Homo sapiens
gataaattatcaggggtttaaa

SEQ ID NO: 7673055 - DNA, 22 bp, Homo sapiens
gataaattatcaggggtttaaa

SEQ ID NO: 7673056 - DNA, 22 bp, Homo sapiens
gataaattgcactttttcttac

SEQ ID NO: 7673057 - DNA, 22 bp, Homo sapiens
gataaattgcactttttcttac

SEQ ID NO: 7673058 - DNA, 22 bp, Homo sapiens
gataaattgcactttttcttac

SEQ ID NO: 7673059 - DNA, 22 bp, Homo sapiens
gataaattatcaggggtttaaa

SEQ ID NO: 7673060 - DNA, 22 bp, Homo sapiens
gataaattgcactttttcttac

SEQ ID NO: 7673061 - DNA, 20 bp, Homo sapiens
gataaattgtctcttaagtg

SEQ ID NO: 7673062 - DNA, 20 bp, Homo sapiens
gataaattgtctcttaagtg

SEQ ID NO: 7673063 - DNA, 20 bp, Homo sapiens
gataaattgtctcttaagtg

SEQ ID NO: 7673064 - DNA, 20 bp, Homo sapiens
gataaattgtctcttaagtg

SEQ ID NO: 7673065 - DNA, 20 bp, Homo sapiens
gataaattgtctcttaagtg

SEQ ID NO: 7673066 - DNA, 20 bp, Homo sapiens
gataaattgtctcttaagtg

SEQ ID NO: 7673067 - DNA, 22 bp, Homo sapiens
gataacattttgaagtgctagt

SEQ ID NO: 7673068 - DNA, 22 bp, Homo sapiens
gataacattataagttcactgt

SEQ ID NO: 7673069 - DNA, 22 bp, Homo sapiens
gataacattttgaagtgctagt

SEQ ID NO: 7673070 - DNA, 22 bp, Homo sapiens
gataacatggttagtgttttta

SEQ ID NO: 7673071 - DNA, 22 bp, Homo sapiens
gataacatggttagtgttttta

SEQ ID NO: 7673072 - DNA, 22 bp, Homo sapiens
gataacatttgtatagcgcttt

SEQ ID NO: 7673073 - DNA, 22 bp, Homo sapiens
gataacatttgtatagcgcttt

SEQ ID NO: 7673074 - DNA, 22 bp, Homo sapiens
gataacaatatgaagtagatat

SEQ ID NO: 7673075 - DNA, 22 bp, Homo sapiens
gataacatacttgcatgtgtat

SEQ ID NO: 7673076 - DNA, 22 bp, Homo sapiens
gataacatacttgcatgtgtat

SEQ ID NO: 7673077 - DNA, 22 bp, Homo sapiens
gataacatacttgcatgtgtat

SEQ ID NO: 7673078 - DNA, 20 bp, Homo sapiens
gataaattgtctcttaagtg

SEQ ID NO: 7673079 - DNA, 20 bp, Homo sapiens
gataaattgtctcttaagtg

SEQ ID NO: 7673080 - DNA, 22 bp, Homo sapiens
gataacaatatgaagtagatat

SEQ ID NO: 7673081 - DNA, 22 bp, Homo sapiens
gataacaatatgaagtagatat

SEQ ID NO: 7673082 - DNA, 22 bp, Homo sapiens
gataacaatatgaagtagatat

SEQ ID NO: 7673083 - DNA, 22 bp, Homo sapiens
gataaaatatgtggcctttagt

SEQ ID NO: 7673084 - DNA, 21 bp, Homo sapiens
gataaaatgggccttggtcct

SEQ ID NO: 7673085 - DNA, 21 bp, Homo sapiens
gataaaatgggccttggtcct

SEQ ID NO: 7673086 - DNA, 21 bp, Homo sapiens
gataaaatgggccttggtcct

SEQ ID NO: 7673087 - DNA, 21 bp, Homo sapiens
gataaaatgggccttggtcct

SEQ ID NO: 7673088 - DNA, 22 bp, Homo sapiens
gataaaattcttattttacccg

SEQ ID NO: 7673089 - DNA, 22 bp, Homo sapiens
gataaaattcttattttacccg

SEQ ID NO: 7673090 - DNA, 22 bp, Homo sapiens
gataaaattcttattttacccg

SEQ ID NO: 7673091 - DNA, 22 bp, Homo sapiens
gataaaattcttattttacccg

SEQ ID NO: 7673092 - DNA, 21 bp, Homo sapiens
gataaaatgggccttggtcct

SEQ ID NO: 7673093 - DNA, 22 bp, Homo sapiens
gataaaataactatggaatact

SEQ ID NO: 7673094 - DNA, 22 bp, Homo sapiens
gataaaataactatggaatact

SEQ ID NO: 7673095 - DNA, 22 bp, Homo sapiens
gataaaatatgtggcctttagt

SEQ ID NO: 7673096 - DNA, 22 bp, Homo sapiens
gataaaatatgtggcctttagt

SEQ ID NO: 7673097 - DNA, 22 bp, Homo sapiens
gataaaatatgtggcctttagt

SEQ ID NO: 7673098 - DNA, 22 bp, Homo sapiens
gataaaatatgtggcctttagt

SEQ ID NO: 7673099 - DNA, 22 bp, Homo sapiens
gataaacattcttgcacatgtg

SEQ ID NO: 7673100 - DNA, 22 bp, Homo sapiens
gataaacattcttgcacatgtg

SEQ ID NO: 7673101 - DNA, 22 bp, Homo sapiens
gataaacatgggagaaaggaat

SEQ ID NO: 7673102 - DNA, 22 bp, Homo sapiens
gataaactggaaccattgcctc

SEQ ID NO: 7673103 - DNA, 22 bp, Homo sapiens
gataaacactaaggtcgctgaa

SEQ ID NO: 7673104 - DNA, 22 bp, Homo sapiens
gataaacactgatgatatgggg

SEQ ID NO: 7673105 - DNA, 22 bp, Homo sapiens
gataaacatgaagttctgtgta

SEQ ID NO: 7673106 - DNA, 22 bp, Homo sapiens
gataaacatgggagaaaggaat

SEQ ID NO: 7673107 - DNA, 22 bp, Homo sapiens
gataaaattcttattttacccg

SEQ ID NO: 7673108 - DNA, 22 bp, Homo sapiens
gataaaattcttattttacccg

SEQ ID NO: 7673109 - DNA, 22 bp, Homo sapiens
gataaacacaaggtgatttcat

SEQ ID NO: 7673110 - DNA, 22 bp, Homo sapiens
gataaacacaaggtgatttcat

SEQ ID NO: 7673111 - DNA, 22 bp, Homo sapiens
gataaacacaaggtgatttcat

SEQ ID NO: 7673112 - DNA, 22 bp, Homo sapiens
gataaacactaaggtcgctgaa

SEQ ID NO: 7673113 - DNA, 22 bp, Homo sapiens
gataaacacaaggtgatttcat

SEQ ID NO: 7673114 - DNA, 22 bp, Homo sapiens
gagtttctgctctaggtctggt

SEQ ID NO: 7673115 - DNA, 22 bp, Homo sapiens
gagtttctgctctaggtctggt

SEQ ID NO: 7673116 - DNA, 22 bp, Homo sapiens
gagtttcttcatggtgcagagg

SEQ ID NO: 7673117 - DNA, 22 bp, Homo sapiens
gagtttcttcatggtgcagagg

SEQ ID NO: 7673118 - DNA, 22 bp, Homo sapiens
gagtttcttaacaggtggaagc

SEQ ID NO: 7673119 - DNA, 22 bp, Homo sapiens
gagtttctgattcagtctgtgt

SEQ ID NO: 7673120 - DNA, 22 bp, Homo sapiens
gagtttctgattcagtctgtgt

SEQ ID NO: 7673121 - DNA, 22 bp, Homo sapiens
gagtttctccagtgctagttgt

SEQ ID NO: 7673122 - DNA, 22 bp, Homo sapiens
gagtttctgatttagtaggtct

SEQ ID NO: 7673123 - DNA, 22 bp, Homo sapiens
gagtttctgatttagtaggtct

SEQ ID NO: 7673124 - DNA, 22 bp, Homo sapiens
gagtttatttgactggattctc

SEQ ID NO: 7673125 - DNA, 22 bp, Homo sapiens
gagtttattgtcttccaggctt

SEQ ID NO: 7673126 - DNA, 22 bp, Homo sapiens
gagtttattcaggaaatagcca

SEQ ID NO: 7673127 - DNA, 22 bp, Homo sapiens
gagtttattgtcttccaggctt

SEQ ID NO: 7673128 - DNA, 22 bp, Homo sapiens
gagtttctccagtgctagttgt

SEQ ID NO: 7673129 - DNA, 22 bp, Homo sapiens
gagtttctccagtgctagttgt

SEQ ID NO: 7673130 - DNA, 22 bp, Homo sapiens
gagtttctaggatggaggtgag

SEQ ID NO: 7673131 - DNA, 22 bp, Homo sapiens
gagtttatttgactggattctc

SEQ ID NO: 7673132 - DNA, 22 bp, Homo sapiens
gagtttccaaatccctgaaggg

SEQ ID NO: 7673133 - DNA, 22 bp, Homo sapiens
gagtttatttgactggattctc

SEQ ID NO: 7673134 - DNA, 22 bp, Homo sapiens
gagtttccaaatccctgaaggg

SEQ ID NO: 7673135 - DNA, 22 bp, Homo sapiens
gataaaagaggaaatttgttca

SEQ ID NO: 7673136 - DNA, 22 bp, Homo sapiens
gagtttttccaaggtcacatga

SEQ ID NO: 7673137 - DNA, 22 bp, Homo sapiens
gagtttttccaaggtcacatga

SEQ ID NO: 7673138 - DNA, 22 bp, Homo sapiens
gagttttatttggtgctaagta

SEQ ID NO: 7673139 - DNA, 22 bp, Homo sapiens
gagtttgtgggaatggagtatt

SEQ ID NO: 7673140 - DNA, 22 bp, Homo sapiens
gataaaataactatggaatact

SEQ ID NO: 7673141 - DNA, 22 bp, Homo sapiens
gataaaataactatggaatact

SEQ ID NO: 7673142 - DNA, 22 bp, Homo sapiens
gataaaataactatggaatact

SEQ ID NO: 7673143 - DNA, 22 bp, Homo sapiens
gataaaataactatggaatact

SEQ ID NO: 7673144 - DNA, 22 bp, Homo sapiens
gataaaagaggaaatttgttca

SEQ ID NO: 7673145 - DNA, 22 bp, Homo sapiens
gataaaagaggaaatttgttca

SEQ ID NO: 7673146 - DNA, 22 bp, Homo sapiens
gataaaagaggaaatttgttca

SEQ ID NO: 7673147 - DNA, 23 bp, Homo sapiens
gagtttcttccaggagccctggg

SEQ ID NO: 7673148 - DNA, 22 bp, Homo sapiens
gagtttggcctccccagcagtt

SEQ ID NO: 7673149 - DNA, 22 bp, Homo sapiens
gagtttgggtggaaggagggta

SEQ ID NO: 7673150 - DNA, 22 bp, Homo sapiens
gagtttgggtggaaggagggta

SEQ ID NO: 7673151 - DNA, 22 bp, Homo sapiens
gagtttgtaaactattcactaa

SEQ ID NO: 7673152 - DNA, 22 bp, Homo sapiens
gagtttgtaaactattcactaa

SEQ ID NO: 7673153 - DNA, 22 bp, Homo sapiens
gagttttatttggtgctaagta

SEQ ID NO: 7673154 - DNA, 22 bp, Homo sapiens
gagttttaatgagctgctgtgg

SEQ ID NO: 7673155 - DNA, 22 bp, Homo sapiens
gagttttaatgagctgctgtgg

SEQ ID NO: 7673156 - DNA, 22 bp, Homo sapiens
gagttttaatgagctgctgtgg

SEQ ID NO: 7673157 - DNA, 22 bp, Homo sapiens
gagttttaacctcagctctctg

SEQ ID NO: 7673158 - DNA, 22 bp, Homo sapiens
gagttttaacctcagctctctg

SEQ ID NO: 7673159 - DNA, 22 bp, Homo sapiens
gagttttaacctcagctctctg

SEQ ID NO: 7673160 - DNA, 22 bp, Homo sapiens
gagttttaaagctggggaagag

SEQ ID NO: 7673161 - DNA, 22 bp, Homo sapiens
gagttttaaagctggggaagag

SEQ ID NO: 7673162 - DNA, 22 bp, Homo sapiens
gagttctgttccttgggagttt

SEQ ID NO: 7673163 - DNA, 22 bp, Homo sapiens
gagttctgttacgtgtcaccaa

SEQ ID NO: 7673164 - DNA, 22 bp, Homo sapiens
gagttctgtgattatttgggac

SEQ ID NO: 7673165 - DNA, 22 bp, Homo sapiens
gagttgcctctaagtccctggt

SEQ ID NO: 7673166 - DNA, 22 bp, Homo sapiens
gagttgcctctaagtccctggt

SEQ ID NO: 7673167 - DNA, 22 bp, Homo sapiens
gagttgaaagcaaaagttgata

SEQ ID NO: 7673168 - DNA, 22 bp, Homo sapiens
gagttggctactctctgaggct

SEQ ID NO: 7673169 - DNA, 22 bp, Homo sapiens
gagtttaaaaagcctggtttgt

SEQ ID NO: 7673170 - DNA, 23 bp, Homo sapiens
gagttgggtgctgaacgaccata

SEQ ID NO: 7673171 - DNA, 22 bp, Homo sapiens
gagtttaaaacgcttgtattta

SEQ ID NO: 7673172 - DNA, 22 bp, Homo sapiens
gagtttaaaacgcttgtattta

SEQ ID NO: 7673173 - DNA, 22 bp, Homo sapiens
gagtttaaaaagcctggtttgt

SEQ ID NO: 7673174 - DNA, 22 bp, Homo sapiens
gagtttaaaacgcttgtattta

SEQ ID NO: 7673175 - DNA, 22 bp, Homo sapiens
gagtttaaaacgcttgtattta

SEQ ID NO: 7673176 - DNA, 22 bp, Homo sapiens
gagtttaaagcatacatatttt

SEQ ID NO: 7673177 - DNA, 22 bp, Homo sapiens
gagtttaaagcatacatatttt

SEQ ID NO: 7673178 - DNA, 22 bp, Homo sapiens
gagtttaaagcatacatatttt

SEQ ID NO: 7673179 - DNA, 22 bp, Homo sapiens
gagtttaaagcatacatatttt

SEQ ID NO: 7673180 - DNA, 22 bp, Homo sapiens
gagtttatgtctttcattgttc

SEQ ID NO: 7673181 - DNA, 22 bp, Homo sapiens
gagtttatgtctttcattgttc

SEQ ID NO: 7673182 - DNA, 22 bp, Homo sapiens
gagtttatgtctttcattgttc

SEQ ID NO: 7673183 - DNA, 19 bp, Homo sapiens
gagtttatctcctagccct

SEQ ID NO: 7673184 - DNA, 22 bp, Homo sapiens
gagtttagtttggcttaaactg

SEQ ID NO: 7673185 - DNA, 19 bp, Homo sapiens
gagtttatctcctagccct

SEQ ID NO: 7673186 - DNA, 22 bp, Homo sapiens
gagtttattcaggaaatagcca

SEQ ID NO: 7673187 - DNA, 22 bp, Homo sapiens
gagtttattcaggaaatagcca

SEQ ID NO: 7673188 - DNA, 22 bp, Homo sapiens
gagtttattcaggaaatagcca

SEQ ID NO: 7673189 - DNA, 22 bp, Homo sapiens
gagtttattcaggaaatagcca

SEQ ID NO: 7673190 - DNA, 22 bp, Homo sapiens
gagtttaatcattgttctatcc

SEQ ID NO: 7673191 - DNA, 22 bp, Homo sapiens
gagtttaatcattgttctatcc

SEQ ID NO: 7673192 - DNA, 22 bp, Homo sapiens
gagtttaacacttggagaaaag

SEQ ID NO: 7673193 - DNA, 22 bp, Homo sapiens
gagtttaatcattgttctatcc

SEQ ID NO: 7673194 - DNA, 22 bp, Homo sapiens
gagtttaaagcatacatatttt

SEQ ID NO: 7673195 - DNA, 22 bp, Homo sapiens
gagtttaaataacacatttcca

SEQ ID NO: 7673196 - DNA, 22 bp, Homo sapiens
gagtttaaataacacatttcca

SEQ ID NO: 7673197 - DNA, 22 bp, Homo sapiens
gagtttagtggaatttccttct

SEQ ID NO: 7673198 - DNA, 22 bp, Homo sapiens
gagtttagtggaatttccttct

SEQ ID NO: 7673199 - DNA, 22 bp, Homo sapiens
gagtttagtttggcttaaactg

SEQ ID NO: 7673200 - DNA, 22 bp, Homo sapiens
gagtttagtttggcttaaactg

SEQ ID NO: 7673201 - DNA, 18 bp, Homo sapiens
gagtttaggttgtagaat

SEQ ID NO: 7673202 - DNA, 18 bp, Homo sapiens
gagtttaggttgtagaat

SEQ ID NO: 7673203 - DNA, 22 bp, Homo sapiens
gagtttaggttcatgaacgagt

SEQ ID NO: 7673204 - DNA, 18 bp, Homo sapiens
gagtttaggttgtagaat

SEQ ID NO: 7673205 - DNA, 22 bp, Homo sapiens
gagtttagccaatttggtcccc

SEQ ID NO: 7673206 - DNA, 22 bp, Homo sapiens
gagtttaggttcatgaacgagt

SEQ ID NO: 7673207 - DNA, 22 bp, Homo sapiens
gagtttagatggcattaaggta

SEQ ID NO: 7673208 - DNA, 22 bp, Homo sapiens
gagtttagccaatttggtcccc

SEQ ID NO: 7673209 - DNA, 22 bp, Homo sapiens
gagtttaatcattgttctatcc

SEQ ID NO: 7673210 - DNA, 22 bp, Homo sapiens
gagtttagatggcattaaggta

SEQ ID NO: 7673211 - DNA, 22 bp, Homo sapiens
gagtgtctgtggggcatggaca

SEQ ID NO: 7673212 - DNA, 22 bp, Homo sapiens
gagtgtctgtgacagctcatga

SEQ ID NO: 7673213 - DNA, 22 bp, Homo sapiens
gagtgtggatcccagaagcaga

SEQ ID NO: 7673214 - DNA, 22 bp, Homo sapiens
gagtgtctgtggggcatggaca

SEQ ID NO: 7673215 - DNA, 22 bp, Homo sapiens
gagtgtggatcccagaagcaga

SEQ ID NO: 7673216 - DNA, 22 bp, Homo sapiens
gagtgtggatcccagaagcaga

SEQ ID NO: 7673217 - DNA, 22 bp, Homo sapiens
gagtgtgggcacgggggccttg

SEQ ID NO: 7673218 - DNA, 22 bp, Homo sapiens
gagtgtgggcacgggggccttg

SEQ ID NO: 7673219 - DNA, 22 bp, Homo sapiens
gagtgtgggcacgggggccttg

SEQ ID NO: 7673220 - DNA, 18 bp, Homo sapiens
gagtgtggcactgggccc

SEQ ID NO: 7673221 - DNA, 18 bp, Homo sapiens
gagtgtggcactgggccc

SEQ ID NO: 7673222 - DNA, 18 bp, Homo sapiens
gagtgtggcactgggccc

SEQ ID NO: 7673223 - DNA, 18 bp, Homo sapiens
gagtgtggcactgggccc

SEQ ID NO: 7673224 - DNA, 18 bp, Homo sapiens
gagtgtggcactgggccc

SEQ ID NO: 7673225 - DNA, 18 bp, Homo sapiens
gagtgtggcactgggccc

SEQ ID NO: 7673226 - DNA, 22 bp, Homo sapiens
gagtgtgggggtgctgaggaca

SEQ ID NO: 7673227 - DNA, 22 bp, Homo sapiens
gagtgtgggcacgggggccttg

SEQ ID NO: 7673228 - DNA, 22 bp, Homo sapiens
gagtgtgggcacgggggccttg

SEQ ID NO: 7673229 - DNA, 22 bp, Homo sapiens
gagtgtgggggtgctgaggaca

SEQ ID NO: 7673230 - DNA, 22 bp, Homo sapiens
gagtgtgggggtgctgaggaca

SEQ ID NO: 7673231 - DNA, 22 bp, Homo sapiens
gagtgtgggggtgctgaggaca

SEQ ID NO: 7673232 - DNA, 22 bp, Homo sapiens
gagtgtgggtctcagctttaag

SEQ ID NO: 7673233 - DNA, 22 bp, Homo sapiens
gagtgtgggtctcagctttaag

SEQ ID NO: 7673234 - DNA, 22 bp, Homo sapiens
gagtgtgggggtgctgaggaca

SEQ ID NO: 7673235 - DNA, 22 bp, Homo sapiens
gagtgtgggggtgctgaggaca

SEQ ID NO: 7673236 - DNA, 22 bp, Homo sapiens
gagtgtggtgaacaggagcacc

SEQ ID NO: 7673237 - DNA, 22 bp, Homo sapiens
gagtgtggtgaacaggagcacc

SEQ ID NO: 7673238 - DNA, 22 bp, Homo sapiens
gagtgtggtatgctctgaggct

SEQ ID NO: 7673239 - DNA, 22 bp, Homo sapiens
gagtgtggtatgctctgaggct

SEQ ID NO: 7673240 - DNA, 22 bp, Homo sapiens
gagtgtggtgaacaggagcacc

SEQ ID NO: 7673241 - DNA, 22 bp, Homo sapiens
gagtgtggtgaacaggagcacc

SEQ ID NO: 7673242 - DNA, 22 bp, Homo sapiens
gagtgtggtgaacaggagcacc

SEQ ID NO: 7673243 - DNA, 22 bp, Homo sapiens
gagttaaaggcagttgaggaaa

SEQ ID NO: 7673244 - DNA, 22 bp, Homo sapiens
gagttaaaggaaaataacttta

SEQ ID NO: 7673245 - DNA, 22 bp, Homo sapiens
gagttaaagtacctttgtatgt

SEQ ID NO: 7673246 - DNA, 22 bp, Homo sapiens
gagttaaagtacctttgtatgt

SEQ ID NO: 7673247 - DNA, 22 bp, Homo sapiens
gagttaaaaatgcctccatgga

SEQ ID NO: 7673248 - DNA, 22 bp, Homo sapiens
gagttaaaagccctctcagcag

SEQ ID NO: 7673249 - DNA, 22 bp, Homo sapiens
gagttaaaggaaaataacttta

SEQ ID NO: 7673250 - DNA, 22 bp, Homo sapiens
gagttaaaagccctctcagcag

SEQ ID NO: 7673251 - DNA, 22 bp, Homo sapiens
gagttaaaggaaaataacttta

SEQ ID NO: 7673252 - DNA, 22 bp, Homo sapiens
gagttctgaactgtgaaatgca

SEQ ID NO: 7673253 - DNA, 22 bp, Homo sapiens
gagttctcaagcaatcaaagag

SEQ ID NO: 7673254 - DNA, 22 bp, Homo sapiens
gagttctgtgagccatcctagc

SEQ ID NO: 7673255 - DNA, 22 bp, Homo sapiens
gagttctgtgagccatcctagc

SEQ ID NO: 7673256 - DNA, 22 bp, Homo sapiens
gagttctgtagggtgaaatagt

SEQ ID NO: 7673257 - DNA, 22 bp, Homo sapiens
gagttctgtagggtgaaatagt

SEQ ID NO: 7673258 - DNA, 22 bp, Homo sapiens
gagttctggtcagcagggcagc

SEQ ID NO: 7673259 - DNA, 22 bp, Homo sapiens
gagttctggccggttcttggac

SEQ ID NO: 7673260 - DNA, 22 bp, Homo sapiens
gagttctcagtaaagttctttg

SEQ ID NO: 7673261 - DNA, 22 bp, Homo sapiens
gagttctggtcagcagggcagc

SEQ ID NO: 7673262 - DNA, 22 bp, Homo sapiens
gagttctggtcagcagggcagc

SEQ ID NO: 7673263 - DNA, 22 bp, Homo sapiens
gagtgtgttattaaagatggaa

SEQ ID NO: 7673264 - DNA, 22 bp, Homo sapiens
gagtgtgttctttatgctgtga

SEQ ID NO: 7673265 - DNA, 22 bp, Homo sapiens
gagtgtgttctttatgctgtga

SEQ ID NO: 7673266 - DNA, 22 bp, Homo sapiens
gagtgtgttctttatgctgtga

SEQ ID NO: 7673267 - DNA, 22 bp, Homo sapiens
gagtgttttactcaaagaaaga

SEQ ID NO: 7673268 - DNA, 22 bp, Homo sapiens
gagttaaaaatgcctccatgga

SEQ ID NO: 7673269 - DNA, 22 bp, Homo sapiens
gagtgtgtgcatgatctcttat

SEQ ID NO: 7673270 - DNA, 22 bp, Homo sapiens
gagtgtgtgacttcactttagc

SEQ ID NO: 7673271 - DNA, 22 bp, Homo sapiens
gagtgtgtcggtcagcgtggcg

SEQ ID NO: 7673272 - DNA, 22 bp, Homo sapiens
gagtgtgtcggtcagcgtggcg

SEQ ID NO: 7673273 - DNA, 22 bp, Homo sapiens
gagtgtgtcggtcagcgtggcg

SEQ ID NO: 7673274 - DNA, 22 bp, Homo sapiens
gagtgtggtgaacaggagcacc

SEQ ID NO: 7673275 - DNA, 22 bp, Homo sapiens
gagtgtggtgaacaggagcacc

SEQ ID NO: 7673276 - DNA, 22 bp, Homo sapiens
gagtgtggtgaacaggagcacc

SEQ ID NO: 7673277 - DNA, 22 bp, Homo sapiens
gagtgggtaccggagcaggtgc

SEQ ID NO: 7673278 - DNA, 22 bp, Homo sapiens
gagtgggtaccggagcaggtgc

SEQ ID NO: 7673279 - DNA, 22 bp, Homo sapiens
gagtgggtaccggagcaggtgc

SEQ ID NO: 7673280 - DNA, 22 bp, Homo sapiens
gagtgggtaccggagcaggtgc

SEQ ID NO: 7673281 - DNA, 22 bp, Homo sapiens
gagtgggtaccggagcaggtgc

SEQ ID NO: 7673282 - DNA, 22 bp, Homo sapiens
gagtgggtccacagaggtgaca

SEQ ID NO: 7673283 - DNA, 22 bp, Homo sapiens
gagtgggtccacagaggtgaca

SEQ ID NO: 7673284 - DNA, 22 bp, Homo sapiens
gagtgggtaccggagcaggtgc

SEQ ID NO: 7673285 - DNA, 22 bp, Homo sapiens
gagtgggtaccggagcaggtgc

SEQ ID NO: 7673286 - DNA, 22 bp, Homo sapiens
gagtgggtccacagaggtgaca

SEQ ID NO: 7673287 - DNA, 22 bp, Homo sapiens
gagtgggtccacagaggtgaca

SEQ ID NO: 7673288 - DNA, 22 bp, Homo sapiens
gagtggggtctgggcatcagtc

SEQ ID NO: 7673289 - DNA, 22 bp, Homo sapiens
gagtgggtaaaggtgcttggct

SEQ ID NO: 7673290 - DNA, 22 bp, Homo sapiens
gagtggggtctgggcatcagtc

SEQ ID NO: 7673291 - DNA, 22 bp, Homo sapiens
gagtggggtctgggcatcagtc

SEQ ID NO: 7673292 - DNA, 22 bp, Homo sapiens
gagtggggtctgggcatcagtc

SEQ ID NO: 7673293 - DNA, 22 bp, Homo sapiens
gagtggggtctgggcatcagtc

SEQ ID NO: 7673294 - DNA, 22 bp, Homo sapiens
gagtggggtctgggcatcagtc

SEQ ID NO: 7673295 - DNA, 22 bp, Homo sapiens
gagtggggtctgggcatcagtc

SEQ ID NO: 7673296 - DNA, 22 bp, Homo sapiens
gagtggggggtccgtctcagtg

SEQ ID NO: 7673297 - DNA, 22 bp, Homo sapiens
gagtggggggtccgtctcagtg

SEQ ID NO: 7673298 - DNA, 22 bp, Homo sapiens
gagtggggctttaaaggctcag

SEQ ID NO: 7673299 - DNA, 22 bp, Homo sapiens
gagtggggctttaaaggctcag

SEQ ID NO: 7673300 - DNA, 22 bp, Homo sapiens
gagtggggggtccgtctcagtg

SEQ ID NO: 7673301 - DNA, 22 bp, Homo sapiens
gagtggggggtccgtctcagtg

SEQ ID NO: 7673302 - DNA, 22 bp, Homo sapiens
gagtggggggtccgtctcagtg

SEQ ID NO: 7673303 - DNA, 22 bp, Homo sapiens
gagtggggggtccgtctcagtg

SEQ ID NO: 7673304 - DNA, 22 bp, Homo sapiens
gagtggggtctgggcatcagtc

SEQ ID NO: 7673305 - DNA, 22 bp, Homo sapiens
gagtggggtctgggcatcagtc

SEQ ID NO: 7673306 - DNA, 22 bp, Homo sapiens
gagtggggtctgggcatcagtc

SEQ ID NO: 7673307 - DNA, 22 bp, Homo sapiens
gagtggggtctgggcatcagtc

SEQ ID NO: 7673308 - DNA, 22 bp, Homo sapiens
gagtggggtctgggcatcagtc

SEQ ID NO: 7673309 - DNA, 22 bp, Homo sapiens
gagtggggtctgggcatcagtc

SEQ ID NO: 7673310 - DNA, 22 bp, Homo sapiens
gagtggggtctgggcatcagtc

SEQ ID NO: 7673311 - DNA, 22 bp, Homo sapiens
gagtggggtctgggcatcagtc

SEQ ID NO: 7673312 - DNA, 22 bp, Homo sapiens
gagtggggggtccgtctcagtg

SEQ ID NO: 7673313 - DNA, 22 bp, Homo sapiens
gagtggggggtccgtctcagtg

SEQ ID NO: 7673314 - DNA, 22 bp, Homo sapiens
gagtgtctgtattttgggcaag

SEQ ID NO: 7673315 - DNA, 22 bp, Homo sapiens
gagtgtctgaattagagcacaa

SEQ ID NO: 7673316 - DNA, 22 bp, Homo sapiens
gagtgtctcacagtagcatttt

SEQ ID NO: 7673317 - DNA, 21 bp, Homo sapiens
gagtgtctaatccaggctgtc

SEQ ID NO: 7673318 - DNA, 21 bp, Homo sapiens
gagtgtctaatccaggctgtc

SEQ ID NO: 7673319 - DNA, 22 bp, Homo sapiens
gagtgtctatgtttagtctttc

SEQ ID NO: 7673320 - DNA, 21 bp, Homo sapiens
gagtgtctaatccaggctgtc

SEQ ID NO: 7673321 - DNA, 22 bp, Homo sapiens
gagtgtcagtgcttggggctac

SEQ ID NO: 7673322 - DNA, 22 bp, Homo sapiens
gagtgtcagtgcttggggctac

SEQ ID NO: 7673323 - DNA, 22 bp, Homo sapiens
gagtgtcagtgcttggggctac

SEQ ID NO: 7673324 - DNA, 22 bp, Homo sapiens
gagtgtcagtgcttggggctac

SEQ ID NO: 7673325 - DNA, 22 bp, Homo sapiens
gagtgtctaatcacgtttcaca

SEQ ID NO: 7673326 - DNA, 22 bp, Homo sapiens
gagtgtccgtgcagccccagac

SEQ ID NO: 7673327 - DNA, 22 bp, Homo sapiens
gagtgtccgtgcagccccagac

SEQ ID NO: 7673328 - DNA, 22 bp, Homo sapiens
gagtgtcagcagggcagagcac

SEQ ID NO: 7673329 - DNA, 22 bp, Homo sapiens
gagtgtcagcagggcagagcac

SEQ ID NO: 7673330 - DNA, 22 bp, Homo sapiens
gagtgtcagcagggcagagcac

SEQ ID NO: 7673331 - DNA, 22 bp, Homo sapiens
gagtgtcagtgcctggcttgtt

SEQ ID NO: 7673332 - DNA, 22 bp, Homo sapiens
gagtgtcagtgcctggcttgtt

SEQ ID NO: 7673333 - DNA, 22 bp, Homo sapiens
gagtgtcagtgcctggcttgtt

SEQ ID NO: 7673334 - DNA, 22 bp, Homo sapiens
gagtgggtgacagaaggaggta

SEQ ID NO: 7673335 - DNA, 22 bp, Homo sapiens
gagtgggtgaatgtgctcataa

SEQ ID NO: 7673336 - DNA, 22 bp, Homo sapiens
gagtgggtgacagaaggaggta

SEQ ID NO: 7673337 - DNA, 22 bp, Homo sapiens
gagtggtagtttctagaggtgt

SEQ ID NO: 7673338 - DNA, 22 bp, Homo sapiens
gagtggtaggcagtgttaggaa

SEQ ID NO: 7673339 - DNA, 22 bp, Homo sapiens
gagtggttagaagtagtgtggc

SEQ ID NO: 7673340 - DNA, 22 bp, Homo sapiens
gagtggtaatgagcagattagg

SEQ ID NO: 7673341 - DNA, 22 bp, Homo sapiens
gagtgggtgagagacttggcac

SEQ ID NO: 7673342 - DNA, 22 bp, Homo sapiens
gagtgggtgagagacttggcac

SEQ ID NO: 7673343 - DNA, 22 bp, Homo sapiens
gagtgtagttcattccgtccta

SEQ ID NO: 7673344 - DNA, 22 bp, Homo sapiens
gagtgtaatctgaaaacttgaa

SEQ ID NO: 7673345 - DNA, 22 bp, Homo sapiens
gagtgtcaaggctctctttggc

SEQ ID NO: 7673346 - DNA, 22 bp, Homo sapiens
gagtgtcacttgatgcagggca

SEQ ID NO: 7673347 - DNA, 22 bp, Homo sapiens
gagtgtcacttgatgcagggca

SEQ ID NO: 7673348 - DNA, 22 bp, Homo sapiens
gagtgtcaaggctctctttggc

SEQ ID NO: 7673349 - DNA, 22 bp, Homo sapiens
gagtgtcaaggctctctttggc

SEQ ID NO: 7673350 - DNA, 22 bp, Homo sapiens
gagtgtcacagggtaattgttt

SEQ ID NO: 7673351 - DNA, 22 bp, Homo sapiens
gagtgtcacttgatgcagggca

SEQ ID NO: 7673352 - DNA, 21 bp, Homo sapiens
gagtgtcagcaagaggtttgg

SEQ ID NO: 7673353 - DNA, 21 bp, Homo sapiens
gagtgtcagcaagaggtttgg

SEQ ID NO: 7673354 - DNA, 22 bp, Homo sapiens
gatgaggaatgctcagctcaat

SEQ ID NO: 7673355 - DNA, 22 bp, Homo sapiens
gatgaggaatttgaggttagaa

SEQ ID NO: 7673356 - DNA, 22 bp, Homo sapiens
gatgaggaatttgaggttagaa

SEQ ID NO: 7673357 - DNA, 22 bp, Homo sapiens
gatgatgggcgctgtttactgg

SEQ ID NO: 7673358 - DNA, 22 bp, Homo sapiens
gatgatgggatccagcaatgta

SEQ ID NO: 7673359 - DNA, 22 bp, Homo sapiens
gatgatgggttgatgtgaaggg

SEQ ID NO: 7673360 - DNA, 22 bp, Homo sapiens
gatgatgggttgatgtgaaggg

SEQ ID NO: 7673361 - DNA, 22 bp, Homo sapiens
gatgatgggttgatgtgaaggg

SEQ ID NO: 7673362 - DNA, 22 bp, Homo sapiens
gatgatggtactgtatttgaat

SEQ ID NO: 7673363 - DNA, 22 bp, Homo sapiens
gatgatggtactgtatttgaat

SEQ ID NO: 7673364 - DNA, 22 bp, Homo sapiens
gatgatggtggacagctggtta

SEQ ID NO: 7673365 - DNA, 22 bp, Homo sapiens
gatgatggtggacagctggtta

SEQ ID NO: 7673366 - DNA, 22 bp, Homo sapiens
gatgatggtggacagctggtta

SEQ ID NO: 7673367 - DNA, 22 bp, Homo sapiens
gatgagctgtgtgtgagggtca

SEQ ID NO: 7673368 - DNA, 22 bp, Homo sapiens
gatgaggaaaccaaggctcagg

SEQ ID NO: 7673369 - DNA, 22 bp, Homo sapiens
gatgaggaaaccaaggctcagg

SEQ ID NO: 7673370 - DNA, 22 bp, Homo sapiens
gatgaggaaaccaaggctcagg

SEQ ID NO: 7673371 - DNA, 22 bp, Homo sapiens
gatgaggaatgctcagctcaat

SEQ ID NO: 7673372 - DNA, 22 bp, Homo sapiens
gatgagctgtctagctgttgga

SEQ ID NO: 7673373 - DNA, 22 bp, Homo sapiens
gatgagctgctcaatctgtggt

SEQ ID NO: 7673374 - DNA, 22 bp, Homo sapiens
gatgagcattgtttcatgtgtt

SEQ ID NO: 7673375 - DNA, 22 bp, Homo sapiens
gatgagaaggctcagatccaaa

SEQ ID NO: 7673376 - DNA, 22 bp, Homo sapiens
gatgagaatgtttatcaaatgc

SEQ ID NO: 7673377 - DNA, 22 bp, Homo sapiens
gatgagaaatggacaggagtgg

SEQ ID NO: 7673378 - DNA, 22 bp, Homo sapiens
gatgagacagaatagcccaagg

SEQ ID NO: 7673379 - DNA, 20 bp, Homo sapiens
gatgagacccatgcatgaga

SEQ ID NO: 7673380 - DNA, 22 bp, Homo sapiens
gatgagaatgtttatcaaatgc

SEQ ID NO: 7673381 - DNA, 22 bp, Homo sapiens
gatgagacagaatagcccaagg

SEQ ID NO: 7673382 - DNA, 22 bp, Homo sapiens
gatgagaaatggacaggagtgg

SEQ ID NO: 7673383 - DNA, 22 bp, Homo sapiens
gatgacttatgtttacaaatgt

SEQ ID NO: 7673384 - DNA, 22 bp, Homo sapiens
gatgacttatgtttacaaatgt

SEQ ID NO: 7673385 - DNA, 22 bp, Homo sapiens
gatgacttatgtttacaaatgt

SEQ ID NO: 7673386 - DNA, 20 bp, Homo sapiens
gatgacatactcacttaggg

SEQ ID NO: 7673387 - DNA, 22 bp, Homo sapiens
gatgacatctcaatttgttctt

SEQ ID NO: 7673388 - DNA, 22 bp, Homo sapiens
gatgaatgggtacacaggatga

SEQ ID NO: 7673389 - DNA, 22 bp, Homo sapiens
gatgaattctggcttggacaga

SEQ ID NO: 7673390 - DNA, 22 bp, Homo sapiens
gatgaattctggcttggacaga

SEQ ID NO: 7673391 - DNA, 22 bp, Homo sapiens
gatgaatgtgggtcaagtacct

SEQ ID NO: 7673392 - DNA, 22 bp, Homo sapiens
gatgaatgtgtccagaagactt

SEQ ID NO: 7673393 - DNA, 22 bp, Homo sapiens
gatgaatgagctgtgcacatta

SEQ ID NO: 7673394 - DNA, 22 bp, Homo sapiens
gatgaatgatggcttgtttctg

SEQ ID NO: 7673395 - DNA, 22 bp, Homo sapiens
gatgaatgggtacacaggatga

SEQ ID NO: 7673396 - DNA, 21 bp, Homo sapiens
gatgaatgtcctgaccagaac

SEQ ID NO: 7673397 - DNA, 22 bp, Homo sapiens
gatgacaaaacttttgccagca

SEQ ID NO: 7673398 - DNA, 22 bp, Homo sapiens
gatgacaaaagagtaagtaatg

SEQ ID NO: 7673399 - DNA, 22 bp, Homo sapiens
gatgacaacttgtttctgttat

SEQ ID NO: 7673400 - DNA, 22 bp, Homo sapiens
gatgacaagatctggatttgaa

SEQ ID NO: 7673401 - DNA, 22 bp, Homo sapiens
gatgacaagatctggatttgaa

SEQ ID NO: 7673402 - DNA, 22 bp, Homo sapiens
gatgaattgaaatcattgggca

SEQ ID NO: 7673403 - DNA, 22 bp, Homo sapiens
gatgaattgttatggctacgag

SEQ ID NO: 7673404 - DNA, 22 bp, Homo sapiens
gatgacagttctagcatctgaa

SEQ ID NO: 7673405 - DNA, 22 bp, Homo sapiens
gatgacagttctagcatctgaa

SEQ ID NO: 7673406 - DNA, 22 bp, Homo sapiens
gatgacagcagctgtggctcac

SEQ ID NO: 7673407 - DNA, 22 bp, Homo sapiens
gatgacagtgagtaaccccaac

SEQ ID NO: 7673408 - DNA, 22 bp, Homo sapiens
gatgacagcagctgtggctcac

SEQ ID NO: 7673409 - DNA, 22 bp, Homo sapiens
gatgacagcagctgtggctcac

SEQ ID NO: 7673410 - DNA, 22 bp, Homo sapiens
gatgacagcagctgtggctcac

SEQ ID NO: 7673411 - DNA, 22 bp, Homo sapiens
gatgacaagcatatgacacgtc

SEQ ID NO: 7673412 - DNA, 22 bp, Homo sapiens
gatgacactaagcatgttgtgg

SEQ ID NO: 7673413 - DNA, 22 bp, Homo sapiens
gatgacacttgtgagaaatcaa

SEQ ID NO: 7673414 - DNA, 22 bp, Homo sapiens
gatgacacttgtgagaaatcaa

SEQ ID NO: 7673415 - DNA, 22 bp, Homo sapiens
gatgaaatttgaaaatagtgtt

SEQ ID NO: 7673416 - DNA, 22 bp, Homo sapiens
gatgaaatttgaaaatagtgtt

SEQ ID NO: 7673417 - DNA, 22 bp, Homo sapiens
gatgaacatattcctctccaga

SEQ ID NO: 7673418 - DNA, 22 bp, Homo sapiens
gatgaaatttgggcaggttaaa

SEQ ID NO: 7673419 - DNA, 22 bp, Homo sapiens
gatgaaatttgggcaggttaaa

SEQ ID NO: 7673420 - DNA, 22 bp, Homo sapiens
gatgaagaggcactgacatatt

SEQ ID NO: 7673421 - DNA, 22 bp, Homo sapiens
gatgaacatttaaagcctcttg

SEQ ID NO: 7673422 - DNA, 22 bp, Homo sapiens
gatgaagaggcactgacatatt

SEQ ID NO: 7673423 - DNA, 21 bp, Homo sapiens
gatgaagcaatctttctgttg

SEQ ID NO: 7673424 - DNA, 21 bp, Homo sapiens
gatgaagcaatctttctgttg

SEQ ID NO: 7673425 - DNA, 22 bp, Homo sapiens
gatgaacatttaaagcctcttg

SEQ ID NO: 7673426 - DNA, 22 bp, Homo sapiens
gatgaagaggcactgacatatt

SEQ ID NO: 7673427 - DNA, 22 bp, Homo sapiens
gatgaagtcattatccttttgg

SEQ ID NO: 7673428 - DNA, 22 bp, Homo sapiens
gatgaagctttgaagtctaatc

SEQ ID NO: 7673429 - DNA, 18 bp, Homo sapiens
gatgaagctgctggggat

SEQ ID NO: 7673430 - DNA, 22 bp, Homo sapiens
gatgaagctaaatctaaggttt

SEQ ID NO: 7673431 - DNA, 22 bp, Homo sapiens
gatgaagctatttggttggcac

SEQ ID NO: 7673432 - DNA, 22 bp, Homo sapiens
gatgaagcctgacttctcggtg

SEQ ID NO: 7673433 - DNA, 22 bp, Homo sapiens
gatgaagccccagtgtaagtaa

SEQ ID NO: 7673434 - DNA, 22 bp, Homo sapiens
gatgaagccccagtgtaagtaa

SEQ ID NO: 7673435 - DNA, 22 bp, Homo sapiens
gatgcatgtatggagtgagggt

SEQ ID NO: 7673436 - DNA, 22 bp, Homo sapiens
gatgcatagtgaagctgacaga

SEQ ID NO: 7673437 - DNA, 22 bp, Homo sapiens
gatgcatgtatggagtgagggt

SEQ ID NO: 7673438 - DNA, 22 bp, Homo sapiens
gatgcatgtatggagtgagggt

SEQ ID NO: 7673439 - DNA, 22 bp, Homo sapiens
gatgcaggtgtgccacagagct

SEQ ID NO: 7673440 - DNA, 22 bp, Homo sapiens
gatgcagggctggcaggagctt

SEQ ID NO: 7673441 - DNA, 22 bp, Homo sapiens
gatgcagggctggcaggagctt

SEQ ID NO: 7673442 - DNA, 22 bp, Homo sapiens
gatgcagggctggcaggagctt

SEQ ID NO: 7673443 - DNA, 22 bp, Homo sapiens
gatgcagaaagtagacaccatc

SEQ ID NO: 7673444 - DNA, 22 bp, Homo sapiens
gatgcagcagccagcttctgaa

SEQ ID NO: 7673445 - DNA, 22 bp, Homo sapiens
gatgcacttgcccctcctcaga

SEQ ID NO: 7673446 - DNA, 22 bp, Homo sapiens
gatgcagggcagctctgggaca

SEQ ID NO: 7673447 - DNA, 22 bp, Homo sapiens
gatgcagggcagctctgggaca

SEQ ID NO: 7673448 - DNA, 22 bp, Homo sapiens
gatgcagggctggcaggagctt

SEQ ID NO: 7673449 - DNA, 22 bp, Homo sapiens
gatgcagggaacttagtgggct

SEQ ID NO: 7673450 - DNA, 22 bp, Homo sapiens
gatgcagggaacttagtgggct

SEQ ID NO: 7673451 - DNA, 22 bp, Homo sapiens
gatgcagggaacttagtgggct

SEQ ID NO: 7673452 - DNA, 22 bp, Homo sapiens
gatgcacggtcatgtcttttca

SEQ ID NO: 7673453 - DNA, 22 bp, Homo sapiens
gatgcacatgtgagtatagaag

SEQ ID NO: 7673454 - DNA, 22 bp, Homo sapiens
gatgcacattgaacaatcacaa

SEQ ID NO: 7673455 - DNA, 22 bp, Homo sapiens
gatgcacattgaacaatcacaa

SEQ ID NO: 7673456 - DNA, 22 bp, Homo sapiens
gatgcacatgtgagtatagaag

SEQ ID NO: 7673457 - DNA, 22 bp, Homo sapiens
gatgcacagtgaccctgccagt

SEQ ID NO: 7673458 - DNA, 22 bp, Homo sapiens
gatgcacagtgaccctgccagt

SEQ ID NO: 7673459 - DNA, 22 bp, Homo sapiens
gatgcacagtgaccctgccagt

SEQ ID NO: 7673460 - DNA, 22 bp, Homo sapiens
gatgcacaggtgagcaggtgca

SEQ ID NO: 7673461 - DNA, 21 bp, Homo sapiens
gatgcacaatgggtaagtaca

SEQ ID NO: 7673462 - DNA, 22 bp, Homo sapiens
gatgcacaaagcagagggaatc

SEQ ID NO: 7673463 - DNA, 22 bp, Homo sapiens
gatgcaaagcatttttgtgtgt

SEQ ID NO: 7673464 - DNA, 22 bp, Homo sapiens
gatgcacagagggcctggaact

SEQ ID NO: 7673465 - DNA, 21 bp, Homo sapiens
gatgcacaatgggtaagtaca

SEQ ID NO: 7673466 - DNA, 22 bp, Homo sapiens
gatgcacagccatgttaatgtg

SEQ ID NO: 7673467 - DNA, 22 bp, Homo sapiens
gatgcaaagataaaacagacgc

SEQ ID NO: 7673468 - DNA, 22 bp, Homo sapiens
gatgcaaagataaaacagacgc

SEQ ID NO: 7673469 - DNA, 22 bp, Homo sapiens
gatgcaaagataaaacagacgc

SEQ ID NO: 7673470 - DNA, 22 bp, Homo sapiens
gatgcaaagataaaacagacgc

SEQ ID NO: 7673471 - DNA, 22 bp, Homo sapiens
gatgcaaagcatttttgtgtgt

SEQ ID NO: 7673472 - DNA, 22 bp, Homo sapiens
gatgcaaagcatttttgtgtgt

SEQ ID NO: 7673473 - DNA, 22 bp, Homo sapiens
gatgcaaagataaaacagacgc

SEQ ID NO: 7673474 - DNA, 22 bp, Homo sapiens
gatgattttctgtgttagaaga

SEQ ID NO: 7673475 - DNA, 22 bp, Homo sapiens
gatgattttgatgcagtaaaga

SEQ ID NO: 7673476 - DNA, 22 bp, Homo sapiens
gatgattttgatgcagtaaaga

SEQ ID NO: 7673477 - DNA, 22 bp, Homo sapiens
gatgattttatgtcttgtcatt

SEQ ID NO: 7673478 - DNA, 22 bp, Homo sapiens
gatgattttctgtgttagaaga

SEQ ID NO: 7673479 - DNA, 22 bp, Homo sapiens
gatgattttctgtgttagaaga

SEQ ID NO: 7673480 - DNA, 22 bp, Homo sapiens
gatgattttctgtgttagaaga

SEQ ID NO: 7673481 - DNA, 22 bp, Homo sapiens
gatgatttgaggatttcatgag

SEQ ID NO: 7673482 - DNA, 22 bp, Homo sapiens
gatgattttagttgactaaact

SEQ ID NO: 7673483 - DNA, 22 bp, Homo sapiens
gatgatttgaggatttcatgag

SEQ ID NO: 7673484 - DNA, 22 bp, Homo sapiens
gatgatttgaggatttcatgag

SEQ ID NO: 7673485 - DNA, 22 bp, Homo sapiens
gatgattttagttgactaaact

SEQ ID NO: 7673486 - DNA, 22 bp, Homo sapiens
gatgattttatgtcttgtcatt

SEQ ID NO: 7673487 - DNA, 22 bp, Homo sapiens
gatgattttatgtcttgtcatt

SEQ ID NO: 7673488 - DNA, 22 bp, Homo sapiens
gatgatttaagtggccaaagta

SEQ ID NO: 7673489 - DNA, 22 bp, Homo sapiens
gatgatttaagtggccaaagta

SEQ ID NO: 7673490 - DNA, 22 bp, Homo sapiens
gatgatttctccattcccttct

SEQ ID NO: 7673491 - DNA, 22 bp, Homo sapiens
gatgatttctccattcccttct

SEQ ID NO: 7673492 - DNA, 22 bp, Homo sapiens
gatgatttaagtggccaaagta

SEQ ID NO: 7673493 - DNA, 22 bp, Homo sapiens
gatgatttctccattcccttct

SEQ ID NO: 7673494 - DNA, 22 bp, Homo sapiens
gatgatgtgtcccaagaagtag

SEQ ID NO: 7673495 - DNA, 22 bp, Homo sapiens
gatgattcctttgttcattgtg

SEQ ID NO: 7673496 - DNA, 22 bp, Homo sapiens
gatgattttgatgcagtaaaga

SEQ ID NO: 7673497 - DNA, 22 bp, Homo sapiens
gatgattttgatgcagtaaaga

SEQ ID NO: 7673498 - DNA, 22 bp, Homo sapiens
gatgattttgatgcagtaaaga

SEQ ID NO: 7673499 - DNA, 22 bp, Homo sapiens
gatgattttgttggtgattcaa

SEQ ID NO: 7673500 - DNA, 22 bp, Homo sapiens
gatgattttgttggtgattcaa

SEQ ID NO: 7673501 - DNA, 22 bp, Homo sapiens
gatgatttttgccagtgtgatg

SEQ ID NO: 7673502 - DNA, 22 bp, Homo sapiens
gatgatttttgccagtgtgatg

SEQ ID NO: 7673503 - DNA, 22 bp, Homo sapiens
gatgatttttgccagtgtgatg

SEQ ID NO: 7673504 - DNA, 22 bp, Homo sapiens
gatgcaaaagtatcattttaat

SEQ ID NO: 7673505 - DNA, 22 bp, Homo sapiens
gatgcaaaagtatcattttaat

SEQ ID NO: 7673506 - DNA, 22 bp, Homo sapiens
gatgcaaaagtatcattttaat

SEQ ID NO: 7673507 - DNA, 22 bp, Homo sapiens
gatgcaaaagtatcattttaat

SEQ ID NO: 7673508 - DNA, 22 bp, Homo sapiens
gatgcaaaccttacatggacct

SEQ ID NO: 7673509 - DNA, 22 bp, Homo sapiens
gatgcaaaccttacatggacct

SEQ ID NO: 7673510 - DNA, 22 bp, Homo sapiens
gatgcaaactgtgacatagagt

SEQ ID NO: 7673511 - DNA, 22 bp, Homo sapiens
gatgcaaactgtgacatagagt

SEQ ID NO: 7673512 - DNA, 22 bp, Homo sapiens
gatgcaaactgtgacatagagt

SEQ ID NO: 7673513 - DNA, 22 bp, Homo sapiens
gatgcaaaccttacatggacct

SEQ ID NO: 7673514 - DNA, 22 bp, Homo sapiens
gatgcaaaccttacatggacct

SEQ ID NO: 7673515 - DNA, 22 bp, Homo sapiens
gatgcaaaccttacatggacct

SEQ ID NO: 7673516 - DNA, 22 bp, Homo sapiens
gatgcaaactgtgacatagagt

SEQ ID NO: 7673517 - DNA, 22 bp, Homo sapiens
gatgcaaactgtgacatagagt

SEQ ID NO: 7673518 - DNA, 22 bp, Homo sapiens
gatgcaaagaggaccttcagta

SEQ ID NO: 7673519 - DNA, 22 bp, Homo sapiens
gatgcaaagaggaccttcagta

SEQ ID NO: 7673520 - DNA, 22 bp, Homo sapiens
gatgcaaagaggaccttcagta

SEQ ID NO: 7673521 - DNA, 22 bp, Homo sapiens
gatgaaatagaattaatttagg

SEQ ID NO: 7673522 - DNA, 22 bp, Homo sapiens
gatgaaatagaattaatttagg

SEQ ID NO: 7673523 - DNA, 22 bp, Homo sapiens
gatgaaaatcttgagatgtcga

SEQ ID NO: 7673524 - DNA, 22 bp, Homo sapiens
gatgaaaatcttgagatgtcga

SEQ ID NO: 7673525 - DNA, 22 bp, Homo sapiens
gatgaaaatcttgagatgtcga

SEQ ID NO: 7673526 - DNA, 22 bp, Homo sapiens
gatgaaaatcttgagatgtcga

SEQ ID NO: 7673527 - DNA, 22 bp, Homo sapiens
gatgaaaatcttgagatgtcga

SEQ ID NO: 7673528 - DNA, 22 bp, Homo sapiens
gatgaaaatcttgagatgtcga

SEQ ID NO: 7673529 - DNA, 22 bp, Homo sapiens
gatgaaaatcttgagatgtcga

SEQ ID NO: 7673530 - DNA, 22 bp, Homo sapiens
gatgaaaatcttgagatgtcga

SEQ ID NO: 7673531 - DNA, 22 bp, Homo sapiens
gatgaaaaattgctgtgtcata

SEQ ID NO: 7673532 - DNA, 22 bp, Homo sapiens
gatgaaaaattgctgtgtcata

SEQ ID NO: 7673533 - DNA, 22 bp, Homo sapiens
gatgaaaaattgctgtgtcata

SEQ ID NO: 7673534 - DNA, 22 bp, Homo sapiens
gatgaaaaattgctgtgtcata

SEQ ID NO: 7673535 - DNA, 22 bp, Homo sapiens
gatgaaaaattgctgtgtcata

SEQ ID NO: 7673536 - DNA, 22 bp, Homo sapiens
gatgaaaaattgctgtgtcata

SEQ ID NO: 7673537 - DNA, 22 bp, Homo sapiens
gatgaaaaattgctgtgtcata

SEQ ID NO: 7673538 - DNA, 22 bp, Homo sapiens
gatgaaaaaagacgagcatata

SEQ ID NO: 7673539 - DNA, 22 bp, Homo sapiens
gatgaaaaattgctgtgtcata

SEQ ID NO: 7673540 - DNA, 22 bp, Homo sapiens
gatgaaaaattgctgtgtcata

SEQ ID NO: 7673541 - DNA, 22 bp, Homo sapiens
gatgaaaaattgctgtgtcata

SEQ ID NO: 7673542 - DNA, 22 bp, Homo sapiens
gatgaaaaattgctgtgtcata

SEQ ID NO: 7673543 - DNA, 22 bp, Homo sapiens
gatctttgcaaactttgtcact

SEQ ID NO: 7673544 - DNA, 19 bp, Homo sapiens
gatctttgccaatttaagc

SEQ ID NO: 7673545 - DNA, 22 bp, Homo sapiens
gatctttatactgtaataatga

SEQ ID NO: 7673546 - DNA, 22 bp, Homo sapiens
gatcttttcagaatttatcagt

SEQ ID NO: 7673547 - DNA, 22 bp, Homo sapiens
gatcttttcagaatttatcagt

SEQ ID NO: 7673548 - DNA, 19 bp, Homo sapiens
gatctttgccaatttaagc

SEQ ID NO: 7673549 - DNA, 22 bp, Homo sapiens
gatcttttcagaatttatcagt

SEQ ID NO: 7673550 - DNA, 22 bp, Homo sapiens
gatgaaaaaagacgagcatata

SEQ ID NO: 7673551 - DNA, 22 bp, Homo sapiens
gatgaaaaaagacgagcatata

SEQ ID NO: 7673552 - DNA, 22 bp, Homo sapiens
gatgaaaaaagacgagcatata

SEQ ID NO: 7673553 - DNA, 22 bp, Homo sapiens
gatgaaaaaagacgagcatata

SEQ ID NO: 7673554 - DNA, 22 bp, Homo sapiens
gatgaaaaaagacgagcatata

SEQ ID NO: 7673555 - DNA, 22 bp, Homo sapiens
gatcttttcaggtttctctagt

SEQ ID NO: 7673556 - DNA, 22 bp, Homo sapiens
gatcttttcaggtttctctagt

SEQ ID NO: 7673557 - DNA, 22 bp, Homo sapiens
gatgaaaaaagacgagcatata

SEQ ID NO: 7673558 - DNA, 22 bp, Homo sapiens
gatgaaaaaagacgagcatata

SEQ ID NO: 7673559 - DNA, 22 bp, Homo sapiens
gatgaaatgtgaaagttctggg

SEQ ID NO: 7673560 - DNA, 22 bp, Homo sapiens
gatgaaatgtgaaagttctggg

SEQ ID NO: 7673561 - DNA, 22 bp, Homo sapiens
gatgaaattcagaattgagggg

SEQ ID NO: 7673562 - DNA, 22 bp, Homo sapiens
gatgaaatgtgaaagttctggg

SEQ ID NO: 7673563 - DNA, 22 bp, Homo sapiens
gatgaaatgtgaaagttctggg

SEQ ID NO: 7673564 - DNA, 22 bp, Homo sapiens
gatgaaatgctgagcctgagtt

SEQ ID NO: 7673565 - DNA, 17 bp, Homo sapiens
gatgaaatgatgcacac

SEQ ID NO: 7673566 - DNA, 22 bp, Homo sapiens
gatgaaatgtgaaagttctggg

SEQ ID NO: 7673567 - DNA, 22 bp, Homo sapiens
gatgaaatgctgagcctgagtt

SEQ ID NO: 7673568 - DNA, 22 bp, Homo sapiens
gatgaaattcagaattgagggg

SEQ ID NO: 7673569 - DNA, 22 bp, Homo sapiens
gatgaaattcagaattgagggg

SEQ ID NO: 7673570 - DNA, 22 bp, Homo sapiens
gatgaaattcagaattgagggg

SEQ ID NO: 7673571 - DNA, 22 bp, Homo sapiens
gatgaaattcagaattgagggg

SEQ ID NO: 7673572 - DNA, 22 bp, Homo sapiens
gatgaaattgttttgatacttt

SEQ ID NO: 7673573 - DNA, 22 bp, Homo sapiens
gatgaaattgttttgatacttt

SEQ ID NO: 7673574 - DNA, 22 bp, Homo sapiens
gatgaaattcagaattgagggg

SEQ ID NO: 7673575 - DNA, 22 bp, Homo sapiens
gatgaaatttgaaaatagtgtt

SEQ ID NO: 7673576 - DNA, 22 bp, Homo sapiens
gatgaaatttgaaaatagtgtt

SEQ ID NO: 7673577 - DNA, 22 bp, Homo sapiens
gatgaaattgttttgatacttt

SEQ ID NO: 7673578 - DNA, 22 bp, Homo sapiens
gatgaaatccagatcacaggtg

SEQ ID NO: 7673579 - DNA, 22 bp, Homo sapiens
gatgaaatccagatcacaggtg

SEQ ID NO: 7673580 - DNA, 22 bp, Homo sapiens
gatgaaatccagatcacaggtg

SEQ ID NO: 7673581 - DNA, 20 bp, Homo sapiens
gatgaaatcactgggcagcc

SEQ ID NO: 7673582 - DNA, 22 bp, Homo sapiens
gatgaaatccagatcacaggtg

SEQ ID NO: 7673583 - DNA, 17 bp, Homo sapiens
gatgaaatgatgcacac

SEQ ID NO: 7673584 - DNA, 17 bp, Homo sapiens
gatgaaatgatgcacac

SEQ ID NO: 7673585 - DNA, 22 bp, Homo sapiens
gatgaaatagaattaatttagg

SEQ ID NO: 7673586 - DNA, 22 bp, Homo sapiens
gatgaaatagaattaatttagg

SEQ ID NO: 7673587 - DNA, 22 bp, Homo sapiens
gatgaaatagaattaatttagg

SEQ ID NO: 7673588 - DNA, 22 bp, Homo sapiens
gatgaaatagcaaaggcatttg

SEQ ID NO: 7673589 - DNA, 22 bp, Homo sapiens
gatgaaatagcaaaggcatttg

SEQ ID NO: 7673590 - DNA, 20 bp, Homo sapiens
gatgaaatcactgggcagcc

SEQ ID NO: 7673591 - DNA, 20 bp, Homo sapiens
gatgaaatcactgggcagcc

SEQ ID NO: 7673592 - DNA, 22 bp, Homo sapiens
gatcatttgactttataaggct

SEQ ID NO: 7673593 - DNA, 22 bp, Homo sapiens
gatcatttgcaggaaacattaa

SEQ ID NO: 7673594 - DNA, 22 bp, Homo sapiens
gatcatttcagtccagtaaata

SEQ ID NO: 7673595 - DNA, 22 bp, Homo sapiens
gatcatttcagtccagtaaata

SEQ ID NO: 7673596 - DNA, 22 bp, Homo sapiens
gatcatttgactttataaggct

SEQ ID NO: 7673597 - DNA, 22 bp, Homo sapiens
gatcatttgcaggaaacattaa

SEQ ID NO: 7673598 - DNA, 22 bp, Homo sapiens
gatcatttgcaggaaacattaa

SEQ ID NO: 7673599 - DNA, 22 bp, Homo sapiens
gatcattttgatgcccttttag

SEQ ID NO: 7673600 - DNA, 22 bp, Homo sapiens
gatcattttatagctatagcaa

SEQ ID NO: 7673601 - DNA, 22 bp, Homo sapiens
gatcattttatagctatagcaa

SEQ ID NO: 7673602 - DNA, 22 bp, Homo sapiens
gatcattttgatgcccttttag

SEQ ID NO: 7673603 - DNA, 22 bp, Homo sapiens
gatcattttgtatagcaaaggt

SEQ ID NO: 7673604 - DNA, 22 bp, Homo sapiens
gatcattttgtatagcaaaggt

SEQ ID NO: 7673605 - DNA, 22 bp, Homo sapiens
gatccacagggccctggcccag

SEQ ID NO: 7673606 - DNA, 22 bp, Homo sapiens
gatccacaggaaccaaaacgca

SEQ ID NO: 7673607 - DNA, 22 bp, Homo sapiens
gatccacagctgcggtaggaga

SEQ ID NO: 7673608 - DNA, 22 bp, Homo sapiens
gatccacagcccgcttgggccc

SEQ ID NO: 7673609 - DNA, 22 bp, Homo sapiens
gatcattttgtatagcaaaggt

SEQ ID NO: 7673610 - DNA, 19 bp, Homo sapiens
gatcatttttgcactgctt

SEQ ID NO: 7673611 - DNA, 19 bp, Homo sapiens
gatcatttttgcactgctt

SEQ ID NO: 7673612 - DNA, 22 bp, Homo sapiens
gatcattttgtatagcaaaggt

SEQ ID NO: 7673613 - DNA, 22 bp, Homo sapiens
gatccaaattattttttagagg

SEQ ID NO: 7673614 - DNA, 22 bp, Homo sapiens
gatccacagtttgatgatcata

SEQ ID NO: 7673615 - DNA, 21 bp, Homo sapiens
gatccactgacctggggatcc

SEQ ID NO: 7673616 - DNA, 22 bp, Homo sapiens
gatccacagtttgatgatcata

SEQ ID NO: 7673617 - DNA, 22 bp, Homo sapiens
gatccagatatttgggctggta

SEQ ID NO: 7673618 - DNA, 22 bp, Homo sapiens
gatccagatatttgggctggta

SEQ ID NO: 7673619 - DNA, 22 bp, Homo sapiens
gatccagatatttgggctggta

SEQ ID NO: 7673620 - DNA, 22 bp, Homo sapiens
gatccagcttctacacagagct

SEQ ID NO: 7673621 - DNA, 22 bp, Homo sapiens
gatccagcttctacacagagct

SEQ ID NO: 7673622 - DNA, 22 bp, Homo sapiens
gatccctgccctcagcctggac

SEQ ID NO: 7673623 - DNA, 22 bp, Homo sapiens
gatccctgccctcagcctggac

SEQ ID NO: 7673624 - DNA, 22 bp, Homo sapiens
gatccccagggcaggcctcccg

SEQ ID NO: 7673625 - DNA, 22 bp, Homo sapiens
gatccagatatttgggctggta

SEQ ID NO: 7673626 - DNA, 22 bp, Homo sapiens
gatccccaggactagggggtgg

SEQ ID NO: 7673627 - DNA, 22 bp, Homo sapiens
gatcccaggtgatcttatttgt

SEQ ID NO: 7673628 - DNA, 22 bp, Homo sapiens
gatcccatgtaggagaatgtta

SEQ ID NO: 7673629 - DNA, 22 bp, Homo sapiens
gatcctcttttcctaggaaggt

SEQ ID NO: 7673630 - DNA, 22 bp, Homo sapiens
gatcccttgggccaaggagttg

SEQ ID NO: 7673631 - DNA, 22 bp, Homo sapiens
gatctgggctggagactgagaa

SEQ ID NO: 7673632 - DNA, 22 bp, Homo sapiens
gatctgggctggagactgagaa

SEQ ID NO: 7673633 - DNA, 22 bp, Homo sapiens
gatcctaggccggcagcagaga

SEQ ID NO: 7673634 - DNA, 22 bp, Homo sapiens
gatctgggagcctcatggagac

SEQ ID NO: 7673635 - DNA, 22 bp, Homo sapiens
gatctgtttcaattgtcttagt

SEQ ID NO: 7673636 - DNA, 22 bp, Homo sapiens
gatctgtttcaattgtcttagt

SEQ ID NO: 7673637 - DNA, 22 bp, Homo sapiens
gatctgttataatctcttttat

SEQ ID NO: 7673638 - DNA, 22 bp, Homo sapiens
gatctgtcctggcagttaacac

SEQ ID NO: 7673639 - DNA, 22 bp, Homo sapiens
gatctgtccagaaagtgtgtac

SEQ ID NO: 7673640 - DNA, 22 bp, Homo sapiens
gatctgtcaggttcatccgcaa

SEQ ID NO: 7673641 - DNA, 22 bp, Homo sapiens
gatctgggagcctcatggagac

SEQ ID NO: 7673642 - DNA, 22 bp, Homo sapiens
gatcttctgaactggagtatct

SEQ ID NO: 7673643 - DNA, 22 bp, Homo sapiens
gatcttctgaactggagtatct

SEQ ID NO: 7673644 - DNA, 22 bp, Homo sapiens
gatcttctttctctgtagaggt

SEQ ID NO: 7673645 - DNA, 22 bp, Homo sapiens
gatcttctctttagtagaaaca

SEQ ID NO: 7673646 - DNA, 22 bp, Homo sapiens
gatcttctctttagtagaaaca

SEQ ID NO: 7673647 - DNA, 22 bp, Homo sapiens
gatcttctctttagtagaaaca

SEQ ID NO: 7673648 - DNA, 22 bp, Homo sapiens
gatcttctatgtaatgaagtgt

SEQ ID NO: 7673649 - DNA, 22 bp, Homo sapiens
gatcttctatgtaatgaagtgt

SEQ ID NO: 7673650 - DNA, 22 bp, Homo sapiens
gatctgtttgcctagagattta

SEQ ID NO: 7673651 - DNA, 22 bp, Homo sapiens
gatcttctagcagaagtaattt

SEQ ID NO: 7673652 - DNA, 22 bp, Homo sapiens
gatcttggaatggcacagctga

SEQ ID NO: 7673653 - DNA, 22 bp, Homo sapiens
gatctttatactgtaataatga

SEQ ID NO: 7673654 - DNA, 22 bp, Homo sapiens
gatagcagctctggggtcagac

SEQ ID NO: 7673655 - DNA, 22 bp, Homo sapiens
gatagcaacatagaacagaatt

SEQ ID NO: 7673656 - DNA, 22 bp, Homo sapiens
gatagataaaactatattttca

SEQ ID NO: 7673657 - DNA, 22 bp, Homo sapiens
gatagagactataatgctcttt

SEQ ID NO: 7673658 - DNA, 22 bp, Homo sapiens
gatagagactataatgctcttt

SEQ ID NO: 7673659 - DNA, 22 bp, Homo sapiens
gatagagactataatgctcttt

SEQ ID NO: 7673660 - DNA, 22 bp, Homo sapiens
gatagagaaacacagataaatg

SEQ ID NO: 7673661 - DNA, 22 bp, Homo sapiens
gatagagactataatgctcttt

SEQ ID NO: 7673662 - DNA, 22 bp, Homo sapiens
gatagaaaggtgttgaaatcca

SEQ ID NO: 7673663 - DNA, 22 bp, Homo sapiens
gatagaaagagtggttcttttt

SEQ ID NO: 7673664 - DNA, 22 bp, Homo sapiens
gatagaaagagtggttcttttt

SEQ ID NO: 7673665 - DNA, 22 bp, Homo sapiens
gatagaaagaatatagattcca

SEQ ID NO: 7673666 - DNA, 22 bp, Homo sapiens
gatagaaagagtggttcttttt

SEQ ID NO: 7673667 - DNA, 22 bp, Homo sapiens
gatagaaagagtggttcttttt

SEQ ID NO: 7673668 - DNA, 22 bp, Homo sapiens
gatagaaaggtgttgaaatcca

SEQ ID NO: 7673669 - DNA, 22 bp, Homo sapiens
gatagaaaggtgttgaaatcca

SEQ ID NO: 7673670 - DNA, 22 bp, Homo sapiens
gatagaaaggtgttgaaatcca

SEQ ID NO: 7673671 - DNA, 22 bp, Homo sapiens
gatagaaaggtgttgaaatcca

SEQ ID NO: 7673672 - DNA, 22 bp, Homo sapiens
gatagaaagaatatagattcca

SEQ ID NO: 7673673 - DNA, 22 bp, Homo sapiens
gatagaaagaatatagattcca

SEQ ID NO: 7673674 - DNA, 22 bp, Homo sapiens
gatagaaagaatatagattcca

SEQ ID NO: 7673675 - DNA, 22 bp, Homo sapiens
gatagaaagaatatagattcca

SEQ ID NO: 7673676 - DNA, 22 bp, Homo sapiens
gatagaaagaatatagattcca

SEQ ID NO: 7673677 - DNA, 22 bp, Homo sapiens
gatagaaagaatatagattcca

SEQ ID NO: 7673678 - DNA, 22 bp, Homo sapiens
gatagaaagaatatagattcca

SEQ ID NO: 7673679 - DNA, 22 bp, Homo sapiens
gatactttgtggaatcctggat

SEQ ID NO: 7673680 - DNA, 22 bp, Homo sapiens
gatactttctcatttacccaag

SEQ ID NO: 7673681 - DNA, 22 bp, Homo sapiens
gatactttccatccaaatgcat

SEQ ID NO: 7673682 - DNA, 22 bp, Homo sapiens
gataccagagcccaaagcagca

SEQ ID NO: 7673683 - DNA, 22 bp, Homo sapiens
gatacccagcaaaatgcaggag

SEQ ID NO: 7673684 - DNA, 22 bp, Homo sapiens
gataccagacagggagggagaa

SEQ ID NO: 7673685 - DNA, 22 bp, Homo sapiens
gataccagacagggagggagaa

SEQ ID NO: 7673686 - DNA, 22 bp, Homo sapiens
gataccagacagggagggagaa

SEQ ID NO: 7673687 - DNA, 22 bp, Homo sapiens
gatactcatttcagtgctttac

SEQ ID NO: 7673688 - DNA, 22 bp, Homo sapiens
gatactgtggtgcatctggagt

SEQ ID NO: 7673689 - DNA, 22 bp, Homo sapiens
gatactttccatccaaatgcat

SEQ ID NO: 7673690 - DNA, 22 bp, Homo sapiens
gatactgttttgtttgtgaggt

SEQ ID NO: 7673691 - DNA, 22 bp, Homo sapiens
gatactttccatccaaatgcat

SEQ ID NO: 7673692 - DNA, 22 bp, Homo sapiens
gatataaattaatcaagtgcaa

SEQ ID NO: 7673693 - DNA, 22 bp, Homo sapiens
gatataaattaatcaagtgcaa

SEQ ID NO: 7673694 - DNA, 19 bp, Homo sapiens
gatataaagagatggtgaa

SEQ ID NO: 7673695 - DNA, 22 bp, Homo sapiens
gatataaattaatcaagtgcaa

SEQ ID NO: 7673696 - DNA, 22 bp, Homo sapiens
gatataaattaatcaagtgcaa

SEQ ID NO: 7673697 - DNA, 22 bp, Homo sapiens
gatataaattaatcaagtgcaa

SEQ ID NO: 7673698 - DNA, 22 bp, Homo sapiens
gatataaattaatcaagtgcaa

SEQ ID NO: 7673699 - DNA, 22 bp, Homo sapiens
gatatacaatccacagttgatt

SEQ ID NO: 7673700 - DNA, 22 bp, Homo sapiens
gatatacagagcattctttgat

SEQ ID NO: 7673701 - DNA, 22 bp, Homo sapiens
gatatacagagcattctttgat

SEQ ID NO: 7673702 - DNA, 22 bp, Homo sapiens
gatatacagagcattctttgat

SEQ ID NO: 7673703 - DNA, 22 bp, Homo sapiens
gatatacagagcattctttgat

SEQ ID NO: 7673704 - DNA, 22 bp, Homo sapiens
gatatacagagcattctttgat

SEQ ID NO: 7673705 - DNA, 22 bp, Homo sapiens
gatatacaatccacagttgatt

SEQ ID NO: 7673706 - DNA, 22 bp, Homo sapiens
gatatacaatccacagttgatt

SEQ ID NO: 7673707 - DNA, 22 bp, Homo sapiens
gatatacaatccacagttgatt

SEQ ID NO: 7673708 - DNA, 22 bp, Homo sapiens
gatataaattaatcaagtgcaa

SEQ ID NO: 7673709 - DNA, 22 bp, Homo sapiens
gatatacaatccacagttgatt

SEQ ID NO: 7673710 - DNA, 22 bp, Homo sapiens
gatatacaatccacagttgatt

SEQ ID NO: 7673711 - DNA, 22 bp, Homo sapiens
gatatacaatccacagttgatt

SEQ ID NO: 7673712 - DNA, 22 bp, Homo sapiens
gatagctgctgggatattttta

SEQ ID NO: 7673713 - DNA, 19 bp, Homo sapiens
gatagctgatgaccatcat

SEQ ID NO: 7673714 - DNA, 22 bp, Homo sapiens
gatagctgctgggatattttta

SEQ ID NO: 7673715 - DNA, 22 bp, Homo sapiens
gataggagatgatccaatggga

SEQ ID NO: 7673716 - DNA, 22 bp, Homo sapiens
gatagggcttcactaggcggag

SEQ ID NO: 7673717 - DNA, 19 bp, Homo sapiens
gataggcagccatgagccc

SEQ ID NO: 7673718 - DNA, 22 bp, Homo sapiens
gataggctggccttgggcaaaa

SEQ ID NO: 7673719 - DNA, 19 bp, Homo sapiens
gatataaagagatggtgaa

SEQ ID NO: 7673720 - DNA, 19 bp, Homo sapiens
gatataaagagatggtgaa

SEQ ID NO: 7673721 - DNA, 19 bp, Homo sapiens
gatataaagagatggtgaa

SEQ ID NO: 7673722 - DNA, 19 bp, Homo sapiens
gatataaagagatggtgaa

SEQ ID NO: 7673723 - DNA, 22 bp, Homo sapiens
gatagtcacctcccttaacttt

SEQ ID NO: 7673724 - DNA, 22 bp, Homo sapiens
gatagtcgaaattgatggagag

SEQ ID NO: 7673725 - DNA, 22 bp, Homo sapiens
gatagtcacctcccttaacttt

SEQ ID NO: 7673726 - DNA, 22 bp, Homo sapiens
gatacactggagcttcctgaca

SEQ ID NO: 7673727 - DNA, 22 bp, Homo sapiens
gatacactggccaagtggagga

SEQ ID NO: 7673728 - DNA, 22 bp, Homo sapiens
gatacactggagcttcctgaca

SEQ ID NO: 7673729 - DNA, 22 bp, Homo sapiens
gatacactggccaagtggagga

SEQ ID NO: 7673730 - DNA, 23 bp, Homo sapiens
gatacactccctgctgggcactg

SEQ ID NO: 7673731 - DNA, 23 bp, Homo sapiens
gatacactccctgctgggcactg

SEQ ID NO: 7673732 - DNA, 23 bp, Homo sapiens
gatacactccctgctgggcactg

SEQ ID NO: 7673733 - DNA, 22 bp, Homo sapiens
gatacacattttagctttgtct

SEQ ID NO: 7673734 - DNA, 21 bp, Homo sapiens
gatacagagggccactgattg

SEQ ID NO: 7673735 - DNA, 21 bp, Homo sapiens
gatacagagggccactgattg

SEQ ID NO: 7673736 - DNA, 22 bp, Homo sapiens
gatacagacaccactcttttcc

SEQ ID NO: 7673737 - DNA, 22 bp, Homo sapiens
gatacagacaccactcttttcc

SEQ ID NO: 7673738 - DNA, 22 bp, Homo sapiens
gatacagtatttaaagagcaac

SEQ ID NO: 7673739 - DNA, 22 bp, Homo sapiens
gatacagtatttaaagagcaac

SEQ ID NO: 7673740 - DNA, 21 bp, Homo sapiens
gatacagagggccactgattg

SEQ ID NO: 7673741 - DNA, 22 bp, Homo sapiens
gatacagtatttaaagagcaac

SEQ ID NO: 7673742 - DNA, 22 bp, Homo sapiens
gatacattgagggtggaggacc

SEQ ID NO: 7673743 - DNA, 22 bp, Homo sapiens
gatacattccgggagggctacc

SEQ ID NO: 7673744 - DNA, 22 bp, Homo sapiens
gatacattgagggtggaggacc

SEQ ID NO: 7673745 - DNA, 22 bp, Homo sapiens
gatacattccgggagggctacc

SEQ ID NO: 7673746 - DNA, 22 bp, Homo sapiens
gatacattccatttctacttaa

SEQ ID NO: 7673747 - DNA, 22 bp, Homo sapiens
gatacattccatttctacttaa

SEQ ID NO: 7673748 - DNA, 22 bp, Homo sapiens
gatacattccatttctacttaa

SEQ ID NO: 7673749 - DNA, 22 bp, Homo sapiens
gatacattttatctcctaacag

SEQ ID NO: 7673750 - DNA, 22 bp, Homo sapiens
gataccaaaatcatcttatagg

SEQ ID NO: 7673751 - DNA, 22 bp, Homo sapiens
gataccagacagggagggagaa

SEQ ID NO: 7673752 - DNA, 22 bp, Homo sapiens
gataccagacagggagggagaa

SEQ ID NO: 7673753 - DNA, 22 bp, Homo sapiens
gatacatttcaaggaggactgg

SEQ ID NO: 7673754 - DNA, 22 bp, Homo sapiens
gatacattgagggtggaggacc

SEQ ID NO: 7673755 - DNA, 22 bp, Homo sapiens
gatacatttcaaggaggactgg

SEQ ID NO: 7673756 - DNA, 22 bp, Homo sapiens
gatacattttatctcctaacag

SEQ ID NO: 7673757 - DNA, 22 bp, Homo sapiens
gatacattttatctcctaacag

SEQ ID NO: 7673758 - DNA, 22 bp, Homo sapiens
gatacatttcaaggaggactgg

SEQ ID NO: 7673759 - DNA, 22 bp, Homo sapiens
gataagggccagtgggcagtag

SEQ ID NO: 7673760 - DNA, 21 bp, Homo sapiens
gataaggcaggaggataagta

SEQ ID NO: 7673761 - DNA, 22 bp, Homo sapiens
gataagcagcagccgttatagg

SEQ ID NO: 7673762 - DNA, 22 bp, Homo sapiens
gataactacacttaagacaacc

SEQ ID NO: 7673763 - DNA, 22 bp, Homo sapiens
gataactacacttaagacaacc

SEQ ID NO: 7673764 - DNA, 22 bp, Homo sapiens
gataagcactatataagtattt

SEQ ID NO: 7673765 - DNA, 22 bp, Homo sapiens
gataatatctggtttattcacc

SEQ ID NO: 7673766 - DNA, 22 bp, Homo sapiens
gataatatctggtttattcacc

SEQ ID NO: 7673767 - DNA, 22 bp, Homo sapiens
gataatatctggtttattcacc

SEQ ID NO: 7673768 - DNA, 22 bp, Homo sapiens
gataatatctggtttattcacc

SEQ ID NO: 7673769 - DNA, 22 bp, Homo sapiens
gataatatctggtttattcacc

SEQ ID NO: 7673770 - DNA, 22 bp, Homo sapiens
gataatacttattaagcactta

SEQ ID NO: 7673771 - DNA, 19 bp, Homo sapiens
gataagtttccaggtaact

SEQ ID NO: 7673772 - DNA, 22 bp, Homo sapiens
gataagttatgtaacttgctca

SEQ ID NO: 7673773 - DNA, 22 bp, Homo sapiens
gataataagcacagcaggatgt

SEQ ID NO: 7673774 - DNA, 20 bp, Homo sapiens
gatacacagcttcactgttg

SEQ ID NO: 7673775 - DNA, 22 bp, Homo sapiens
gatacacagggctaagatggat

SEQ ID NO: 7673776 - DNA, 22 bp, Homo sapiens
gatacacagggctaagatggat

SEQ ID NO: 7673777 - DNA, 15 bp, Homo sapiens
gatacacatgactgg

SEQ ID NO: 7673778 - DNA, 22 bp, Homo sapiens
gatacacatgcatgtgcatgta

SEQ ID NO: 7673779 - DNA, 22 bp, Homo sapiens
gatacacattttagctttgtct

SEQ ID NO: 7673780 - DNA, 22 bp, Homo sapiens
gatacacaagtggaaggagacg

SEQ ID NO: 7673781 - DNA, 22 bp, Homo sapiens
gataatatctggtttattcacc

SEQ ID NO: 7673782 - DNA, 22 bp, Homo sapiens
gatacacacccttgataggact

SEQ ID NO: 7673783 - DNA, 22 bp, Homo sapiens
gatacacacccttgataggact

SEQ ID NO: 7673784 - DNA, 22 bp, Homo sapiens
gatacacacccttgataggact

SEQ ID NO: 7673785 - DNA, 20 bp, Homo sapiens
gatacacagcacagagggcc

SEQ ID NO: 7673786 - DNA, 20 bp, Homo sapiens
gatacacagcacagagggcc

SEQ ID NO: 7673787 - DNA, 22 bp, Homo sapiens
gatcagagagctctttatggcc

SEQ ID NO: 7673788 - DNA, 22 bp, Homo sapiens
gatcacatgaatggaatagaag

SEQ ID NO: 7673789 - DNA, 22 bp, Homo sapiens
gatcagaattcttgtgtgtttc

SEQ ID NO: 7673790 - DNA, 22 bp, Homo sapiens
gatcagaatttacttataattg

SEQ ID NO: 7673791 - DNA, 22 bp, Homo sapiens
gatcagagtggctagagccttg

SEQ ID NO: 7673792 - DNA, 22 bp, Homo sapiens
gatcagagagttagaaatgtca

SEQ ID NO: 7673793 - DNA, 19 bp, Homo sapiens
gatcagagtgtcagcttgt

SEQ ID NO: 7673794 - DNA, 20 bp, Homo sapiens
gatcaggaagcggcttggga

SEQ ID NO: 7673795 - DNA, 20 bp, Homo sapiens
gatcaggaagcggcttggga

SEQ ID NO: 7673796 - DNA, 20 bp, Homo sapiens
gatcaggaagcggcttggga

SEQ ID NO: 7673797 - DNA, 22 bp, Homo sapiens
gatcaggaatattggaaagtac

SEQ ID NO: 7673798 - DNA, 22 bp, Homo sapiens
gatcaggaatattggaaagtac

SEQ ID NO: 7673799 - DNA, 22 bp, Homo sapiens
gatcaggaatattggaaagtac

SEQ ID NO: 7673800 - DNA, 22 bp, Homo sapiens
gatcaggaatattggaaagtac

SEQ ID NO: 7673801 - DNA, 22 bp, Homo sapiens
gatcaggaatattggaaagtac

SEQ ID NO: 7673802 - DNA, 22 bp, Homo sapiens
gatcaggacatagctataggct

SEQ ID NO: 7673803 - DNA, 22 bp, Homo sapiens
gatcaggacatagctataggct

SEQ ID NO: 7673804 - DNA, 22 bp, Homo sapiens
gatcaggacatagctataggct

SEQ ID NO: 7673805 - DNA, 22 bp, Homo sapiens
gatcaggagatggcctcagacc

SEQ ID NO: 7673806 - DNA, 22 bp, Homo sapiens
gatcaggagatggcctcagacc

SEQ ID NO: 7673807 - DNA, 22 bp, Homo sapiens
gatcaggagatggcctcagacc

SEQ ID NO: 7673808 - DNA, 18 bp, Homo sapiens
gatcaggatcaatcaccc

SEQ ID NO: 7673809 - DNA, 18 bp, Homo sapiens
gatcaggatcaatcaccc

SEQ ID NO: 7673810 - DNA, 18 bp, Homo sapiens
gatcaggatcaatcaccc

SEQ ID NO: 7673811 - DNA, 19 bp, Homo sapiens
gatcaggagccgacaactg

SEQ ID NO: 7673812 - DNA, 19 bp, Homo sapiens
gatcaggagccgacaactg

SEQ ID NO: 7673813 - DNA, 19 bp, Homo sapiens
gatcaggagccgacaactg

SEQ ID NO: 7673814 - DNA, 22 bp, Homo sapiens
gatcagtaagtgaataatgagt

SEQ ID NO: 7673815 - DNA, 22 bp, Homo sapiens
gatcaggacatagctataggct

SEQ ID NO: 7673816 - DNA, 22 bp, Homo sapiens
gatcagtaagtgaataatgagt

SEQ ID NO: 7673817 - DNA, 22 bp, Homo sapiens
gatcaggacatagctataggct

SEQ ID NO: 7673818 - DNA, 22 bp, Homo sapiens
gatcatagcgtcttcttgcagc

SEQ ID NO: 7673819 - DNA, 22 bp, Homo sapiens
gatcatgaaccactggaattcc

SEQ ID NO: 7673820 - DNA, 22 bp, Homo sapiens
gatcatcatggctctggagctg

SEQ ID NO: 7673821 - DNA, 22 bp, Homo sapiens
gatcatgctggctgccctgttg

SEQ ID NO: 7673822 - DNA, 22 bp, Homo sapiens
gatcatgcttaaagttggagtc

SEQ ID NO: 7673823 - DNA, 22 bp, Homo sapiens
gatcatgcttaaagttggagtc

SEQ ID NO: 7673824 - DNA, 22 bp, Homo sapiens
gatcatcatggctctggagctg

SEQ ID NO: 7673825 - DNA, 22 bp, Homo sapiens
gatcatcaagcaagaacctgat

SEQ ID NO: 7673826 - DNA, 22 bp, Homo sapiens
gatcatcatctttcaggcaagt

SEQ ID NO: 7673827 - DNA, 22 bp, Homo sapiens
gatcattagcttttcaaaggag

SEQ ID NO: 7673828 - DNA, 22 bp, Homo sapiens
gatcatttacttgttctggact

SEQ ID NO: 7673829 - DNA, 22 bp, Homo sapiens
gatcatttacttgttctggact

SEQ ID NO: 7673830 - DNA, 22 bp, Homo sapiens
gatcatttcagtccagtaaata

SEQ ID NO: 7673831 - DNA, 22 bp, Homo sapiens
gatcaattcaaactattttcct

SEQ ID NO: 7673832 - DNA, 22 bp, Homo sapiens
gatcacagtattttagatgtgt

SEQ ID NO: 7673833 - DNA, 22 bp, Homo sapiens
gatcacaatttagactttttaa

SEQ ID NO: 7673834 - DNA, 22 bp, Homo sapiens
gatcacaatttagactttttaa

SEQ ID NO: 7673835 - DNA, 22 bp, Homo sapiens
gatcacataatttggaaacagc

SEQ ID NO: 7673836 - DNA, 22 bp, Homo sapiens
gatcacagtattttagatgtgt

SEQ ID NO: 7673837 - DNA, 22 bp, Homo sapiens
gatcacataatttggaaacagc

SEQ ID NO: 7673838 - DNA, 22 bp, Homo sapiens
gatcaaggcagtagggccagct

SEQ ID NO: 7673839 - DNA, 22 bp, Homo sapiens
gatcaataagaactggccctaa

SEQ ID NO: 7673840 - DNA, 22 bp, Homo sapiens
gatcaatactattaagatcata

SEQ ID NO: 7673841 - DNA, 22 bp, Homo sapiens
gatcaatactattaagatcata

SEQ ID NO: 7673842 - DNA, 22 bp, Homo sapiens
gatcaatggtgtaacttgtcct

SEQ ID NO: 7673843 - DNA, 22 bp, Homo sapiens
gatcacatctttatgagtattt

SEQ ID NO: 7673844 - DNA, 22 bp, Homo sapiens
gatcacatgaatggaatagaag

SEQ ID NO: 7673845 - DNA, 22 bp, Homo sapiens
gatcacatgaatggaatagaag

SEQ ID NO: 7673846 - DNA, 22 bp, Homo sapiens
gatcacatgagttatctaactt

SEQ ID NO: 7673847 - DNA, 22 bp, Homo sapiens
gatcagaatcttcattttcagt

SEQ ID NO: 7673848 - DNA, 22 bp, Homo sapiens
gatcagaatcttcattttcagt

SEQ ID NO: 7673849 - DNA, 22 bp, Homo sapiens
gatcacatgaatggaatagaag

SEQ ID NO: 7673850 - DNA, 22 bp, Homo sapiens
gatcacatgagttatctaactt

SEQ ID NO: 7673851 - DNA, 22 bp, Homo sapiens
gatcaaagccagtgaggagtga

SEQ ID NO: 7673852 - DNA, 22 bp, Homo sapiens
gatcaaagccagtgaggagtga

SEQ ID NO: 7673853 - DNA, 22 bp, Homo sapiens
gatcaaaagctgggttctaaaa

SEQ ID NO: 7673854 - DNA, 22 bp, Homo sapiens
gatatttttgcagacacctggg

SEQ ID NO: 7673855 - DNA, 22 bp, Homo sapiens
gatcaacaacttttgaatagct

SEQ ID NO: 7673856 - DNA, 22 bp, Homo sapiens
gatcaacaaatgtcctttgtga

SEQ ID NO: 7673857 - DNA, 22 bp, Homo sapiens
gatcaaatatattatgccacag

SEQ ID NO: 7673858 - DNA, 22 bp, Homo sapiens
gatcaaagcctagttccaagat

SEQ ID NO: 7673859 - DNA, 22 bp, Homo sapiens
gatcaaaggaattttttacatg

SEQ ID NO: 7673860 - DNA, 22 bp, Homo sapiens
gatatttttagtatttctgcct

SEQ ID NO: 7673861 - DNA, 22 bp, Homo sapiens
gatatttttgcagacacctggg

SEQ ID NO: 7673862 - DNA, 22 bp, Homo sapiens
gatatttttaggtgatgcaggc

SEQ ID NO: 7673863 - DNA, 22 bp, Homo sapiens
gatatttttgcagacacctggg

SEQ ID NO: 7673864 - DNA, 22 bp, Homo sapiens
gatatttttgcagacacctggg

SEQ ID NO: 7673865 - DNA, 22 bp, Homo sapiens
gatatttttgcagacacctggg

SEQ ID NO: 7673866 - DNA, 22 bp, Homo sapiens
gatatttttgcagacacctggg

SEQ ID NO: 7673867 - DNA, 22 bp, Homo sapiens
gatatttttagtatttctgcct

SEQ ID NO: 7673868 - DNA, 22 bp, Homo sapiens
gatatttttagtatttctgcct

SEQ ID NO: 7673869 - DNA, 22 bp, Homo sapiens
gatatttttagtatttctgcct

SEQ ID NO: 7673870 - DNA, 22 bp, Homo sapiens
gatatttttagtatttctgcct

SEQ ID NO: 7673871 - DNA, 22 bp, Homo sapiens
gatatttttagtatttctgcct

SEQ ID NO: 7673872 - DNA, 22 bp, Homo sapiens
gatatttttagtatttctgcct

SEQ ID NO: 7673873 - DNA, 22 bp, Homo sapiens
gatatactgtctgtattacata

SEQ ID NO: 7673874 - DNA, 22 bp, Homo sapiens
gatatactgtctgtattacata

SEQ ID NO: 7673875 - DNA, 22 bp, Homo sapiens
gatatactgtctgtattacata

SEQ ID NO: 7673876 - DNA, 22 bp, Homo sapiens
gatataggttcatagtgttaca

SEQ ID NO: 7673877 - DNA, 22 bp, Homo sapiens
gatatacataggtttctatgca

SEQ ID NO: 7673878 - DNA, 22 bp, Homo sapiens
gatataggttcatagtgttaca

SEQ ID NO: 7673879 - DNA, 22 bp, Homo sapiens
gatataggttcatagtgttaca

SEQ ID NO: 7673880 - DNA, 22 bp, Homo sapiens
gatatacataggtttctatgca

SEQ ID NO: 7673881 - DNA, 22 bp, Homo sapiens
gatatacataggtttctatgca

SEQ ID NO: 7673882 - DNA, 22 bp, Homo sapiens
gatatacataggtttctatgca

SEQ ID NO: 7673883 - DNA, 22 bp, Homo sapiens
gatatacagagcattctttgat

SEQ ID NO: 7673884 - DNA, 22 bp, Homo sapiens
gatatacataggtttctatgca

SEQ ID NO: 7673885 - DNA, 22 bp, Homo sapiens
gatatacataggtttctatgca

SEQ ID NO: 7673886 - DNA, 22 bp, Homo sapiens
gatatacataggtttctatgca

SEQ ID NO: 7673887 - DNA, 18 bp, Homo sapiens
gatatataggaggaaagt

SEQ ID NO: 7673888 - DNA, 18 bp, Homo sapiens
gatatataggaggaaagt

SEQ ID NO: 7673889 - DNA, 18 bp, Homo sapiens
gatatataggaggaaagt

SEQ ID NO: 7673890 - DNA, 18 bp, Homo sapiens
gatatataggaggaaagt

SEQ ID NO: 7673891 - DNA, 18 bp, Homo sapiens
gatatataggaggaaagt

SEQ ID NO: 7673892 - DNA, 22 bp, Homo sapiens
gatataggttcatagtgttaca

SEQ ID NO: 7673893 - DNA, 22 bp, Homo sapiens
gatatatcacagcttactgtca

SEQ ID NO: 7673894 - DNA, 22 bp, Homo sapiens
gatatatgtaaaagtagacaga

SEQ ID NO: 7673895 - DNA, 22 bp, Homo sapiens
gatatatttggaccagagcatt

SEQ ID NO: 7673896 - DNA, 22 bp, Homo sapiens
gatatatttggaccagagcatt

SEQ ID NO: 7673897 - DNA, 22 bp, Homo sapiens
gatatatttggaccagagcatt

SEQ ID NO: 7673898 - DNA, 22 bp, Homo sapiens
gatatttacattaagcacattg

SEQ ID NO: 7673899 - DNA, 22 bp, Homo sapiens
gatatttacattaagcacattg

SEQ ID NO: 7673900 - DNA, 21 bp, Homo sapiens
gatatttatgactcattcctt

SEQ ID NO: 7673901 - DNA, 22 bp, Homo sapiens
gatatttacattaagcacattg

SEQ ID NO: 7673902 - DNA, 21 bp, Homo sapiens
gatatttatgactcattcctt

SEQ ID NO: 7673903 - DNA, 22 bp, Homo sapiens
gatatttattaagtggttggta

SEQ ID NO: 7673904 - DNA, 22 bp, Homo sapiens
gatatttattaagtggttggta

SEQ ID NO: 7673905 - DNA, 22 bp, Homo sapiens
gatatttattaagtggttggta

SEQ ID NO: 7673906 - DNA, 22 bp, Homo sapiens
gatatttattaagtggttggta

SEQ ID NO: 7673907 - DNA, 22 bp, Homo sapiens
gatatttattaagtggttggta

SEQ ID NO: 7673908 - DNA, 22 bp, Homo sapiens
gatattttcgcagggagaattc

SEQ ID NO: 7673909 - DNA, 22 bp, Homo sapiens
gatattttcgcagggagaattc

SEQ ID NO: 7673910 - DNA, 22 bp, Homo sapiens
gatattttcgcagggagaattc

SEQ ID NO: 7673911 - DNA, 22 bp, Homo sapiens
gatattttcgcagggagaattc

SEQ ID NO: 7673912 - DNA, 22 bp, Homo sapiens
gatattttcattcggatgctca

SEQ ID NO: 7673913 - DNA, 22 bp, Homo sapiens
gatattttcattcggatgctca

SEQ ID NO: 7673914 - DNA, 22 bp, Homo sapiens
gatattttcattcggatgctca

SEQ ID NO: 7673915 - DNA, 22 bp, Homo sapiens
gatattttcgcagggagaattc

SEQ ID NO: 7673916 - DNA, 22 bp, Homo sapiens
gatattttcgcagggagaattc

SEQ ID NO: 7673917 - DNA, 22 bp, Homo sapiens
gatattttcgcagggagaattc

SEQ ID NO: 7673918 - DNA, 22 bp, Homo sapiens
gatattttcgcagggagaattc

SEQ ID NO: 7673919 - DNA, 22 bp, Homo sapiens
gatattttcgcagggagaattc

SEQ ID NO: 7673920 - DNA, 22 bp, Homo sapiens
gatattttcagtctcctttcaa

SEQ ID NO: 7673921 - DNA, 22 bp, Homo sapiens
gatattttcagtctcctttcaa

SEQ ID NO: 7673922 - DNA, 22 bp, Homo sapiens
gatattttcagtctcctttcaa

SEQ ID NO: 7673923 - DNA, 22 bp, Homo sapiens
gatattttcagtctcctttcaa

SEQ ID NO: 7673924 - DNA, 22 bp, Homo sapiens
gatattttcagtctcctttcaa

SEQ ID NO: 7673925 - DNA, 22 bp, Homo sapiens
gatattttcagtctcctttcaa

SEQ ID NO: 7673926 - DNA, 22 bp, Homo sapiens
gatattttcagtctcctttcaa

SEQ ID NO: 7673927 - DNA, 22 bp, Homo sapiens
gatattttcagtctcctttcaa

SEQ ID NO: 7673928 - DNA, 22 bp, Homo sapiens
gatattttcagtctcctttcaa

SEQ ID NO: 7673929 - DNA, 22 bp, Homo sapiens
gatattttcattcggatgctca

SEQ ID NO: 7673930 - DNA, 22 bp, Homo sapiens
gatattttcattcggatgctca

SEQ ID NO: 7673931 - DNA, 22 bp, Homo sapiens
gatattttcattcggatgctca

SEQ ID NO: 7673932 - DNA, 22 bp, Homo sapiens
gatattttcattcggatgctca

SEQ ID NO: 7673933 - DNA, 22 bp, Homo sapiens
gatatttttaggtgatgcaggc

SEQ ID NO: 7673934 - DNA, 22 bp, Homo sapiens
gatatttttaggtgatgcaggc

SEQ ID NO: 7673935 - DNA, 22 bp, Homo sapiens
gatatttttaggtgatgcaggc

SEQ ID NO: 7673936 - DNA, 22 bp, Homo sapiens
gatatttttagtatttctgcct

SEQ ID NO: 7673937 - DNA, 22 bp, Homo sapiens
gatatttttaggtgatgcaggc

SEQ ID NO: 7673938 - DNA, 22 bp, Homo sapiens
gatatttttaggtgatgcaggc

SEQ ID NO: 7673939 - DNA, 22 bp, Homo sapiens
gatatttttaggtgatgcaggc

SEQ ID NO: 7673940 - DNA, 22 bp, Homo sapiens
gatatttttaggtgatgcaggc

SEQ ID NO: 7673941 - DNA, 22 bp, Homo sapiens
gatattttgagaaatcctatga

SEQ ID NO: 7673942 - DNA, 22 bp, Homo sapiens
gatattttgagaaatcctatga

SEQ ID NO: 7673943 - DNA, 22 bp, Homo sapiens
gatattttgagaaatcctatga

SEQ ID NO: 7673944 - DNA, 22 bp, Homo sapiens
gatattttgagaaatcctatga

SEQ ID NO: 7673945 - DNA, 22 bp, Homo sapiens
gatattttgagaaatcctatga

SEQ ID NO: 7673946 - DNA, 22 bp, Homo sapiens
gatattttgagaaatcctatga

SEQ ID NO: 7673947 - DNA, 22 bp, Homo sapiens
gatattttgagaaatcctatga

SEQ ID NO: 7673948 - DNA, 22 bp, Homo sapiens
gatattttgagaaatcctatga

SEQ ID NO: 7673949 - DNA, 22 bp, Homo sapiens
gatattttgagaaatcctatga

SEQ ID NO: 7673950 - DNA, 22 bp, Homo sapiens
gatattttgagaaatcctatga

SEQ ID NO: 7673951 - DNA, 22 bp, Homo sapiens
gatattttgagaaatcctatga

SEQ ID NO: 7673952 - DNA, 22 bp, Homo sapiens
gatattttgagaaatcctatga

SEQ ID NO: 7673953 - DNA, 22 bp, Homo sapiens
gagtcaggtccgtggacagtta

SEQ ID NO: 7673954 - DNA, 22 bp, Homo sapiens
gagtcaggctagggtgacaggc

SEQ ID NO: 7673955 - DNA, 22 bp, Homo sapiens
gagtcaggtccgtggacagtta

SEQ ID NO: 7673956 - DNA, 22 bp, Homo sapiens
gagtcattgcacactagctcag

SEQ ID NO: 7673957 - DNA, 22 bp, Homo sapiens
gagtcattgttggtccctcccc

SEQ ID NO: 7673958 - DNA, 22 bp, Homo sapiens
gagtccaagctagagccactca

SEQ ID NO: 7673959 - DNA, 22 bp, Homo sapiens
gagtcatttgggggcttcttga

SEQ ID NO: 7673960 - DNA, 22 bp, Homo sapiens
gagtccaagctagagccactca

SEQ ID NO: 7673961 - DNA, 22 bp, Homo sapiens
gagtccaagctagagccactca

SEQ ID NO: 7673962 - DNA, 18 bp, Homo sapiens
gagtccaataaatttctg

SEQ ID NO: 7673963 - DNA, 22 bp, Homo sapiens
gagtccagacaccatacctgat

SEQ ID NO: 7673964 - DNA, 22 bp, Homo sapiens
gagtccagacaccatacctgat

SEQ ID NO: 7673965 - DNA, 22 bp, Homo sapiens
gagtccagacaccatacctgat

SEQ ID NO: 7673966 - DNA, 22 bp, Homo sapiens
gagtccagagattaagcacctc

SEQ ID NO: 7673967 - DNA, 22 bp, Homo sapiens
gagtccagagattaagcacctc

SEQ ID NO: 7673968 - DNA, 22 bp, Homo sapiens
gagtccagttctttccagcagt

SEQ ID NO: 7673969 - DNA, 22 bp, Homo sapiens
gagtccagagattaagcacctc

SEQ ID NO: 7673970 - DNA, 22 bp, Homo sapiens
gagtccagttctttccagcagt

SEQ ID NO: 7673971 - DNA, 22 bp, Homo sapiens
gagtcccatgatgatagccaca

SEQ ID NO: 7673972 - DNA, 22 bp, Homo sapiens
gagtcctagaagtggctttatt

SEQ ID NO: 7673973 - DNA, 22 bp, Homo sapiens
gagtcccatgatgatagccaca

SEQ ID NO: 7673974 - DNA, 22 bp, Homo sapiens
gagtcccatgatgatagccaca

SEQ ID NO: 7673975 - DNA, 22 bp, Homo sapiens
gagtcctcagatagaaagtgcg

SEQ ID NO: 7673976 - DNA, 22 bp, Homo sapiens
gagtcctcaacggggagaggcg

SEQ ID NO: 7673977 - DNA, 22 bp, Homo sapiens
gagtcctgaatcctgtggcaac

SEQ ID NO: 7673978 - DNA, 22 bp, Homo sapiens
gagtcctgaatcctgtggcaac

SEQ ID NO: 7673979 - DNA, 22 bp, Homo sapiens
gagtcctgaatcctgtggcaac

SEQ ID NO: 7673980 - DNA, 22 bp, Homo sapiens
gagtcccaggaatgagcatagt

SEQ ID NO: 7673981 - DNA, 22 bp, Homo sapiens
gagtccagttgttcacagaggc

SEQ ID NO: 7673982 - DNA, 22 bp, Homo sapiens
gagtcccaggatatgtgctgtt

SEQ ID NO: 7673983 - DNA, 22 bp, Homo sapiens
gagtcccaggatatgtgctgtt

SEQ ID NO: 7673984 - DNA, 22 bp, Homo sapiens
gagtccagttgttcacagaggc

SEQ ID NO: 7673985 - DNA, 22 bp, Homo sapiens
gagtccagttgttcacagaggc

SEQ ID NO: 7673986 - DNA, 22 bp, Homo sapiens
gagtccagttgttcacagaggc

SEQ ID NO: 7673987 - DNA, 22 bp, Homo sapiens
gagtccagttctttccagcagt

SEQ ID NO: 7673988 - DNA, 22 bp, Homo sapiens
gagtccagttgttcacagaggc

SEQ ID NO: 7673989 - DNA, 22 bp, Homo sapiens
gagtccagttgttcacagaggc

SEQ ID NO: 7673990 - DNA, 22 bp, Homo sapiens
gagtcagaatgtcctcctgcgg

SEQ ID NO: 7673991 - DNA, 22 bp, Homo sapiens
gagtcagaatgtcctcctgcgg

SEQ ID NO: 7673992 - DNA, 22 bp, Homo sapiens
gagtcagaagaaactatttaca

SEQ ID NO: 7673993 - DNA, 22 bp, Homo sapiens
gagtcagaatgtcctcctgcgg

SEQ ID NO: 7673994 - DNA, 22 bp, Homo sapiens
gagtcagaagaaactatttaca

SEQ ID NO: 7673995 - DNA, 22 bp, Homo sapiens
gagtcagaagaaactatttaca

SEQ ID NO: 7673996 - DNA, 22 bp, Homo sapiens
gagtcagaatgtcctcctgcgg

SEQ ID NO: 7673997 - DNA, 22 bp, Homo sapiens
gagtcagaattgtattttaaac

SEQ ID NO: 7673998 - DNA, 22 bp, Homo sapiens
gagtcagaattgtattttaaac

SEQ ID NO: 7673999 - DNA, 22 bp, Homo sapiens
gagtcagacagggtcacccaga

SEQ ID NO: 7674000 - DNA, 22 bp, Homo sapiens
gagtcagacagggtcacccaga

SEQ ID NO: 7674001 - DNA, 22 bp, Homo sapiens
gagtcagaccgactgggctcat

SEQ ID NO: 7674002 - DNA, 22 bp, Homo sapiens
gagtcagctagtctccttcttt

SEQ ID NO: 7674003 - DNA, 22 bp, Homo sapiens
gagtcagctagtctccttcttt

SEQ ID NO: 7674004 - DNA, 22 bp, Homo sapiens
gagtcagattgcagacagggct

SEQ ID NO: 7674005 - DNA, 22 bp, Homo sapiens
gagtcagattgcagacagggct

SEQ ID NO: 7674006 - DNA, 22 bp, Homo sapiens
gagtcagattgcagacagggct

SEQ ID NO: 7674007 - DNA, 22 bp, Homo sapiens
gagtcagattgcagacagggct

SEQ ID NO: 7674008 - DNA, 22 bp, Homo sapiens
gagtcagattgcagacagggct

SEQ ID NO: 7674009 - DNA, 22 bp, Homo sapiens
gagtcagattgcagacagggct

SEQ ID NO: 7674010 - DNA, 22 bp, Homo sapiens
gagtcagattgcagacagggct

SEQ ID NO: 7674011 - DNA, 22 bp, Homo sapiens
gagtcagattgcagacagggct

SEQ ID NO: 7674012 - DNA, 22 bp, Homo sapiens
gagtcagatgaagataaaaggg

SEQ ID NO: 7674013 - DNA, 22 bp, Homo sapiens
gagtcagatgaagataaaaggg

SEQ ID NO: 7674014 - DNA, 22 bp, Homo sapiens
gagtcagaccgactgggctcat

SEQ ID NO: 7674015 - DNA, 22 bp, Homo sapiens
gagtcagaccgactgggctcat

SEQ ID NO: 7674016 - DNA, 22 bp, Homo sapiens
gagtcagatgaagataaaaggg

SEQ ID NO: 7674017 - DNA, 22 bp, Homo sapiens
gagtcagatgaagataaaaggg

SEQ ID NO: 7674018 - DNA, 22 bp, Homo sapiens
gagtcaggctagaggtgagtct

SEQ ID NO: 7674019 - DNA, 22 bp, Homo sapiens
gagtcaggctagaggtgagtct

SEQ ID NO: 7674020 - DNA, 22 bp, Homo sapiens
gagtcaggctagaggtgagtct

SEQ ID NO: 7674021 - DNA, 22 bp, Homo sapiens
gagtcaggcatgaaggtaatta

SEQ ID NO: 7674022 - DNA, 22 bp, Homo sapiens
gagtcaggctagggtgacaggc

SEQ ID NO: 7674023 - DNA, 22 bp, Homo sapiens
gagtcaggctagggtgacaggc

SEQ ID NO: 7674024 - DNA, 22 bp, Homo sapiens
gagtcaggctagggtgacaggc

SEQ ID NO: 7674025 - DNA, 22 bp, Homo sapiens
gagtcaggctagggtgacaggc

SEQ ID NO: 7674026 - DNA, 22 bp, Homo sapiens
gagtcaggctagggtgacaggc

SEQ ID NO: 7674027 - DNA, 22 bp, Homo sapiens
gagtcaggagtcctgtgtgaga

SEQ ID NO: 7674028 - DNA, 22 bp, Homo sapiens
gagtcaggagttatgctccacc

SEQ ID NO: 7674029 - DNA, 22 bp, Homo sapiens
gagtcaggagtcctgtgtgaga

SEQ ID NO: 7674030 - DNA, 22 bp, Homo sapiens
gagtcaggagttatgctccacc

SEQ ID NO: 7674031 - DNA, 22 bp, Homo sapiens
gagtcaggatgcaaggggatgg

SEQ ID NO: 7674032 - DNA, 22 bp, Homo sapiens
gagtcaggatgcaaggggatgg

SEQ ID NO: 7674033 - DNA, 22 bp, Homo sapiens
gagtcaggatgcaaggggatgg

SEQ ID NO: 7674034 - DNA, 22 bp, Homo sapiens
gagtcaggcactgctgctgctc

SEQ ID NO: 7674035 - DNA, 22 bp, Homo sapiens
gagtcaggcactgctgctgctc

SEQ ID NO: 7674036 - DNA, 22 bp, Homo sapiens
gagtcaggatgcaaggggatgg

SEQ ID NO: 7674037 - DNA, 22 bp, Homo sapiens
gagtcaggcatgaaggtaatta

SEQ ID NO: 7674038 - DNA, 22 bp, Homo sapiens
gagtcaggcatgaaggtaatta

SEQ ID NO: 7674039 - DNA, 22 bp, Homo sapiens
gaggtgggtgtatcacaggtca

SEQ ID NO: 7674040 - DNA, 22 bp, Homo sapiens
gaggtgggtgtatcacaggtca

SEQ ID NO: 7674041 - DNA, 22 bp, Homo sapiens
gaggtgggtgtatcacaggtca

SEQ ID NO: 7674042 - DNA, 22 bp, Homo sapiens
gaggtgggtgtatcacaggtca

SEQ ID NO: 7674043 - DNA, 22 bp, Homo sapiens
gaggtgggtgtatcacaggtca

SEQ ID NO: 7674044 - DNA, 22 bp, Homo sapiens
gaggtgggtgtatcacaggtca

SEQ ID NO: 7674045 - DNA, 22 bp, Homo sapiens
gaggtgggtgtatcacaggtca

SEQ ID NO: 7674046 - DNA, 22 bp, Homo sapiens
gaggtgggtgtatcacaggtca

SEQ ID NO: 7674047 - DNA, 22 bp, Homo sapiens
gaggtgggtgtatcacaggtca

SEQ ID NO: 7674048 - DNA, 22 bp, Homo sapiens
gaggtgggtgtatcacaggtca

SEQ ID NO: 7674049 - DNA, 19 bp, Homo sapiens
gaggtgggtccccgcagcc

SEQ ID NO: 7674050 - DNA, 19 bp, Homo sapiens
gaggtgggtccccgcagcc

SEQ ID NO: 7674051 - DNA, 19 bp, Homo sapiens
gaggtgggtccccgcagcc

SEQ ID NO: 7674052 - DNA, 22 bp, Homo sapiens
gaggtggggttttgttcttgaa

SEQ ID NO: 7674053 - DNA, 19 bp, Homo sapiens
gaggtgggtccccgcagcc

SEQ ID NO: 7674054 - DNA, 19 bp, Homo sapiens
gaggtgggtccccgcagcc

SEQ ID NO: 7674055 - DNA, 22 bp, Homo sapiens
gaggtggtcgaggaggggtacc

SEQ ID NO: 7674056 - DNA, 22 bp, Homo sapiens
gaggtgggtgtatcacaggtca

SEQ ID NO: 7674057 - DNA, 22 bp, Homo sapiens
gaggtggtggtggaggcatagc

SEQ ID NO: 7674058 - DNA, 22 bp, Homo sapiens
gaggtggtggtggaggcatagc

SEQ ID NO: 7674059 - DNA, 22 bp, Homo sapiens
gaggtggtggtggaggcatagc

SEQ ID NO: 7674060 - DNA, 22 bp, Homo sapiens
gaggtggtggtggaggcatagc

SEQ ID NO: 7674061 - DNA, 22 bp, Homo sapiens
gaggtgtcagggtagtcatgat

SEQ ID NO: 7674062 - DNA, 22 bp, Homo sapiens
gaggtgtcagggtagtcatgat

SEQ ID NO: 7674063 - DNA, 22 bp, Homo sapiens
gaggtgtcactattttgcttat

SEQ ID NO: 7674064 - DNA, 22 bp, Homo sapiens
gaggtggttcaggtagagccca

SEQ ID NO: 7674065 - DNA, 22 bp, Homo sapiens
gaggtggttcaggtagagccca

SEQ ID NO: 7674066 - DNA, 22 bp, Homo sapiens
gaggtggtttgtggtgactcat

SEQ ID NO: 7674067 - DNA, 22 bp, Homo sapiens
gagtcagaaagtagtgtgccta

SEQ ID NO: 7674068 - DNA, 22 bp, Homo sapiens
gagtcagaaagtagtgtgccta

SEQ ID NO: 7674069 - DNA, 22 bp, Homo sapiens
gagtcagaaagtagtgtgccta

SEQ ID NO: 7674070 - DNA, 22 bp, Homo sapiens
gagtcagaaactcactctatag

SEQ ID NO: 7674071 - DNA, 22 bp, Homo sapiens
gagtcagaaactcactctatag

SEQ ID NO: 7674072 - DNA, 22 bp, Homo sapiens
gagtcagaaactcactctatag

SEQ ID NO: 7674073 - DNA, 22 bp, Homo sapiens
gagtcactgaggagggtactca

SEQ ID NO: 7674074 - DNA, 22 bp, Homo sapiens
gagtcactgtttcccggctctg

SEQ ID NO: 7674075 - DNA, 22 bp, Homo sapiens
gagtcacattaatttaatttta

SEQ ID NO: 7674076 - DNA, 22 bp, Homo sapiens
gagtcaccacacggtgctgact

SEQ ID NO: 7674077 - DNA, 22 bp, Homo sapiens
gagtcacatactatgtaataga

SEQ ID NO: 7674078 - DNA, 22 bp, Homo sapiens
gaggtgtctgctgtgttcaaag

SEQ ID NO: 7674079 - DNA, 22 bp, Homo sapiens
gaggtgtcccgcagtccccaag

SEQ ID NO: 7674080 - DNA, 22 bp, Homo sapiens
gaggtgtccctgaccctttgca

SEQ ID NO: 7674081 - DNA, 22 bp, Homo sapiens
gaggtgtcctagaagtattcag

SEQ ID NO: 7674082 - DNA, 22 bp, Homo sapiens
gaggtgtcctcagccaactctg

SEQ ID NO: 7674083 - DNA, 22 bp, Homo sapiens
gaggtgtcctcagccaactctg

SEQ ID NO: 7674084 - DNA, 22 bp, Homo sapiens
gaggtgtcgtagattattctca

SEQ ID NO: 7674085 - DNA, 22 bp, Homo sapiens
gaggtgtctagatctaccagta

SEQ ID NO: 7674086 - DNA, 22 bp, Homo sapiens
gaggtgtctgagtggggacctg

SEQ ID NO: 7674087 - DNA, 22 bp, Homo sapiens
gaggtgtcatgagggcctgctc

SEQ ID NO: 7674088 - DNA, 22 bp, Homo sapiens
gaggtgtcatttagttaatcag

SEQ ID NO: 7674089 - DNA, 22 bp, Homo sapiens
gaggtgtcatcaggcagctctg

SEQ ID NO: 7674090 - DNA, 22 bp, Homo sapiens
gaggtgtcatgagggcctgctc

SEQ ID NO: 7674091 - DNA, 22 bp, Homo sapiens
gaggtgtcatgagggcctgctc

SEQ ID NO: 7674092 - DNA, 22 bp, Homo sapiens
gaggtatttgatcctctgcagt

SEQ ID NO: 7674093 - DNA, 22 bp, Homo sapiens
gaggtattggccattgtctgtt

SEQ ID NO: 7674094 - DNA, 22 bp, Homo sapiens
gaggtattgactatgggatggc

SEQ ID NO: 7674095 - DNA, 23 bp, Homo sapiens
gaggtcaaggctgcagtgattgc

SEQ ID NO: 7674096 - DNA, 22 bp, Homo sapiens
gaggtatttgatcctctgcagt

SEQ ID NO: 7674097 - DNA, 22 bp, Homo sapiens
gaggtatttttgcatgcctgat

SEQ ID NO: 7674098 - DNA, 22 bp, Homo sapiens
gaggtatgttatttcttgaaac

SEQ ID NO: 7674099 - DNA, 22 bp, Homo sapiens
gaggtatgtatgctacattctt

SEQ ID NO: 7674100 - DNA, 22 bp, Homo sapiens
gaggtatcttagagagtgtaga

SEQ ID NO: 7674101 - DNA, 22 bp, Homo sapiens
gaggtatcttagagagtgtaga

SEQ ID NO: 7674102 - DNA, 22 bp, Homo sapiens
gaggtcaaggtcaagagacaga

SEQ ID NO: 7674103 - DNA, 22 bp, Homo sapiens
gaggtcaataatatgtgcttta

SEQ ID NO: 7674104 - DNA, 22 bp, Homo sapiens
gaggtcaaggtcaagagacaga

SEQ ID NO: 7674105 - DNA, 19 bp, Homo sapiens
gaggtcagcaagaagtatt

SEQ ID NO: 7674106 - DNA, 19 bp, Homo sapiens
gaggtcagcaagaagtatt

SEQ ID NO: 7674107 - DNA, 22 bp, Homo sapiens
gaggtcaggctcaagctgggcc

SEQ ID NO: 7674108 - DNA, 19 bp, Homo sapiens
gaggtcagcaagaagtatt

SEQ ID NO: 7674109 - DNA, 19 bp, Homo sapiens
gaggtcagcaagaagtatt

SEQ ID NO: 7674110 - DNA, 22 bp, Homo sapiens
gaggtaggtgtaggaggcctgc

SEQ ID NO: 7674111 - DNA, 22 bp, Homo sapiens
gaggtagtaagcagagtggggt

SEQ ID NO: 7674112 - DNA, 22 bp, Homo sapiens
gaggtagtgagcagctgaacta

SEQ ID NO: 7674113 - DNA, 22 bp, Homo sapiens
gaggtagtgagttaaacagatg

SEQ ID NO: 7674114 - DNA, 22 bp, Homo sapiens
gaggtatagttctattagatga

SEQ ID NO: 7674115 - DNA, 22 bp, Homo sapiens
gaggtaggtgtaggaggcctgc

SEQ ID NO: 7674116 - DNA, 22 bp, Homo sapiens
gaggtaggtgtaggaggcctgc

SEQ ID NO: 7674117 - DNA, 22 bp, Homo sapiens
gaggtaggtgtaggaggcctgc

SEQ ID NO: 7674118 - DNA, 22 bp, Homo sapiens
gaggtaggtgtaggaggcctgc

SEQ ID NO: 7674119 - DNA, 22 bp, Homo sapiens
gaggtaggtgtaggaggcctgc

SEQ ID NO: 7674120 - DNA, 22 bp, Homo sapiens
gaggtaggtgtaggaggcctgc

SEQ ID NO: 7674121 - DNA, 22 bp, Homo sapiens
gaggtaggtgtaggaggcctgc

SEQ ID NO: 7674122 - DNA, 22 bp, Homo sapiens
gaggtaagggcaggagagtgaa

SEQ ID NO: 7674123 - DNA, 22 bp, Homo sapiens
gaggtaagggcaggagagtgaa

SEQ ID NO: 7674124 - DNA, 22 bp, Homo sapiens
gaggtaacaactgaaatgagaa

SEQ ID NO: 7674125 - DNA, 22 bp, Homo sapiens
gagggttgtaagattgtagagc

SEQ ID NO: 7674126 - DNA, 22 bp, Homo sapiens
gaggtaacactgttcagtgggc

SEQ ID NO: 7674127 - DNA, 22 bp, Homo sapiens
gaggtaacactgttcagtgggc

SEQ ID NO: 7674128 - DNA, 22 bp, Homo sapiens
gaggtaacactgttcagtgggc

SEQ ID NO: 7674129 - DNA, 22 bp, Homo sapiens
gaggtaacactgttcagtgggc

SEQ ID NO: 7674130 - DNA, 22 bp, Homo sapiens
gaggtaacactgttcagtgggc

SEQ ID NO: 7674131 - DNA, 22 bp, Homo sapiens
gaggggcgtcctgagtgggcct

SEQ ID NO: 7674132 - DNA, 22 bp, Homo sapiens
gaggggcgtcctgagtgggcct

SEQ ID NO: 7674133 - DNA, 22 bp, Homo sapiens
gaggggctcttgggcatgaagg

SEQ ID NO: 7674134 - DNA, 22 bp, Homo sapiens
gaggggctcttgggcatgaagg

SEQ ID NO: 7674135 - DNA, 22 bp, Homo sapiens
gaggggctcttgggcatgaagg

SEQ ID NO: 7674136 - DNA, 22 bp, Homo sapiens
gaggggcgtcctgagtgggcct

SEQ ID NO: 7674137 - DNA, 22 bp, Homo sapiens
gaggggcgtcctgagtgggcct

SEQ ID NO: 7674138 - DNA, 22 bp, Homo sapiens
gaggggcgtcctgagtgggcct

SEQ ID NO: 7674139 - DNA, 22 bp, Homo sapiens
gaggggcgtcctgagtgggcct

SEQ ID NO: 7674140 - DNA, 22 bp, Homo sapiens
gaggggcgtcctgagtgggcct

SEQ ID NO: 7674141 - DNA, 22 bp, Homo sapiens
gagggttggtgcaaatgggatg

SEQ ID NO: 7674142 - DNA, 22 bp, Homo sapiens
gagggttggtgcaaatgggatg

SEQ ID NO: 7674143 - DNA, 22 bp, Homo sapiens
gagggtgtgaacactggctgtg

SEQ ID NO: 7674144 - DNA, 22 bp, Homo sapiens
gaggggctctttaatagtaaca

SEQ ID NO: 7674145 - DNA, 22 bp, Homo sapiens
gagggtgtctggatgctagact

SEQ ID NO: 7674146 - DNA, 22 bp, Homo sapiens
gaggggctcttgggcatgaagg

SEQ ID NO: 7674147 - DNA, 22 bp, Homo sapiens
gaggggctctttaatagtaaca

SEQ ID NO: 7674148 - DNA, 22 bp, Homo sapiens
gaggggctctttaatagtaaca

SEQ ID NO: 7674149 - DNA, 22 bp, Homo sapiens
gaggggctctttaatagtaaca

SEQ ID NO: 7674150 - DNA, 22 bp, Homo sapiens
gaggggcgctgtcgggtcacct

SEQ ID NO: 7674151 - DNA, 22 bp, Homo sapiens
gaggggcgctgtcgggtcacct

SEQ ID NO: 7674152 - DNA, 22 bp, Homo sapiens
gaggggcgctgtcgggtcacct

SEQ ID NO: 7674153 - DNA, 22 bp, Homo sapiens
gaggggcctggcgaggacatgt

SEQ ID NO: 7674154 - DNA, 22 bp, Homo sapiens
gaggggcctggcgaggacatgt

SEQ ID NO: 7674155 - DNA, 22 bp, Homo sapiens
gaggggcctggcgaggacatgt

SEQ ID NO: 7674156 - DNA, 22 bp, Homo sapiens
gaggggcctggcgaggacatgt

SEQ ID NO: 7674157 - DNA, 22 bp, Homo sapiens
gaggggcctggcactgagctgg

SEQ ID NO: 7674158 - DNA, 22 bp, Homo sapiens
gaggggcctggcgaggacatgt

SEQ ID NO: 7674159 - DNA, 22 bp, Homo sapiens
gaggggcctggcactgagctgg

SEQ ID NO: 7674160 - DNA, 22 bp, Homo sapiens
gaggggcctggcactgagctgg

SEQ ID NO: 7674161 - DNA, 22 bp, Homo sapiens
gaggggcctggcactgagctgg

SEQ ID NO: 7674162 - DNA, 22 bp, Homo sapiens
gaggggccggcatgtgcctctc

SEQ ID NO: 7674163 - DNA, 22 bp, Homo sapiens
gaggggccggcatgtgcctctc

SEQ ID NO: 7674164 - DNA, 22 bp, Homo sapiens
gaggtcaggctcaagctgggcc

SEQ ID NO: 7674165 - DNA, 22 bp, Homo sapiens
gaggtcaggctcaagctgggcc

SEQ ID NO: 7674166 - DNA, 22 bp, Homo sapiens
gaggtcaggctcaagctgggcc

SEQ ID NO: 7674167 - DNA, 22 bp, Homo sapiens
gaggtcaggcttgcagcagggt

SEQ ID NO: 7674168 - DNA, 22 bp, Homo sapiens
gaggtcaggcttgcagcagggt

SEQ ID NO: 7674169 - DNA, 22 bp, Homo sapiens
gaggtcaggctcaagctgggcc

SEQ ID NO: 7674170 - DNA, 22 bp, Homo sapiens
gaggtcaggctcaagctgggcc

SEQ ID NO: 7674171 - DNA, 22 bp, Homo sapiens
gaggtcaggggagaggctgatg

SEQ ID NO: 7674172 - DNA, 22 bp, Homo sapiens
gaggtcaggggagaggctgatg

SEQ ID NO: 7674173 - DNA, 22 bp, Homo sapiens
gaggtcaggcttgcagcagggt

SEQ ID NO: 7674174 - DNA, 22 bp, Homo sapiens
gaggtcaggcttgcagcagggt

SEQ ID NO: 7674175 - DNA, 22 bp, Homo sapiens
gaggtcaggcttgcagcagggt

SEQ ID NO: 7674176 - DNA, 22 bp, Homo sapiens
gaggtcaggggagaggctgatg

SEQ ID NO: 7674177 - DNA, 22 bp, Homo sapiens
gaggtcaggggagaggctgatg

SEQ ID NO: 7674178 - DNA, 22 bp, Homo sapiens
gaggtcaggcttgcagcagggt

SEQ ID NO: 7674179 - DNA, 22 bp, Homo sapiens
gaggtcaggcttgcagcagggt

SEQ ID NO: 7674180 - DNA, 22 bp, Homo sapiens
gaggtcaggcttgcagcagggt

SEQ ID NO: 7674181 - DNA, 22 bp, Homo sapiens
gaggtcagtcagaccagggttt

SEQ ID NO: 7674182 - DNA, 22 bp, Homo sapiens
gaggtcaggggagaggctgatg

SEQ ID NO: 7674183 - DNA, 22 bp, Homo sapiens
gaggtcaggggagaggctgatg

SEQ ID NO: 7674184 - DNA, 22 bp, Homo sapiens
gaggtcaggggagaggctgatg

SEQ ID NO: 7674185 - DNA, 22 bp, Homo sapiens
gaggtcaggtgaggaattaaga

SEQ ID NO: 7674186 - DNA, 22 bp, Homo sapiens
gaggtcaggtgaggaattaaga

SEQ ID NO: 7674187 - DNA, 22 bp, Homo sapiens
gaggtcaggtgaggaattaaga

SEQ ID NO: 7674188 - DNA, 22 bp, Homo sapiens
gaggtccactgaggcaacaggg

SEQ ID NO: 7674189 - DNA, 22 bp, Homo sapiens
gaggtccactgaggcaacaggg

SEQ ID NO: 7674190 - DNA, 22 bp, Homo sapiens
gaggtccagagcaggttcagtg

SEQ ID NO: 7674191 - DNA, 22 bp, Homo sapiens
gaggtccactgaggcaacaggg

SEQ ID NO: 7674192 - DNA, 22 bp, Homo sapiens
gaggtccaacacaatgggtgtt

SEQ ID NO: 7674193 - DNA, 22 bp, Homo sapiens
gaggtccaacacaatgggtgtt

SEQ ID NO: 7674194 - DNA, 22 bp, Homo sapiens
gaggtccaacacaatgggtgtt

SEQ ID NO: 7674195 - DNA, 22 bp, Homo sapiens
gaggtccaacacaatgggtgtt

SEQ ID NO: 7674196 - DNA, 22 bp, Homo sapiens
gaggtccactgaggcaacaggg

SEQ ID NO: 7674197 - DNA, 22 bp, Homo sapiens
gaggtgggagggcagtccctaa

SEQ ID NO: 7674198 - DNA, 22 bp, Homo sapiens
gaggtcccccatggctgtgact

SEQ ID NO: 7674199 - DNA, 22 bp, Homo sapiens
gaggtccattttcacatatgat

SEQ ID NO: 7674200 - DNA, 22 bp, Homo sapiens
gaggtcccccatggctgtgact

SEQ ID NO: 7674201 - DNA, 22 bp, Homo sapiens
gaggtcccccatggctgtgact

SEQ ID NO: 7674202 - DNA, 22 bp, Homo sapiens
gaggtccagggtggggcctgag

SEQ ID NO: 7674203 - DNA, 22 bp, Homo sapiens
gaggtccagggtggggcctgag

SEQ ID NO: 7674204 - DNA, 22 bp, Homo sapiens
gaggtccagggtggggcctgag

SEQ ID NO: 7674205 - DNA, 22 bp, Homo sapiens
gaggtccatacagctattctac

SEQ ID NO: 7674206 - DNA, 22 bp, Homo sapiens
gaggtccatacagctattctac

SEQ ID NO: 7674207 - DNA, 22 bp, Homo sapiens
gaggtccattttcacatatgat

SEQ ID NO: 7674208 - DNA, 22 bp, Homo sapiens
gaggtccagagcaggttcagtg

SEQ ID NO: 7674209 - DNA, 22 bp, Homo sapiens
gaggtccagagcaggttcagtg

SEQ ID NO: 7674210 - DNA, 22 bp, Homo sapiens
gaggtccagccaagcggcaagg

SEQ ID NO: 7674211 - DNA, 22 bp, Homo sapiens
gaggtccagccaagcggcaagg

SEQ ID NO: 7674212 - DNA, 22 bp, Homo sapiens
gaggtccagccaagcggcaagg

SEQ ID NO: 7674213 - DNA, 22 bp, Homo sapiens
gaggtccagggtggggcctgag

SEQ ID NO: 7674214 - DNA, 22 bp, Homo sapiens
gaggtccagggtggggcctgag

SEQ ID NO: 7674215 - DNA, 22 bp, Homo sapiens
gaggtccagggtggggcctgag

SEQ ID NO: 7674216 - DNA, 22 bp, Homo sapiens
gaggtccagggtggggcctgag

SEQ ID NO: 7674217 - DNA, 22 bp, Homo sapiens
gaggtgggcggatcacaaggtc

SEQ ID NO: 7674218 - DNA, 22 bp, Homo sapiens
gaggtgggatgtgtgtgctact

SEQ ID NO: 7674219 - DNA, 22 bp, Homo sapiens
gaggtgggatgtgtgtgctact

SEQ ID NO: 7674220 - DNA, 22 bp, Homo sapiens
gaggtgggatgtgtgtgctact

SEQ ID NO: 7674221 - DNA, 22 bp, Homo sapiens
gaggtgggatgtgtgtgctact

SEQ ID NO: 7674222 - DNA, 22 bp, Homo sapiens
gaggtgggatgtgtgtgctact

SEQ ID NO: 7674223 - DNA, 22 bp, Homo sapiens
gaggtgggatgtgtgtgctact

SEQ ID NO: 7674224 - DNA, 22 bp, Homo sapiens
gaggtgggatgtgtgtgctact

SEQ ID NO: 7674225 - DNA, 22 bp, Homo sapiens
gaggtgggatgtgtgtgctact

SEQ ID NO: 7674226 - DNA, 22 bp, Homo sapiens
gaggtggggttttgttcttgaa

SEQ ID NO: 7674227 - DNA, 22 bp, Homo sapiens
gaggtgggcggatcacaaggtc

SEQ ID NO: 7674228 - DNA, 22 bp, Homo sapiens
gaggtgggcggatcacaaggtc

SEQ ID NO: 7674229 - DNA, 22 bp, Homo sapiens
gaggtgggcggatcacaaggtc

SEQ ID NO: 7674230 - DNA, 22 bp, Homo sapiens
gaggtgggcggatcacaaggtc

SEQ ID NO: 7674231 - DNA, 22 bp, Homo sapiens
gaggtgggcggatcacaaggtc

SEQ ID NO: 7674232 - DNA, 22 bp, Homo sapiens
gaggtgggcggatcacaaggtc

SEQ ID NO: 7674233 - DNA, 22 bp, Homo sapiens
gaggtgggcggatcacaaggtc

SEQ ID NO: 7674234 - DNA, 22 bp, Homo sapiens
gaggtgggcggatcacaaggtc

SEQ ID NO: 7674235 - DNA, 22 bp, Homo sapiens
gagggccaatgtgtccctgagc

SEQ ID NO: 7674236 - DNA, 22 bp, Homo sapiens
gagggccaatgtgtccctgagc

SEQ ID NO: 7674237 - DNA, 22 bp, Homo sapiens
gaggggaaagtgtgaggctgcg

SEQ ID NO: 7674238 - DNA, 22 bp, Homo sapiens
gaggggaaagtgtgaggctgcg

SEQ ID NO: 7674239 - DNA, 22 bp, Homo sapiens
gaggggaaagtgtgaggctgcg

SEQ ID NO: 7674240 - DNA, 22 bp, Homo sapiens
gaggggaaagtgtgaggctgcg

SEQ ID NO: 7674241 - DNA, 22 bp, Homo sapiens
gagggccaatgtgtccctgagc

SEQ ID NO: 7674242 - DNA, 22 bp, Homo sapiens
gagggccaatggatttcaactg

SEQ ID NO: 7674243 - DNA, 22 bp, Homo sapiens
gagggccaactagcaccacttt

SEQ ID NO: 7674244 - DNA, 22 bp, Homo sapiens
gagggccaactagcaccacttt

SEQ ID NO: 7674245 - DNA, 22 bp, Homo sapiens
gagggccaatggatttcaactg

SEQ ID NO: 7674246 - DNA, 22 bp, Homo sapiens
gagggccaatggatttcaactg

SEQ ID NO: 7674247 - DNA, 22 bp, Homo sapiens
gagggccaactagcaccacttt

SEQ ID NO: 7674248 - DNA, 22 bp, Homo sapiens
gaggggaaagttctgcacaagg

SEQ ID NO: 7674249 - DNA, 22 bp, Homo sapiens
gaggggaaagttctgcacaagg

SEQ ID NO: 7674250 - DNA, 22 bp, Homo sapiens
gaggggaaagttctgcacaagg

SEQ ID NO: 7674251 - DNA, 22 bp, Homo sapiens
gaggggaagacttctggacagt

SEQ ID NO: 7674252 - DNA, 22 bp, Homo sapiens
gaggggaaagttctgcacaagg

SEQ ID NO: 7674253 - DNA, 22 bp, Homo sapiens
gaggggaaagttctgcacaagg

SEQ ID NO: 7674254 - DNA, 22 bp, Homo sapiens
gaggggaaagtgtgaggctgcg

SEQ ID NO: 7674255 - DNA, 22 bp, Homo sapiens
gaggggaaagtgtgaggctgcg

SEQ ID NO: 7674256 - DNA, 22 bp, Homo sapiens
gaggggaaagtgtgaggctgcg

SEQ ID NO: 7674257 - DNA, 22 bp, Homo sapiens
gaggggaaagtgtgaggctgcg

SEQ ID NO: 7674258 - DNA, 22 bp, Homo sapiens
gaggggaaagtgtgaggctgcg

SEQ ID NO: 7674259 - DNA, 22 bp, Homo sapiens
gaggggaaagtgtgaggctgcg

SEQ ID NO: 7674260 - DNA, 22 bp, Homo sapiens
gagggccaaagagcaagagcct

SEQ ID NO: 7674261 - DNA, 22 bp, Homo sapiens
gagggccaaagagcaagagcct

SEQ ID NO: 7674262 - DNA, 22 bp, Homo sapiens
gagggccaaagagcaagagcct

SEQ ID NO: 7674263 - DNA, 22 bp, Homo sapiens
gagggcatctagagcctaatcc

SEQ ID NO: 7674264 - DNA, 22 bp, Homo sapiens
gagggccaaagagcaagagcct

SEQ ID NO: 7674265 - DNA, 22 bp, Homo sapiens
gagggccaaagagcaagagcct

SEQ ID NO: 7674266 - DNA, 22 bp, Homo sapiens
gagggccaaagagcaagagcct

SEQ ID NO: 7674267 - DNA, 22 bp, Homo sapiens
gagggccaactagcaccacttt

SEQ ID NO: 7674268 - DNA, 22 bp, Homo sapiens
gagggccaaagagcaagagcct

SEQ ID NO: 7674269 - DNA, 22 bp, Homo sapiens
gagggccaaagagcaagagcct

SEQ ID NO: 7674270 - DNA, 22 bp, Homo sapiens
gagggcagtgaattttgaagct

SEQ ID NO: 7674271 - DNA, 22 bp, Homo sapiens
gagggcagtgaattttgaagct

SEQ ID NO: 7674272 - DNA, 22 bp, Homo sapiens
gagggcagtgaattttgaagct

SEQ ID NO: 7674273 - DNA, 22 bp, Homo sapiens
gagggcagtgaattttgaagct

SEQ ID NO: 7674274 - DNA, 22 bp, Homo sapiens
gagggcagtgaattttgaagct

SEQ ID NO: 7674275 - DNA, 22 bp, Homo sapiens
gagggcagtgaattttgaagct

SEQ ID NO: 7674276 - DNA, 22 bp, Homo sapiens
gagggcatctagagcctaatcc

SEQ ID NO: 7674277 - DNA, 22 bp, Homo sapiens
gagggcatctagagcctaatcc

SEQ ID NO: 7674278 - DNA, 22 bp, Homo sapiens
gagggcatagttaaataggagg

SEQ ID NO: 7674279 - DNA, 22 bp, Homo sapiens
gagggcagtgaattttgaagct

SEQ ID NO: 7674280 - DNA, 20 bp, Homo sapiens
gagggcaggcacccatttca

SEQ ID NO: 7674281 - DNA, 20 bp, Homo sapiens
gagggcaggcacccatttca

SEQ ID NO: 7674282 - DNA, 20 bp, Homo sapiens
gagggcaggcacccatttca

SEQ ID NO: 7674283 - DNA, 20 bp, Homo sapiens
gagggcaggcacccatttca

SEQ ID NO: 7674284 - DNA, 22 bp, Homo sapiens
gagggcaggggtcttgcacggt

SEQ ID NO: 7674285 - DNA, 20 bp, Homo sapiens
gagggcaggcacccatttca

SEQ ID NO: 7674286 - DNA, 22 bp, Homo sapiens
gagggcaggggtcttgcacggt

SEQ ID NO: 7674287 - DNA, 22 bp, Homo sapiens
gagggcaggggtcttgcacggt

SEQ ID NO: 7674288 - DNA, 22 bp, Homo sapiens
gagggcaggggtcttgcacggt

SEQ ID NO: 7674289 - DNA, 20 bp, Homo sapiens
gagggcaggcacccatttca

SEQ ID NO: 7674290 - DNA, 20 bp, Homo sapiens
gagggcaggcacccatttca

SEQ ID NO: 7674291 - DNA, 20 bp, Homo sapiens
gagggcaggcacccatttca

SEQ ID NO: 7674292 - DNA, 22 bp, Homo sapiens
gagggcagagtctaatgatgca

SEQ ID NO: 7674293 - DNA, 22 bp, Homo sapiens
gagggcagagtctaatgatgca

SEQ ID NO: 7674294 - DNA, 22 bp, Homo sapiens
gagggcagagtctaatgatgca

SEQ ID NO: 7674295 - DNA, 22 bp, Homo sapiens
gagggcagagtctaatgatgca

SEQ ID NO: 7674296 - DNA, 22 bp, Homo sapiens
gagggcagagtctaatgatgca

SEQ ID NO: 7674297 - DNA, 22 bp, Homo sapiens
gagggcagagtctaatgatgca

SEQ ID NO: 7674298 - DNA, 22 bp, Homo sapiens
gagggcagagtctaatgatgca

SEQ ID NO: 7674299 - DNA, 22 bp, Homo sapiens
gagggcaggggtcttgcacggt

SEQ ID NO: 7674300 - DNA, 22 bp, Homo sapiens
gagggcaggggtcttgcacggt

SEQ ID NO: 7674301 - DNA, 22 bp, Homo sapiens
gagggcaggggtcttgcacggt

SEQ ID NO: 7674302 - DNA, 22 bp, Homo sapiens
gagggcaggggtcttgcacggt

SEQ ID NO: 7674303 - DNA, 22 bp, Homo sapiens
gagggcagtagcctcgtaccct

SEQ ID NO: 7674304 - DNA, 22 bp, Homo sapiens
gagggcagtagcctcgtaccct

SEQ ID NO: 7674305 - DNA, 22 bp, Homo sapiens
gagggcagtagcctcgtaccct

SEQ ID NO: 7674306 - DNA, 22 bp, Homo sapiens
gagggcagtagcctcgtaccct

SEQ ID NO: 7674307 - DNA, 22 bp, Homo sapiens
gagggcagtagcctcgtaccct

SEQ ID NO: 7674308 - DNA, 22 bp, Homo sapiens
gagggcagtagcctcgtaccct

SEQ ID NO: 7674309 - DNA, 22 bp, Homo sapiens
gagggcagtagcctcgtaccct

SEQ ID NO: 7674310 - DNA, 22 bp, Homo sapiens
gagggcagtagcctcgtaccct

SEQ ID NO: 7674311 - DNA, 22 bp, Homo sapiens
gagggcagtagcctcgtaccct

SEQ ID NO: 7674312 - DNA, 22 bp, Homo sapiens
gaggggcacagcagctgttgca

SEQ ID NO: 7674313 - DNA, 22 bp, Homo sapiens
gaggggcacagcagctgttgca

SEQ ID NO: 7674314 - DNA, 22 bp, Homo sapiens
gaggggcacagcagctgttgca

SEQ ID NO: 7674315 - DNA, 22 bp, Homo sapiens
gaggggcaatgagggaaagagt

SEQ ID NO: 7674316 - DNA, 22 bp, Homo sapiens
gaggggcacagcagctgttgca

SEQ ID NO: 7674317 - DNA, 22 bp, Homo sapiens
gaggggcaatgagggaaagagt

SEQ ID NO: 7674318 - DNA, 22 bp, Homo sapiens
gaggggcaatgagggaaagagt

SEQ ID NO: 7674319 - DNA, 22 bp, Homo sapiens
gaggggcaatgagggaaagagt

SEQ ID NO: 7674320 - DNA, 22 bp, Homo sapiens
gaggggcaatgagggaaagagt

SEQ ID NO: 7674321 - DNA, 22 bp, Homo sapiens
gaggggcaagaagttggcctct

SEQ ID NO: 7674322 - DNA, 22 bp, Homo sapiens
gaggggcaatgagggaaagagt

SEQ ID NO: 7674323 - DNA, 22 bp, Homo sapiens
gaggggcaatgagggaaagagt

SEQ ID NO: 7674324 - DNA, 22 bp, Homo sapiens
gaggggcaatgagggaaagagt

SEQ ID NO: 7674325 - DNA, 22 bp, Homo sapiens
gaggggcaatgagggaaagagt

SEQ ID NO: 7674326 - DNA, 22 bp, Homo sapiens
gaggggcaatgagggaaagagt

SEQ ID NO: 7674327 - DNA, 22 bp, Homo sapiens
gaggggcaagaagttggcctct

SEQ ID NO: 7674328 - DNA, 22 bp, Homo sapiens
gaggggcaagaagttggcctct

SEQ ID NO: 7674329 - DNA, 22 bp, Homo sapiens
gaggggcaagaagttggcctct

SEQ ID NO: 7674330 - DNA, 22 bp, Homo sapiens
gaggggattggaaggaacaccc

SEQ ID NO: 7674331 - DNA, 22 bp, Homo sapiens
gaggggattggaaggaacaccc

SEQ ID NO: 7674332 - DNA, 22 bp, Homo sapiens
gaggggattggaaggaacaccc

SEQ ID NO: 7674333 - DNA, 22 bp, Homo sapiens
gaggggagtgtcctccgggccc

SEQ ID NO: 7674334 - DNA, 22 bp, Homo sapiens
gaggggatgcagagaggcttat

SEQ ID NO: 7674335 - DNA, 22 bp, Homo sapiens
gaggggatgcagagaggcttat

SEQ ID NO: 7674336 - DNA, 22 bp, Homo sapiens
gaggggatgcagagaggcttat

SEQ ID NO: 7674337 - DNA, 22 bp, Homo sapiens
gaggggatgcagagaggcttat

SEQ ID NO: 7674338 - DNA, 22 bp, Homo sapiens
gaggggagtgtcctccgggccc

SEQ ID NO: 7674339 - DNA, 22 bp, Homo sapiens
gaggggagtgtcctccgggccc

SEQ ID NO: 7674340 - DNA, 22 bp, Homo sapiens
gaggggagtgtcctccgggccc

SEQ ID NO: 7674341 - DNA, 22 bp, Homo sapiens
gaggggagtgtcctccgggccc

SEQ ID NO: 7674342 - DNA, 22 bp, Homo sapiens
gaggggagtgtcctccgggccc

SEQ ID NO: 7674343 - DNA, 22 bp, Homo sapiens
gaggggagtaaagtcatgttac

SEQ ID NO: 7674344 - DNA, 22 bp, Homo sapiens
gaggggagtgtcctccgggccc

SEQ ID NO: 7674345 - DNA, 22 bp, Homo sapiens
gaggggagtaaagtcatgttac

SEQ ID NO: 7674346 - DNA, 22 bp, Homo sapiens
gaggggagtaaagtcatgttac

SEQ ID NO: 7674347 - DNA, 22 bp, Homo sapiens
gaggggagtaaagtcatgttac

SEQ ID NO: 7674348 - DNA, 22 bp, Homo sapiens
gaggggagtaaagtcatgttac

SEQ ID NO: 7674349 - DNA, 22 bp, Homo sapiens
gaggggagtaaagtcatgttac

SEQ ID NO: 7674350 - DNA, 22 bp, Homo sapiens
gaggggcagttgattgtgctat

SEQ ID NO: 7674351 - DNA, 22 bp, Homo sapiens
gaggggcagttgattgtgctat

SEQ ID NO: 7674352 - DNA, 22 bp, Homo sapiens
gaggggcagttgattgtgctat

SEQ ID NO: 7674353 - DNA, 22 bp, Homo sapiens
gaggggcagttgattgtgctat

SEQ ID NO: 7674354 - DNA, 22 bp, Homo sapiens
gaggggccggcatgtgcctctc

SEQ ID NO: 7674355 - DNA, 22 bp, Homo sapiens
gaggggcaggattattgggatt

SEQ ID NO: 7674356 - DNA, 22 bp, Homo sapiens
gaggggcaggattattgggatt

SEQ ID NO: 7674357 - DNA, 22 bp, Homo sapiens
gaggggcaggattattgggatt

SEQ ID NO: 7674358 - DNA, 22 bp, Homo sapiens
gaggggcagtgcacccgggccc

SEQ ID NO: 7674359 - DNA, 22 bp, Homo sapiens
gaggggcagtgcacccgggccc

SEQ ID NO: 7674360 - DNA, 21 bp, Homo sapiens
gaggggcagctcttagcatta

SEQ ID NO: 7674361 - DNA, 22 bp, Homo sapiens
gaggggcaggattattgggatt

SEQ ID NO: 7674362 - DNA, 22 bp, Homo sapiens
gaggggcaggattattgggatt

SEQ ID NO: 7674363 - DNA, 22 bp, Homo sapiens
gaggggcaggattattgggatt

SEQ ID NO: 7674364 - DNA, 22 bp, Homo sapiens
gaggggcaggattattgggatt

SEQ ID NO: 7674365 - DNA, 22 bp, Homo sapiens
gaggggcaggattattgggatt

SEQ ID NO: 7674366 - DNA, 22 bp, Homo sapiens
gaggggcagaggtagagaacaa

SEQ ID NO: 7674367 - DNA, 22 bp, Homo sapiens
gaggggcagaggtagagaacaa

SEQ ID NO: 7674368 - DNA, 22 bp, Homo sapiens
gaggggcagaggtagagaacaa

SEQ ID NO: 7674369 - DNA, 22 bp, Homo sapiens
gaggggcagaatgtgatcaggg

SEQ ID NO: 7674370 - DNA, 22 bp, Homo sapiens
gaggggcagaatgtgatcaggg

SEQ ID NO: 7674371 - DNA, 22 bp, Homo sapiens
gaggggcagaggtagagaacaa

SEQ ID NO: 7674372 - DNA, 22 bp, Homo sapiens
gaggggcagaggtagagaacaa

SEQ ID NO: 7674373 - DNA, 22 bp, Homo sapiens
gaggggcagaatgtgatcaggg

SEQ ID NO: 7674374 - DNA, 22 bp, Homo sapiens
gaggggcagaatgtgatcaggg

SEQ ID NO: 7674375 - DNA, 22 bp, Homo sapiens
gaggggcagaatgtgatcaggg

SEQ ID NO: 7674376 - DNA, 22 bp, Homo sapiens
gaggggcagaatgtgatcaggg

SEQ ID NO: 7674377 - DNA, 22 bp, Homo sapiens
gaggggcagaatgtgatcaggg

SEQ ID NO: 7674378 - DNA, 22 bp, Homo sapiens
gaggggcacagtaaagggtccc

SEQ ID NO: 7674379 - DNA, 22 bp, Homo sapiens
gaggggcacagtaaagggtccc

SEQ ID NO: 7674380 - DNA, 22 bp, Homo sapiens
gaggggcacagtaaagggtccc

SEQ ID NO: 7674381 - DNA, 22 bp, Homo sapiens
gaggggcacagtaaagggtccc

SEQ ID NO: 7674382 - DNA, 22 bp, Homo sapiens
gaggggcacagtaaagggtccc

SEQ ID NO: 7674383 - DNA, 22 bp, Homo sapiens
gaggggcacagtaaagggtccc

SEQ ID NO: 7674384 - DNA, 22 bp, Homo sapiens
gaggggcacagtaaagggtccc

SEQ ID NO: 7674385 - DNA, 22 bp, Homo sapiens
gaggggcacagtaaagggtccc

SEQ ID NO: 7674386 - DNA, 22 bp, Homo sapiens
gaggggcacagtaaagggtccc

SEQ ID NO: 7674387 - DNA, 22 bp, Homo sapiens
gaggggcacagtaaagggtccc

SEQ ID NO: 7674388 - DNA, 22 bp, Homo sapiens
gaggcctggaattccagcctgg

SEQ ID NO: 7674389 - DNA, 22 bp, Homo sapiens
gaggcctggaattccagcctgg

SEQ ID NO: 7674390 - DNA, 22 bp, Homo sapiens
gaggcctggaattccagcctgg

SEQ ID NO: 7674391 - DNA, 22 bp, Homo sapiens
gaggctgcccaactggagtgga

SEQ ID NO: 7674392 - DNA, 22 bp, Homo sapiens
gaggcctgctttggcactctgg

SEQ ID NO: 7674393 - DNA, 22 bp, Homo sapiens
gaggcctgctttggcactctgg

SEQ ID NO: 7674394 - DNA, 22 bp, Homo sapiens
gaggcctgctttggcactctgg

SEQ ID NO: 7674395 - DNA, 22 bp, Homo sapiens
gaggcctgaggctgcctggagc

SEQ ID NO: 7674396 - DNA, 22 bp, Homo sapiens
gaggcctgaggctgcctggagc

SEQ ID NO: 7674397 - DNA, 22 bp, Homo sapiens
gaggcctgcagcgtggtccctg

SEQ ID NO: 7674398 - DNA, 22 bp, Homo sapiens
gaggcctgcagcgtggtccctg

SEQ ID NO: 7674399 - DNA, 22 bp, Homo sapiens
gaggcctgcagcgtggtccctg

SEQ ID NO: 7674400 - DNA, 22 bp, Homo sapiens
gaggcctgcagcgtggtccctg

SEQ ID NO: 7674401 - DNA, 22 bp, Homo sapiens
gaggctgcccaactggagtgga

SEQ ID NO: 7674402 - DNA, 22 bp, Homo sapiens
gaggctgcccaactggagtgga

SEQ ID NO: 7674403 - DNA, 22 bp, Homo sapiens
gaggctgcccaactggagtgga

SEQ ID NO: 7674404 - DNA, 22 bp, Homo sapiens
gaggctgcccaactggagtgga

SEQ ID NO: 7674405 - DNA, 22 bp, Homo sapiens
gaggctgcccacacctgcgccg

SEQ ID NO: 7674406 - DNA, 22 bp, Homo sapiens
gaggctgcccacacctgcgccg

SEQ ID NO: 7674407 - DNA, 22 bp, Homo sapiens
gaggctgcccacacctgcgccg

SEQ ID NO: 7674408 - DNA, 22 bp, Homo sapiens
gaggctgcccacacctgcgccg

SEQ ID NO: 7674409 - DNA, 22 bp, Homo sapiens
gaggctggaatattagaaatgt

SEQ ID NO: 7674410 - DNA, 22 bp, Homo sapiens
gaggctggacgtgcatttctac

SEQ ID NO: 7674411 - DNA, 22 bp, Homo sapiens
gaggctggacgtgcatttctac

SEQ ID NO: 7674412 - DNA, 22 bp, Homo sapiens
gaggctggacgtgcatttctac

SEQ ID NO: 7674413 - DNA, 22 bp, Homo sapiens
gaggctggacgtgcatttctac

SEQ ID NO: 7674414 - DNA, 22 bp, Homo sapiens
gaggctggacgtgcatttctac

SEQ ID NO: 7674415 - DNA, 22 bp, Homo sapiens
gaggctggaatattagaaatgt

SEQ ID NO: 7674416 - DNA, 22 bp, Homo sapiens
gaggctgccccttcctcagctg

SEQ ID NO: 7674417 - DNA, 22 bp, Homo sapiens
gaggctggaatattagaaatgt

SEQ ID NO: 7674418 - DNA, 16 bp, Homo sapiens
gaggctggcagatgtc

SEQ ID NO: 7674419 - DNA, 16 bp, Homo sapiens
gaggctggcagatgtc

SEQ ID NO: 7674420 - DNA, 16 bp, Homo sapiens
gaggctggcagatgtc

SEQ ID NO: 7674421 - DNA, 16 bp, Homo sapiens
gaggctggcagatgtc

SEQ ID NO: 7674422 - DNA, 22 bp, Homo sapiens
gaggctggcagaaaagcacagg

SEQ ID NO: 7674423 - DNA, 22 bp, Homo sapiens
gaggctggcagaaaagcacagg

SEQ ID NO: 7674424 - DNA, 22 bp, Homo sapiens
gaggctggcagaaaagcacagg

SEQ ID NO: 7674425 - DNA, 22 bp, Homo sapiens
gaggctggaggtcaaagatgaa

SEQ ID NO: 7674426 - DNA, 22 bp, Homo sapiens
gaggctggcagaaaagcacagg

SEQ ID NO: 7674427 - DNA, 22 bp, Homo sapiens
gaggctggcagaaaagcacagg

SEQ ID NO: 7674428 - DNA, 22 bp, Homo sapiens
gaggctggcagaaaagcacagg

SEQ ID NO: 7674429 - DNA, 22 bp, Homo sapiens
gaggctggcagaaaagcacagg

SEQ ID NO: 7674430 - DNA, 22 bp, Homo sapiens
gaggctggcagaaaagcacagg

SEQ ID NO: 7674431 - DNA, 22 bp, Homo sapiens
gaggctggcagaaaagcacagg

SEQ ID NO: 7674432 - DNA, 22 bp, Homo sapiens
gaggctggcagaaaagcacagg

SEQ ID NO: 7674433 - DNA, 22 bp, Homo sapiens
gaggctggaggtcaaagatgaa

SEQ ID NO: 7674434 - DNA, 22 bp, Homo sapiens
gaggctggaggtcaaagatgaa

SEQ ID NO: 7674435 - DNA, 22 bp, Homo sapiens
gaggctggaggtcaaagatgaa

SEQ ID NO: 7674436 - DNA, 22 bp, Homo sapiens
gaggctggaggtcaaagatgaa

SEQ ID NO: 7674437 - DNA, 22 bp, Homo sapiens
gaggctggaggtcaaagatgaa

SEQ ID NO: 7674438 - DNA, 22 bp, Homo sapiens
gaggctggagatattccaatct

SEQ ID NO: 7674439 - DNA, 22 bp, Homo sapiens
gaggctggagatattccaatct

SEQ ID NO: 7674440 - DNA, 22 bp, Homo sapiens
gaggctggagatattccaatct

SEQ ID NO: 7674441 - DNA, 22 bp, Homo sapiens
gaggctggagatattccaatct

SEQ ID NO: 7674442 - DNA, 22 bp, Homo sapiens
gaggctggagatattccaatct

SEQ ID NO: 7674443 - DNA, 22 bp, Homo sapiens
gaggctggagatattccaatct

SEQ ID NO: 7674444 - DNA, 22 bp, Homo sapiens
gaggctggagatattccaatct

SEQ ID NO: 7674445 - DNA, 22 bp, Homo sapiens
gaggctggaggtcaaagatgaa

SEQ ID NO: 7674446 - DNA, 22 bp, Homo sapiens
gaggctggaggtcaaagatgaa

SEQ ID NO: 7674447 - DNA, 22 bp, Homo sapiens
gaggctggaggtcaaagatgaa

SEQ ID NO: 7674448 - DNA, 22 bp, Homo sapiens
gaggctggaggtcaaagatgaa

SEQ ID NO: 7674449 - DNA, 22 bp, Homo sapiens
gaggctggaggtcaaagatgaa

SEQ ID NO: 7674450 - DNA, 22 bp, Homo sapiens
gaggctggaggtcaaagatgaa

SEQ ID NO: 7674451 - DNA, 22 bp, Homo sapiens
gaggctggaggtcaaagatgaa

SEQ ID NO: 7674452 - DNA, 22 bp, Homo sapiens
gaggctggaggtcaaagatgaa

SEQ ID NO: 7674453 - DNA, 22 bp, Homo sapiens
gaggctggaggtcaaagatgaa

SEQ ID NO: 7674454 - DNA, 22 bp, Homo sapiens
gagggatggtagttgacactga

SEQ ID NO: 7674455 - DNA, 22 bp, Homo sapiens
gagggatggtagttgacactga

SEQ ID NO: 7674456 - DNA, 22 bp, Homo sapiens
gagggatgcagaaacagaggcc

SEQ ID NO: 7674457 - DNA, 22 bp, Homo sapiens
gagggatgcagaaacagaggcc

SEQ ID NO: 7674458 - DNA, 22 bp, Homo sapiens
gagggcagagacagtgattcac

SEQ ID NO: 7674459 - DNA, 22 bp, Homo sapiens
gagggcagagacagtgattcac

SEQ ID NO: 7674460 - DNA, 22 bp, Homo sapiens
gagggatgcagaaacagaggcc

SEQ ID NO: 7674461 - DNA, 22 bp, Homo sapiens
gagggatggtagttgacactga

SEQ ID NO: 7674462 - DNA, 22 bp, Homo sapiens
gagggatggtagttgacactga

SEQ ID NO: 7674463 - DNA, 22 bp, Homo sapiens
gagggatggtagttgacactga

SEQ ID NO: 7674464 - DNA, 22 bp, Homo sapiens
gaggctgggggctgccttcctc

SEQ ID NO: 7674465 - DNA, 22 bp, Homo sapiens
gagggatctttaggcagcctca

SEQ ID NO: 7674466 - DNA, 22 bp, Homo sapiens
gaggctggggtctgcctttctg

SEQ ID NO: 7674467 - DNA, 22 bp, Homo sapiens
gagggatgcagaaacagaggcc

SEQ ID NO: 7674468 - DNA, 22 bp, Homo sapiens
gagggatgcagaaacagaggcc

SEQ ID NO: 7674469 - DNA, 22 bp, Homo sapiens
gagggatgcagaaacagaggcc

SEQ ID NO: 7674470 - DNA, 22 bp, Homo sapiens
gagggatgcagaaacagaggcc

SEQ ID NO: 7674471 - DNA, 22 bp, Homo sapiens
gagggatgcagaaacagaggcc

SEQ ID NO: 7674472 - DNA, 22 bp, Homo sapiens
gagggatgcagaaacagaggcc

SEQ ID NO: 7674473 - DNA, 16 bp, Homo sapiens
gagggcagaggcggaa

SEQ ID NO: 7674474 - DNA, 22 bp, Homo sapiens
gagggcagagacagtgattcac

SEQ ID NO: 7674475 - DNA, 22 bp, Homo sapiens
gagggcagagacagtgattcac

SEQ ID NO: 7674476 - DNA, 22 bp, Homo sapiens
gagggcagagacagtgattcac

SEQ ID NO: 7674477 - DNA, 22 bp, Homo sapiens
gagggcagagacagtgattcac

SEQ ID NO: 7674478 - DNA, 22 bp, Homo sapiens
gagggcagagacagtgattcac

SEQ ID NO: 7674479 - DNA, 16 bp, Homo sapiens
gagggcagaggcggaa

SEQ ID NO: 7674480 - DNA, 22 bp, Homo sapiens
gagggcagagacagtgattcac

SEQ ID NO: 7674481 - DNA, 16 bp, Homo sapiens
gagggcagaggcggaa

SEQ ID NO: 7674482 - DNA, 16 bp, Homo sapiens
gagggcagaggcggaa

SEQ ID NO: 7674483 - DNA, 16 bp, Homo sapiens
gagggcagaggcggaa

SEQ ID NO: 7674484 - DNA, 22 bp, Homo sapiens
gagggcagagtctaatgatgca

SEQ ID NO: 7674485 - DNA, 22 bp, Homo sapiens
gagggcagagtctaatgatgca

SEQ ID NO: 7674486 - DNA, 22 bp, Homo sapiens
gagggcagagtctaatgatgca

SEQ ID NO: 7674487 - DNA, 16 bp, Homo sapiens
gagggcagaggcggaa

SEQ ID NO: 7674488 - DNA, 16 bp, Homo sapiens
gagggcagaggcggaa

SEQ ID NO: 7674489 - DNA, 16 bp, Homo sapiens
gagggcagaggcggaa

SEQ ID NO: 7674490 - DNA, 16 bp, Homo sapiens
gagggcagaggcggaa

SEQ ID NO: 7674491 - DNA, 16 bp, Homo sapiens
gagggcagaggcggaa

SEQ ID NO: 7674492 - DNA, 22 bp, Homo sapiens
gaggctgggaagtccaagatca

SEQ ID NO: 7674493 - DNA, 22 bp, Homo sapiens
gaggctgggaagtccaagatca

SEQ ID NO: 7674494 - DNA, 22 bp, Homo sapiens
gaggctgggaagtccaagacca

SEQ ID NO: 7674495 - DNA, 22 bp, Homo sapiens
gaggctgggaagtccaagacca

SEQ ID NO: 7674496 - DNA, 22 bp, Homo sapiens
gaggctgggaagtccaagacca

SEQ ID NO: 7674497 - DNA, 22 bp, Homo sapiens
gaggctgggaagtccaagacca

SEQ ID NO: 7674498 - DNA, 22 bp, Homo sapiens
gaggctgggaagtccaagacca

SEQ ID NO: 7674499 - DNA, 22 bp, Homo sapiens
gaggctgggaagtccaagacca

SEQ ID NO: 7674500 - DNA, 22 bp, Homo sapiens
gaggctgggaagtccaagacca

SEQ ID NO: 7674501 - DNA, 22 bp, Homo sapiens
gaggctgggaagtccaagacca

SEQ ID NO: 7674502 - DNA, 22 bp, Homo sapiens
gaggctgggaagtccaagacca

SEQ ID NO: 7674503 - DNA, 16 bp, Homo sapiens
gaggctggcagatgtc

SEQ ID NO: 7674504 - DNA, 16 bp, Homo sapiens
gaggctggcagatgtc

SEQ ID NO: 7674505 - DNA, 22 bp, Homo sapiens
gaggctgggaagtccaagacca

SEQ ID NO: 7674506 - DNA, 16 bp, Homo sapiens
gaggctggcagatgtc

SEQ ID NO: 7674507 - DNA, 22 bp, Homo sapiens
gaggctgggaagtccaatatca

SEQ ID NO: 7674508 - DNA, 22 bp, Homo sapiens
gaggctgggaagtccaatatca

SEQ ID NO: 7674509 - DNA, 22 bp, Homo sapiens
gaggctgggaagtccaatatca

SEQ ID NO: 7674510 - DNA, 22 bp, Homo sapiens
gaggctgggaagtccaatatca

SEQ ID NO: 7674511 - DNA, 22 bp, Homo sapiens
gaggctgggaagtccaatatca

SEQ ID NO: 7674512 - DNA, 22 bp, Homo sapiens
gaggctgggaagtccaagatca

SEQ ID NO: 7674513 - DNA, 22 bp, Homo sapiens
gaggctgggaagtccaagatca

SEQ ID NO: 7674514 - DNA, 22 bp, Homo sapiens
gaggctgggaagtccaagatca

SEQ ID NO: 7674515 - DNA, 22 bp, Homo sapiens
gaggctgggaagtccaagatca

SEQ ID NO: 7674516 - DNA, 22 bp, Homo sapiens
gaggctgggaagtccaagatca

SEQ ID NO: 7674517 - DNA, 22 bp, Homo sapiens
gaggctgggaagtccaagatca

SEQ ID NO: 7674518 - DNA, 22 bp, Homo sapiens
gaggctgggggctgccttcctc

SEQ ID NO: 7674519 - DNA, 22 bp, Homo sapiens
gaggctgggggctgccttcctc

SEQ ID NO: 7674520 - DNA, 22 bp, Homo sapiens
gaggctgggggctgccttcctc

SEQ ID NO: 7674521 - DNA, 22 bp, Homo sapiens
gaggctgggggctgccttcctc

SEQ ID NO: 7674522 - DNA, 22 bp, Homo sapiens
gaggctgggggctgccttcctc

SEQ ID NO: 7674523 - DNA, 22 bp, Homo sapiens
gaggctgggggctgccttcctc

SEQ ID NO: 7674524 - DNA, 22 bp, Homo sapiens
gaggctgggggctgccttcctc

SEQ ID NO: 7674525 - DNA, 22 bp, Homo sapiens
gaggctgggggctgccttcctc

SEQ ID NO: 7674526 - DNA, 22 bp, Homo sapiens
gaggctgggggctgccttcctc

SEQ ID NO: 7674527 - DNA, 22 bp, Homo sapiens
gaggctgggggctgccttcctc

SEQ ID NO: 7674528 - DNA, 22 bp, Homo sapiens
gaggcagctgggatacaaggga

SEQ ID NO: 7674529 - DNA, 22 bp, Homo sapiens
gaggcagctgggatacaaggga

SEQ ID NO: 7674530 - DNA, 22 bp, Homo sapiens
gaggcagctgggatacaaggga

SEQ ID NO: 7674531 - DNA, 22 bp, Homo sapiens
gaggcagctgggatacaaggga

SEQ ID NO: 7674532 - DNA, 22 bp, Homo sapiens
gaggcagctgggctggtggttt

SEQ ID NO: 7674533 - DNA, 22 bp, Homo sapiens
gaggcagctgggctggtggttt

SEQ ID NO: 7674534 - DNA, 22 bp, Homo sapiens
gaggcagctgaaggagtgacag

SEQ ID NO: 7674535 - DNA, 22 bp, Homo sapiens
gaggcagctgaaggagtgacag

SEQ ID NO: 7674536 - DNA, 22 bp, Homo sapiens
gaggcagctgggatacaaggga

SEQ ID NO: 7674537 - DNA, 22 bp, Homo sapiens
gaggcagctgggatacaaggga

SEQ ID NO: 7674538 - DNA, 22 bp, Homo sapiens
gaggcagctgggatacaaggga

SEQ ID NO: 7674539 - DNA, 22 bp, Homo sapiens
gaggcagctgaaggagtgacag

SEQ ID NO: 7674540 - DNA, 22 bp, Homo sapiens
gaggcagctgaaggagtgacag

SEQ ID NO: 7674541 - DNA, 22 bp, Homo sapiens
gaggcagctgaaggagtgacag

SEQ ID NO: 7674542 - DNA, 22 bp, Homo sapiens
gaggcagctgaaggagtgacag

SEQ ID NO: 7674543 - DNA, 22 bp, Homo sapiens
gaggcagctgggctggtggttt

SEQ ID NO: 7674544 - DNA, 22 bp, Homo sapiens
gaggcagctgggtccggtcggg

SEQ ID NO: 7674545 - DNA, 22 bp, Homo sapiens
gaggcccagggtacaggccgct

SEQ ID NO: 7674546 - DNA, 22 bp, Homo sapiens
gaggcccagcattcagggcagg

SEQ ID NO: 7674547 - DNA, 22 bp, Homo sapiens
gaggcccagcattcagggcagg

SEQ ID NO: 7674548 - DNA, 22 bp, Homo sapiens
gaggcccagcattcagggcagg

SEQ ID NO: 7674549 - DNA, 22 bp, Homo sapiens
gaggcccagcattcagggcagg

SEQ ID NO: 7674550 - DNA, 22 bp, Homo sapiens
gaggcccaggtcaagcagccac

SEQ ID NO: 7674551 - DNA, 22 bp, Homo sapiens
gaggcccaggtcaagcagccac

SEQ ID NO: 7674552 - DNA, 22 bp, Homo sapiens
gaggcccaggtcaagcagccac

SEQ ID NO: 7674553 - DNA, 22 bp, Homo sapiens
gaggcccagggtacaggccgct

SEQ ID NO: 7674554 - DNA, 22 bp, Homo sapiens
gaggcccagggtacaggccgct

SEQ ID NO: 7674555 - DNA, 22 bp, Homo sapiens
gaggcccagtcctgcaagcacg

SEQ ID NO: 7674556 - DNA, 22 bp, Homo sapiens
gaggcccagtcctgcaagcacg

SEQ ID NO: 7674557 - DNA, 22 bp, Homo sapiens
gaggcccagtcctgcaagcacg

SEQ ID NO: 7674558 - DNA, 23 bp, Homo sapiens
gaggcagctcctgcagtgccctg

SEQ ID NO: 7674559 - DNA, 23 bp, Homo sapiens
gaggcagctcctgcagtgccctg

SEQ ID NO: 7674560 - DNA, 23 bp, Homo sapiens
gaggcagctcctgcagtgccctg

SEQ ID NO: 7674561 - DNA, 23 bp, Homo sapiens
gaggcagctcctgcagtgccctg

SEQ ID NO: 7674562 - DNA, 18 bp, Homo sapiens
gaggcagctagcaatttt

SEQ ID NO: 7674563 - DNA, 23 bp, Homo sapiens
gaggcagctcctgcagtgccctg

SEQ ID NO: 7674564 - DNA, 22 bp, Homo sapiens
gaggcagctcttctgaatgggg

SEQ ID NO: 7674565 - DNA, 22 bp, Homo sapiens
gaggcagctcttctgaatgggg

SEQ ID NO: 7674566 - DNA, 23 bp, Homo sapiens
gaggcagctcctgcagtgccctg

SEQ ID NO: 7674567 - DNA, 23 bp, Homo sapiens
gaggcagctcctgcagtgccctg

SEQ ID NO: 7674568 - DNA, 23 bp, Homo sapiens
gaggcagctcctgcagtgccctg

SEQ ID NO: 7674569 - DNA, 22 bp, Homo sapiens
gaggcagctgaagcttcaaaga

SEQ ID NO: 7674570 - DNA, 22 bp, Homo sapiens
gaggcagctgaaggagtgacag

SEQ ID NO: 7674571 - DNA, 22 bp, Homo sapiens
gaggcagctgaagcttcaaaga

SEQ ID NO: 7674572 - DNA, 22 bp, Homo sapiens
gaggcagcaggctgaggaggat

SEQ ID NO: 7674573 - DNA, 22 bp, Homo sapiens
gaggcagcaggctgaggaggat

SEQ ID NO: 7674574 - DNA, 22 bp, Homo sapiens
gaggcagcaggctgaggaggat

SEQ ID NO: 7674575 - DNA, 22 bp, Homo sapiens
gaggcagcagggctggttcctt

SEQ ID NO: 7674576 - DNA, 22 bp, Homo sapiens
gaggcagcagggctggttcctt

SEQ ID NO: 7674577 - DNA, 18 bp, Homo sapiens
gaggcagctagcaatttt

SEQ ID NO: 7674578 - DNA, 18 bp, Homo sapiens
gaggcagctagcaatttt

SEQ ID NO: 7674579 - DNA, 18 bp, Homo sapiens
gaggcagctagcaatttt

SEQ ID NO: 7674580 - DNA, 22 bp, Homo sapiens
gaggcagcgggtcaggaccgtg

SEQ ID NO: 7674581 - DNA, 22 bp, Homo sapiens
gaggcagcagaacatggaagag

SEQ ID NO: 7674582 - DNA, 22 bp, Homo sapiens
gaggcagcagaacatggaagag

SEQ ID NO: 7674583 - DNA, 22 bp, Homo sapiens
gaggcagcaggctgaggaggat

SEQ ID NO: 7674584 - DNA, 22 bp, Homo sapiens
gaggcagcagaacatggaagag

SEQ ID NO: 7674585 - DNA, 22 bp, Homo sapiens
gaggcagcaggctgaggaggat

SEQ ID NO: 7674586 - DNA, 22 bp, Homo sapiens
gaggcagcaggctgaggaggat

SEQ ID NO: 7674587 - DNA, 22 bp, Homo sapiens
gaggcagcaggctgaggaggat

SEQ ID NO: 7674588 - DNA, 22 bp, Homo sapiens
gaggcagcaggctgaggaggat

SEQ ID NO: 7674589 - DNA, 22 bp, Homo sapiens
gaggcagcaggctgaggaggat

SEQ ID NO: 7674590 - DNA, 22 bp, Homo sapiens
gaggcctctgtcccgccaggga

SEQ ID NO: 7674591 - DNA, 22 bp, Homo sapiens
gaggcctcctctgagacatctg

SEQ ID NO: 7674592 - DNA, 22 bp, Homo sapiens
gaggcctctgtcccaccaggga

SEQ ID NO: 7674593 - DNA, 22 bp, Homo sapiens
gaggcctcctctgagacatctg

SEQ ID NO: 7674594 - DNA, 22 bp, Homo sapiens
gaggcctcctctgagacatctg

SEQ ID NO: 7674595 - DNA, 22 bp, Homo sapiens
gaggcctcctctgagacatctg

SEQ ID NO: 7674596 - DNA, 22 bp, Homo sapiens
gaggcctcctctgagacatctg

SEQ ID NO: 7674597 - DNA, 22 bp, Homo sapiens
gaggcctctgtcccaccaggga

SEQ ID NO: 7674598 - DNA, 22 bp, Homo sapiens
gaggcctcaggaatgtcgtgtg

SEQ ID NO: 7674599 - DNA, 22 bp, Homo sapiens
gaggcctcaggaatgtcgtgtg

SEQ ID NO: 7674600 - DNA, 22 bp, Homo sapiens
gaggcctcagcctgccctgaac

SEQ ID NO: 7674601 - DNA, 22 bp, Homo sapiens
gaggcctcagcctgccctgaac

SEQ ID NO: 7674602 - DNA, 21 bp, Homo sapiens
gaggcctcagcctcagctcct

SEQ ID NO: 7674603 - DNA, 21 bp, Homo sapiens
gaggcctcagcctcagctcct

SEQ ID NO: 7674604 - DNA, 21 bp, Homo sapiens
gaggcctcagcctcagctcct

SEQ ID NO: 7674605 - DNA, 22 bp, Homo sapiens
gaggcctcaggcgtgggaaggg

SEQ ID NO: 7674606 - DNA, 22 bp, Homo sapiens
gaggcctcaggcgtgggaaggg

SEQ ID NO: 7674607 - DNA, 22 bp, Homo sapiens
gaggcctcatgaggtgagcatt

SEQ ID NO: 7674608 - DNA, 22 bp, Homo sapiens
gaggcctcaggaatgtcgtgtg

SEQ ID NO: 7674609 - DNA, 22 bp, Homo sapiens
gaggcctcctctgagacatctg

SEQ ID NO: 7674610 - DNA, 22 bp, Homo sapiens
gaggcctcctctgagacatctg

SEQ ID NO: 7674611 - DNA, 22 bp, Homo sapiens
gaggcctcttctttgttaacct

SEQ ID NO: 7674612 - DNA, 22 bp, Homo sapiens
gaggcctctgtcccgccaggga

SEQ ID NO: 7674613 - DNA, 22 bp, Homo sapiens
gaggcctctgtcccgccaggga

SEQ ID NO: 7674614 - DNA, 22 bp, Homo sapiens
gaggcctcttctttgttaacct

SEQ ID NO: 7674615 - DNA, 17 bp, Homo sapiens
gaggcctcttggcatct

SEQ ID NO: 7674616 - DNA, 17 bp, Homo sapiens
gaggcctcttggcatct

SEQ ID NO: 7674617 - DNA, 18 bp, Homo sapiens
gaggcctgagaaccaggt

SEQ ID NO: 7674618 - DNA, 22 bp, Homo sapiens
gaggcctgaaaggggacctatg

SEQ ID NO: 7674619 - DNA, 22 bp, Homo sapiens
gaggcctgaaaggggacctatg

SEQ ID NO: 7674620 - DNA, 22 bp, Homo sapiens
gaggcctgaggctgcctggagc

SEQ ID NO: 7674621 - DNA, 22 bp, Homo sapiens
gaggcctgaggctgcctggagc

SEQ ID NO: 7674622 - DNA, 22 bp, Homo sapiens
gaggcctgaggctgcctggagc

SEQ ID NO: 7674623 - DNA, 22 bp, Homo sapiens
gaggcctgaggctgcctggagc

SEQ ID NO: 7674624 - DNA, 18 bp, Homo sapiens
gaggcctgagaaccaggt

SEQ ID NO: 7674625 - DNA, 18 bp, Homo sapiens
gaggcctgagaaccaggt

SEQ ID NO: 7674626 - DNA, 22 bp, Homo sapiens
gaggccctcttgccacaatgaa

SEQ ID NO: 7674627 - DNA, 22 bp, Homo sapiens
gaggccctcttgccacaatgaa

SEQ ID NO: 7674628 - DNA, 22 bp, Homo sapiens
gaggccctccagctgtcagctg

SEQ ID NO: 7674629 - DNA, 22 bp, Homo sapiens
gaggccctccagctgtcagctg

SEQ ID NO: 7674630 - DNA, 22 bp, Homo sapiens
gaggcccggcgcaggcggactt

SEQ ID NO: 7674631 - DNA, 22 bp, Homo sapiens
gaggcccggcgcaggcggactt

SEQ ID NO: 7674632 - DNA, 21 bp, Homo sapiens
gaggcccatgggacaggggct

SEQ ID NO: 7674633 - DNA, 21 bp, Homo sapiens
gaggcccatgggacaggggct

SEQ ID NO: 7674634 - DNA, 21 bp, Homo sapiens
gaggcccatgggacaggggct

SEQ ID NO: 7674635 - DNA, 21 bp, Homo sapiens
gaggcccatgggacaggggct

SEQ ID NO: 7674636 - DNA, 22 bp, Homo sapiens
gaggcccagtcctgcaagcacg

SEQ ID NO: 7674637 - DNA, 22 bp, Homo sapiens
gaggcccagtggagggccatgg

SEQ ID NO: 7674638 - DNA, 22 bp, Homo sapiens
gaggcccagtcctgcaagcacg

SEQ ID NO: 7674639 - DNA, 19 bp, Homo sapiens
gaggcccatgagggtgctc

SEQ ID NO: 7674640 - DNA, 22 bp, Homo sapiens
gaggcccagtggagggccatgg

SEQ ID NO: 7674641 - DNA, 19 bp, Homo sapiens
gaggcccatgagggtgctc

SEQ ID NO: 7674642 - DNA, 19 bp, Homo sapiens
gaggcccatgagggtgctc

SEQ ID NO: 7674643 - DNA, 19 bp, Homo sapiens
gaggcccatgagggtgctc

SEQ ID NO: 7674644 - DNA, 22 bp, Homo sapiens
gaggcccagtggagggccatgg

SEQ ID NO: 7674645 - DNA, 20 bp, Homo sapiens
gaggcctcagcctcagctcc

SEQ ID NO: 7674646 - DNA, 20 bp, Homo sapiens
gaggcctcagcctcagctcc

SEQ ID NO: 7674647 - DNA, 20 bp, Homo sapiens
gaggcctcagcctcagctcc

SEQ ID NO: 7674648 - DNA, 22 bp, Homo sapiens
gaggcctaggagccaggcatca

SEQ ID NO: 7674649 - DNA, 20 bp, Homo sapiens
gaggcctcagcctcagctcc

SEQ ID NO: 7674650 - DNA, 21 bp, Homo sapiens
gaggcctcagcctcagctcct

SEQ ID NO: 7674651 - DNA, 20 bp, Homo sapiens
gaggcctcagcctcagctcc

SEQ ID NO: 7674652 - DNA, 22 bp, Homo sapiens
gaggccctgaagacagctgggg

SEQ ID NO: 7674653 - DNA, 22 bp, Homo sapiens
gaggccctgaagacagctgggg

SEQ ID NO: 7674654 - DNA, 22 bp, Homo sapiens
gaggccctgaagacagctgggg

SEQ ID NO: 7674655 - DNA, 22 bp, Homo sapiens
gaggccctgaagacagctgggg

SEQ ID NO: 7674656 - DNA, 22 bp, Homo sapiens
gaggccctcttgccacaatgaa

SEQ ID NO: 7674657 - DNA, 22 bp, Homo sapiens
gaggccctcttgccacaatgaa

SEQ ID NO: 7674658 - DNA, 22 bp, Homo sapiens
gaggccctggtaggtcagagtg

SEQ ID NO: 7674659 - DNA, 22 bp, Homo sapiens
gaggccctggtaggtcagagtg

SEQ ID NO: 7674660 - DNA, 22 bp, Homo sapiens
gaggccctgaagacagctgggg

SEQ ID NO: 7674661 - DNA, 22 bp, Homo sapiens
gaggccctgaagacagctgggg

SEQ ID NO: 7674662 - DNA, 22 bp, Homo sapiens
gaggcagcaataaaaagaattt

SEQ ID NO: 7674663 - DNA, 22 bp, Homo sapiens
gaggcagcagaacatggaagag

SEQ ID NO: 7674664 - DNA, 22 bp, Homo sapiens
gaggcagcagaacatggaagag

SEQ ID NO: 7674665 - DNA, 22 bp, Homo sapiens
gaggcagcagaacatggaagag

SEQ ID NO: 7674666 - DNA, 22 bp, Homo sapiens
gaggcagcagaacatggaagag

SEQ ID NO: 7674667 - DNA, 22 bp, Homo sapiens
gaggcagcaaaatatatcataa

SEQ ID NO: 7674668 - DNA, 22 bp, Homo sapiens
gaggcagcaataaaaagaattt

SEQ ID NO: 7674669 - DNA, 22 bp, Homo sapiens
gaggcagcaaaatatatcataa

SEQ ID NO: 7674670 - DNA, 22 bp, Homo sapiens
gaggcagagtgcaccccaggag

SEQ ID NO: 7674671 - DNA, 22 bp, Homo sapiens
gaggcagagtgcaccccaggag

SEQ ID NO: 7674672 - DNA, 22 bp, Homo sapiens
gaggcagagtgcaccccaggag

SEQ ID NO: 7674673 - DNA, 22 bp, Homo sapiens
gaggcagagtgcaccccaggag

SEQ ID NO: 7674674 - DNA, 22 bp, Homo sapiens
gaggcagagtcacaaagagtct

SEQ ID NO: 7674675 - DNA, 22 bp, Homo sapiens
gaggcagagtgcaccccaggag

SEQ ID NO: 7674676 - DNA, 22 bp, Homo sapiens
gaggcagagtgcaccccaggag

SEQ ID NO: 7674677 - DNA, 22 bp, Homo sapiens
gaggcagagtcacaaagagtct

SEQ ID NO: 7674678 - DNA, 22 bp, Homo sapiens
gaggcagagtgcaccccaggag

SEQ ID NO: 7674679 - DNA, 22 bp, Homo sapiens
gaggcagaggttgttgcagtga

SEQ ID NO: 7674680 - DNA, 22 bp, Homo sapiens
gaggcagaggttgttgcagtga

SEQ ID NO: 7674681 - DNA, 22 bp, Homo sapiens
gaggcagaggttgttgcagtga

SEQ ID NO: 7674682 - DNA, 22 bp, Homo sapiens
gaggcagaggttgttgcagtga

SEQ ID NO: 7674683 - DNA, 22 bp, Homo sapiens
gaggcagaggttgcagtgagct

SEQ ID NO: 7674684 - DNA, 22 bp, Homo sapiens
gaggcagaggttgttgcagtga

SEQ ID NO: 7674685 - DNA, 22 bp, Homo sapiens
gaggcagaggttgcagtgagct

SEQ ID NO: 7674686 - DNA, 22 bp, Homo sapiens
gaggcagaggttgcagtgagct

SEQ ID NO: 7674687 - DNA, 22 bp, Homo sapiens
gaggcagaggttgcagtgagct

SEQ ID NO: 7674688 - DNA, 22 bp, Homo sapiens
gaggcagaggttgcagtgagct

SEQ ID NO: 7674689 - DNA, 22 bp, Homo sapiens
gaggcagagtcacaaagagtct

SEQ ID NO: 7674690 - DNA, 22 bp, Homo sapiens
gaggcagagtcacaaagagtct

SEQ ID NO: 7674691 - DNA, 22 bp, Homo sapiens
gaggcagagtcacaaagagtct

SEQ ID NO: 7674692 - DNA, 22 bp, Homo sapiens
gaggcagaggttgttgcagtga

SEQ ID NO: 7674693 - DNA, 22 bp, Homo sapiens
gaggcagaggttgttgcagtga

SEQ ID NO: 7674694 - DNA, 22 bp, Homo sapiens
gaggcagagtcacaaagagtct

SEQ ID NO: 7674695 - DNA, 22 bp, Homo sapiens
gaggcagagtcacaaagagtct

SEQ ID NO: 7674696 - DNA, 22 bp, Homo sapiens
gaggaggtggagtcatgcagag

SEQ ID NO: 7674697 - DNA, 22 bp, Homo sapiens
gaggaggtggagtcatgcagag

SEQ ID NO: 7674698 - DNA, 22 bp, Homo sapiens
gaggaggtggagtcatgcagag

SEQ ID NO: 7674699 - DNA, 22 bp, Homo sapiens
gaggaggtggaattccaggaat

SEQ ID NO: 7674700 - DNA, 22 bp, Homo sapiens
gaggaggtggaattccaggaat

SEQ ID NO: 7674701 - DNA, 22 bp, Homo sapiens
gaggaggtggaattccaggaat

SEQ ID NO: 7674702 - DNA, 22 bp, Homo sapiens
gaggaggtggaattccaggaat

SEQ ID NO: 7674703 - DNA, 22 bp, Homo sapiens
gaggaggtggaattccaggaat

SEQ ID NO: 7674704 - DNA, 22 bp, Homo sapiens
gaggaggtggaattccaggaat

SEQ ID NO: 7674705 - DNA, 22 bp, Homo sapiens
gaggaggtggaattccaggaat

SEQ ID NO: 7674706 - DNA, 22 bp, Homo sapiens
gaggaggtctcctccgcagggg

SEQ ID NO: 7674707 - DNA, 22 bp, Homo sapiens
gaggaggtctcctccgcagggg

SEQ ID NO: 7674708 - DNA, 22 bp, Homo sapiens
gaggaggtctcctccgcagggg

SEQ ID NO: 7674709 - DNA, 22 bp, Homo sapiens
gaggcagaggttgcagtgagct

SEQ ID NO: 7674710 - DNA, 22 bp, Homo sapiens
gaggcagaggttgcagtgagct

SEQ ID NO: 7674711 - DNA, 22 bp, Homo sapiens
gaggaggtggagtcatgcagag

SEQ ID NO: 7674712 - DNA, 22 bp, Homo sapiens
gaggcagaggttgcagtgagct

SEQ ID NO: 7674713 - DNA, 22 bp, Homo sapiens
gaggcagaggttgcagtgagct

SEQ ID NO: 7674714 - DNA, 22 bp, Homo sapiens
gaggcagaggttgcagtgagct

SEQ ID NO: 7674715 - DNA, 22 bp, Homo sapiens
gaggcagaggttgcagtgagct

SEQ ID NO: 7674716 - DNA, 22 bp, Homo sapiens
gaggcagaggttgcagtgagct

SEQ ID NO: 7674717 - DNA, 22 bp, Homo sapiens
gaggagggttggccttaggtag

SEQ ID NO: 7674718 - DNA, 22 bp, Homo sapiens
gaggagggttggccttaggtag

SEQ ID NO: 7674719 - DNA, 22 bp, Homo sapiens
gaggagggttggccttaggtag

SEQ ID NO: 7674720 - DNA, 22 bp, Homo sapiens
gaggagggttggccttaggtag

SEQ ID NO: 7674721 - DNA, 22 bp, Homo sapiens
gaggagggttggccttaggtag

SEQ ID NO: 7674722 - DNA, 22 bp, Homo sapiens
gaggagggttggccttaggtag

SEQ ID NO: 7674723 - DNA, 23 bp, Homo sapiens
gaggagggtctgacaagtgtagc

SEQ ID NO: 7674724 - DNA, 22 bp, Homo sapiens
gaggagggttggccttaggtag

SEQ ID NO: 7674725 - DNA, 22 bp, Homo sapiens
gaggaggtcccccgacatgcct

SEQ ID NO: 7674726 - DNA, 22 bp, Homo sapiens
gaggaggtcccccgacatgcct

SEQ ID NO: 7674727 - DNA, 22 bp, Homo sapiens
gaggaggtcccccgacatgcct

SEQ ID NO: 7674728 - DNA, 22 bp, Homo sapiens
gaggaggtcccccgacatgcct

SEQ ID NO: 7674729 - DNA, 22 bp, Homo sapiens
gaggaggtcccccgacatgcct

SEQ ID NO: 7674730 - DNA, 22 bp, Homo sapiens
gaggaggtcccccgacatgcct

SEQ ID NO: 7674731 - DNA, 22 bp, Homo sapiens
gaggaggtcgctgctgagcccc

SEQ ID NO: 7674732 - DNA, 22 bp, Homo sapiens
gaggaggtcgctgctgagcccc

SEQ ID NO: 7674733 - DNA, 22 bp, Homo sapiens
gaggaggtcgctgctgagcccc

SEQ ID NO: 7674734 - DNA, 22 bp, Homo sapiens
gaggaggtcgctgctgagcccc

SEQ ID NO: 7674735 - DNA, 22 bp, Homo sapiens
gaggaggtcgctgctgagcccc

SEQ ID NO: 7674736 - DNA, 22 bp, Homo sapiens
gaggaggtcgctgctgagcccc

SEQ ID NO: 7674737 - DNA, 22 bp, Homo sapiens
gaggagggagctggaagctctt

SEQ ID NO: 7674738 - DNA, 22 bp, Homo sapiens
gaggagggagctggaagctctt

SEQ ID NO: 7674739 - DNA, 22 bp, Homo sapiens
gaggagggagctggaagctctt

SEQ ID NO: 7674740 - DNA, 22 bp, Homo sapiens
gaggagggagctggaagctctt

SEQ ID NO: 7674741 - DNA, 22 bp, Homo sapiens
gaggagggagctggaagctctt

SEQ ID NO: 7674742 - DNA, 22 bp, Homo sapiens
gaggagggagctggaagctctt

SEQ ID NO: 7674743 - DNA, 22 bp, Homo sapiens
gaggagggagctggaagctctt

SEQ ID NO: 7674744 - DNA, 22 bp, Homo sapiens
gaggagggagctggaagctctt

SEQ ID NO: 7674745 - DNA, 22 bp, Homo sapiens
gaggagggagctggaagctctt

SEQ ID NO: 7674746 - DNA, 22 bp, Homo sapiens
gaggagggagctggaagctctt

SEQ ID NO: 7674747 - DNA, 22 bp, Homo sapiens
gaggagggagaattaggcttaa

SEQ ID NO: 7674748 - DNA, 22 bp, Homo sapiens
gaggagggagctggaagctctt

SEQ ID NO: 7674749 - DNA, 22 bp, Homo sapiens
gaggaggcttccgggaggcacg

SEQ ID NO: 7674750 - DNA, 22 bp, Homo sapiens
gaggagggagaattaggcttaa

SEQ ID NO: 7674751 - DNA, 22 bp, Homo sapiens
gaggagggagaattaggcttaa

SEQ ID NO: 7674752 - DNA, 22 bp, Homo sapiens
gaggagggagaattaggcttaa

SEQ ID NO: 7674753 - DNA, 22 bp, Homo sapiens
gaggaggcttccgggaggcacg

SEQ ID NO: 7674754 - DNA, 22 bp, Homo sapiens
gaggagggagaattaggcttaa

SEQ ID NO: 7674755 - DNA, 22 bp, Homo sapiens
gaggagggagaattaggcttaa

SEQ ID NO: 7674756 - DNA, 22 bp, Homo sapiens
gaggagggagaattaggcttaa

SEQ ID NO: 7674757 - DNA, 22 bp, Homo sapiens
gaggagggagaattaggcttaa

SEQ ID NO: 7674758 - DNA, 22 bp, Homo sapiens
gaggagggagctggaagctctt

SEQ ID NO: 7674759 - DNA, 22 bp, Homo sapiens
gaggagggagctggaagctctt

SEQ ID NO: 7674760 - DNA, 22 bp, Homo sapiens
gaggagggagctggaagctctt

SEQ ID NO: 7674761 - DNA, 22 bp, Homo sapiens
gaggagggagctggaagctctt

SEQ ID NO: 7674762 - DNA, 22 bp, Homo sapiens
gaggagggagctggaagctctt

SEQ ID NO: 7674763 - DNA, 23 bp, Homo sapiens
gaggagggtctgacaagtgtagc

SEQ ID NO: 7674764 - DNA, 23 bp, Homo sapiens
gaggagggtctgacaagtgtagc

SEQ ID NO: 7674765 - DNA, 22 bp, Homo sapiens
gaggagggagctggaagctctt

SEQ ID NO: 7674766 - DNA, 23 bp, Homo sapiens
gaggagggtctgacaagtgtagc

SEQ ID NO: 7674767 - DNA, 23 bp, Homo sapiens
gaggagggtctgacaagtgtagc

SEQ ID NO: 7674768 - DNA, 23 bp, Homo sapiens
gaggagggtctgacaagtgtagc

SEQ ID NO: 7674769 - DNA, 22 bp, Homo sapiens
gaggagggttggccttaggtag

SEQ ID NO: 7674770 - DNA, 23 bp, Homo sapiens
gaggagggtctgacaagtgtagc

SEQ ID NO: 7674771 - DNA, 23 bp, Homo sapiens
gaggagggtctgacaagtgtagc

SEQ ID NO: 7674772 - DNA, 22 bp, Homo sapiens
gaggaggcttccgggaggcacg

SEQ ID NO: 7674773 - DNA, 22 bp, Homo sapiens
gaggaggcttccgggaggcacg

SEQ ID NO: 7674774 - DNA, 22 bp, Homo sapiens
gaggaggcttccgggaggcacg

SEQ ID NO: 7674775 - DNA, 19 bp, Homo sapiens
gaggaggcttcagctttct

SEQ ID NO: 7674776 - DNA, 19 bp, Homo sapiens
gaggaggcttcagctttct

SEQ ID NO: 7674777 - DNA, 19 bp, Homo sapiens
gaggaggcttcagctttct

SEQ ID NO: 7674778 - DNA, 19 bp, Homo sapiens
gaggaggcttcagctttct

SEQ ID NO: 7674779 - DNA, 19 bp, Homo sapiens
gaggaggcttcagctttct

SEQ ID NO: 7674780 - DNA, 22 bp, Homo sapiens
gaggaggctgtttctctgcatt

SEQ ID NO: 7674781 - DNA, 22 bp, Homo sapiens
gaggaggctgtttctctgcatt

SEQ ID NO: 7674782 - DNA, 22 bp, Homo sapiens
gaggaggcttccgggaggcacg

SEQ ID NO: 7674783 - DNA, 22 bp, Homo sapiens
gaggaggcttccgggaggcacg

SEQ ID NO: 7674784 - DNA, 22 bp, Homo sapiens
gaggaggcttccgggaggcacg

SEQ ID NO: 7674785 - DNA, 22 bp, Homo sapiens
gaggaggcttccgggaggcacg

SEQ ID NO: 7674786 - DNA, 22 bp, Homo sapiens
gaggaggcttccgggaggcacg

SEQ ID NO: 7674787 - DNA, 22 bp, Homo sapiens
gaggaggcttccgggaggcacg

SEQ ID NO: 7674788 - DNA, 22 bp, Homo sapiens
gaggaggcttccgggaggcacg

SEQ ID NO: 7674789 - DNA, 22 bp, Homo sapiens
gaggaggcttccgggaggcacg

SEQ ID NO: 7674790 - DNA, 22 bp, Homo sapiens
gaggaggcttccgggaggcacg

SEQ ID NO: 7674791 - DNA, 22 bp, Homo sapiens
gaggaggctggcgccgcctgcc

SEQ ID NO: 7674792 - DNA, 22 bp, Homo sapiens
gaggaggctggcgccgcctgcc

SEQ ID NO: 7674793 - DNA, 22 bp, Homo sapiens
gaggaggctggcgccgcctgcc

SEQ ID NO: 7674794 - DNA, 22 bp, Homo sapiens
gaggaggctgaacaatgccctg

SEQ ID NO: 7674795 - DNA, 22 bp, Homo sapiens
gaggaggctggcgccgcctgcc

SEQ ID NO: 7674796 - DNA, 22 bp, Homo sapiens
gaggaggctgaacaatgccctg

SEQ ID NO: 7674797 - DNA, 22 bp, Homo sapiens
gaggaggctgaacaatgccctg

SEQ ID NO: 7674798 - DNA, 22 bp, Homo sapiens
gaggaggctggcgccgcctgcc

SEQ ID NO: 7674799 - DNA, 22 bp, Homo sapiens
gaggaggctggcgccgcctgcc

SEQ ID NO: 7674800 - DNA, 22 bp, Homo sapiens
gaggaggctggcgccgcctgcc

SEQ ID NO: 7674801 - DNA, 22 bp, Homo sapiens
gaggaggctgtttctctgcatt

SEQ ID NO: 7674802 - DNA, 22 bp, Homo sapiens
gaggaggctgtttctctgcatt

SEQ ID NO: 7674803 - DNA, 22 bp, Homo sapiens
gaggaggctgtttctctgcatt

SEQ ID NO: 7674804 - DNA, 22 bp, Homo sapiens
gaggaggctgtttctctgcatt

SEQ ID NO: 7674805 - DNA, 22 bp, Homo sapiens
gaggaggctgtttctctgcatt

SEQ ID NO: 7674806 - DNA, 22 bp, Homo sapiens
gaggaggctgtttctctgcatt

SEQ ID NO: 7674807 - DNA, 22 bp, Homo sapiens
gaggaggctgtttctctgcatt

SEQ ID NO: 7674808 - DNA, 22 bp, Homo sapiens
gaggaggctgtttctctgcatt

SEQ ID NO: 7674809 - DNA, 22 bp, Homo sapiens
gaggaggctgtttctctgcatt

SEQ ID NO: 7674810 - DNA, 21 bp, Homo sapiens
gaggaatggtttgcaaagcac

SEQ ID NO: 7674811 - DNA, 22 bp, Homo sapiens
gaggaatgggtgtctcgtgatt

SEQ ID NO: 7674812 - DNA, 21 bp, Homo sapiens
gaggaatggtttgcaaagcac

SEQ ID NO: 7674813 - DNA, 22 bp, Homo sapiens
gaggaatgggtgtctcgtgatt

SEQ ID NO: 7674814 - DNA, 22 bp, Homo sapiens
gaggaagtttacaaagcatctg

SEQ ID NO: 7674815 - DNA, 22 bp, Homo sapiens
gaggaagtttacaaagcatctg

SEQ ID NO: 7674816 - DNA, 22 bp, Homo sapiens
gaggaatgggtgtctcgtgatt

SEQ ID NO: 7674817 - DNA, 22 bp, Homo sapiens
gaggaatgggtgtctcgtgatt

SEQ ID NO: 7674818 - DNA, 22 bp, Homo sapiens
gaggaatgggtgtctcgtgatt

SEQ ID NO: 7674819 - DNA, 22 bp, Homo sapiens
gaggaagttaggatacattggt

SEQ ID NO: 7674820 - DNA, 22 bp, Homo sapiens
gaggaagtctctctacaagaaa

SEQ ID NO: 7674821 - DNA, 22 bp, Homo sapiens
gaggaagttctatgattacatc

SEQ ID NO: 7674822 - DNA, 22 bp, Homo sapiens
gaggaagtctctctacaagaaa

SEQ ID NO: 7674823 - DNA, 22 bp, Homo sapiens
gaggaagtctctctacaagaaa

SEQ ID NO: 7674824 - DNA, 22 bp, Homo sapiens
gaggaaggtcccatcagaattt

SEQ ID NO: 7674825 - DNA, 22 bp, Homo sapiens
gaggaaggtcccatcagaattt

SEQ ID NO: 7674826 - DNA, 22 bp, Homo sapiens
gaggaaggtcccatcagaattt

SEQ ID NO: 7674827 - DNA, 22 bp, Homo sapiens
gaggaaggtcccatcagaattt

SEQ ID NO: 7674828 - DNA, 22 bp, Homo sapiens
gaggaatgtcagcacaggcctc

SEQ ID NO: 7674829 - DNA, 22 bp, Homo sapiens
gaggaatgtcagcacaggcctc

SEQ ID NO: 7674830 - DNA, 22 bp, Homo sapiens
gaggaatgttattaaaggagct

SEQ ID NO: 7674831 - DNA, 22 bp, Homo sapiens
gaggaatgttattaaaggagct

SEQ ID NO: 7674832 - DNA, 22 bp, Homo sapiens
gaggaatgttattaaaggagct

SEQ ID NO: 7674833 - DNA, 22 bp, Homo sapiens
gaggacaaagcccaggtgctgg

SEQ ID NO: 7674834 - DNA, 22 bp, Homo sapiens
gaggaatgttattaaaggagct

SEQ ID NO: 7674835 - DNA, 22 bp, Homo sapiens
gaggacaaagcccaggtgctgg

SEQ ID NO: 7674836 - DNA, 22 bp, Homo sapiens
gaggacaaagcccaggtgctgg

SEQ ID NO: 7674837 - DNA, 22 bp, Homo sapiens
gaggacaaagcccaggtgctgg

SEQ ID NO: 7674838 - DNA, 22 bp, Homo sapiens
gaggacaaagcccaggtgctgg

SEQ ID NO: 7674839 - DNA, 22 bp, Homo sapiens
gaggacaaagcccaggtgctgg

SEQ ID NO: 7674840 - DNA, 22 bp, Homo sapiens
gaggacaagctgtgagtggggt

SEQ ID NO: 7674841 - DNA, 22 bp, Homo sapiens
gaggacacaaagtggctgagat

SEQ ID NO: 7674842 - DNA, 22 bp, Homo sapiens
gaggacaaggccttgcaattct

SEQ ID NO: 7674843 - DNA, 22 bp, Homo sapiens
gaggacaaggccttgcaattct

SEQ ID NO: 7674844 - DNA, 22 bp, Homo sapiens
gaggacacaaagtggctgagat

SEQ ID NO: 7674845 - DNA, 22 bp, Homo sapiens
gaggacacaaagtggctgagat

SEQ ID NO: 7674846 - DNA, 22 bp, Homo sapiens
gaggacacatgactccagcagg

SEQ ID NO: 7674847 - DNA, 23 bp, Homo sapiens
gaggacacagcccagacagccgt

SEQ ID NO: 7674848 - DNA, 23 bp, Homo sapiens
gaggacacagcccagacagccgt

SEQ ID NO: 7674849 - DNA, 22 bp, Homo sapiens
gaggacacaaagtggctgagat

SEQ ID NO: 7674850 - DNA, 22 bp, Homo sapiens
gaggacagagccgcctggcaag

SEQ ID NO: 7674851 - DNA, 22 bp, Homo sapiens
gaggacagagccgcctggcaag

SEQ ID NO: 7674852 - DNA, 22 bp, Homo sapiens
gaggacagagccgcctggcaag

SEQ ID NO: 7674853 - DNA, 22 bp, Homo sapiens
gaggacagagccgcctggcaag

SEQ ID NO: 7674854 - DNA, 22 bp, Homo sapiens
gaggacagagccgcctggcaag

SEQ ID NO: 7674855 - DNA, 22 bp, Homo sapiens
gaggacagagccgcctggcaag

SEQ ID NO: 7674856 - DNA, 22 bp, Homo sapiens
gaggacagagccgcctggcaag

SEQ ID NO: 7674857 - DNA, 22 bp, Homo sapiens
gaggacacatgactccagcagg

SEQ ID NO: 7674858 - DNA, 22 bp, Homo sapiens
gaggacacatgactccagcagg

SEQ ID NO: 7674859 - DNA, 22 bp, Homo sapiens
gaggacacctcacagcctcaca

SEQ ID NO: 7674860 - DNA, 22 bp, Homo sapiens
gaggacacctcacagcctcaca

SEQ ID NO: 7674861 - DNA, 22 bp, Homo sapiens
gaggacacctcacagcctcaca

SEQ ID NO: 7674862 - DNA, 22 bp, Homo sapiens
gaggacacctcacagcctcaca

SEQ ID NO: 7674863 - DNA, 22 bp, Homo sapiens
gaggacacggccttttggaaaa

SEQ ID NO: 7674864 - DNA, 22 bp, Homo sapiens
gaggacagagccgcctggcaag

SEQ ID NO: 7674865 - DNA, 22 bp, Homo sapiens
gaggacacctcacagcctcaca

SEQ ID NO: 7674866 - DNA, 22 bp, Homo sapiens
gaggacagctctaactaaagtc

SEQ ID NO: 7674867 - DNA, 22 bp, Homo sapiens
gaggacagagccgcctggcaag

SEQ ID NO: 7674868 - DNA, 22 bp, Homo sapiens
gaggacagctctaactaaagtc

SEQ ID NO: 7674869 - DNA, 22 bp, Homo sapiens
gaggacagcttagggcttcctg

SEQ ID NO: 7674870 - DNA, 22 bp, Homo sapiens
gaggacagcttagggcttcctg

SEQ ID NO: 7674871 - DNA, 22 bp, Homo sapiens
gaggacagctctaactaaagtc

SEQ ID NO: 7674872 - DNA, 22 bp, Homo sapiens
gaggacagcttagggcttcctg

SEQ ID NO: 7674873 - DNA, 22 bp, Homo sapiens
gaggacagcttagggcttcctg

SEQ ID NO: 7674874 - DNA, 22 bp, Homo sapiens
gaggacagcttagggcttcctg

SEQ ID NO: 7674875 - DNA, 22 bp, Homo sapiens
gaggaggctgaacaatgccctg

SEQ ID NO: 7674876 - DNA, 22 bp, Homo sapiens
gaggaggctgaacaatgccctg

SEQ ID NO: 7674877 - DNA, 22 bp, Homo sapiens
gaggacagcttagggcttcctg

SEQ ID NO: 7674878 - DNA, 22 bp, Homo sapiens
gaggacagcttagggcttcctg

SEQ ID NO: 7674879 - DNA, 22 bp, Homo sapiens
gaggacagcttagggcttcctg

SEQ ID NO: 7674880 - DNA, 22 bp, Homo sapiens
gaggacagcttagggcttcctg

SEQ ID NO: 7674881 - DNA, 22 bp, Homo sapiens
gaggacagcttagggcttcctg

SEQ ID NO: 7674882 - DNA, 22 bp, Homo sapiens
gaggaagagagctctgccttgt

SEQ ID NO: 7674883 - DNA, 22 bp, Homo sapiens
gaggaagagagctctgccttgt

SEQ ID NO: 7674884 - DNA, 22 bp, Homo sapiens
gaggaagagagctctgccttgt

SEQ ID NO: 7674885 - DNA, 22 bp, Homo sapiens
gaggaagagagctctgccttgt

SEQ ID NO: 7674886 - DNA, 22 bp, Homo sapiens
gaggaagagcatggccagtttc

SEQ ID NO: 7674887 - DNA, 22 bp, Homo sapiens
gaggaagatggttgagtggtcc

SEQ ID NO: 7674888 - DNA, 22 bp, Homo sapiens
gaggaagatggttgagtggtcc

SEQ ID NO: 7674889 - DNA, 22 bp, Homo sapiens
gaggaagatggttgagtggtcc

SEQ ID NO: 7674890 - DNA, 22 bp, Homo sapiens
gaggaagagcatggccagtttc

SEQ ID NO: 7674891 - DNA, 22 bp, Homo sapiens
gaggaagagcatggccagtttc

SEQ ID NO: 7674892 - DNA, 22 bp, Homo sapiens
gaggaagagcatggccagtttc

SEQ ID NO: 7674893 - DNA, 23 bp, Homo sapiens
gagctgggatacaggcttactgc

SEQ ID NO: 7674894 - DNA, 22 bp, Homo sapiens
gagctgggattcatctatgtct

SEQ ID NO: 7674895 - DNA, 22 bp, Homo sapiens
gagctgggattcatctatgtct

SEQ ID NO: 7674896 - DNA, 22 bp, Homo sapiens
gaggaagaattggttattggag

SEQ ID NO: 7674897 - DNA, 22 bp, Homo sapiens
gaggaagaattggttattggag

SEQ ID NO: 7674898 - DNA, 22 bp, Homo sapiens
gagctgggagttatagcatgtt

SEQ ID NO: 7674899 - DNA, 22 bp, Homo sapiens
gagctgggagttatagcatgtt

SEQ ID NO: 7674900 - DNA, 23 bp, Homo sapiens
gagctgggatacaggcttactgc

SEQ ID NO: 7674901 - DNA, 23 bp, Homo sapiens
gagctgggatacaggcttactgc

SEQ ID NO: 7674902 - DNA, 23 bp, Homo sapiens
gagctgggatacaggcttactgc

SEQ ID NO: 7674903 - DNA, 22 bp, Homo sapiens
gagctgggagttatagcatgtt

SEQ ID NO: 7674904 - DNA, 22 bp, Homo sapiens
gaggaagggctgcctgccgggc

SEQ ID NO: 7674905 - DNA, 22 bp, Homo sapiens
gaggaagggctgcctgccgggc

SEQ ID NO: 7674906 - DNA, 22 bp, Homo sapiens
gaggaagggctgcctgccgggc

SEQ ID NO: 7674907 - DNA, 22 bp, Homo sapiens
gaggaagggctgcctgccgggc

SEQ ID NO: 7674908 - DNA, 22 bp, Homo sapiens
gaggaagggctgcctgccgggc

SEQ ID NO: 7674909 - DNA, 22 bp, Homo sapiens
gaggaagatggttgagtggtcc

SEQ ID NO: 7674910 - DNA, 22 bp, Homo sapiens
gaggaagatggttgagtggtcc

SEQ ID NO: 7674911 - DNA, 22 bp, Homo sapiens
gaggaagatggttgagtggtcc

SEQ ID NO: 7674912 - DNA, 22 bp, Homo sapiens
gaggaagatggttgagtggtcc

SEQ ID NO: 7674913 - DNA, 22 bp, Homo sapiens
gaggaagggactttattatctg

SEQ ID NO: 7674914 - DNA, 22 bp, Homo sapiens
gaggaagggactttattatctg

SEQ ID NO: 7674915 - DNA, 22 bp, Homo sapiens
gaggaaggtcccatcagaattt

SEQ ID NO: 7674916 - DNA, 22 bp, Homo sapiens
gaggaaggtcccatcagaattt

SEQ ID NO: 7674917 - DNA, 22 bp, Homo sapiens
gaggaaggtcccatcagaattt

SEQ ID NO: 7674918 - DNA, 22 bp, Homo sapiens
gaggaagggctgcctgccgggc

SEQ ID NO: 7674919 - DNA, 22 bp, Homo sapiens
gaggaagggctgcctgccgggc

SEQ ID NO: 7674920 - DNA, 22 bp, Homo sapiens
gaggaagggctgcctgccgggc

SEQ ID NO: 7674921 - DNA, 22 bp, Homo sapiens
gaggaagggctgcctgccgggc

SEQ ID NO: 7674922 - DNA, 22 bp, Homo sapiens
gaggaagggctgcctgccgggc

SEQ ID NO: 7674923 - DNA, 18 bp, Homo sapiens
gagctgggagaaggaagg

SEQ ID NO: 7674924 - DNA, 18 bp, Homo sapiens
gagctgggagaaggaagg

SEQ ID NO: 7674925 - DNA, 18 bp, Homo sapiens
gagctgggagaaggaagg

SEQ ID NO: 7674926 - DNA, 18 bp, Homo sapiens
gagctgggagaaggaagg

SEQ ID NO: 7674927 - DNA, 18 bp, Homo sapiens
gagctgggagaaggaagg

SEQ ID NO: 7674928 - DNA, 22 bp, Homo sapiens
gagctgggacttggaatccaca

SEQ ID NO: 7674929 - DNA, 22 bp, Homo sapiens
gagctgggacttggaatccaca

SEQ ID NO: 7674930 - DNA, 22 bp, Homo sapiens
gagctgggacttggaatccaca

SEQ ID NO: 7674931 - DNA, 22 bp, Homo sapiens
gagctgggacttggaatccaca

SEQ ID NO: 7674932 - DNA, 22 bp, Homo sapiens
gagctgggagctgggatttgga

SEQ ID NO: 7674933 - DNA, 22 bp, Homo sapiens
gagctgggagctgggatttgga

SEQ ID NO: 7674934 - DNA, 18 bp, Homo sapiens
gagctgggagaaggaagg

SEQ ID NO: 7674935 - DNA, 22 bp, Homo sapiens
gagctgggagctgggatttgga

SEQ ID NO: 7674936 - DNA, 22 bp, Homo sapiens
gagctgggagctgggatttgga

SEQ ID NO: 7674937 - DNA, 18 bp, Homo sapiens
gagctgggagaaggaagg

SEQ ID NO: 7674938 - DNA, 18 bp, Homo sapiens
gagctgggagaaggaagg

SEQ ID NO: 7674939 - DNA, 22 bp, Homo sapiens
gagctgggagttatagcatgtt

SEQ ID NO: 7674940 - DNA, 22 bp, Homo sapiens
gagctgggagttatagcatgtt

SEQ ID NO: 7674941 - DNA, 22 bp, Homo sapiens
gagctgggagttatagcatgtt

SEQ ID NO: 7674942 - DNA, 22 bp, Homo sapiens
gagctgggagttatagcatgtt

SEQ ID NO: 7674943 - DNA, 22 bp, Homo sapiens
gagctgggaggactgggaactt

SEQ ID NO: 7674944 - DNA, 22 bp, Homo sapiens
gagctgggaggactgggaactt

SEQ ID NO: 7674945 - DNA, 22 bp, Homo sapiens
gagctgggagttatagcatgtt

SEQ ID NO: 7674946 - DNA, 22 bp, Homo sapiens
gagctgggagttatagcatgtt

SEQ ID NO: 7674947 - DNA, 22 bp, Homo sapiens
gagctgggaggactgggaactt

SEQ ID NO: 7674948 - DNA, 22 bp, Homo sapiens
gagctgggaggactgggaactt

SEQ ID NO: 7674949 - DNA, 22 bp, Homo sapiens
gagctgggaggactgggaactt

SEQ ID NO: 7674950 - DNA, 22 bp, Homo sapiens
gagctgggaggactgggaactt

SEQ ID NO: 7674951 - DNA, 22 bp, Homo sapiens
gagctgggagctgggatttgga

SEQ ID NO: 7674952 - DNA, 22 bp, Homo sapiens
gagctgggagctgggatttgga

SEQ ID NO: 7674953 - DNA, 22 bp, Homo sapiens
gagctgggagctgggatttgga

SEQ ID NO: 7674954 - DNA, 22 bp, Homo sapiens
gagctgggagctgggatttgga

SEQ ID NO: 7674955 - DNA, 22 bp, Homo sapiens
gagctgggaggactgggaactt

SEQ ID NO: 7674956 - DNA, 22 bp, Homo sapiens
gagctgggaggactgggaactt

SEQ ID NO: 7674957 - DNA, 22 bp, Homo sapiens
gagctggaggaccaggactggg

SEQ ID NO: 7674958 - DNA, 22 bp, Homo sapiens
gagctggaggcagtgctgaggt

SEQ ID NO: 7674959 - DNA, 22 bp, Homo sapiens
gagctggaggcagtgctgaggt

SEQ ID NO: 7674960 - DNA, 22 bp, Homo sapiens
gagctggaggcagtgctgaggt

SEQ ID NO: 7674961 - DNA, 22 bp, Homo sapiens
gagctggactttcagatacatc

SEQ ID NO: 7674962 - DNA, 22 bp, Homo sapiens
gagctggactttcagatacatc

SEQ ID NO: 7674963 - DNA, 22 bp, Homo sapiens
gagctggactttcagatacatc

SEQ ID NO: 7674964 - DNA, 22 bp, Homo sapiens
gagctggaggaccaggactggg

SEQ ID NO: 7674965 - DNA, 22 bp, Homo sapiens
gagctggaggaccaggactggg

SEQ ID NO: 7674966 - DNA, 22 bp, Homo sapiens
gagctggaggaccaggactggg

SEQ ID NO: 7674967 - DNA, 22 bp, Homo sapiens
gagatccagatttccattcctt

SEQ ID NO: 7674968 - DNA, 20 bp, Homo sapiens
gagatcctcatctgtaaagt

SEQ ID NO: 7674969 - DNA, 22 bp, Homo sapiens
gagctgcttgcccagaagcaga

SEQ ID NO: 7674970 - DNA, 22 bp, Homo sapiens
gagatcctgtaggcagctaaga

SEQ ID NO: 7674971 - DNA, 22 bp, Homo sapiens
gagctggactttcagatacatc

SEQ ID NO: 7674972 - DNA, 22 bp, Homo sapiens
gagctggaagtctgtggtcaga

SEQ ID NO: 7674973 - DNA, 22 bp, Homo sapiens
gagctggaagtctgtggtcaga

SEQ ID NO: 7674974 - DNA, 22 bp, Homo sapiens
gagctgcttgcccagaagcaga

SEQ ID NO: 7674975 - DNA, 22 bp, Homo sapiens
gagctgcttgcccagaagcaga

SEQ ID NO: 7674976 - DNA, 22 bp, Homo sapiens
gagctggccgcagagagggcag

SEQ ID NO: 7674977 - DNA, 22 bp, Homo sapiens
gagctggccgcagagagggcag

SEQ ID NO: 7674978 - DNA, 22 bp, Homo sapiens
gagctggcagtggtagacatgg

SEQ ID NO: 7674979 - DNA, 22 bp, Homo sapiens
gagctggccgcagagagggcag

SEQ ID NO: 7674980 - DNA, 22 bp, Homo sapiens
gagctggccgcagagagggcag

SEQ ID NO: 7674981 - DNA, 22 bp, Homo sapiens
gagctggcaggaggctccccga

SEQ ID NO: 7674982 - DNA, 22 bp, Homo sapiens
gagctggcaggaggctccccga

SEQ ID NO: 7674983 - DNA, 22 bp, Homo sapiens
gagctggcaatgacttgtgtat

SEQ ID NO: 7674984 - DNA, 22 bp, Homo sapiens
gagctggcaatgacttgtgtat

SEQ ID NO: 7674985 - DNA, 22 bp, Homo sapiens
gagctggcacagaaggatctta

SEQ ID NO: 7674986 - DNA, 22 bp, Homo sapiens
gagctggcacagaaggatctta

SEQ ID NO: 7674987 - DNA, 22 bp, Homo sapiens
gagctggcacagaaggatctta

SEQ ID NO: 7674988 - DNA, 22 bp, Homo sapiens
gagctggcaggaggctccccga

SEQ ID NO: 7674989 - DNA, 22 bp, Homo sapiens
gagctggcacagaaggatctta

SEQ ID NO: 7674990 - DNA, 22 bp, Homo sapiens
gagctgggacttggaatccaca

SEQ ID NO: 7674991 - DNA, 22 bp, Homo sapiens
gagctgggacatgggtcctctc

SEQ ID NO: 7674992 - DNA, 22 bp, Homo sapiens
gagctgggacatgggtcctctc

SEQ ID NO: 7674993 - DNA, 22 bp, Homo sapiens
gagctgggacatgggtcctctc

SEQ ID NO: 7674994 - DNA, 22 bp, Homo sapiens
gagctgggacatgggtcctctc

SEQ ID NO: 7674995 - DNA, 22 bp, Homo sapiens
gagctgggacatgggtcctctc

SEQ ID NO: 7674996 - DNA, 22 bp, Homo sapiens
gagctgggacatgggtcctctc

SEQ ID NO: 7674997 - DNA, 22 bp, Homo sapiens
gagctgggacatgggtcctctc

SEQ ID NO: 7674998 - DNA, 22 bp, Homo sapiens
gagctgggaagatagcttgagc

SEQ ID NO: 7674999 - DNA, 22 bp, Homo sapiens
gagctgggaagatagcttgagc

SEQ ID NO: 7675000 - DNA, 22 bp, Homo sapiens
gagctgggaagatagcttgagc

SEQ ID NO: 7675001 - DNA, 22 bp, Homo sapiens
gagctggctgtggttgagtgca

SEQ ID NO: 7675002 - DNA, 22 bp, Homo sapiens
gagctggctgtggttgagtgca

SEQ ID NO: 7675003 - DNA, 22 bp, Homo sapiens
gagctggctgtggttgagtgca

SEQ ID NO: 7675004 - DNA, 22 bp, Homo sapiens
gagctgggaagatagcttgagc

SEQ ID NO: 7675005 - DNA, 22 bp, Homo sapiens
gagctgggacatgggtcctctc

SEQ ID NO: 7675006 - DNA, 22 bp, Homo sapiens
gagctgggaagatagcttgagc

SEQ ID NO: 7675007 - DNA, 22 bp, Homo sapiens
gagctggcctcaggcacaggag

SEQ ID NO: 7675008 - DNA, 22 bp, Homo sapiens
gagctggcctcaggcacaggag

SEQ ID NO: 7675009 - DNA, 22 bp, Homo sapiens
gagctggcctcaggcacaggag

SEQ ID NO: 7675010 - DNA, 22 bp, Homo sapiens
gagctggcctcaggcacaggag

SEQ ID NO: 7675011 - DNA, 22 bp, Homo sapiens
gagctggccgcagagagggcag

SEQ ID NO: 7675012 - DNA, 22 bp, Homo sapiens
gagctggcctcaggcacaggag

SEQ ID NO: 7675013 - DNA, 22 bp, Homo sapiens
gagctggcctcaggcacaggag

SEQ ID NO: 7675014 - DNA, 22 bp, Homo sapiens
gagctggctaatactgacttat

SEQ ID NO: 7675015 - DNA, 22 bp, Homo sapiens
gagctggctaatactgacttat

SEQ ID NO: 7675016 - DNA, 22 bp, Homo sapiens
gagctggctcctccgaggatgg

SEQ ID NO: 7675017 - DNA, 22 bp, Homo sapiens
gagctggctccgccatgctgct

SEQ ID NO: 7675018 - DNA, 22 bp, Homo sapiens
gagctggctccgccatgctgct

SEQ ID NO: 7675019 - DNA, 22 bp, Homo sapiens
gagctggctccgccatgctgct

SEQ ID NO: 7675020 - DNA, 22 bp, Homo sapiens
gagctggctccgccatgctgct

SEQ ID NO: 7675021 - DNA, 22 bp, Homo sapiens
gagctggctccgccatgctgct

SEQ ID NO: 7675022 - DNA, 22 bp, Homo sapiens
gagctggctaatactgacttat

SEQ ID NO: 7675023 - DNA, 22 bp, Homo sapiens
gagatatgttggcagctggtat

SEQ ID NO: 7675024 - DNA, 22 bp, Homo sapiens
gagatatgttggcagctggtat

SEQ ID NO: 7675025 - DNA, 22 bp, Homo sapiens
gagatatgttggcagctggtat

SEQ ID NO: 7675026 - DNA, 22 bp, Homo sapiens
gagatccacttaatttttttgc

SEQ ID NO: 7675027 - DNA, 22 bp, Homo sapiens
gagatccacacatttagggtgc

SEQ ID NO: 7675028 - DNA, 22 bp, Homo sapiens
gagatccagatttccattcctt

SEQ ID NO: 7675029 - DNA, 22 bp, Homo sapiens
gagatatttattcatactgtca

SEQ ID NO: 7675030 - DNA, 22 bp, Homo sapiens
gagatatttattcatactgtca

SEQ ID NO: 7675031 - DNA, 19 bp, Homo sapiens
gagatactgaagtgaggaa

SEQ ID NO: 7675032 - DNA, 19 bp, Homo sapiens
gagatactgaagtgaggaa

SEQ ID NO: 7675033 - DNA, 22 bp, Homo sapiens
gagatacagttggctgcaggct

SEQ ID NO: 7675034 - DNA, 22 bp, Homo sapiens
gagatatattaacattaatctt

SEQ ID NO: 7675035 - DNA, 22 bp, Homo sapiens
gagatatgttagaaagctattg

SEQ ID NO: 7675036 - DNA, 19 bp, Homo sapiens
gagatatagaagtagatgt

SEQ ID NO: 7675037 - DNA, 19 bp, Homo sapiens
gagatatagaagtagatgt

SEQ ID NO: 7675038 - DNA, 22 bp, Homo sapiens
gagagtgtctggaggaagctaa

SEQ ID NO: 7675039 - DNA, 22 bp, Homo sapiens
gagagttccagtaagtggattc

SEQ ID NO: 7675040 - DNA, 22 bp, Homo sapiens
gagagttctacctctgaaggcg

SEQ ID NO: 7675041 - DNA, 22 bp, Homo sapiens
gagataaagctaccatgttgat

SEQ ID NO: 7675042 - DNA, 22 bp, Homo sapiens
gagataaagctaccatgttgat

SEQ ID NO: 7675043 - DNA, 22 bp, Homo sapiens
gagataaagctaccatgttgat

SEQ ID NO: 7675044 - DNA, 22 bp, Homo sapiens
gagagttcttgcctgggtatta

SEQ ID NO: 7675045 - DNA, 22 bp, Homo sapiens
gagagttctacctctgaaggcg

SEQ ID NO: 7675046 - DNA, 22 bp, Homo sapiens
gagataaatttttgataaatat

SEQ ID NO: 7675047 - DNA, 22 bp, Homo sapiens
gagataaatttttgataaatat

SEQ ID NO: 7675048 - DNA, 22 bp, Homo sapiens
gagataaatttttgataaatat

SEQ ID NO: 7675049 - DNA, 22 bp, Homo sapiens
gagataaatttttgataaatat

SEQ ID NO: 7675050 - DNA, 22 bp, Homo sapiens
gagataaagctaccatgttgat

SEQ ID NO: 7675051 - DNA, 22 bp, Homo sapiens
gagataaagctaccatgttgat

SEQ ID NO: 7675052 - DNA, 22 bp, Homo sapiens
gagatacagttggctgcaggct

SEQ ID NO: 7675053 - DNA, 22 bp, Homo sapiens
gagatacacaggcagaaaaaga

SEQ ID NO: 7675054 - DNA, 22 bp, Homo sapiens
gagatacacaggcagaaaaaga

SEQ ID NO: 7675055 - DNA, 22 bp, Homo sapiens
gagataataatcgcttgatgga

SEQ ID NO: 7675056 - DNA, 22 bp, Homo sapiens
gagataataatcgcttgatgga

SEQ ID NO: 7675057 - DNA, 22 bp, Homo sapiens
gagataactctaggtcttcgag

SEQ ID NO: 7675058 - DNA, 22 bp, Homo sapiens
gagagtggaaagcaagctgagt

SEQ ID NO: 7675059 - DNA, 20 bp, Homo sapiens
gagagtgcttttcattgctc

SEQ ID NO: 7675060 - DNA, 22 bp, Homo sapiens
gagagtgattccctcccataga

SEQ ID NO: 7675061 - DNA, 22 bp, Homo sapiens
gagagtgctgaacggcaagggt

SEQ ID NO: 7675062 - DNA, 22 bp, Homo sapiens
gagagtgctgaacggcaagggt

SEQ ID NO: 7675063 - DNA, 22 bp, Homo sapiens
gagagtgaggcctgggaatcta

SEQ ID NO: 7675064 - DNA, 22 bp, Homo sapiens
gagagtggatggagctgcgaag

SEQ ID NO: 7675065 - DNA, 22 bp, Homo sapiens
gagagtggatggagctgcgaag

SEQ ID NO: 7675066 - DNA, 22 bp, Homo sapiens
gagagtggatggagctgcgaag

SEQ ID NO: 7675067 - DNA, 22 bp, Homo sapiens
gagagtggatggagctgcgaag

SEQ ID NO: 7675068 - DNA, 22 bp, Homo sapiens
gagagtggatggagctgcgaag

SEQ ID NO: 7675069 - DNA, 22 bp, Homo sapiens
gagagtggatggagctgcgaag

SEQ ID NO: 7675070 - DNA, 22 bp, Homo sapiens
gagagtggaaagcaagctgagt

SEQ ID NO: 7675071 - DNA, 22 bp, Homo sapiens
gagagtggatggagctgcgaag

SEQ ID NO: 7675072 - DNA, 22 bp, Homo sapiens
gagagtctagtgcacctagttt

SEQ ID NO: 7675073 - DNA, 22 bp, Homo sapiens
gagagtctagtgcacctagttt

SEQ ID NO: 7675074 - DNA, 22 bp, Homo sapiens
gagagtctagtgcacctagttt

SEQ ID NO: 7675075 - DNA, 22 bp, Homo sapiens
gagagtctagtgcacctagttt

SEQ ID NO: 7675076 - DNA, 22 bp, Homo sapiens
gagagtgaaggcttcccagcaa

SEQ ID NO: 7675077 - DNA, 22 bp, Homo sapiens
gagagtctagtgcacctagttt

SEQ ID NO: 7675078 - DNA, 22 bp, Homo sapiens
gagagtctagtgcacctagttt

SEQ ID NO: 7675079 - DNA, 22 bp, Homo sapiens
gagagtctagtgcacctagttt

SEQ ID NO: 7675080 - DNA, 22 bp, Homo sapiens
gagagtgagataatttcacata

SEQ ID NO: 7675081 - DNA, 22 bp, Homo sapiens
gagagtctggtagagcagcaag

SEQ ID NO: 7675082 - DNA, 22 bp, Homo sapiens
gagagtgagatcctcctgggga

SEQ ID NO: 7675083 - DNA, 22 bp, Homo sapiens
gagagtgaggcatcaggggcag

SEQ ID NO: 7675084 - DNA, 22 bp, Homo sapiens
gagagtgagatcctcctgggga

SEQ ID NO: 7675085 - DNA, 22 bp, Homo sapiens
gagagtgagatcctcctgggga

SEQ ID NO: 7675086 - DNA, 22 bp, Homo sapiens
gagagtgaggcatcaggggcag

SEQ ID NO: 7675087 - DNA, 22 bp, Homo sapiens
gagagtgaggcatcaggggcag

SEQ ID NO: 7675088 - DNA, 22 bp, Homo sapiens
gagagtgaggcctgggaatcta

SEQ ID NO: 7675089 - DNA, 22 bp, Homo sapiens
gagagtgaggcctgggaatcta

SEQ ID NO: 7675090 - DNA, 22 bp, Homo sapiens
cttcttttacaggtcttgggtt

SEQ ID NO: 7675091 - DNA, 22 bp, Homo sapiens
cttcttttacaggtcttgggtt

SEQ ID NO: 7675092 - DNA, 22 bp, Homo sapiens
cttcttttacaggtcttgggtt

SEQ ID NO: 7675093 - DNA, 22 bp, Homo sapiens
cttcttttcatggcttgggaag

SEQ ID NO: 7675094 - DNA, 22 bp, Homo sapiens
cttcttttcatggcttgggaag

SEQ ID NO: 7675095 - DNA, 22 bp, Homo sapiens
cttcttttcatggcttgggaag

SEQ ID NO: 7675096 - DNA, 22 bp, Homo sapiens
cttctttgaaaaaggcagtcag

SEQ ID NO: 7675097 - DNA, 22 bp, Homo sapiens
cttctttgtgcctattggtgac

SEQ ID NO: 7675098 - DNA, 22 bp, Homo sapiens
cttctttgtgcctattggtgac

SEQ ID NO: 7675099 - DNA, 22 bp, Homo sapiens
cttctttgttctgttgtctcac

SEQ ID NO: 7675100 - DNA, 22 bp, Homo sapiens
cttctttcttttgatcacaggt

SEQ ID NO: 7675101 - DNA, 22 bp, Homo sapiens
cttctttgaaaaaggcagtcag

SEQ ID NO: 7675102 - DNA, 22 bp, Homo sapiens
cttctttgaaaaaggcagtcag

SEQ ID NO: 7675103 - DNA, 22 bp, Homo sapiens
cttctttgaaaaaggcagtcag

SEQ ID NO: 7675104 - DNA, 22 bp, Homo sapiens
cttctttccttcctccagtggc

SEQ ID NO: 7675105 - DNA, 22 bp, Homo sapiens
cttctttcttttgatcacaggt

SEQ ID NO: 7675106 - DNA, 22 bp, Homo sapiens
cttctttcttttgatcacaggt

SEQ ID NO: 7675107 - DNA, 22 bp, Homo sapiens
cttctttcccaggcatgtttta

SEQ ID NO: 7675108 - DNA, 22 bp, Homo sapiens
cttctttcccaggcatgtttta

SEQ ID NO: 7675109 - DNA, 22 bp, Homo sapiens
cttctttcaagaatggattagg

SEQ ID NO: 7675110 - DNA, 22 bp, Homo sapiens
cttctttcaagaatggattagg

SEQ ID NO: 7675111 - DNA, 22 bp, Homo sapiens
cttctttcaagaatggattagg

SEQ ID NO: 7675112 - DNA, 22 bp, Homo sapiens
cttctttagggatctcttgctg

SEQ ID NO: 7675113 - DNA, 22 bp, Homo sapiens
cttcttgattgctttcaaacca

SEQ ID NO: 7675114 - DNA, 22 bp, Homo sapiens
cttctttagggatctcttgctg

SEQ ID NO: 7675115 - DNA, 22 bp, Homo sapiens
cttctttagggatctcttgctg

SEQ ID NO: 7675116 - DNA, 22 bp, Homo sapiens
cttctttcccaggcatgtttta

SEQ ID NO: 7675117 - DNA, 22 bp, Homo sapiens
cttctttccttcctccagtggc

SEQ ID NO: 7675118 - DNA, 22 bp, Homo sapiens
cttctttcccaggcatgtttta

SEQ ID NO: 7675119 - DNA, 22 bp, Homo sapiens
cttctttcccaggcatgtttta

SEQ ID NO: 7675120 - DNA, 22 bp, Homo sapiens
cttctttcccaggcatgtttta

SEQ ID NO: 7675121 - DNA, 22 bp, Homo sapiens
cttctttcccaggcatgtttta

SEQ ID NO: 7675122 - DNA, 22 bp, Homo sapiens
cttcttttcatggcttgggaag

SEQ ID NO: 7675123 - DNA, 22 bp, Homo sapiens
cttcttttgaagggcgttgtgt

SEQ ID NO: 7675124 - DNA, 22 bp, Homo sapiens
cttcttttgaagggcgttgtgt

SEQ ID NO: 7675125 - DNA, 22 bp, Homo sapiens
cttgaaaaatatgccttgcttc

SEQ ID NO: 7675126 - DNA, 22 bp, Homo sapiens
cttgaaaataagaaagactttc

SEQ ID NO: 7675127 - DNA, 22 bp, Homo sapiens
cttgaaaataagaaagactttc

SEQ ID NO: 7675128 - DNA, 22 bp, Homo sapiens
cttgaaaaatatgccttgcttc

SEQ ID NO: 7675129 - DNA, 22 bp, Homo sapiens
cttcttttgaagggcgttgtgt

SEQ ID NO: 7675130 - DNA, 22 bp, Homo sapiens
cttgaaagaagggtcttttaat

SEQ ID NO: 7675131 - DNA, 22 bp, Homo sapiens
cttgaaagcacttagtaaatta

SEQ ID NO: 7675132 - DNA, 22 bp, Homo sapiens
cttgaaagcacttagtaaatta

SEQ ID NO: 7675133 - DNA, 22 bp, Homo sapiens
cttgaaagaagggtcttttaat

SEQ ID NO: 7675134 - DNA, 22 bp, Homo sapiens
cttgaaagaagggtcttttaat

SEQ ID NO: 7675135 - DNA, 22 bp, Homo sapiens
cttgaaaataagaaagactttc

SEQ ID NO: 7675136 - DNA, 22 bp, Homo sapiens
cttgaaaataagaaagactttc

SEQ ID NO: 7675137 - DNA, 22 bp, Homo sapiens
cttgaaaataagaaagactttc

SEQ ID NO: 7675138 - DNA, 22 bp, Homo sapiens
cttgaaaataagaaagactttc

SEQ ID NO: 7675139 - DNA, 18 bp, Homo sapiens
cttgaagaattttgcagt

SEQ ID NO: 7675140 - DNA, 18 bp, Homo sapiens
cttgaagaattttgcagt

SEQ ID NO: 7675141 - DNA, 22 bp, Homo sapiens
cttgaagacaatggcagattcc

SEQ ID NO: 7675142 - DNA, 22 bp, Homo sapiens
cttgaagaaagtatgttgggat

SEQ ID NO: 7675143 - DNA, 20 bp, Homo sapiens
cttgaactgattctatttcc

SEQ ID NO: 7675144 - DNA, 22 bp, Homo sapiens
cttgaagaaatggagacaggat

SEQ ID NO: 7675145 - DNA, 22 bp, Homo sapiens
cttgaagaaatggagacaggat

SEQ ID NO: 7675146 - DNA, 22 bp, Homo sapiens
cttgaactcaatgtgaggaaga

SEQ ID NO: 7675147 - DNA, 22 bp, Homo sapiens
cttgaaccaatcactgtagcca

SEQ ID NO: 7675148 - DNA, 22 bp, Homo sapiens
cttgaaatgacaggagcacatc

SEQ ID NO: 7675149 - DNA, 19 bp, Homo sapiens
cttgaaatgagactgaagg

SEQ ID NO: 7675150 - DNA, 22 bp, Homo sapiens
cttgaaatccagatttcagagg

SEQ ID NO: 7675151 - DNA, 22 bp, Homo sapiens
cttgaaatccagatttcagagg

SEQ ID NO: 7675152 - DNA, 22 bp, Homo sapiens
cttgaaatgacaggagcacatc

SEQ ID NO: 7675153 - DNA, 22 bp, Homo sapiens
cttgaaatccagatttcagagg

SEQ ID NO: 7675154 - DNA, 22 bp, Homo sapiens
cttgaaatccagatttcagagg

SEQ ID NO: 7675155 - DNA, 22 bp, Homo sapiens
cttctctctgcataggcatggg

SEQ ID NO: 7675156 - DNA, 22 bp, Homo sapiens
cttctctctgcataggcatggg

SEQ ID NO: 7675157 - DNA, 22 bp, Homo sapiens
cttctctctgcataggcatggg

SEQ ID NO: 7675158 - DNA, 22 bp, Homo sapiens
cttctctctgcataggcatggg

SEQ ID NO: 7675159 - DNA, 22 bp, Homo sapiens
cttctctctgcataggcatggg

SEQ ID NO: 7675160 - DNA, 22 bp, Homo sapiens
cttctctctgcataggcatggg

SEQ ID NO: 7675161 - DNA, 22 bp, Homo sapiens
cttctctctgcataggcatggg

SEQ ID NO: 7675162 - DNA, 22 bp, Homo sapiens
cttctctctgcataggcatggg

SEQ ID NO: 7675163 - DNA, 22 bp, Homo sapiens
cttctctctgcataggcatggg

SEQ ID NO: 7675164 - DNA, 22 bp, Homo sapiens
cttctctgacagtctgtttcac

SEQ ID NO: 7675165 - DNA, 22 bp, Homo sapiens
cttctctgacagtctgtttcac

SEQ ID NO: 7675166 - DNA, 22 bp, Homo sapiens
cttctctgcaccccacttttgc

SEQ ID NO: 7675167 - DNA, 22 bp, Homo sapiens
cttctctgcaccccacttttgc

SEQ ID NO: 7675168 - DNA, 17 bp, Homo sapiens
cttctctggcagaagat

SEQ ID NO: 7675169 - DNA, 22 bp, Homo sapiens
cttctctgcccataggaaatgc

SEQ ID NO: 7675170 - DNA, 22 bp, Homo sapiens
cttctctggctcctcagcgccc

SEQ ID NO: 7675171 - DNA, 22 bp, Homo sapiens
cttctctggctcctcagcgccc

SEQ ID NO: 7675172 - DNA, 22 bp, Homo sapiens
cttctctggctcctcagcgccc

SEQ ID NO: 7675173 - DNA, 22 bp, Homo sapiens
cttctctggctcctcagcgccc

SEQ ID NO: 7675174 - DNA, 22 bp, Homo sapiens
cttctctggcagatgtgtgtcc

SEQ ID NO: 7675175 - DNA, 22 bp, Homo sapiens
cttctcttcctttgtcaactga

SEQ ID NO: 7675176 - DNA, 22 bp, Homo sapiens
cttctcttcctttgtcaactga

SEQ ID NO: 7675177 - DNA, 22 bp, Homo sapiens
cttctcttgggtgtggtgtctt

SEQ ID NO: 7675178 - DNA, 22 bp, Homo sapiens
cttctcttgggtgtggtgtctt

SEQ ID NO: 7675179 - DNA, 22 bp, Homo sapiens
cttctcttcctttgtcaactga

SEQ ID NO: 7675180 - DNA, 22 bp, Homo sapiens
cttctcttcctttgtcaactga

SEQ ID NO: 7675181 - DNA, 22 bp, Homo sapiens
cttctcttcctttgtcaactga

SEQ ID NO: 7675182 - DNA, 22 bp, Homo sapiens
cttctcttcctttgtcaactga

SEQ ID NO: 7675183 - DNA, 22 bp, Homo sapiens
cttctcttcctttgtcaactga

SEQ ID NO: 7675184 - DNA, 22 bp, Homo sapiens
cttctcttcctttgtcaactga

SEQ ID NO: 7675185 - DNA, 22 bp, Homo sapiens
cttctctggctcctcagcgccc

SEQ ID NO: 7675186 - DNA, 22 bp, Homo sapiens
cttctctgtcacagggttacgt

SEQ ID NO: 7675187 - DNA, 22 bp, Homo sapiens
cttctcttcccagggacacagg

SEQ ID NO: 7675188 - DNA, 22 bp, Homo sapiens
cttctcttcccagggacacagg

SEQ ID NO: 7675189 - DNA, 22 bp, Homo sapiens
cttctcttcccagggacacagg

SEQ ID NO: 7675190 - DNA, 22 bp, Homo sapiens
cttctctgtgtagagattcaga

SEQ ID NO: 7675191 - DNA, 22 bp, Homo sapiens
cttctcttgggtgtggtgtctt

SEQ ID NO: 7675192 - DNA, 22 bp, Homo sapiens
cttctcttggtagttcttgttg

SEQ ID NO: 7675193 - DNA, 22 bp, Homo sapiens
cttctcttggtagttcttgttg

SEQ ID NO: 7675194 - DNA, 22 bp, Homo sapiens
cttcttcttttaataaatgtct

SEQ ID NO: 7675195 - DNA, 22 bp, Homo sapiens
cttcttcttttaataaatgtct

SEQ ID NO: 7675196 - DNA, 22 bp, Homo sapiens
cttctcttggtagttcttgttg

SEQ ID NO: 7675197 - DNA, 22 bp, Homo sapiens
cttcttcttttaataaatgtct

SEQ ID NO: 7675198 - DNA, 22 bp, Homo sapiens
cttcttcttttaataaatgtct

SEQ ID NO: 7675199 - DNA, 22 bp, Homo sapiens
cttcttcttttgtgggtggtaa

SEQ ID NO: 7675200 - DNA, 22 bp, Homo sapiens
cttcttgaagtcctccagaagt

SEQ ID NO: 7675201 - DNA, 22 bp, Homo sapiens
cttcttgacttctgggtgccct

SEQ ID NO: 7675202 - DNA, 22 bp, Homo sapiens
cttcttcttttgtgggtggtaa

SEQ ID NO: 7675203 - DNA, 22 bp, Homo sapiens
cttcttgaaacctgctccctca

SEQ ID NO: 7675204 - DNA, 22 bp, Homo sapiens
cttcttgaaacctgctccctca

SEQ ID NO: 7675205 - DNA, 22 bp, Homo sapiens
cttcttgaaagtggtgaccctc

SEQ ID NO: 7675206 - DNA, 22 bp, Homo sapiens
cttctttactttctagaaataa

SEQ ID NO: 7675207 - DNA, 19 bp, Homo sapiens
cttcttgataaggttcttt

SEQ ID NO: 7675208 - DNA, 22 bp, Homo sapiens
cttcttgattgctttcaaacca

SEQ ID NO: 7675209 - DNA, 22 bp, Homo sapiens
cttcttgattgctttcaaacca

SEQ ID NO: 7675210 - DNA, 22 bp, Homo sapiens
cttcttgagcatgggtagtact

SEQ ID NO: 7675211 - DNA, 19 bp, Homo sapiens
cttcttgataaggttcttt

SEQ ID NO: 7675212 - DNA, 19 bp, Homo sapiens
cttcttgataaggttcttt

SEQ ID NO: 7675213 - DNA, 22 bp, Homo sapiens
cttctctccctggcactcagac

SEQ ID NO: 7675214 - DNA, 22 bp, Homo sapiens
cttctctccctggcactcagac

SEQ ID NO: 7675215 - DNA, 22 bp, Homo sapiens
cttctctccctggcactcagac

SEQ ID NO: 7675216 - DNA, 22 bp, Homo sapiens
cttctctccctggcactcagac

SEQ ID NO: 7675217 - DNA, 22 bp, Homo sapiens
cttctctccctggcactcagac

SEQ ID NO: 7675218 - DNA, 22 bp, Homo sapiens
cttctctccctggcactcagac

SEQ ID NO: 7675219 - DNA, 22 bp, Homo sapiens
cttctctccctggcactcagac

SEQ ID NO: 7675220 - DNA, 22 bp, Homo sapiens
cttctctccctggcactcagac

SEQ ID NO: 7675221 - DNA, 22 bp, Homo sapiens
cttctctccctggcactcagac

SEQ ID NO: 7675222 - DNA, 22 bp, Homo sapiens
cttctctctgcataggcatggg

SEQ ID NO: 7675223 - DNA, 22 bp, Homo sapiens
cttctctcggtgcatccctcac

SEQ ID NO: 7675224 - DNA, 22 bp, Homo sapiens
cttctctcggtgcatccctcac

SEQ ID NO: 7675225 - DNA, 22 bp, Homo sapiens
cttctctcggtgcatccctcac

SEQ ID NO: 7675226 - DNA, 22 bp, Homo sapiens
cttctctcggtgcatccctcac

SEQ ID NO: 7675227 - DNA, 22 bp, Homo sapiens
cttctctcggtgcatccctcac

SEQ ID NO: 7675228 - DNA, 22 bp, Homo sapiens
cttctctcggtgcatccctcac

SEQ ID NO: 7675229 - DNA, 22 bp, Homo sapiens
cttctctcggtgcatccctcac

SEQ ID NO: 7675230 - DNA, 22 bp, Homo sapiens
cttctcagttgcaagtgtcaga

SEQ ID NO: 7675231 - DNA, 22 bp, Homo sapiens
cttctcagttgcaagtgtcaga

SEQ ID NO: 7675232 - DNA, 22 bp, Homo sapiens
cttctcagttgcaagtgtcaga

SEQ ID NO: 7675233 - DNA, 22 bp, Homo sapiens
ctggctgtcttctgggagctgt

SEQ ID NO: 7675234 - DNA, 22 bp, Homo sapiens
cttctcagtcttggttagagag

SEQ ID NO: 7675235 - DNA, 22 bp, Homo sapiens
cttctcagtcttggttagagag

SEQ ID NO: 7675236 - DNA, 22 bp, Homo sapiens
ctggctgtgaaatggcagtgtc

SEQ ID NO: 7675237 - DNA, 22 bp, Homo sapiens
ctggctgtgaaatggcagtgtc

SEQ ID NO: 7675238 - DNA, 22 bp, Homo sapiens
cttctcggggttcccgcgccct

SEQ ID NO: 7675239 - DNA, 22 bp, Homo sapiens
cttctccagccacgcccactcc

SEQ ID NO: 7675240 - DNA, 22 bp, Homo sapiens
cttctccagccacgcccactcc

SEQ ID NO: 7675241 - DNA, 22 bp, Homo sapiens
cttctccagccacgcccactcc

SEQ ID NO: 7675242 - DNA, 22 bp, Homo sapiens
cttctcattcaagcaaaacaga

SEQ ID NO: 7675243 - DNA, 22 bp, Homo sapiens
cttctcattcaagcaaaacaga

SEQ ID NO: 7675244 - DNA, 22 bp, Homo sapiens
ctggctgtcttggaggaaggag

SEQ ID NO: 7675245 - DNA, 22 bp, Homo sapiens
ctggctgtgaaatggcagtgtc

SEQ ID NO: 7675246 - DNA, 22 bp, Homo sapiens
ctggctgtgaaatggcagtgtc

SEQ ID NO: 7675247 - DNA, 22 bp, Homo sapiens
ctggctgtgaaatggcagtgtc

SEQ ID NO: 7675248 - DNA, 22 bp, Homo sapiens
ctggctgtcttggaggaaggag

SEQ ID NO: 7675249 - DNA, 22 bp, Homo sapiens
ctggctgtcttggaggaaggag

SEQ ID NO: 7675250 - DNA, 22 bp, Homo sapiens
ctggctgtcttctgggagctgt

SEQ ID NO: 7675251 - DNA, 22 bp, Homo sapiens
ctggctgtcttctgggagctgt

SEQ ID NO: 7675252 - DNA, 22 bp, Homo sapiens
ctggctgtatgctggcctcaga

SEQ ID NO: 7675253 - DNA, 22 bp, Homo sapiens
ctggctgtatgctggcctcaga

SEQ ID NO: 7675254 - DNA, 22 bp, Homo sapiens
ctggctgtattagtttgatcct

SEQ ID NO: 7675255 - DNA, 22 bp, Homo sapiens
ctggctgtatgctggcctcaga

SEQ ID NO: 7675256 - DNA, 22 bp, Homo sapiens
ctggctgtaacattttgccata

SEQ ID NO: 7675257 - DNA, 22 bp, Homo sapiens
ctggctggtttttaaagctagg

SEQ ID NO: 7675258 - DNA, 22 bp, Homo sapiens
ctggctggtttttaaagctagg

SEQ ID NO: 7675259 - DNA, 22 bp, Homo sapiens
ctggctggttggggagaagaca

SEQ ID NO: 7675260 - DNA, 22 bp, Homo sapiens
ctggctggttccctgctccagg

SEQ ID NO: 7675261 - DNA, 22 bp, Homo sapiens
ctggctggttccctgctccagg

SEQ ID NO: 7675262 - DNA, 22 bp, Homo sapiens
ctggctggttactatttctggt

SEQ ID NO: 7675263 - DNA, 22 bp, Homo sapiens
ctggctggttccctgctccagg

SEQ ID NO: 7675264 - DNA, 22 bp, Homo sapiens
ctggctggttccctgctccagg

SEQ ID NO: 7675265 - DNA, 22 bp, Homo sapiens
ctggctggttggggagaagaca

SEQ ID NO: 7675266 - DNA, 22 bp, Homo sapiens
ctggctggttccctgctccagg

SEQ ID NO: 7675267 - DNA, 22 bp, Homo sapiens
ctggctggttccctgctccagg

SEQ ID NO: 7675268 - DNA, 22 bp, Homo sapiens
ctggctggtctgagcagtcgca

SEQ ID NO: 7675269 - DNA, 22 bp, Homo sapiens
ctggctggttactatttctggt

SEQ ID NO: 7675270 - DNA, 22 bp, Homo sapiens
ctggctggttactatttctggt

SEQ ID NO: 7675271 - DNA, 22 bp, Homo sapiens
ctggctggttactatttctggt

SEQ ID NO: 7675272 - DNA, 22 bp, Homo sapiens
ctggctggttactatttctggt

SEQ ID NO: 7675273 - DNA, 22 bp, Homo sapiens
ctggctggtctgagcagtcgca

SEQ ID NO: 7675274 - DNA, 22 bp, Homo sapiens
ctggctggtctgagcagtcgca

SEQ ID NO: 7675275 - DNA, 22 bp, Homo sapiens
ctggctggtctgagcagtcgca

SEQ ID NO: 7675276 - DNA, 22 bp, Homo sapiens
ctggctggtctgagcagtcgca

SEQ ID NO: 7675277 - DNA, 22 bp, Homo sapiens
ctggctggtcatgtcatgagcc

SEQ ID NO: 7675278 - DNA, 22 bp, Homo sapiens
ctggctggtcatgtcatgagcc

SEQ ID NO: 7675279 - DNA, 22 bp, Homo sapiens
ctggctggtcatgtcatgagcc

SEQ ID NO: 7675280 - DNA, 22 bp, Homo sapiens
ctggctggtcatgtcatgagcc

SEQ ID NO: 7675281 - DNA, 22 bp, Homo sapiens
ctggctggtcatgtcatgagcc

SEQ ID NO: 7675282 - DNA, 22 bp, Homo sapiens
ctggctggtcatgtcatgagcc

SEQ ID NO: 7675283 - DNA, 22 bp, Homo sapiens
ctggctggtcatgtcatgagcc

SEQ ID NO: 7675284 - DNA, 22 bp, Homo sapiens
ctggctggtcatgtcatgagcc

SEQ ID NO: 7675285 - DNA, 22 bp, Homo sapiens
ctggctggtcctcggggacagc

SEQ ID NO: 7675286 - DNA, 22 bp, Homo sapiens
ctggctggtcctcggggacagc

SEQ ID NO: 7675287 - DNA, 22 bp, Homo sapiens
ctggctggtcctcggggacagc

SEQ ID NO: 7675288 - DNA, 22 bp, Homo sapiens
ctggctggtcctcggggacagc

SEQ ID NO: 7675289 - DNA, 22 bp, Homo sapiens
ctggctggtcctcggggacagc

SEQ ID NO: 7675290 - DNA, 22 bp, Homo sapiens
ctggctggtcctcggggacagc

SEQ ID NO: 7675291 - DNA, 22 bp, Homo sapiens
ctggctggtcctcggggacagc

SEQ ID NO: 7675292 - DNA, 22 bp, Homo sapiens
ctggctggtcctcggggacagc

SEQ ID NO: 7675293 - DNA, 22 bp, Homo sapiens
ctggctggtcctcggggacagc

SEQ ID NO: 7675294 - DNA, 22 bp, Homo sapiens
ctggctggtaatggaacgacag

SEQ ID NO: 7675295 - DNA, 22 bp, Homo sapiens
ctggctgggttccaggattcca

SEQ ID NO: 7675296 - DNA, 22 bp, Homo sapiens
ctggctgggttccaggattcca

SEQ ID NO: 7675297 - DNA, 22 bp, Homo sapiens
ctggctgggttccaggattcca

SEQ ID NO: 7675298 - DNA, 22 bp, Homo sapiens
ctggctgggttccaggattcca

SEQ ID NO: 7675299 - DNA, 22 bp, Homo sapiens
ctggctggggtccatcctctaa

SEQ ID NO: 7675300 - DNA, 22 bp, Homo sapiens
ctggctggggtccatcctctaa

SEQ ID NO: 7675301 - DNA, 22 bp, Homo sapiens
ctggctggggtccatcctctaa

SEQ ID NO: 7675302 - DNA, 22 bp, Homo sapiens
ctggctggtaatggaacgacag

SEQ ID NO: 7675303 - DNA, 22 bp, Homo sapiens
ctggctggtaatggaacgacag

SEQ ID NO: 7675304 - DNA, 22 bp, Homo sapiens
ctggctggtaatggaacgacag

SEQ ID NO: 7675305 - DNA, 22 bp, Homo sapiens
ctggctggtagaattgtgacct

SEQ ID NO: 7675306 - DNA, 22 bp, Homo sapiens
ctggctggtagaattgtgacct

SEQ ID NO: 7675307 - DNA, 22 bp, Homo sapiens
ctggctggtcatcagcagtacg

SEQ ID NO: 7675308 - DNA, 22 bp, Homo sapiens
ctggctggggtaccagttgaac

SEQ ID NO: 7675309 - DNA, 22 bp, Homo sapiens
ctggctggggtaccagttgaac

SEQ ID NO: 7675310 - DNA, 22 bp, Homo sapiens
ctggctggggtaccagttgaac

SEQ ID NO: 7675311 - DNA, 22 bp, Homo sapiens
ctggctggggtaccagttgaac

SEQ ID NO: 7675312 - DNA, 22 bp, Homo sapiens
ctggctggggtaccagttgaac

SEQ ID NO: 7675313 - DNA, 22 bp, Homo sapiens
ctggctggggtaccagttgaac

SEQ ID NO: 7675314 - DNA, 22 bp, Homo sapiens
ctggctggggaagtcatttgat

SEQ ID NO: 7675315 - DNA, 22 bp, Homo sapiens
ctggctggggaagtcatttgat

SEQ ID NO: 7675316 - DNA, 22 bp, Homo sapiens
ctggctgggcagacagaatgct

SEQ ID NO: 7675317 - DNA, 22 bp, Homo sapiens
ctggctgggcagacagaatgct

SEQ ID NO: 7675318 - DNA, 22 bp, Homo sapiens
ctggctgggcagacagaatgct

SEQ ID NO: 7675319 - DNA, 22 bp, Homo sapiens
ctggctgggagctcgcctgcgg

SEQ ID NO: 7675320 - DNA, 22 bp, Homo sapiens
ctggctgggattttaaagagca

SEQ ID NO: 7675321 - DNA, 22 bp, Homo sapiens
ctggctgggccatttctttagg

SEQ ID NO: 7675322 - DNA, 22 bp, Homo sapiens
ctggctgggcagacagaatgct

SEQ ID NO: 7675323 - DNA, 22 bp, Homo sapiens
ctggctgggcagacagaatgct

SEQ ID NO: 7675324 - DNA, 22 bp, Homo sapiens
ctggctggaggtgagtcactga

SEQ ID NO: 7675325 - DNA, 22 bp, Homo sapiens
ctggctggagtgcaggtgagtg

SEQ ID NO: 7675326 - DNA, 22 bp, Homo sapiens
ctggctggaggtgagtcactga

SEQ ID NO: 7675327 - DNA, 22 bp, Homo sapiens
ctggctggagtgcaggtgagtg

SEQ ID NO: 7675328 - DNA, 22 bp, Homo sapiens
ctggctggagtgcaggtgagtg

SEQ ID NO: 7675329 - DNA, 22 bp, Homo sapiens
ctggctggagtgcaggtgagtg

SEQ ID NO: 7675330 - DNA, 22 bp, Homo sapiens
ctggctggagtgcaggtgagtg

SEQ ID NO: 7675331 - DNA, 22 bp, Homo sapiens
ctggctggagtgcaggtgagtg

SEQ ID NO: 7675332 - DNA, 22 bp, Homo sapiens
ctggctggagtgcaggtgagtg

SEQ ID NO: 7675333 - DNA, 22 bp, Homo sapiens
ctggctgggagctcgcctgcgg

SEQ ID NO: 7675334 - DNA, 22 bp, Homo sapiens
ctggctgggagctcgcctgcgg

SEQ ID NO: 7675335 - DNA, 22 bp, Homo sapiens
ctggctgggagctcgcctgcgg

SEQ ID NO: 7675336 - DNA, 22 bp, Homo sapiens
ctggctggaggtgagtcactga

SEQ ID NO: 7675337 - DNA, 22 bp, Homo sapiens
ctggctggaggtgagtcactga

SEQ ID NO: 7675338 - DNA, 22 bp, Homo sapiens
ctggctggaggtgagtcactga

SEQ ID NO: 7675339 - DNA, 22 bp, Homo sapiens
ctggctctgtgggacctggcct

SEQ ID NO: 7675340 - DNA, 21 bp, Homo sapiens
ctggctctgttgtcacccggc

SEQ ID NO: 7675341 - DNA, 21 bp, Homo sapiens
ctggctctgttgtcacccggc

SEQ ID NO: 7675342 - DNA, 22 bp, Homo sapiens
ctggctctgtgggacctggcct

SEQ ID NO: 7675343 - DNA, 22 bp, Homo sapiens
ctggctctgtgggacctggcct

SEQ ID NO: 7675344 - DNA, 22 bp, Homo sapiens
ctggctggagctgttgtaggct

SEQ ID NO: 7675345 - DNA, 22 bp, Homo sapiens
ctggctggagctgttgtaggct

SEQ ID NO: 7675346 - DNA, 22 bp, Homo sapiens
ctttatgagccttgtgaaggag

SEQ ID NO: 7675347 - DNA, 22 bp, Homo sapiens
ctttatgactgagttgtcaatt

SEQ ID NO: 7675348 - DNA, 22 bp, Homo sapiens
ctttggcagcctcagctgcagg

SEQ ID NO: 7675349 - DNA, 22 bp, Homo sapiens
ctttggcagcctcagctgcagg

SEQ ID NO: 7675350 - DNA, 22 bp, Homo sapiens
ctttggcagcctcagctgcagg

SEQ ID NO: 7675351 - DNA, 22 bp, Homo sapiens
ctttatgaaggaacaatgctcc

SEQ ID NO: 7675352 - DNA, 22 bp, Homo sapiens
ctttatgaaggaacaatgctcc

SEQ ID NO: 7675353 - DNA, 22 bp, Homo sapiens
ctttatgaacctgttcagcttg

SEQ ID NO: 7675354 - DNA, 22 bp, Homo sapiens
ctttatgaacctgttcagcttg

SEQ ID NO: 7675355 - DNA, 22 bp, Homo sapiens
ctttatgaaaaccagattgggg

SEQ ID NO: 7675356 - DNA, 22 bp, Homo sapiens
ctttatgaaaaccagattgggg

SEQ ID NO: 7675357 - DNA, 22 bp, Homo sapiens
ctttatgaaaacctgaattatg

SEQ ID NO: 7675358 - DNA, 22 bp, Homo sapiens
ctttatcgcaaacactgggtaa

SEQ ID NO: 7675359 - DNA, 22 bp, Homo sapiens
ctttatctagggtaagaaaacc

SEQ ID NO: 7675360 - DNA, 22 bp, Homo sapiens
ctttatcatggaggtaaatatg

SEQ ID NO: 7675361 - DNA, 22 bp, Homo sapiens
ctttatcatggaggtaaatatg

SEQ ID NO: 7675362 - DNA, 22 bp, Homo sapiens
ctttatcatggaggtaaatatg

SEQ ID NO: 7675363 - DNA, 22 bp, Homo sapiens
ctttatcagaaaacacattagg

SEQ ID NO: 7675364 - DNA, 22 bp, Homo sapiens
ctttatctagggtaagaaaacc

SEQ ID NO: 7675365 - DNA, 22 bp, Homo sapiens
ctttatctagggtaagaaaacc

SEQ ID NO: 7675366 - DNA, 22 bp, Homo sapiens
ctttatctagggtaagaaaacc

SEQ ID NO: 7675367 - DNA, 22 bp, Homo sapiens
ctttatatattcccaggctgcc

SEQ ID NO: 7675368 - DNA, 22 bp, Homo sapiens
ctttagttttcatcaaatctat

SEQ ID NO: 7675369 - DNA, 22 bp, Homo sapiens
ctttatatattcccaggctgcc

SEQ ID NO: 7675370 - DNA, 22 bp, Homo sapiens
ctttatatccagatgtttggtg

SEQ ID NO: 7675371 - DNA, 22 bp, Homo sapiens
ctttatcagaaaacacattagg

SEQ ID NO: 7675372 - DNA, 22 bp, Homo sapiens
ctttggcagcctctgctattga

SEQ ID NO: 7675373 - DNA, 22 bp, Homo sapiens
ctttggcagcctcagctgcagg

SEQ ID NO: 7675374 - DNA, 22 bp, Homo sapiens
ctttggcagcctctgctattga

SEQ ID NO: 7675375 - DNA, 20 bp, Homo sapiens
ctttggcaggccttgccacg

SEQ ID NO: 7675376 - DNA, 17 bp, Homo sapiens
ctttggcaggagggagg

SEQ ID NO: 7675377 - DNA, 22 bp, Homo sapiens
ctttggttctgtccttcccaga

SEQ ID NO: 7675378 - DNA, 21 bp, Homo sapiens
ctttggtttcctcctgccttc

SEQ ID NO: 7675379 - DNA, 22 bp, Homo sapiens
ctttggttctgtccttcccaga

SEQ ID NO: 7675380 - DNA, 22 bp, Homo sapiens
ctttggttcaggagtacctctc

SEQ ID NO: 7675381 - DNA, 21 bp, Homo sapiens
ctttggtttctgacttgcata

SEQ ID NO: 7675382 - DNA, 22 bp, Homo sapiens
ctttggttctgtccttcccaga

SEQ ID NO: 7675383 - DNA, 21 bp, Homo sapiens
ctttggtttcctcctgccttc

SEQ ID NO: 7675384 - DNA, 22 bp, Homo sapiens
ctttgtaagtctttctccaaga

SEQ ID NO: 7675385 - DNA, 22 bp, Homo sapiens
ctttgtaagtctttctccaaga

SEQ ID NO: 7675386 - DNA, 22 bp, Homo sapiens
ctttgtaagtctttctccaaga

SEQ ID NO: 7675387 - DNA, 22 bp, Homo sapiens
ctttgtaatcattcccttggtt

SEQ ID NO: 7675388 - DNA, 22 bp, Homo sapiens
ctttgtatctaaatatcttgaa

SEQ ID NO: 7675389 - DNA, 22 bp, Homo sapiens
ctttgtatggtggcacttccgt

SEQ ID NO: 7675390 - DNA, 22 bp, Homo sapiens
ctttgtatctaaatatcttgaa

SEQ ID NO: 7675391 - DNA, 22 bp, Homo sapiens
ctttgtcattttgtctctcagt

SEQ ID NO: 7675392 - DNA, 22 bp, Homo sapiens
ctttgtcattttgtctctcagt

SEQ ID NO: 7675393 - DNA, 19 bp, Homo sapiens
ctttgtcagaacatgcttc

SEQ ID NO: 7675394 - DNA, 19 bp, Homo sapiens
ctttgtcagaacatgcttc

SEQ ID NO: 7675395 - DNA, 19 bp, Homo sapiens
ctttgtcagaacatgcttc

SEQ ID NO: 7675396 - DNA, 17 bp, Homo sapiens
ctttgtcaccaatgcca

SEQ ID NO: 7675397 - DNA, 22 bp, Homo sapiens
ctttgtatttaatagctgtctt

SEQ ID NO: 7675398 - DNA, 22 bp, Homo sapiens
ctttgtattcatccgtaataat

SEQ ID NO: 7675399 - DNA, 22 bp, Homo sapiens
ctttagaagggtaacggaatta

SEQ ID NO: 7675400 - DNA, 22 bp, Homo sapiens
ctttagaagggtaacggaatta

SEQ ID NO: 7675401 - DNA, 20 bp, Homo sapiens
ctttagaagaacccaagcat

SEQ ID NO: 7675402 - DNA, 20 bp, Homo sapiens
ctttagaagaacccaagcat

SEQ ID NO: 7675403 - DNA, 22 bp, Homo sapiens
ctttagaagggtaacggaatta

SEQ ID NO: 7675404 - DNA, 22 bp, Homo sapiens
ctttagaagggtaacggaatta

SEQ ID NO: 7675405 - DNA, 20 bp, Homo sapiens
ctttagaagaacccaagcat

SEQ ID NO: 7675406 - DNA, 22 bp, Homo sapiens
ctttagaaatctggatgtattt

SEQ ID NO: 7675407 - DNA, 22 bp, Homo sapiens
ctttacacaatgattttcttta

SEQ ID NO: 7675408 - DNA, 22 bp, Homo sapiens
ctttagaaatctggatgtattt

SEQ ID NO: 7675409 - DNA, 22 bp, Homo sapiens
ctttacaattcaagggaactct

SEQ ID NO: 7675410 - DNA, 22 bp, Homo sapiens
ctttacaattcaagggaactct

SEQ ID NO: 7675411 - DNA, 22 bp, Homo sapiens
ctttacaattcaagggaactct

SEQ ID NO: 7675412 - DNA, 22 bp, Homo sapiens
ctttacaattcaagggaactct

SEQ ID NO: 7675413 - DNA, 22 bp, Homo sapiens
ctttacaattcaagggaactct

SEQ ID NO: 7675414 - DNA, 22 bp, Homo sapiens
ctttacaattcaagggaactct

SEQ ID NO: 7675415 - DNA, 22 bp, Homo sapiens
ctttacaacctaagttgaagct

SEQ ID NO: 7675416 - DNA, 22 bp, Homo sapiens
ctttacaacctaagttgaagct

SEQ ID NO: 7675417 - DNA, 22 bp, Homo sapiens
ctttacaacctaagttgaagct

SEQ ID NO: 7675418 - DNA, 22 bp, Homo sapiens
ctttacaattcaagggaactct

SEQ ID NO: 7675419 - DNA, 22 bp, Homo sapiens
ctttacaattcaagggaactct

SEQ ID NO: 7675420 - DNA, 22 bp, Homo sapiens
ctttacaattcaagggaactct

SEQ ID NO: 7675421 - DNA, 22 bp, Homo sapiens
ctttagaatttgatataatcaa

SEQ ID NO: 7675422 - DNA, 22 bp, Homo sapiens
ctttagaatttgatataatcaa

SEQ ID NO: 7675423 - DNA, 22 bp, Homo sapiens
ctttagacatacagaatttcca

SEQ ID NO: 7675424 - DNA, 19 bp, Homo sapiens
ctttagacacacctggaca

SEQ ID NO: 7675425 - DNA, 22 bp, Homo sapiens
ctttagacatctcattgtgtaa

SEQ ID NO: 7675426 - DNA, 22 bp, Homo sapiens
ctttagacatctcattgtgtaa

SEQ ID NO: 7675427 - DNA, 22 bp, Homo sapiens
ctttagaatttcatgtttggtc

SEQ ID NO: 7675428 - DNA, 22 bp, Homo sapiens
ctttagaatttcatgtttggtc

SEQ ID NO: 7675429 - DNA, 22 bp, Homo sapiens
ctttagaagggtaacggaatta

SEQ ID NO: 7675430 - DNA, 22 bp, Homo sapiens
ctttagaatttcatgtttggtc

SEQ ID NO: 7675431 - DNA, 22 bp, Homo sapiens
ctttagaatttgatataatcaa

SEQ ID NO: 7675432 - DNA, 22 bp, Homo sapiens
ctttagaatttgatataatcaa

SEQ ID NO: 7675433 - DNA, 22 bp, Homo sapiens
ctttagaatttgatataatcaa

SEQ ID NO: 7675434 - DNA, 22 bp, Homo sapiens
ctttagaatttgatataatcaa

SEQ ID NO: 7675435 - DNA, 22 bp, Homo sapiens
ctttagaatttgatataatcaa

SEQ ID NO: 7675436 - DNA, 22 bp, Homo sapiens
ctttagaatttgatataatcaa

SEQ ID NO: 7675437 - DNA, 22 bp, Homo sapiens
ctttagttgtctcctcaagggt

SEQ ID NO: 7675438 - DNA, 22 bp, Homo sapiens
ctttagttgttatttcttcaca

SEQ ID NO: 7675439 - DNA, 22 bp, Homo sapiens
ctttagttgtatcagtcaagtt

SEQ ID NO: 7675440 - DNA, 22 bp, Homo sapiens
ctttagttgtatcagtcaagtt

SEQ ID NO: 7675441 - DNA, 22 bp, Homo sapiens
ctttagttctagaaagtgaaac

SEQ ID NO: 7675442 - DNA, 22 bp, Homo sapiens
ctttagttctagaaagtgaaac

SEQ ID NO: 7675443 - DNA, 20 bp, Homo sapiens
ctttagttattaacagcact

SEQ ID NO: 7675444 - DNA, 22 bp, Homo sapiens
ctttagttatttagactacagt

SEQ ID NO: 7675445 - DNA, 22 bp, Homo sapiens
ctttagttatttagactacagt

SEQ ID NO: 7675446 - DNA, 20 bp, Homo sapiens
ctttagttattaacagcact

SEQ ID NO: 7675447 - DNA, 22 bp, Homo sapiens
ctttagttatttagactacagt

SEQ ID NO: 7675448 - DNA, 22 bp, Homo sapiens
ctttagtttaagaacatgatga

SEQ ID NO: 7675449 - DNA, 22 bp, Homo sapiens
ctttagtttaagaacatgatga

SEQ ID NO: 7675450 - DNA, 22 bp, Homo sapiens
ctttagtttaagaacatgatga

SEQ ID NO: 7675451 - DNA, 22 bp, Homo sapiens
ctttagtttaagaacatgatga

SEQ ID NO: 7675452 - DNA, 22 bp, Homo sapiens
ctttagtttaagaacatgatga

SEQ ID NO: 7675453 - DNA, 22 bp, Homo sapiens
ctttagtttaagaacatgatga

SEQ ID NO: 7675454 - DNA, 22 bp, Homo sapiens
ctttagtttgtgatacgaagat

SEQ ID NO: 7675455 - DNA, 22 bp, Homo sapiens
ctttagtttgtgatacgaagat

SEQ ID NO: 7675456 - DNA, 22 bp, Homo sapiens
ctttagttttcatcaaatctat

SEQ ID NO: 7675457 - DNA, 22 bp, Homo sapiens
ctttagttttcatcaaatctat

SEQ ID NO: 7675458 - DNA, 22 bp, Homo sapiens
ctttagtttgtaagagcaagag

SEQ ID NO: 7675459 - DNA, 22 bp, Homo sapiens
ctttagtgagtgtggagctaga

SEQ ID NO: 7675460 - DNA, 22 bp, Homo sapiens
ctttagtgttgttgtgaggatt

SEQ ID NO: 7675461 - DNA, 20 bp, Homo sapiens
ctttagttattaacagcact

SEQ ID NO: 7675462 - DNA, 22 bp, Homo sapiens
ctttagttagtagataatggca

SEQ ID NO: 7675463 - DNA, 20 bp, Homo sapiens
ctttagttattaacagcact

SEQ ID NO: 7675464 - DNA, 20 bp, Homo sapiens
ctttagttattaacagcact

SEQ ID NO: 7675465 - DNA, 20 bp, Homo sapiens
ctttagttattaacagcact

SEQ ID NO: 7675466 - DNA, 20 bp, Homo sapiens
ctttagttattaacagcact

SEQ ID NO: 7675467 - DNA, 21 bp, Homo sapiens
ctttagtgaaaaggggctaac

SEQ ID NO: 7675468 - DNA, 21 bp, Homo sapiens
ctttagtgaaaaggggctaac

SEQ ID NO: 7675469 - DNA, 22 bp, Homo sapiens
ctttaggttttgcctgagatct

SEQ ID NO: 7675470 - DNA, 22 bp, Homo sapiens
ctttaggcccttgctggttctg

SEQ ID NO: 7675471 - DNA, 22 bp, Homo sapiens
ctttagatttctatgtatcact

SEQ ID NO: 7675472 - DNA, 22 bp, Homo sapiens
ctttagcaacgatgatgatatt

SEQ ID NO: 7675473 - DNA, 22 bp, Homo sapiens
ctttagcaacgatgatgatatt

SEQ ID NO: 7675474 - DNA, 22 bp, Homo sapiens
cttgggggccattaaggggcct

SEQ ID NO: 7675475 - DNA, 22 bp, Homo sapiens
ctttacaacctaagttgaagct

SEQ ID NO: 7675476 - DNA, 22 bp, Homo sapiens
ctttacaacctaagttgaagct

SEQ ID NO: 7675477 - DNA, 22 bp, Homo sapiens
ctttacaacctaagttgaagct

SEQ ID NO: 7675478 - DNA, 22 bp, Homo sapiens
ctttacaacctaagttgaagct

SEQ ID NO: 7675479 - DNA, 22 bp, Homo sapiens
ctttacaacctaagttgaagct

SEQ ID NO: 7675480 - DNA, 22 bp, Homo sapiens
ctttacaacctaagttgaagct

SEQ ID NO: 7675481 - DNA, 22 bp, Homo sapiens
cttgggggccattaaggggcct

SEQ ID NO: 7675482 - DNA, 22 bp, Homo sapiens
cttgggggccattaaggggcct

SEQ ID NO: 7675483 - DNA, 22 bp, Homo sapiens
cttgggggccattaaggggcct

SEQ ID NO: 7675484 - DNA, 22 bp, Homo sapiens
cttgggggccattaaggggcct

SEQ ID NO: 7675485 - DNA, 22 bp, Homo sapiens
cttgggggccattaaggggcct

SEQ ID NO: 7675486 - DNA, 22 bp, Homo sapiens
cttggggctttgtgtgtaggat

SEQ ID NO: 7675487 - DNA, 22 bp, Homo sapiens
cttggggctttgtgtgtaggat

SEQ ID NO: 7675488 - DNA, 22 bp, Homo sapiens
cttggggctttgtgtgtaggat

SEQ ID NO: 7675489 - DNA, 22 bp, Homo sapiens
cttggggcagtgcttggcacat

SEQ ID NO: 7675490 - DNA, 22 bp, Homo sapiens
cttggggcagtgcttggcacat

SEQ ID NO: 7675491 - DNA, 22 bp, Homo sapiens
cttggggcagcccaggctgagc

SEQ ID NO: 7675492 - DNA, 22 bp, Homo sapiens
cttggggcagcccaggctgagc

SEQ ID NO: 7675493 - DNA, 22 bp, Homo sapiens
cttggggcagcccaggctgagc

SEQ ID NO: 7675494 - DNA, 22 bp, Homo sapiens
cttggggctgtcactctggcat

SEQ ID NO: 7675495 - DNA, 22 bp, Homo sapiens
cttggggctgtcactctggcat

SEQ ID NO: 7675496 - DNA, 22 bp, Homo sapiens
cttggggctgtcactctggcat

SEQ ID NO: 7675497 - DNA, 22 bp, Homo sapiens
cttggggctttgtgtgtaggat

SEQ ID NO: 7675498 - DNA, 22 bp, Homo sapiens
cttggggaagccactgatccct

SEQ ID NO: 7675499 - DNA, 22 bp, Homo sapiens
cttgggctgtgccttaaattct

SEQ ID NO: 7675500 - DNA, 22 bp, Homo sapiens
cttgggcttagaaggtaagtga

SEQ ID NO: 7675501 - DNA, 22 bp, Homo sapiens
cttgggctctaaatgccagtga

SEQ ID NO: 7675502 - DNA, 22 bp, Homo sapiens
cttgggctctaaatgccagtga

SEQ ID NO: 7675503 - DNA, 22 bp, Homo sapiens
cttgggctctaaatgccagtga

SEQ ID NO: 7675504 - DNA, 22 bp, Homo sapiens
cttgggctctaaatgccagtga

SEQ ID NO: 7675505 - DNA, 22 bp, Homo sapiens
cttgggctcagacttgaggaca

SEQ ID NO: 7675506 - DNA, 22 bp, Homo sapiens
cttgggctcagacttgaggaca

SEQ ID NO: 7675507 - DNA, 22 bp, Homo sapiens
cttggggatgcaaagccagtgt

SEQ ID NO: 7675508 - DNA, 22 bp, Homo sapiens
cttggggattttaaagacctct

SEQ ID NO: 7675509 - DNA, 22 bp, Homo sapiens
cttggggattttaaagacctct

SEQ ID NO: 7675510 - DNA, 22 bp, Homo sapiens
cttggggatgcaaagccagtgt

SEQ ID NO: 7675511 - DNA, 22 bp, Homo sapiens
cttggggatgcaaagccagtgt

SEQ ID NO: 7675512 - DNA, 22 bp, Homo sapiens
cttggggacacagagcccaggg

SEQ ID NO: 7675513 - DNA, 22 bp, Homo sapiens
cttggggacacagagcccaggg

SEQ ID NO: 7675514 - DNA, 21 bp, Homo sapiens
cttgggcttgtagatggtgga

SEQ ID NO: 7675515 - DNA, 22 bp, Homo sapiens
cttggggaagccactgatccct

SEQ ID NO: 7675516 - DNA, 22 bp, Homo sapiens
cttggggaggacgcagtgtcct

SEQ ID NO: 7675517 - DNA, 22 bp, Homo sapiens
cttggggaggacgcagtgtcct

SEQ ID NO: 7675518 - DNA, 22 bp, Homo sapiens
cttggggacacagagcccaggg

SEQ ID NO: 7675519 - DNA, 22 bp, Homo sapiens
cttgggagacacaagaagacat

SEQ ID NO: 7675520 - DNA, 22 bp, Homo sapiens
cttgggaccctcacatttgatg

SEQ ID NO: 7675521 - DNA, 22 bp, Homo sapiens
cttgggaggcagaggttgcagt

SEQ ID NO: 7675522 - DNA, 22 bp, Homo sapiens
cttgggaggcagaggttgcagt

SEQ ID NO: 7675523 - DNA, 22 bp, Homo sapiens
cttgggaggcagaggttgcagt

SEQ ID NO: 7675524 - DNA, 22 bp, Homo sapiens
cttgggaggagaacaaagctcc

SEQ ID NO: 7675525 - DNA, 22 bp, Homo sapiens
cttgggaggagaacaaagctcc

SEQ ID NO: 7675526 - DNA, 22 bp, Homo sapiens
cttgggaggggagcattggcct

SEQ ID NO: 7675527 - DNA, 22 bp, Homo sapiens
cttgggagtagaggcaggagca

SEQ ID NO: 7675528 - DNA, 22 bp, Homo sapiens
cttgggaggggagcattggcct

SEQ ID NO: 7675529 - DNA, 22 bp, Homo sapiens
cttgggaggggagcattggcct

SEQ ID NO: 7675530 - DNA, 22 bp, Homo sapiens
cttgggaggggagcattggcct

SEQ ID NO: 7675531 - DNA, 22 bp, Homo sapiens
cttgggagtagaggcaggagca

SEQ ID NO: 7675532 - DNA, 22 bp, Homo sapiens
cttgggagtagaggcaggagca

SEQ ID NO: 7675533 - DNA, 22 bp, Homo sapiens
cttgggagtagaggcaggagca

SEQ ID NO: 7675534 - DNA, 22 bp, Homo sapiens
cttgggagtagaggcaggagca

SEQ ID NO: 7675535 - DNA, 22 bp, Homo sapiens
cttgggagtagaggcaggagca

SEQ ID NO: 7675536 - DNA, 22 bp, Homo sapiens
cttgggagtagaggcaggagca

SEQ ID NO: 7675537 - DNA, 22 bp, Homo sapiens
cttgggagtagaggcaggagca

SEQ ID NO: 7675538 - DNA, 22 bp, Homo sapiens
cttgggagtagaggcaggagca

SEQ ID NO: 7675539 - DNA, 22 bp, Homo sapiens
cttgggccagcccagggggcat

SEQ ID NO: 7675540 - DNA, 22 bp, Homo sapiens
cttgggccagcccagggggcat

SEQ ID NO: 7675541 - DNA, 22 bp, Homo sapiens
cttgggccagcccagggggcat

SEQ ID NO: 7675542 - DNA, 22 bp, Homo sapiens
cttgggcagggtattgtagaag

SEQ ID NO: 7675543 - DNA, 22 bp, Homo sapiens
cttgggccacctggagggactg

SEQ ID NO: 7675544 - DNA, 22 bp, Homo sapiens
cttgggccacctggagggactg

SEQ ID NO: 7675545 - DNA, 22 bp, Homo sapiens
cttgggctataaatataaccat

SEQ ID NO: 7675546 - DNA, 22 bp, Homo sapiens
cttgggcccccacacgagctcg

SEQ ID NO: 7675547 - DNA, 22 bp, Homo sapiens
cttgggcccccacacgagctcg

SEQ ID NO: 7675548 - DNA, 22 bp, Homo sapiens
cttgggccctccccttgtgaat

SEQ ID NO: 7675549 - DNA, 22 bp, Homo sapiens
cttgggccttgagaatgttctg

SEQ ID NO: 7675550 - DNA, 22 bp, Homo sapiens
cttgggcaagcagcattcagaa

SEQ ID NO: 7675551 - DNA, 22 bp, Homo sapiens
cttgggcaggggaaacagctgc

SEQ ID NO: 7675552 - DNA, 22 bp, Homo sapiens
cttgggcaggggaaacagctgc

SEQ ID NO: 7675553 - DNA, 19 bp, Homo sapiens
cttgggcatatctgaggca

SEQ ID NO: 7675554 - DNA, 19 bp, Homo sapiens
cttgggcatatctgaggca

SEQ ID NO: 7675555 - DNA, 17 bp, Homo sapiens
cttggcacctctgccat

SEQ ID NO: 7675556 - DNA, 17 bp, Homo sapiens
cttggcacctctgccat

SEQ ID NO: 7675557 - DNA, 22 bp, Homo sapiens
cttggcacattttgttcttctg

SEQ ID NO: 7675558 - DNA, 22 bp, Homo sapiens
cttggcaccaccaagtggccat

SEQ ID NO: 7675559 - DNA, 22 bp, Homo sapiens
cttggcacgtgataggtgttga

SEQ ID NO: 7675560 - DNA, 22 bp, Homo sapiens
cttggcacttgggcagtgagca

SEQ ID NO: 7675561 - DNA, 22 bp, Homo sapiens
cttggcacttgggcagtgagca

SEQ ID NO: 7675562 - DNA, 22 bp, Homo sapiens
cttggcagagggctgggctcag

SEQ ID NO: 7675563 - DNA, 22 bp, Homo sapiens
cttggcagagggctgggctcag

SEQ ID NO: 7675564 - DNA, 22 bp, Homo sapiens
cttggcacattttgttcttctg

SEQ ID NO: 7675565 - DNA, 21 bp, Homo sapiens
cttggcacagggaagatgcac

SEQ ID NO: 7675566 - DNA, 21 bp, Homo sapiens
cttggcacagggaagatgcac

SEQ ID NO: 7675567 - DNA, 22 bp, Homo sapiens
cttggcaactgaagactggctg

SEQ ID NO: 7675568 - DNA, 22 bp, Homo sapiens
cttggattgtacctagtatggt

SEQ ID NO: 7675569 - DNA, 22 bp, Homo sapiens
cttggatttgggcccttaaatt

SEQ ID NO: 7675570 - DNA, 22 bp, Homo sapiens
cttgacaactggcagatatata

SEQ ID NO: 7675571 - DNA, 22 bp, Homo sapiens
cttgacaactggcagatatata

SEQ ID NO: 7675572 - DNA, 21 bp, Homo sapiens
cttggagttggttgaggatgc

SEQ ID NO: 7675573 - DNA, 21 bp, Homo sapiens
cttggagttggttgaggatgc

SEQ ID NO: 7675574 - DNA, 21 bp, Homo sapiens
cttggagttggttgaggatgc

SEQ ID NO: 7675575 - DNA, 22 bp, Homo sapiens
cttggatatcactcagaaagat

SEQ ID NO: 7675576 - DNA, 22 bp, Homo sapiens
cttggatctcaaggcactcaaa

SEQ ID NO: 7675577 - DNA, 22 bp, Homo sapiens
cttggattcattgtgggaggga

SEQ ID NO: 7675578 - DNA, 22 bp, Homo sapiens
cttgaagattgatccagtttga

SEQ ID NO: 7675579 - DNA, 22 bp, Homo sapiens
cttgaaggacagcatctccgag

SEQ ID NO: 7675580 - DNA, 22 bp, Homo sapiens
cttgaagattgatccagtttga

SEQ ID NO: 7675581 - DNA, 22 bp, Homo sapiens
cttgaagattgatccagtttga

SEQ ID NO: 7675582 - DNA, 22 bp, Homo sapiens
cttgaagagtgggaaggatttg

SEQ ID NO: 7675583 - DNA, 22 bp, Homo sapiens
cttgaagagtaaattggtacac

SEQ ID NO: 7675584 - DNA, 22 bp, Homo sapiens
cttgaagagtaaattggtacac

SEQ ID NO: 7675585 - DNA, 22 bp, Homo sapiens
cttgaagacaatggcagattcc

SEQ ID NO: 7675586 - DNA, 22 bp, Homo sapiens
cttgaagagtgggaaggatttg

SEQ ID NO: 7675587 - DNA, 22 bp, Homo sapiens
cttgaagagtgggaaggatttg

SEQ ID NO: 7675588 - DNA, 22 bp, Homo sapiens
cttgaagttgcaaaacattaat

SEQ ID NO: 7675589 - DNA, 22 bp, Homo sapiens
cttgaagtggatgttggtataa

SEQ ID NO: 7675590 - DNA, 22 bp, Homo sapiens
cttgaagtggagcttttgaaat

SEQ ID NO: 7675591 - DNA, 22 bp, Homo sapiens
cttgaagtgcctgagtcttatc

SEQ ID NO: 7675592 - DNA, 22 bp, Homo sapiens
cttgaagtgcctgagtcttatc

SEQ ID NO: 7675593 - DNA, 22 bp, Homo sapiens
cttgaagtaagacagctctgga

SEQ ID NO: 7675594 - DNA, 22 bp, Homo sapiens
cttgaagtttgcttagattcct

SEQ ID NO: 7675595 - DNA, 22 bp, Homo sapiens
cttgaatcttctgagtatttgc

SEQ ID NO: 7675596 - DNA, 22 bp, Homo sapiens
cttgaatgaaaccaactgatga

SEQ ID NO: 7675597 - DNA, 22 bp, Homo sapiens
cttgaatgaaaccaactgatga

SEQ ID NO: 7675598 - DNA, 23 bp, Homo sapiens
cttgaatgggatggaattcactg

SEQ ID NO: 7675599 - DNA, 22 bp, Homo sapiens
cttgaatgggccataagacggt

SEQ ID NO: 7675600 - DNA, 22 bp, Homo sapiens
cttgaatgggccataagacggt

SEQ ID NO: 7675601 - DNA, 22 bp, Homo sapiens
cttgaatggtatgagagtaatt

SEQ ID NO: 7675602 - DNA, 22 bp, Homo sapiens
cttgaatggtatgagagtaatt

SEQ ID NO: 7675603 - DNA, 22 bp, Homo sapiens
cttgaatgtaaataatgtacag

SEQ ID NO: 7675604 - DNA, 22 bp, Homo sapiens
cttgaatgtcctgtggcaaagt

SEQ ID NO: 7675605 - DNA, 22 bp, Homo sapiens
cttgaattgggggaagatcact

SEQ ID NO: 7675606 - DNA, 22 bp, Homo sapiens
cttgaattgggggaagatcact

SEQ ID NO: 7675607 - DNA, 22 bp, Homo sapiens
cttgaatgtaaataatgtacag

SEQ ID NO: 7675608 - DNA, 22 bp, Homo sapiens
cttggctgtctataggaaagag

SEQ ID NO: 7675609 - DNA, 22 bp, Homo sapiens
cttggctgtcataaggtcctgg

SEQ ID NO: 7675610 - DNA, 22 bp, Homo sapiens
cttggctgtctataggaaagag

SEQ ID NO: 7675611 - DNA, 22 bp, Homo sapiens
cttggctgtctataggaaagag

SEQ ID NO: 7675612 - DNA, 22 bp, Homo sapiens
cttggctgtctataggaaagag

SEQ ID NO: 7675613 - DNA, 22 bp, Homo sapiens
cttggctgtctataggaaagag

SEQ ID NO: 7675614 - DNA, 22 bp, Homo sapiens
cttggctgttgggcattgagaa

SEQ ID NO: 7675615 - DNA, 22 bp, Homo sapiens
cttggctgttgggcattgagaa

SEQ ID NO: 7675616 - DNA, 19 bp, Homo sapiens
cttggcttagcttcttagc

SEQ ID NO: 7675617 - DNA, 19 bp, Homo sapiens
cttggcttagcttcttagc

SEQ ID NO: 7675618 - DNA, 22 bp, Homo sapiens
cttggctttagaacatgggagc

SEQ ID NO: 7675619 - DNA, 22 bp, Homo sapiens
cttggctttagaacatgggagc

SEQ ID NO: 7675620 - DNA, 22 bp, Homo sapiens
cttggcttttgctcccagatca

SEQ ID NO: 7675621 - DNA, 22 bp, Homo sapiens
cttggctttagaacatgggagc

SEQ ID NO: 7675622 - DNA, 22 bp, Homo sapiens
cttggctttctgacccttgtca

SEQ ID NO: 7675623 - DNA, 22 bp, Homo sapiens
cttggcttttgctcccagatca

SEQ ID NO: 7675624 - DNA, 22 bp, Homo sapiens
cttgggaactgccttgcctttg

SEQ ID NO: 7675625 - DNA, 22 bp, Homo sapiens
cttgggaactgccttgcctttg

SEQ ID NO: 7675626 - DNA, 22 bp, Homo sapiens
cttgggaagtgtttaaagctga

SEQ ID NO: 7675627 - DNA, 22 bp, Homo sapiens
cttgggaagtgtttaaagctga

SEQ ID NO: 7675628 - DNA, 22 bp, Homo sapiens
cttgggaatgctaacagatgac

SEQ ID NO: 7675629 - DNA, 22 bp, Homo sapiens
cttgggaatgctaacagatgac

SEQ ID NO: 7675630 - DNA, 22 bp, Homo sapiens
cttgggaagtgtttaaagctga

SEQ ID NO: 7675631 - DNA, 22 bp, Homo sapiens
cttgggaatgctaacagatgac

SEQ ID NO: 7675632 - DNA, 22 bp, Homo sapiens
cttggctgggaactgtgattca

SEQ ID NO: 7675633 - DNA, 22 bp, Homo sapiens
cttggctgtcataaggtcctgg

SEQ ID NO: 7675634 - DNA, 22 bp, Homo sapiens
cttggctgtcataaggtcctgg

SEQ ID NO: 7675635 - DNA, 22 bp, Homo sapiens
cttggctggaactcctgagaaa

SEQ ID NO: 7675636 - DNA, 22 bp, Homo sapiens
cttggctggaactcctgagaaa

SEQ ID NO: 7675637 - DNA, 22 bp, Homo sapiens
cttggctggaactcctgagaaa

SEQ ID NO: 7675638 - DNA, 22 bp, Homo sapiens
cttggctggaactcctgagaaa

SEQ ID NO: 7675639 - DNA, 22 bp, Homo sapiens
cttggctgcttttgtgcacatt

SEQ ID NO: 7675640 - DNA, 22 bp, Homo sapiens
cttggctgcttttgtgcacatt

SEQ ID NO: 7675641 - DNA, 21 bp, Homo sapiens
cttggctgcagtgacaggcat

SEQ ID NO: 7675642 - DNA, 21 bp, Homo sapiens
cttggctgcagtgacaggcat

SEQ ID NO: 7675643 - DNA, 22 bp, Homo sapiens
cttggcacgtgataggtgttga

SEQ ID NO: 7675644 - DNA, 18 bp, Homo sapiens
cttggctgatgggggtgt

SEQ ID NO: 7675645 - DNA, 22 bp, Homo sapiens
cttggctgaactccaggatgca

SEQ ID NO: 7675646 - DNA, 22 bp, Homo sapiens
cttggctgcttttgtgcacatt

SEQ ID NO: 7675647 - DNA, 17 bp, Homo sapiens
cttggctgctgtgcgat

SEQ ID NO: 7675648 - DNA, 17 bp, Homo sapiens
cttggctgctgtgcgat

SEQ ID NO: 7675649 - DNA, 21 bp, Homo sapiens
cttggctgcagtgacaggcat

SEQ ID NO: 7675650 - DNA, 17 bp, Homo sapiens
cttggctgctgtgcgat

SEQ ID NO: 7675651 - DNA, 21 bp, Homo sapiens
cttggctgcagtgacaggcat

SEQ ID NO: 7675652 - DNA, 22 bp, Homo sapiens
gaactcccagccctttgttggc

SEQ ID NO: 7675653 - DNA, 22 bp, Homo sapiens
gaactcattagcctgctttcag

SEQ ID NO: 7675654 - DNA, 22 bp, Homo sapiens
gaactcagagcctgagctagga

SEQ ID NO: 7675655 - DNA, 22 bp, Homo sapiens
gaactcagagcctgagctagga

SEQ ID NO: 7675656 - DNA, 22 bp, Homo sapiens
gaactcagagcctgagctagga

SEQ ID NO: 7675657 - DNA, 22 bp, Homo sapiens
gaactcagagcctgagctagga

SEQ ID NO: 7675658 - DNA, 22 bp, Homo sapiens
gaactattcattctcattagcg

SEQ ID NO: 7675659 - DNA, 22 bp, Homo sapiens
gaactcaacacagtatttggta

SEQ ID NO: 7675660 - DNA, 22 bp, Homo sapiens
gaactcagagcctgagctagga

SEQ ID NO: 7675661 - DNA, 22 bp, Homo sapiens
gaactattcattctcattagcg

SEQ ID NO: 7675662 - DNA, 22 bp, Homo sapiens
gaactatatgtcttaaagcttt

SEQ ID NO: 7675663 - DNA, 22 bp, Homo sapiens
gaactatatcttcaagaaaatg

SEQ ID NO: 7675664 - DNA, 22 bp, Homo sapiens
gaactagaatgttctgatggag

SEQ ID NO: 7675665 - DNA, 22 bp, Homo sapiens
gaactatatcttcaagaaaatg

SEQ ID NO: 7675666 - DNA, 22 bp, Homo sapiens
gaactatatcttcaagaaaatg

SEQ ID NO: 7675667 - DNA, 22 bp, Homo sapiens
gaactgaagacttttactgtac

SEQ ID NO: 7675668 - DNA, 22 bp, Homo sapiens
gaactgaaacttggtttaaagc

SEQ ID NO: 7675669 - DNA, 22 bp, Homo sapiens
gaactgaagacttttactgtac

SEQ ID NO: 7675670 - DNA, 22 bp, Homo sapiens
gaactgcattgtggtatatgtt

SEQ ID NO: 7675671 - DNA, 19 bp, Homo sapiens
gaactgaggtctgaggctt

SEQ ID NO: 7675672 - DNA, 22 bp, Homo sapiens
gaactgagatttttgtctggct

SEQ ID NO: 7675673 - DNA, 22 bp, Homo sapiens
gaactgcatcttaaataatact

SEQ ID NO: 7675674 - DNA, 22 bp, Homo sapiens
gaactggtgaagtgaagggcag

SEQ ID NO: 7675675 - DNA, 22 bp, Homo sapiens
gaactggtcttttaggttttct

SEQ ID NO: 7675676 - DNA, 22 bp, Homo sapiens
gaactggtcagtttagcccact

SEQ ID NO: 7675677 - DNA, 22 bp, Homo sapiens
gaactggttacagagggatgtt

SEQ ID NO: 7675678 - DNA, 22 bp, Homo sapiens
gaactggtgagagttcacggga

SEQ ID NO: 7675679 - DNA, 22 bp, Homo sapiens
gaactgtaaaataattggcaat

SEQ ID NO: 7675680 - DNA, 22 bp, Homo sapiens
gaactgtagagaatacatttct

SEQ ID NO: 7675681 - DNA, 22 bp, Homo sapiens
gaactgtagagaatacatttct

SEQ ID NO: 7675682 - DNA, 22 bp, Homo sapiens
gaacgggtgcagccatgggccc

SEQ ID NO: 7675683 - DNA, 22 bp, Homo sapiens
gaacgcaacggaaaagatttca

SEQ ID NO: 7675684 - DNA, 22 bp, Homo sapiens
gaacgcaacggaaaagatttca

SEQ ID NO: 7675685 - DNA, 22 bp, Homo sapiens
gaactaaatgaaattactggtg

SEQ ID NO: 7675686 - DNA, 22 bp, Homo sapiens
gaactaaatgaaattactggtg

SEQ ID NO: 7675687 - DNA, 22 bp, Homo sapiens
gaacgtaaatgttcatgtttga

SEQ ID NO: 7675688 - DNA, 22 bp, Homo sapiens
gaactaaaagctaacatcaggc

SEQ ID NO: 7675689 - DNA, 22 bp, Homo sapiens
gaactacagtgcattttcttaa

SEQ ID NO: 7675690 - DNA, 22 bp, Homo sapiens
gaactacagtaagaattgatgt

SEQ ID NO: 7675691 - DNA, 22 bp, Homo sapiens
gaactacagtgcattttcttaa

SEQ ID NO: 7675692 - DNA, 22 bp, Homo sapiens
gaactacaggtgcagcaagtga

SEQ ID NO: 7675693 - DNA, 22 bp, Homo sapiens
gaactacagtaagaattgatgt

SEQ ID NO: 7675694 - DNA, 22 bp, Homo sapiens
gaacctgtaagtatagatgtgg

SEQ ID NO: 7675695 - DNA, 22 bp, Homo sapiens
gaacctgtttatgttacctgcg

SEQ ID NO: 7675696 - DNA, 20 bp, Homo sapiens
gaacctggggaaggagtagg

SEQ ID NO: 7675697 - DNA, 22 bp, Homo sapiens
gaacctgcttccttttatatta

SEQ ID NO: 7675698 - DNA, 22 bp, Homo sapiens
gaacctctttgtgcttcagctt

SEQ ID NO: 7675699 - DNA, 22 bp, Homo sapiens
gaacctctttagtgcatccttc

SEQ ID NO: 7675700 - DNA, 22 bp, Homo sapiens
gaacctctttaaagaacagaat

SEQ ID NO: 7675701 - DNA, 20 bp, Homo sapiens
gaacctctcccagcccctgg

SEQ ID NO: 7675702 - DNA, 22 bp, Homo sapiens
gaacctctcagcagccatgatc

SEQ ID NO: 7675703 - DNA, 22 bp, Homo sapiens
gaacctctatatttgtgacatc

SEQ ID NO: 7675704 - DNA, 22 bp, Homo sapiens
gaacctgagcccaggtggcatt

SEQ ID NO: 7675705 - DNA, 22 bp, Homo sapiens
gaacctgagcccaggtggcatt

SEQ ID NO: 7675706 - DNA, 22 bp, Homo sapiens
gaacctgagcgggcagcaagcg

SEQ ID NO: 7675707 - DNA, 22 bp, Homo sapiens
gaacctgagcgggcagcaagcg

SEQ ID NO: 7675708 - DNA, 21 bp, Homo sapiens
gaacctgagtgaagacttggg

SEQ ID NO: 7675709 - DNA, 21 bp, Homo sapiens
gaacctgagtgaagacttggg

SEQ ID NO: 7675710 - DNA, 21 bp, Homo sapiens
gaacctgagtgaagacttggg

SEQ ID NO: 7675711 - DNA, 22 bp, Homo sapiens
gaacctgatccaatatttactc

SEQ ID NO: 7675712 - DNA, 22 bp, Homo sapiens
gaacctgatccaatatttactc

SEQ ID NO: 7675713 - DNA, 22 bp, Homo sapiens
gaacactgaggacactgagaat

SEQ ID NO: 7675714 - DNA, 22 bp, Homo sapiens
gaacactgaggacactgagaat

SEQ ID NO: 7675715 - DNA, 22 bp, Homo sapiens
gaacactgagagagatgggcag

SEQ ID NO: 7675716 - DNA, 22 bp, Homo sapiens
gaacactgctgttgggttctga

SEQ ID NO: 7675717 - DNA, 22 bp, Homo sapiens
gaacactgaggacactgagaat

SEQ ID NO: 7675718 - DNA, 22 bp, Homo sapiens
gaacactgaggacactgagaat

SEQ ID NO: 7675719 - DNA, 22 bp, Homo sapiens
gaacactgaggacactgagaat

SEQ ID NO: 7675720 - DNA, 22 bp, Homo sapiens
gaacactggggtatcattgagc

SEQ ID NO: 7675721 - DNA, 22 bp, Homo sapiens
gaacactggggtatcattgagc

SEQ ID NO: 7675722 - DNA, 22 bp, Homo sapiens
gaacactggggtatcattgagc

SEQ ID NO: 7675723 - DNA, 22 bp, Homo sapiens
gaacactgtttcttcgtgaaca

SEQ ID NO: 7675724 - DNA, 22 bp, Homo sapiens
gaacactgtttcttcgtgaaca

SEQ ID NO: 7675725 - DNA, 22 bp, Homo sapiens
gaacactggggtatcattgagc

SEQ ID NO: 7675726 - DNA, 22 bp, Homo sapiens
gaacactgtttcttcgtgaaca

SEQ ID NO: 7675727 - DNA, 22 bp, Homo sapiens
gaacactttaacattccttttc

SEQ ID NO: 7675728 - DNA, 22 bp, Homo sapiens
gaacacttggctttggatttaa

SEQ ID NO: 7675729 - DNA, 22 bp, Homo sapiens
gaacacttggctttggatttaa

SEQ ID NO: 7675730 - DNA, 22 bp, Homo sapiens
gaacacttggctttggatttaa

SEQ ID NO: 7675731 - DNA, 22 bp, Homo sapiens
gaacacttggctttggatttaa

SEQ ID NO: 7675732 - DNA, 22 bp, Homo sapiens
gaacactttaacattccttttc

SEQ ID NO: 7675733 - DNA, 22 bp, Homo sapiens
gaacactttaacattccttttc

SEQ ID NO: 7675734 - DNA, 22 bp, Homo sapiens
gaacacttgctgttaataagtg

SEQ ID NO: 7675735 - DNA, 22 bp, Homo sapiens
gaacacttgctgttaataagtg

SEQ ID NO: 7675736 - DNA, 19 bp, Homo sapiens
gaacacttactatatttct

SEQ ID NO: 7675737 - DNA, 19 bp, Homo sapiens
gaacacttactatatttct

SEQ ID NO: 7675738 - DNA, 22 bp, Homo sapiens
gaacactgtttcttcgtgaaca

SEQ ID NO: 7675739 - DNA, 22 bp, Homo sapiens
gaacagaagaggctggtgccac

SEQ ID NO: 7675740 - DNA, 22 bp, Homo sapiens
gaacagaagaggctggtgccac

SEQ ID NO: 7675741 - DNA, 22 bp, Homo sapiens
gaacagaattaccgaagatctg

SEQ ID NO: 7675742 - DNA, 22 bp, Homo sapiens
gaacagaattaccgaagatctg

SEQ ID NO: 7675743 - DNA, 22 bp, Homo sapiens
gaacagaattaccgaagatctg

SEQ ID NO: 7675744 - DNA, 22 bp, Homo sapiens
gaacagaattaccgaagatctg

SEQ ID NO: 7675745 - DNA, 22 bp, Homo sapiens
gaacagaattaccgaagatctg

SEQ ID NO: 7675746 - DNA, 22 bp, Homo sapiens
gaacagaattaccgaagatctg

SEQ ID NO: 7675747 - DNA, 22 bp, Homo sapiens
gaacagaattaccgaagatctg

SEQ ID NO: 7675748 - DNA, 22 bp, Homo sapiens
gaacagaattaccgaagatctg

SEQ ID NO: 7675749 - DNA, 22 bp, Homo sapiens
gaacagaattaccgaagatctg

SEQ ID NO: 7675750 - DNA, 22 bp, Homo sapiens
gaacagagttgaaacaaggctg

SEQ ID NO: 7675751 - DNA, 22 bp, Homo sapiens
gaacagagctgactacaaggca

SEQ ID NO: 7675752 - DNA, 19 bp, Homo sapiens
gaacagacttggggtgagg

SEQ ID NO: 7675753 - DNA, 17 bp, Homo sapiens
gaacagcagaggggaca

SEQ ID NO: 7675754 - DNA, 18 bp, Homo sapiens
gaacagcaatttcatgtt

SEQ ID NO: 7675755 - DNA, 18 bp, Homo sapiens
gaacagcaatttcatgtt

SEQ ID NO: 7675756 - DNA, 22 bp, Homo sapiens
gaacagatgggctcagatcctg

SEQ ID NO: 7675757 - DNA, 22 bp, Homo sapiens
gaacagatgggctcagatcctg

SEQ ID NO: 7675758 - DNA, 18 bp, Homo sapiens
gaacagcaatttcatgtt

SEQ ID NO: 7675759 - DNA, 18 bp, Homo sapiens
gaacagcaatttcatgtt

SEQ ID NO: 7675760 - DNA, 22 bp, Homo sapiens
gaacagagttgaaacaaggctg

SEQ ID NO: 7675761 - DNA, 22 bp, Homo sapiens
gaacagatgggctcagatcctg

SEQ ID NO: 7675762 - DNA, 22 bp, Homo sapiens
gaacagatgcctgattcatagg

SEQ ID NO: 7675763 - DNA, 22 bp, Homo sapiens
gaacagatgggctcagatcctg

SEQ ID NO: 7675764 - DNA, 22 bp, Homo sapiens
gaacccggggaggttgcagtga

SEQ ID NO: 7675765 - DNA, 22 bp, Homo sapiens
gaaccccaacttataagacaga

SEQ ID NO: 7675766 - DNA, 22 bp, Homo sapiens
gaaccccaacttataagacaga

SEQ ID NO: 7675767 - DNA, 22 bp, Homo sapiens
gaacctctagtttgttctttga

SEQ ID NO: 7675768 - DNA, 22 bp, Homo sapiens
gaacctctatatttgtgacatc

SEQ ID NO: 7675769 - DNA, 22 bp, Homo sapiens
gaacccagtccaggtgcagcct

SEQ ID NO: 7675770 - DNA, 22 bp, Homo sapiens
gaacccagtccaggtgcagcct

SEQ ID NO: 7675771 - DNA, 22 bp, Homo sapiens
gaacccagtccaggtgcagcct

SEQ ID NO: 7675772 - DNA, 22 bp, Homo sapiens
gaacccaggaggttgcagtgag

SEQ ID NO: 7675773 - DNA, 22 bp, Homo sapiens
gaacccaggaggttgcagtgag

SEQ ID NO: 7675774 - DNA, 22 bp, Homo sapiens
gaacccaggaggttgcagtgag

SEQ ID NO: 7675775 - DNA, 23 bp, Homo sapiens
gaacccagctctgccacttgcca

SEQ ID NO: 7675776 - DNA, 22 bp, Homo sapiens
gaacccaggaggcagaggttgc

SEQ ID NO: 7675777 - DNA, 23 bp, Homo sapiens
gaacccagctctgccacttgcca

SEQ ID NO: 7675778 - DNA, 22 bp, Homo sapiens
gaacccagccagactccctaca

SEQ ID NO: 7675779 - DNA, 21 bp, Homo sapiens
gaacccagcagcagtgctctg

SEQ ID NO: 7675780 - DNA, 23 bp, Homo sapiens
gaacccagctctgccacttgcca

SEQ ID NO: 7675781 - DNA, 23 bp, Homo sapiens
gaacccagctctgccacttgcca

SEQ ID NO: 7675782 - DNA, 23 bp, Homo sapiens
gaacccagctctgccacttgcca

SEQ ID NO: 7675783 - DNA, 22 bp, Homo sapiens
gaacccagccagactccctaca

SEQ ID NO: 7675784 - DNA, 22 bp, Homo sapiens
gaacacatgtcctccttggatt

SEQ ID NO: 7675785 - DNA, 22 bp, Homo sapiens
gaacacatttctctgactgtag

SEQ ID NO: 7675786 - DNA, 22 bp, Homo sapiens
gaacacatttctctgactgtag

SEQ ID NO: 7675787 - DNA, 22 bp, Homo sapiens
gaacacattagtctgagttggc

SEQ ID NO: 7675788 - DNA, 22 bp, Homo sapiens
gaacacatttctctgactgtag

SEQ ID NO: 7675789 - DNA, 22 bp, Homo sapiens
gaacactgagaaagtcagcttt

SEQ ID NO: 7675790 - DNA, 22 bp, Homo sapiens
gaacactgacattttcctgact

SEQ ID NO: 7675791 - DNA, 22 bp, Homo sapiens
gaacactgacattttcctgact

SEQ ID NO: 7675792 - DNA, 22 bp, Homo sapiens
gaacactgacattttcctgact

SEQ ID NO: 7675793 - DNA, 22 bp, Homo sapiens
gaacactgagagagatgggcag

SEQ ID NO: 7675794 - DNA, 22 bp, Homo sapiens
gaacactgagaaagtcagcttt

SEQ ID NO: 7675795 - DNA, 22 bp, Homo sapiens
gaacactgagaaagtcagcttt

SEQ ID NO: 7675796 - DNA, 22 bp, Homo sapiens
gaacacagtcaagggctgctgt

SEQ ID NO: 7675797 - DNA, 22 bp, Homo sapiens
gaacacagtggttgtttggagg

SEQ ID NO: 7675798 - DNA, 22 bp, Homo sapiens
gaacacagtggttgtttggagg

SEQ ID NO: 7675799 - DNA, 22 bp, Homo sapiens
gaacacagtcaagggctgctgt

SEQ ID NO: 7675800 - DNA, 22 bp, Homo sapiens
gaacacagtgtgatcgtatgtc

SEQ ID NO: 7675801 - DNA, 22 bp, Homo sapiens
gaacacatcacattttacagtg

SEQ ID NO: 7675802 - DNA, 22 bp, Homo sapiens
gaacacagtttagaaaatgctg

SEQ ID NO: 7675803 - DNA, 22 bp, Homo sapiens
gaacacagtcaagggctgctgt

SEQ ID NO: 7675804 - DNA, 22 bp, Homo sapiens
gaacacagtacttttcctgatg

SEQ ID NO: 7675805 - DNA, 22 bp, Homo sapiens
gaacacagtcaagggctgctgt

SEQ ID NO: 7675806 - DNA, 22 bp, Homo sapiens
gaacacagtcaagggctgctgt

SEQ ID NO: 7675807 - DNA, 22 bp, Homo sapiens
gaacacagtcaagggctgctgt

SEQ ID NO: 7675808 - DNA, 22 bp, Homo sapiens
gaacacaggtggcccggcaggg

SEQ ID NO: 7675809 - DNA, 22 bp, Homo sapiens
gaacacagcggggcttacccgg

SEQ ID NO: 7675810 - DNA, 22 bp, Homo sapiens
gaacacagcggggcttacccgg

SEQ ID NO: 7675811 - DNA, 22 bp, Homo sapiens
gaacacaggtggcccggcaggg

SEQ ID NO: 7675812 - DNA, 22 bp, Homo sapiens
gaacacagtacttgttcgtctt

SEQ ID NO: 7675813 - DNA, 22 bp, Homo sapiens
gaaatacaaatgcctagatcct

SEQ ID NO: 7675814 - DNA, 22 bp, Homo sapiens
gaaatacaaatgcctagatcct

SEQ ID NO: 7675815 - DNA, 22 bp, Homo sapiens
gaaatacaaatgcctagatcct

SEQ ID NO: 7675816 - DNA, 22 bp, Homo sapiens
gaaatacaattttgtcccagct

SEQ ID NO: 7675817 - DNA, 22 bp, Homo sapiens
gaaatacaattttgtcccagct

SEQ ID NO: 7675818 - DNA, 22 bp, Homo sapiens
gaaatacaattttgtcccagct

SEQ ID NO: 7675819 - DNA, 22 bp, Homo sapiens
gaaatacaaatgcctagatcct

SEQ ID NO: 7675820 - DNA, 22 bp, Homo sapiens
gaaatacaattttgtcccagct

SEQ ID NO: 7675821 - DNA, 22 bp, Homo sapiens
gaaatacaattttgtcccagct

SEQ ID NO: 7675822 - DNA, 22 bp, Homo sapiens
gaaatacagaaagggctgaatg

SEQ ID NO: 7675823 - DNA, 22 bp, Homo sapiens
gaaatacagaaagggctgaatg

SEQ ID NO: 7675824 - DNA, 22 bp, Homo sapiens
gaaatacaattttgtcccagct

SEQ ID NO: 7675825 - DNA, 22 bp, Homo sapiens
gaaatacaattttgtcccagct

SEQ ID NO: 7675826 - DNA, 22 bp, Homo sapiens
gaaattgtgcatttagcaacac

SEQ ID NO: 7675827 - DNA, 22 bp, Homo sapiens
gaaatacagaaagggctgaatg

SEQ ID NO: 7675828 - DNA, 22 bp, Homo sapiens
gaaatacagaaagggctgaatg

SEQ ID NO: 7675829 - DNA, 22 bp, Homo sapiens
gaaatttacaactttctcatgg

SEQ ID NO: 7675830 - DNA, 22 bp, Homo sapiens
gaaatttacaactttctcatgg

SEQ ID NO: 7675831 - DNA, 22 bp, Homo sapiens
gaaatttacaactttctcatgg

SEQ ID NO: 7675832 - DNA, 22 bp, Homo sapiens
gaaattgtgcatttagcaacac

SEQ ID NO: 7675833 - DNA, 22 bp, Homo sapiens
gaaattgtggggttaaaaggct

SEQ ID NO: 7675834 - DNA, 22 bp, Homo sapiens
gaaatttattatctacatcatt

SEQ ID NO: 7675835 - DNA, 22 bp, Homo sapiens
gaaatttattatctacatcatt

SEQ ID NO: 7675836 - DNA, 22 bp, Homo sapiens
gaaatttattatctacatcatt

SEQ ID NO: 7675837 - DNA, 22 bp, Homo sapiens
gaaatttattatctacatcatt

SEQ ID NO: 7675838 - DNA, 22 bp, Homo sapiens
gaaatttacaactttctcatgg

SEQ ID NO: 7675839 - DNA, 22 bp, Homo sapiens
gaaatttacaactttctcatgg

SEQ ID NO: 7675840 - DNA, 22 bp, Homo sapiens
gaaatttacaactttctcatgg

SEQ ID NO: 7675841 - DNA, 22 bp, Homo sapiens
gaaatttacaactttctcatgg

SEQ ID NO: 7675842 - DNA, 22 bp, Homo sapiens
gaacacaactcagaatgctggt

SEQ ID NO: 7675843 - DNA, 22 bp, Homo sapiens
gaacacaagcgtatgtctttgt

SEQ ID NO: 7675844 - DNA, 22 bp, Homo sapiens
gaacacaactcagaatgctggt

SEQ ID NO: 7675845 - DNA, 22 bp, Homo sapiens
gaacacaactcagaatgctggt

SEQ ID NO: 7675846 - DNA, 22 bp, Homo sapiens
gaacacaactcagaatgctggt

SEQ ID NO: 7675847 - DNA, 22 bp, Homo sapiens
gaacacaactcagaatgctggt

SEQ ID NO: 7675848 - DNA, 22 bp, Homo sapiens
gaacacagcagggataaccact

SEQ ID NO: 7675849 - DNA, 22 bp, Homo sapiens
gaacacagcagggataaccact

SEQ ID NO: 7675850 - DNA, 22 bp, Homo sapiens
gaacacagcagggataaccact

SEQ ID NO: 7675851 - DNA, 22 bp, Homo sapiens
gaacacaagcgtatgtctttgt

SEQ ID NO: 7675852 - DNA, 22 bp, Homo sapiens
gaacacagaagaatttctaaga

SEQ ID NO: 7675853 - DNA, 22 bp, Homo sapiens
gaacacagaagaatttctaaga

SEQ ID NO: 7675854 - DNA, 22 bp, Homo sapiens
gaacacagaagaatttctaaga

SEQ ID NO: 7675855 - DNA, 22 bp, Homo sapiens
gaaatacaaagccagccatttt

SEQ ID NO: 7675856 - DNA, 22 bp, Homo sapiens
gaaatacaaagccagccatttt

SEQ ID NO: 7675857 - DNA, 22 bp, Homo sapiens
gaaatacaaagccagccatttt

SEQ ID NO: 7675858 - DNA, 22 bp, Homo sapiens
gaaatacaaatgcctagatcct

SEQ ID NO: 7675859 - DNA, 22 bp, Homo sapiens
gaaatacaaatgcctagatcct

SEQ ID NO: 7675860 - DNA, 22 bp, Homo sapiens
gaaatacaaatgcctagatcct

SEQ ID NO: 7675861 - DNA, 22 bp, Homo sapiens
gaaatacaaatgcctagatcct

SEQ ID NO: 7675862 - DNA, 22 bp, Homo sapiens
gaaatacaaatgcctagatcct

SEQ ID NO: 7675863 - DNA, 22 bp, Homo sapiens
gaaatacaaatgcctagatcct

SEQ ID NO: 7675864 - DNA, 22 bp, Homo sapiens
gaaatacaaatgcctagatcct

SEQ ID NO: 7675865 - DNA, 22 bp, Homo sapiens
gaaatacaaagccagccatttt

SEQ ID NO: 7675866 - DNA, 22 bp, Homo sapiens
gaaatacaaagccagccatttt

SEQ ID NO: 7675867 - DNA, 22 bp, Homo sapiens
gaaatacaaagccagccatttt

SEQ ID NO: 7675868 - DNA, 22 bp, Homo sapiens
gaaatacaaagccagccatttt

SEQ ID NO: 7675869 - DNA, 22 bp, Homo sapiens
gaaatacaaagccagccatttt

SEQ ID NO: 7675870 - DNA, 22 bp, Homo sapiens
gaaatacaaagccagccatttt

SEQ ID NO: 7675871 - DNA, 22 bp, Homo sapiens
gaaatacaaagccagccatttt

SEQ ID NO: 7675872 - DNA, 22 bp, Homo sapiens
gaaatacaaagccagccatttt

SEQ ID NO: 7675873 - DNA, 22 bp, Homo sapiens
gaaataatttagaaggtattcc

SEQ ID NO: 7675874 - DNA, 22 bp, Homo sapiens
gaaataattctgtgtctgaaca

SEQ ID NO: 7675875 - DNA, 22 bp, Homo sapiens
gaaataattctgtgtctgaaca

SEQ ID NO: 7675876 - DNA, 22 bp, Homo sapiens
gaaataatttagaaggtattcc

SEQ ID NO: 7675877 - DNA, 22 bp, Homo sapiens
gaaataatttagaaggtattcc

SEQ ID NO: 7675878 - DNA, 22 bp, Homo sapiens
gaaataatttagaaggtattcc

SEQ ID NO: 7675879 - DNA, 22 bp, Homo sapiens
gaaataatttagaaggtattcc

SEQ ID NO: 7675880 - DNA, 22 bp, Homo sapiens
gaaataattctgtgtctgaaca

SEQ ID NO: 7675881 - DNA, 22 bp, Homo sapiens
gaaataattctgtgtctgaaca

SEQ ID NO: 7675882 - DNA, 22 bp, Homo sapiens
gaaataattctgtgtctgaaca

SEQ ID NO: 7675883 - DNA, 22 bp, Homo sapiens
gaaataattctgtgtctgaaca

SEQ ID NO: 7675884 - DNA, 22 bp, Homo sapiens
gaaataagagtccatgccaggt

SEQ ID NO: 7675885 - DNA, 22 bp, Homo sapiens
gaaataatacagtgctcttctc

SEQ ID NO: 7675886 - DNA, 22 bp, Homo sapiens
gaaataagagtccatgccaggt

SEQ ID NO: 7675887 - DNA, 22 bp, Homo sapiens
gaaataagagtccatgccaggt

SEQ ID NO: 7675888 - DNA, 22 bp, Homo sapiens
gaaataagagtccatgccaggt

SEQ ID NO: 7675889 - DNA, 22 bp, Homo sapiens
gaaataatacagtgctcttctc

SEQ ID NO: 7675890 - DNA, 22 bp, Homo sapiens
gaaataatacagtgctcttctc

SEQ ID NO: 7675891 - DNA, 22 bp, Homo sapiens
gaaataatacagtgctcttctc

SEQ ID NO: 7675892 - DNA, 22 bp, Homo sapiens
gaaataatacagtgctcttctc

SEQ ID NO: 7675893 - DNA, 22 bp, Homo sapiens
gaaataatacagtgctcttctc

SEQ ID NO: 7675894 - DNA, 22 bp, Homo sapiens
gaaataacagctctggaagagt

SEQ ID NO: 7675895 - DNA, 22 bp, Homo sapiens
gaaagttttctcacacagtaat

SEQ ID NO: 7675896 - DNA, 22 bp, Homo sapiens
gaaagttttctcacacagtaat

SEQ ID NO: 7675897 - DNA, 22 bp, Homo sapiens
gaaataacctcatgcaccatga

SEQ ID NO: 7675898 - DNA, 22 bp, Homo sapiens
gaaataacctcatgcaccatga

SEQ ID NO: 7675899 - DNA, 22 bp, Homo sapiens
gaaataacagctctggaagagt

SEQ ID NO: 7675900 - DNA, 22 bp, Homo sapiens
gaaataacagctctggaagagt

SEQ ID NO: 7675901 - DNA, 22 bp, Homo sapiens
gaaataacctcatgcaccatga

SEQ ID NO: 7675902 - DNA, 22 bp, Homo sapiens
gaaagtttcttcattaagatgt

SEQ ID NO: 7675903 - DNA, 22 bp, Homo sapiens
gaaagtttcttcattaagatgt

SEQ ID NO: 7675904 - DNA, 17 bp, Homo sapiens
gaaagtttctctctctt

SEQ ID NO: 7675905 - DNA, 22 bp, Homo sapiens
gaaagtttcttcattaagatgt

SEQ ID NO: 7675906 - DNA, 22 bp, Homo sapiens
gaaagtttcttcattaagatgt

SEQ ID NO: 7675907 - DNA, 17 bp, Homo sapiens
gaaagtttctctctctt

SEQ ID NO: 7675908 - DNA, 17 bp, Homo sapiens
gaaagtttctctctctt

SEQ ID NO: 7675909 - DNA, 22 bp, Homo sapiens
gaaagtttgcctctctcttgag

SEQ ID NO: 7675910 - DNA, 22 bp, Homo sapiens
gaaagtttgcctctctcttgag

SEQ ID NO: 7675911 - DNA, 22 bp, Homo sapiens
gaaagtttgcctctctcttgag

SEQ ID NO: 7675912 - DNA, 22 bp, Homo sapiens
gaaagtttgcctctctcttgag

SEQ ID NO: 7675913 - DNA, 22 bp, Homo sapiens
gaaagtttcttcattaagatgt

SEQ ID NO: 7675914 - DNA, 22 bp, Homo sapiens
gaaagtttcttcattaagatgt

SEQ ID NO: 7675915 - DNA, 22 bp, Homo sapiens
gaaagtttcttcattaagatgt

SEQ ID NO: 7675916 - DNA, 22 bp, Homo sapiens
gaaagtttcttcattaagatgt

SEQ ID NO: 7675917 - DNA, 22 bp, Homo sapiens
gaaagttttcatatataccaaa

SEQ ID NO: 7675918 - DNA, 22 bp, Homo sapiens
gaaagttttcatatataccaaa

SEQ ID NO: 7675919 - DNA, 22 bp, Homo sapiens
gaaagtttgcctctctcttgag

SEQ ID NO: 7675920 - DNA, 22 bp, Homo sapiens
gaaagttttcatatataccaaa

SEQ ID NO: 7675921 - DNA, 22 bp, Homo sapiens
gaaagttttcatatataccaaa

SEQ ID NO: 7675922 - DNA, 22 bp, Homo sapiens
gaaagttttcatatataccaaa

SEQ ID NO: 7675923 - DNA, 22 bp, Homo sapiens
gaaagttttctcacacagtaat

SEQ ID NO: 7675924 - DNA, 22 bp, Homo sapiens
gaaagttttctcacacagtaat

SEQ ID NO: 7675925 - DNA, 22 bp, Homo sapiens
gaaagttttctcacacagtaat

SEQ ID NO: 7675926 - DNA, 22 bp, Homo sapiens
gaaagttttctcacacagtaat

SEQ ID NO: 7675927 - DNA, 22 bp, Homo sapiens
gaaagttatatcatgattttag

SEQ ID NO: 7675928 - DNA, 22 bp, Homo sapiens
gaaagttacagaaaccattagt

SEQ ID NO: 7675929 - DNA, 22 bp, Homo sapiens
gaaagtgctctctctatacaca

SEQ ID NO: 7675930 - DNA, 18 bp, Homo sapiens
gaaagtgttgctggtttt

SEQ ID NO: 7675931 - DNA, 22 bp, Homo sapiens
gaaagtgcttttgagtgtgtgc

SEQ ID NO: 7675932 - DNA, 22 bp, Homo sapiens
gaaagtgcttttgagtgtgtgc

SEQ ID NO: 7675933 - DNA, 22 bp, Homo sapiens
gaaagtgcttttgagtgtgtgc

SEQ ID NO: 7675934 - DNA, 22 bp, Homo sapiens
gaaagtgcttttgagtgtgtgc

SEQ ID NO: 7675935 - DNA, 22 bp, Homo sapiens
gaaagtgcttttgagtgtgtgc

SEQ ID NO: 7675936 - DNA, 22 bp, Homo sapiens
gaaagtgcttttgagtgtgtgc

SEQ ID NO: 7675937 - DNA, 22 bp, Homo sapiens
gaaagtgcttagagtgtggtat

SEQ ID NO: 7675938 - DNA, 22 bp, Homo sapiens
gaaagtgcttagagtgtggtat

SEQ ID NO: 7675939 - DNA, 22 bp, Homo sapiens
gaaagtgcttagagtgtggtat

SEQ ID NO: 7675940 - DNA, 22 bp, Homo sapiens
gaaagtgcttagagtgtggtat

SEQ ID NO: 7675941 - DNA, 22 bp, Homo sapiens
gaaagtgctctctctatacaca

SEQ ID NO: 7675942 - DNA, 22 bp, Homo sapiens
gaaagtgcttagagtgtggtat

SEQ ID NO: 7675943 - DNA, 22 bp, Homo sapiens
gaaagtgcttagagtgtggtat

SEQ ID NO: 7675944 - DNA, 22 bp, Homo sapiens
gaaagtgctctctctatacaca

SEQ ID NO: 7675945 - DNA, 22 bp, Homo sapiens
gaaagtgctctctctatacaca

SEQ ID NO: 7675946 - DNA, 22 bp, Homo sapiens
gaaagtgctctctctatacaca

SEQ ID NO: 7675947 - DNA, 22 bp, Homo sapiens
gaaagtgctaggaagtgttaga

SEQ ID NO: 7675948 - DNA, 22 bp, Homo sapiens
gaaagtgctaggaagtgttaga

SEQ ID NO: 7675949 - DNA, 22 bp, Homo sapiens
gaaagtgctaggaagtgttaga

SEQ ID NO: 7675950 - DNA, 18 bp, Homo sapiens
gaaagtgcggggcagggg

SEQ ID NO: 7675951 - DNA, 22 bp, Homo sapiens
gaaagtgctaggaagtgttaga

SEQ ID NO: 7675952 - DNA, 22 bp, Homo sapiens
gaaagtgctaggaagtgttaga

SEQ ID NO: 7675953 - DNA, 18 bp, Homo sapiens
gaaagtgcggggcagggg

SEQ ID NO: 7675954 - DNA, 22 bp, Homo sapiens
gaaagttattgaaccttattta

SEQ ID NO: 7675955 - DNA, 22 bp, Homo sapiens
gaaagttattcagcctctctga

SEQ ID NO: 7675956 - DNA, 22 bp, Homo sapiens
gaaagttattgaaccttattta

SEQ ID NO: 7675957 - DNA, 22 bp, Homo sapiens
gaaagttcacacatccacatgg

SEQ ID NO: 7675958 - DNA, 22 bp, Homo sapiens
gaaagttgcaatcatggctttt

SEQ ID NO: 7675959 - DNA, 22 bp, Homo sapiens
gaaagtttataggttatataat

SEQ ID NO: 7675960 - DNA, 22 bp, Homo sapiens
gaaagtttataggttatataat

SEQ ID NO: 7675961 - DNA, 22 bp, Homo sapiens
gaaagtttataggttatataat

SEQ ID NO: 7675962 - DNA, 22 bp, Homo sapiens
gaaagtttctcacacatgcaga

SEQ ID NO: 7675963 - DNA, 22 bp, Homo sapiens
gaaagtttctcacacatgcaga

SEQ ID NO: 7675964 - DNA, 22 bp, Homo sapiens
gaaagtttctcacacatgcaga

SEQ ID NO: 7675965 - DNA, 22 bp, Homo sapiens
gaaagtttctcacacatgcaga

SEQ ID NO: 7675966 - DNA, 22 bp, Homo sapiens
gaaagtttctcacacatgcaga

SEQ ID NO: 7675967 - DNA, 22 bp, Homo sapiens
gaaagtttataggttatataat

SEQ ID NO: 7675968 - DNA, 22 bp, Homo sapiens
gaaagtttataggttatataat

SEQ ID NO: 7675969 - DNA, 22 bp, Homo sapiens
gaaagtttataggttatataat

SEQ ID NO: 7675970 - DNA, 22 bp, Homo sapiens
gaaagtttataggttatataat

SEQ ID NO: 7675971 - DNA, 22 bp, Homo sapiens
gaaagtttataggttatataat

SEQ ID NO: 7675972 - DNA, 22 bp, Homo sapiens
gaaagggtctttgatttccctc

SEQ ID NO: 7675973 - DNA, 22 bp, Homo sapiens
gaaaggtgccccataggcagga

SEQ ID NO: 7675974 - DNA, 21 bp, Homo sapiens
gaaaggtcttaacttacagag

SEQ ID NO: 7675975 - DNA, 22 bp, Homo sapiens
gaaagggcatgggcatgacaac

SEQ ID NO: 7675976 - DNA, 22 bp, Homo sapiens
gaaaggggcatgtagggatcac

SEQ ID NO: 7675977 - DNA, 22 bp, Homo sapiens
gaaaggggcatgtagggatcac

SEQ ID NO: 7675978 - DNA, 22 bp, Homo sapiens
gaaaggggcatgtagggatcac

SEQ ID NO: 7675979 - DNA, 22 bp, Homo sapiens
gaaagggataccatgttacttg

SEQ ID NO: 7675980 - DNA, 22 bp, Homo sapiens
gaaagggataccatgttacttg

SEQ ID NO: 7675981 - DNA, 22 bp, Homo sapiens
gaaagggataccatgttacttg

SEQ ID NO: 7675982 - DNA, 22 bp, Homo sapiens
gaaagggagtggacaacaggca

SEQ ID NO: 7675983 - DNA, 22 bp, Homo sapiens
gaaagggagtggacaacaggca

SEQ ID NO: 7675984 - DNA, 22 bp, Homo sapiens
gaaagggagtggacaacaggca

SEQ ID NO: 7675985 - DNA, 22 bp, Homo sapiens
gaaagggagtggacaacaggca

SEQ ID NO: 7675986 - DNA, 22 bp, Homo sapiens
gaaagggagtggacaacaggca

SEQ ID NO: 7675987 - DNA, 22 bp, Homo sapiens
gaaagtgcctcagtcctcttat

SEQ ID NO: 7675988 - DNA, 22 bp, Homo sapiens
gaaagtgcctcagtcctcttat

SEQ ID NO: 7675989 - DNA, 22 bp, Homo sapiens
gaaagtgcctcagtcctcttat

SEQ ID NO: 7675990 - DNA, 18 bp, Homo sapiens
gaaagtgcggggcagggg

SEQ ID NO: 7675991 - DNA, 18 bp, Homo sapiens
gaaagtgcggggcagggg

SEQ ID NO: 7675992 - DNA, 18 bp, Homo sapiens
gaaagtgcggggcagggg

SEQ ID NO: 7675993 - DNA, 18 bp, Homo sapiens
gaaagtgcggggcagggg

SEQ ID NO: 7675994 - DNA, 22 bp, Homo sapiens
gaaagtgcctcagtcctcttat

SEQ ID NO: 7675995 - DNA, 22 bp, Homo sapiens
gaaagtgccagaataggaggcc

SEQ ID NO: 7675996 - DNA, 22 bp, Homo sapiens
gaaagtgcctcagtcctcttat

SEQ ID NO: 7675997 - DNA, 22 bp, Homo sapiens
gaaagtgccagaataggaggcc

SEQ ID NO: 7675998 - DNA, 22 bp, Homo sapiens
gaaagtgccagaataggaggcc

SEQ ID NO: 7675999 - DNA, 22 bp, Homo sapiens
gaaagtgcatgtgcccaccatt

SEQ ID NO: 7676000 - DNA, 22 bp, Homo sapiens
gaaagtgcatgtgcccaccatt

SEQ ID NO: 7676001 - DNA, 22 bp, Homo sapiens
gaaagtgccagaataggaggcc

SEQ ID NO: 7676002 - DNA, 22 bp, Homo sapiens
gaaagtgccagaataggaggcc

SEQ ID NO: 7676003 - DNA, 22 bp, Homo sapiens
gaaagtgcatgtgcccaccatt

SEQ ID NO: 7676004 - DNA, 22 bp, Homo sapiens
gaaaggttcttgggagttcaca

SEQ ID NO: 7676005 - DNA, 22 bp, Homo sapiens
gaaagtgcatgtgcccaccatt

SEQ ID NO: 7676006 - DNA, 22 bp, Homo sapiens
gaaaggttgggtgaatggtgga

SEQ ID NO: 7676007 - DNA, 22 bp, Homo sapiens
gaaaggttgggtgaatggtgga

SEQ ID NO: 7676008 - DNA, 22 bp, Homo sapiens
gaaaggttcttgggagttcaca

SEQ ID NO: 7676009 - DNA, 22 bp, Homo sapiens
gaaaggtgccccataggcagga

SEQ ID NO: 7676010 - DNA, 22 bp, Homo sapiens
gaaaggcagtacagctgagcct

SEQ ID NO: 7676011 - DNA, 22 bp, Homo sapiens
gaaaggcagtacagctgagcct

SEQ ID NO: 7676012 - DNA, 22 bp, Homo sapiens
gaaaggcatcttcagtctctga

SEQ ID NO: 7676013 - DNA, 22 bp, Homo sapiens
gaaaggcatcttcagtctctga

SEQ ID NO: 7676014 - DNA, 22 bp, Homo sapiens
gaaaggcatcttcagtctctga

SEQ ID NO: 7676015 - DNA, 22 bp, Homo sapiens
gaaaatacttcagtgttctggc

SEQ ID NO: 7676016 - DNA, 22 bp, Homo sapiens
gaaaggcagtacagctgagcct

SEQ ID NO: 7676017 - DNA, 22 bp, Homo sapiens
gaaaggcagtacagctgagcct

SEQ ID NO: 7676018 - DNA, 22 bp, Homo sapiens
gaaaggcagtacagctgagcct

SEQ ID NO: 7676019 - DNA, 21 bp, Homo sapiens
gaaaatacaatgagcttgacc

SEQ ID NO: 7676020 - DNA, 21 bp, Homo sapiens
gaaaatacaatgagcttgacc

SEQ ID NO: 7676021 - DNA, 18 bp, Homo sapiens
gaaaatactctgggctca

SEQ ID NO: 7676022 - DNA, 18 bp, Homo sapiens
gaaaatactctgggctca

SEQ ID NO: 7676023 - DNA, 18 bp, Homo sapiens
gaaaatactctgggctca

SEQ ID NO: 7676024 - DNA, 18 bp, Homo sapiens
gaaaatactctgggctca

SEQ ID NO: 7676025 - DNA, 22 bp, Homo sapiens
gaaaatacaaatagccttgaaa

SEQ ID NO: 7676026 - DNA, 22 bp, Homo sapiens
gaaaatacaaatagccttgaaa

SEQ ID NO: 7676027 - DNA, 22 bp, Homo sapiens
gaaaatacaaatagccttgaaa

SEQ ID NO: 7676028 - DNA, 22 bp, Homo sapiens
gaaaatacaaatagccttgaaa

SEQ ID NO: 7676029 - DNA, 21 bp, Homo sapiens
gaaaatacaatgagcttgacc

SEQ ID NO: 7676030 - DNA, 21 bp, Homo sapiens
gaaaatacaatgagcttgacc

SEQ ID NO: 7676031 - DNA, 21 bp, Homo sapiens
gaaaatacaatgagcttgacc

SEQ ID NO: 7676032 - DNA, 22 bp, Homo sapiens
gaaaagttcatcatatattcag

SEQ ID NO: 7676033 - DNA, 22 bp, Homo sapiens
gaaaagttcatcatatattcag

SEQ ID NO: 7676034 - DNA, 22 bp, Homo sapiens
gaaaagggcaagagagagggca

SEQ ID NO: 7676035 - DNA, 22 bp, Homo sapiens
gaaaagttcatcatatattcag

SEQ ID NO: 7676036 - DNA, 22 bp, Homo sapiens
gaaaagttcatcatatattcag

SEQ ID NO: 7676037 - DNA, 22 bp, Homo sapiens
gaaaagttcatcatatattcag

SEQ ID NO: 7676038 - DNA, 22 bp, Homo sapiens
gaaaagtatgtttattttgact

SEQ ID NO: 7676039 - DNA, 22 bp, Homo sapiens
gaaaagtatgtttattttgact

SEQ ID NO: 7676040 - DNA, 22 bp, Homo sapiens
gaaaagtatgtttattttgact

SEQ ID NO: 7676041 - DNA, 22 bp, Homo sapiens
gaaaggccacgtgccaagatta

SEQ ID NO: 7676042 - DNA, 22 bp, Homo sapiens
gaaaggccaccatgccagggac

SEQ ID NO: 7676043 - DNA, 22 bp, Homo sapiens
gaaaggccatttctgagggttt

SEQ ID NO: 7676044 - DNA, 22 bp, Homo sapiens
gaaaggctaaaattataagggt

SEQ ID NO: 7676045 - DNA, 22 bp, Homo sapiens
gaaaggctaaaattataagggt

SEQ ID NO: 7676046 - DNA, 22 bp, Homo sapiens
gaaaggctactgtcatcaatta

SEQ ID NO: 7676047 - DNA, 22 bp, Homo sapiens
gaaaggctactgtcatcaatta

SEQ ID NO: 7676048 - DNA, 22 bp, Homo sapiens
gaaaggctactgtcatcaatta

SEQ ID NO: 7676049 - DNA, 22 bp, Homo sapiens
gaaaggctaaaattataagggt

SEQ ID NO: 7676050 - DNA, 23 bp, Homo sapiens
gaaaggctctgggacccccaact

SEQ ID NO: 7676051 - DNA, 23 bp, Homo sapiens
gaaaggctctgggacccccaact

SEQ ID NO: 7676052 - DNA, 23 bp, Homo sapiens
gaaaggctctgggacccccaact

SEQ ID NO: 7676053 - DNA, 22 bp, Homo sapiens
gaaaggctcagattcccccagg

SEQ ID NO: 7676054 - DNA, 22 bp, Homo sapiens
gaaaggctcagattcccccagg

SEQ ID NO: 7676055 - DNA, 22 bp, Homo sapiens
gaaaggctcagattcccccagg

SEQ ID NO: 7676056 - DNA, 22 bp, Homo sapiens
gaaaggctcagaagtttgtatt

SEQ ID NO: 7676057 - DNA, 22 bp, Homo sapiens
gaaaggctcagaagtttgtatt

SEQ ID NO: 7676058 - DNA, 22 bp, Homo sapiens
gaaaggctcactttagatcatg

SEQ ID NO: 7676059 - DNA, 22 bp, Homo sapiens
gaaaggctcactttagatcatg

SEQ ID NO: 7676060 - DNA, 22 bp, Homo sapiens
gaaaggctcactttagatcatg

SEQ ID NO: 7676061 - DNA, 22 bp, Homo sapiens
gaaaggctatgagtttggtata

SEQ ID NO: 7676062 - DNA, 22 bp, Homo sapiens
gaaaggctatgagtttggtata

SEQ ID NO: 7676063 - DNA, 22 bp, Homo sapiens
gaaagggagtgaagatggtata

SEQ ID NO: 7676064 - DNA, 22 bp, Homo sapiens
gaaagggagtgaagatggtata

SEQ ID NO: 7676065 - DNA, 22 bp, Homo sapiens
gaaagggagtgaagatggtata

SEQ ID NO: 7676066 - DNA, 22 bp, Homo sapiens
gaaagggagtgaagatggtata

SEQ ID NO: 7676067 - DNA, 22 bp, Homo sapiens
gaaagggagtgaagatggtata

SEQ ID NO: 7676068 - DNA, 22 bp, Homo sapiens
gaaagggagtgaagatggtata

SEQ ID NO: 7676069 - DNA, 22 bp, Homo sapiens
gaaaggcttggttttgaatata

SEQ ID NO: 7676070 - DNA, 22 bp, Homo sapiens
gaaaggcttggttttgaatata

SEQ ID NO: 7676071 - DNA, 22 bp, Homo sapiens
gaaaggcttggttttgaatata

SEQ ID NO: 7676072 - DNA, 22 bp, Homo sapiens
gaaaggcttgcttttgctcggt

SEQ ID NO: 7676073 - DNA, 22 bp, Homo sapiens
gaaaggcttgcttttgctcggt

SEQ ID NO: 7676074 - DNA, 22 bp, Homo sapiens
gaaaggcttgagacattgatga

SEQ ID NO: 7676075 - DNA, 22 bp, Homo sapiens
gaaaggcttgagacattgatga

SEQ ID NO: 7676076 - DNA, 22 bp, Homo sapiens
gaaaggcttcttaagcttcact

SEQ ID NO: 7676077 - DNA, 22 bp, Homo sapiens
gaaaggcttcttaagcttcact

SEQ ID NO: 7676078 - DNA, 22 bp, Homo sapiens
gaaaggcttaaattgtaagggc

SEQ ID NO: 7676079 - DNA, 22 bp, Homo sapiens
gaaaggcttaaattgtaagggc

SEQ ID NO: 7676080 - DNA, 22 bp, Homo sapiens
gaaaggctgggatttagcgctg

SEQ ID NO: 7676081 - DNA, 22 bp, Homo sapiens
gaaaggctgggatttagcgctg

SEQ ID NO: 7676082 - DNA, 19 bp, Homo sapiens
gaaaggctgctgctacctg

SEQ ID NO: 7676083 - DNA, 19 bp, Homo sapiens
gaaaggctgctgctacctg

SEQ ID NO: 7676084 - DNA, 22 bp, Homo sapiens
gaaaggctgcatctcgcctcag

SEQ ID NO: 7676085 - DNA, 22 bp, Homo sapiens
gaaaggctgcatctcgcctcag

SEQ ID NO: 7676086 - DNA, 22 bp, Homo sapiens
gaaaggctgcatctcgcctcag

SEQ ID NO: 7676087 - DNA, 22 bp, Homo sapiens
ctttgttctgccaatggcccat

SEQ ID NO: 7676088 - DNA, 22 bp, Homo sapiens
ctttgttctgcacacacagaca

SEQ ID NO: 7676089 - DNA, 22 bp, Homo sapiens
ctttgttcatgacatctgcttc

SEQ ID NO: 7676090 - DNA, 22 bp, Homo sapiens
ctttgttcatgacatctgcttc

SEQ ID NO: 7676091 - DNA, 22 bp, Homo sapiens
ctttgttctgcacacacagaca

SEQ ID NO: 7676092 - DNA, 22 bp, Homo sapiens
ctttgttatctgtaaatggtta

SEQ ID NO: 7676093 - DNA, 22 bp, Homo sapiens
ctttgttcatgacatctgcttc

SEQ ID NO: 7676094 - DNA, 22 bp, Homo sapiens
ctttgttcatgacatctgcttc

SEQ ID NO: 7676095 - DNA, 22 bp, Homo sapiens
ctttgttatctgtaaatggtta

SEQ ID NO: 7676096 - DNA, 22 bp, Homo sapiens
ctttgttatctgtaaatggtta

SEQ ID NO: 7676097 - DNA, 22 bp, Homo sapiens
ctttgttgttaattggcgctta

SEQ ID NO: 7676098 - DNA, 22 bp, Homo sapiens
ctttgttgtgcctgagtgcacc

SEQ ID NO: 7676099 - DNA, 22 bp, Homo sapiens
ctttgtttatatttctcctcga

SEQ ID NO: 7676100 - DNA, 22 bp, Homo sapiens
ctttgtttatatttctcctcga

SEQ ID NO: 7676101 - DNA, 22 bp, Homo sapiens
ctttgtttatatttctcctcga

SEQ ID NO: 7676102 - DNA, 22 bp, Homo sapiens
ctttgtttatatttctcctcga

SEQ ID NO: 7676103 - DNA, 22 bp, Homo sapiens
ctttgttttactcagaggcatg

SEQ ID NO: 7676104 - DNA, 22 bp, Homo sapiens
ctttgtttatatttctcctcga

SEQ ID NO: 7676105 - DNA, 22 bp, Homo sapiens
ctttgtttatatttctcctcga

SEQ ID NO: 7676106 - DNA, 22 bp, Homo sapiens
ctttgtctcctaagaactctca

SEQ ID NO: 7676107 - DNA, 22 bp, Homo sapiens
ctttgtgatagtgttaagacca

SEQ ID NO: 7676108 - DNA, 22 bp, Homo sapiens
ctttgttaggggctcagggtgg

SEQ ID NO: 7676109 - DNA, 22 bp, Homo sapiens
ctttgttagcagccaatttgtt

SEQ ID NO: 7676110 - DNA, 22 bp, Homo sapiens
ctttgttactgatttcagtggg

SEQ ID NO: 7676111 - DNA, 22 bp, Homo sapiens
ctttgttagcagccaatttgtt

SEQ ID NO: 7676112 - DNA, 22 bp, Homo sapiens
ctttgttagcagccaatttgtt

SEQ ID NO: 7676113 - DNA, 22 bp, Homo sapiens
ctttgtgtctgttaataattat

SEQ ID NO: 7676114 - DNA, 22 bp, Homo sapiens
ctttgtgtctgttaataattat

SEQ ID NO: 7676115 - DNA, 22 bp, Homo sapiens
ctttgtggctcctgcaggccat

SEQ ID NO: 7676116 - DNA, 22 bp, Homo sapiens
ctttgtgtctgttaataattat

SEQ ID NO: 7676117 - DNA, 22 bp, Homo sapiens
cttttaagggataataagatgt

SEQ ID NO: 7676118 - DNA, 22 bp, Homo sapiens
cttttaagggataataagatgt

SEQ ID NO: 7676119 - DNA, 22 bp, Homo sapiens
cttttaatgagcattgctgtct

SEQ ID NO: 7676120 - DNA, 22 bp, Homo sapiens
cttttaatgagcattgctgtct

SEQ ID NO: 7676121 - DNA, 22 bp, Homo sapiens
cttttaatgagcattgctgtct

SEQ ID NO: 7676122 - DNA, 22 bp, Homo sapiens
cttttaatgagcattgctgtct

SEQ ID NO: 7676123 - DNA, 23 bp, Homo sapiens
cttttaacttgatctgagaccag

SEQ ID NO: 7676124 - DNA, 23 bp, Homo sapiens
cttttaacttgatctgagaccag

SEQ ID NO: 7676125 - DNA, 22 bp, Homo sapiens
cttttaagggataataagatgt

SEQ ID NO: 7676126 - DNA, 22 bp, Homo sapiens
cttttaagggataataagatgt

SEQ ID NO: 7676127 - DNA, 22 bp, Homo sapiens
cttttaagggataataagatgt

SEQ ID NO: 7676128 - DNA, 22 bp, Homo sapiens
ctttgttttactcagaggcatg

SEQ ID NO: 7676129 - DNA, 22 bp, Homo sapiens
ctttgttttactcagaggcatg

SEQ ID NO: 7676130 - DNA, 22 bp, Homo sapiens
ctttgttttactcagaggcatg

SEQ ID NO: 7676131 - DNA, 22 bp, Homo sapiens
ctttgttttactcagaggcatg

SEQ ID NO: 7676132 - DNA, 22 bp, Homo sapiens
ctttgttttactcagaggcatg

SEQ ID NO: 7676133 - DNA, 23 bp, Homo sapiens
cttttaactagagtatcagctgc

SEQ ID NO: 7676134 - DNA, 23 bp, Homo sapiens
cttttaaccggcatgggagggca

SEQ ID NO: 7676135 - DNA, 22 bp, Homo sapiens
cttttaatgggagcagtatttg

SEQ ID NO: 7676136 - DNA, 22 bp, Homo sapiens
cttttaatgggagcagtatttg

SEQ ID NO: 7676137 - DNA, 17 bp, Homo sapiens
cttttaatttacttccc

SEQ ID NO: 7676138 - DNA, 17 bp, Homo sapiens
cttttaatttacttccc

SEQ ID NO: 7676139 - DNA, 17 bp, Homo sapiens
cttttaatttacttccc

SEQ ID NO: 7676140 - DNA, 17 bp, Homo sapiens
cttttaatttacttccc

SEQ ID NO: 7676141 - DNA, 22 bp, Homo sapiens
cttttaatgggagcagtatttg

SEQ ID NO: 7676142 - DNA, 22 bp, Homo sapiens
cttttaatgggagcagtatttg

SEQ ID NO: 7676143 - DNA, 22 bp, Homo sapiens
cttttaatgagcattgctgtct

SEQ ID NO: 7676144 - DNA, 22 bp, Homo sapiens
cttttaatgggagcagtatttg

SEQ ID NO: 7676145 - DNA, 22 bp, Homo sapiens
cttttaatgggagcagtatttg

SEQ ID NO: 7676146 - DNA, 22 bp, Homo sapiens
cttttaatgggagcagtatttg

SEQ ID NO: 7676147 - DNA, 22 bp, Homo sapiens
cttttacactcatctgggaggg

SEQ ID NO: 7676148 - DNA, 17 bp, Homo sapiens
cttttaatttacttccc

SEQ ID NO: 7676149 - DNA, 17 bp, Homo sapiens
cttttaatttacttccc

SEQ ID NO: 7676150 - DNA, 17 bp, Homo sapiens
cttttaatttacttccc

SEQ ID NO: 7676151 - DNA, 22 bp, Homo sapiens
gaaaacatccagagatagacct

SEQ ID NO: 7676152 - DNA, 22 bp, Homo sapiens
gaaaacactttgatctgaaagt

SEQ ID NO: 7676153 - DNA, 22 bp, Homo sapiens
gaaaacactttgatctgaaagt

SEQ ID NO: 7676154 - DNA, 22 bp, Homo sapiens
gaaaacactttgatctgaaagt

SEQ ID NO: 7676155 - DNA, 22 bp, Homo sapiens
cttttacactcatctgggaggg

SEQ ID NO: 7676156 - DNA, 22 bp, Homo sapiens
cttttacactcatctgggaggg

SEQ ID NO: 7676157 - DNA, 22 bp, Homo sapiens
gaaaaggattggtaaaatatct

SEQ ID NO: 7676158 - DNA, 22 bp, Homo sapiens
gaaaaggcagagttccggggaa

SEQ ID NO: 7676159 - DNA, 22 bp, Homo sapiens
gaaaaggcagagttccggggaa

SEQ ID NO: 7676160 - DNA, 22 bp, Homo sapiens
gaaaaggattggtaaaatatct

SEQ ID NO: 7676161 - DNA, 22 bp, Homo sapiens
gaaaaggaaatttatagagatc

SEQ ID NO: 7676162 - DNA, 22 bp, Homo sapiens
gaaaaggattggtaaaatatct

SEQ ID NO: 7676163 - DNA, 22 bp, Homo sapiens
gaaaaggattggtaaaatatct

SEQ ID NO: 7676164 - DNA, 22 bp, Homo sapiens
gaaaaggattggtaaaatatct

SEQ ID NO: 7676165 - DNA, 22 bp, Homo sapiens
gaaaaggaaatttatagagatc

SEQ ID NO: 7676166 - DNA, 22 bp, Homo sapiens
gaaaaggccactcctaggagct

SEQ ID NO: 7676167 - DNA, 22 bp, Homo sapiens
gaaaaggccactcctaggagct

SEQ ID NO: 7676168 - DNA, 22 bp, Homo sapiens
gaaaaggccactcctaggagct

SEQ ID NO: 7676169 - DNA, 22 bp, Homo sapiens
gaaaaggccactcctaggagct

SEQ ID NO: 7676170 - DNA, 22 bp, Homo sapiens
gaaaaggcctggggcaaagtgt

SEQ ID NO: 7676171 - DNA, 22 bp, Homo sapiens
gaaaaggcctggggcaaagtgt

SEQ ID NO: 7676172 - DNA, 22 bp, Homo sapiens
gaaaaggcctccccataggaat

SEQ ID NO: 7676173 - DNA, 22 bp, Homo sapiens
gaaaaggcctccccataggaat

SEQ ID NO: 7676174 - DNA, 22 bp, Homo sapiens
gaaaaggcctccccataggaat

SEQ ID NO: 7676175 - DNA, 22 bp, Homo sapiens
gaaaaggcctccccataggaat

SEQ ID NO: 7676176 - DNA, 22 bp, Homo sapiens
gaaaagtacacagcccaaacat

SEQ ID NO: 7676177 - DNA, 22 bp, Homo sapiens
gaaaagtaaacactaggggtca

SEQ ID NO: 7676178 - DNA, 22 bp, Homo sapiens
gaaaagtacacagcccaaacat

SEQ ID NO: 7676179 - DNA, 22 bp, Homo sapiens
gaaaagtacacagcccaaacat

SEQ ID NO: 7676180 - DNA, 22 bp, Homo sapiens
gaaaagtacacagcccaaacat

SEQ ID NO: 7676181 - DNA, 22 bp, Homo sapiens
gaaaagtatgtttattttgact

SEQ ID NO: 7676182 - DNA, 22 bp, Homo sapiens
gaaaagtatgtttattttgact

SEQ ID NO: 7676183 - DNA, 22 bp, Homo sapiens
gaaaagtatgtttattttgact

SEQ ID NO: 7676184 - DNA, 22 bp, Homo sapiens
gaaaagtatgtttattttgact

SEQ ID NO: 7676185 - DNA, 22 bp, Homo sapiens
gaaaagtatgtttattttgact

SEQ ID NO: 7676186 - DNA, 22 bp, Homo sapiens
gaaaagtatgtttattttgact

SEQ ID NO: 7676187 - DNA, 22 bp, Homo sapiens
gaaaagggcaagagagagggca

SEQ ID NO: 7676188 - DNA, 22 bp, Homo sapiens
gaaaagtaaacactaggggtca

SEQ ID NO: 7676189 - DNA, 22 bp, Homo sapiens
gaaaagtaaacactaggggtca

SEQ ID NO: 7676190 - DNA, 22 bp, Homo sapiens
gaaaagggcaagagagagggca

SEQ ID NO: 7676191 - DNA, 22 bp, Homo sapiens
gaaaagggcaagagagagggca

SEQ ID NO: 7676192 - DNA, 22 bp, Homo sapiens
gaaaagggcaagagagagggca

SEQ ID NO: 7676193 - DNA, 22 bp, Homo sapiens
gaaaaggctctcactccctccg

SEQ ID NO: 7676194 - DNA, 22 bp, Homo sapiens
gaaaaggctgcccacttattga

SEQ ID NO: 7676195 - DNA, 22 bp, Homo sapiens
gaaaaggctctcactccctccg

SEQ ID NO: 7676196 - DNA, 22 bp, Homo sapiens
gaaaaggctgcccacttattga

SEQ ID NO: 7676197 - DNA, 22 bp, Homo sapiens
gaaaaggctctcactccctccg

SEQ ID NO: 7676198 - DNA, 22 bp, Homo sapiens
gaaaaggcctggggcaaagtgt

SEQ ID NO: 7676199 - DNA, 21 bp, Homo sapiens
gaaaagcaagggagtagaaca

SEQ ID NO: 7676200 - DNA, 22 bp, Homo sapiens
gaaaagagtcctgtgtgaggag

SEQ ID NO: 7676201 - DNA, 22 bp, Homo sapiens
gaaaagagacagggtgggtgat

SEQ ID NO: 7676202 - DNA, 21 bp, Homo sapiens
gaaaagcaagggagtagaaca

SEQ ID NO: 7676203 - DNA, 22 bp, Homo sapiens
gaaaagagtcctgtgtgaggag

SEQ ID NO: 7676204 - DNA, 21 bp, Homo sapiens
gaaaagcaagggagtagaaca

SEQ ID NO: 7676205 - DNA, 21 bp, Homo sapiens
gaaaagcaagggagtagaaca

SEQ ID NO: 7676206 - DNA, 21 bp, Homo sapiens
gaaaagcaagggagtagaaca

SEQ ID NO: 7676207 - DNA, 21 bp, Homo sapiens
gaaaagcaagggagtagaaca

SEQ ID NO: 7676208 - DNA, 21 bp, Homo sapiens
gaaaagcaagggagtagaaca

SEQ ID NO: 7676209 - DNA, 22 bp, Homo sapiens
gaaaacatccagagatagacct

SEQ ID NO: 7676210 - DNA, 22 bp, Homo sapiens
gaaaacatccagagatagacct

SEQ ID NO: 7676211 - DNA, 22 bp, Homo sapiens
gaaaacatccagagatagacct

SEQ ID NO: 7676212 - DNA, 22 bp, Homo sapiens
gaaaacatccagagatagacct

SEQ ID NO: 7676213 - DNA, 22 bp, Homo sapiens
gaaaacatccagagatagacct

SEQ ID NO: 7676214 - DNA, 22 bp, Homo sapiens
gaaaacatccagagatagacct

SEQ ID NO: 7676215 - DNA, 22 bp, Homo sapiens
gaaaacatccagagatagacct

SEQ ID NO: 7676216 - DNA, 22 bp, Homo sapiens
gaaaacatccagagatagacct

SEQ ID NO: 7676217 - DNA, 22 bp, Homo sapiens
gaaaacatccagagatagacct

SEQ ID NO: 7676218 - DNA, 22 bp, Homo sapiens
gaaaaggaaatttatagagatc

SEQ ID NO: 7676219 - DNA, 22 bp, Homo sapiens
gaaaagcttactgccacttggc

SEQ ID NO: 7676220 - DNA, 22 bp, Homo sapiens
gaaaagctaggccagttcagct

SEQ ID NO: 7676221 - DNA, 22 bp, Homo sapiens
gaaaaggaaatttatagagatc

SEQ ID NO: 7676222 - DNA, 22 bp, Homo sapiens
gaaaaggaaatttatagagatc

SEQ ID NO: 7676223 - DNA, 22 bp, Homo sapiens
gaaaaggaaatttatagagatc

SEQ ID NO: 7676224 - DNA, 22 bp, Homo sapiens
gaaaaggaaatttatagagatc

SEQ ID NO: 7676225 - DNA, 22 bp, Homo sapiens
gaaaaggaaatttatagagatc

SEQ ID NO: 7676226 - DNA, 22 bp, Homo sapiens
gaaaaggaaatttatagagatc

SEQ ID NO: 7676227 - DNA, 22 bp, Homo sapiens
gaaaaggaaatttatagagatc

SEQ ID NO: 7676228 - DNA, 22 bp, Homo sapiens
gaaaagctaggccagttcagct

SEQ ID NO: 7676229 - DNA, 22 bp, Homo sapiens
gaaaagctaggccagttcagct

SEQ ID NO: 7676230 - DNA, 21 bp, Homo sapiens
gaaaagcaagggagtagaaca

SEQ ID NO: 7676231 - DNA, 22 bp, Homo sapiens
gaaaagccttctcacataagta

SEQ ID NO: 7676232 - DNA, 22 bp, Homo sapiens
gaaaagccttctcacataagta

SEQ ID NO: 7676233 - DNA, 21 bp, Homo sapiens
gaaaagcaagggagtagaaca

SEQ ID NO: 7676234 - DNA, 21 bp, Homo sapiens
gaaaagcaagggagtagaaca

SEQ ID NO: 7676235 - DNA, 21 bp, Homo sapiens
gaaaagcaagggagtagaaca

SEQ ID NO: 7676236 - DNA, 21 bp, Homo sapiens
gaaaagcaagggagtagaaca

SEQ ID NO: 7676237 - DNA, 21 bp, Homo sapiens
gaaaagcaagggagtagaaca

SEQ ID NO: 7676238 - DNA, 21 bp, Homo sapiens
gaaaagcaagggagtagaaca

SEQ ID NO: 7676239 - DNA, 21 bp, Homo sapiens
gaaaagcaagggagtagaaca

SEQ ID NO: 7676240 - DNA, 21 bp, Homo sapiens
gaaaagcaagggagtagaaca

SEQ ID NO: 7676241 - DNA, 21 bp, Homo sapiens
gaaggcttctgcctggaggag

SEQ ID NO: 7676242 - DNA, 22 bp, Homo sapiens
gaaggcttgattgaggaatgcc

SEQ ID NO: 7676243 - DNA, 22 bp, Homo sapiens
gaaggcttgattgaggaatgcc

SEQ ID NO: 7676244 - DNA, 22 bp, Homo sapiens
gaaggcttctccagggcttact

SEQ ID NO: 7676245 - DNA, 22 bp, Homo sapiens
gaaggcttctccagggcttact

SEQ ID NO: 7676246 - DNA, 21 bp, Homo sapiens
gaaggcttctgcctggaggag

SEQ ID NO: 7676247 - DNA, 21 bp, Homo sapiens
gaaggcttctgcctggaggag

SEQ ID NO: 7676248 - DNA, 22 bp, Homo sapiens
gaaggcttcctggaggaggtgg

SEQ ID NO: 7676249 - DNA, 22 bp, Homo sapiens
gaaggcttcctggaggaggtgg

SEQ ID NO: 7676250 - DNA, 22 bp, Homo sapiens
gaaggcttcctggaggaggtgg

SEQ ID NO: 7676251 - DNA, 22 bp, Homo sapiens
gaaggcttcccacctgatattt

SEQ ID NO: 7676252 - DNA, 22 bp, Homo sapiens
gaaggcttcccacctgatattt

SEQ ID NO: 7676253 - DNA, 22 bp, Homo sapiens
gaaggcttcctgatgccaacca

SEQ ID NO: 7676254 - DNA, 22 bp, Homo sapiens
gaaggcttcctgatgccaacca

SEQ ID NO: 7676255 - DNA, 22 bp, Homo sapiens
gaaggctgcgaggggagtgccg

SEQ ID NO: 7676256 - DNA, 22 bp, Homo sapiens
gaaggcttcaaaaggtgtaatt

SEQ ID NO: 7676257 - DNA, 22 bp, Homo sapiens
gaaggcttcaaaaggtgtaatt

SEQ ID NO: 7676258 - DNA, 22 bp, Homo sapiens
gaaggctgcgaggggagtgccg

SEQ ID NO: 7676259 - DNA, 22 bp, Homo sapiens
gaaggctgcgaggggagtgccg

SEQ ID NO: 7676260 - DNA, 22 bp, Homo sapiens
gaaggcttggttttttcaacac

SEQ ID NO: 7676261 - DNA, 22 bp, Homo sapiens
gaaggcttggttttttcaacac

SEQ ID NO: 7676262 - DNA, 22 bp, Homo sapiens
gaaggctttagagagatataaa

SEQ ID NO: 7676263 - DNA, 22 bp, Homo sapiens
gaaggctttagagagatataaa

SEQ ID NO: 7676264 - DNA, 22 bp, Homo sapiens
gaaggcttttctaccagatctt

SEQ ID NO: 7676265 - DNA, 22 bp, Homo sapiens
gaaggcttttctaccagatctt

SEQ ID NO: 7676266 - DNA, 19 bp, Homo sapiens
gaaggcttttggtatgttt

SEQ ID NO: 7676267 - DNA, 19 bp, Homo sapiens
gaaggcttttggtatgttt

SEQ ID NO: 7676268 - DNA, 22 bp, Homo sapiens
gaaggctttttgggtaattgta

SEQ ID NO: 7676269 - DNA, 22 bp, Homo sapiens
gaaggctttttgggtaattgta

SEQ ID NO: 7676270 - DNA, 22 bp, Homo sapiens
gaagggaaagtgacttacccga

SEQ ID NO: 7676271 - DNA, 22 bp, Homo sapiens
gaagggaaagtgacttacccga

SEQ ID NO: 7676272 - DNA, 22 bp, Homo sapiens
gaagggaaagtgacttacccga

SEQ ID NO: 7676273 - DNA, 22 bp, Homo sapiens
gaaggcttgcagctctgtggca

SEQ ID NO: 7676274 - DNA, 22 bp, Homo sapiens
gaaggcttgcagctctgtggca

SEQ ID NO: 7676275 - DNA, 22 bp, Homo sapiens
gaaggcttgccgggaagcggca

SEQ ID NO: 7676276 - DNA, 22 bp, Homo sapiens
gaaggcttgccgggaagcggca

SEQ ID NO: 7676277 - DNA, 22 bp, Homo sapiens
gaaggcttgcaagtggttcata

SEQ ID NO: 7676278 - DNA, 22 bp, Homo sapiens
gaaggcttgcaagtggttcata

SEQ ID NO: 7676279 - DNA, 22 bp, Homo sapiens
gaaggcttgcaagtggttcata

SEQ ID NO: 7676280 - DNA, 22 bp, Homo sapiens
gaaggcttgcaagtggttcata

SEQ ID NO: 7676281 - DNA, 20 bp, Homo sapiens
gaaggcttggacagtgacag

SEQ ID NO: 7676282 - DNA, 20 bp, Homo sapiens
gaaggcttggacagtgacag

SEQ ID NO: 7676283 - DNA, 20 bp, Homo sapiens
gaaggcttggacagtgacag

SEQ ID NO: 7676284 - DNA, 20 bp, Homo sapiens
gaaggcttggacagtgacag

SEQ ID NO: 7676285 - DNA, 22 bp, Homo sapiens
gaaggctgcgaggggagtgccg

SEQ ID NO: 7676286 - DNA, 22 bp, Homo sapiens
gaaggctgcgaggggagtgccg

SEQ ID NO: 7676287 - DNA, 22 bp, Homo sapiens
gaaggctgcgaggggagtgccg

SEQ ID NO: 7676288 - DNA, 22 bp, Homo sapiens
gaaggctgcgaggggagtgccg

SEQ ID NO: 7676289 - DNA, 22 bp, Homo sapiens
gaaggctgcgaggggagtgccg

SEQ ID NO: 7676290 - DNA, 22 bp, Homo sapiens
gaaggctgcatggaggctgtgg

SEQ ID NO: 7676291 - DNA, 22 bp, Homo sapiens
gaaggctgccagtggccctctt

SEQ ID NO: 7676292 - DNA, 22 bp, Homo sapiens
gaaggctgccagtggccctctt

SEQ ID NO: 7676293 - DNA, 22 bp, Homo sapiens
gaaggctgcatggaggctgtgg

SEQ ID NO: 7676294 - DNA, 22 bp, Homo sapiens
gaaggctgcatggaggctgtgg

SEQ ID NO: 7676295 - DNA, 22 bp, Homo sapiens
gaaggctgatgacagattctgc

SEQ ID NO: 7676296 - DNA, 22 bp, Homo sapiens
gaaggctgcatggaggctgtgg

SEQ ID NO: 7676297 - DNA, 22 bp, Homo sapiens
gaaggctgcatggaggctgtgg

SEQ ID NO: 7676298 - DNA, 22 bp, Homo sapiens
gaaggctgcatggaggctgtgg

SEQ ID NO: 7676299 - DNA, 22 bp, Homo sapiens
gaaggctgagtgggtacggagg

SEQ ID NO: 7676300 - DNA, 22 bp, Homo sapiens
gaaggctgatgacagattctgc

SEQ ID NO: 7676301 - DNA, 22 bp, Homo sapiens
gaaggctgatgacagattctgc

SEQ ID NO: 7676302 - DNA, 22 bp, Homo sapiens
gaaggctgagcagacaggccaa

SEQ ID NO: 7676303 - DNA, 22 bp, Homo sapiens
gaaggctgagtgggtacggagg

SEQ ID NO: 7676304 - DNA, 22 bp, Homo sapiens
gaaggctgagtgggtacggagg

SEQ ID NO: 7676305 - DNA, 22 bp, Homo sapiens
gaaggctgagcagacaggccaa

SEQ ID NO: 7676306 - DNA, 22 bp, Homo sapiens
gaaggctgagcagacaggccaa

SEQ ID NO: 7676307 - DNA, 22 bp, Homo sapiens
gaaggctgagcagacaggccaa

SEQ ID NO: 7676308 - DNA, 22 bp, Homo sapiens
gaaggctccttgagggaaggac

SEQ ID NO: 7676309 - DNA, 22 bp, Homo sapiens
gaaggctccttgagggaaggac

SEQ ID NO: 7676310 - DNA, 22 bp, Homo sapiens
gaaggctatatgactcagccct

SEQ ID NO: 7676311 - DNA, 22 bp, Homo sapiens
gaaggctatatgactcagccct

SEQ ID NO: 7676312 - DNA, 22 bp, Homo sapiens
gaaggctaaaggggcagaggtt

SEQ ID NO: 7676313 - DNA, 22 bp, Homo sapiens
gaaggctaaaggggcagaggtt

SEQ ID NO: 7676314 - DNA, 22 bp, Homo sapiens
gaaggctaaaggggcagaggtt

SEQ ID NO: 7676315 - DNA, 22 bp, Homo sapiens
gaaggctacttctcctcagggc

SEQ ID NO: 7676316 - DNA, 22 bp, Homo sapiens
gaaggctacttctcctcagggc

SEQ ID NO: 7676317 - DNA, 22 bp, Homo sapiens
gaaggctagaaacgatgcttat

SEQ ID NO: 7676318 - DNA, 22 bp, Homo sapiens
gaaggctagaaacgatgcttat

SEQ ID NO: 7676319 - DNA, 19 bp, Homo sapiens
gaaggctgaaatgaagcac

SEQ ID NO: 7676320 - DNA, 22 bp, Homo sapiens
gaaggctcttgaggccaggtaa

SEQ ID NO: 7676321 - DNA, 22 bp, Homo sapiens
gaaggctctggggattgagata

SEQ ID NO: 7676322 - DNA, 19 bp, Homo sapiens
gaaggctgaaatgaagcac

SEQ ID NO: 7676323 - DNA, 19 bp, Homo sapiens
gaaggctgaaatgaagcac

SEQ ID NO: 7676324 - DNA, 19 bp, Homo sapiens
gaaggctgaaatgaagcac

SEQ ID NO: 7676325 - DNA, 19 bp, Homo sapiens
gaaggctgaaatgaagcac

SEQ ID NO: 7676326 - DNA, 22 bp, Homo sapiens
gaaggctgaattatttgttcct

SEQ ID NO: 7676327 - DNA, 22 bp, Homo sapiens
gaaggctgaattatttgttcct

SEQ ID NO: 7676328 - DNA, 22 bp, Homo sapiens
gaagtgcaacctgaaatactag

SEQ ID NO: 7676329 - DNA, 22 bp, Homo sapiens
gaagtggaagccatcggcagtc

SEQ ID NO: 7676330 - DNA, 22 bp, Homo sapiens
gaagtgcaaaaccacatggtaa

SEQ ID NO: 7676331 - DNA, 22 bp, Homo sapiens
gaagtgcaaaaccacatggtaa

SEQ ID NO: 7676332 - DNA, 22 bp, Homo sapiens
gaagtgcaacctgaaatactag

SEQ ID NO: 7676333 - DNA, 22 bp, Homo sapiens
gaagtgcaacctgaaatactag

SEQ ID NO: 7676334 - DNA, 22 bp, Homo sapiens
gaagtgcaaaaccacatggtaa

SEQ ID NO: 7676335 - DNA, 22 bp, Homo sapiens
gaagtgatcttccagaagaata

SEQ ID NO: 7676336 - DNA, 22 bp, Homo sapiens
gaagtgatcttccagaagaata

SEQ ID NO: 7676337 - DNA, 22 bp, Homo sapiens
gaagtgaagagattagaaatca

SEQ ID NO: 7676338 - DNA, 22 bp, Homo sapiens
gaagtgaagagattagaaatca

SEQ ID NO: 7676339 - DNA, 22 bp, Homo sapiens
gaagtgaaggttactctagatt

SEQ ID NO: 7676340 - DNA, 22 bp, Homo sapiens
gaagtgaaggttactctagatt

SEQ ID NO: 7676341 - DNA, 22 bp, Homo sapiens
gaagtgaaggttactctagatt

SEQ ID NO: 7676342 - DNA, 18 bp, Homo sapiens
gaagtgaagtgactcaat

SEQ ID NO: 7676343 - DNA, 18 bp, Homo sapiens
gaagtgaagtgactcaat

SEQ ID NO: 7676344 - DNA, 22 bp, Homo sapiens
gaagtacaaaggacatggaaac

SEQ ID NO: 7676345 - DNA, 22 bp, Homo sapiens
gaagtacaaaggacatggaaac

SEQ ID NO: 7676346 - DNA, 22 bp, Homo sapiens
gaagtacaaaggacatggaaac

SEQ ID NO: 7676347 - DNA, 22 bp, Homo sapiens
gaagtacaaaggacatggaaac

SEQ ID NO: 7676348 - DNA, 22 bp, Homo sapiens
gaagtacaaaggacatggaaac

SEQ ID NO: 7676349 - DNA, 22 bp, Homo sapiens
gaagtacaaaggacatggaaac

SEQ ID NO: 7676350 - DNA, 22 bp, Homo sapiens
gaagtaacattacttttcatga

SEQ ID NO: 7676351 - DNA, 22 bp, Homo sapiens
gaaggttttgattccactgaat

SEQ ID NO: 7676352 - DNA, 22 bp, Homo sapiens
gaaggttttgtttgcaaatcat

SEQ ID NO: 7676353 - DNA, 22 bp, Homo sapiens
gaaggttttcaggagcctagtc

SEQ ID NO: 7676354 - DNA, 22 bp, Homo sapiens
gaagggaaggaaagaaccagca

SEQ ID NO: 7676355 - DNA, 22 bp, Homo sapiens
gaagggaaggaaagaaccagca

SEQ ID NO: 7676356 - DNA, 22 bp, Homo sapiens
gaagggaaggaaagaaccagca

SEQ ID NO: 7676357 - DNA, 22 bp, Homo sapiens
gaagggaaggaaagaaccagca

SEQ ID NO: 7676358 - DNA, 22 bp, Homo sapiens
gaagggaaggaaagaaccagca

SEQ ID NO: 7676359 - DNA, 22 bp, Homo sapiens
gaagggaaggaaagaaccagca

SEQ ID NO: 7676360 - DNA, 22 bp, Homo sapiens
gaagggaactgggtctccttgt

SEQ ID NO: 7676361 - DNA, 22 bp, Homo sapiens
gaagggaactgggtctccttgt

SEQ ID NO: 7676362 - DNA, 22 bp, Homo sapiens
gaagggaactgggtctccttgt

SEQ ID NO: 7676363 - DNA, 22 bp, Homo sapiens
gaagggaactgggtctccttgt

SEQ ID NO: 7676364 - DNA, 22 bp, Homo sapiens
gaagggaaattcagatcttcag

SEQ ID NO: 7676365 - DNA, 22 bp, Homo sapiens
gaagggaaattcagatcttcag

SEQ ID NO: 7676366 - DNA, 22 bp, Homo sapiens
gaagggaaattcagatcttcag

SEQ ID NO: 7676367 - DNA, 22 bp, Homo sapiens
gaagtgttgtatctttttaata

SEQ ID NO: 7676368 - DNA, 22 bp, Homo sapiens
gaagtgttgacttctgtgaatt

SEQ ID NO: 7676369 - DNA, 22 bp, Homo sapiens
gaagtgttgacttctgtgaatt

SEQ ID NO: 7676370 - DNA, 20 bp, Homo sapiens
gaagtgtggagttgggaagc

SEQ ID NO: 7676371 - DNA, 22 bp, Homo sapiens
gaagtgtgcacatcttacaagt

SEQ ID NO: 7676372 - DNA, 22 bp, Homo sapiens
gaagtgtgcacatcttacaagt

SEQ ID NO: 7676373 - DNA, 22 bp, Homo sapiens
gaagtgtgaaggtgatgtggag

SEQ ID NO: 7676374 - DNA, 23 bp, Homo sapiens
gaagtgtctgagctgtatttttc

SEQ ID NO: 7676375 - DNA, 22 bp, Homo sapiens
gaagtgtctccgtttttaaagg

SEQ ID NO: 7676376 - DNA, 17 bp, Homo sapiens
gaagtgtttcttcatga

SEQ ID NO: 7676377 - DNA, 17 bp, Homo sapiens
gaagtgtttcttcatga

SEQ ID NO: 7676378 - DNA, 22 bp, Homo sapiens
gaagttacatactgtcacttct

SEQ ID NO: 7676379 - DNA, 22 bp, Homo sapiens
gaagttaccgaacctctccatg

SEQ ID NO: 7676380 - DNA, 22 bp, Homo sapiens
gaagttactctcgttaaatatg

SEQ ID NO: 7676381 - DNA, 22 bp, Homo sapiens
gaagttactctcgttaaatatg

SEQ ID NO: 7676382 - DNA, 22 bp, Homo sapiens
gaagttactctcgttaaatatg

SEQ ID NO: 7676383 - DNA, 22 bp, Homo sapiens
gaagtggaattactgggtcata

SEQ ID NO: 7676384 - DNA, 22 bp, Homo sapiens
gaagtggaattactgggtcata

SEQ ID NO: 7676385 - DNA, 22 bp, Homo sapiens
gaagtggaattactgggtcata

SEQ ID NO: 7676386 - DNA, 22 bp, Homo sapiens
gaagtggaattactgggtcata

SEQ ID NO: 7676387 - DNA, 22 bp, Homo sapiens
gaagtgcctcggtgtccaaggc

SEQ ID NO: 7676388 - DNA, 22 bp, Homo sapiens
gaagtggaagccatcggcagtc

SEQ ID NO: 7676389 - DNA, 22 bp, Homo sapiens
gaagtgggctttgtggtcagct

SEQ ID NO: 7676390 - DNA, 22 bp, Homo sapiens
gaagtggcctgaagtgaatgct

SEQ ID NO: 7676391 - DNA, 22 bp, Homo sapiens
gaagtgggctttgtggtcagct

SEQ ID NO: 7676392 - DNA, 22 bp, Homo sapiens
gaagtgggctttgtggtcagct

SEQ ID NO: 7676393 - DNA, 22 bp, Homo sapiens
gaagtgggctttgtggtcagct

SEQ ID NO: 7676394 - DNA, 22 bp, Homo sapiens
gaagtgggctttgtggtcagct

SEQ ID NO: 7676395 - DNA, 22 bp, Homo sapiens
gaagtgggctttgtggtcagct

SEQ ID NO: 7676396 - DNA, 22 bp, Homo sapiens
gaagtgtagtcttgagccccca

SEQ ID NO: 7676397 - DNA, 22 bp, Homo sapiens
gaagtgtagtcttgagccccca

SEQ ID NO: 7676398 - DNA, 22 bp, Homo sapiens
gaagtgtagtcttgagccccca

SEQ ID NO: 7676399 - DNA, 22 bp, Homo sapiens
gaagtgtaccttcctttccagc

SEQ ID NO: 7676400 - DNA, 22 bp, Homo sapiens
gaagtgggtggtgatatcactg

SEQ ID NO: 7676401 - DNA, 22 bp, Homo sapiens
gaagtggggaagcaacaggaga

SEQ ID NO: 7676402 - DNA, 22 bp, Homo sapiens
gaagtggggaagcaacaggaga

SEQ ID NO: 7676403 - DNA, 22 bp, Homo sapiens
gaagtgggctttgtggtcagct

SEQ ID NO: 7676404 - DNA, 22 bp, Homo sapiens
gaagtgggctttgtggtcagct

SEQ ID NO: 7676405 - DNA, 22 bp, Homo sapiens
gaagtggggaagcaacaggaga

SEQ ID NO: 7676406 - DNA, 22 bp, Homo sapiens
gaaggaagtcattagtgcagac

SEQ ID NO: 7676407 - DNA, 22 bp, Homo sapiens
gaaggaagtcattagtgcagac

SEQ ID NO: 7676408 - DNA, 22 bp, Homo sapiens
gaaggaagtcattagtgcagac

SEQ ID NO: 7676409 - DNA, 22 bp, Homo sapiens
gaaggaagtcattagtgcagac

SEQ ID NO: 7676410 - DNA, 22 bp, Homo sapiens
gaaggaagtcattagtgcagac

SEQ ID NO: 7676411 - DNA, 22 bp, Homo sapiens
gaaggaagtcattagtgcagac

SEQ ID NO: 7676412 - DNA, 22 bp, Homo sapiens
gaaggaagtcattagtgcagac

SEQ ID NO: 7676413 - DNA, 20 bp, Homo sapiens
gaaggaagggggcaaggtga

SEQ ID NO: 7676414 - DNA, 20 bp, Homo sapiens
gaaggaagggggcaaggtga

SEQ ID NO: 7676415 - DNA, 22 bp, Homo sapiens
gaaggaagtcattagtgcagac

SEQ ID NO: 7676416 - DNA, 20 bp, Homo sapiens
gaaggaagggggcaaggtga

SEQ ID NO: 7676417 - DNA, 20 bp, Homo sapiens
gaaggaagggggcaaggtga

SEQ ID NO: 7676418 - DNA, 20 bp, Homo sapiens
gaaggaagggggcaaggtga

SEQ ID NO: 7676419 - DNA, 20 bp, Homo sapiens
gaaggaagggggcaaggtga

SEQ ID NO: 7676420 - DNA, 22 bp, Homo sapiens
gaaggacccacgaagtcactgg

SEQ ID NO: 7676421 - DNA, 22 bp, Homo sapiens
gaaggaagtttattttagaaga

SEQ ID NO: 7676422 - DNA, 22 bp, Homo sapiens
gaaggaagtttattttagaaga

SEQ ID NO: 7676423 - DNA, 22 bp, Homo sapiens
gaaggaagtgctcatactagtt

SEQ ID NO: 7676424 - DNA, 22 bp, Homo sapiens
gaaggaagtgctcatactagtt

SEQ ID NO: 7676425 - DNA, 22 bp, Homo sapiens
gaaggaagtgctcatactagtt

SEQ ID NO: 7676426 - DNA, 22 bp, Homo sapiens
gaaggaagtgctcatactagtt

SEQ ID NO: 7676427 - DNA, 22 bp, Homo sapiens
gaaggaagtgctcatactagtt

SEQ ID NO: 7676428 - DNA, 22 bp, Homo sapiens
gaaggaagtgctcatactagtt

SEQ ID NO: 7676429 - DNA, 22 bp, Homo sapiens
gaaggaagtgctcatactagtt

SEQ ID NO: 7676430 - DNA, 22 bp, Homo sapiens
gaaggaagtgctcatactagtt

SEQ ID NO: 7676431 - DNA, 22 bp, Homo sapiens
gaaggaagtcattagtgcagac

SEQ ID NO: 7676432 - DNA, 22 bp, Homo sapiens
gaaggaagtgctcatactagtt

SEQ ID NO: 7676433 - DNA, 21 bp, Homo sapiens
gaaggagaaagcaagtgctgc

SEQ ID NO: 7676434 - DNA, 21 bp, Homo sapiens
gaaggagaaagcaagtgctgc

SEQ ID NO: 7676435 - DNA, 21 bp, Homo sapiens
gaaggagaaagcaagtgctgc

SEQ ID NO: 7676436 - DNA, 21 bp, Homo sapiens
gaaggagaaagcaagtgctgc

SEQ ID NO: 7676437 - DNA, 21 bp, Homo sapiens
gaaggagaaagcaagtgctgc

SEQ ID NO: 7676438 - DNA, 21 bp, Homo sapiens
gaaggagaaagcaagtgctgc

SEQ ID NO: 7676439 - DNA, 21 bp, Homo sapiens
gaaggagaaagcaagtgctgc

SEQ ID NO: 7676440 - DNA, 22 bp, Homo sapiens
gaaggacctgtccgtggtgctg

SEQ ID NO: 7676441 - DNA, 22 bp, Homo sapiens
gaaggacctgtccgtggtgctg

SEQ ID NO: 7676442 - DNA, 22 bp, Homo sapiens
gaaggaccctctggggtctcag

SEQ ID NO: 7676443 - DNA, 22 bp, Homo sapiens
gaaggacccacgaagtcactgg

SEQ ID NO: 7676444 - DNA, 22 bp, Homo sapiens
gaaggaccctctggggtctcag

SEQ ID NO: 7676445 - DNA, 22 bp, Homo sapiens
gaaggaaggaaaaatatattta

SEQ ID NO: 7676446 - DNA, 22 bp, Homo sapiens
gaaggaaggaaaaatatattta

SEQ ID NO: 7676447 - DNA, 22 bp, Homo sapiens
gaaggaaggaaaaatatattta

SEQ ID NO: 7676448 - DNA, 22 bp, Homo sapiens
gaaggaaggaaaaatatattta

SEQ ID NO: 7676449 - DNA, 22 bp, Homo sapiens
gaaggaagctgtctggatgtgt

SEQ ID NO: 7676450 - DNA, 22 bp, Homo sapiens
gaaggaagctgtctggatgtgt

SEQ ID NO: 7676451 - DNA, 22 bp, Homo sapiens
gaaggaagctgtctggatgtgt

SEQ ID NO: 7676452 - DNA, 22 bp, Homo sapiens
gaaggaagggctggctgtcttg

SEQ ID NO: 7676453 - DNA, 22 bp, Homo sapiens
gaaggaagggctggctgtcttg

SEQ ID NO: 7676454 - DNA, 22 bp, Homo sapiens
gaaggaagggctggctgtcttg

SEQ ID NO: 7676455 - DNA, 22 bp, Homo sapiens
gaaggaagggctggctgtcttg

SEQ ID NO: 7676456 - DNA, 22 bp, Homo sapiens
gaaggaagggctggctgtcttg

SEQ ID NO: 7676457 - DNA, 22 bp, Homo sapiens
gaaggaagggctggctgtcttg

SEQ ID NO: 7676458 - DNA, 22 bp, Homo sapiens
gaaggaagccgtttctctccag

SEQ ID NO: 7676459 - DNA, 22 bp, Homo sapiens
gaaggaagccgtttctctccag

SEQ ID NO: 7676460 - DNA, 22 bp, Homo sapiens
gaaggaagccgtttctctccag

SEQ ID NO: 7676461 - DNA, 22 bp, Homo sapiens
gaaggaagccgtttctctccag

SEQ ID NO: 7676462 - DNA, 22 bp, Homo sapiens
gaaggaagctgtctggatgtgt

SEQ ID NO: 7676463 - DNA, 22 bp, Homo sapiens
gaaggaagctgtctggatgtgt

SEQ ID NO: 7676464 - DNA, 22 bp, Homo sapiens
gaaggaagccgtttctctccag

SEQ ID NO: 7676465 - DNA, 22 bp, Homo sapiens
gaaggaagctgtctggatgtgt

SEQ ID NO: 7676466 - DNA, 22 bp, Homo sapiens
gaaggaagctgtctggatgtgt

SEQ ID NO: 7676467 - DNA, 22 bp, Homo sapiens
gaaggaagctgtctggatgtgt

SEQ ID NO: 7676468 - DNA, 22 bp, Homo sapiens
gaaggaagctgtctggatgtgt

SEQ ID NO: 7676469 - DNA, 22 bp, Homo sapiens
gaactgtagttaatactacaca

SEQ ID NO: 7676470 - DNA, 22 bp, Homo sapiens
gaactgtagttaatactacaca

SEQ ID NO: 7676471 - DNA, 22 bp, Homo sapiens
gaactgtataggagcagtgttt

SEQ ID NO: 7676472 - DNA, 20 bp, Homo sapiens
gaactgtgcactggtcacag

SEQ ID NO: 7676473 - DNA, 22 bp, Homo sapiens
gaactgtggggtggtagcagga

SEQ ID NO: 7676474 - DNA, 22 bp, Homo sapiens
gaactgtataggagcagtgttt

SEQ ID NO: 7676475 - DNA, 22 bp, Homo sapiens
gaactgtcattggggacatcag

SEQ ID NO: 7676476 - DNA, 22 bp, Homo sapiens
gaactgtgtacattgtagataa

SEQ ID NO: 7676477 - DNA, 22 bp, Homo sapiens
gaactgtgggtaatatattaga

SEQ ID NO: 7676478 - DNA, 22 bp, Homo sapiens
gaactgtatgcacgttgccatt

SEQ ID NO: 7676479 - DNA, 22 bp, Homo sapiens
gaactgtatgcacgttgccatt

SEQ ID NO: 7676480 - DNA, 22 bp, Homo sapiens
gaactgtgtttgtttctaggtc

SEQ ID NO: 7676481 - DNA, 22 bp, Homo sapiens
gaactgtgtttgtttctaggtc

SEQ ID NO: 7676482 - DNA, 22 bp, Homo sapiens
gaactgtgtttgtttctaggtc

SEQ ID NO: 7676483 - DNA, 22 bp, Homo sapiens
gaacttaacggcaactatttaa

SEQ ID NO: 7676484 - DNA, 22 bp, Homo sapiens
gaacttaacggcaactatttaa

SEQ ID NO: 7676485 - DNA, 22 bp, Homo sapiens
gaactgtttttaagtcctaaga

SEQ ID NO: 7676486 - DNA, 22 bp, Homo sapiens
gaactgtttctggtgaaagagt

SEQ ID NO: 7676487 - DNA, 23 bp, Homo sapiens
gaactgttgatgaatagaatata

SEQ ID NO: 7676488 - DNA, 23 bp, Homo sapiens
gaactgttgatgaatagaatata

SEQ ID NO: 7676489 - DNA, 22 bp, Homo sapiens
gaactgttccctcacaggctgg

SEQ ID NO: 7676490 - DNA, 22 bp, Homo sapiens
gaactgttccctcacaggctgg

SEQ ID NO: 7676491 - DNA, 22 bp, Homo sapiens
gaaggccctgttttccctattt

SEQ ID NO: 7676492 - DNA, 22 bp, Homo sapiens
gaaggccctggtattcttgagg

SEQ ID NO: 7676493 - DNA, 22 bp, Homo sapiens
gaaggcccgccctgagcaaggg

SEQ ID NO: 7676494 - DNA, 22 bp, Homo sapiens
gaaggcccgccctgagcaaggg

SEQ ID NO: 7676495 - DNA, 22 bp, Homo sapiens
gaaggccctggtattcttgagg

SEQ ID NO: 7676496 - DNA, 22 bp, Homo sapiens
gaaggcctaggaaggaagcctt

SEQ ID NO: 7676497 - DNA, 22 bp, Homo sapiens
gaaggcctaggaaggaagcctt

SEQ ID NO: 7676498 - DNA, 22 bp, Homo sapiens
gaaggcctaggaaggaagcctt

SEQ ID NO: 7676499 - DNA, 22 bp, Homo sapiens
gaaggcctagggatgctctgcg

SEQ ID NO: 7676500 - DNA, 22 bp, Homo sapiens
gaaggcctaggaaggaagcctt

SEQ ID NO: 7676501 - DNA, 22 bp, Homo sapiens
gaaggcctcactctgcagcata

SEQ ID NO: 7676502 - DNA, 22 bp, Homo sapiens
gaaggcctcactctgcagcata

SEQ ID NO: 7676503 - DNA, 22 bp, Homo sapiens
gaaggcctcactctgcagcata

SEQ ID NO: 7676504 - DNA, 22 bp, Homo sapiens
gaaggcctctaccatagaaggc

SEQ ID NO: 7676505 - DNA, 22 bp, Homo sapiens
gaaggcctctaccatagaaggc

SEQ ID NO: 7676506 - DNA, 17 bp, Homo sapiens
gaaggcctgcacaggcc

SEQ ID NO: 7676507 - DNA, 17 bp, Homo sapiens
gaaggcctgcacaggcc

SEQ ID NO: 7676508 - DNA, 17 bp, Homo sapiens
gaaggcctgcacaggcc

SEQ ID NO: 7676509 - DNA, 22 bp, Homo sapiens
gaaggcctgtggtagtgagacg

SEQ ID NO: 7676510 - DNA, 22 bp, Homo sapiens
gaaggcctgtggtagtgagacg

SEQ ID NO: 7676511 - DNA, 22 bp, Homo sapiens
gaaggcctgtggtagtgagacg

SEQ ID NO: 7676512 - DNA, 22 bp, Homo sapiens
gaaggagagggtcaaggataat

SEQ ID NO: 7676513 - DNA, 22 bp, Homo sapiens
gaaggagagggtcaaggataat

SEQ ID NO: 7676514 - DNA, 22 bp, Homo sapiens
gaaggagagggtcaaggataat

SEQ ID NO: 7676515 - DNA, 22 bp, Homo sapiens
gaaggagagggtcaaggataat

SEQ ID NO: 7676516 - DNA, 22 bp, Homo sapiens
gaaggagagggtcaaggataat

SEQ ID NO: 7676517 - DNA, 22 bp, Homo sapiens
gaaggagaggattgtgaggctg

SEQ ID NO: 7676518 - DNA, 22 bp, Homo sapiens
gaaggagaggattgtgaggctg

SEQ ID NO: 7676519 - DNA, 22 bp, Homo sapiens
gaaggagagggtcaaggataat

SEQ ID NO: 7676520 - DNA, 22 bp, Homo sapiens
gaaggagaggattgtgaggctg

SEQ ID NO: 7676521 - DNA, 22 bp, Homo sapiens
gaaggagagggtcaaggataat

SEQ ID NO: 7676522 - DNA, 19 bp, Homo sapiens
gaaggagagctgagttagg

SEQ ID NO: 7676523 - DNA, 19 bp, Homo sapiens
gaaggagagctgagttagg

SEQ ID NO: 7676524 - DNA, 22 bp, Homo sapiens
gaaggagagagacatcgtccct

SEQ ID NO: 7676525 - DNA, 22 bp, Homo sapiens
gaaggagaggattgtgaggctg

SEQ ID NO: 7676526 - DNA, 22 bp, Homo sapiens
gaaggagaggattgtgaggctg

SEQ ID NO: 7676527 - DNA, 22 bp, Homo sapiens
gaaggagaggattgtgaggctg

SEQ ID NO: 7676528 - DNA, 22 bp, Homo sapiens
gaaggagaggattgtgaggctg

SEQ ID NO: 7676529 - DNA, 22 bp, Homo sapiens
gaaggagaggattgtgaggctg

SEQ ID NO: 7676530 - DNA, 22 bp, Homo sapiens
gaaggagaggattgtgaggctg

SEQ ID NO: 7676531 - DNA, 21 bp, Homo sapiens
gaaggagaaagcaagtgctgc

SEQ ID NO: 7676532 - DNA, 21 bp, Homo sapiens
gaaggagaaagcaagtgctgc

SEQ ID NO: 7676533 - DNA, 21 bp, Homo sapiens
gaaggagaaagcaagtgctgc

SEQ ID NO: 7676534 - DNA, 22 bp, Homo sapiens
gaaggagaccctgaagatgctg

SEQ ID NO: 7676535 - DNA, 22 bp, Homo sapiens
gaaggagaccctgaagatgctg

SEQ ID NO: 7676536 - DNA, 21 bp, Homo sapiens
gaaggagaaagcaagtgctgc

SEQ ID NO: 7676537 - DNA, 22 bp, Homo sapiens
gaaggagaccctgaagatgctg

SEQ ID NO: 7676538 - DNA, 22 bp, Homo sapiens
gaaggagaccctgaagatgctg

SEQ ID NO: 7676539 - DNA, 22 bp, Homo sapiens
gaaggagagaaaggcaattctg

SEQ ID NO: 7676540 - DNA, 22 bp, Homo sapiens
gaaggagaccctgaagatgctg

SEQ ID NO: 7676541 - DNA, 22 bp, Homo sapiens
gaaggagagaaaggcaattctg

SEQ ID NO: 7676542 - DNA, 22 bp, Homo sapiens
gaaggagaccctgaagatgctg

SEQ ID NO: 7676543 - DNA, 22 bp, Homo sapiens
gaaggagagagacatcgtccct

SEQ ID NO: 7676544 - DNA, 22 bp, Homo sapiens
gaaggagagaaaggcaattctg

SEQ ID NO: 7676545 - DNA, 22 bp, Homo sapiens
gacacaggggggcgctagaaga

SEQ ID NO: 7676546 - DNA, 22 bp, Homo sapiens
gacacaggtagaataaagtact

SEQ ID NO: 7676547 - DNA, 22 bp, Homo sapiens
gacacaggtagaataaagtact

SEQ ID NO: 7676548 - DNA, 22 bp, Homo sapiens
gacacaggtagaataaagtact

SEQ ID NO: 7676549 - DNA, 22 bp, Homo sapiens
gacacaggggggcgctagaaga

SEQ ID NO: 7676550 - DNA, 22 bp, Homo sapiens
gacacaggggggcgctagaaga

SEQ ID NO: 7676551 - DNA, 22 bp, Homo sapiens
gacacaggggggcgctagaaga

SEQ ID NO: 7676552 - DNA, 22 bp, Homo sapiens
gacacaggggggcgctagaaga

SEQ ID NO: 7676553 - DNA, 22 bp, Homo sapiens
gacacaggggggcgctagaaga

SEQ ID NO: 7676554 - DNA, 22 bp, Homo sapiens
gacacagggggatgtgtggacg

SEQ ID NO: 7676555 - DNA, 22 bp, Homo sapiens
gacacagggggatgtgtggacg

SEQ ID NO: 7676556 - DNA, 22 bp, Homo sapiens
gacacagggggatgtgtggacg

SEQ ID NO: 7676557 - DNA, 22 bp, Homo sapiens
gacacagggacgtgctctgcct

SEQ ID NO: 7676558 - DNA, 22 bp, Homo sapiens
gacacagggacgtgctctgcct

SEQ ID NO: 7676559 - DNA, 22 bp, Homo sapiens
gacacagggacgtgctctgcct

SEQ ID NO: 7676560 - DNA, 22 bp, Homo sapiens
gacacagggacgtgctctgcct

SEQ ID NO: 7676561 - DNA, 22 bp, Homo sapiens
gacacagggacgtgctctgcct

SEQ ID NO: 7676562 - DNA, 22 bp, Homo sapiens
gacacagggacgtgctctgcct

SEQ ID NO: 7676563 - DNA, 22 bp, Homo sapiens
gacacagggggatgtgtggacg

SEQ ID NO: 7676564 - DNA, 22 bp, Homo sapiens
gacacagggggatgtgtggacg

SEQ ID NO: 7676565 - DNA, 22 bp, Homo sapiens
gacacagggggatgtgtggacg

SEQ ID NO: 7676566 - DNA, 22 bp, Homo sapiens
gacacagggggatgtgtggacg

SEQ ID NO: 7676567 - DNA, 22 bp, Homo sapiens
gacagctgtggagaggcatgtg

SEQ ID NO: 7676568 - DNA, 22 bp, Homo sapiens
gacagctgtggagaggcatgtg

SEQ ID NO: 7676569 - DNA, 22 bp, Homo sapiens
gacagctgtggagaggcatgtg

SEQ ID NO: 7676570 - DNA, 22 bp, Homo sapiens
gacaggaacataaatgtaggag

SEQ ID NO: 7676571 - DNA, 22 bp, Homo sapiens
gacagctgtggagaggcatgtg

SEQ ID NO: 7676572 - DNA, 22 bp, Homo sapiens
gacagctgtggagaggcatgtg

SEQ ID NO: 7676573 - DNA, 22 bp, Homo sapiens
gacagctgtggagaggcatgtg

SEQ ID NO: 7676574 - DNA, 22 bp, Homo sapiens
gacagctgtggagaggcatgtg

SEQ ID NO: 7676575 - DNA, 22 bp, Homo sapiens
gacagctgtggagaggcatgtg

SEQ ID NO: 7676576 - DNA, 22 bp, Homo sapiens
gacagctgtgcaggagaagggg

SEQ ID NO: 7676577 - DNA, 22 bp, Homo sapiens
gacagctgtgcaggagaagggg

SEQ ID NO: 7676578 - DNA, 22 bp, Homo sapiens
gacacaggtagaataaagtact

SEQ ID NO: 7676579 - DNA, 22 bp, Homo sapiens
gacacaggtagaataaagtact

SEQ ID NO: 7676580 - DNA, 22 bp, Homo sapiens
gacagctgtgcaggagaagggg

SEQ ID NO: 7676581 - DNA, 22 bp, Homo sapiens
gacagctgtgcaggagaagggg

SEQ ID NO: 7676582 - DNA, 22 bp, Homo sapiens
gacagctgtgcaggagaagggg

SEQ ID NO: 7676583 - DNA, 22 bp, Homo sapiens
gacagctgtgcaggagaagggg

SEQ ID NO: 7676584 - DNA, 20 bp, Homo sapiens
gacaggagagttaggtaggt

SEQ ID NO: 7676585 - DNA, 20 bp, Homo sapiens
gacaggagagttaggtaggt

SEQ ID NO: 7676586 - DNA, 20 bp, Homo sapiens
gacaggagagttaggtaggt

SEQ ID NO: 7676587 - DNA, 20 bp, Homo sapiens
gacaggagagttaggtaggt

SEQ ID NO: 7676588 - DNA, 20 bp, Homo sapiens
gacaggagagttaggtaggt

SEQ ID NO: 7676589 - DNA, 20 bp, Homo sapiens
gacaggagagttaggtaggt

SEQ ID NO: 7676590 - DNA, 22 bp, Homo sapiens
gacaggacttcactgtgttgcc

SEQ ID NO: 7676591 - DNA, 20 bp, Homo sapiens
gacaggagagttaggtaggt

SEQ ID NO: 7676592 - DNA, 20 bp, Homo sapiens
gacaggagagttaggtaggt

SEQ ID NO: 7676593 - DNA, 19 bp, Homo sapiens
gacaggacgaagggaagtt

SEQ ID NO: 7676594 - DNA, 19 bp, Homo sapiens
gacaggacgaagggaagtt

SEQ ID NO: 7676595 - DNA, 19 bp, Homo sapiens
gacaggacgaagggaagtt

SEQ ID NO: 7676596 - DNA, 19 bp, Homo sapiens
gacaggacgaagggaagtt

SEQ ID NO: 7676597 - DNA, 22 bp, Homo sapiens
gacaggacttcactgtgttgcc

SEQ ID NO: 7676598 - DNA, 21 bp, Homo sapiens
gacaggactagaccagagctc

SEQ ID NO: 7676599 - DNA, 22 bp, Homo sapiens
gacaggaatgtgtggatgcgga

SEQ ID NO: 7676600 - DNA, 22 bp, Homo sapiens
gacaggaatgtgtggatgcgga

SEQ ID NO: 7676601 - DNA, 22 bp, Homo sapiens
gacaggaatgtgtggatgcgga

SEQ ID NO: 7676602 - DNA, 22 bp, Homo sapiens
gacaggaatgtgtggatgcgga

SEQ ID NO: 7676603 - DNA, 22 bp, Homo sapiens
gacaggaatgtgtggatgcgga

SEQ ID NO: 7676604 - DNA, 19 bp, Homo sapiens
gacaggaaggctaccagta

SEQ ID NO: 7676605 - DNA, 22 bp, Homo sapiens
gacaggaagtctgaaggaggga

SEQ ID NO: 7676606 - DNA, 22 bp, Homo sapiens
gacaggaagtctgaaggaggga

SEQ ID NO: 7676607 - DNA, 22 bp, Homo sapiens
gacaggaagtctgaaggaggga

SEQ ID NO: 7676608 - DNA, 22 bp, Homo sapiens
gacaggaagtctgaaggaggga

SEQ ID NO: 7676609 - DNA, 22 bp, Homo sapiens
gacaggaagtctgaaggaggga

SEQ ID NO: 7676610 - DNA, 22 bp, Homo sapiens
gacaggaagtctgaaggaggga

SEQ ID NO: 7676611 - DNA, 22 bp, Homo sapiens
gacaggaagtctgaaggaggga

SEQ ID NO: 7676612 - DNA, 22 bp, Homo sapiens
gacaggaacataaatgtaggag

SEQ ID NO: 7676613 - DNA, 22 bp, Homo sapiens
gacaggaacataaatgtaggag

SEQ ID NO: 7676614 - DNA, 22 bp, Homo sapiens
gacaggaacataaatgtaggag

SEQ ID NO: 7676615 - DNA, 22 bp, Homo sapiens
gacaggaacataaatgtaggag

SEQ ID NO: 7676616 - DNA, 22 bp, Homo sapiens
gacaggaacataaatgtaggag

SEQ ID NO: 7676617 - DNA, 19 bp, Homo sapiens
gacaggaaggctaccagta

SEQ ID NO: 7676618 - DNA, 19 bp, Homo sapiens
gacaggaaggctaccagta

SEQ ID NO: 7676619 - DNA, 19 bp, Homo sapiens
gacaggaaggctaccagta

SEQ ID NO: 7676620 - DNA, 19 bp, Homo sapiens
gacaggaaggctaccagta

SEQ ID NO: 7676621 - DNA, 19 bp, Homo sapiens
gacaggaaggctaccagta

SEQ ID NO: 7676622 - DNA, 20 bp, Homo sapiens
gacacaggcagtcctcagag

SEQ ID NO: 7676623 - DNA, 20 bp, Homo sapiens
gacacaggcagtcctcagag

SEQ ID NO: 7676624 - DNA, 22 bp, Homo sapiens
gacacaggattcctggctctgc

SEQ ID NO: 7676625 - DNA, 20 bp, Homo sapiens
gacacaggcagtcctcagag

SEQ ID NO: 7676626 - DNA, 20 bp, Homo sapiens
gacacaggcagtcctcagag

SEQ ID NO: 7676627 - DNA, 20 bp, Homo sapiens
gacacaggcagtcctcagag

SEQ ID NO: 7676628 - DNA, 20 bp, Homo sapiens
gacacaggcagtcctcagag

SEQ ID NO: 7676629 - DNA, 20 bp, Homo sapiens
gacacaggcagtcctcagag

SEQ ID NO: 7676630 - DNA, 20 bp, Homo sapiens
gacacaggcagtcctcagag

SEQ ID NO: 7676631 - DNA, 22 bp, Homo sapiens
gacacaggattcctggctctgc

SEQ ID NO: 7676632 - DNA, 22 bp, Homo sapiens
gacacaggattcctggctctgc

SEQ ID NO: 7676633 - DNA, 22 bp, Homo sapiens
gacacaggattcctggctctgc

SEQ ID NO: 7676634 - DNA, 22 bp, Homo sapiens
gacacaggattcctggctctgc

SEQ ID NO: 7676635 - DNA, 23 bp, Homo sapiens
gacacaggagcacccagctgagc

SEQ ID NO: 7676636 - DNA, 23 bp, Homo sapiens
gacacaggagcacccagctgagc

SEQ ID NO: 7676637 - DNA, 23 bp, Homo sapiens
gacacaggagcacccagctgagc

SEQ ID NO: 7676638 - DNA, 23 bp, Homo sapiens
gacacaggagcacccagctgagc

SEQ ID NO: 7676639 - DNA, 22 bp, Homo sapiens
gacacaggaatcaccttggatg

SEQ ID NO: 7676640 - DNA, 18 bp, Homo sapiens
gacacaggagagagtccc

SEQ ID NO: 7676641 - DNA, 18 bp, Homo sapiens
gacacaggagagagtccc

SEQ ID NO: 7676642 - DNA, 18 bp, Homo sapiens
gacacaggagagagtccc

SEQ ID NO: 7676643 - DNA, 18 bp, Homo sapiens
gacacaggagagagtccc

SEQ ID NO: 7676644 - DNA, 18 bp, Homo sapiens
gacacaggagagagtccc

SEQ ID NO: 7676645 - DNA, 23 bp, Homo sapiens
gacacaggagcacccagctgagc

SEQ ID NO: 7676646 - DNA, 23 bp, Homo sapiens
gacacaggagcacccagctgagc

SEQ ID NO: 7676647 - DNA, 23 bp, Homo sapiens
gacacaggagcacccagctgagc

SEQ ID NO: 7676648 - DNA, 23 bp, Homo sapiens
gacacaggagcacccagctgagc

SEQ ID NO: 7676649 - DNA, 18 bp, Homo sapiens
gacacaggagagagtccc

SEQ ID NO: 7676650 - DNA, 18 bp, Homo sapiens
gacacaggagagagtccc

SEQ ID NO: 7676651 - DNA, 18 bp, Homo sapiens
gacacaggagagagtccc

SEQ ID NO: 7676652 - DNA, 18 bp, Homo sapiens
gacacaggagagagtccc

SEQ ID NO: 7676653 - DNA, 22 bp, Homo sapiens
gacacaggaatcaccttggatg

SEQ ID NO: 7676654 - DNA, 22 bp, Homo sapiens
gacacaggaatcaccttggatg

SEQ ID NO: 7676655 - DNA, 22 bp, Homo sapiens
gacacaggaatcaccttggatg

SEQ ID NO: 7676656 - DNA, 22 bp, Homo sapiens
gacacaggaaaagctccagccc

SEQ ID NO: 7676657 - DNA, 22 bp, Homo sapiens
gacacaggaaaagctccagccc

SEQ ID NO: 7676658 - DNA, 22 bp, Homo sapiens
gacacaggaatcaccttggatg

SEQ ID NO: 7676659 - DNA, 22 bp, Homo sapiens
gacacaggaaaagctccagccc

SEQ ID NO: 7676660 - DNA, 22 bp, Homo sapiens
gacacaggaaaagctccagccc

SEQ ID NO: 7676661 - DNA, 22 bp, Homo sapiens
gacacagctttctgaagagcat

SEQ ID NO: 7676662 - DNA, 22 bp, Homo sapiens
gacacagctaatggcttaggac

SEQ ID NO: 7676663 - DNA, 22 bp, Homo sapiens
gacacagctaatggcttaggac

SEQ ID NO: 7676664 - DNA, 22 bp, Homo sapiens
gacacagcactgtacaaggaat

SEQ ID NO: 7676665 - DNA, 22 bp, Homo sapiens
gacacagcactgtacaaggaat

SEQ ID NO: 7676666 - DNA, 22 bp, Homo sapiens
gacacagcttgatgagggcttt

SEQ ID NO: 7676667 - DNA, 22 bp, Homo sapiens
gacacagctttctgaagagcat

SEQ ID NO: 7676668 - DNA, 22 bp, Homo sapiens
gacacagctttctgaagagcat

SEQ ID NO: 7676669 - DNA, 22 bp, Homo sapiens
gacacagcttgatgagggcttt

SEQ ID NO: 7676670 - DNA, 22 bp, Homo sapiens
gacacagcttgatgagggcttt

SEQ ID NO: 7676671 - DNA, 22 bp, Homo sapiens
gacacagcttgatgagggcttt

SEQ ID NO: 7676672 - DNA, 22 bp, Homo sapiens
gacacagatatctctgagatta

SEQ ID NO: 7676673 - DNA, 22 bp, Homo sapiens
gacacagatatctctgagatta

SEQ ID NO: 7676674 - DNA, 22 bp, Homo sapiens
gacacagatatctctgagatta

SEQ ID NO: 7676675 - DNA, 22 bp, Homo sapiens
gacacagatgatcaggtgtgga

SEQ ID NO: 7676676 - DNA, 22 bp, Homo sapiens
gacacagatgatcaggtgtgga

SEQ ID NO: 7676677 - DNA, 22 bp, Homo sapiens
gacacagatgatcaggtgtgga

SEQ ID NO: 7676678 - DNA, 22 bp, Homo sapiens
gacacagatgatcaggtgtgga

SEQ ID NO: 7676679 - DNA, 22 bp, Homo sapiens
gacacagatgatcaggtgtgga

SEQ ID NO: 7676680 - DNA, 22 bp, Homo sapiens
gacacagagataggcctgtgtt

SEQ ID NO: 7676681 - DNA, 22 bp, Homo sapiens
gacacagagctcacagtctcct

SEQ ID NO: 7676682 - DNA, 22 bp, Homo sapiens
gacacagagctcacagtctcct

SEQ ID NO: 7676683 - DNA, 22 bp, Homo sapiens
gacacagagataggcctgtgtt

SEQ ID NO: 7676684 - DNA, 22 bp, Homo sapiens
gacacagagctcacagtctcct

SEQ ID NO: 7676685 - DNA, 22 bp, Homo sapiens
gacacagagctcacagtctcct

SEQ ID NO: 7676686 - DNA, 22 bp, Homo sapiens
gacacagagctcacagtctcct

SEQ ID NO: 7676687 - DNA, 22 bp, Homo sapiens
gacacagatatctctgagatta

SEQ ID NO: 7676688 - DNA, 22 bp, Homo sapiens
gacacagataatttagttaaaa

SEQ ID NO: 7676689 - DNA, 22 bp, Homo sapiens
gacacagataatttagttaaaa

SEQ ID NO: 7676690 - DNA, 22 bp, Homo sapiens
gacacagagtattttaagtact

SEQ ID NO: 7676691 - DNA, 22 bp, Homo sapiens
gacacagagtattttaagtact

SEQ ID NO: 7676692 - DNA, 22 bp, Homo sapiens
gacacagagctcacagtctcct

SEQ ID NO: 7676693 - DNA, 22 bp, Homo sapiens
gacacagagggcaccagatatg

SEQ ID NO: 7676694 - DNA, 22 bp, Homo sapiens
gacacagagggcaccagatatg

SEQ ID NO: 7676695 - DNA, 22 bp, Homo sapiens
gacacagagggcaccagatatg

SEQ ID NO: 7676696 - DNA, 19 bp, Homo sapiens
gaattatttttatgggatg

SEQ ID NO: 7676697 - DNA, 22 bp, Homo sapiens
gaattatgggcttgtttggaga

SEQ ID NO: 7676698 - DNA, 22 bp, Homo sapiens
gaattcaaatattaaacacgac

SEQ ID NO: 7676699 - DNA, 22 bp, Homo sapiens
gaattataggtttgcatgctaa

SEQ ID NO: 7676700 - DNA, 22 bp, Homo sapiens
gaattataggtttgcatgctaa

SEQ ID NO: 7676701 - DNA, 22 bp, Homo sapiens
gaattataggtttgcatgctaa

SEQ ID NO: 7676702 - DNA, 22 bp, Homo sapiens
gaattcatcgtcttagctgcca

SEQ ID NO: 7676703 - DNA, 22 bp, Homo sapiens
gaattcagttatctaattcaag

SEQ ID NO: 7676704 - DNA, 22 bp, Homo sapiens
gaattcaatttcttggtctttg

SEQ ID NO: 7676705 - DNA, 22 bp, Homo sapiens
gaattcaagtgcaatggtatat

SEQ ID NO: 7676706 - DNA, 22 bp, Homo sapiens
gaattcaatttcttggtctttg

SEQ ID NO: 7676707 - DNA, 22 bp, Homo sapiens
gaattcacttgtcttccatttt

SEQ ID NO: 7676708 - DNA, 22 bp, Homo sapiens
gaattcacttgtcttccatttt

SEQ ID NO: 7676709 - DNA, 22 bp, Homo sapiens
gaattccactttggcttttggg

SEQ ID NO: 7676710 - DNA, 22 bp, Homo sapiens
gaattcattagggaagctatct

SEQ ID NO: 7676711 - DNA, 22 bp, Homo sapiens
gaattcctctgagctaggagat

SEQ ID NO: 7676712 - DNA, 22 bp, Homo sapiens
gaattcctctgagctaggagat

SEQ ID NO: 7676713 - DNA, 20 bp, Homo sapiens
gaattcctgcagcatttagt

SEQ ID NO: 7676714 - DNA, 22 bp, Homo sapiens
gaattccttaggctcttgactg

SEQ ID NO: 7676715 - DNA, 20 bp, Homo sapiens
gaattcctgcagcatttagt

SEQ ID NO: 7676716 - DNA, 22 bp, Homo sapiens
gaattccttaggctcttgactg

SEQ ID NO: 7676717 - DNA, 22 bp, Homo sapiens
gaattctaaccattaagccaag

SEQ ID NO: 7676718 - DNA, 22 bp, Homo sapiens
gaattccttggcaaaacaccca

SEQ ID NO: 7676719 - DNA, 22 bp, Homo sapiens
gaattccttaggctcttgactg

SEQ ID NO: 7676720 - DNA, 22 bp, Homo sapiens
gaattccttccagaccctgtac

SEQ ID NO: 7676721 - DNA, 22 bp, Homo sapiens
gaattccttccagaccctgtac

SEQ ID NO: 7676722 - DNA, 22 bp, Homo sapiens
gaattaggtaatagaactagta

SEQ ID NO: 7676723 - DNA, 22 bp, Homo sapiens
gaattagtgttgaaatcagggc

SEQ ID NO: 7676724 - DNA, 22 bp, Homo sapiens
gaattataaactagtgacttca

SEQ ID NO: 7676725 - DNA, 22 bp, Homo sapiens
gaattataaactagtgacttca

SEQ ID NO: 7676726 - DNA, 22 bp, Homo sapiens
gaattataggcaaagcagtcat

SEQ ID NO: 7676727 - DNA, 22 bp, Homo sapiens
gaattataggcaaagcagtcat

SEQ ID NO: 7676728 - DNA, 22 bp, Homo sapiens
gaattataaactagtgacttca

SEQ ID NO: 7676729 - DNA, 22 bp, Homo sapiens
gaattagtgttgaaatcagggc

SEQ ID NO: 7676730 - DNA, 22 bp, Homo sapiens
gaattataaactagtgacttca

SEQ ID NO: 7676731 - DNA, 22 bp, Homo sapiens
gaattataggcaaagcagtcat

SEQ ID NO: 7676732 - DNA, 22 bp, Homo sapiens
gaattagacatgctttgctttt

SEQ ID NO: 7676733 - DNA, 22 bp, Homo sapiens
gaattacatttgtgttactgca

SEQ ID NO: 7676734 - DNA, 22 bp, Homo sapiens
gaattacatttgtgttactgca

SEQ ID NO: 7676735 - DNA, 22 bp, Homo sapiens
gaattacatttgtgttactgca

SEQ ID NO: 7676736 - DNA, 22 bp, Homo sapiens
gaattacatgaccctgagtaga

SEQ ID NO: 7676737 - DNA, 22 bp, Homo sapiens
gaattacattgttagccttcct

SEQ ID NO: 7676738 - DNA, 22 bp, Homo sapiens
gaattacatgaccctgagtaga

SEQ ID NO: 7676739 - DNA, 22 bp, Homo sapiens
gaattacatgaccctgagtaga

SEQ ID NO: 7676740 - DNA, 22 bp, Homo sapiens
gaattacatgaccctgagtaga

SEQ ID NO: 7676741 - DNA, 22 bp, Homo sapiens
gaagttcactggctacattcca

SEQ ID NO: 7676742 - DNA, 22 bp, Homo sapiens
gaagttcacatagctggcaggt

SEQ ID NO: 7676743 - DNA, 22 bp, Homo sapiens
gaagttcaactgccatgcttgg

SEQ ID NO: 7676744 - DNA, 21 bp, Homo sapiens
gaagttcatgatctttctgct

SEQ ID NO: 7676745 - DNA, 22 bp, Homo sapiens
gaagttcaggtgggaattgagc

SEQ ID NO: 7676746 - DNA, 22 bp, Homo sapiens
gaagttccagtgatataaaact

SEQ ID NO: 7676747 - DNA, 22 bp, Homo sapiens
gaagttcctcgtaggagtctct

SEQ ID NO: 7676748 - DNA, 22 bp, Homo sapiens
gaagttcctcgtaggagtctct

SEQ ID NO: 7676749 - DNA, 22 bp, Homo sapiens
gaagttcctcgtaggagtctct

SEQ ID NO: 7676750 - DNA, 22 bp, Homo sapiens
gaagttctcaaggatcacagaa

SEQ ID NO: 7676751 - DNA, 22 bp, Homo sapiens
gaagttctcaaggatcacagaa

SEQ ID NO: 7676752 - DNA, 22 bp, Homo sapiens
gaagttctagaactgtgccctt

SEQ ID NO: 7676753 - DNA, 22 bp, Homo sapiens
gaagttctcagctaggtgatgt

SEQ ID NO: 7676754 - DNA, 22 bp, Homo sapiens
gaagttattttacctgttaaag

SEQ ID NO: 7676755 - DNA, 22 bp, Homo sapiens
gaagttattttacctgttaaag

SEQ ID NO: 7676756 - DNA, 22 bp, Homo sapiens
gaagttattttacctgttaaag

SEQ ID NO: 7676757 - DNA, 22 bp, Homo sapiens
gaagttatcaggattaaagttg

SEQ ID NO: 7676758 - DNA, 22 bp, Homo sapiens
gaagttatttcctggtgttgga

SEQ ID NO: 7676759 - DNA, 22 bp, Homo sapiens
gaagttatttgctatctactga

SEQ ID NO: 7676760 - DNA, 22 bp, Homo sapiens
gaagttatcaaagatgtattct

SEQ ID NO: 7676761 - DNA, 22 bp, Homo sapiens
gaagttataaacttttcctccc

SEQ ID NO: 7676762 - DNA, 22 bp, Homo sapiens
gaagttatagctatgatcttaa

SEQ ID NO: 7676763 - DNA, 22 bp, Homo sapiens
gaagttatcaggattaaagttg

SEQ ID NO: 7676764 - DNA, 22 bp, Homo sapiens
gaagttatcaaagatgtattct

SEQ ID NO: 7676765 - DNA, 22 bp, Homo sapiens
gaagttatcaggattaaagttg

SEQ ID NO: 7676766 - DNA, 22 bp, Homo sapiens
gaatttaagaggatgaatctgt

SEQ ID NO: 7676767 - DNA, 22 bp, Homo sapiens
gaatttaagaggatgaatctgt

SEQ ID NO: 7676768 - DNA, 22 bp, Homo sapiens
gaatttaagaggatgaatctgt

SEQ ID NO: 7676769 - DNA, 22 bp, Homo sapiens
gaatttaagaggatgaatctgt

SEQ ID NO: 7676770 - DNA, 22 bp, Homo sapiens
gaatttaagaggatgaatctgt

SEQ ID NO: 7676771 - DNA, 22 bp, Homo sapiens
gaatttaaggaccaagcatttt

SEQ ID NO: 7676772 - DNA, 22 bp, Homo sapiens
gaatttaaggaccaagcatttt

SEQ ID NO: 7676773 - DNA, 22 bp, Homo sapiens
gaatttaaggaccaagcatttt

SEQ ID NO: 7676774 - DNA, 22 bp, Homo sapiens
gaatttaaggaccaagcatttt

SEQ ID NO: 7676775 - DNA, 22 bp, Homo sapiens
gacacagagataggcctgtgtt

SEQ ID NO: 7676776 - DNA, 22 bp, Homo sapiens
gacacagagataggcctgtgtt

SEQ ID NO: 7676777 - DNA, 22 bp, Homo sapiens
gaatttaaggaccaagcatttt

SEQ ID NO: 7676778 - DNA, 22 bp, Homo sapiens
gacacagagataggcctgtgtt

SEQ ID NO: 7676779 - DNA, 22 bp, Homo sapiens
gaatttaaatttaaatctacca

SEQ ID NO: 7676780 - DNA, 22 bp, Homo sapiens
gaatttaaatttaaatctacca

SEQ ID NO: 7676781 - DNA, 22 bp, Homo sapiens
gaatttaagaggatgaatctgt

SEQ ID NO: 7676782 - DNA, 22 bp, Homo sapiens
gaatttaaaggccagacctgag

SEQ ID NO: 7676783 - DNA, 22 bp, Homo sapiens
gaatttaaaggccagacctgag

SEQ ID NO: 7676784 - DNA, 22 bp, Homo sapiens
gaatttaaaggccagacctgag

SEQ ID NO: 7676785 - DNA, 22 bp, Homo sapiens
gaatttaaatttaaatctacca

SEQ ID NO: 7676786 - DNA, 22 bp, Homo sapiens
gaatttaaatttaaatctacca

SEQ ID NO: 7676787 - DNA, 22 bp, Homo sapiens
gaattgtatgctgtcttgatag

SEQ ID NO: 7676788 - DNA, 22 bp, Homo sapiens
gaattgtatgcagttacttgga

SEQ ID NO: 7676789 - DNA, 22 bp, Homo sapiens
gaattgtactgcaatcagggga

SEQ ID NO: 7676790 - DNA, 22 bp, Homo sapiens
gaattgtatgcagttacttgga

SEQ ID NO: 7676791 - DNA, 22 bp, Homo sapiens
gaattgtagagggaacagaagc

SEQ ID NO: 7676792 - DNA, 22 bp, Homo sapiens
gaattgtagagggaacagaagc

SEQ ID NO: 7676793 - DNA, 18 bp, Homo sapiens
gaattgtgctaaggtgat

SEQ ID NO: 7676794 - DNA, 21 bp, Homo sapiens
gaattgtgccccttggtgttg

SEQ ID NO: 7676795 - DNA, 22 bp, Homo sapiens
gaattgtattgatttttcagag

SEQ ID NO: 7676796 - DNA, 22 bp, Homo sapiens
gaattgtattgatttttcagag

SEQ ID NO: 7676797 - DNA, 22 bp, Homo sapiens
gaattgtattgatttttcagag

SEQ ID NO: 7676798 - DNA, 22 bp, Homo sapiens
gaattgtattgatttttcagag

SEQ ID NO: 7676799 - DNA, 22 bp, Homo sapiens
gaattgggggttttgcaaggca

SEQ ID NO: 7676800 - DNA, 22 bp, Homo sapiens
gaattgggggttttgcaaggca

SEQ ID NO: 7676801 - DNA, 22 bp, Homo sapiens
gaattgtaagtaccagcatgct

SEQ ID NO: 7676802 - DNA, 22 bp, Homo sapiens
gaattgtaagtaccagcatgct

SEQ ID NO: 7676803 - DNA, 22 bp, Homo sapiens
gaattgggggttttgcaaggca

SEQ ID NO: 7676804 - DNA, 22 bp, Homo sapiens
gaattgtagagggaacagaagc

SEQ ID NO: 7676805 - DNA, 22 bp, Homo sapiens
gaattgtagagggaacagaagc

SEQ ID NO: 7676806 - DNA, 22 bp, Homo sapiens
gaattgtactgcaatcagggga

SEQ ID NO: 7676807 - DNA, 22 bp, Homo sapiens
gaattgtacgctttacataggt

SEQ ID NO: 7676808 - DNA, 22 bp, Homo sapiens
gaattgtacgctttacataggt

SEQ ID NO: 7676809 - DNA, 22 bp, Homo sapiens
gaattgtaagtaccagcatgct

SEQ ID NO: 7676810 - DNA, 22 bp, Homo sapiens
gaattgggggttttgcaaggca

SEQ ID NO: 7676811 - DNA, 22 bp, Homo sapiens
gaattgtaagtaccagcatgct

SEQ ID NO: 7676812 - DNA, 22 bp, Homo sapiens
gaattgtacgctttacataggt

SEQ ID NO: 7676813 - DNA, 22 bp, Homo sapiens
gaattctaccagggcaagaggg

SEQ ID NO: 7676814 - DNA, 22 bp, Homo sapiens
gaattctagggtaaatatccta

SEQ ID NO: 7676815 - DNA, 22 bp, Homo sapiens
gaattctagggtaaatatccta

SEQ ID NO: 7676816 - DNA, 22 bp, Homo sapiens
gaattctagtcacacacattca

SEQ ID NO: 7676817 - DNA, 22 bp, Homo sapiens
gaattctagtcacacacattca

SEQ ID NO: 7676818 - DNA, 22 bp, Homo sapiens
gaattctagtcacacacattca

SEQ ID NO: 7676819 - DNA, 22 bp, Homo sapiens
gaattctagtcacacacattca

SEQ ID NO: 7676820 - DNA, 22 bp, Homo sapiens
gaattctagtcacacacattca

SEQ ID NO: 7676821 - DNA, 22 bp, Homo sapiens
gaattctgggagagatctgaca

SEQ ID NO: 7676822 - DNA, 22 bp, Homo sapiens
gaattctgggagagatctgaca

SEQ ID NO: 7676823 - DNA, 22 bp, Homo sapiens
gaattctgggagagatctgaca

SEQ ID NO: 7676824 - DNA, 22 bp, Homo sapiens
gaattctggttttgaaatgaat

SEQ ID NO: 7676825 - DNA, 22 bp, Homo sapiens
gaattctggttttgaaatgaat

SEQ ID NO: 7676826 - DNA, 23 bp, Homo sapiens
gaattcttaaggtcactaaagtc

SEQ ID NO: 7676827 - DNA, 22 bp, Homo sapiens
gaattctgtcgcttactagatg

SEQ ID NO: 7676828 - DNA, 22 bp, Homo sapiens
gaattctggttttgaaatgaat

SEQ ID NO: 7676829 - DNA, 22 bp, Homo sapiens
gaattctgtcgcttactagatg

SEQ ID NO: 7676830 - DNA, 22 bp, Homo sapiens
gaattctgtcgcttactagatg

SEQ ID NO: 7676831 - DNA, 22 bp, Homo sapiens
gaattctttaggtgaatttcta

SEQ ID NO: 7676832 - DNA, 22 bp, Homo sapiens
gaattctttaggtgaatttcta

SEQ ID NO: 7676833 - DNA, 22 bp, Homo sapiens
gaattctttaggtgaatttcta

SEQ ID NO: 7676834 - DNA, 22 bp, Homo sapiens
gaattctttaggtgaatttcta

SEQ ID NO: 7676835 - DNA, 22 bp, Homo sapiens
gaattcttctgtctttaactga

SEQ ID NO: 7676836 - DNA, 22 bp, Homo sapiens
gaattcttctgtctttaactga

SEQ ID NO: 7676837 - DNA, 22 bp, Homo sapiens
gaattctttgatcttaatcttg

SEQ ID NO: 7676838 - DNA, 22 bp, Homo sapiens
gaattctttgatcttaatcttg

SEQ ID NO: 7676839 - DNA, 22 bp, Homo sapiens
gaattcttttctttctgaaagt

SEQ ID NO: 7676840 - DNA, 22 bp, Homo sapiens
gaattcttttctttctgaaagt

SEQ ID NO: 7676841 - DNA, 22 bp, Homo sapiens
gaattcttttctttctgaaagt

SEQ ID NO: 7676842 - DNA, 22 bp, Homo sapiens
gaattgaattcatttactcaaa

SEQ ID NO: 7676843 - DNA, 22 bp, Homo sapiens
gaattgctaaccaattcaaaat

SEQ ID NO: 7676844 - DNA, 22 bp, Homo sapiens
gaattgctaatccaagtgactg

SEQ ID NO: 7676845 - DNA, 22 bp, Homo sapiens
gaattgctctgcctggccagcc

SEQ ID NO: 7676846 - DNA, 22 bp, Homo sapiens
gaattgctgatgaatctgattg

SEQ ID NO: 7676847 - DNA, 22 bp, Homo sapiens
gactttataaatgagaggcgga

SEQ ID NO: 7676848 - DNA, 22 bp, Homo sapiens
gactttattactaaccctgtga

SEQ ID NO: 7676849 - DNA, 22 bp, Homo sapiens
gactttattatagtggcaatag

SEQ ID NO: 7676850 - DNA, 22 bp, Homo sapiens
gactttattttaacggagattc

SEQ ID NO: 7676851 - DNA, 22 bp, Homo sapiens
gactttggttcagggctcagag

SEQ ID NO: 7676852 - DNA, 22 bp, Homo sapiens
gactttggtttgagcaagtcag

SEQ ID NO: 7676853 - DNA, 22 bp, Homo sapiens
gactttatttccttatttgtga

SEQ ID NO: 7676854 - DNA, 22 bp, Homo sapiens
gagaaaatcttgggtcaagaat

SEQ ID NO: 7676855 - DNA, 22 bp, Homo sapiens
gagaaaatcttgggtcaagaat

SEQ ID NO: 7676856 - DNA, 22 bp, Homo sapiens
gagaaaatcttgggtcaagaat

SEQ ID NO: 7676857 - DNA, 22 bp, Homo sapiens
gagaaaatcttgggtcaagaat

SEQ ID NO: 7676858 - DNA, 22 bp, Homo sapiens
gagaaaatcttgggtcaagaat

SEQ ID NO: 7676859 - DNA, 22 bp, Homo sapiens
gagaaaatgtcagacttggtcg

SEQ ID NO: 7676860 - DNA, 22 bp, Homo sapiens
gagaaaatgtcagacttggtcg

SEQ ID NO: 7676861 - DNA, 22 bp, Homo sapiens
gagaaaatgtcagacttggtcg

SEQ ID NO: 7676862 - DNA, 22 bp, Homo sapiens
gagaaaatgtcagacttggtcg

SEQ ID NO: 7676863 - DNA, 22 bp, Homo sapiens
gagaaaatgtcagacttggtcg

SEQ ID NO: 7676864 - DNA, 22 bp, Homo sapiens
gagaaacaacacttgatgcctt

SEQ ID NO: 7676865 - DNA, 22 bp, Homo sapiens
gagacacaagaagacatgcaca

SEQ ID NO: 7676866 - DNA, 22 bp, Homo sapiens
gagacacaagaagacatgcaca

SEQ ID NO: 7676867 - DNA, 22 bp, Homo sapiens
gagacacaagaagacatgcaca

SEQ ID NO: 7676868 - DNA, 22 bp, Homo sapiens
gagacacaagaagacatgcaca

SEQ ID NO: 7676869 - DNA, 22 bp, Homo sapiens
gagaaacaacacttgatgcctt

SEQ ID NO: 7676870 - DNA, 22 bp, Homo sapiens
gagaaacaacacttgatgcctt

SEQ ID NO: 7676871 - DNA, 22 bp, Homo sapiens
gagaaacaacacttgatgcctt

SEQ ID NO: 7676872 - DNA, 22 bp, Homo sapiens
gagaaacaacacttgatgcctt

SEQ ID NO: 7676873 - DNA, 22 bp, Homo sapiens
gagaaacaacacttgatgcctt

SEQ ID NO: 7676874 - DNA, 22 bp, Homo sapiens
gagaaacaacacttgatgcctt

SEQ ID NO: 7676875 - DNA, 22 bp, Homo sapiens
gagaaacaacacttgatgcctt

SEQ ID NO: 7676876 - DNA, 22 bp, Homo sapiens
gagaaaatagcatgtgtagtat

SEQ ID NO: 7676877 - DNA, 22 bp, Homo sapiens
gagaaaatagcatgtgtagtat

SEQ ID NO: 7676878 - DNA, 22 bp, Homo sapiens
gagaaaagcgaaggacctggag

SEQ ID NO: 7676879 - DNA, 22 bp, Homo sapiens
gagaaaatagcatgtgtagtat

SEQ ID NO: 7676880 - DNA, 22 bp, Homo sapiens
gagaaaatagcatgtgtagtat

SEQ ID NO: 7676881 - DNA, 22 bp, Homo sapiens
gagaaaagcgaaggacctggag

SEQ ID NO: 7676882 - DNA, 22 bp, Homo sapiens
gagaaaagcgaaggacctggag

SEQ ID NO: 7676883 - DNA, 22 bp, Homo sapiens
gagaaaagcgaaggacctggag

SEQ ID NO: 7676884 - DNA, 22 bp, Homo sapiens
gacttttccatcatccccctta

SEQ ID NO: 7676885 - DNA, 22 bp, Homo sapiens
gacttttagaatggtgaggaat

SEQ ID NO: 7676886 - DNA, 22 bp, Homo sapiens
gagaaaagcgaaggacctggag

SEQ ID NO: 7676887 - DNA, 22 bp, Homo sapiens
gagaaaagcgaaggacctggag

SEQ ID NO: 7676888 - DNA, 22 bp, Homo sapiens
gacttttctgagacaatgcttt

SEQ ID NO: 7676889 - DNA, 22 bp, Homo sapiens
gacttttgaataaggtaggata

SEQ ID NO: 7676890 - DNA, 22 bp, Homo sapiens
gactttgtgccaaacgccagaa

SEQ ID NO: 7676891 - DNA, 22 bp, Homo sapiens
gactttgtgccaaacgccagaa

SEQ ID NO: 7676892 - DNA, 22 bp, Homo sapiens
gactttgtaggtaattgtgtct

SEQ ID NO: 7676893 - DNA, 22 bp, Homo sapiens
gactttgtaggtaattgtgtct

SEQ ID NO: 7676894 - DNA, 22 bp, Homo sapiens
gactttggtttgagcaagtcag

SEQ ID NO: 7676895 - DNA, 22 bp, Homo sapiens
gagacacaggtggttcctgtca

SEQ ID NO: 7676896 - DNA, 22 bp, Homo sapiens
gagacacaggtggttcctgtca

SEQ ID NO: 7676897 - DNA, 22 bp, Homo sapiens
gagacacaggtggttcctgtca

SEQ ID NO: 7676898 - DNA, 22 bp, Homo sapiens
gagacacaggcacagaagaggc

SEQ ID NO: 7676899 - DNA, 22 bp, Homo sapiens
gagacacagagaggctgtgtga

SEQ ID NO: 7676900 - DNA, 22 bp, Homo sapiens
gagacacagttatcaggcatac

SEQ ID NO: 7676901 - DNA, 22 bp, Homo sapiens
gagacacagttatcaggcatac

SEQ ID NO: 7676902 - DNA, 22 bp, Homo sapiens
gagacacaggtggttcctgtca

SEQ ID NO: 7676903 - DNA, 22 bp, Homo sapiens
gagacacagcagatattcaatc

SEQ ID NO: 7676904 - DNA, 22 bp, Homo sapiens
gagacacagcagatattcaatc

SEQ ID NO: 7676905 - DNA, 22 bp, Homo sapiens
gagacacagagaggctgtgtga

SEQ ID NO: 7676906 - DNA, 22 bp, Homo sapiens
gagacacaggcacagaagaggc

SEQ ID NO: 7676907 - DNA, 22 bp, Homo sapiens
gagacacaggcacagaagaggc

SEQ ID NO: 7676908 - DNA, 22 bp, Homo sapiens
gagacacaggcacagaagaggc

SEQ ID NO: 7676909 - DNA, 22 bp, Homo sapiens
gagacacaggcacagaagaggc

SEQ ID NO: 7676910 - DNA, 22 bp, Homo sapiens
gagacagagaggtactcaacat

SEQ ID NO: 7676911 - DNA, 21 bp, Homo sapiens
gagacagactttcgtcccctg

SEQ ID NO: 7676912 - DNA, 22 bp, Homo sapiens
gagacagagaggtactcaacat

SEQ ID NO: 7676913 - DNA, 22 bp, Homo sapiens
gagacagagaggtactcaacat

SEQ ID NO: 7676914 - DNA, 22 bp, Homo sapiens
gagacagagatcttgctgagtc

SEQ ID NO: 7676915 - DNA, 22 bp, Homo sapiens
gagacagagaggtactcaacat

SEQ ID NO: 7676916 - DNA, 21 bp, Homo sapiens
gagacagactttcgtcccctg

SEQ ID NO: 7676917 - DNA, 22 bp, Homo sapiens
gagacacttgctgtgaggtcgc

SEQ ID NO: 7676918 - DNA, 22 bp, Homo sapiens
gagacacttgctgtgaggtcgc

SEQ ID NO: 7676919 - DNA, 22 bp, Homo sapiens
gagacacagttatcaggcatac

SEQ ID NO: 7676920 - DNA, 22 bp, Homo sapiens
gagacacagttatcaggcatac

SEQ ID NO: 7676921 - DNA, 22 bp, Homo sapiens
gagacacagttatcaggcatac

SEQ ID NO: 7676922 - DNA, 22 bp, Homo sapiens
gagacacagttatcaggcatac

SEQ ID NO: 7676923 - DNA, 22 bp, Homo sapiens
gagacacagttatcaggcatac

SEQ ID NO: 7676924 - DNA, 22 bp, Homo sapiens
gagacacagttatcaggcatac

SEQ ID NO: 7676925 - DNA, 22 bp, Homo sapiens
gagacactcaacaaagatatga

SEQ ID NO: 7676926 - DNA, 22 bp, Homo sapiens
gagacactcaacaaagatatga

SEQ ID NO: 7676927 - DNA, 22 bp, Homo sapiens
gagacacaatctcatttacatt

SEQ ID NO: 7676928 - DNA, 22 bp, Homo sapiens
gagacacaatctcatttacatt

SEQ ID NO: 7676929 - DNA, 18 bp, Homo sapiens
gagacacaagggcctgga

SEQ ID NO: 7676930 - DNA, 22 bp, Homo sapiens
gagacacaatttccccatccta

SEQ ID NO: 7676931 - DNA, 22 bp, Homo sapiens
gagacacaatttccccatccta

SEQ ID NO: 7676932 - DNA, 22 bp, Homo sapiens
gagacacaatctcatttacatt

SEQ ID NO: 7676933 - DNA, 22 bp, Homo sapiens
gagacacaatttccccatccta

SEQ ID NO: 7676934 - DNA, 22 bp, Homo sapiens
gagacacaatctcatttacatt

SEQ ID NO: 7676935 - DNA, 22 bp, Homo sapiens
gagacacaagacgcaactctgt

SEQ ID NO: 7676936 - DNA, 22 bp, Homo sapiens
gagacacaagaagacatgcaca

SEQ ID NO: 7676937 - DNA, 22 bp, Homo sapiens
gagacacaagaagacatgcaca

SEQ ID NO: 7676938 - DNA, 22 bp, Homo sapiens
gagacacaagaagacatgcaca

SEQ ID NO: 7676939 - DNA, 18 bp, Homo sapiens
gagacacaagggcctgga

SEQ ID NO: 7676940 - DNA, 22 bp, Homo sapiens
gagacacaagacgcaactctgt

SEQ ID NO: 7676941 - DNA, 22 bp, Homo sapiens
gagacacaagacgcaactctgt

SEQ ID NO: 7676942 - DNA, 18 bp, Homo sapiens
gagacacaagggcctgga

SEQ ID NO: 7676943 - DNA, 18 bp, Homo sapiens
gagacacaagggcctgga

SEQ ID NO: 7676944 - DNA, 22 bp, Homo sapiens
gagacacacccaaggttatgag

SEQ ID NO: 7676945 - DNA, 22 bp, Homo sapiens
gagacacacccaaggttatgag

SEQ ID NO: 7676946 - DNA, 22 bp, Homo sapiens
gagacacacccaaggttatgag

SEQ ID NO: 7676947 - DNA, 22 bp, Homo sapiens
gagacacacccaaggttatgag

SEQ ID NO: 7676948 - DNA, 22 bp, Homo sapiens
gagacacacccaaggttatgag

SEQ ID NO: 7676949 - DNA, 22 bp, Homo sapiens
gagacacacattctggagagaa

SEQ ID NO: 7676950 - DNA, 22 bp, Homo sapiens
gagacacacattctggagagaa

SEQ ID NO: 7676951 - DNA, 22 bp, Homo sapiens
gagacacacattctggagagaa

SEQ ID NO: 7676952 - DNA, 22 bp, Homo sapiens
gagacacacattctggagagaa

SEQ ID NO: 7676953 - DNA, 22 bp, Homo sapiens
gagacacacacaggaggtggca

SEQ ID NO: 7676954 - DNA, 22 bp, Homo sapiens
gagacacacacaggaggtggca

SEQ ID NO: 7676955 - DNA, 22 bp, Homo sapiens
gagacacacacaggaggtggca

SEQ ID NO: 7676956 - DNA, 22 bp, Homo sapiens
gagacagagtttcactcttgtt

SEQ ID NO: 7676957 - DNA, 22 bp, Homo sapiens
gagacagagtttcactcttgtt

SEQ ID NO: 7676958 - DNA, 22 bp, Homo sapiens
gagacagatctcggctccatgc

SEQ ID NO: 7676959 - DNA, 22 bp, Homo sapiens
gagacagatctcggctccatgc

SEQ ID NO: 7676960 - DNA, 22 bp, Homo sapiens
gagacagatctcggctccatgc

SEQ ID NO: 7676961 - DNA, 22 bp, Homo sapiens
gagacagatctcggctccatgc

SEQ ID NO: 7676962 - DNA, 22 bp, Homo sapiens
gagacagagtttcactcttgtt

SEQ ID NO: 7676963 - DNA, 22 bp, Homo sapiens
gagacagagtttcactcttgtt

SEQ ID NO: 7676964 - DNA, 22 bp, Homo sapiens
gagacagagaggtactcaacat

SEQ ID NO: 7676965 - DNA, 22 bp, Homo sapiens
gagacagagatcttgctgagtc

SEQ ID NO: 7676966 - DNA, 22 bp, Homo sapiens
gagacagagatcttgctgagtc

SEQ ID NO: 7676967 - DNA, 22 bp, Homo sapiens
gagacagagatcttgctgagtc

SEQ ID NO: 7676968 - DNA, 22 bp, Homo sapiens
gagacagagatcttgctgagtc

SEQ ID NO: 7676969 - DNA, 22 bp, Homo sapiens
gagacagagatcttgctgagtc

SEQ ID NO: 7676970 - DNA, 22 bp, Homo sapiens
gagacagagtgttttttaaggt

SEQ ID NO: 7676971 - DNA, 22 bp, Homo sapiens
gagacagagatcttgctgagtc

SEQ ID NO: 7676972 - DNA, 22 bp, Homo sapiens
gagacagagtgttttttaaggt

SEQ ID NO: 7676973 - DNA, 22 bp, Homo sapiens
gagacagagtgttttttaaggt

SEQ ID NO: 7676974 - DNA, 22 bp, Homo sapiens
gagacagagatcttgctgagtc

SEQ ID NO: 7676975 - DNA, 22 bp, Homo sapiens
gagacagagatcttgctgagtc

SEQ ID NO: 7676976 - DNA, 22 bp, Homo sapiens
gagagcccttaggtttagagtt

SEQ ID NO: 7676977 - DNA, 22 bp, Homo sapiens
gagagccctgctcctatcccag

SEQ ID NO: 7676978 - DNA, 22 bp, Homo sapiens
gagacagatctcggctccatgc

SEQ ID NO: 7676979 - DNA, 22 bp, Homo sapiens
gagacagatctcggctccatgc

SEQ ID NO: 7676980 - DNA, 22 bp, Homo sapiens
gagacagatctcggctccatgc

SEQ ID NO: 7676981 - DNA, 22 bp, Homo sapiens
gagagctaactacctggaaatg

SEQ ID NO: 7676982 - DNA, 22 bp, Homo sapiens
gagagctaggccactggggctt

SEQ ID NO: 7676983 - DNA, 21 bp, Homo sapiens
gagagctaacagtgacagctc

SEQ ID NO: 7676984 - DNA, 22 bp, Homo sapiens
gagagcctttgaagggaagtga

SEQ ID NO: 7676985 - DNA, 22 bp, Homo sapiens
gagagcccttaggtttagagtt

SEQ ID NO: 7676986 - DNA, 22 bp, Homo sapiens
gagagcctttgaagggaagtga

SEQ ID NO: 7676987 - DNA, 22 bp, Homo sapiens
gagagcctgccagtgagtgtat

SEQ ID NO: 7676988 - DNA, 22 bp, Homo sapiens
gagagctgaggggcctggcact

SEQ ID NO: 7676989 - DNA, 22 bp, Homo sapiens
gagagctgaggggcctggcact

SEQ ID NO: 7676990 - DNA, 23 bp, Homo sapiens
gagagctgactgtcaagactgtt

SEQ ID NO: 7676991 - DNA, 23 bp, Homo sapiens
gagagctgactgtcaagactgtt

SEQ ID NO: 7676992 - DNA, 23 bp, Homo sapiens
gagagctgactgtcaagactgtt

SEQ ID NO: 7676993 - DNA, 22 bp, Homo sapiens
gagagctccatgttcatgctgt

SEQ ID NO: 7676994 - DNA, 22 bp, Homo sapiens
gagagctatttggcaagcattt

SEQ ID NO: 7676995 - DNA, 22 bp, Homo sapiens
gagagctaggccactggggctt

SEQ ID NO: 7676996 - DNA, 22 bp, Homo sapiens
gagagctccatgttcatgctgt

SEQ ID NO: 7676997 - DNA, 18 bp, Homo sapiens
gagagctgctacctagct

SEQ ID NO: 7676998 - DNA, 18 bp, Homo sapiens
gagagctgctacctagct

SEQ ID NO: 7676999 - DNA, 22 bp, Homo sapiens
gagagctgcattctcagacaca

SEQ ID NO: 7677000 - DNA, 22 bp, Homo sapiens
gagagctgcattctcagacaca

SEQ ID NO: 7677001 - DNA, 22 bp, Homo sapiens
gagagctgcattctcagacaca

SEQ ID NO: 7677002 - DNA, 22 bp, Homo sapiens
gagagctgcattctcagacaca

SEQ ID NO: 7677003 - DNA, 17 bp, Homo sapiens
gagagctgctgcttccg

SEQ ID NO: 7677004 - DNA, 17 bp, Homo sapiens
gagagctgctgcttccg

SEQ ID NO: 7677005 - DNA, 17 bp, Homo sapiens
gagagctgctgcttccg

SEQ ID NO: 7677006 - DNA, 20 bp, Homo sapiens
gagagctggaaataaagtcc

SEQ ID NO: 7677007 - DNA, 17 bp, Homo sapiens
gagagctgctgcttccg

SEQ ID NO: 7677008 - DNA, 17 bp, Homo sapiens
gagagctgctgcttccg

SEQ ID NO: 7677009 - DNA, 17 bp, Homo sapiens
gagagctgctgcttccg

SEQ ID NO: 7677010 - DNA, 22 bp, Homo sapiens
gagagctgcagccgagaggggg

SEQ ID NO: 7677011 - DNA, 22 bp, Homo sapiens
gagagctgcagccgagaggggg

SEQ ID NO: 7677012 - DNA, 22 bp, Homo sapiens
gagagctgcagccgagaggggg

SEQ ID NO: 7677013 - DNA, 22 bp, Homo sapiens
gagagctgcaaggtagggcggg

SEQ ID NO: 7677014 - DNA, 22 bp, Homo sapiens
gagagctgcaaggtagggcggg

SEQ ID NO: 7677015 - DNA, 22 bp, Homo sapiens
gagagctgatagatgagctact

SEQ ID NO: 7677016 - DNA, 22 bp, Homo sapiens
gagagctgatagatgagctact

SEQ ID NO: 7677017 - DNA, 22 bp, Homo sapiens
gagagctgatagatgagctact

SEQ ID NO: 7677018 - DNA, 22 bp, Homo sapiens
gagagctgaggggcctggcact

SEQ ID NO: 7677019 - DNA, 22 bp, Homo sapiens
gagagctgaggggcctggcact

SEQ ID NO: 7677020 - DNA, 22 bp, Homo sapiens
gagagctgaggggcctggcact

SEQ ID NO: 7677021 - DNA, 20 bp, Homo sapiens
gagagctggggatgaggctg

SEQ ID NO: 7677022 - DNA, 20 bp, Homo sapiens
gagagctggggatgaggctg

SEQ ID NO: 7677023 - DNA, 20 bp, Homo sapiens
gagagctggggatgaggctg

SEQ ID NO: 7677024 - DNA, 20 bp, Homo sapiens
gagagctggggatgaggctg

SEQ ID NO: 7677025 - DNA, 20 bp, Homo sapiens
gagagctggggatgaggctg

SEQ ID NO: 7677026 - DNA, 20 bp, Homo sapiens
gagagctggggatgaggctg

SEQ ID NO: 7677027 - DNA, 20 bp, Homo sapiens
gagagctggggatgaggctg

SEQ ID NO: 7677028 - DNA, 22 bp, Homo sapiens
gagagctgggctttgggtgaag

SEQ ID NO: 7677029 - DNA, 22 bp, Homo sapiens
gagagctgggaaagccgtggag

SEQ ID NO: 7677030 - DNA, 22 bp, Homo sapiens
gagagctgggctttgggtgaag

SEQ ID NO: 7677031 - DNA, 22 bp, Homo sapiens
gagagctgggctttgggtgaag

SEQ ID NO: 7677032 - DNA, 22 bp, Homo sapiens
gagagctgggctttgggtgaag

SEQ ID NO: 7677033 - DNA, 22 bp, Homo sapiens
gagagctgggctttgggtgaag

SEQ ID NO: 7677034 - DNA, 22 bp, Homo sapiens
gagagctgggaaagccgtggag

SEQ ID NO: 7677035 - DNA, 22 bp, Homo sapiens
gagagctggattctggataggt

SEQ ID NO: 7677036 - DNA, 22 bp, Homo sapiens
gagagctggattctggataggt

SEQ ID NO: 7677037 - DNA, 22 bp, Homo sapiens
gagagctggattctggataggt

SEQ ID NO: 7677038 - DNA, 22 bp, Homo sapiens
gagagctggccagcttcagtat

SEQ ID NO: 7677039 - DNA, 22 bp, Homo sapiens
gagagctggccagcttcagtat

SEQ ID NO: 7677040 - DNA, 22 bp, Homo sapiens
gagagctgggaaagccgtggag

SEQ ID NO: 7677041 - DNA, 22 bp, Homo sapiens
gagagctgggaaagccgtggag

SEQ ID NO: 7677042 - DNA, 22 bp, Homo sapiens
gagagctgggaaagccgtggag

SEQ ID NO: 7677043 - DNA, 22 bp, Homo sapiens
gagagctggattctggataggt

SEQ ID NO: 7677044 - DNA, 22 bp, Homo sapiens
gagagctggagttatttctctg

SEQ ID NO: 7677045 - DNA, 22 bp, Homo sapiens
gagagctggagttatttctctg

SEQ ID NO: 7677046 - DNA, 22 bp, Homo sapiens
gagagctggagttatttctctg

SEQ ID NO: 7677047 - DNA, 20 bp, Homo sapiens
gagagctggaaataaagtcc

SEQ ID NO: 7677048 - DNA, 20 bp, Homo sapiens
gagagctggaaataaagtcc

SEQ ID NO: 7677049 - DNA, 22 bp, Homo sapiens
gagagctggattctggataggt

SEQ ID NO: 7677050 - DNA, 22 bp, Homo sapiens
gagagctggattctggataggt

SEQ ID NO: 7677051 - DNA, 22 bp, Homo sapiens
gagagctggattctggataggt

SEQ ID NO: 7677052 - DNA, 22 bp, Homo sapiens
gagagctgggggactgtggatg

SEQ ID NO: 7677053 - DNA, 22 bp, Homo sapiens
gagagctgggggactgtggatg

SEQ ID NO: 7677054 - DNA, 22 bp, Homo sapiens
gagagctgggggactgtggatg

SEQ ID NO: 7677055 - DNA, 22 bp, Homo sapiens
gagagctgggggactgtggatg

SEQ ID NO: 7677056 - DNA, 22 bp, Homo sapiens
gagagctgggggactgtggatg

SEQ ID NO: 7677057 - DNA, 20 bp, Homo sapiens
gagagctggggatgaggctg

SEQ ID NO: 7677058 - DNA, 20 bp, Homo sapiens
gagagctggggatgaggctg

SEQ ID NO: 7677059 - DNA, 22 bp, Homo sapiens
gagagctgtaatagtcatgtct

SEQ ID NO: 7677060 - DNA, 22 bp, Homo sapiens
gagaggtaatttgaagtgcaaa

SEQ ID NO: 7677061 - DNA, 22 bp, Homo sapiens
gagagctgggttcaagtagctg

SEQ ID NO: 7677062 - DNA, 22 bp, Homo sapiens
gagagctgggttcaagtagctg

SEQ ID NO: 7677063 - DNA, 22 bp, Homo sapiens
gagagctgggttcaagtagctg

SEQ ID NO: 7677064 - DNA, 22 bp, Homo sapiens
gagagtctaggaacctcatata

SEQ ID NO: 7677065 - DNA, 22 bp, Homo sapiens
gagagtctaggaacctcatata

SEQ ID NO: 7677066 - DNA, 17 bp, Homo sapiens
gagagtctaatgggaga

SEQ ID NO: 7677067 - DNA, 22 bp, Homo sapiens
gagagtccttagtttgcaggta

SEQ ID NO: 7677068 - DNA, 22 bp, Homo sapiens
gagaggtagaggctctgcttaa

SEQ ID NO: 7677069 - DNA, 22 bp, Homo sapiens
gagagtccttagtttgcaggta

SEQ ID NO: 7677070 - DNA, 22 bp, Homo sapiens
gagagtctaggaacctcatata

SEQ ID NO: 7677071 - DNA, 22 bp, Homo sapiens
gagagtctaggaacctcatata

SEQ ID NO: 7677072 - DNA, 22 bp, Homo sapiens
gagaggtacggaaagagcgtgg

SEQ ID NO: 7677073 - DNA, 22 bp, Homo sapiens
gagaggtacaccctttaaactt

SEQ ID NO: 7677074 - DNA, 22 bp, Homo sapiens
gagaggtacggaaagagcgtgg

SEQ ID NO: 7677075 - DNA, 22 bp, Homo sapiens
gagaggtagaggctctgcttaa

SEQ ID NO: 7677076 - DNA, 22 bp, Homo sapiens
gagagtccttagtttgcaggta

SEQ ID NO: 7677077 - DNA, 22 bp, Homo sapiens
gagagtccttagtttgcaggta

SEQ ID NO: 7677078 - DNA, 22 bp, Homo sapiens
gacaggcaggccagggctgtgg

SEQ ID NO: 7677079 - DNA, 22 bp, Homo sapiens
gacaggcaggccagggctgtgg

SEQ ID NO: 7677080 - DNA, 22 bp, Homo sapiens
gacaggcaggccagggctgtgg

SEQ ID NO: 7677081 - DNA, 22 bp, Homo sapiens
gacaggcaggccagggctgtgg

SEQ ID NO: 7677082 - DNA, 22 bp, Homo sapiens
gacaggcaggccagggctgtgg

SEQ ID NO: 7677083 - DNA, 22 bp, Homo sapiens
gacaggcagttttccagatcag

SEQ ID NO: 7677084 - DNA, 22 bp, Homo sapiens
gacaggcagttttccagatcag

SEQ ID NO: 7677085 - DNA, 22 bp, Homo sapiens
gacaggcagttttccagatcag

SEQ ID NO: 7677086 - DNA, 22 bp, Homo sapiens
gacaggcatgctttcaggacta

SEQ ID NO: 7677087 - DNA, 22 bp, Homo sapiens
gacaggcatgctttcaggacta

SEQ ID NO: 7677088 - DNA, 22 bp, Homo sapiens
gacaggccagacaggagactga

SEQ ID NO: 7677089 - DNA, 22 bp, Homo sapiens
gacaggccagacaggagactga

SEQ ID NO: 7677090 - DNA, 22 bp, Homo sapiens
gacaggccagacaggagactga

SEQ ID NO: 7677091 - DNA, 22 bp, Homo sapiens
gaccaggctgttccagtctaac

SEQ ID NO: 7677092 - DNA, 22 bp, Homo sapiens
gaccaggcttccccagacctca

SEQ ID NO: 7677093 - DNA, 22 bp, Homo sapiens
gaccaggcttccccagacctca

SEQ ID NO: 7677094 - DNA, 22 bp, Homo sapiens
gaccatcctggccaacgtggta

SEQ ID NO: 7677095 - DNA, 22 bp, Homo sapiens
gaccatcctggccaacgtggta

SEQ ID NO: 7677096 - DNA, 22 bp, Homo sapiens
gaccatgtgaaaatagaggaga

SEQ ID NO: 7677097 - DNA, 22 bp, Homo sapiens
gaccatcctggccaacgtggta

SEQ ID NO: 7677098 - DNA, 22 bp, Homo sapiens
gaccatcctggccaacgtggta

SEQ ID NO: 7677099 - DNA, 22 bp, Homo sapiens
gaccatcctggccaacgtggta

SEQ ID NO: 7677100 - DNA, 22 bp, Homo sapiens
gaccatcctggccaacgtggta

SEQ ID NO: 7677101 - DNA, 22 bp, Homo sapiens
gaccatcctggccaacgtggta

SEQ ID NO: 7677102 - DNA, 22 bp, Homo sapiens
gaccagttttctgctttggaag

SEQ ID NO: 7677103 - DNA, 22 bp, Homo sapiens
gaccagggtcactcacagggct

SEQ ID NO: 7677104 - DNA, 22 bp, Homo sapiens
gaccagggtcactcacagggct

SEQ ID NO: 7677105 - DNA, 22 bp, Homo sapiens
gaccagggtcactcacagggct

SEQ ID NO: 7677106 - DNA, 22 bp, Homo sapiens
gaccaggcttccccagacctca

SEQ ID NO: 7677107 - DNA, 22 bp, Homo sapiens
gaccagggtcactcacagggct

SEQ ID NO: 7677108 - DNA, 22 bp, Homo sapiens
gaccagtcattactcatgccct

SEQ ID NO: 7677109 - DNA, 22 bp, Homo sapiens
gaccagtcattactcatgccct

SEQ ID NO: 7677110 - DNA, 22 bp, Homo sapiens
gaccagtcattactcatgccct

SEQ ID NO: 7677111 - DNA, 22 bp, Homo sapiens
gaccagtcattactcatgccct

SEQ ID NO: 7677112 - DNA, 22 bp, Homo sapiens
gaccagtcattactcatgccct

SEQ ID NO: 7677113 - DNA, 22 bp, Homo sapiens
gaccagtcattactcatgccct

SEQ ID NO: 7677114 - DNA, 20 bp, Homo sapiens
gacaggagagttaggtaggt

SEQ ID NO: 7677115 - DNA, 22 bp, Homo sapiens
gacaggaggcagagctcaggtg

SEQ ID NO: 7677116 - DNA, 20 bp, Homo sapiens
gacaggagagttaggtaggt

SEQ ID NO: 7677117 - DNA, 22 bp, Homo sapiens
gacaggaggcagagctcaggtg

SEQ ID NO: 7677118 - DNA, 22 bp, Homo sapiens
gacaggaggcagagctcaggtg

SEQ ID NO: 7677119 - DNA, 22 bp, Homo sapiens
gacaggaggcagagctcaggtg

SEQ ID NO: 7677120 - DNA, 22 bp, Homo sapiens
gacaggaggcagagctcaggtg

SEQ ID NO: 7677121 - DNA, 22 bp, Homo sapiens
gacaggaggcagagctcaggtg

SEQ ID NO: 7677122 - DNA, 22 bp, Homo sapiens
gacaggaggcagagctcaggtg

SEQ ID NO: 7677123 - DNA, 22 bp, Homo sapiens
gacaggaggcagagctcaggtg

SEQ ID NO: 7677124 - DNA, 22 bp, Homo sapiens
gacaggaggcagagctcaggtg

SEQ ID NO: 7677125 - DNA, 22 bp, Homo sapiens
gacaggaggcagagctcaggtg

SEQ ID NO: 7677126 - DNA, 22 bp, Homo sapiens
gacaggaggcagagctcaggtg

SEQ ID NO: 7677127 - DNA, 21 bp, Homo sapiens
gacaggcaaggagtcacttag

SEQ ID NO: 7677128 - DNA, 22 bp, Homo sapiens
gacaggcaattaccagcgccca

SEQ ID NO: 7677129 - DNA, 22 bp, Homo sapiens
gacaggcaattaccagcgccca

SEQ ID NO: 7677130 - DNA, 22 bp, Homo sapiens
gacaggcaattaccagcgccca

SEQ ID NO: 7677131 - DNA, 22 bp, Homo sapiens
gacaggcaattaccagcgccca

SEQ ID NO: 7677132 - DNA, 21 bp, Homo sapiens
gacaggcaaggagtcacttag

SEQ ID NO: 7677133 - DNA, 21 bp, Homo sapiens
gacaggcaaggagtcacttag

SEQ ID NO: 7677134 - DNA, 22 bp, Homo sapiens
gacaggatgtattggcaagagg

SEQ ID NO: 7677135 - DNA, 22 bp, Homo sapiens
gacaggatgtattggcaagagg

SEQ ID NO: 7677136 - DNA, 22 bp, Homo sapiens
gacaggatattatgatagattc

SEQ ID NO: 7677137 - DNA, 22 bp, Homo sapiens
gacaggatgtattggcaagagg

SEQ ID NO: 7677138 - DNA, 21 bp, Homo sapiens
gacaggcaaggagtcacttag

SEQ ID NO: 7677139 - DNA, 22 bp, Homo sapiens
gacaggatattatgatagattc

SEQ ID NO: 7677140 - DNA, 21 bp, Homo sapiens
gacaggcaaggagtcacttag

SEQ ID NO: 7677141 - DNA, 22 bp, Homo sapiens
gacaggcagacctgtgccctgg

SEQ ID NO: 7677142 - DNA, 22 bp, Homo sapiens
gacaggcagacctgtgccctgg

SEQ ID NO: 7677143 - DNA, 22 bp, Homo sapiens
gacaggcagacctgtgccctgg

SEQ ID NO: 7677144 - DNA, 22 bp, Homo sapiens
gacaggcagacctgtgccctgg

SEQ ID NO: 7677145 - DNA, 22 bp, Homo sapiens
gacaggcagacctgtgccctgg

SEQ ID NO: 7677146 - DNA, 22 bp, Homo sapiens
gacaggcacgaaattgggctgg

SEQ ID NO: 7677147 - DNA, 22 bp, Homo sapiens
gacaggcacgaaattgggctgg

SEQ ID NO: 7677148 - DNA, 22 bp, Homo sapiens
gacaggcaccttgtctgtcttg

SEQ ID NO: 7677149 - DNA, 22 bp, Homo sapiens
gacaggcacgaaattgggctgg

SEQ ID NO: 7677150 - DNA, 22 bp, Homo sapiens
gacccagggtatccagagctgc

SEQ ID NO: 7677151 - DNA, 22 bp, Homo sapiens
gacccagggtatccagagctgc

SEQ ID NO: 7677152 - DNA, 22 bp, Homo sapiens
gacccaggggtccatttctcct

SEQ ID NO: 7677153 - DNA, 22 bp, Homo sapiens
gacccagggtatccagagctgc

SEQ ID NO: 7677154 - DNA, 22 bp, Homo sapiens
gacccaggggcagggagaaagt

SEQ ID NO: 7677155 - DNA, 22 bp, Homo sapiens
gacccaggggcagggagaaagt

SEQ ID NO: 7677156 - DNA, 22 bp, Homo sapiens
gacccaggctcgtgggacggct

SEQ ID NO: 7677157 - DNA, 22 bp, Homo sapiens
gacccaggggcagggagaaagt

SEQ ID NO: 7677158 - DNA, 22 bp, Homo sapiens
gacccagggtatccagagctgc

SEQ ID NO: 7677159 - DNA, 22 bp, Homo sapiens
gacccagggtatccagagctgc

SEQ ID NO: 7677160 - DNA, 22 bp, Homo sapiens
gacccagggtatccagagctgc

SEQ ID NO: 7677161 - DNA, 22 bp, Homo sapiens
gacccagggtatccagagctgc

SEQ ID NO: 7677162 - DNA, 22 bp, Homo sapiens
gacccagggtggtcacctgaaa

SEQ ID NO: 7677163 - DNA, 22 bp, Homo sapiens
gacccagggtggtcacctgaaa

SEQ ID NO: 7677164 - DNA, 22 bp, Homo sapiens
gacccagggtggtcacctgaaa

SEQ ID NO: 7677165 - DNA, 22 bp, Homo sapiens
gacccagggtatccagagctgc

SEQ ID NO: 7677166 - DNA, 22 bp, Homo sapiens
gacccagggtatccagagctgc

SEQ ID NO: 7677167 - DNA, 22 bp, Homo sapiens
gacccagggtatccagagctgc

SEQ ID NO: 7677168 - DNA, 22 bp, Homo sapiens
gacccagggtatccagagctgc

SEQ ID NO: 7677169 - DNA, 22 bp, Homo sapiens
gacccaggcaatgaacttactt

SEQ ID NO: 7677170 - DNA, 22 bp, Homo sapiens
gacccaggcaatgaacttactt

SEQ ID NO: 7677171 - DNA, 22 bp, Homo sapiens
gacccaggcccaaggctgccag

SEQ ID NO: 7677172 - DNA, 22 bp, Homo sapiens
gacccaggcccaaggctgccag

SEQ ID NO: 7677173 - DNA, 22 bp, Homo sapiens
gacccaggcccaaggctgccag

SEQ ID NO: 7677174 - DNA, 22 bp, Homo sapiens
gacccaggcccaaggctgccag

SEQ ID NO: 7677175 - DNA, 22 bp, Homo sapiens
gacccaggcctggggcttaagg

SEQ ID NO: 7677176 - DNA, 22 bp, Homo sapiens
gacccaggcctggggcttaagg

SEQ ID NO: 7677177 - DNA, 22 bp, Homo sapiens
gacccaggcctggggcttaagg

SEQ ID NO: 7677178 - DNA, 22 bp, Homo sapiens
gacccaggcccaaggctgccag

SEQ ID NO: 7677179 - DNA, 22 bp, Homo sapiens
gacccaggcccaaggctgccag

SEQ ID NO: 7677180 - DNA, 22 bp, Homo sapiens
gacccaggctcgtgggacggct

SEQ ID NO: 7677181 - DNA, 22 bp, Homo sapiens
gacccaggctcgtgggacggct

SEQ ID NO: 7677182 - DNA, 22 bp, Homo sapiens
gacccaggagtgcagagagtgg

SEQ ID NO: 7677183 - DNA, 22 bp, Homo sapiens
gacccaggagagagggttgcat

SEQ ID NO: 7677184 - DNA, 22 bp, Homo sapiens
gacccaggagtgcagagagtgg

SEQ ID NO: 7677185 - DNA, 22 bp, Homo sapiens
gacccaggagtgcagagagtgg

SEQ ID NO: 7677186 - DNA, 22 bp, Homo sapiens
gacccaggagtgcagagagtgg

SEQ ID NO: 7677187 - DNA, 22 bp, Homo sapiens
gacccaggagtgcagagagtgg

SEQ ID NO: 7677188 - DNA, 22 bp, Homo sapiens
gacccaggagtgcagagagtgg

SEQ ID NO: 7677189 - DNA, 22 bp, Homo sapiens
gacccaggagagagggttgcat

SEQ ID NO: 7677190 - DNA, 22 bp, Homo sapiens
gacccaggagagagggttgcat

SEQ ID NO: 7677191 - DNA, 22 bp, Homo sapiens
gacccaggagagagggttgcat

SEQ ID NO: 7677192 - DNA, 22 bp, Homo sapiens
gacccaggagagagggttgcat

SEQ ID NO: 7677193 - DNA, 22 bp, Homo sapiens
gacccaggaagctacttctggt

SEQ ID NO: 7677194 - DNA, 18 bp, Homo sapiens
gacccaggaaagagtcct

SEQ ID NO: 7677195 - DNA, 18 bp, Homo sapiens
gacccaggaaagagtcct

SEQ ID NO: 7677196 - DNA, 22 bp, Homo sapiens
gacccagcttaagtcacatgtt

SEQ ID NO: 7677197 - DNA, 18 bp, Homo sapiens
gacccaggaaagagtcct

SEQ ID NO: 7677198 - DNA, 18 bp, Homo sapiens
gacccaggaaagagtcct

SEQ ID NO: 7677199 - DNA, 18 bp, Homo sapiens
gacccaggaaagagtcct

SEQ ID NO: 7677200 - DNA, 22 bp, Homo sapiens
gacccagcttaagtcacatgtt

SEQ ID NO: 7677201 - DNA, 22 bp, Homo sapiens
gacccagcttaagtcacatgtt

SEQ ID NO: 7677202 - DNA, 22 bp, Homo sapiens
gacccagcttaagtcacatgtt

SEQ ID NO: 7677203 - DNA, 22 bp, Homo sapiens
gacccagctaaccaggtgggga

SEQ ID NO: 7677204 - DNA, 18 bp, Homo sapiens
gacccagcagatgggctt

SEQ ID NO: 7677205 - DNA, 22 bp, Homo sapiens
gacccagaaggagtgccctaga

SEQ ID NO: 7677206 - DNA, 22 bp, Homo sapiens
gacccagaggcctgacagtgtg

SEQ ID NO: 7677207 - DNA, 22 bp, Homo sapiens
gaccatttttacagagcattca

SEQ ID NO: 7677208 - DNA, 22 bp, Homo sapiens
gacccagaggcctgacagtgtg

SEQ ID NO: 7677209 - DNA, 18 bp, Homo sapiens
gacccagcagatgggctt

SEQ ID NO: 7677210 - DNA, 22 bp, Homo sapiens
gacccagaggcctgacagtgtg

SEQ ID NO: 7677211 - DNA, 22 bp, Homo sapiens
gacccagaggcctgacagtgtg

SEQ ID NO: 7677212 - DNA, 22 bp, Homo sapiens
gacccagaaggagtgccctaga

SEQ ID NO: 7677213 - DNA, 22 bp, Homo sapiens
gaccatttgttgaaaagattat

SEQ ID NO: 7677214 - DNA, 22 bp, Homo sapiens
gaccatttgttgaaaagattat

SEQ ID NO: 7677215 - DNA, 22 bp, Homo sapiens
gaccatttgctagtaaattgca

SEQ ID NO: 7677216 - DNA, 22 bp, Homo sapiens
gaccatttgctagtaaattgca

SEQ ID NO: 7677217 - DNA, 22 bp, Homo sapiens
gaccatttccaccatgggcaca

SEQ ID NO: 7677218 - DNA, 22 bp, Homo sapiens
gaccatttctaggaatcagact

SEQ ID NO: 7677219 - DNA, 22 bp, Homo sapiens
gaccatttctaggaatcagact

SEQ ID NO: 7677220 - DNA, 22 bp, Homo sapiens
gaccattagctgctattcagta

SEQ ID NO: 7677221 - DNA, 22 bp, Homo sapiens
gaccattagctgctattcagta

SEQ ID NO: 7677222 - DNA, 22 bp, Homo sapiens
gaccattggcacagagcttttt

SEQ ID NO: 7677223 - DNA, 22 bp, Homo sapiens
gaccatttcaggggcagggact

SEQ ID NO: 7677224 - DNA, 22 bp, Homo sapiens
gaccatttcaggggcagggact

SEQ ID NO: 7677225 - DNA, 18 bp, Homo sapiens
gactttaaaacactgctc

SEQ ID NO: 7677226 - DNA, 18 bp, Homo sapiens
gactttaaaacactgctc

SEQ ID NO: 7677227 - DNA, 22 bp, Homo sapiens
gactttaaaagtttgtgcttgg

SEQ ID NO: 7677228 - DNA, 22 bp, Homo sapiens
gactttaaaagtttgtgcttgg

SEQ ID NO: 7677229 - DNA, 22 bp, Homo sapiens
gacttgtttcaggtttgattgc

SEQ ID NO: 7677230 - DNA, 22 bp, Homo sapiens
gacttgggtgtcggggcagtct

SEQ ID NO: 7677231 - DNA, 22 bp, Homo sapiens
gacttgggtgtcggggcagtct

SEQ ID NO: 7677232 - DNA, 22 bp, Homo sapiens
gactttaaagcctgacatttta

SEQ ID NO: 7677233 - DNA, 22 bp, Homo sapiens
gactttaaagcctgacatttta

SEQ ID NO: 7677234 - DNA, 22 bp, Homo sapiens
gactttaaaatgctagaacagg

SEQ ID NO: 7677235 - DNA, 22 bp, Homo sapiens
gactttaagtaagtcaaggagc

SEQ ID NO: 7677236 - DNA, 22 bp, Homo sapiens
gactttaaaggttctgctgctt

SEQ ID NO: 7677237 - DNA, 22 bp, Homo sapiens
gactttaaaggttctgctgctt

SEQ ID NO: 7677238 - DNA, 19 bp, Homo sapiens
gacttctgatgtccagatg

SEQ ID NO: 7677239 - DNA, 22 bp, Homo sapiens
gacttctgcctcaggggaaggt

SEQ ID NO: 7677240 - DNA, 22 bp, Homo sapiens
gacttctgttaacttgtaagag

SEQ ID NO: 7677241 - DNA, 22 bp, Homo sapiens
gacttcttcatgtcttttccac

SEQ ID NO: 7677242 - DNA, 22 bp, Homo sapiens
gacttctgttaacttgtaagag

SEQ ID NO: 7677243 - DNA, 22 bp, Homo sapiens
gacttcttcatgtcttttccac

SEQ ID NO: 7677244 - DNA, 22 bp, Homo sapiens
gacttgggagtcttctgagatg

SEQ ID NO: 7677245 - DNA, 22 bp, Homo sapiens
gacttgcctgcactgagcctat

SEQ ID NO: 7677246 - DNA, 22 bp, Homo sapiens
gacttgggagtcttctgagatg

SEQ ID NO: 7677247 - DNA, 22 bp, Homo sapiens
gacttgggagtcttctgagatg

SEQ ID NO: 7677248 - DNA, 22 bp, Homo sapiens
gacttgggctgagggccagcag

SEQ ID NO: 7677249 - DNA, 22 bp, Homo sapiens
gacttgggctgagggccagcag

SEQ ID NO: 7677250 - DNA, 22 bp, Homo sapiens
gacttggggatttatctcacag

SEQ ID NO: 7677251 - DNA, 22 bp, Homo sapiens
gacttgggggctttggataggc

SEQ ID NO: 7677252 - DNA, 22 bp, Homo sapiens
gacttgggtggattgtgactct

SEQ ID NO: 7677253 - DNA, 22 bp, Homo sapiens
gacttgggtggattgtgactct

SEQ ID NO: 7677254 - DNA, 22 bp, Homo sapiens
gacttgggtgtcggggcagtct

SEQ ID NO: 7677255 - DNA, 22 bp, Homo sapiens
gacttgggcttgggcgtgggtt

SEQ ID NO: 7677256 - DNA, 22 bp, Homo sapiens
gacttgggcttgggcgtgggtt

SEQ ID NO: 7677257 - DNA, 22 bp, Homo sapiens
gacttgggggaagatgtggctg

SEQ ID NO: 7677258 - DNA, 22 bp, Homo sapiens
gacttgggggaagatgtggctg

SEQ ID NO: 7677259 - DNA, 17 bp, Homo sapiens
gacttcaacttctgctg

SEQ ID NO: 7677260 - DNA, 22 bp, Homo sapiens
gacttcaaaggtcaaacatcgc

SEQ ID NO: 7677261 - DNA, 22 bp, Homo sapiens
gacttcaaagcgtgataaagat

SEQ ID NO: 7677262 - DNA, 22 bp, Homo sapiens
gacttcaaagcgtgataaagat

SEQ ID NO: 7677263 - DNA, 22 bp, Homo sapiens
gacttcaaacagttaaaggcta

SEQ ID NO: 7677264 - DNA, 22 bp, Homo sapiens
gacttcaaaagctgacattcat

SEQ ID NO: 7677265 - DNA, 22 bp, Homo sapiens
gacttcaaaagctgacattcat

SEQ ID NO: 7677266 - DNA, 21 bp, Homo sapiens
gacttatctatattctattta

SEQ ID NO: 7677267 - DNA, 22 bp, Homo sapiens
gacttaatttccactttctgct

SEQ ID NO: 7677268 - DNA, 22 bp, Homo sapiens
gacttaatgcttcattacctta

SEQ ID NO: 7677269 - DNA, 22 bp, Homo sapiens
gacttaagtggtgtgataagtg

SEQ ID NO: 7677270 - DNA, 22 bp, Homo sapiens
gacttaatttccactttctgct

SEQ ID NO: 7677271 - DNA, 22 bp, Homo sapiens
gactgttagaatgtaaaatata

SEQ ID NO: 7677272 - DNA, 22 bp, Homo sapiens
gactgttattgttaatagcatg

SEQ ID NO: 7677273 - DNA, 22 bp, Homo sapiens
gactgtttaatactgtgagttc

SEQ ID NO: 7677274 - DNA, 22 bp, Homo sapiens
gacttaagtggtgtgataagtg

SEQ ID NO: 7677275 - DNA, 22 bp, Homo sapiens
gactgtggtctgttctccaggt

SEQ ID NO: 7677276 - DNA, 22 bp, Homo sapiens
gactgtgtccatgtgctggatt

SEQ ID NO: 7677277 - DNA, 22 bp, Homo sapiens
gactgtggtctgttctccaggt

SEQ ID NO: 7677278 - DNA, 22 bp, Homo sapiens
gactgtggtctgttctccaggt

SEQ ID NO: 7677279 - DNA, 22 bp, Homo sapiens
gacttcataatattgagcatgt

SEQ ID NO: 7677280 - DNA, 22 bp, Homo sapiens
gacttcatgacattcaggtcag

SEQ ID NO: 7677281 - DNA, 20 bp, Homo sapiens
gacttcaatttctatctttt

SEQ ID NO: 7677282 - DNA, 22 bp, Homo sapiens
gacttcaacttctggggagcaa

SEQ ID NO: 7677283 - DNA, 17 bp, Homo sapiens
gacttcaacttctgctg

SEQ ID NO: 7677284 - DNA, 22 bp, Homo sapiens
gacttcaaatcatgctaaacct

SEQ ID NO: 7677285 - DNA, 20 bp, Homo sapiens
gacttcccatatcttcttca

SEQ ID NO: 7677286 - DNA, 22 bp, Homo sapiens
gacttcatgtgcaagcgctttg

SEQ ID NO: 7677287 - DNA, 22 bp, Homo sapiens
gacttcctaagattcaggaatg

SEQ ID NO: 7677288 - DNA, 21 bp, Homo sapiens
gacttcatgggtcaaccaatt

SEQ ID NO: 7677289 - DNA, 21 bp, Homo sapiens
gacttcatgggtcaaccaatt

SEQ ID NO: 7677290 - DNA, 20 bp, Homo sapiens
gacttcccatatcttcttca

SEQ ID NO: 7677291 - DNA, 22 bp, Homo sapiens
gacttctccagactgcctggta

SEQ ID NO: 7677292 - DNA, 22 bp, Homo sapiens
gacttctcccaaccatcagagg

SEQ ID NO: 7677293 - DNA, 22 bp, Homo sapiens
gacttctccgtcatctccagtg

SEQ ID NO: 7677294 - DNA, 22 bp, Homo sapiens
gacttctgaattcctatcaggt

SEQ ID NO: 7677295 - DNA, 22 bp, Homo sapiens
gacttctgaattcctatcaggt

SEQ ID NO: 7677296 - DNA, 19 bp, Homo sapiens
gacttctgatgtccagatg

SEQ ID NO: 7677297 - DNA, 22 bp, Homo sapiens
gacttctgaattcctatcaggt

SEQ ID NO: 7677298 - DNA, 22 bp, Homo sapiens
gacccagggtttctgcacaggg

SEQ ID NO: 7677299 - DNA, 22 bp, Homo sapiens
gacccagggtatccagagctgc

SEQ ID NO: 7677300 - DNA, 22 bp, Homo sapiens
gacccagggtttctgcacaggg

SEQ ID NO: 7677301 - DNA, 22 bp, Homo sapiens
gacccagggtttctgcacaggg

SEQ ID NO: 7677302 - DNA, 22 bp, Homo sapiens
gacccagggtggtcacctgaaa

SEQ ID NO: 7677303 - DNA, 22 bp, Homo sapiens
gacccagggtggtcacctgaaa

SEQ ID NO: 7677304 - DNA, 22 bp, Homo sapiens
gacccagggtttctgcacaggg

SEQ ID NO: 7677305 - DNA, 22 bp, Homo sapiens
gacccagggtttctgcacaggg

SEQ ID NO: 7677306 - DNA, 22 bp, Homo sapiens
gacccagggtttctgcacaggg

SEQ ID NO: 7677307 - DNA, 22 bp, Homo sapiens
gacccagggtttctgcacaggg

SEQ ID NO: 7677308 - DNA, 22 bp, Homo sapiens
gacccagggtttctgcacaggg

SEQ ID NO: 7677309 - DNA, 22 bp, Homo sapiens
gacccagggtttctgcacaggg

SEQ ID NO: 7677310 - DNA, 22 bp, Homo sapiens
gacccagggtttctgcacaggg

SEQ ID NO: 7677311 - DNA, 22 bp, Homo sapiens
gactgcttatatgttaaagata

SEQ ID NO: 7677312 - DNA, 22 bp, Homo sapiens
gactgctttggtttgtaaatgt

SEQ ID NO: 7677313 - DNA, 22 bp, Homo sapiens
gactgggtcctctgcttatggt

SEQ ID NO: 7677314 - DNA, 22 bp, Homo sapiens
gactggtaaggaaattcactaa

SEQ ID NO: 7677315 - DNA, 22 bp, Homo sapiens
gactggtaaggtattggaattc

SEQ ID NO: 7677316 - DNA, 22 bp, Homo sapiens
gactggttgctaagcacagctt

SEQ ID NO: 7677317 - DNA, 22 bp, Homo sapiens
gactggttgaactcaggacaga

SEQ ID NO: 7677318 - DNA, 22 bp, Homo sapiens
gactggttatccccagcacaca

SEQ ID NO: 7677319 - DNA, 22 bp, Homo sapiens
gactggtcttttgtgatggatg

SEQ ID NO: 7677320 - DNA, 22 bp, Homo sapiens
gactggaaagcctgtcctcaga

SEQ ID NO: 7677321 - DNA, 22 bp, Homo sapiens
gactggggtaaggtgaggaggt

SEQ ID NO: 7677322 - DNA, 22 bp, Homo sapiens
gactggggtaaggtgaggaggt

SEQ ID NO: 7677323 - DNA, 22 bp, Homo sapiens
gactggggtaaggtgaggaggt

SEQ ID NO: 7677324 - DNA, 22 bp, Homo sapiens
gactggggtaaggtgaggaggt

SEQ ID NO: 7677325 - DNA, 22 bp, Homo sapiens
gactggaaagcctgtcctcaga

SEQ ID NO: 7677326 - DNA, 22 bp, Homo sapiens
gactggaaagcctgtcctcaga

SEQ ID NO: 7677327 - DNA, 22 bp, Homo sapiens
gactgtgggaagactgtaggtt

SEQ ID NO: 7677328 - DNA, 22 bp, Homo sapiens
gactgtggggaagcagatgcca

SEQ ID NO: 7677329 - DNA, 22 bp, Homo sapiens
gactgtggggaagcagatgcca

SEQ ID NO: 7677330 - DNA, 22 bp, Homo sapiens
gactgtggatagaacactgcag

SEQ ID NO: 7677331 - DNA, 22 bp, Homo sapiens
gactgtggcaggctcagcactg

SEQ ID NO: 7677332 - DNA, 22 bp, Homo sapiens
gactgtggctgcgtgtaaggaa

SEQ ID NO: 7677333 - DNA, 22 bp, Homo sapiens
gactgtgccagtcagtgggcgg

SEQ ID NO: 7677334 - DNA, 22 bp, Homo sapiens
gactgtgccagtcagtgggcgg

SEQ ID NO: 7677335 - DNA, 22 bp, Homo sapiens
gactgtcttttgaataaaaatg

SEQ ID NO: 7677336 - DNA, 22 bp, Homo sapiens
gactgtcttttgaataaaaatg

SEQ ID NO: 7677337 - DNA, 22 bp, Homo sapiens
gactgtcattctagtgcccatg

SEQ ID NO: 7677338 - DNA, 22 bp, Homo sapiens
gactgtccagaattcctaggtg

SEQ ID NO: 7677339 - DNA, 22 bp, Homo sapiens
gactgtctcctgtcatgaggga

SEQ ID NO: 7677340 - DNA, 22 bp, Homo sapiens
gactgtctctgtgaatggtagg

SEQ ID NO: 7677341 - DNA, 22 bp, Homo sapiens
gactggttgaactcaggacaga

SEQ ID NO: 7677342 - DNA, 22 bp, Homo sapiens
gactgtacttgagagaggaact

SEQ ID NO: 7677343 - DNA, 22 bp, Homo sapiens
gactgtacttgagagaggaact

SEQ ID NO: 7677344 - DNA, 22 bp, Homo sapiens
gactgtcattctagtgcccatg

SEQ ID NO: 7677345 - DNA, 22 bp, Homo sapiens
gactgtccagaattcctaggtg

SEQ ID NO: 7677346 - DNA, 22 bp, Homo sapiens
gactgtacttgagagaggaact

SEQ ID NO: 7677347 - DNA, 22 bp, Homo sapiens
gactggtaaggtattggaattc

SEQ ID NO: 7677348 - DNA, 22 bp, Homo sapiens
gactgtacgtcattgaaggcca

SEQ ID NO: 7677349 - DNA, 22 bp, Homo sapiens
gactggtttgccaccgacagat

SEQ ID NO: 7677350 - DNA, 22 bp, Homo sapiens
gactggtttctagcctcatagt

SEQ ID NO: 7677351 - DNA, 22 bp, Homo sapiens
cctggggaatcttgcaggggaa

SEQ ID NO: 7677352 - DNA, 22 bp, Homo sapiens
cctggggaatcttgcaggggaa

SEQ ID NO: 7677353 - DNA, 22 bp, Homo sapiens
cctggggaatcttgcaggggaa

SEQ ID NO: 7677354 - DNA, 22 bp, Homo sapiens
cctggggaatcttgcaggggaa

SEQ ID NO: 7677355 - DNA, 22 bp, Homo sapiens
cctggggaatcttgcaggggaa

SEQ ID NO: 7677356 - DNA, 22 bp, Homo sapiens
cctggggaatcttgcaggggaa

SEQ ID NO: 7677357 - DNA, 22 bp, Homo sapiens
cctggggaatagagtcaagggg

SEQ ID NO: 7677358 - DNA, 22 bp, Homo sapiens
cctggggaatagagtcaagggg

SEQ ID NO: 7677359 - DNA, 22 bp, Homo sapiens
cctggggaatagagtcaagggg

SEQ ID NO: 7677360 - DNA, 22 bp, Homo sapiens
cctggggaatagagtcaagggg

SEQ ID NO: 7677361 - DNA, 22 bp, Homo sapiens
cctggggaatagagtcaagggg

SEQ ID NO: 7677362 - DNA, 22 bp, Homo sapiens
cctggggaatagagtcaagggg

SEQ ID NO: 7677363 - DNA, 22 bp, Homo sapiens
cctggggaagtcacttctcttt

SEQ ID NO: 7677364 - DNA, 22 bp, Homo sapiens
cctggggaatagagtcaagggg

SEQ ID NO: 7677365 - DNA, 22 bp, Homo sapiens
cctggggaatagagtcaagggg

SEQ ID NO: 7677366 - DNA, 22 bp, Homo sapiens
cctggggaatagagtcaagggg

SEQ ID NO: 7677367 - DNA, 22 bp, Homo sapiens
cctgggctttggaacagtactt

SEQ ID NO: 7677368 - DNA, 22 bp, Homo sapiens
cctggggaaaagcaggcattta

SEQ ID NO: 7677369 - DNA, 22 bp, Homo sapiens
cctgggctttggaacagtactt

SEQ ID NO: 7677370 - DNA, 22 bp, Homo sapiens
cctgggctttggaacagtactt

SEQ ID NO: 7677371 - DNA, 22 bp, Homo sapiens
cctgggctttggaacagtactt

SEQ ID NO: 7677372 - DNA, 22 bp, Homo sapiens
cctgggctttggaacagtactt

SEQ ID NO: 7677373 - DNA, 22 bp, Homo sapiens
cctgggctttggaacagtactt

SEQ ID NO: 7677374 - DNA, 22 bp, Homo sapiens
cctggggaagtcacttctcttt

SEQ ID NO: 7677375 - DNA, 22 bp, Homo sapiens
cctggggaagtcacttctcttt

SEQ ID NO: 7677376 - DNA, 22 bp, Homo sapiens
cctggggaaaagcaggcattta

SEQ ID NO: 7677377 - DNA, 22 bp, Homo sapiens
cctggggaaaagcaggcattta

SEQ ID NO: 7677378 - DNA, 22 bp, Homo sapiens
cctggggaaaagcaggcattta

SEQ ID NO: 7677379 - DNA, 22 bp, Homo sapiens
cctggggaaaagcaggcattta

SEQ ID NO: 7677380 - DNA, 22 bp, Homo sapiens
cctggggaaaagcaggcattta

SEQ ID NO: 7677381 - DNA, 22 bp, Homo sapiens
cctgggccttgacctcgtgggc

SEQ ID NO: 7677382 - DNA, 22 bp, Homo sapiens
cctgggccttgacctcgtgggc

SEQ ID NO: 7677383 - DNA, 22 bp, Homo sapiens
cctgggccttgacctcgtgggc

SEQ ID NO: 7677384 - DNA, 22 bp, Homo sapiens
cctgggccttgacctcgtgggc

SEQ ID NO: 7677385 - DNA, 22 bp, Homo sapiens
cctgggccttgacctcgtgggc

SEQ ID NO: 7677386 - DNA, 22 bp, Homo sapiens
cctgggccttgacctcgtgggc

SEQ ID NO: 7677387 - DNA, 22 bp, Homo sapiens
cctgggccttgacctcgtgggc

SEQ ID NO: 7677388 - DNA, 22 bp, Homo sapiens
cctgggccttgacctcgtgggc

SEQ ID NO: 7677389 - DNA, 20 bp, Homo sapiens
cctgggctcaaagcatcctc

SEQ ID NO: 7677390 - DNA, 20 bp, Homo sapiens
cctgggctcaaagcatcctc

SEQ ID NO: 7677391 - DNA, 20 bp, Homo sapiens
cctgggctcaaagcatcctc

SEQ ID NO: 7677392 - DNA, 20 bp, Homo sapiens
cctgggctcaaagcatcctc

SEQ ID NO: 7677393 - DNA, 20 bp, Homo sapiens
cctgggctcaaagcatcctc

SEQ ID NO: 7677394 - DNA, 20 bp, Homo sapiens
cctgggctcaaagcatcctc

SEQ ID NO: 7677395 - DNA, 20 bp, Homo sapiens
cctgggctcaaagcatcctc

SEQ ID NO: 7677396 - DNA, 20 bp, Homo sapiens
cctgggctcaaagcatcctc

SEQ ID NO: 7677397 - DNA, 20 bp, Homo sapiens
cctgggctcaaagcatcctc

SEQ ID NO: 7677398 - DNA, 22 bp, Homo sapiens
cctgggcttccacgagcagagg

SEQ ID NO: 7677399 - DNA, 22 bp, Homo sapiens
cctgggctttgctggcaaggcc

SEQ ID NO: 7677400 - DNA, 22 bp, Homo sapiens
cctgggctttgctggcaaggcc

SEQ ID NO: 7677401 - DNA, 22 bp, Homo sapiens
cctgggctttgctggcaaggcc

SEQ ID NO: 7677402 - DNA, 22 bp, Homo sapiens
cctgggctttgctggcaaggcc

SEQ ID NO: 7677403 - DNA, 22 bp, Homo sapiens
cctgggctttgctggcaaggcc

SEQ ID NO: 7677404 - DNA, 22 bp, Homo sapiens
cctgggctcaagtgatcctcct

SEQ ID NO: 7677405 - DNA, 22 bp, Homo sapiens
cctgggctcaagcgatcttgtc

SEQ ID NO: 7677406 - DNA, 22 bp, Homo sapiens
cctgggctcaagcgatcttgtc

SEQ ID NO: 7677407 - DNA, 22 bp, Homo sapiens
cctgggctcaagcgatcttgtc

SEQ ID NO: 7677408 - DNA, 22 bp, Homo sapiens
cctgggctcaagtgatcctcct

SEQ ID NO: 7677409 - DNA, 22 bp, Homo sapiens
cctgggctcaagtgatcctcct

SEQ ID NO: 7677410 - DNA, 22 bp, Homo sapiens
cctgggcttccacgagcagagg

SEQ ID NO: 7677411 - DNA, 22 bp, Homo sapiens
tgtgtgtcatttagggtggagc

SEQ ID NO: 7677412 - DNA, 22 bp, Homo sapiens
tgtgtgtcatttagggtggagc

SEQ ID NO: 7677413 - DNA, 22 bp, Homo sapiens
tgtgtgtcatttagggtggagc

SEQ ID NO: 7677414 - DNA, 22 bp, Homo sapiens
tgtgtgtccttgacctcagtgg

SEQ ID NO: 7677415 - DNA, 22 bp, Homo sapiens
tgtgtgtcatttagggtggagc

SEQ ID NO: 7677416 - DNA, 22 bp, Homo sapiens
tgtgtgtctgcacatgtataat

SEQ ID NO: 7677417 - DNA, 19 bp, Homo sapiens
cctgggcctccatcacccc

SEQ ID NO: 7677418 - DNA, 19 bp, Homo sapiens
cctgggcctccatcacccc

SEQ ID NO: 7677419 - DNA, 19 bp, Homo sapiens
cctgggcctccatcacccc

SEQ ID NO: 7677420 - DNA, 19 bp, Homo sapiens
cctgggcctccatcacccc

SEQ ID NO: 7677421 - DNA, 22 bp, Homo sapiens
tgtgtgtctggaagctcaggga

SEQ ID NO: 7677422 - DNA, 22 bp, Homo sapiens
tgtgtgtctggaagctcaggga

SEQ ID NO: 7677423 - DNA, 19 bp, Homo sapiens
cctgggcctccatcacccc

SEQ ID NO: 7677424 - DNA, 19 bp, Homo sapiens
cctgggcctccatcacccc

SEQ ID NO: 7677425 - DNA, 22 bp, Homo sapiens
tgtgtgtccttgacctcagtgg

SEQ ID NO: 7677426 - DNA, 19 bp, Homo sapiens
cctgggcctccatcacccc

SEQ ID NO: 7677427 - DNA, 22 bp, Homo sapiens
cctgggcctctcaaagtgctgg

SEQ ID NO: 7677428 - DNA, 22 bp, Homo sapiens
cctgggcctctcaaagtgctgg

SEQ ID NO: 7677429 - DNA, 22 bp, Homo sapiens
cctgggcctctcaaagtgctgg

SEQ ID NO: 7677430 - DNA, 22 bp, Homo sapiens
cctgggcctctcaaagtgctgg

SEQ ID NO: 7677431 - DNA, 22 bp, Homo sapiens
cctgggcctctcaaagtgctgg

SEQ ID NO: 7677432 - DNA, 22 bp, Homo sapiens
cctgggcctctcaaagtgctgg

SEQ ID NO: 7677433 - DNA, 22 bp, Homo sapiens
cctgggcctctcaaagtgctgg

SEQ ID NO: 7677434 - DNA, 22 bp, Homo sapiens
cctgggcctctcaaagtgctgg

SEQ ID NO: 7677435 - DNA, 22 bp, Homo sapiens
cctgggcctgaaaacatttctc

SEQ ID NO: 7677436 - DNA, 22 bp, Homo sapiens
cctgggcctgaaaacatttctc

SEQ ID NO: 7677437 - DNA, 22 bp, Homo sapiens
cctgggcctgaaaacatttctc

SEQ ID NO: 7677438 - DNA, 22 bp, Homo sapiens
cctgggcctgaaaacatttctc

SEQ ID NO: 7677439 - DNA, 22 bp, Homo sapiens
cctgggcctctcaaagtgctgg

SEQ ID NO: 7677440 - DNA, 22 bp, Homo sapiens
cctgggcctggcgggtcggctc

SEQ ID NO: 7677441 - DNA, 22 bp, Homo sapiens
cctgggcctggcgggtcggctc

SEQ ID NO: 7677442 - DNA, 22 bp, Homo sapiens
cctgggcctggcgggtcggctc

SEQ ID NO: 7677443 - DNA, 22 bp, Homo sapiens
cctgggcctggcgggtcggctc

SEQ ID NO: 7677444 - DNA, 22 bp, Homo sapiens
cctgggcctggcgggtcggctc

SEQ ID NO: 7677445 - DNA, 22 bp, Homo sapiens
cctgggcctggcgggtcggctc

SEQ ID NO: 7677446 - DNA, 22 bp, Homo sapiens
cctgggcctgaaaacatttctc

SEQ ID NO: 7677447 - DNA, 22 bp, Homo sapiens
cctgggcctggcgggtcggctc

SEQ ID NO: 7677448 - DNA, 19 bp, Homo sapiens
tgtgtgggtttagagtagt

SEQ ID NO: 7677449 - DNA, 19 bp, Homo sapiens
tgtgtgggtttagagtagt

SEQ ID NO: 7677450 - DNA, 19 bp, Homo sapiens
tgtgtgggtttagagtagt

SEQ ID NO: 7677451 - DNA, 22 bp, Homo sapiens
tgtgtgggtggtaaggaaggcc

SEQ ID NO: 7677452 - DNA, 22 bp, Homo sapiens
tgtgtgggtggtaaggaaggcc

SEQ ID NO: 7677453 - DNA, 22 bp, Homo sapiens
tgtgtgtaatgtttctctcttc

SEQ ID NO: 7677454 - DNA, 22 bp, Homo sapiens
tgtgtgtaaggaagctttatgg

SEQ ID NO: 7677455 - DNA, 22 bp, Homo sapiens
tgtgtgtaaggaagctttatgg

SEQ ID NO: 7677456 - DNA, 19 bp, Homo sapiens
tgtgtggttggtgaaactc

SEQ ID NO: 7677457 - DNA, 22 bp, Homo sapiens
tgtgtgtataataatgtctgca

SEQ ID NO: 7677458 - DNA, 22 bp, Homo sapiens
tgtgtgtactctccagtcctga

SEQ ID NO: 7677459 - DNA, 22 bp, Homo sapiens
tgtgtgtagaaagggccctggt

SEQ ID NO: 7677460 - DNA, 22 bp, Homo sapiens
tgtgtgtataataatgtctgca

SEQ ID NO: 7677461 - DNA, 22 bp, Homo sapiens
tgtgtgtataataatgtctgca

SEQ ID NO: 7677462 - DNA, 22 bp, Homo sapiens
tgtgtgtataataatgtctgca

SEQ ID NO: 7677463 - DNA, 22 bp, Homo sapiens
tgtgtgtataataatgtctgca

SEQ ID NO: 7677464 - DNA, 22 bp, Homo sapiens
tgtgtgtataataatgtctgca

SEQ ID NO: 7677465 - DNA, 22 bp, Homo sapiens
tgtgtgtataataatgtctgca

SEQ ID NO: 7677466 - DNA, 22 bp, Homo sapiens
tgtgtgtcagcccaagggcctt

SEQ ID NO: 7677467 - DNA, 22 bp, Homo sapiens
tgtgtgtcagtcttgtttaggg

SEQ ID NO: 7677468 - DNA, 22 bp, Homo sapiens
tgtgtgtcagtcttgtttaggg

SEQ ID NO: 7677469 - DNA, 22 bp, Homo sapiens
tgtgtgtcagtcttgtttaggg

SEQ ID NO: 7677470 - DNA, 22 bp, Homo sapiens
tgtgtgtcagagtctccatggt

SEQ ID NO: 7677471 - DNA, 22 bp, Homo sapiens
tgtgtgtcagcccaagggcctt

SEQ ID NO: 7677472 - DNA, 22 bp, Homo sapiens
tgtgtgtcagagtctccatggt

SEQ ID NO: 7677473 - DNA, 22 bp, Homo sapiens
tgtgtgtcactgaaagaaatct

SEQ ID NO: 7677474 - DNA, 19 bp, Homo sapiens
tgtgtgtatttcagttctt

SEQ ID NO: 7677475 - DNA, 22 bp, Homo sapiens
tgtgtgtatgtttacttttcct

SEQ ID NO: 7677476 - DNA, 22 bp, Homo sapiens
tgtgtgtcactgaaagaaatct

SEQ ID NO: 7677477 - DNA, 22 bp, Homo sapiens
tgtgtgtcactgaaagaaatct

SEQ ID NO: 7677478 - DNA, 21 bp, Homo sapiens
tgtgtgtatgcacacacatgc

SEQ ID NO: 7677479 - DNA, 22 bp, Homo sapiens
tgtgtgtatatgcatttatcta

SEQ ID NO: 7677480 - DNA, 22 bp, Homo sapiens
tgtgtgtatccattagaggcca

SEQ ID NO: 7677481 - DNA, 21 bp, Homo sapiens
tgtgtgtatgcacacacatgc

SEQ ID NO: 7677482 - DNA, 22 bp, Homo sapiens
tgtgtgtatatgcatttatcta

SEQ ID NO: 7677483 - DNA, 22 bp, Homo sapiens
tgtgtgtatatgcatttatcta

SEQ ID NO: 7677484 - DNA, 22 bp, Homo sapiens
tgtgtgtatatgcatttatcta

SEQ ID NO: 7677485 - DNA, 22 bp, Homo sapiens
cctgggtgaaatctctcctgca

SEQ ID NO: 7677486 - DNA, 22 bp, Homo sapiens
cctgggtgaaatctctcctgca

SEQ ID NO: 7677487 - DNA, 22 bp, Homo sapiens
cctgggtgaaatctctcctgca

SEQ ID NO: 7677488 - DNA, 22 bp, Homo sapiens
cctgggtgaaatctctcctgca

SEQ ID NO: 7677489 - DNA, 22 bp, Homo sapiens
cctgggtgaaatctctcctgca

SEQ ID NO: 7677490 - DNA, 22 bp, Homo sapiens
cctgggtgaaatagtcctcaag

SEQ ID NO: 7677491 - DNA, 22 bp, Homo sapiens
cctgggtgaaatagtcctcaag

SEQ ID NO: 7677492 - DNA, 22 bp, Homo sapiens
cctgggtgaaatagtcctcaag

SEQ ID NO: 7677493 - DNA, 22 bp, Homo sapiens
cctgggtgaaatagtcctcaag

SEQ ID NO: 7677494 - DNA, 22 bp, Homo sapiens
cctgggtgacagagtgagacct

SEQ ID NO: 7677495 - DNA, 22 bp, Homo sapiens
cctgggtgacagagtgagacct

SEQ ID NO: 7677496 - DNA, 22 bp, Homo sapiens
cctgggtgacagagtgagacct

SEQ ID NO: 7677497 - DNA, 22 bp, Homo sapiens
cctgggtgacagagtgagacct

SEQ ID NO: 7677498 - DNA, 22 bp, Homo sapiens
cctgggtgaatgatattctaaa

SEQ ID NO: 7677499 - DNA, 22 bp, Homo sapiens
cctgggtgaaatctctcctgca

SEQ ID NO: 7677500 - DNA, 22 bp, Homo sapiens
cctgggtgacagagtgagacct

SEQ ID NO: 7677501 - DNA, 22 bp, Homo sapiens
cctgggtgacccgtgagcgtcc

SEQ ID NO: 7677502 - DNA, 22 bp, Homo sapiens
cctgggtgacagagtgagacct

SEQ ID NO: 7677503 - DNA, 22 bp, Homo sapiens
cctgggtgacagagtgagacct

SEQ ID NO: 7677504 - DNA, 22 bp, Homo sapiens
cctgggtgatgtgctgccctcg

SEQ ID NO: 7677505 - DNA, 22 bp, Homo sapiens
cctgggtgacccgtgagcgtcc

SEQ ID NO: 7677506 - DNA, 22 bp, Homo sapiens
cctgggtgacccgtgagcgtcc

SEQ ID NO: 7677507 - DNA, 22 bp, Homo sapiens
cctgggtggcagaggttgcagt

SEQ ID NO: 7677508 - DNA, 22 bp, Homo sapiens
cctgggtgcccggcccttctct

SEQ ID NO: 7677509 - DNA, 22 bp, Homo sapiens
cctgggtggcagaggttgcagt

SEQ ID NO: 7677510 - DNA, 22 bp, Homo sapiens
cctgggtggcagaggttgcagt

SEQ ID NO: 7677511 - DNA, 22 bp, Homo sapiens
cctgggtggcagaggttgcagt

SEQ ID NO: 7677512 - DNA, 22 bp, Homo sapiens
cctgggtgcccggcccttctct

SEQ ID NO: 7677513 - DNA, 22 bp, Homo sapiens
cctgggtgcccggcccttctct

SEQ ID NO: 7677514 - DNA, 22 bp, Homo sapiens
cctgggtgcccggcccttctct

SEQ ID NO: 7677515 - DNA, 22 bp, Homo sapiens
cctgggtgatgtgctgccctcg

SEQ ID NO: 7677516 - DNA, 22 bp, Homo sapiens
cctgggtgatgtgctgccctcg

SEQ ID NO: 7677517 - DNA, 22 bp, Homo sapiens
cctgggtctgtattggtaggta

SEQ ID NO: 7677518 - DNA, 22 bp, Homo sapiens
cctgggtctgtattggtaggta

SEQ ID NO: 7677519 - DNA, 22 bp, Homo sapiens
cctgggtctgtattggtaggta

SEQ ID NO: 7677520 - DNA, 22 bp, Homo sapiens
cctgggtctgtattggtaggta

SEQ ID NO: 7677521 - DNA, 19 bp, Homo sapiens
cctgggtctgcagcattca

SEQ ID NO: 7677522 - DNA, 19 bp, Homo sapiens
cctgggtctgcagcattca

SEQ ID NO: 7677523 - DNA, 19 bp, Homo sapiens
cctgggtctgcagcattca

SEQ ID NO: 7677524 - DNA, 22 bp, Homo sapiens
cctgggtctggtcactaagtca

SEQ ID NO: 7677525 - DNA, 22 bp, Homo sapiens
cctgggtctggtcactaagtca

SEQ ID NO: 7677526 - DNA, 22 bp, Homo sapiens
cctgggtcttcagtctgctggt

SEQ ID NO: 7677527 - DNA, 22 bp, Homo sapiens
cctgggtcttcagtctgctggt

SEQ ID NO: 7677528 - DNA, 22 bp, Homo sapiens
cctgggtcttcagtctgctggt

SEQ ID NO: 7677529 - DNA, 22 bp, Homo sapiens
cctgggtcttggttcatgctct

SEQ ID NO: 7677530 - DNA, 22 bp, Homo sapiens
cctgggtcttggttcatgctct

SEQ ID NO: 7677531 - DNA, 22 bp, Homo sapiens
cctgggtcttggttcatgctct

SEQ ID NO: 7677532 - DNA, 22 bp, Homo sapiens
cctgggtctatagacttcaaga

SEQ ID NO: 7677533 - DNA, 22 bp, Homo sapiens
cctgggtcctggcagcctcctg

SEQ ID NO: 7677534 - DNA, 22 bp, Homo sapiens
cctgggtcctggcagcctcctg

SEQ ID NO: 7677535 - DNA, 22 bp, Homo sapiens
cctgggtcctggcagcctcctg

SEQ ID NO: 7677536 - DNA, 22 bp, Homo sapiens
cctgggtctcctcctgctggct

SEQ ID NO: 7677537 - DNA, 22 bp, Homo sapiens
cctgggtctcctcctgctggct

SEQ ID NO: 7677538 - DNA, 22 bp, Homo sapiens
cctgggtctatagacttcaaga

SEQ ID NO: 7677539 - DNA, 22 bp, Homo sapiens
cctgggtctcctcctgctggct

SEQ ID NO: 7677540 - DNA, 22 bp, Homo sapiens
cctgggtctcctcctgctggct

SEQ ID NO: 7677541 - DNA, 22 bp, Homo sapiens
cctgggtctcctcctgctggct

SEQ ID NO: 7677542 - DNA, 22 bp, Homo sapiens
cctgggtccctgagagatgatt

SEQ ID NO: 7677543 - DNA, 22 bp, Homo sapiens
cctgggtccctgagagatgatt

SEQ ID NO: 7677544 - DNA, 22 bp, Homo sapiens
cctgggtcccatcccagagtga

SEQ ID NO: 7677545 - DNA, 22 bp, Homo sapiens
cctgggtcccatcccagagtga

SEQ ID NO: 7677546 - DNA, 22 bp, Homo sapiens
cctgggtcccagccaggctttg

SEQ ID NO: 7677547 - DNA, 22 bp, Homo sapiens
cctgggtcccagccaggctttg

SEQ ID NO: 7677548 - DNA, 23 bp, Homo sapiens
tgtgttcagtcaaggatcagagt

SEQ ID NO: 7677549 - DNA, 23 bp, Homo sapiens
tgtgttcagtcaaggatcagagt

SEQ ID NO: 7677550 - DNA, 22 bp, Homo sapiens
tgtgttcatcatgatatcaggt

SEQ ID NO: 7677551 - DNA, 22 bp, Homo sapiens
tgtgttcatcatgatatcaggt

SEQ ID NO: 7677552 - DNA, 22 bp, Homo sapiens
tgtgttcatcatgatatcaggt

SEQ ID NO: 7677553 - DNA, 22 bp, Homo sapiens
tgtgttcatcatgatatcaggt

SEQ ID NO: 7677554 - DNA, 22 bp, Homo sapiens
tgtgttcatctttaaagggaag

SEQ ID NO: 7677555 - DNA, 22 bp, Homo sapiens
tgtgttcatgtatgtatacata

SEQ ID NO: 7677556 - DNA, 22 bp, Homo sapiens
tgtgttcatgtatgtatacata

SEQ ID NO: 7677557 - DNA, 22 bp, Homo sapiens
tgtgttcatgtatgtatacata

SEQ ID NO: 7677558 - DNA, 22 bp, Homo sapiens
tgtgttcatgtatgtatacata

SEQ ID NO: 7677559 - DNA, 22 bp, Homo sapiens
tgtgttcatgtcactggaatcc

SEQ ID NO: 7677560 - DNA, 22 bp, Homo sapiens
tgtgttcaatgacttcatcttt

SEQ ID NO: 7677561 - DNA, 22 bp, Homo sapiens
tgtgttcaccaaagtgtagaaa

SEQ ID NO: 7677562 - DNA, 22 bp, Homo sapiens
tgtgttcaccaaagtgtagaaa

SEQ ID NO: 7677563 - DNA, 22 bp, Homo sapiens
tgtgttcaccctagcacttaac

SEQ ID NO: 7677564 - DNA, 22 bp, Homo sapiens
tgtgttcagaatttgctgcttt

SEQ ID NO: 7677565 - DNA, 22 bp, Homo sapiens
tgtgttcaccaaagtgtagaaa

SEQ ID NO: 7677566 - DNA, 22 bp, Homo sapiens
tgtgttcagtatgacattcaca

SEQ ID NO: 7677567 - DNA, 22 bp, Homo sapiens
tgtgttcagtatgacattcaca

SEQ ID NO: 7677568 - DNA, 22 bp, Homo sapiens
tgtgttcagtatgacattcaca

SEQ ID NO: 7677569 - DNA, 22 bp, Homo sapiens
tgtgttcagtatgacattcaca

SEQ ID NO: 7677570 - DNA, 22 bp, Homo sapiens
tgtgttcagcaggcaccttctt

SEQ ID NO: 7677571 - DNA, 22 bp, Homo sapiens
tgtgttcaatccctagtctcag

SEQ ID NO: 7677572 - DNA, 22 bp, Homo sapiens
tgtgttcaatccctagtctcag

SEQ ID NO: 7677573 - DNA, 22 bp, Homo sapiens
tgtgttcaatgacttcatcttt

SEQ ID NO: 7677574 - DNA, 22 bp, Homo sapiens
cctggggacctgcctcagccct

SEQ ID NO: 7677575 - DNA, 22 bp, Homo sapiens
tgtgttcaatccctagtctcag

SEQ ID NO: 7677576 - DNA, 22 bp, Homo sapiens
cctggggacctgcctcagccct

SEQ ID NO: 7677577 - DNA, 22 bp, Homo sapiens
cctggggagaagagcttccccc

SEQ ID NO: 7677578 - DNA, 22 bp, Homo sapiens
cctggggacctgcctcagccct

SEQ ID NO: 7677579 - DNA, 22 bp, Homo sapiens
cctggggacctgcctcagccct

SEQ ID NO: 7677580 - DNA, 22 bp, Homo sapiens
cctggggaatcttgcaggggaa

SEQ ID NO: 7677581 - DNA, 22 bp, Homo sapiens
cctggggaatcttgcaggggaa

SEQ ID NO: 7677582 - DNA, 22 bp, Homo sapiens
cctggggacctgcctcagccct

SEQ ID NO: 7677583 - DNA, 22 bp, Homo sapiens
cctggggacctgcctcagccct

SEQ ID NO: 7677584 - DNA, 22 bp, Homo sapiens
cctggggacctgcctcagccct

SEQ ID NO: 7677585 - DNA, 22 bp, Homo sapiens
cctggggctccagagcagcgga

SEQ ID NO: 7677586 - DNA, 22 bp, Homo sapiens
cctggggctccagagcagcgga

SEQ ID NO: 7677587 - DNA, 22 bp, Homo sapiens
cctggggctccagagcagcgga

SEQ ID NO: 7677588 - DNA, 22 bp, Homo sapiens
cctggggctccagagcagcgga

SEQ ID NO: 7677589 - DNA, 22 bp, Homo sapiens
cctggggctccagagcagcgga

SEQ ID NO: 7677590 - DNA, 22 bp, Homo sapiens
tgtgttctcctacagataagga

SEQ ID NO: 7677591 - DNA, 22 bp, Homo sapiens
tgtgttctccaactgtagattt

SEQ ID NO: 7677592 - DNA, 23 bp, Homo sapiens
tgtgttctcacacagatgcagta

SEQ ID NO: 7677593 - DNA, 22 bp, Homo sapiens
cctgggtccaccctgtgaagta

SEQ ID NO: 7677594 - DNA, 19 bp, Homo sapiens
cctgggtccactcagacta

SEQ ID NO: 7677595 - DNA, 19 bp, Homo sapiens
cctgggtccactcagacta

SEQ ID NO: 7677596 - DNA, 22 bp, Homo sapiens
cctggggctccagagcagcgga

SEQ ID NO: 7677597 - DNA, 22 bp, Homo sapiens
cctggggctccagagcagcgga

SEQ ID NO: 7677598 - DNA, 19 bp, Homo sapiens
cctgggtccactcagacta

SEQ ID NO: 7677599 - DNA, 19 bp, Homo sapiens
cctgggtccactcagacta

SEQ ID NO: 7677600 - DNA, 22 bp, Homo sapiens
cctgggtcccagccaggctttg

SEQ ID NO: 7677601 - DNA, 22 bp, Homo sapiens
cctgggtcccagccaggctttg

SEQ ID NO: 7677602 - DNA, 22 bp, Homo sapiens
cctgggtcccagccaggctttg

SEQ ID NO: 7677603 - DNA, 22 bp, Homo sapiens
tgtgttcatgttgattcatagc

SEQ ID NO: 7677604 - DNA, 22 bp, Homo sapiens
tgtgttcattagcattgccttg

SEQ ID NO: 7677605 - DNA, 22 bp, Homo sapiens
tgtgttcatgttgattcatagc

SEQ ID NO: 7677606 - DNA, 22 bp, Homo sapiens
tgtgttcatgttgattcatagc

SEQ ID NO: 7677607 - DNA, 22 bp, Homo sapiens
tgtgttcatgttgattcatagc

SEQ ID NO: 7677608 - DNA, 22 bp, Homo sapiens
tgtgttcatttaactgttcttt

SEQ ID NO: 7677609 - DNA, 22 bp, Homo sapiens
tgtgttcatttaactgttcttt

SEQ ID NO: 7677610 - DNA, 22 bp, Homo sapiens
tgtgttcattagcattgccttg

SEQ ID NO: 7677611 - DNA, 19 bp, Homo sapiens
tgtgttcattcatcagagg

SEQ ID NO: 7677612 - DNA, 19 bp, Homo sapiens
tgtgttcattcatcagagg

SEQ ID NO: 7677613 - DNA, 23 bp, Homo sapiens
tgtgttctcacacagatgcagta

SEQ ID NO: 7677614 - DNA, 23 bp, Homo sapiens
tgtgttctcacacagatgcagta

SEQ ID NO: 7677615 - DNA, 23 bp, Homo sapiens
tgtgttctcacacagatgcagta

SEQ ID NO: 7677616 - DNA, 23 bp, Homo sapiens
tgtgttctcacacagatgcagta

SEQ ID NO: 7677617 - DNA, 23 bp, Homo sapiens
tgtgttctcacacagatgcagta

SEQ ID NO: 7677618 - DNA, 22 bp, Homo sapiens
tgtgttccttaaaggatgggca

SEQ ID NO: 7677619 - DNA, 22 bp, Homo sapiens
tgtgttcctgcctggctctggt

SEQ ID NO: 7677620 - DNA, 22 bp, Homo sapiens
tgtgttcatttctctctgctgt

SEQ ID NO: 7677621 - DNA, 22 bp, Homo sapiens
tgtgttccagagcatccaggtc

SEQ ID NO: 7677622 - DNA, 19 bp, Homo sapiens
tgtgttccatccaccaccc

SEQ ID NO: 7677623 - DNA, 22 bp, Homo sapiens
cctgggcattctttgagttctc

SEQ ID NO: 7677624 - DNA, 22 bp, Homo sapiens
cctgggcattctttgagttctc

SEQ ID NO: 7677625 - DNA, 22 bp, Homo sapiens
cctgggcatctcatgcacctgc

SEQ ID NO: 7677626 - DNA, 22 bp, Homo sapiens
cctgggcatctcatgcacctgc

SEQ ID NO: 7677627 - DNA, 22 bp, Homo sapiens
cctgggcatctcatgcacctgc

SEQ ID NO: 7677628 - DNA, 22 bp, Homo sapiens
cctgggcatctcatgcacctgc

SEQ ID NO: 7677629 - DNA, 21 bp, Homo sapiens
cctgggccaaattccctggac

SEQ ID NO: 7677630 - DNA, 21 bp, Homo sapiens
cctgggccaaattccctggac

SEQ ID NO: 7677631 - DNA, 21 bp, Homo sapiens
cctgggccaaattccctggac

SEQ ID NO: 7677632 - DNA, 21 bp, Homo sapiens
cctgggccaaattccctggac

SEQ ID NO: 7677633 - DNA, 21 bp, Homo sapiens
cctgggccaaattccctggac

SEQ ID NO: 7677634 - DNA, 23 bp, Homo sapiens
cctgggcattggctgcagcttct

SEQ ID NO: 7677635 - DNA, 23 bp, Homo sapiens
cctgggcattggctgcagcttct

SEQ ID NO: 7677636 - DNA, 22 bp, Homo sapiens
cctgggcctatcctagaaccaa

SEQ ID NO: 7677637 - DNA, 22 bp, Homo sapiens
cctgggccctcaccgccggtgg

SEQ ID NO: 7677638 - DNA, 22 bp, Homo sapiens
cctgggccctcaccgccggtgg

SEQ ID NO: 7677639 - DNA, 22 bp, Homo sapiens
cctgggccctcaccgccggtgg

SEQ ID NO: 7677640 - DNA, 22 bp, Homo sapiens
cctgggccctcaccgccggtgg

SEQ ID NO: 7677641 - DNA, 22 bp, Homo sapiens
cctgggccaggcttgggaatgc

SEQ ID NO: 7677642 - DNA, 22 bp, Homo sapiens
cctgggccaggcttgggaatgc

SEQ ID NO: 7677643 - DNA, 22 bp, Homo sapiens
cctgggccctcaccgccggtgg

SEQ ID NO: 7677644 - DNA, 22 bp, Homo sapiens
cctgggccctcaccgccggtgg

SEQ ID NO: 7677645 - DNA, 21 bp, Homo sapiens
cctgggccaaattccctggac

SEQ ID NO: 7677646 - DNA, 21 bp, Homo sapiens
cctgggccaaattccctggac

SEQ ID NO: 7677647 - DNA, 22 bp, Homo sapiens
cctgggccaggcttgggaatgc

SEQ ID NO: 7677648 - DNA, 22 bp, Homo sapiens
cctgggccaggcttgggaatgc

SEQ ID NO: 7677649 - DNA, 22 bp, Homo sapiens
cctgggccaggcttgggaatgc

SEQ ID NO: 7677650 - DNA, 22 bp, Homo sapiens
cctgggccaggcttgggaatgc

SEQ ID NO: 7677651 - DNA, 22 bp, Homo sapiens
cctgggaggcggaggttgcagt

SEQ ID NO: 7677652 - DNA, 22 bp, Homo sapiens
cctgggaggcggaggttgcagt

SEQ ID NO: 7677653 - DNA, 22 bp, Homo sapiens
cctgggaggctgaggctgcagt

SEQ ID NO: 7677654 - DNA, 22 bp, Homo sapiens
cctgggcaatatagtgaggccc

SEQ ID NO: 7677655 - DNA, 22 bp, Homo sapiens
cctgggcaatatagtgaggccc

SEQ ID NO: 7677656 - DNA, 22 bp, Homo sapiens
cctgggcagcctgctcaaggac

SEQ ID NO: 7677657 - DNA, 22 bp, Homo sapiens
cctgggcagcctgctcaaggac

SEQ ID NO: 7677658 - DNA, 22 bp, Homo sapiens
cctgggcatcaacaagcagaga

SEQ ID NO: 7677659 - DNA, 22 bp, Homo sapiens
cctgggcatcaacaagcagaga

SEQ ID NO: 7677660 - DNA, 22 bp, Homo sapiens
cctgggcatcaacaagcagaga

SEQ ID NO: 7677661 - DNA, 22 bp, Homo sapiens
cctgggcatcaacaagcagaga

SEQ ID NO: 7677662 - DNA, 22 bp, Homo sapiens
cctgggcatcaacaagcagaga

SEQ ID NO: 7677663 - DNA, 22 bp, Homo sapiens
cctgggcagcctgctcaaggac

SEQ ID NO: 7677664 - DNA, 22 bp, Homo sapiens
cctgggcatcaacaagcagaga

SEQ ID NO: 7677665 - DNA, 22 bp, Homo sapiens
cctgggcatcaacaagcagaga

SEQ ID NO: 7677666 - DNA, 22 bp, Homo sapiens
cctgggcataaatcactccaag

SEQ ID NO: 7677667 - DNA, 22 bp, Homo sapiens
cctgggaggcggaggttgcagt

SEQ ID NO: 7677668 - DNA, 22 bp, Homo sapiens
cctgggaggcggaggttgcagt

SEQ ID NO: 7677669 - DNA, 22 bp, Homo sapiens
cctgggaggcggaggttgcagt

SEQ ID NO: 7677670 - DNA, 22 bp, Homo sapiens
cctgggaggcggaggttgcagt

SEQ ID NO: 7677671 - DNA, 22 bp, Homo sapiens
cctgggaggcggaggttgcagt

SEQ ID NO: 7677672 - DNA, 22 bp, Homo sapiens
cctgggaggcggaggttgcagg

SEQ ID NO: 7677673 - DNA, 22 bp, Homo sapiens
cctgggaggcggaggttgcagg

SEQ ID NO: 7677674 - DNA, 22 bp, Homo sapiens
cctgggaggcggaggttgcagg

SEQ ID NO: 7677675 - DNA, 22 bp, Homo sapiens
cctgggaggcggaggttgcagg

SEQ ID NO: 7677676 - DNA, 22 bp, Homo sapiens
cctgggaggcggaggttgcagg

SEQ ID NO: 7677677 - DNA, 22 bp, Homo sapiens
cctgggaggcggaggttgcagg

SEQ ID NO: 7677678 - DNA, 22 bp, Homo sapiens
cctgggaggcggaggttgcagg

SEQ ID NO: 7677679 - DNA, 19 bp, Homo sapiens
cctgggaggcggaggttgc

SEQ ID NO: 7677680 - DNA, 23 bp, Homo sapiens
tgtgtctgtttagggaggatgtg

SEQ ID NO: 7677681 - DNA, 22 bp, Homo sapiens
tgtgtctgtcctcggttgatgc

SEQ ID NO: 7677682 - DNA, 22 bp, Homo sapiens
tgtgtctgtgtatacacggcat

SEQ ID NO: 7677683 - DNA, 22 bp, Homo sapiens
tgtgtctgtgtatacacggcat

SEQ ID NO: 7677684 - DNA, 22 bp, Homo sapiens
tgtgtctgtgtatacacggcat

SEQ ID NO: 7677685 - DNA, 23 bp, Homo sapiens
tgtgtctgtttagggaggatgtg

SEQ ID NO: 7677686 - DNA, 22 bp, Homo sapiens
tgtgtctgtcctcggttgatgc

SEQ ID NO: 7677687 - DNA, 22 bp, Homo sapiens
tgtgtctgtcctcggttgatgc

SEQ ID NO: 7677688 - DNA, 22 bp, Homo sapiens
tgtgtctgtcctcggttgatgc

SEQ ID NO: 7677689 - DNA, 22 bp, Homo sapiens
tgtgtctgtgtatacacggcat

SEQ ID NO: 7677690 - DNA, 23 bp, Homo sapiens
tgtgtctgtttagggaggatgtg

SEQ ID NO: 7677691 - DNA, 22 bp, Homo sapiens
tgtgtgggtacagatgattgtt

SEQ ID NO: 7677692 - DNA, 22 bp, Homo sapiens
tgtgtggggaaggaaggagctg

SEQ ID NO: 7677693 - DNA, 22 bp, Homo sapiens
tgtgtgggtggtaaggaaggcc

SEQ ID NO: 7677694 - DNA, 22 bp, Homo sapiens
tgtgtggggaaggaaggagctg

SEQ ID NO: 7677695 - DNA, 22 bp, Homo sapiens
tgtgtgggcgaagacagccttt

SEQ ID NO: 7677696 - DNA, 22 bp, Homo sapiens
tgtgtctgtcctcggttgatgc

SEQ ID NO: 7677697 - DNA, 22 bp, Homo sapiens
tgtggggtgtggtccaggcatc

SEQ ID NO: 7677698 - DNA, 22 bp, Homo sapiens
tgtggggtagcagtttccgtgt

SEQ ID NO: 7677699 - DNA, 22 bp, Homo sapiens
tgtggggtgtggtccaggcatc

SEQ ID NO: 7677700 - DNA, 22 bp, Homo sapiens
tgtggggtgtggtccaggcatc

SEQ ID NO: 7677701 - DNA, 22 bp, Homo sapiens
tgtggggtgtggtccaggcatc

SEQ ID NO: 7677702 - DNA, 22 bp, Homo sapiens
tgtgggggtacacgtacacatg

SEQ ID NO: 7677703 - DNA, 22 bp, Homo sapiens
tgtgggggtacacgtacacatg

SEQ ID NO: 7677704 - DNA, 22 bp, Homo sapiens
tgtgggggtacacgtacacatg

SEQ ID NO: 7677705 - DNA, 22 bp, Homo sapiens
tgtggggcttacaaaggcagat

SEQ ID NO: 7677706 - DNA, 22 bp, Homo sapiens
tgtggggcttacaaaggcagat

SEQ ID NO: 7677707 - DNA, 22 bp, Homo sapiens
tgtggggctgtggtgttcttct

SEQ ID NO: 7677708 - DNA, 22 bp, Homo sapiens
tgtggggctgtcaggcaactgg

SEQ ID NO: 7677709 - DNA, 22 bp, Homo sapiens
tgtggggccaaagcccagccac

SEQ ID NO: 7677710 - DNA, 22 bp, Homo sapiens
tgtggggccaaagcccagccac

SEQ ID NO: 7677711 - DNA, 22 bp, Homo sapiens
tgtggggatcttctagcttttc

SEQ ID NO: 7677712 - DNA, 22 bp, Homo sapiens
tgtggggcagctagccggcctg

SEQ ID NO: 7677713 - DNA, 22 bp, Homo sapiens
tgtggggctgtcaggcaactgg

SEQ ID NO: 7677714 - DNA, 22 bp, Homo sapiens
tgtggggctgtcaggcaactgg

SEQ ID NO: 7677715 - DNA, 22 bp, Homo sapiens
tgtggggctccctggcagcctg

SEQ ID NO: 7677716 - DNA, 22 bp, Homo sapiens
tgtggggctccctggcagcctg

SEQ ID NO: 7677717 - DNA, 22 bp, Homo sapiens
tgtggggcctcgtgctagctgg

SEQ ID NO: 7677718 - DNA, 19 bp, Homo sapiens
tgtggggagtcagggggct

SEQ ID NO: 7677719 - DNA, 22 bp, Homo sapiens
cctgggcctcacccagctcttg

SEQ ID NO: 7677720 - DNA, 22 bp, Homo sapiens
tgtggggatcttctagcttttc

SEQ ID NO: 7677721 - DNA, 22 bp, Homo sapiens
cctgggcctcacccagctcttg

SEQ ID NO: 7677722 - DNA, 22 bp, Homo sapiens
cctgggcctcacccagctcttg

SEQ ID NO: 7677723 - DNA, 22 bp, Homo sapiens
cctgggcctcacccagctcttg

SEQ ID NO: 7677724 - DNA, 22 bp, Homo sapiens
cctgggcctcacccagctcttg

SEQ ID NO: 7677725 - DNA, 22 bp, Homo sapiens
cctgggcctcacccagctcttg

SEQ ID NO: 7677726 - DNA, 22 bp, Homo sapiens
cctgggcctcacccagctcttg

SEQ ID NO: 7677727 - DNA, 22 bp, Homo sapiens
cctgggcctcacccagctcttg

SEQ ID NO: 7677728 - DNA, 22 bp, Homo sapiens
cctgggcctcacccagctcttg

SEQ ID NO: 7677729 - DNA, 22 bp, Homo sapiens
cctgggcctcacccagctcttg

SEQ ID NO: 7677730 - DNA, 22 bp, Homo sapiens
cctgggcctcacccagctcttg

SEQ ID NO: 7677731 - DNA, 22 bp, Homo sapiens
cctgggcctatcctagaaccaa

SEQ ID NO: 7677732 - DNA, 22 bp, Homo sapiens
cctgggcctatcctagaaccaa

SEQ ID NO: 7677733 - DNA, 22 bp, Homo sapiens
cctgggcctatcctagaaccaa

SEQ ID NO: 7677734 - DNA, 22 bp, Homo sapiens
cctgggcctatcctagaaccaa

SEQ ID NO: 7677735 - DNA, 22 bp, Homo sapiens
cctgggcctcacccagctcttg

SEQ ID NO: 7677736 - DNA, 22 bp, Homo sapiens
cctgggcctatcctagaaccaa

SEQ ID NO: 7677737 - DNA, 20 bp, Homo sapiens
tgtggaaaaacagaagcaga

SEQ ID NO: 7677738 - DNA, 22 bp, Homo sapiens
tgtggaaaaaccacaagtttgg

SEQ ID NO: 7677739 - DNA, 20 bp, Homo sapiens
tgtggaaaaacagaagcaga

SEQ ID NO: 7677740 - DNA, 22 bp, Homo sapiens
tgtgctttggttttacaggatg

SEQ ID NO: 7677741 - DNA, 22 bp, Homo sapiens
tgtgctttggttttacaggatg

SEQ ID NO: 7677742 - DNA, 22 bp, Homo sapiens
tgtgctttggttttacaggatg

SEQ ID NO: 7677743 - DNA, 22 bp, Homo sapiens
tgtgcttttctctgctcctgga

SEQ ID NO: 7677744 - DNA, 22 bp, Homo sapiens
tgtgctttggttttacaggatg

SEQ ID NO: 7677745 - DNA, 22 bp, Homo sapiens
tgtgctttggttttacaggatg

SEQ ID NO: 7677746 - DNA, 22 bp, Homo sapiens
tgtgcttggggttgactagtgt

SEQ ID NO: 7677747 - DNA, 22 bp, Homo sapiens
tgtgcttggggttgactagtgt

SEQ ID NO: 7677748 - DNA, 22 bp, Homo sapiens
tgtgcttgaaattcagttttga

SEQ ID NO: 7677749 - DNA, 22 bp, Homo sapiens
tgtgctttcaaagttaagtaaa

SEQ ID NO: 7677750 - DNA, 22 bp, Homo sapiens
tgtgcttgtcgtggagccaggc

SEQ ID NO: 7677751 - DNA, 22 bp, Homo sapiens
tgtggcagctggaggtggagaa

SEQ ID NO: 7677752 - DNA, 22 bp, Homo sapiens
tgtggcagctggaggtggagaa

SEQ ID NO: 7677753 - DNA, 22 bp, Homo sapiens
tgtggcagctggaggtggagaa

SEQ ID NO: 7677754 - DNA, 22 bp, Homo sapiens
tgtggcagctggaggtggagaa

SEQ ID NO: 7677755 - DNA, 22 bp, Homo sapiens
tgtggaaaaaccacaagtttgg

SEQ ID NO: 7677756 - DNA, 22 bp, Homo sapiens
tgtggcaggaagagcttctgag

SEQ ID NO: 7677757 - DNA, 22 bp, Homo sapiens
tgtggcaggaagagcttctgag

SEQ ID NO: 7677758 - DNA, 22 bp, Homo sapiens
tgtggcagctggaggtggagaa

SEQ ID NO: 7677759 - DNA, 22 bp, Homo sapiens
tgtggcagctggaggtggagaa

SEQ ID NO: 7677760 - DNA, 22 bp, Homo sapiens
tgtggcagctggaggtggagaa

SEQ ID NO: 7677761 - DNA, 20 bp, Homo sapiens
tgtggcaggatgagggcgga

SEQ ID NO: 7677762 - DNA, 20 bp, Homo sapiens
tgtggcaggatgagggcgga

SEQ ID NO: 7677763 - DNA, 20 bp, Homo sapiens
tgtggcaggatgagggcgga

SEQ ID NO: 7677764 - DNA, 20 bp, Homo sapiens
tgtggcaggatgagggcgga

SEQ ID NO: 7677765 - DNA, 20 bp, Homo sapiens
tgtggcaggatgagggcgga

SEQ ID NO: 7677766 - DNA, 22 bp, Homo sapiens
tgtggcaggaagagcttctgag

SEQ ID NO: 7677767 - DNA, 22 bp, Homo sapiens
tgtggcaggaagagcttctgag

SEQ ID NO: 7677768 - DNA, 22 bp, Homo sapiens
tgtggcaggaagagcttctgag

SEQ ID NO: 7677769 - DNA, 22 bp, Homo sapiens
tgtggcaggaagagcttctgag

SEQ ID NO: 7677770 - DNA, 22 bp, Homo sapiens
tgtggcaggaagagcttctgag

SEQ ID NO: 7677771 - DNA, 20 bp, Homo sapiens
tgtggcaggatgagggcgga

SEQ ID NO: 7677772 - DNA, 20 bp, Homo sapiens
tgtggcaggatgagggcgga

SEQ ID NO: 7677773 - DNA, 22 bp, Homo sapiens
tgtggcaggatgcggaagatgc

SEQ ID NO: 7677774 - DNA, 22 bp, Homo sapiens
tgtggcaggatgcggaagatgc

SEQ ID NO: 7677775 - DNA, 20 bp, Homo sapiens
tgtggcaggatgagggcgga

SEQ ID NO: 7677776 - DNA, 22 bp, Homo sapiens
tgtggcaggatgcggaagatgc

SEQ ID NO: 7677777 - DNA, 22 bp, Homo sapiens
tgtggcaggcaagatgtacaga

SEQ ID NO: 7677778 - DNA, 22 bp, Homo sapiens
tgtggcaggcaagatgtacaga

SEQ ID NO: 7677779 - DNA, 22 bp, Homo sapiens
tgtggcaggcaagatgtacaga

SEQ ID NO: 7677780 - DNA, 22 bp, Homo sapiens
tgtggcaggctaggctttttgg

SEQ ID NO: 7677781 - DNA, 22 bp, Homo sapiens
tgtggcagggatactgaggcag

SEQ ID NO: 7677782 - DNA, 22 bp, Homo sapiens
tgtggcaggcattctgaggctg

SEQ ID NO: 7677783 - DNA, 22 bp, Homo sapiens
tgtggcaggcattctgaggctg

SEQ ID NO: 7677784 - DNA, 22 bp, Homo sapiens
tgtggcaggcattctgaggctg

SEQ ID NO: 7677785 - DNA, 22 bp, Homo sapiens
tgtggcaggcattctgaggctg

SEQ ID NO: 7677786 - DNA, 22 bp, Homo sapiens
tgtggcaggcaagatgtacaga

SEQ ID NO: 7677787 - DNA, 22 bp, Homo sapiens
tgtggcaggcattctgaggctg

SEQ ID NO: 7677788 - DNA, 22 bp, Homo sapiens
tgtggcaggcattctgaggctg

SEQ ID NO: 7677789 - DNA, 22 bp, Homo sapiens
tgtggcaggcattctgaggctg

SEQ ID NO: 7677790 - DNA, 22 bp, Homo sapiens
tgtggcaggcattctgaggctg

SEQ ID NO: 7677791 - DNA, 22 bp, Homo sapiens
tgtggcaggcattctgaggctg

SEQ ID NO: 7677792 - DNA, 21 bp, Homo sapiens
tgtggctgcctctggccctgg

SEQ ID NO: 7677793 - DNA, 18 bp, Homo sapiens
tgtggcaggggtgggaga

SEQ ID NO: 7677794 - DNA, 21 bp, Homo sapiens
tgtggctgcctctggccctgg

SEQ ID NO: 7677795 - DNA, 22 bp, Homo sapiens
tgtggctgctcaggtgcagacc

SEQ ID NO: 7677796 - DNA, 22 bp, Homo sapiens
tgtggctgctcaggtgcagacc

SEQ ID NO: 7677797 - DNA, 22 bp, Homo sapiens
tgtggcagggcgtgacatttgg

SEQ ID NO: 7677798 - DNA, 22 bp, Homo sapiens
tgtggcagggatactgaggcag

SEQ ID NO: 7677799 - DNA, 18 bp, Homo sapiens
tgtggcaggggtgggaga

SEQ ID NO: 7677800 - DNA, 18 bp, Homo sapiens
tgtggcaggggtgggaga

SEQ ID NO: 7677801 - DNA, 18 bp, Homo sapiens
tgtggcaggggtgggaga

SEQ ID NO: 7677802 - DNA, 18 bp, Homo sapiens
tgtggcaggggtgggaga

SEQ ID NO: 7677803 - DNA, 22 bp, Homo sapiens
tgtggcagggatactgaggcag

SEQ ID NO: 7677804 - DNA, 22 bp, Homo sapiens
tgtggcagggatactgaggcag

SEQ ID NO: 7677805 - DNA, 22 bp, Homo sapiens
tgtggcagggatactgaggcag

SEQ ID NO: 7677806 - DNA, 22 bp, Homo sapiens
tgtggcagggatactgaggcag

SEQ ID NO: 7677807 - DNA, 22 bp, Homo sapiens
tgtggcagggatactgaggcag

SEQ ID NO: 7677808 - DNA, 22 bp, Homo sapiens
tgtggcagggatactgaggcag

SEQ ID NO: 7677809 - DNA, 22 bp, Homo sapiens
tgtggcagggatactgaggcag

SEQ ID NO: 7677810 - DNA, 18 bp, Homo sapiens
tgtggctggtccacactg

SEQ ID NO: 7677811 - DNA, 22 bp, Homo sapiens
tgtggctgggctaataggcaaa

SEQ ID NO: 7677812 - DNA, 18 bp, Homo sapiens
tgtggctggtccacactg

SEQ ID NO: 7677813 - DNA, 22 bp, Homo sapiens
tgtggctgggctaataggcaaa

SEQ ID NO: 7677814 - DNA, 22 bp, Homo sapiens
tgtggctgggaagaaggtaact

SEQ ID NO: 7677815 - DNA, 22 bp, Homo sapiens
tgtggctgggaagaaggtaact

SEQ ID NO: 7677816 - DNA, 15 bp, Homo sapiens
tgtggctggctcctg

SEQ ID NO: 7677817 - DNA, 22 bp, Homo sapiens
tgtggctggattgattttacct

SEQ ID NO: 7677818 - DNA, 22 bp, Homo sapiens
tgtggctgctcctgggtggtca

SEQ ID NO: 7677819 - DNA, 22 bp, Homo sapiens
tgtggctgctcctgggtggtca

SEQ ID NO: 7677820 - DNA, 22 bp, Homo sapiens
tgtggctgctcaggtgcagacc

SEQ ID NO: 7677821 - DNA, 22 bp, Homo sapiens
tgtggctgctcctgggtggtca

SEQ ID NO: 7677822 - DNA, 22 bp, Homo sapiens
tgtggctgtgccgtcacacgtg

SEQ ID NO: 7677823 - DNA, 22 bp, Homo sapiens
tgtggctgtgccgtcacacgtg

SEQ ID NO: 7677824 - DNA, 22 bp, Homo sapiens
tgtggctgtctgttctcctagg

SEQ ID NO: 7677825 - DNA, 22 bp, Homo sapiens
tgtggctgtctgttctcctagg

SEQ ID NO: 7677826 - DNA, 22 bp, Homo sapiens
tgtggctggtctccgagcgtcg

SEQ ID NO: 7677827 - DNA, 18 bp, Homo sapiens
tgtggctggtccacactg

SEQ ID NO: 7677828 - DNA, 22 bp, Homo sapiens
tgtggctgtctgttctcctagg

SEQ ID NO: 7677829 - DNA, 22 bp, Homo sapiens
tgtggctggtctccgagcgtcg

SEQ ID NO: 7677830 - DNA, 22 bp, Homo sapiens
tgtggctgtgtccacctgctgc

SEQ ID NO: 7677831 - DNA, 22 bp, Homo sapiens
tgtggctgtggttttcataaat

SEQ ID NO: 7677832 - DNA, 22 bp, Homo sapiens
tgtggctgtggatgctttccag

SEQ ID NO: 7677833 - DNA, 22 bp, Homo sapiens
tgtggctgtgccgtcacacgtg

SEQ ID NO: 7677834 - DNA, 22 bp, Homo sapiens
tgtggctgtggatgctttccag

SEQ ID NO: 7677835 - DNA, 22 bp, Homo sapiens
cctgggagctgtggaaaggctg

SEQ ID NO: 7677836 - DNA, 22 bp, Homo sapiens
cctgggagctgtggaaaggctg

SEQ ID NO: 7677837 - DNA, 22 bp, Homo sapiens
cctgggagctgtggaaaggctg

SEQ ID NO: 7677838 - DNA, 22 bp, Homo sapiens
cctgggagctgtggaaaggctg

SEQ ID NO: 7677839 - DNA, 22 bp, Homo sapiens
tgtgggaaatgggagtggaaga

SEQ ID NO: 7677840 - DNA, 22 bp, Homo sapiens
tgtgggaaatgggagtggaaga

SEQ ID NO: 7677841 - DNA, 22 bp, Homo sapiens
tgtgggaaatgggagtggaaga

SEQ ID NO: 7677842 - DNA, 22 bp, Homo sapiens
tgtggcttttgctagctttgca

SEQ ID NO: 7677843 - DNA, 22 bp, Homo sapiens
tgtggcttttgctagctttgca

SEQ ID NO: 7677844 - DNA, 22 bp, Homo sapiens
tgtggctgtgtccacctgctgc

SEQ ID NO: 7677845 - DNA, 22 bp, Homo sapiens
tgtggctgttgaggaccccaag

SEQ ID NO: 7677846 - DNA, 22 bp, Homo sapiens
tgtggctgttgaggaccccaag

SEQ ID NO: 7677847 - DNA, 22 bp, Homo sapiens
tgtggctgttgaggaccccaag

SEQ ID NO: 7677848 - DNA, 19 bp, Homo sapiens
cctgggaggcggaggttgc

SEQ ID NO: 7677849 - DNA, 19 bp, Homo sapiens
cctgggaggcggaggttgc

SEQ ID NO: 7677850 - DNA, 19 bp, Homo sapiens
cctgggaggcggaggttgc

SEQ ID NO: 7677851 - DNA, 19 bp, Homo sapiens
cctgggaggcggaggttgc

SEQ ID NO: 7677852 - DNA, 19 bp, Homo sapiens
cctgggaggcggaggttgc

SEQ ID NO: 7677853 - DNA, 19 bp, Homo sapiens
cctgggaggcggaggttgc

SEQ ID NO: 7677854 - DNA, 22 bp, Homo sapiens
cctgggaggcagaggttgcagt

SEQ ID NO: 7677855 - DNA, 22 bp, Homo sapiens
cctgggaggcagaggttgcagt

SEQ ID NO: 7677856 - DNA, 22 bp, Homo sapiens
cctgggagctgtggaaaggctg

SEQ ID NO: 7677857 - DNA, 22 bp, Homo sapiens
cctgggagctgtggaaaggctg

SEQ ID NO: 7677858 - DNA, 17 bp, Homo sapiens
cctgggaggagttatga

SEQ ID NO: 7677859 - DNA, 22 bp, Homo sapiens
cctgggaggcagaggttgcagt

SEQ ID NO: 7677860 - DNA, 22 bp, Homo sapiens
cctgggaggcagaggttgcagt

SEQ ID NO: 7677861 - DNA, 22 bp, Homo sapiens
cctgggaggcagaggttgcagt

SEQ ID NO: 7677862 - DNA, 22 bp, Homo sapiens
cctgggaggcagaggttgcagt

SEQ ID NO: 7677863 - DNA, 22 bp, Homo sapiens
cctgggaggcagaggttgcagt

SEQ ID NO: 7677864 - DNA, 22 bp, Homo sapiens
tgtgaggagtaggctgagggtg

SEQ ID NO: 7677865 - DNA, 22 bp, Homo sapiens
tgtgaggagggtcaaactgagt

SEQ ID NO: 7677866 - DNA, 22 bp, Homo sapiens
tgtgaggagggtcaaactgagt

SEQ ID NO: 7677867 - DNA, 22 bp, Homo sapiens
tgtgaggaggcggccagaagag

SEQ ID NO: 7677868 - DNA, 22 bp, Homo sapiens
tgtgaggataaaaaggaaggag

SEQ ID NO: 7677869 - DNA, 22 bp, Homo sapiens
tgtgaggataaaaaggaaggag

SEQ ID NO: 7677870 - DNA, 22 bp, Homo sapiens
tgtgaggagtaggctgagggtg

SEQ ID NO: 7677871 - DNA, 22 bp, Homo sapiens
tgtgaggagtaggctgagggtg

SEQ ID NO: 7677872 - DNA, 22 bp, Homo sapiens
tgtgaggacattggaggactca

SEQ ID NO: 7677873 - DNA, 22 bp, Homo sapiens
tgtgaggacattggaggactca

SEQ ID NO: 7677874 - DNA, 22 bp, Homo sapiens
tgtgaggacattggaggactca

SEQ ID NO: 7677875 - DNA, 22 bp, Homo sapiens
tgtgaggacctcagcagagtct

SEQ ID NO: 7677876 - DNA, 22 bp, Homo sapiens
tgtgaggacctcagcagagtct

SEQ ID NO: 7677877 - DNA, 17 bp, Homo sapiens
tgtgagcatctatagaa

SEQ ID NO: 7677878 - DNA, 17 bp, Homo sapiens
tgtgagcatctatagaa

SEQ ID NO: 7677879 - DNA, 20 bp, Homo sapiens
tgtgagcagatgctgagtga

SEQ ID NO: 7677880 - DNA, 22 bp, Homo sapiens
tgtgagcatatgttttcagctc

SEQ ID NO: 7677881 - DNA, 22 bp, Homo sapiens
tgtgagcatatgttttcagctc

SEQ ID NO: 7677882 - DNA, 22 bp, Homo sapiens
tgtgagcagctctgtggactca

SEQ ID NO: 7677883 - DNA, 20 bp, Homo sapiens
tgtgagcagatgctgagtga

SEQ ID NO: 7677884 - DNA, 20 bp, Homo sapiens
tgtgagcagatgctgagtga

SEQ ID NO: 7677885 - DNA, 22 bp, Homo sapiens
tgtgagcagagacatgaaaagc

SEQ ID NO: 7677886 - DNA, 20 bp, Homo sapiens
tgtgagcagatgctgagtga

SEQ ID NO: 7677887 - DNA, 22 bp, Homo sapiens
tgtgaggaacaggactagagca

SEQ ID NO: 7677888 - DNA, 22 bp, Homo sapiens
tgtgaggaacaggactagagca

SEQ ID NO: 7677889 - DNA, 22 bp, Homo sapiens
tgtgagctttctgctctcctgt

SEQ ID NO: 7677890 - DNA, 22 bp, Homo sapiens
tgtgaggaacccggaatgtggg

SEQ ID NO: 7677891 - DNA, 22 bp, Homo sapiens
tgtgaggaacaggactagagca

SEQ ID NO: 7677892 - DNA, 22 bp, Homo sapiens
tgtgaggaacaggactagagca

SEQ ID NO: 7677893 - DNA, 20 bp, Homo sapiens
cctggctgcattcaggacgg

SEQ ID NO: 7677894 - DNA, 22 bp, Homo sapiens
cctggctgcagtttttgcagaa

SEQ ID NO: 7677895 - DNA, 21 bp, Homo sapiens
cctggctgcacagttgctggt

SEQ ID NO: 7677896 - DNA, 22 bp, Homo sapiens
cctggctgcagtttttgcagaa

SEQ ID NO: 7677897 - DNA, 22 bp, Homo sapiens
cctggctgcagtttttgcagaa

SEQ ID NO: 7677898 - DNA, 22 bp, Homo sapiens
tgtgagggttttaagggaatga

SEQ ID NO: 7677899 - DNA, 22 bp, Homo sapiens
tgtgaggcttgaagtaattcca

SEQ ID NO: 7677900 - DNA, 22 bp, Homo sapiens
tgtgagggttttaagggaatga

SEQ ID NO: 7677901 - DNA, 22 bp, Homo sapiens
tgtgagggttttaagggaatga

SEQ ID NO: 7677902 - DNA, 22 bp, Homo sapiens
tgtgagggttttaagggaatga

SEQ ID NO: 7677903 - DNA, 22 bp, Homo sapiens
tgtgagggttttaagggaatga

SEQ ID NO: 7677904 - DNA, 22 bp, Homo sapiens
tgtgaggctggcaggggccagg

SEQ ID NO: 7677905 - DNA, 22 bp, Homo sapiens
tgtgaggctacctgccagggtc

SEQ ID NO: 7677906 - DNA, 22 bp, Homo sapiens
tgtgaggctacctgccagggtc

SEQ ID NO: 7677907 - DNA, 22 bp, Homo sapiens
tgtgaggctacctgccagggtc

SEQ ID NO: 7677908 - DNA, 22 bp, Homo sapiens
tgtgaggctacctgccagggtc

SEQ ID NO: 7677909 - DNA, 22 bp, Homo sapiens
tgtgaggcgaggccagtgagct

SEQ ID NO: 7677910 - DNA, 22 bp, Homo sapiens
tgtgaggcgaggccagtgagct

SEQ ID NO: 7677911 - DNA, 22 bp, Homo sapiens
tgtgaggcgaggccagtgagct

SEQ ID NO: 7677912 - DNA, 22 bp, Homo sapiens
tgtgaggataaaaaggaaggag

SEQ ID NO: 7677913 - DNA, 22 bp, Homo sapiens
tgtgaggatgtaaccagaagtc

SEQ ID NO: 7677914 - DNA, 22 bp, Homo sapiens
tgtgaggatggagttctacagg

SEQ ID NO: 7677915 - DNA, 22 bp, Homo sapiens
tgtgaggcctagacagcctggg

SEQ ID NO: 7677916 - DNA, 22 bp, Homo sapiens
tgtgaggattaaatgcatagtg

SEQ ID NO: 7677917 - DNA, 22 bp, Homo sapiens
tgtgaggattaaatgcatagtg

SEQ ID NO: 7677918 - DNA, 22 bp, Homo sapiens
tgtgaggcctctgcaggagcag

SEQ ID NO: 7677919 - DNA, 22 bp, Homo sapiens
tgtgaggcctctgcaggagcag

SEQ ID NO: 7677920 - DNA, 22 bp, Homo sapiens
tgtgaggcgaggccagtgagct

SEQ ID NO: 7677921 - DNA, 22 bp, Homo sapiens
tgtgaggcctagacagcctggg

SEQ ID NO: 7677922 - DNA, 22 bp, Homo sapiens
tgtgaggcctctgcaggagcag

SEQ ID NO: 7677923 - DNA, 22 bp, Homo sapiens
tgtgaggcctagacagcctggg

SEQ ID NO: 7677924 - DNA, 22 bp, Homo sapiens
tgtctttctatctctagattta

SEQ ID NO: 7677925 - DNA, 22 bp, Homo sapiens
tgtctttctgacccaaggtagt

SEQ ID NO: 7677926 - DNA, 22 bp, Homo sapiens
tgtctttctgcaccacctcaca

SEQ ID NO: 7677927 - DNA, 20 bp, Homo sapiens
tgtctttccatggctggatc

SEQ ID NO: 7677928 - DNA, 22 bp, Homo sapiens
tgtctttctgcaccacctcaca

SEQ ID NO: 7677929 - DNA, 22 bp, Homo sapiens
tgtctttctgcaccacctcaca

SEQ ID NO: 7677930 - DNA, 22 bp, Homo sapiens
tgtctttagttttactgtctgg

SEQ ID NO: 7677931 - DNA, 22 bp, Homo sapiens
tgtctttatatatttggaaaat

SEQ ID NO: 7677932 - DNA, 22 bp, Homo sapiens
tgtctttatatatttggaaaat

SEQ ID NO: 7677933 - DNA, 22 bp, Homo sapiens
tgtctttatatatttggaaaat

SEQ ID NO: 7677934 - DNA, 22 bp, Homo sapiens
tgtctttatgcacactgacttg

SEQ ID NO: 7677935 - DNA, 22 bp, Homo sapiens
tgtctttatgcacactgacttg

SEQ ID NO: 7677936 - DNA, 22 bp, Homo sapiens
tgtctttatgcacactgacttg

SEQ ID NO: 7677937 - DNA, 22 bp, Homo sapiens
tgtctttatgcacactgacttg

SEQ ID NO: 7677938 - DNA, 22 bp, Homo sapiens
tgtctttctatctctagattta

SEQ ID NO: 7677939 - DNA, 22 bp, Homo sapiens
tgtgaaccttggtgagtcagta

SEQ ID NO: 7677940 - DNA, 18 bp, Homo sapiens
tgtctttggaccactgaa

SEQ ID NO: 7677941 - DNA, 18 bp, Homo sapiens
tgtctttggaccactgaa

SEQ ID NO: 7677942 - DNA, 22 bp, Homo sapiens
tgtctttgattgataggctatg

SEQ ID NO: 7677943 - DNA, 22 bp, Homo sapiens
tgtctttggaatatttagctga

SEQ ID NO: 7677944 - DNA, 22 bp, Homo sapiens
tgtctttggaatatttagctga

SEQ ID NO: 7677945 - DNA, 22 bp, Homo sapiens
tgtctttggaatatttagctga

SEQ ID NO: 7677946 - DNA, 22 bp, Homo sapiens
tgtgaagaattaatgtgaatca

SEQ ID NO: 7677947 - DNA, 22 bp, Homo sapiens
tgtgaactttggatggttctga

SEQ ID NO: 7677948 - DNA, 22 bp, Homo sapiens
tgtgaactttggatggttctga

SEQ ID NO: 7677949 - DNA, 22 bp, Homo sapiens
tgtgaagaattaatgtgaatca

SEQ ID NO: 7677950 - DNA, 22 bp, Homo sapiens
tgtgaagagagtaataaagtca

SEQ ID NO: 7677951 - DNA, 22 bp, Homo sapiens
tgtgaagagagtaataaagtca

SEQ ID NO: 7677952 - DNA, 22 bp, Homo sapiens
tgtgaagaattaatgtgaatca

SEQ ID NO: 7677953 - DNA, 22 bp, Homo sapiens
tgtgaagaattaatgtgaatca

SEQ ID NO: 7677954 - DNA, 22 bp, Homo sapiens
tgtgaagcattttggacagcgc

SEQ ID NO: 7677955 - DNA, 22 bp, Homo sapiens
tgtgaagcattttggacagcgc

SEQ ID NO: 7677956 - DNA, 23 bp, Homo sapiens
tgtgaagccgctcataggggtcc

SEQ ID NO: 7677957 - DNA, 22 bp, Homo sapiens
tgtgaagcccagagaggttcac

SEQ ID NO: 7677958 - DNA, 22 bp, Homo sapiens
tgtgaagcgtgtgcaggggaca

SEQ ID NO: 7677959 - DNA, 22 bp, Homo sapiens
tgtgaagctggatcctggagct

SEQ ID NO: 7677960 - DNA, 22 bp, Homo sapiens
tgtgaagcagtcacacgctttc

SEQ ID NO: 7677961 - DNA, 22 bp, Homo sapiens
tgtgaagcatagattctgtaga

SEQ ID NO: 7677962 - DNA, 22 bp, Homo sapiens
tgtgaagatttggcatgcagaa

SEQ ID NO: 7677963 - DNA, 20 bp, Homo sapiens
tgtgaagcaggagggtggtt

SEQ ID NO: 7677964 - DNA, 22 bp, Homo sapiens
tgtgaagatttggcatgcagaa

SEQ ID NO: 7677965 - DNA, 22 bp, Homo sapiens
tgtgaagagtagacatgtggtg

SEQ ID NO: 7677966 - DNA, 22 bp, Homo sapiens
tgtgaagagtagacatgtggtg

SEQ ID NO: 7677967 - DNA, 22 bp, Homo sapiens
tgtgaagattaagttactgggc

SEQ ID NO: 7677968 - DNA, 22 bp, Homo sapiens
tgtgaagattaagttactgggc

SEQ ID NO: 7677969 - DNA, 22 bp, Homo sapiens
tgtgaagatcagggtcctagag

SEQ ID NO: 7677970 - DNA, 22 bp, Homo sapiens
tgtgaagatttggcatgcagaa

SEQ ID NO: 7677971 - DNA, 22 bp, Homo sapiens
tgtgaagatttggcatgcagaa

SEQ ID NO: 7677972 - DNA, 22 bp, Homo sapiens
tgtgaagatttggcatgcagaa

SEQ ID NO: 7677973 - DNA, 22 bp, Homo sapiens
tgtgaagatttggcatgcagaa

SEQ ID NO: 7677974 - DNA, 22 bp, Homo sapiens
tgtgaaggcagagccagtgaaa

SEQ ID NO: 7677975 - DNA, 22 bp, Homo sapiens
tgtgaaggtaaggaggggcaag

SEQ ID NO: 7677976 - DNA, 22 bp, Homo sapiens
tgtgaaggtaaggaggggcaag

SEQ ID NO: 7677977 - DNA, 22 bp, Homo sapiens
tgtgaaggtaaggaggggcaag

SEQ ID NO: 7677978 - DNA, 23 bp, Homo sapiens
tgtgaaggtgggtccaagggctg

SEQ ID NO: 7677979 - DNA, 22 bp, Homo sapiens
tgtgaaggagcatgcagagggg

SEQ ID NO: 7677980 - DNA, 22 bp, Homo sapiens
tgtgaaggcagagccagtgaaa

SEQ ID NO: 7677981 - DNA, 22 bp, Homo sapiens
tgtgaaggcagagccagtgaaa

SEQ ID NO: 7677982 - DNA, 22 bp, Homo sapiens
tgtgaaggcagagccagtgaaa

SEQ ID NO: 7677983 - DNA, 22 bp, Homo sapiens
tgtgaaggagatgaagggagtg

SEQ ID NO: 7677984 - DNA, 22 bp, Homo sapiens
tgtgaaggagatgaagggagtg

SEQ ID NO: 7677985 - DNA, 22 bp, Homo sapiens
tgtgaagcgtgtgcaggggaca

SEQ ID NO: 7677986 - DNA, 22 bp, Homo sapiens
cctggctgagcctccaggaaga

SEQ ID NO: 7677987 - DNA, 22 bp, Homo sapiens
cctggctgagcctccaggaaga

SEQ ID NO: 7677988 - DNA, 23 bp, Homo sapiens
cctggctgacctgaaggtgtagt

SEQ ID NO: 7677989 - DNA, 23 bp, Homo sapiens
cctggctgacctgaaggtgtagt

SEQ ID NO: 7677990 - DNA, 22 bp, Homo sapiens
cctggctgagcctccaggaaga

SEQ ID NO: 7677991 - DNA, 22 bp, Homo sapiens
cctggctgagcctccaggaaga

SEQ ID NO: 7677992 - DNA, 22 bp, Homo sapiens
cctggctgagcctccaggaaga

SEQ ID NO: 7677993 - DNA, 22 bp, Homo sapiens
cctggctgagggacctcgggta

SEQ ID NO: 7677994 - DNA, 22 bp, Homo sapiens
cctggctgagggacctcgggta

SEQ ID NO: 7677995 - DNA, 22 bp, Homo sapiens
cctggctgagggacctcgggta

SEQ ID NO: 7677996 - DNA, 22 bp, Homo sapiens
cctggctgagggacctcgggta

SEQ ID NO: 7677997 - DNA, 22 bp, Homo sapiens
cctggctgagggacctcgggta

SEQ ID NO: 7677998 - DNA, 22 bp, Homo sapiens
cctggctgagggacctcgggta

SEQ ID NO: 7677999 - DNA, 22 bp, Homo sapiens
cctggctgagggacctcgggta

SEQ ID NO: 7678000 - DNA, 22 bp, Homo sapiens
cctggctgagggacctcgggta

SEQ ID NO: 7678001 - DNA, 22 bp, Homo sapiens
cctggctgaggggccaaggacc

SEQ ID NO: 7678002 - DNA, 22 bp, Homo sapiens
cctggctgaggggccaaggacc

SEQ ID NO: 7678003 - DNA, 22 bp, Homo sapiens
cctggctgaggggccaaggacc

SEQ ID NO: 7678004 - DNA, 22 bp, Homo sapiens
cctggctgaggggccaaggacc

SEQ ID NO: 7678005 - DNA, 22 bp, Homo sapiens
cctggctgaggggccaaggacc

SEQ ID NO: 7678006 - DNA, 22 bp, Homo sapiens
cctggctgaggggccaaggacc

SEQ ID NO: 7678007 - DNA, 22 bp, Homo sapiens
cctggctgaggggccaaggacc

SEQ ID NO: 7678008 - DNA, 21 bp, Homo sapiens
cctggctgcacagttgctggt

SEQ ID NO: 7678009 - DNA, 22 bp, Homo sapiens
cctggctgaggggccaaggacc

SEQ ID NO: 7678010 - DNA, 22 bp, Homo sapiens
cctggctgaggggccaaggacc

SEQ ID NO: 7678011 - DNA, 22 bp, Homo sapiens
tgtctgggtcacccctcctggc

SEQ ID NO: 7678012 - DNA, 22 bp, Homo sapiens
tgtctgggtcacccctcctggc

SEQ ID NO: 7678013 - DNA, 22 bp, Homo sapiens
tgtctgggtcacccctcctggc

SEQ ID NO: 7678014 - DNA, 22 bp, Homo sapiens
tgtctgggttttgggtcatatt

SEQ ID NO: 7678015 - DNA, 22 bp, Homo sapiens
tgtctgggttttgggtcatatt

SEQ ID NO: 7678016 - DNA, 22 bp, Homo sapiens
tgtctgggggttctgaaagctg

SEQ ID NO: 7678017 - DNA, 23 bp, Homo sapiens
tgtctggggcgccagaagagaga

SEQ ID NO: 7678018 - DNA, 23 bp, Homo sapiens
tgtctggggcgccagaagagaga

SEQ ID NO: 7678019 - DNA, 23 bp, Homo sapiens
tgtctggggcgccagaagagaga

SEQ ID NO: 7678020 - DNA, 21 bp, Homo sapiens
cctggctgcacagttgctggt

SEQ ID NO: 7678021 - DNA, 21 bp, Homo sapiens
cctggctgcacagttgctggt

SEQ ID NO: 7678022 - DNA, 21 bp, Homo sapiens
cctggctgcacagttgctggt

SEQ ID NO: 7678023 - DNA, 22 bp, Homo sapiens
tgtctggggaactgtgcatcca

SEQ ID NO: 7678024 - DNA, 21 bp, Homo sapiens
cctggctgcacagttgctggt

SEQ ID NO: 7678025 - DNA, 21 bp, Homo sapiens
cctggctgcacagttgctggt

SEQ ID NO: 7678026 - DNA, 21 bp, Homo sapiens
cctggctgcacagttgctggt

SEQ ID NO: 7678027 - DNA, 21 bp, Homo sapiens
cctggctgcacagttgctggt

SEQ ID NO: 7678028 - DNA, 21 bp, Homo sapiens
cctggctgcacagttgctggt

SEQ ID NO: 7678029 - DNA, 21 bp, Homo sapiens
cctggctgcacagttgctggt

SEQ ID NO: 7678030 - DNA, 19 bp, Homo sapiens
cctggctctgagcccagcc

SEQ ID NO: 7678031 - DNA, 19 bp, Homo sapiens
cctggctctgagcccagcc

SEQ ID NO: 7678032 - DNA, 19 bp, Homo sapiens
cctggctctgagcccagcc

SEQ ID NO: 7678033 - DNA, 19 bp, Homo sapiens
cctggctctgagcccagcc

SEQ ID NO: 7678034 - DNA, 19 bp, Homo sapiens
cctggctctgagcccagcc

SEQ ID NO: 7678035 - DNA, 22 bp, Homo sapiens
cctggctctgaagtccacatca

SEQ ID NO: 7678036 - DNA, 22 bp, Homo sapiens
cctggctctgaagtccacatca

SEQ ID NO: 7678037 - DNA, 22 bp, Homo sapiens
cctggctctgaagtccacatca

SEQ ID NO: 7678038 - DNA, 19 bp, Homo sapiens
cctggctctgagcccagcc

SEQ ID NO: 7678039 - DNA, 19 bp, Homo sapiens
cctggctctgagcccagcc

SEQ ID NO: 7678040 - DNA, 19 bp, Homo sapiens
cctggctctgagcccagcc

SEQ ID NO: 7678041 - DNA, 19 bp, Homo sapiens
cctggctctgagcccagcc

SEQ ID NO: 7678042 - DNA, 19 bp, Homo sapiens
cctggctctgagcccagcc

SEQ ID NO: 7678043 - DNA, 19 bp, Homo sapiens
cctggctctgagcccagcc

SEQ ID NO: 7678044 - DNA, 22 bp, Homo sapiens
cctggctcttcgggagtttgtt

SEQ ID NO: 7678045 - DNA, 22 bp, Homo sapiens
cctggctcttctgtgtcagccc

SEQ ID NO: 7678046 - DNA, 22 bp, Homo sapiens
cctggctcttctgtgtcagccc

SEQ ID NO: 7678047 - DNA, 22 bp, Homo sapiens
cctggctcttctgtgtcagccc

SEQ ID NO: 7678048 - DNA, 22 bp, Homo sapiens
cctggctcttctgtgtcagccc

SEQ ID NO: 7678049 - DNA, 22 bp, Homo sapiens
cctggctcttctgtgtcagccc

SEQ ID NO: 7678050 - DNA, 22 bp, Homo sapiens
cctggctcttcgggagtttgtt

SEQ ID NO: 7678051 - DNA, 22 bp, Homo sapiens
cctggctcttcagaggttccta

SEQ ID NO: 7678052 - DNA, 22 bp, Homo sapiens
cctggctcttcagaggttccta

SEQ ID NO: 7678053 - DNA, 19 bp, Homo sapiens
cctggctctgagcccagcc

SEQ ID NO: 7678054 - DNA, 22 bp, Homo sapiens
cctggctcttcagaggttccta

SEQ ID NO: 7678055 - DNA, 23 bp, Homo sapiens
cctggctgacctgaaggtgtagt

SEQ ID NO: 7678056 - DNA, 23 bp, Homo sapiens
cctggctgacctgaaggtgtagt

SEQ ID NO: 7678057 - DNA, 23 bp, Homo sapiens
cctggctgacctgaaggtgtagt

SEQ ID NO: 7678058 - DNA, 23 bp, Homo sapiens
cctggctgacctgaaggtgtagt

SEQ ID NO: 7678059 - DNA, 23 bp, Homo sapiens
cctggctgacctgaaggtgtagt

SEQ ID NO: 7678060 - DNA, 23 bp, Homo sapiens
cctggctgacctgaaggtgtagt

SEQ ID NO: 7678061 - DNA, 23 bp, Homo sapiens
cctggctgacctgaaggtgtagt

SEQ ID NO: 7678062 - DNA, 22 bp, Homo sapiens
cctggctgaaccaatgaagtgg

SEQ ID NO: 7678063 - DNA, 22 bp, Homo sapiens
cctggctgaaccaatgaagtgg

SEQ ID NO: 7678064 - DNA, 22 bp, Homo sapiens
cctggctgaaccaatgaagtgg

SEQ ID NO: 7678065 - DNA, 22 bp, Homo sapiens
cctggctgaacaaagtccctcc

SEQ ID NO: 7678066 - DNA, 22 bp, Homo sapiens
cctggctgaaccaatgaagtgg

SEQ ID NO: 7678067 - DNA, 22 bp, Homo sapiens
cctggctgaaccaatgaagtgg

SEQ ID NO: 7678068 - DNA, 22 bp, Homo sapiens
cctggctgacagcttaattcca

SEQ ID NO: 7678069 - DNA, 22 bp, Homo sapiens
cctggctgacagcttaattcca

SEQ ID NO: 7678070 - DNA, 22 bp, Homo sapiens
cctggctgaacaaagtccctcc

SEQ ID NO: 7678071 - DNA, 22 bp, Homo sapiens
cctggctgaacaaagtccctcc

SEQ ID NO: 7678072 - DNA, 22 bp, Homo sapiens
cctggctgaacaaagtccctcc

SEQ ID NO: 7678073 - DNA, 22 bp, Homo sapiens
cctggctcttctgtgtcagccc

SEQ ID NO: 7678074 - DNA, 22 bp, Homo sapiens
cctggctcttctgtgtcagccc

SEQ ID NO: 7678075 - DNA, 22 bp, Homo sapiens
cctggctgaacaaagtccctcc

SEQ ID NO: 7678076 - DNA, 22 bp, Homo sapiens
cctggctgaacaaagtccctcc

SEQ ID NO: 7678077 - DNA, 22 bp, Homo sapiens
cctggctgaacaaagtccctcc

SEQ ID NO: 7678078 - DNA, 22 bp, Homo sapiens
cctggctgaacaaagtccctcc

SEQ ID NO: 7678079 - DNA, 19 bp, Homo sapiens
tgtctgtataggtaaagaa

SEQ ID NO: 7678080 - DNA, 22 bp, Homo sapiens
tgtctgtaggtgtaatagagct

SEQ ID NO: 7678081 - DNA, 22 bp, Homo sapiens
tgtctgtacaaattttctgtgt

SEQ ID NO: 7678082 - DNA, 22 bp, Homo sapiens
tgtctgtaggtgtaatagagct

SEQ ID NO: 7678083 - DNA, 22 bp, Homo sapiens
tgtctgtaaggtgtttatgtta

SEQ ID NO: 7678084 - DNA, 22 bp, Homo sapiens
tgtctgtaaggtgtttatgtta

SEQ ID NO: 7678085 - DNA, 22 bp, Homo sapiens
tgtctgtaatagtcactatgtg

SEQ ID NO: 7678086 - DNA, 22 bp, Homo sapiens
tgtctgtaatcaactgagtttc

SEQ ID NO: 7678087 - DNA, 23 bp, Homo sapiens
tgtctggttcatgcttattttgg

SEQ ID NO: 7678088 - DNA, 23 bp, Homo sapiens
tgtctggtttcttttatttagca

SEQ ID NO: 7678089 - DNA, 22 bp, Homo sapiens
tgtctggtgggttgacaggcag

SEQ ID NO: 7678090 - DNA, 22 bp, Homo sapiens
tgtctggtgggttgacaggcag

SEQ ID NO: 7678091 - DNA, 22 bp, Homo sapiens
tgtctggtgggttgacaggcag

SEQ ID NO: 7678092 - DNA, 22 bp, Homo sapiens
tgtctggtgggttgacaggcag

SEQ ID NO: 7678093 - DNA, 22 bp, Homo sapiens
tgtctggtgggttgacaggcag

SEQ ID NO: 7678094 - DNA, 22 bp, Homo sapiens
tgtctggtgggttgacaggcag

SEQ ID NO: 7678095 - DNA, 22 bp, Homo sapiens
tgtctggtgggttgacaggcag

SEQ ID NO: 7678096 - DNA, 22 bp, Homo sapiens
tgtctggtgggttgacaggcag

SEQ ID NO: 7678097 - DNA, 22 bp, Homo sapiens
tgtctggtgggttgacaggcag

SEQ ID NO: 7678098 - DNA, 22 bp, Homo sapiens
tgtctgtctgcacagctcatgg

SEQ ID NO: 7678099 - DNA, 22 bp, Homo sapiens
tgtctgtcctgcttccttggac

SEQ ID NO: 7678100 - DNA, 22 bp, Homo sapiens
tgtctgtccttgtttggtatca

SEQ ID NO: 7678101 - DNA, 22 bp, Homo sapiens
tgtctgtcggatgcaatttgta

SEQ ID NO: 7678102 - DNA, 22 bp, Homo sapiens
tgtctgtctccctgtgggcccc

SEQ ID NO: 7678103 - DNA, 22 bp, Homo sapiens
tgtctgtctgcaagccagaaag

SEQ ID NO: 7678104 - DNA, 22 bp, Homo sapiens
tgtctgtcccctgccttgaggg

SEQ ID NO: 7678105 - DNA, 22 bp, Homo sapiens
tgtctgtccatctgtctgggac

SEQ ID NO: 7678106 - DNA, 22 bp, Homo sapiens
tgtctgtccatctgtctgggac

SEQ ID NO: 7678107 - DNA, 17 bp, Homo sapiens
tgtctgtcatcagttcc

SEQ ID NO: 7678108 - DNA, 23 bp, Homo sapiens
tgtctgtcatggaatttcaaggt

SEQ ID NO: 7678109 - DNA, 23 bp, Homo sapiens
tgtctgtcatggaatttcaaggt

SEQ ID NO: 7678110 - DNA, 22 bp, Homo sapiens
tgtctgtccactcactgtggag

SEQ ID NO: 7678111 - DNA, 22 bp, Homo sapiens
tgtctgtcagtataggcaggtg

SEQ ID NO: 7678112 - DNA, 22 bp, Homo sapiens
tgtctgtcagtataggcaggtg

SEQ ID NO: 7678113 - DNA, 22 bp, Homo sapiens
tgtctgtcagatattaagtttc

SEQ ID NO: 7678114 - DNA, 22 bp, Homo sapiens
tgtctgtcagcagtgggtcagg

SEQ ID NO: 7678115 - DNA, 17 bp, Homo sapiens
tgtctgtcatcagttcc

SEQ ID NO: 7678116 - DNA, 22 bp, Homo sapiens
tgtctgtcatcagggatatcct

SEQ ID NO: 7678117 - DNA, 22 bp, Homo sapiens
tgtctgtcagatattaagtttc

SEQ ID NO: 7678118 - DNA, 22 bp, Homo sapiens
tgtctgtattgaggtgcatatt

SEQ ID NO: 7678119 - DNA, 20 bp, Homo sapiens
tgtctgtatgcagtcatata

SEQ ID NO: 7678120 - DNA, 20 bp, Homo sapiens
tgtctgtatgcagtcatata

SEQ ID NO: 7678121 - DNA, 22 bp, Homo sapiens
tgtctgtattagtcagcattct

SEQ ID NO: 7678122 - DNA, 22 bp, Homo sapiens
tgtctttagaaagaagcagaca

SEQ ID NO: 7678123 - DNA, 22 bp, Homo sapiens
tgtctttacttagaagttcagg

SEQ ID NO: 7678124 - DNA, 22 bp, Homo sapiens
tgtctttacttagaagttcagg

SEQ ID NO: 7678125 - DNA, 22 bp, Homo sapiens
tgtctttagagtcacaaaacca

SEQ ID NO: 7678126 - DNA, 22 bp, Homo sapiens
tgtctttagagtcacaaaacca

SEQ ID NO: 7678127 - DNA, 22 bp, Homo sapiens
tgtctttagacctctctggcct

SEQ ID NO: 7678128 - DNA, 22 bp, Homo sapiens
tgtctttagacctctctggcct

SEQ ID NO: 7678129 - DNA, 22 bp, Homo sapiens
tgtctttagaaagaagcagaca

SEQ ID NO: 7678130 - DNA, 22 bp, Homo sapiens
tgtctttagaaagaagcagaca

SEQ ID NO: 7678131 - DNA, 22 bp, Homo sapiens
tgtctttacttaataaatatac

SEQ ID NO: 7678132 - DNA, 22 bp, Homo sapiens
tgtctttacttaataaatatac

SEQ ID NO: 7678133 - DNA, 22 bp, Homo sapiens
tgtctttacttaataaatatac

SEQ ID NO: 7678134 - DNA, 22 bp, Homo sapiens
tgtctttacttagaagttcagg

SEQ ID NO: 7678135 - DNA, 22 bp, Homo sapiens
tgtctttacttagaagttcagg

SEQ ID NO: 7678136 - DNA, 22 bp, Homo sapiens
tgtctttacttagaagttcagg

SEQ ID NO: 7678137 - DNA, 22 bp, Homo sapiens
tgtctttacttagaagttcagg

SEQ ID NO: 7678138 - DNA, 22 bp, Homo sapiens
tgtctgtctttagtgagattgc

SEQ ID NO: 7678139 - DNA, 22 bp, Homo sapiens
tgtctgtctgttgattcagaaa

SEQ ID NO: 7678140 - DNA, 22 bp, Homo sapiens
tgtctgtctttagtgagattgc

SEQ ID NO: 7678141 - DNA, 22 bp, Homo sapiens
tgtctgtctgtacctatttttt

SEQ ID NO: 7678142 - DNA, 22 bp, Homo sapiens
tgtctgtctgtccttctcatta

SEQ ID NO: 7678143 - DNA, 21 bp, Homo sapiens
tgtctttaggacctgttaaat

SEQ ID NO: 7678144 - DNA, 21 bp, Homo sapiens
tgtctttaggacctgttaaat

SEQ ID NO: 7678145 - DNA, 21 bp, Homo sapiens
tgtctttaggacctgttaaat

SEQ ID NO: 7678146 - DNA, 21 bp, Homo sapiens
tgtctttaggacctgttaaat

SEQ ID NO: 7678147 - DNA, 22 bp, Homo sapiens
tgtctttagttgcttagatttg

SEQ ID NO: 7678148 - DNA, 22 bp, Homo sapiens
tgtctttagttgcttagatttg

SEQ ID NO: 7678149 - DNA, 22 bp, Homo sapiens
tgtctttagttgcttagatttg

SEQ ID NO: 7678150 - DNA, 22 bp, Homo sapiens
tgtctttagttgcttagatttg

SEQ ID NO: 7678151 - DNA, 22 bp, Homo sapiens
tgtctttagttttactgtctgg

SEQ ID NO: 7678152 - DNA, 22 bp, Homo sapiens
tgtctttagttttactgtctgg

SEQ ID NO: 7678153 - DNA, 22 bp, Homo sapiens
tgtctttagttttactgtctgg

SEQ ID NO: 7678154 - DNA, 22 bp, Homo sapiens
tgtctttagttgcttagatttg

SEQ ID NO: 7678155 - DNA, 22 bp, Homo sapiens
tgtctttagttgcttagatttg

SEQ ID NO: 7678156 - DNA, 22 bp, Homo sapiens
tgtctttagttgcttagatttg

SEQ ID NO: 7678157 - DNA, 22 bp, Homo sapiens
tgtctttagccagcagtcttct

SEQ ID NO: 7678158 - DNA, 22 bp, Homo sapiens
tgtctttagcccatatagactt

SEQ ID NO: 7678159 - DNA, 22 bp, Homo sapiens
tgtctttagcccatatagactt

SEQ ID NO: 7678160 - DNA, 22 bp, Homo sapiens
tgtctttagcccatatagactt

SEQ ID NO: 7678161 - DNA, 22 bp, Homo sapiens
tgtctttagcccatatagactt

SEQ ID NO: 7678162 - DNA, 22 bp, Homo sapiens
tgtctttagagtcacaaaacca

SEQ ID NO: 7678163 - DNA, 22 bp, Homo sapiens
tgtctttagagtcacaaaacca

SEQ ID NO: 7678164 - DNA, 22 bp, Homo sapiens
tgtctttagccacttgcctctt

SEQ ID NO: 7678165 - DNA, 22 bp, Homo sapiens
tgtctttagccacttgcctctt

SEQ ID NO: 7678166 - DNA, 22 bp, Homo sapiens
tgtctttagccacttgcctctt

SEQ ID NO: 7678167 - DNA, 22 bp, Homo sapiens
tgtctttagccagcagtcttct

SEQ ID NO: 7678168 - DNA, 22 bp, Homo sapiens
tgtctttagccagcagtcttct

SEQ ID NO: 7678169 - DNA, 22 bp, Homo sapiens
tgtctttagccagcagtcttct

SEQ ID NO: 7678170 - DNA, 22 bp, Homo sapiens
cctggctgtgtgaccttggcaa

SEQ ID NO: 7678171 - DNA, 22 bp, Homo sapiens
cctggctgtggcggtgctctca

SEQ ID NO: 7678172 - DNA, 22 bp, Homo sapiens
cctggctgtggcggtgctctca

SEQ ID NO: 7678173 - DNA, 22 bp, Homo sapiens
cctggctgtggcggtgctctca

SEQ ID NO: 7678174 - DNA, 22 bp, Homo sapiens
cctggctgtggcggtgctctca

SEQ ID NO: 7678175 - DNA, 22 bp, Homo sapiens
cctggctgtggcggtgctctca

SEQ ID NO: 7678176 - DNA, 22 bp, Homo sapiens
cctggctgtggcggtgctctca

SEQ ID NO: 7678177 - DNA, 22 bp, Homo sapiens
cctggctgtggcggtgctctca

SEQ ID NO: 7678178 - DNA, 23 bp, Homo sapiens
cctggctgtggatttgggcctgc

SEQ ID NO: 7678179 - DNA, 22 bp, Homo sapiens
cctggctgtggcggtgctctca

SEQ ID NO: 7678180 - DNA, 22 bp, Homo sapiens
cctggctgtggcggtgctctca

SEQ ID NO: 7678181 - DNA, 22 bp, Homo sapiens
cctggctgtgtgaccttggcaa

SEQ ID NO: 7678182 - DNA, 22 bp, Homo sapiens
cctggctgtttatttcggggct

SEQ ID NO: 7678183 - DNA, 22 bp, Homo sapiens
cctggctgtttatttcggggct

SEQ ID NO: 7678184 - DNA, 22 bp, Homo sapiens
cctggctgtttatttcggggct

SEQ ID NO: 7678185 - DNA, 22 bp, Homo sapiens
cctggctgtttgagcggggaat

SEQ ID NO: 7678186 - DNA, 22 bp, Homo sapiens
cctggctgtttgagcggggaat

SEQ ID NO: 7678187 - DNA, 22 bp, Homo sapiens
cctggctgtttatttcggggct

SEQ ID NO: 7678188 - DNA, 22 bp, Homo sapiens
cctggctgtgtgaccttggcaa

SEQ ID NO: 7678189 - DNA, 22 bp, Homo sapiens
cctggctgtgtgaccttggcaa

SEQ ID NO: 7678190 - DNA, 22 bp, Homo sapiens
cctggctgtgtgaccttggcaa

SEQ ID NO: 7678191 - DNA, 22 bp, Homo sapiens
cctggctgtgtgaccttggcaa

SEQ ID NO: 7678192 - DNA, 22 bp, Homo sapiens
cctggctgtgtgaccttggcaa

SEQ ID NO: 7678193 - DNA, 21 bp, Homo sapiens
cctggcttcagggtgcactgg

SEQ ID NO: 7678194 - DNA, 22 bp, Homo sapiens
cctggcttcagcattgccctct

SEQ ID NO: 7678195 - DNA, 22 bp, Homo sapiens
cctggcttatttttatagcagt

SEQ ID NO: 7678196 - DNA, 22 bp, Homo sapiens
cctggcttatttttatagcagt

SEQ ID NO: 7678197 - DNA, 22 bp, Homo sapiens
cctggctgtttgagcggggaat

SEQ ID NO: 7678198 - DNA, 22 bp, Homo sapiens
cctggctgtttgagcggggaat

SEQ ID NO: 7678199 - DNA, 22 bp, Homo sapiens
cctggctgtttgagcggggaat

SEQ ID NO: 7678200 - DNA, 22 bp, Homo sapiens
cctggctgtttgagcggggaat

SEQ ID NO: 7678201 - DNA, 22 bp, Homo sapiens
cctggcttccatatggcacata

SEQ ID NO: 7678202 - DNA, 22 bp, Homo sapiens
cctggcttccatatggcacata

SEQ ID NO: 7678203 - DNA, 22 bp, Homo sapiens
cctggcttcctggagctcacaa

SEQ ID NO: 7678204 - DNA, 20 bp, Homo sapiens
cctggctttgcagcatgaga

SEQ ID NO: 7678205 - DNA, 20 bp, Homo sapiens
cctggctttgcagcatgaga

SEQ ID NO: 7678206 - DNA, 22 bp, Homo sapiens
cctggctttgaccttgctgttt

SEQ ID NO: 7678207 - DNA, 22 bp, Homo sapiens
cctggctttctcatttacaggc

SEQ ID NO: 7678208 - DNA, 22 bp, Homo sapiens
cctggcttctgggtctgtgaga

SEQ ID NO: 7678209 - DNA, 22 bp, Homo sapiens
cctggcttctataccaccaggt

SEQ ID NO: 7678210 - DNA, 22 bp, Homo sapiens
cctggcttctataccaccaggt

SEQ ID NO: 7678211 - DNA, 22 bp, Homo sapiens
cctggcttctgggtctgtgaga

SEQ ID NO: 7678212 - DNA, 22 bp, Homo sapiens
cctggcttctgggtctgtgaga

SEQ ID NO: 7678213 - DNA, 22 bp, Homo sapiens
cctggcttctgggtctgtgaga

SEQ ID NO: 7678214 - DNA, 22 bp, Homo sapiens
cctggcttctgggtctgtgaga

SEQ ID NO: 7678215 - DNA, 18 bp, Homo sapiens
cctggcttttctacttgc

SEQ ID NO: 7678216 - DNA, 20 bp, Homo sapiens
cctggctttgcatctgtgat

SEQ ID NO: 7678217 - DNA, 23 bp, Homo sapiens
cctgggaaaactgctgatcttgc

SEQ ID NO: 7678218 - DNA, 22 bp, Homo sapiens
cctggcttttgtttataaattc

SEQ ID NO: 7678219 - DNA, 22 bp, Homo sapiens
cctgggaaagtgaggtcattat

SEQ ID NO: 7678220 - DNA, 22 bp, Homo sapiens
cctgggaacagcagagtcctgg

SEQ ID NO: 7678221 - DNA, 22 bp, Homo sapiens
cctgggaaagtgaggtcattat

SEQ ID NO: 7678222 - DNA, 22 bp, Homo sapiens
cctgggaaagtgaggtcattat

SEQ ID NO: 7678223 - DNA, 22 bp, Homo sapiens
cctgggaacagtgggttggctc

SEQ ID NO: 7678224 - DNA, 22 bp, Homo sapiens
cctgggaagaccggcagtgggg

SEQ ID NO: 7678225 - DNA, 22 bp, Homo sapiens
cctgggaagaccggcagtgggg

SEQ ID NO: 7678226 - DNA, 22 bp, Homo sapiens
cctggctgtgcattgccggccc

SEQ ID NO: 7678227 - DNA, 22 bp, Homo sapiens
cctggctgtgcattgccggccc

SEQ ID NO: 7678228 - DNA, 22 bp, Homo sapiens
cctggctgtgcatgtttctatg

SEQ ID NO: 7678229 - DNA, 22 bp, Homo sapiens
cctggctgtgcattgccggccc

SEQ ID NO: 7678230 - DNA, 22 bp, Homo sapiens
cctggctgtgcattgccggccc

SEQ ID NO: 7678231 - DNA, 22 bp, Homo sapiens
cctggctgtgcattgccggccc

SEQ ID NO: 7678232 - DNA, 19 bp, Homo sapiens
cctggctgtgaagcctgca

SEQ ID NO: 7678233 - DNA, 19 bp, Homo sapiens
cctggctgtgaagcctgca

SEQ ID NO: 7678234 - DNA, 22 bp, Homo sapiens
cctggctgtgcatgtttctatg

SEQ ID NO: 7678235 - DNA, 19 bp, Homo sapiens
cctggctgtgaagcctgca

SEQ ID NO: 7678236 - DNA, 19 bp, Homo sapiens
cctggctgtgaagcctgca

SEQ ID NO: 7678237 - DNA, 23 bp, Homo sapiens
cctggctgtggatttgggcctgc

SEQ ID NO: 7678238 - DNA, 23 bp, Homo sapiens
cctggctgtggatttgggcctgc

SEQ ID NO: 7678239 - DNA, 22 bp, Homo sapiens
cctggctgtgcattgccggccc

SEQ ID NO: 7678240 - DNA, 22 bp, Homo sapiens
cctggctgtgcattgccggccc

SEQ ID NO: 7678241 - DNA, 22 bp, Homo sapiens
cctggctgtgcattgccggccc

SEQ ID NO: 7678242 - DNA, 22 bp, Homo sapiens
cctggctgtgcattgccggccc

SEQ ID NO: 7678243 - DNA, 23 bp, Homo sapiens
cctggctgtggatttgggcctgc

SEQ ID NO: 7678244 - DNA, 23 bp, Homo sapiens
cctggctgtggatttgggcctgc

SEQ ID NO: 7678245 - DNA, 23 bp, Homo sapiens
cctggctgtggatttgggcctgc

SEQ ID NO: 7678246 - DNA, 19 bp, Homo sapiens
cctggctgtgaagcctgca

SEQ ID NO: 7678247 - DNA, 19 bp, Homo sapiens
cctggctgtgaagcctgca

SEQ ID NO: 7678248 - DNA, 19 bp, Homo sapiens
cctggctgtgaagcctgca

SEQ ID NO: 7678249 - DNA, 19 bp, Homo sapiens
cctggctgtgaagcctgca

SEQ ID NO: 7678250 - DNA, 19 bp, Homo sapiens
cctggctgtgaagcctgca

SEQ ID NO: 7678251 - DNA, 22 bp, Homo sapiens
cctggctgtcgttttgtgaaat

SEQ ID NO: 7678252 - DNA, 22 bp, Homo sapiens
cctggctgctgtcactgaccat

SEQ ID NO: 7678253 - DNA, 22 bp, Homo sapiens
cctggctggttgtctgattcta

SEQ ID NO: 7678254 - DNA, 22 bp, Homo sapiens
cctggctggttgtctgattcta

SEQ ID NO: 7678255 - DNA, 22 bp, Homo sapiens
cctggctggttgtctgattcta

SEQ ID NO: 7678256 - DNA, 22 bp, Homo sapiens
cctggctgctgtcactgaccat

SEQ ID NO: 7678257 - DNA, 22 bp, Homo sapiens
cctggctgctgtcactgaccat

SEQ ID NO: 7678258 - DNA, 22 bp, Homo sapiens
cctggctgctctgatgagcgcc

SEQ ID NO: 7678259 - DNA, 22 bp, Homo sapiens
cctggctgctatagcagcatgt

SEQ ID NO: 7678260 - DNA, 22 bp, Homo sapiens
cctggctgctatagcagcatgt

SEQ ID NO: 7678261 - DNA, 22 bp, Homo sapiens
cctggctgctatagcagcatgt

SEQ ID NO: 7678262 - DNA, 22 bp, Homo sapiens
cctggctgctatagcagcatgt

SEQ ID NO: 7678263 - DNA, 22 bp, Homo sapiens
cctggctgctatagcagcatgt

SEQ ID NO: 7678264 - DNA, 22 bp, Homo sapiens
cctggctgctgtcactgaccat

SEQ ID NO: 7678265 - DNA, 22 bp, Homo sapiens
cctggctgctgtcactgaccat

SEQ ID NO: 7678266 - DNA, 22 bp, Homo sapiens
cctggctgctctgatgagcgcc

SEQ ID NO: 7678267 - DNA, 22 bp, Homo sapiens
cctggctgctctgatgagcgcc

SEQ ID NO: 7678268 - DNA, 22 bp, Homo sapiens
cctggctgctctgatgagcgcc

SEQ ID NO: 7678269 - DNA, 22 bp, Homo sapiens
cctggctgctgtcactgaccat

SEQ ID NO: 7678270 - DNA, 22 bp, Homo sapiens
cctggctgcccatggaccctct

SEQ ID NO: 7678271 - DNA, 22 bp, Homo sapiens
cctggctgcattttgctggatg

SEQ ID NO: 7678272 - DNA, 22 bp, Homo sapiens
cctggctgcattttgctggatg

SEQ ID NO: 7678273 - DNA, 22 bp, Homo sapiens
cctggctgcccatggaccctct

SEQ ID NO: 7678274 - DNA, 22 bp, Homo sapiens
cctggctgcattttgctggatg

SEQ ID NO: 7678275 - DNA, 22 bp, Homo sapiens
cctggctgcattttgctggatg

SEQ ID NO: 7678276 - DNA, 22 bp, Homo sapiens
cctggctgcattttgctggatg

SEQ ID NO: 7678277 - DNA, 20 bp, Homo sapiens
cctggctgcattcaggacgg

SEQ ID NO: 7678278 - DNA, 22 bp, Homo sapiens
cctggctgcattttgctggatg

SEQ ID NO: 7678279 - DNA, 22 bp, Homo sapiens
cctggctgcattttgctggatg

SEQ ID NO: 7678280 - DNA, 22 bp, Homo sapiens
cctggctgcattttgctggatg

SEQ ID NO: 7678281 - DNA, 22 bp, Homo sapiens
cctggctgcattttgctggatg

SEQ ID NO: 7678282 - DNA, 22 bp, Homo sapiens
cctggctgcattttgctggatg

SEQ ID NO: 7678283 - DNA, 20 bp, Homo sapiens
cctggctgcattcaggacgg

SEQ ID NO: 7678284 - DNA, 20 bp, Homo sapiens
cctggctgcattcaggacgg

SEQ ID NO: 7678285 - DNA, 20 bp, Homo sapiens
cctggctgcattcaggacgg

SEQ ID NO: 7678286 - DNA, 20 bp, Homo sapiens
cctggctgcattcaggacgg

SEQ ID NO: 7678287 - DNA, 22 bp, Homo sapiens
cctggctgccgagtgtgcagcg

SEQ ID NO: 7678288 - DNA, 22 bp, Homo sapiens
cctggctgccgagtgtgcagcg

SEQ ID NO: 7678289 - DNA, 22 bp, Homo sapiens
cctggctgccgagtgtgcagcg

SEQ ID NO: 7678290 - DNA, 22 bp, Homo sapiens
cctggctgccttgtgttgatct

SEQ ID NO: 7678291 - DNA, 22 bp, Homo sapiens
cctggctgccttgtgttgatct

SEQ ID NO: 7678292 - DNA, 22 bp, Homo sapiens
cctggctgccttgtgttgatct

SEQ ID NO: 7678293 - DNA, 22 bp, Homo sapiens
cctggctgctatagcagcatgt

SEQ ID NO: 7678294 - DNA, 22 bp, Homo sapiens
cctggctgctatagcagcatgt

SEQ ID NO: 7678295 - DNA, 22 bp, Homo sapiens
cctggctgctatagcagcatgt

SEQ ID NO: 7678296 - DNA, 22 bp, Homo sapiens
cctggctgctatagcagcatgt

SEQ ID NO: 7678297 - DNA, 22 bp, Homo sapiens
cctggctgccgagtgtgcagcg

SEQ ID NO: 7678298 - DNA, 22 bp, Homo sapiens
cctggctgccgagtgtgcagcg

SEQ ID NO: 7678299 - DNA, 22 bp, Homo sapiens
cctggctgccgagtgtgcagcg

SEQ ID NO: 7678300 - DNA, 22 bp, Homo sapiens
cctggctgcccatggaccctct

SEQ ID NO: 7678301 - DNA, 22 bp, Homo sapiens
cctggctgcccatggaccctct

SEQ ID NO: 7678302 - DNA, 22 bp, Homo sapiens
cctggctgcccatggaccctct

SEQ ID NO: 7678303 - DNA, 22 bp, Homo sapiens
cctggctgcccatggaccctct

SEQ ID NO: 7678304 - DNA, 22 bp, Homo sapiens
cctggctgccgagtgtgcagcg

SEQ ID NO: 7678305 - DNA, 22 bp, Homo sapiens
cctggctgccgagtgtgcagcg

SEQ ID NO: 7678306 - DNA, 22 bp, Homo sapiens
cctggctgccgagtgtgcagcg

SEQ ID NO: 7678307 - DNA, 22 bp, Homo sapiens
cctggctgccgagtgtgcagcg

SEQ ID NO: 7678308 - DNA, 22 bp, Homo sapiens
tgtgcccagactgcctcagtga

SEQ ID NO: 7678309 - DNA, 20 bp, Homo sapiens
tgtgcccaatgtccaggttc

SEQ ID NO: 7678310 - DNA, 22 bp, Homo sapiens
tgtgcccagactgcctcagtga

SEQ ID NO: 7678311 - DNA, 20 bp, Homo sapiens
tgtgcccagcagaggctgcc

SEQ ID NO: 7678312 - DNA, 20 bp, Homo sapiens
tgtgcccagcagaggctgcc

SEQ ID NO: 7678313 - DNA, 20 bp, Homo sapiens
tgtgcccagcagaggctgcc

SEQ ID NO: 7678314 - DNA, 20 bp, Homo sapiens
tgtgcccagcagaggctgcc

SEQ ID NO: 7678315 - DNA, 22 bp, Homo sapiens
tgtgcccagactgcctcagtga

SEQ ID NO: 7678316 - DNA, 20 bp, Homo sapiens
tgtgcccagcagaggctgcc

SEQ ID NO: 7678317 - DNA, 22 bp, Homo sapiens
tgtgcccatccctctggagtgt

SEQ ID NO: 7678318 - DNA, 22 bp, Homo sapiens
tgtgcccatccctctggagtgt

SEQ ID NO: 7678319 - DNA, 22 bp, Homo sapiens
tgtgcccatccctctggagtgt

SEQ ID NO: 7678320 - DNA, 22 bp, Homo sapiens
tgtgcccagactgcctcagtga

SEQ ID NO: 7678321 - DNA, 22 bp, Homo sapiens
tgtgcccatctcccagcttgac

SEQ ID NO: 7678322 - DNA, 22 bp, Homo sapiens
tgtgcccattacacagaggcat

SEQ ID NO: 7678323 - DNA, 22 bp, Homo sapiens
tgtgcccattacacagaggcat

SEQ ID NO: 7678324 - DNA, 22 bp, Homo sapiens
tgtgccaggccctggggaccaa

SEQ ID NO: 7678325 - DNA, 22 bp, Homo sapiens
tgtgccaggccctggggaccaa

SEQ ID NO: 7678326 - DNA, 22 bp, Homo sapiens
tgtgccaggccggggcaggaca

SEQ ID NO: 7678327 - DNA, 22 bp, Homo sapiens
tgtgccaggccggggcaggaca

SEQ ID NO: 7678328 - DNA, 22 bp, Homo sapiens
tgtgccaggccggggcaggaca

SEQ ID NO: 7678329 - DNA, 21 bp, Homo sapiens
tgtgccagggatggggagccc

SEQ ID NO: 7678330 - DNA, 21 bp, Homo sapiens
tgtgccagggatggggagccc

SEQ ID NO: 7678331 - DNA, 22 bp, Homo sapiens
tgtgccaggggccgcttgcctt

SEQ ID NO: 7678332 - DNA, 22 bp, Homo sapiens
tgtgccagggcctccaaaagcc

SEQ ID NO: 7678333 - DNA, 22 bp, Homo sapiens
tgtgccagtcatccagatgtgt

SEQ ID NO: 7678334 - DNA, 22 bp, Homo sapiens
tgtgcccaacgtgcaggtttgt

SEQ ID NO: 7678335 - DNA, 22 bp, Homo sapiens
tgtgccatttctattctgcagc

SEQ ID NO: 7678336 - DNA, 23 bp, Homo sapiens
tgtgccattgaggctgaggctca

SEQ ID NO: 7678337 - DNA, 23 bp, Homo sapiens
tgtgccattgaggctgaggctca

SEQ ID NO: 7678338 - DNA, 22 bp, Homo sapiens
tgtgccattgagaggtttcaga

SEQ ID NO: 7678339 - DNA, 22 bp, Homo sapiens
tgtgccatgaggctctgatatg

SEQ ID NO: 7678340 - DNA, 22 bp, Homo sapiens
tgtgccatctgatataagagcc

SEQ ID NO: 7678341 - DNA, 22 bp, Homo sapiens
tgtgccagttttgtctaagccc

SEQ ID NO: 7678342 - DNA, 22 bp, Homo sapiens
tgtgccagtcatccagatgtgt

SEQ ID NO: 7678343 - DNA, 22 bp, Homo sapiens
tgtgcttctcacatcactgttg

SEQ ID NO: 7678344 - DNA, 22 bp, Homo sapiens
tgtgcttactttgaattatata

SEQ ID NO: 7678345 - DNA, 22 bp, Homo sapiens
tgtgctgtcagtatcaagggat

SEQ ID NO: 7678346 - DNA, 22 bp, Homo sapiens
tgtgcttctcacatcactgttg

SEQ ID NO: 7678347 - DNA, 22 bp, Homo sapiens
tgtgcttcttgcagctcctgta

SEQ ID NO: 7678348 - DNA, 22 bp, Homo sapiens
tgtgcttctgcagagactattt

SEQ ID NO: 7678349 - DNA, 22 bp, Homo sapiens
tgtgcttctgcagagactattt

SEQ ID NO: 7678350 - DNA, 22 bp, Homo sapiens
tgtgctgggaaatggcaggata

SEQ ID NO: 7678351 - DNA, 22 bp, Homo sapiens
tgtgctgggaaatggcaggata

SEQ ID NO: 7678352 - DNA, 22 bp, Homo sapiens
tgtgctgggaaatggcaggata

SEQ ID NO: 7678353 - DNA, 22 bp, Homo sapiens
tgtgctgggaaatggcaggata

SEQ ID NO: 7678354 - DNA, 22 bp, Homo sapiens
tgtgctgggaaatggcaggata

SEQ ID NO: 7678355 - DNA, 22 bp, Homo sapiens
tgtgctgggagatagagggagg

SEQ ID NO: 7678356 - DNA, 22 bp, Homo sapiens
tgtgctgggagatagagggagg

SEQ ID NO: 7678357 - DNA, 22 bp, Homo sapiens
tgtgctggggtccagctgagcc

SEQ ID NO: 7678358 - DNA, 22 bp, Homo sapiens
tgtgctggtacatgtgaggatg

SEQ ID NO: 7678359 - DNA, 22 bp, Homo sapiens
tgtgctggtacatgtgaggatg

SEQ ID NO: 7678360 - DNA, 22 bp, Homo sapiens
tgtgctggggtccagctgagcc

SEQ ID NO: 7678361 - DNA, 22 bp, Homo sapiens
tgtgctgggagatagagggagg

SEQ ID NO: 7678362 - DNA, 22 bp, Homo sapiens
tgtgctggggtccagctgagcc

SEQ ID NO: 7678363 - DNA, 22 bp, Homo sapiens
tgtgctggggtccagctgagcc

SEQ ID NO: 7678364 - DNA, 22 bp, Homo sapiens
tgtgctgggagatagagggagg

SEQ ID NO: 7678365 - DNA, 21 bp, Homo sapiens
cctgggagatcagctgccttc

SEQ ID NO: 7678366 - DNA, 22 bp, Homo sapiens
cctgggagagtctgtggtctcc

SEQ ID NO: 7678367 - DNA, 22 bp, Homo sapiens
cctgggagagtctgtggtctcc

SEQ ID NO: 7678368 - DNA, 22 bp, Homo sapiens
cctgggagagtctgtggtctcc

SEQ ID NO: 7678369 - DNA, 22 bp, Homo sapiens
cctgggagagtctgtggtctcc

SEQ ID NO: 7678370 - DNA, 22 bp, Homo sapiens
cctgggagagctgcccgggtga

SEQ ID NO: 7678371 - DNA, 22 bp, Homo sapiens
cctgggagagctgcccgggtga

SEQ ID NO: 7678372 - DNA, 22 bp, Homo sapiens
cctgggagagtctgtggtctcc

SEQ ID NO: 7678373 - DNA, 22 bp, Homo sapiens
cctgggagagtctgtggtctcc

SEQ ID NO: 7678374 - DNA, 22 bp, Homo sapiens
cctgggagagctgcccgggtga

SEQ ID NO: 7678375 - DNA, 22 bp, Homo sapiens
cctgggagagccatctgtggcc

SEQ ID NO: 7678376 - DNA, 22 bp, Homo sapiens
cctgggaagagctgacaggagg

SEQ ID NO: 7678377 - DNA, 22 bp, Homo sapiens
cctgggaagcccatagcagctt

SEQ ID NO: 7678378 - DNA, 22 bp, Homo sapiens
cctgggaagaccggcagtgggg

SEQ ID NO: 7678379 - DNA, 22 bp, Homo sapiens
cctgggaagaccggcagtgggg

SEQ ID NO: 7678380 - DNA, 22 bp, Homo sapiens
cctgggaacagtgggttggctc

SEQ ID NO: 7678381 - DNA, 22 bp, Homo sapiens
cctgggaagagctgacaggagg

SEQ ID NO: 7678382 - DNA, 22 bp, Homo sapiens
cctgggaagcccatagcagctt

SEQ ID NO: 7678383 - DNA, 20 bp, Homo sapiens
cctgggaaggcagccccagc

SEQ ID NO: 7678384 - DNA, 22 bp, Homo sapiens
cctgggagagccatctgtggcc

SEQ ID NO: 7678385 - DNA, 22 bp, Homo sapiens
cctgggagagccatctgtggcc

SEQ ID NO: 7678386 - DNA, 22 bp, Homo sapiens
cctgggagagccatctgtggcc

SEQ ID NO: 7678387 - DNA, 22 bp, Homo sapiens
cctgggagagccatctgtggcc

SEQ ID NO: 7678388 - DNA, 22 bp, Homo sapiens
cctgggagagccatctgtggcc

SEQ ID NO: 7678389 - DNA, 21 bp, Homo sapiens
cctgggagatcagctgccttc

SEQ ID NO: 7678390 - DNA, 21 bp, Homo sapiens
cctgggagatcagctgccttc

SEQ ID NO: 7678391 - DNA, 21 bp, Homo sapiens
cctgggagatcagctgccttc

SEQ ID NO: 7678392 - DNA, 21 bp, Homo sapiens
cctgggagatcagctgccttc

SEQ ID NO: 7678393 - DNA, 21 bp, Homo sapiens
cctgggagatcagctgccttc

SEQ ID NO: 7678394 - DNA, 21 bp, Homo sapiens
cctgggagatcagctgccttc

SEQ ID NO: 7678395 - DNA, 22 bp, Homo sapiens
cctgggagccgactgactgtgc

SEQ ID NO: 7678396 - DNA, 22 bp, Homo sapiens
cctgggagccaagcctctgtgt

SEQ ID NO: 7678397 - DNA, 22 bp, Homo sapiens
cctgggagccaagcctctgtgt

SEQ ID NO: 7678398 - DNA, 22 bp, Homo sapiens
cctgggagccaagcctctgtgt

SEQ ID NO: 7678399 - DNA, 22 bp, Homo sapiens
cctgggagccaagcctctgtgt

SEQ ID NO: 7678400 - DNA, 22 bp, Homo sapiens
cctgggagccaagcctctgtgt

SEQ ID NO: 7678401 - DNA, 22 bp, Homo sapiens
cctgggagccaagcctctgtgt

SEQ ID NO: 7678402 - DNA, 22 bp, Homo sapiens
cctgggagccaagcctctgtgt

SEQ ID NO: 7678403 - DNA, 22 bp, Homo sapiens
tgtgccagcctctggctgtgtc

SEQ ID NO: 7678404 - DNA, 22 bp, Homo sapiens
tgtgccaggccctggggaccaa

SEQ ID NO: 7678405 - DNA, 22 bp, Homo sapiens
tgtgccaggcacttgcccaggc

SEQ ID NO: 7678406 - DNA, 22 bp, Homo sapiens
tgtgccaggcacttgcccaggc

SEQ ID NO: 7678407 - DNA, 22 bp, Homo sapiens
tgtgccaggcacttgcccaggc

SEQ ID NO: 7678408 - DNA, 22 bp, Homo sapiens
tgtgccagcctctggctgtgtc

SEQ ID NO: 7678409 - DNA, 22 bp, Homo sapiens
tgtgccagcctctggctgtgtc

SEQ ID NO: 7678410 - DNA, 22 bp, Homo sapiens
cctgggagctgtggaaaggctg

SEQ ID NO: 7678411 - DNA, 22 bp, Homo sapiens
cctgggagccgactgactgtgc

SEQ ID NO: 7678412 - DNA, 22 bp, Homo sapiens
tgtattaacattaataaaatgg

SEQ ID NO: 7678413 - DNA, 22 bp, Homo sapiens
tgtattacaaagaagaggctgg

SEQ ID NO: 7678414 - DNA, 22 bp, Homo sapiens
tgtattaacattaataaaatgg

SEQ ID NO: 7678415 - DNA, 22 bp, Homo sapiens
tgtatgtttctaaatgattgct

SEQ ID NO: 7678416 - DNA, 22 bp, Homo sapiens
tgtatgtttctaaatgattgct

SEQ ID NO: 7678417 - DNA, 22 bp, Homo sapiens
tgtattaacattaataaaatgg

SEQ ID NO: 7678418 - DNA, 22 bp, Homo sapiens
tgtattaacattaataaaatgg

SEQ ID NO: 7678419 - DNA, 22 bp, Homo sapiens
tgtattaacattaataaaatgg

SEQ ID NO: 7678420 - DNA, 22 bp, Homo sapiens
tgtattaacattaataaaatgg

SEQ ID NO: 7678421 - DNA, 22 bp, Homo sapiens
tgtattaacattaataaaatgg

SEQ ID NO: 7678422 - DNA, 22 bp, Homo sapiens
tgtattatcaagtaaatacatg

SEQ ID NO: 7678423 - DNA, 22 bp, Homo sapiens
tgtattaggagattccatgttt

SEQ ID NO: 7678424 - DNA, 22 bp, Homo sapiens
tgtattaggttgatgcgaaagt

SEQ ID NO: 7678425 - DNA, 22 bp, Homo sapiens
tgtattagatctgagaacttct

SEQ ID NO: 7678426 - DNA, 22 bp, Homo sapiens
tgtattagagcatataatttga

SEQ ID NO: 7678427 - DNA, 22 bp, Homo sapiens
tgtattagagcagtagaattat

SEQ ID NO: 7678428 - DNA, 22 bp, Homo sapiens
tgtattagagcagtagaattat

SEQ ID NO: 7678429 - DNA, 23 bp, Homo sapiens
tgtattacagatgcatcagtgat

SEQ ID NO: 7678430 - DNA, 22 bp, Homo sapiens
tgtattacaaagaagaggctgg

SEQ ID NO: 7678431 - DNA, 22 bp, Homo sapiens
tgtattacaaagaagaggctgg

SEQ ID NO: 7678432 - DNA, 23 bp, Homo sapiens
tgtattacagatgcatcagtgat

SEQ ID NO: 7678433 - DNA, 20 bp, Homo sapiens
tgtattacttggtcttacaa

SEQ ID NO: 7678434 - DNA, 22 bp, Homo sapiens
tgtattcaacttcttaaaaatt

SEQ ID NO: 7678435 - DNA, 22 bp, Homo sapiens
tgtattcaacttcttaaaaatt

SEQ ID NO: 7678436 - DNA, 22 bp, Homo sapiens
tgtattcaacttcttaaaaatt

SEQ ID NO: 7678437 - DNA, 22 bp, Homo sapiens
tgtattatgattgttgttcatg

SEQ ID NO: 7678438 - DNA, 22 bp, Homo sapiens
tgtattatgattgttgttcatg

SEQ ID NO: 7678439 - DNA, 22 bp, Homo sapiens
tgtattatgattgttgttcatg

SEQ ID NO: 7678440 - DNA, 22 bp, Homo sapiens
tgtattatcaagtaaatacatg

SEQ ID NO: 7678441 - DNA, 22 bp, Homo sapiens
tgtattatcaagtaaatacatg

SEQ ID NO: 7678442 - DNA, 22 bp, Homo sapiens
tgtattatcaagtaaatacatg

SEQ ID NO: 7678443 - DNA, 22 bp, Homo sapiens
tgtattatcaagtaaatacatg

SEQ ID NO: 7678444 - DNA, 22 bp, Homo sapiens
tgtattatcaagtaaatacatg

SEQ ID NO: 7678445 - DNA, 22 bp, Homo sapiens
tgtattatcaagtaaatacatg

SEQ ID NO: 7678446 - DNA, 22 bp, Homo sapiens
tgtattatcaagtaaatacatg

SEQ ID NO: 7678447 - DNA, 22 bp, Homo sapiens
tgtattcagtgatttcacaata

SEQ ID NO: 7678448 - DNA, 22 bp, Homo sapiens
tgtattcagggacatatatgta

SEQ ID NO: 7678449 - DNA, 22 bp, Homo sapiens
tgtattcagggacatatatgta

SEQ ID NO: 7678450 - DNA, 22 bp, Homo sapiens
tgtattcagggacatatatgta

SEQ ID NO: 7678451 - DNA, 22 bp, Homo sapiens
tgtattcagggacatatatgta

SEQ ID NO: 7678452 - DNA, 22 bp, Homo sapiens
tgtattcaacttcttaaaaatt

SEQ ID NO: 7678453 - DNA, 22 bp, Homo sapiens
tgtattcagggacatatatgta

SEQ ID NO: 7678454 - DNA, 22 bp, Homo sapiens
tgtattcagggacatatatgta

SEQ ID NO: 7678455 - DNA, 22 bp, Homo sapiens
tgtcaggacattttatgaatca

SEQ ID NO: 7678456 - DNA, 21 bp, Homo sapiens
tgtcagctccctgtcctgtgt

SEQ ID NO: 7678457 - DNA, 22 bp, Homo sapiens
tgtcaggacacagctttctgtg

SEQ ID NO: 7678458 - DNA, 22 bp, Homo sapiens
tgtcagctggagatggcatggg

SEQ ID NO: 7678459 - DNA, 21 bp, Homo sapiens
tgtcagctccctgtcctgtgt

SEQ ID NO: 7678460 - DNA, 22 bp, Homo sapiens
tgtattcagtgatttcacaata

SEQ ID NO: 7678461 - DNA, 22 bp, Homo sapiens
tgtcaggagccaccagcactcc

SEQ ID NO: 7678462 - DNA, 22 bp, Homo sapiens
tgtcaggagccaccagcactcc

SEQ ID NO: 7678463 - DNA, 22 bp, Homo sapiens
tgtcaggagccaccagcactcc

SEQ ID NO: 7678464 - DNA, 22 bp, Homo sapiens
tgtcaggagccaccagcactcc

SEQ ID NO: 7678465 - DNA, 22 bp, Homo sapiens
tgtcatgccaccgtttcccaga

SEQ ID NO: 7678466 - DNA, 20 bp, Homo sapiens
tgtcatgcattagatgaaga

SEQ ID NO: 7678467 - DNA, 22 bp, Homo sapiens
tgtcatggacagattagatgag

SEQ ID NO: 7678468 - DNA, 22 bp, Homo sapiens
tgtcatgcccaggagcaaggta

SEQ ID NO: 7678469 - DNA, 22 bp, Homo sapiens
tgtcatgcccaggagcaaggta

SEQ ID NO: 7678470 - DNA, 22 bp, Homo sapiens
tgtcatgcccaggagcaaggta

SEQ ID NO: 7678471 - DNA, 22 bp, Homo sapiens
tgtcatggggaaaataacagac

SEQ ID NO: 7678472 - DNA, 22 bp, Homo sapiens
tgtcatgccatttaaaatgttt

SEQ ID NO: 7678473 - DNA, 17 bp, Homo sapiens
tgtcatggctatggttg

SEQ ID NO: 7678474 - DNA, 22 bp, Homo sapiens
tgtcatggagcttatattccag

SEQ ID NO: 7678475 - DNA, 22 bp, Homo sapiens
tgtcatggactggatttctgct

SEQ ID NO: 7678476 - DNA, 22 bp, Homo sapiens
tgtcatgtggcaattaaagcag

SEQ ID NO: 7678477 - DNA, 22 bp, Homo sapiens
tgtcatgtctgtaaatacacca

SEQ ID NO: 7678478 - DNA, 22 bp, Homo sapiens
tgtcatgtagcattttatgtct

SEQ ID NO: 7678479 - DNA, 22 bp, Homo sapiens
tgtcatgtaacctttctgagcc

SEQ ID NO: 7678480 - DNA, 22 bp, Homo sapiens
tgtcatggtgctatttaattag

SEQ ID NO: 7678481 - DNA, 22 bp, Homo sapiens
tgtcatgtaaagagtaaatggt

SEQ ID NO: 7678482 - DNA, 22 bp, Homo sapiens
tgtcatggtatttgtgagctgc

SEQ ID NO: 7678483 - DNA, 22 bp, Homo sapiens
tgtcatgggtctaaacattgat

SEQ ID NO: 7678484 - DNA, 22 bp, Homo sapiens
tgtcatgggtctaaacattgat

SEQ ID NO: 7678485 - DNA, 22 bp, Homo sapiens
tgtatgtgcaatgtttatatgt

SEQ ID NO: 7678486 - DNA, 22 bp, Homo sapiens
tgtatgtatgcatcttttatgt

SEQ ID NO: 7678487 - DNA, 22 bp, Homo sapiens
tgtatgtatgtatgtatttggg

SEQ ID NO: 7678488 - DNA, 22 bp, Homo sapiens
tgtatgtgtatgtacatatgca

SEQ ID NO: 7678489 - DNA, 22 bp, Homo sapiens
tgtatgtgtggatagatgtata

SEQ ID NO: 7678490 - DNA, 22 bp, Homo sapiens
tgtatgtgtggatagatgtata

SEQ ID NO: 7678491 - DNA, 22 bp, Homo sapiens
tgtatgttgggtcaaagtacat

SEQ ID NO: 7678492 - DNA, 22 bp, Homo sapiens
tgtatgtgtatgtacatatgca

SEQ ID NO: 7678493 - DNA, 22 bp, Homo sapiens
tgtatgtgtatgtacatatgca

SEQ ID NO: 7678494 - DNA, 22 bp, Homo sapiens
tgtatgtatgcatcttttatgt

SEQ ID NO: 7678495 - DNA, 22 bp, Homo sapiens
tgtatgtatgaataagcaagat

SEQ ID NO: 7678496 - DNA, 22 bp, Homo sapiens
tgtatgtatacactgatcatca

SEQ ID NO: 7678497 - DNA, 22 bp, Homo sapiens
cctggcagactgtgagggcagg

SEQ ID NO: 7678498 - DNA, 22 bp, Homo sapiens
cctggcagacagcactgaagct

SEQ ID NO: 7678499 - DNA, 22 bp, Homo sapiens
cctggcagacagcactgaagct

SEQ ID NO: 7678500 - DNA, 22 bp, Homo sapiens
cctggcagaatattaaagtgca

SEQ ID NO: 7678501 - DNA, 22 bp, Homo sapiens
cctggcagacagcactgaagct

SEQ ID NO: 7678502 - DNA, 22 bp, Homo sapiens
cctggcagacagcactgaagct

SEQ ID NO: 7678503 - DNA, 22 bp, Homo sapiens
cctggcagacagcactgaagct

SEQ ID NO: 7678504 - DNA, 22 bp, Homo sapiens
cctggcagacagcactgaagct

SEQ ID NO: 7678505 - DNA, 22 bp, Homo sapiens
cctggcagacagcactgaagct

SEQ ID NO: 7678506 - DNA, 22 bp, Homo sapiens
cctggcacgaagggctgaggtt

SEQ ID NO: 7678507 - DNA, 22 bp, Homo sapiens
cctggcacgaagggctgaggtt

SEQ ID NO: 7678508 - DNA, 22 bp, Homo sapiens
cctggcaccttcacagactact

SEQ ID NO: 7678509 - DNA, 22 bp, Homo sapiens
cctggcacgaagggctgaggtt

SEQ ID NO: 7678510 - DNA, 22 bp, Homo sapiens
cctggcacgaagggctgaggtt

SEQ ID NO: 7678511 - DNA, 22 bp, Homo sapiens
cctggcacatagtgggcatgca

SEQ ID NO: 7678512 - DNA, 22 bp, Homo sapiens
cctggcacgaagggctgaggtt

SEQ ID NO: 7678513 - DNA, 22 bp, Homo sapiens
cctggcaccttcacagactact

SEQ ID NO: 7678514 - DNA, 22 bp, Homo sapiens
cctggcaccttcacagactact

SEQ ID NO: 7678515 - DNA, 22 bp, Homo sapiens
cctggcaccttcacagactact

SEQ ID NO: 7678516 - DNA, 22 bp, Homo sapiens
cctggcaccttcacagactact

SEQ ID NO: 7678517 - DNA, 22 bp, Homo sapiens
cctggcaccttcacagactact

SEQ ID NO: 7678518 - DNA, 22 bp, Homo sapiens
cctggcacctgtgttttctgga

SEQ ID NO: 7678519 - DNA, 22 bp, Homo sapiens
cctggcacatagtgggcatgca

SEQ ID NO: 7678520 - DNA, 22 bp, Homo sapiens
cctggcacatctaactcactct

SEQ ID NO: 7678521 - DNA, 22 bp, Homo sapiens
cctggcacatctaactcactct

SEQ ID NO: 7678522 - DNA, 22 bp, Homo sapiens
cctggcacatctaactcactct

SEQ ID NO: 7678523 - DNA, 22 bp, Homo sapiens
cctggcacatgatagatgctca

SEQ ID NO: 7678524 - DNA, 22 bp, Homo sapiens
cctggcacatgatagatgctca

SEQ ID NO: 7678525 - DNA, 22 bp, Homo sapiens
cctggcacatgatagatgctca

SEQ ID NO: 7678526 - DNA, 22 bp, Homo sapiens
cctggcacatctaactcactct

SEQ ID NO: 7678527 - DNA, 22 bp, Homo sapiens
cctggcacatgcagtactcaag

SEQ ID NO: 7678528 - DNA, 22 bp, Homo sapiens
cctggcacatgcagtactcaag

SEQ ID NO: 7678529 - DNA, 22 bp, Homo sapiens
cctggcacatgcagtactcaag

SEQ ID NO: 7678530 - DNA, 22 bp, Homo sapiens
cctggcacattcccgcgcatgc

SEQ ID NO: 7678531 - DNA, 22 bp, Homo sapiens
cctggcacattcccgcgcatgc

SEQ ID NO: 7678532 - DNA, 22 bp, Homo sapiens
cctggcacctgtgttttctgga

SEQ ID NO: 7678533 - DNA, 22 bp, Homo sapiens
cctggcacatgatagatgctca

SEQ ID NO: 7678534 - DNA, 22 bp, Homo sapiens
cctggcacatgatagatgctca

SEQ ID NO: 7678535 - DNA, 22 bp, Homo sapiens
cctggcactgctgaagtcctgg

SEQ ID NO: 7678536 - DNA, 22 bp, Homo sapiens
cctggcactgctgaagtcctgg

SEQ ID NO: 7678537 - DNA, 22 bp, Homo sapiens
cctggcactgctgaagtcctgg

SEQ ID NO: 7678538 - DNA, 21 bp, Homo sapiens
cctggcactggcctgctgagc

SEQ ID NO: 7678539 - DNA, 21 bp, Homo sapiens
cctggcactggcctgctgagc

SEQ ID NO: 7678540 - DNA, 21 bp, Homo sapiens
cctggcactggcctgctgagc

SEQ ID NO: 7678541 - DNA, 22 bp, Homo sapiens
cctggcagaaagagttacacct

SEQ ID NO: 7678542 - DNA, 22 bp, Homo sapiens
cctggcactgaccaggcactga

SEQ ID NO: 7678543 - DNA, 22 bp, Homo sapiens
cctggcactgaccaggcactga

SEQ ID NO: 7678544 - DNA, 22 bp, Homo sapiens
cctggcactgaccaggcactga

SEQ ID NO: 7678545 - DNA, 22 bp, Homo sapiens
cctggcactgaccaggcactga

SEQ ID NO: 7678546 - DNA, 22 bp, Homo sapiens
cctggcagaatattaaagtgca

SEQ ID NO: 7678547 - DNA, 21 bp, Homo sapiens
cctggcagaagcctgatatgc

SEQ ID NO: 7678548 - DNA, 22 bp, Homo sapiens
tgtaaactggatttgagggtgg

SEQ ID NO: 7678549 - DNA, 22 bp, Homo sapiens
tgtaaactgtagaaaatacttt

SEQ ID NO: 7678550 - DNA, 22 bp, Homo sapiens
tgtaaacttttgcatactgctt

SEQ ID NO: 7678551 - DNA, 22 bp, Homo sapiens
tgtaaactgtagaaaatacttt

SEQ ID NO: 7678552 - DNA, 22 bp, Homo sapiens
tgtaaactgtagaaaatacttt

SEQ ID NO: 7678553 - DNA, 22 bp, Homo sapiens
tgtaccaaaaatgtgtcagact

SEQ ID NO: 7678554 - DNA, 22 bp, Homo sapiens
tgtaaagaaatagcatttgtag

SEQ ID NO: 7678555 - DNA, 22 bp, Homo sapiens
tgtaaagaaagacgcagagtta

SEQ ID NO: 7678556 - DNA, 22 bp, Homo sapiens
tgtaaagaaatagcatttgtag

SEQ ID NO: 7678557 - DNA, 22 bp, Homo sapiens
tgtaccaagacaaatcagaaac

SEQ ID NO: 7678558 - DNA, 22 bp, Homo sapiens
tgtaccaagacaaatcagaaac

SEQ ID NO: 7678559 - DNA, 22 bp, Homo sapiens
tgtaccaaacccatcataacta

SEQ ID NO: 7678560 - DNA, 22 bp, Homo sapiens
tgtaccagatggaaaacgtgag

SEQ ID NO: 7678561 - DNA, 22 bp, Homo sapiens
tgtaccagatgtctaaagccat

SEQ ID NO: 7678562 - DNA, 22 bp, Homo sapiens
tgtaccagatgtctaaagccat

SEQ ID NO: 7678563 - DNA, 22 bp, Homo sapiens
tgtaccagatgtctaaagccat

SEQ ID NO: 7678564 - DNA, 22 bp, Homo sapiens
tgtaggaattccagtgacttca

SEQ ID NO: 7678565 - DNA, 22 bp, Homo sapiens
tgtaggaatggattctagaagg

SEQ ID NO: 7678566 - DNA, 22 bp, Homo sapiens
tgtaccaggaggaggacaaatt

SEQ ID NO: 7678567 - DNA, 22 bp, Homo sapiens
tgtaaactcagtatgttttact

SEQ ID NO: 7678568 - DNA, 22 bp, Homo sapiens
tgtaaactcagtatgttttact

SEQ ID NO: 7678569 - DNA, 22 bp, Homo sapiens
tgtaaactgagggtagctgatt

SEQ ID NO: 7678570 - DNA, 22 bp, Homo sapiens
tgtaaactgcttctcaccaagg

SEQ ID NO: 7678571 - DNA, 22 bp, Homo sapiens
tgtaaactagggctgataaggg

SEQ ID NO: 7678572 - DNA, 23 bp, Homo sapiens
tgtaaaccattttgcatcccatg

SEQ ID NO: 7678573 - DNA, 23 bp, Homo sapiens
tgtaaaccattttgcatcccatg

SEQ ID NO: 7678574 - DNA, 23 bp, Homo sapiens
tgtaaaccattttgcatcccatg

SEQ ID NO: 7678575 - DNA, 22 bp, Homo sapiens
tgtaaaccagggtcatccttag

SEQ ID NO: 7678576 - DNA, 22 bp, Homo sapiens
tgtaaacatatgtatgtatgta

SEQ ID NO: 7678577 - DNA, 22 bp, Homo sapiens
tgtaaacatatgtatgtatgta

SEQ ID NO: 7678578 - DNA, 22 bp, Homo sapiens
tgtaaacatatgtatgtatgta

SEQ ID NO: 7678579 - DNA, 22 bp, Homo sapiens
tgtaaacatatgtatgtatgta

SEQ ID NO: 7678580 - DNA, 22 bp, Homo sapiens
tgtaaacatgctgaggctggag

SEQ ID NO: 7678581 - DNA, 23 bp, Homo sapiens
tgtaggcagtacagttgtaaatg

SEQ ID NO: 7678582 - DNA, 22 bp, Homo sapiens
tgtaggcacatgtatatatccc

SEQ ID NO: 7678583 - DNA, 23 bp, Homo sapiens
tgtaggctaagtcccataaatca

SEQ ID NO: 7678584 - DNA, 22 bp, Homo sapiens
tgtagggactgaggctggagag

SEQ ID NO: 7678585 - DNA, 21 bp, Homo sapiens
tgtaggaggcatctggggctg

SEQ ID NO: 7678586 - DNA, 21 bp, Homo sapiens
tgtaggaggcatctggggctg

SEQ ID NO: 7678587 - DNA, 21 bp, Homo sapiens
tgtaggaggcaagcctgtctc

SEQ ID NO: 7678588 - DNA, 22 bp, Homo sapiens
tgtaggagtccaatcaggagac

SEQ ID NO: 7678589 - DNA, 22 bp, Homo sapiens
tgtaggagtccaatcaggagac

SEQ ID NO: 7678590 - DNA, 22 bp, Homo sapiens
tgtaggagtccaatcaggagac

SEQ ID NO: 7678591 - DNA, 22 bp, Homo sapiens
tgtaggactgagaatgattttt

SEQ ID NO: 7678592 - DNA, 21 bp, Homo sapiens
tgtaggaggcatctggggctg

SEQ ID NO: 7678593 - DNA, 22 bp, Homo sapiens
tgtaggagtccaatcaggagac

SEQ ID NO: 7678594 - DNA, 22 bp, Homo sapiens
tgtaggtaaaagcatctagtgt

SEQ ID NO: 7678595 - DNA, 22 bp, Homo sapiens
tgtagggagagggagttgcacc

SEQ ID NO: 7678596 - DNA, 22 bp, Homo sapiens
tgtaggtcagtttgttcatgtt

SEQ ID NO: 7678597 - DNA, 23 bp, Homo sapiens
tgtaggtctgccttatctgctgc

SEQ ID NO: 7678598 - DNA, 22 bp, Homo sapiens
tgtagtaaacactattctgatc

SEQ ID NO: 7678599 - DNA, 20 bp, Homo sapiens
tgtaggtgtacagtaaggag

SEQ ID NO: 7678600 - DNA, 22 bp, Homo sapiens
tgtaggtctcagtgtctgagct

SEQ ID NO: 7678601 - DNA, 22 bp, Homo sapiens
tgtagggagagggagttgcacc

SEQ ID NO: 7678602 - DNA, 22 bp, Homo sapiens
tgtagggagaagagaggcacct

SEQ ID NO: 7678603 - DNA, 22 bp, Homo sapiens
tgtagggactgaggctggagag

SEQ ID NO: 7678604 - DNA, 22 bp, Homo sapiens
tgtagggaggaagggttggaaa

SEQ ID NO: 7678605 - DNA, 22 bp, Homo sapiens
tgtagggagaagagaggcacct

SEQ ID NO: 7678606 - DNA, 22 bp, Homo sapiens
tgtagggacttggcgatcactt

SEQ ID NO: 7678607 - DNA, 22 bp, Homo sapiens
tgtagggacttggcgatcactt

SEQ ID NO: 7678608 - DNA, 22 bp, Homo sapiens
tgtagggactgaggctggagag

SEQ ID NO: 7678609 - DNA, 22 bp, Homo sapiens
cctggagaggcgctgcagagga

SEQ ID NO: 7678610 - DNA, 22 bp, Homo sapiens
cctggagaggcgctgcagagga

SEQ ID NO: 7678611 - DNA, 22 bp, Homo sapiens
cctggagaggcgctgcagagga

SEQ ID NO: 7678612 - DNA, 22 bp, Homo sapiens
cctggagaggcgctgcagagga

SEQ ID NO: 7678613 - DNA, 22 bp, Homo sapiens
cctggagaggcgctgcagagga

SEQ ID NO: 7678614 - DNA, 22 bp, Homo sapiens
cctggagaggcgctgcagagga

SEQ ID NO: 7678615 - DNA, 22 bp, Homo sapiens
cctggagattatttggtccaat

SEQ ID NO: 7678616 - DNA, 22 bp, Homo sapiens
cctggagattatttggtccaat

SEQ ID NO: 7678617 - DNA, 22 bp, Homo sapiens
cctggagaggcgctgcagagga

SEQ ID NO: 7678618 - DNA, 22 bp, Homo sapiens
cctggagaggcgctgcagagga

SEQ ID NO: 7678619 - DNA, 22 bp, Homo sapiens
cctggagaggcgctgcagagga

SEQ ID NO: 7678620 - DNA, 22 bp, Homo sapiens
cctggagaggcgctgcagagga

SEQ ID NO: 7678621 - DNA, 22 bp, Homo sapiens
cctggagaggagaaagggccca

SEQ ID NO: 7678622 - DNA, 22 bp, Homo sapiens
cctggagaggagaaagggccca

SEQ ID NO: 7678623 - DNA, 22 bp, Homo sapiens
cctggagaggagaaagggccca

SEQ ID NO: 7678624 - DNA, 22 bp, Homo sapiens
cctggagaggagaaagggccca

SEQ ID NO: 7678625 - DNA, 22 bp, Homo sapiens
cctggagaggagaaagggccca

SEQ ID NO: 7678626 - DNA, 22 bp, Homo sapiens
cctggagagctcgggccaggca

SEQ ID NO: 7678627 - DNA, 22 bp, Homo sapiens
tgtataaaccatggacagcttt

SEQ ID NO: 7678628 - DNA, 22 bp, Homo sapiens
cctggagagctcgggccaggca

SEQ ID NO: 7678629 - DNA, 22 bp, Homo sapiens
cctggagagctcgggccaggca

SEQ ID NO: 7678630 - DNA, 22 bp, Homo sapiens
tgtagtagcattcacgaagtgt

SEQ ID NO: 7678631 - DNA, 22 bp, Homo sapiens
tgtagtagcattcacgaagtgt

SEQ ID NO: 7678632 - DNA, 22 bp, Homo sapiens
tgtagtaagtgcgcaataaata

SEQ ID NO: 7678633 - DNA, 22 bp, Homo sapiens
tgtagtaagtgcgcaataaata

SEQ ID NO: 7678634 - DNA, 22 bp, Homo sapiens
tgtagtccaggaattgtgtctg

SEQ ID NO: 7678635 - DNA, 22 bp, Homo sapiens
tgtagtcacaaaaactgtaagc

SEQ ID NO: 7678636 - DNA, 22 bp, Homo sapiens
tgtagtagcattcacgaagtgt

SEQ ID NO: 7678637 - DNA, 22 bp, Homo sapiens
tgtagtagcattcacgaagtgt

SEQ ID NO: 7678638 - DNA, 22 bp, Homo sapiens
tgtagtagcattcacgaagtgt

SEQ ID NO: 7678639 - DNA, 22 bp, Homo sapiens
tgtagtagcattcacgaagtgt

SEQ ID NO: 7678640 - DNA, 22 bp, Homo sapiens
tgtagtagcattcacgaagtgt

SEQ ID NO: 7678641 - DNA, 22 bp, Homo sapiens
tgtataaaccatggacagcttt

SEQ ID NO: 7678642 - DNA, 22 bp, Homo sapiens
tgtataaaccatggacagcttt

SEQ ID NO: 7678643 - DNA, 22 bp, Homo sapiens
tgtataaaccatggacagcttt

SEQ ID NO: 7678644 - DNA, 22 bp, Homo sapiens
tgtataaaccatggacagcttt

SEQ ID NO: 7678645 - DNA, 22 bp, Homo sapiens
tgtagttaggctgggaattggc

SEQ ID NO: 7678646 - DNA, 22 bp, Homo sapiens
tgtagtgtggcctatctttgcc

SEQ ID NO: 7678647 - DNA, 22 bp, Homo sapiens
tgtagtgtggcctatctttgcc

SEQ ID NO: 7678648 - DNA, 22 bp, Homo sapiens
tgtagtgtttctcagatatttg

SEQ ID NO: 7678649 - DNA, 22 bp, Homo sapiens
tgtagtgtgacataggtgtcca

SEQ ID NO: 7678650 - DNA, 22 bp, Homo sapiens
tgtagtgtgacataggtgtcca

SEQ ID NO: 7678651 - DNA, 22 bp, Homo sapiens
tgtagtgtagcagggtgggaca

SEQ ID NO: 7678652 - DNA, 22 bp, Homo sapiens
tgtagtgtagcagggtgggaca

SEQ ID NO: 7678653 - DNA, 22 bp, Homo sapiens
cctggaggtggaggttgcagtg

SEQ ID NO: 7678654 - DNA, 22 bp, Homo sapiens
cctggaggtggaggttgcagtg

SEQ ID NO: 7678655 - DNA, 19 bp, Homo sapiens
cctggaggtgaaggttctc

SEQ ID NO: 7678656 - DNA, 22 bp, Homo sapiens
cctggagcacatggcaggaggc

SEQ ID NO: 7678657 - DNA, 22 bp, Homo sapiens
cctggagcacatggcaggaggc

SEQ ID NO: 7678658 - DNA, 22 bp, Homo sapiens
cctggagcacatggcaggaggc

SEQ ID NO: 7678659 - DNA, 22 bp, Homo sapiens
cctggcacatagtaagtactag

SEQ ID NO: 7678660 - DNA, 22 bp, Homo sapiens
cctggcacatagcaacccctcc

SEQ ID NO: 7678661 - DNA, 22 bp, Homo sapiens
cctggcacatagtaagtactag

SEQ ID NO: 7678662 - DNA, 22 bp, Homo sapiens
cctggcacatagtgggcatgca

SEQ ID NO: 7678663 - DNA, 22 bp, Homo sapiens
cctggcacatagtgggcatgca

SEQ ID NO: 7678664 - DNA, 22 bp, Homo sapiens
cctggcacatagtaagtactag

SEQ ID NO: 7678665 - DNA, 22 bp, Homo sapiens
cctggcacatagtaagtactag

SEQ ID NO: 7678666 - DNA, 22 bp, Homo sapiens
cctggcacatagcaacccctcc

SEQ ID NO: 7678667 - DNA, 22 bp, Homo sapiens
cctggcacatagcaacccctcc

SEQ ID NO: 7678668 - DNA, 22 bp, Homo sapiens
cctggaggtggaggttgcagtg

SEQ ID NO: 7678669 - DNA, 22 bp, Homo sapiens
cctggaggtggaggttgcagtg

SEQ ID NO: 7678670 - DNA, 22 bp, Homo sapiens
cctggagcacatggcaggaggc

SEQ ID NO: 7678671 - DNA, 22 bp, Homo sapiens
cctggagcacatggcaggaggc

SEQ ID NO: 7678672 - DNA, 22 bp, Homo sapiens
cctggagcacatggcaggaggc

SEQ ID NO: 7678673 - DNA, 22 bp, Homo sapiens
cctggagcacagcccagtccca

SEQ ID NO: 7678674 - DNA, 22 bp, Homo sapiens
cctggagcacagcccagtccca

SEQ ID NO: 7678675 - DNA, 22 bp, Homo sapiens
cctggagcaaaaatctaaggag

SEQ ID NO: 7678676 - DNA, 22 bp, Homo sapiens
cctggagcaaaaatctaaggag

SEQ ID NO: 7678677 - DNA, 22 bp, Homo sapiens
cctggagcacagcccagtccca

SEQ ID NO: 7678678 - DNA, 22 bp, Homo sapiens
cctggagatttcttcaagcttt

SEQ ID NO: 7678679 - DNA, 22 bp, Homo sapiens
cctggagatttcttcaagcttt

SEQ ID NO: 7678680 - DNA, 22 bp, Homo sapiens
cctggagcaaaaatctaaggag

SEQ ID NO: 7678681 - DNA, 22 bp, Homo sapiens
cctggagcaaaaatctaaggag

SEQ ID NO: 7678682 - DNA, 22 bp, Homo sapiens
cctggagattatttggtccaat

SEQ ID NO: 7678683 - DNA, 22 bp, Homo sapiens
cctggagattatttggtccaat

SEQ ID NO: 7678684 - DNA, 22 bp, Homo sapiens
cctggagattatttggtccaat

SEQ ID NO: 7678685 - DNA, 17 bp, Homo sapiens
tggtccaggtggagcca

SEQ ID NO: 7678686 - DNA, 22 bp, Homo sapiens
tggtccagtaagggtggagaga

SEQ ID NO: 7678687 - DNA, 22 bp, Homo sapiens
tggtccagtcgttcctttcctt

SEQ ID NO: 7678688 - DNA, 22 bp, Homo sapiens
tggtccagtcgttcctttcctt

SEQ ID NO: 7678689 - DNA, 22 bp, Homo sapiens
tggtccagtagcagggatacca

SEQ ID NO: 7678690 - DNA, 18 bp, Homo sapiens
tggtccagttcagatata

SEQ ID NO: 7678691 - DNA, 22 bp, Homo sapiens
tggtccagtgacagataggcac

SEQ ID NO: 7678692 - DNA, 22 bp, Homo sapiens
tggtccagtgacagataggcac

SEQ ID NO: 7678693 - DNA, 22 bp, Homo sapiens
tggtccagtgacagataggcac

SEQ ID NO: 7678694 - DNA, 22 bp, Homo sapiens
tggtccagtgacagataggcac

SEQ ID NO: 7678695 - DNA, 22 bp, Homo sapiens
tggtccagtcgttcctttcctt

SEQ ID NO: 7678696 - DNA, 22 bp, Homo sapiens
tggtaggagggaaatgcgggtt

SEQ ID NO: 7678697 - DNA, 22 bp, Homo sapiens
tggtaggatagtgacttatatg

SEQ ID NO: 7678698 - DNA, 22 bp, Homo sapiens
cctctgtggccctgactctctt

SEQ ID NO: 7678699 - DNA, 22 bp, Homo sapiens
tggtaggagatatggtctccga

SEQ ID NO: 7678700 - DNA, 22 bp, Homo sapiens
tggtccagtaagggtggagaga

SEQ ID NO: 7678701 - DNA, 17 bp, Homo sapiens
tggtccaggtggagcca

SEQ ID NO: 7678702 - DNA, 22 bp, Homo sapiens
tggtagggacactatgcagaaa

SEQ ID NO: 7678703 - DNA, 22 bp, Homo sapiens
tggtagggacactatgcagaaa

SEQ ID NO: 7678704 - DNA, 22 bp, Homo sapiens
tggtagggacactatgcagaaa

SEQ ID NO: 7678705 - DNA, 22 bp, Homo sapiens
tggtagggacactatgcagaaa

SEQ ID NO: 7678706 - DNA, 22 bp, Homo sapiens
cctctgtggccctgactctctt

SEQ ID NO: 7678707 - DNA, 22 bp, Homo sapiens
cctctgtgctttgtccagcctc

SEQ ID NO: 7678708 - DNA, 22 bp, Homo sapiens
cctctgtgctttgtccagcctc

SEQ ID NO: 7678709 - DNA, 22 bp, Homo sapiens
cctctgtgctttgtccagcctc

SEQ ID NO: 7678710 - DNA, 21 bp, Homo sapiens
cctctgtgctaaagggctccc

SEQ ID NO: 7678711 - DNA, 21 bp, Homo sapiens
cctctgtgctaaagggctccc

SEQ ID NO: 7678712 - DNA, 21 bp, Homo sapiens
cctctgtgctaaagggctccc

SEQ ID NO: 7678713 - DNA, 22 bp, Homo sapiens
cctctgtgcctcgtgtcctctg

SEQ ID NO: 7678714 - DNA, 22 bp, Homo sapiens
cctctgtgcctcgtgtcctctg

SEQ ID NO: 7678715 - DNA, 22 bp, Homo sapiens
cctctgtgcctcgtgtcctctg

SEQ ID NO: 7678716 - DNA, 22 bp, Homo sapiens
cctctgtgcctcgtgtcctctg

SEQ ID NO: 7678717 - DNA, 22 bp, Homo sapiens
cctctgtgcctcgtgtcctctg

SEQ ID NO: 7678718 - DNA, 22 bp, Homo sapiens
cctctgtgcctcgtgtcctctg

SEQ ID NO: 7678719 - DNA, 22 bp, Homo sapiens
cctctgtgcctcgtgtcctctg

SEQ ID NO: 7678720 - DNA, 22 bp, Homo sapiens
cctctgtgcaggaaatacatgt

SEQ ID NO: 7678721 - DNA, 22 bp, Homo sapiens
cctctgtgcctcagtttcatgt

SEQ ID NO: 7678722 - DNA, 22 bp, Homo sapiens
tggtcccattgttctgcccagg

SEQ ID NO: 7678723 - DNA, 22 bp, Homo sapiens
tggtcccattgttctgcccagg

SEQ ID NO: 7678724 - DNA, 19 bp, Homo sapiens
tggtcccatactgctggcc

SEQ ID NO: 7678725 - DNA, 19 bp, Homo sapiens
tggtcccatactgctggcc

SEQ ID NO: 7678726 - DNA, 22 bp, Homo sapiens
tggtcccattgttctgcccagg

SEQ ID NO: 7678727 - DNA, 20 bp, Homo sapiens
tggtccccatccttgcgatt

SEQ ID NO: 7678728 - DNA, 22 bp, Homo sapiens
tggtccctaaagatgtctacat

SEQ ID NO: 7678729 - DNA, 22 bp, Homo sapiens
tggtccctagcacagctgtcct

SEQ ID NO: 7678730 - DNA, 22 bp, Homo sapiens
tggtccctagcacagctgtcct

SEQ ID NO: 7678731 - DNA, 22 bp, Homo sapiens
tggtccctagaagttctgaatc

SEQ ID NO: 7678732 - DNA, 22 bp, Homo sapiens
tggtccctaaagatgtctacat

SEQ ID NO: 7678733 - DNA, 22 bp, Homo sapiens
tggtccatgttcccagaagaca

SEQ ID NO: 7678734 - DNA, 22 bp, Homo sapiens
tggtccagtttagcattgagtg

SEQ ID NO: 7678735 - DNA, 22 bp, Homo sapiens
tggtccatgcccacggaatgtg

SEQ ID NO: 7678736 - DNA, 22 bp, Homo sapiens
tggtccatgtcctccatctctc

SEQ ID NO: 7678737 - DNA, 22 bp, Homo sapiens
tggtccagtttagcattgagtg

SEQ ID NO: 7678738 - DNA, 22 bp, Homo sapiens
tggtccctttctactgagcaca

SEQ ID NO: 7678739 - DNA, 22 bp, Homo sapiens
tggtccctttctactgagcaca

SEQ ID NO: 7678740 - DNA, 22 bp, Homo sapiens
tggtccctttgactgcccgcca

SEQ ID NO: 7678741 - DNA, 22 bp, Homo sapiens
tggtccctttgactgcccgcca

SEQ ID NO: 7678742 - DNA, 22 bp, Homo sapiens
tggtccctgcctgccaagtgct

SEQ ID NO: 7678743 - DNA, 22 bp, Homo sapiens
tggtccctgatctaatgtctca

SEQ ID NO: 7678744 - DNA, 22 bp, Homo sapiens
tggtccctgatctaatgtctca

SEQ ID NO: 7678745 - DNA, 22 bp, Homo sapiens
tggtccctgcctgccaagtgct

SEQ ID NO: 7678746 - DNA, 22 bp, Homo sapiens
tggtccctagtgtgggagcttg

SEQ ID NO: 7678747 - DNA, 22 bp, Homo sapiens
tggtccctaggaaagcagtgtt

SEQ ID NO: 7678748 - DNA, 22 bp, Homo sapiens
tggtccctaggaaagcagtgtt

SEQ ID NO: 7678749 - DNA, 22 bp, Homo sapiens
tggtccctagcacagctgtcct

SEQ ID NO: 7678750 - DNA, 22 bp, Homo sapiens
tggtccctagcacagctgtcct

SEQ ID NO: 7678751 - DNA, 22 bp, Homo sapiens
tggtccctaggaaagcagtgtt

SEQ ID NO: 7678752 - DNA, 23 bp, Homo sapiens
tggtccctcaaggaggccagggc

SEQ ID NO: 7678753 - DNA, 22 bp, Homo sapiens
tggtccctgaagagagaccttg

SEQ ID NO: 7678754 - DNA, 22 bp, Homo sapiens
cctgccatggtagacttccagg

SEQ ID NO: 7678755 - DNA, 22 bp, Homo sapiens
cctgcccacacagcaattttaa

SEQ ID NO: 7678756 - DNA, 22 bp, Homo sapiens
cctgccatggtagacttccagg

SEQ ID NO: 7678757 - DNA, 22 bp, Homo sapiens
cctgcccacagagagggtgcat

SEQ ID NO: 7678758 - DNA, 22 bp, Homo sapiens
cctgcccacacagcaattttaa

SEQ ID NO: 7678759 - DNA, 22 bp, Homo sapiens
cctgcccacacagcaattttaa

SEQ ID NO: 7678760 - DNA, 22 bp, Homo sapiens
cctgcccacagagagggtgcat

SEQ ID NO: 7678761 - DNA, 22 bp, Homo sapiens
cctgcccacagagagggtgcat

SEQ ID NO: 7678762 - DNA, 22 bp, Homo sapiens
cctgccatcagaaacactcaaa

SEQ ID NO: 7678763 - DNA, 22 bp, Homo sapiens
cctgccagtgcctcccactggt

SEQ ID NO: 7678764 - DNA, 22 bp, Homo sapiens
cctgccatcagaaacactcaaa

SEQ ID NO: 7678765 - DNA, 22 bp, Homo sapiens
cctgccatgccagcatgcccgt

SEQ ID NO: 7678766 - DNA, 22 bp, Homo sapiens
cctgccatgccagcatgcccgt

SEQ ID NO: 7678767 - DNA, 22 bp, Homo sapiens
cctgcccactccaggagcaact

SEQ ID NO: 7678768 - DNA, 22 bp, Homo sapiens
cctgcccactgcccggtcagcc

SEQ ID NO: 7678769 - DNA, 22 bp, Homo sapiens
cctgcccactccaggagcaact

SEQ ID NO: 7678770 - DNA, 22 bp, Homo sapiens
cctgcccactccaggagcaact

SEQ ID NO: 7678771 - DNA, 22 bp, Homo sapiens
cctgcccactccaggagcaact

SEQ ID NO: 7678772 - DNA, 22 bp, Homo sapiens
cctgcccactccaggagcaact

SEQ ID NO: 7678773 - DNA, 22 bp, Homo sapiens
cctgcccacagagagggtgcat

SEQ ID NO: 7678774 - DNA, 22 bp, Homo sapiens
cctgcccactccaggagcaact

SEQ ID NO: 7678775 - DNA, 22 bp, Homo sapiens
cctgcccacagagagggtgcat

SEQ ID NO: 7678776 - DNA, 22 bp, Homo sapiens
cctgcccacagagagggtgcat

SEQ ID NO: 7678777 - DNA, 22 bp, Homo sapiens
cctgccagtgcctcccactggt

SEQ ID NO: 7678778 - DNA, 22 bp, Homo sapiens
cctgccagtgcctcccactggt

SEQ ID NO: 7678779 - DNA, 22 bp, Homo sapiens
cctgccagtgcctcccactggt

SEQ ID NO: 7678780 - DNA, 22 bp, Homo sapiens
cctgccagtgaagctgacgggc

SEQ ID NO: 7678781 - DNA, 22 bp, Homo sapiens
cctgccagtgcctcccactggt

SEQ ID NO: 7678782 - DNA, 22 bp, Homo sapiens
cctgccagtgcctcccactggt

SEQ ID NO: 7678783 - DNA, 22 bp, Homo sapiens
cctgccagtgcctcccactggt

SEQ ID NO: 7678784 - DNA, 22 bp, Homo sapiens
cctgccagtgaagctgacgggc

SEQ ID NO: 7678785 - DNA, 22 bp, Homo sapiens
cctgccagtgaagctgacgggc

SEQ ID NO: 7678786 - DNA, 22 bp, Homo sapiens
cctgccagtgaagctgacgggc

SEQ ID NO: 7678787 - DNA, 22 bp, Homo sapiens
cctgccagtgaagctgacgggc

SEQ ID NO: 7678788 - DNA, 20 bp, Homo sapiens
tggtcctcacatgccatctt

SEQ ID NO: 7678789 - DNA, 20 bp, Homo sapiens
tggtcctcacaggtcctccc

SEQ ID NO: 7678790 - DNA, 22 bp, Homo sapiens
tggtccgctcctattcgccgca

SEQ ID NO: 7678791 - DNA, 20 bp, Homo sapiens
tggtcctcacaggtcctccc

SEQ ID NO: 7678792 - DNA, 18 bp, Homo sapiens
tggtgcctttcactcttc

SEQ ID NO: 7678793 - DNA, 18 bp, Homo sapiens
tggtgcctttcactcttc

SEQ ID NO: 7678794 - DNA, 22 bp, Homo sapiens
tggtgctcttatgttttcatca

SEQ ID NO: 7678795 - DNA, 22 bp, Homo sapiens
tggtgctccctggagttgtgca

SEQ ID NO: 7678796 - DNA, 18 bp, Homo sapiens
tggtgaagggtggaggag

SEQ ID NO: 7678797 - DNA, 22 bp, Homo sapiens
tggtgccttgggcctacagcgc

SEQ ID NO: 7678798 - DNA, 22 bp, Homo sapiens
tggtctttgagagaagttgatt

SEQ ID NO: 7678799 - DNA, 22 bp, Homo sapiens
tggtgctgataatggcaggatt

SEQ ID NO: 7678800 - DNA, 22 bp, Homo sapiens
tggtgctgataatggcaggatt

SEQ ID NO: 7678801 - DNA, 22 bp, Homo sapiens
tggtgctgataatggcaggatt

SEQ ID NO: 7678802 - DNA, 22 bp, Homo sapiens
tggtgctgagatgaagtgctcc

SEQ ID NO: 7678803 - DNA, 22 bp, Homo sapiens
tggtgctgataatggcaggatt

SEQ ID NO: 7678804 - DNA, 22 bp, Homo sapiens
tggtgctgagatgaagtgctcc

SEQ ID NO: 7678805 - DNA, 22 bp, Homo sapiens
tggtgctgacagttctgagtgc

SEQ ID NO: 7678806 - DNA, 22 bp, Homo sapiens
tggtgctgacagttctgagtgc

SEQ ID NO: 7678807 - DNA, 17 bp, Homo sapiens
cctgcccagagacagat

SEQ ID NO: 7678808 - DNA, 17 bp, Homo sapiens
cctgcccagagacagat

SEQ ID NO: 7678809 - DNA, 17 bp, Homo sapiens
cctgcccagagacagat

SEQ ID NO: 7678810 - DNA, 22 bp, Homo sapiens
tggtcttgtactatgttgcatt

SEQ ID NO: 7678811 - DNA, 23 bp, Homo sapiens
tggtcttgaactcctgtccctgc

SEQ ID NO: 7678812 - DNA, 22 bp, Homo sapiens
tggtcttccatgaggagttcat

SEQ ID NO: 7678813 - DNA, 22 bp, Homo sapiens
tggtcttagctggaaggaggga

SEQ ID NO: 7678814 - DNA, 17 bp, Homo sapiens
cctgcccagagacagat

SEQ ID NO: 7678815 - DNA, 17 bp, Homo sapiens
cctgcccagagacagat

SEQ ID NO: 7678816 - DNA, 17 bp, Homo sapiens
cctgcccagagacagat

SEQ ID NO: 7678817 - DNA, 22 bp, Homo sapiens
cctgcccactgcccggtcagcc

SEQ ID NO: 7678818 - DNA, 22 bp, Homo sapiens
cctgcccactgcccggtcagcc

SEQ ID NO: 7678819 - DNA, 17 bp, Homo sapiens
cctgcccagagacagat

SEQ ID NO: 7678820 - DNA, 17 bp, Homo sapiens
cctgcccagagacagat

SEQ ID NO: 7678821 - DNA, 17 bp, Homo sapiens
cctgcccagagacagat

SEQ ID NO: 7678822 - DNA, 17 bp, Homo sapiens
cctgcccagagacagat

SEQ ID NO: 7678823 - DNA, 22 bp, Homo sapiens
cctggagacgaggctggaccat

SEQ ID NO: 7678824 - DNA, 22 bp, Homo sapiens
cctggagacgaggctggaccat

SEQ ID NO: 7678825 - DNA, 22 bp, Homo sapiens
cctggagacgaggctggaccat

SEQ ID NO: 7678826 - DNA, 22 bp, Homo sapiens
cctggagacgaggctggaccat

SEQ ID NO: 7678827 - DNA, 22 bp, Homo sapiens
cctggagagagaggccaactgc

SEQ ID NO: 7678828 - DNA, 22 bp, Homo sapiens
cctggagacgaggctggaccat

SEQ ID NO: 7678829 - DNA, 22 bp, Homo sapiens
cctggagacgaggctggaccat

SEQ ID NO: 7678830 - DNA, 22 bp, Homo sapiens
cctggagacgaggctggaccat

SEQ ID NO: 7678831 - DNA, 22 bp, Homo sapiens
cctggagacccacttctgccaa

SEQ ID NO: 7678832 - DNA, 22 bp, Homo sapiens
cctggagacctgatggcagcgg

SEQ ID NO: 7678833 - DNA, 22 bp, Homo sapiens
cctggagacctgatggcagcgg

SEQ ID NO: 7678834 - DNA, 22 bp, Homo sapiens
cctggagacctgatggcagcgg

SEQ ID NO: 7678835 - DNA, 22 bp, Homo sapiens
cctggagacctgatggcagcgg

SEQ ID NO: 7678836 - DNA, 22 bp, Homo sapiens
cctggagacctgatggcagcgg

SEQ ID NO: 7678837 - DNA, 22 bp, Homo sapiens
cctggagacctgatggcagcgg

SEQ ID NO: 7678838 - DNA, 22 bp, Homo sapiens
cctggagacctgatggcagcgg

SEQ ID NO: 7678839 - DNA, 22 bp, Homo sapiens
tgtaaacagtaggactaaagag

SEQ ID NO: 7678840 - DNA, 22 bp, Homo sapiens
tgtaaacagtaggactaaagag

SEQ ID NO: 7678841 - DNA, 22 bp, Homo sapiens
tgtaaacagtaggactaaagag

SEQ ID NO: 7678842 - DNA, 22 bp, Homo sapiens
tgtaaacagccccatggagagc

SEQ ID NO: 7678843 - DNA, 22 bp, Homo sapiens
tgtaaacagtaggactaaagag

SEQ ID NO: 7678844 - DNA, 22 bp, Homo sapiens
tgtaaacagtaggactaaagag

SEQ ID NO: 7678845 - DNA, 22 bp, Homo sapiens
tgtaaacataccagagccaagt

SEQ ID NO: 7678846 - DNA, 22 bp, Homo sapiens
tgtaaacatatcagactttctt

SEQ ID NO: 7678847 - DNA, 22 bp, Homo sapiens
tgtaaacatatcagactttctt

SEQ ID NO: 7678848 - DNA, 22 bp, Homo sapiens
cctggagagctcgggccaggca

SEQ ID NO: 7678849 - DNA, 22 bp, Homo sapiens
cctggagagctcgggccaggca

SEQ ID NO: 7678850 - DNA, 22 bp, Homo sapiens
cctggagagagaggccaactgc

SEQ ID NO: 7678851 - DNA, 22 bp, Homo sapiens
cctggagagctcgggccaggca

SEQ ID NO: 7678852 - DNA, 22 bp, Homo sapiens
cctggagagctcgggccaggca

SEQ ID NO: 7678853 - DNA, 22 bp, Homo sapiens
cctggagagctcgggccaggca

SEQ ID NO: 7678854 - DNA, 22 bp, Homo sapiens
tgtaaacagccccatggagagc

SEQ ID NO: 7678855 - DNA, 22 bp, Homo sapiens
cctggactcagaggtgctggtg

SEQ ID NO: 7678856 - DNA, 22 bp, Homo sapiens
cctggactcaggctgtgggcac

SEQ ID NO: 7678857 - DNA, 22 bp, Homo sapiens
cctggactcaggctgtgggcac

SEQ ID NO: 7678858 - DNA, 22 bp, Homo sapiens
cctggactcagaggtgctggtg

SEQ ID NO: 7678859 - DNA, 22 bp, Homo sapiens
cctggaaagagaatgaatgagc

SEQ ID NO: 7678860 - DNA, 22 bp, Homo sapiens
cctggaaagagaatgaatgagc

SEQ ID NO: 7678861 - DNA, 22 bp, Homo sapiens
cctggactcaggctgtgggcac

SEQ ID NO: 7678862 - DNA, 21 bp, Homo sapiens
cctggactgggagcagcactg

SEQ ID NO: 7678863 - DNA, 21 bp, Homo sapiens
cctggactgggagcagcactg

SEQ ID NO: 7678864 - DNA, 21 bp, Homo sapiens
cctggactgggagcagcactg

SEQ ID NO: 7678865 - DNA, 21 bp, Homo sapiens
cctggactgggagcagcactg

SEQ ID NO: 7678866 - DNA, 21 bp, Homo sapiens
cctggactgggagcagcactg

SEQ ID NO: 7678867 - DNA, 22 bp, Homo sapiens
cctggactgtgtcctgtggtca

SEQ ID NO: 7678868 - DNA, 22 bp, Homo sapiens
cctggaaactgttgtcaaatct

SEQ ID NO: 7678869 - DNA, 22 bp, Homo sapiens
cctggaaacacatgatgatgaa

SEQ ID NO: 7678870 - DNA, 22 bp, Homo sapiens
cctggaaaatgccactttcaca

SEQ ID NO: 7678871 - DNA, 22 bp, Homo sapiens
cctggaaacacatgatgatgaa

SEQ ID NO: 7678872 - DNA, 22 bp, Homo sapiens
tggtgggacatctgaggagagg

SEQ ID NO: 7678873 - DNA, 22 bp, Homo sapiens
tggtgggacatctgaggagagg

SEQ ID NO: 7678874 - DNA, 22 bp, Homo sapiens
tggtgggacatctgaggagagg

SEQ ID NO: 7678875 - DNA, 23 bp, Homo sapiens
tggtggcttgtggtggccaccag

SEQ ID NO: 7678876 - DNA, 23 bp, Homo sapiens
tggtggcttgtggtggccaccag

SEQ ID NO: 7678877 - DNA, 22 bp, Homo sapiens
cctggaaaatgccactttcaca

SEQ ID NO: 7678878 - DNA, 22 bp, Homo sapiens
tggtgggacatctgaggagagg

SEQ ID NO: 7678879 - DNA, 21 bp, Homo sapiens
cctggagacaaagacagggtg

SEQ ID NO: 7678880 - DNA, 22 bp, Homo sapiens
cctggactttcatttccccttg

SEQ ID NO: 7678881 - DNA, 22 bp, Homo sapiens
cctggactttcatttccccttg

SEQ ID NO: 7678882 - DNA, 21 bp, Homo sapiens
cctggagacaaagacagggtg

SEQ ID NO: 7678883 - DNA, 21 bp, Homo sapiens
cctggagacaaagacagggtg

SEQ ID NO: 7678884 - DNA, 21 bp, Homo sapiens
cctggagacaaagacagggtg

SEQ ID NO: 7678885 - DNA, 22 bp, Homo sapiens
cctggactgtgtcctgtggtca

SEQ ID NO: 7678886 - DNA, 22 bp, Homo sapiens
cctggactgtgtcctgtggtca

SEQ ID NO: 7678887 - DNA, 22 bp, Homo sapiens
cctggacttgatattctctttc

SEQ ID NO: 7678888 - DNA, 22 bp, Homo sapiens
cctggacttgatattctctttc

SEQ ID NO: 7678889 - DNA, 22 bp, Homo sapiens
cctggacttgatattctctttc

SEQ ID NO: 7678890 - DNA, 22 bp, Homo sapiens
cctggactttcatttccccttg

SEQ ID NO: 7678891 - DNA, 22 bp, Homo sapiens
cctggactttcatttccccttg

SEQ ID NO: 7678892 - DNA, 22 bp, Homo sapiens
cctggactttcaggactactgt

SEQ ID NO: 7678893 - DNA, 22 bp, Homo sapiens
cctggactttcaggactactgt

SEQ ID NO: 7678894 - DNA, 22 bp, Homo sapiens
cctggactttcaggactactgt

SEQ ID NO: 7678895 - DNA, 22 bp, Homo sapiens
cctggagaccagaggatacttc

SEQ ID NO: 7678896 - DNA, 22 bp, Homo sapiens
cctggagacccacttctgccaa

SEQ ID NO: 7678897 - DNA, 22 bp, Homo sapiens
cctggagaccagaggatacttc

SEQ ID NO: 7678898 - DNA, 22 bp, Homo sapiens
cctggagaccagaggatacttc

SEQ ID NO: 7678899 - DNA, 22 bp, Homo sapiens
cctggagaccagaggatacttc

SEQ ID NO: 7678900 - DNA, 22 bp, Homo sapiens
cctggagaccagaggatacttc

SEQ ID NO: 7678901 - DNA, 21 bp, Homo sapiens
cctggagacaaagacagggtg

SEQ ID NO: 7678902 - DNA, 21 bp, Homo sapiens
cctggagacaaagacagggtg

SEQ ID NO: 7678903 - DNA, 21 bp, Homo sapiens
cctggagacaaagacagggtg

SEQ ID NO: 7678904 - DNA, 21 bp, Homo sapiens
cctggagacaaagacagggtg

SEQ ID NO: 7678905 - DNA, 22 bp, Homo sapiens
tggtgctgccaggctcctgcca

SEQ ID NO: 7678906 - DNA, 22 bp, Homo sapiens
tggtgctgccacctcctctgct

SEQ ID NO: 7678907 - DNA, 22 bp, Homo sapiens
tggtgctgccacctcctctgct

SEQ ID NO: 7678908 - DNA, 22 bp, Homo sapiens
tggtgctgccacctcctctgct

SEQ ID NO: 7678909 - DNA, 22 bp, Homo sapiens
tggtgctgccacctcctctgct

SEQ ID NO: 7678910 - DNA, 22 bp, Homo sapiens
tggtgctgcctcagatgcctta

SEQ ID NO: 7678911 - DNA, 22 bp, Homo sapiens
tggtgctgccaggctcctgcca

SEQ ID NO: 7678912 - DNA, 22 bp, Homo sapiens
tggtgctgccaggctcctgcca

SEQ ID NO: 7678913 - DNA, 22 bp, Homo sapiens
tggtgctgccaggctcctgcca

SEQ ID NO: 7678914 - DNA, 22 bp, Homo sapiens
tggtgctgccacctcctctgct

SEQ ID NO: 7678915 - DNA, 22 bp, Homo sapiens
tggtgctgccacctcctctgct

SEQ ID NO: 7678916 - DNA, 22 bp, Homo sapiens
tggtgctgccacctcctctgct

SEQ ID NO: 7678917 - DNA, 22 bp, Homo sapiens
tggtgctgcaggtgggcacagt

SEQ ID NO: 7678918 - DNA, 22 bp, Homo sapiens
tggtgctgcaggtgggcacagt

SEQ ID NO: 7678919 - DNA, 22 bp, Homo sapiens
tggtgctgataatggcaggatt

SEQ ID NO: 7678920 - DNA, 22 bp, Homo sapiens
tggtgctgataatggcaggatt

SEQ ID NO: 7678921 - DNA, 22 bp, Homo sapiens
tggtgctgataatggcaggatt

SEQ ID NO: 7678922 - DNA, 22 bp, Homo sapiens
tggtgctgataatggcaggatt

SEQ ID NO: 7678923 - DNA, 22 bp, Homo sapiens
tggtgctgcaggtgggcacagt

SEQ ID NO: 7678924 - DNA, 22 bp, Homo sapiens
tggtgctgcaggtgggcacagt

SEQ ID NO: 7678925 - DNA, 19 bp, Homo sapiens
tggtgctggcctcccatgg

SEQ ID NO: 7678926 - DNA, 22 bp, Homo sapiens
tggtgctgtctactttgtgcag

SEQ ID NO: 7678927 - DNA, 22 bp, Homo sapiens
tggtgctgtgatacgaggcact

SEQ ID NO: 7678928 - DNA, 22 bp, Homo sapiens
tggtgctgtgatacgaggcact

SEQ ID NO: 7678929 - DNA, 22 bp, Homo sapiens
tggtgctggtgccacgcccctt

SEQ ID NO: 7678930 - DNA, 22 bp, Homo sapiens
tggtgctgcctcagatgcctta

SEQ ID NO: 7678931 - DNA, 19 bp, Homo sapiens
tggtgctggcctcccatgg

SEQ ID NO: 7678932 - DNA, 19 bp, Homo sapiens
tggtgctggcctcccatgg

SEQ ID NO: 7678933 - DNA, 22 bp, Homo sapiens
tggtgctgcctcagatgcctta

SEQ ID NO: 7678934 - DNA, 22 bp, Homo sapiens
tggtgctgcctcagatgcctta

SEQ ID NO: 7678935 - DNA, 22 bp, Homo sapiens
tggtggccgaagccctctctca

SEQ ID NO: 7678936 - DNA, 22 bp, Homo sapiens
tggtggccgaagccctctctca

SEQ ID NO: 7678937 - DNA, 22 bp, Homo sapiens
tggtggccccctcaagtctttg

SEQ ID NO: 7678938 - DNA, 22 bp, Homo sapiens
tggtgctgtggaggggcagaag

SEQ ID NO: 7678939 - DNA, 22 bp, Homo sapiens
tggtgctgtggaggggcagaag

SEQ ID NO: 7678940 - DNA, 22 bp, Homo sapiens
tggtgctgtggaggggcagaag

SEQ ID NO: 7678941 - DNA, 22 bp, Homo sapiens
tggtgctgtggaggggcagaag

SEQ ID NO: 7678942 - DNA, 22 bp, Homo sapiens
tggtgctgtggaggggcagaag

SEQ ID NO: 7678943 - DNA, 22 bp, Homo sapiens
tggtgctgtgatacgaggcact

SEQ ID NO: 7678944 - DNA, 22 bp, Homo sapiens
tggtgctgtggaggggcagaag

SEQ ID NO: 7678945 - DNA, 22 bp, Homo sapiens
tggtgctgtgatacgaggcact

SEQ ID NO: 7678946 - DNA, 22 bp, Homo sapiens
tggtgctgtgatacgaggcact

SEQ ID NO: 7678947 - DNA, 22 bp, Homo sapiens
tggtggcttctgaggatggcga

SEQ ID NO: 7678948 - DNA, 22 bp, Homo sapiens
tggtggcttctgaggatggcga

SEQ ID NO: 7678949 - DNA, 22 bp, Homo sapiens
tggtggcttctgaggatggcga

SEQ ID NO: 7678950 - DNA, 22 bp, Homo sapiens
tggtggcttctgaggatggcga

SEQ ID NO: 7678951 - DNA, 23 bp, Homo sapiens
tggtggcttgtggtggccaccag

SEQ ID NO: 7678952 - DNA, 22 bp, Homo sapiens
tggtggcttctgaggatggcga

SEQ ID NO: 7678953 - DNA, 23 bp, Homo sapiens
tggtggcttgtggtggccaccag

SEQ ID NO: 7678954 - DNA, 23 bp, Homo sapiens
tggtggcttgtggtggccaccag

SEQ ID NO: 7678955 - DNA, 23 bp, Homo sapiens
tggtggcttgtggtggccaccag

SEQ ID NO: 7678956 - DNA, 23 bp, Homo sapiens
tggtggcttgtggtggccaccag

SEQ ID NO: 7678957 - DNA, 22 bp, Homo sapiens
tggtggctgtaagggagagaag

SEQ ID NO: 7678958 - DNA, 22 bp, Homo sapiens
tggtggctgttgcagaactgag

SEQ ID NO: 7678959 - DNA, 22 bp, Homo sapiens
tggtggctgtaagggagagaag

SEQ ID NO: 7678960 - DNA, 22 bp, Homo sapiens
tggtggctgtaagggagagaag

SEQ ID NO: 7678961 - DNA, 22 bp, Homo sapiens
tggtggctgtaagggagagaag

SEQ ID NO: 7678962 - DNA, 17 bp, Homo sapiens
tggtggctggagtcagg

SEQ ID NO: 7678963 - DNA, 17 bp, Homo sapiens
tggtggctggagtcagg

SEQ ID NO: 7678964 - DNA, 17 bp, Homo sapiens
tggtggctggagtcagg

SEQ ID NO: 7678965 - DNA, 17 bp, Homo sapiens
tggtggctggagtcagg

SEQ ID NO: 7678966 - DNA, 17 bp, Homo sapiens
tggtggctggagtcagg

SEQ ID NO: 7678967 - DNA, 17 bp, Homo sapiens
tggtggctggagtcagg

SEQ ID NO: 7678968 - DNA, 17 bp, Homo sapiens
tggtggctggagtcagg

SEQ ID NO: 7678969 - DNA, 22 bp, Homo sapiens
tggtggctgctccctgccttga

SEQ ID NO: 7678970 - DNA, 22 bp, Homo sapiens
tggtggctcacgtctgtaatct

SEQ ID NO: 7678971 - DNA, 22 bp, Homo sapiens
tggtggctcacacctgtaatcc

SEQ ID NO: 7678972 - DNA, 22 bp, Homo sapiens
tggtggctcacgtctgtaatct

SEQ ID NO: 7678973 - DNA, 22 bp, Homo sapiens
tggtggctcacacctgtaatcc

SEQ ID NO: 7678974 - DNA, 22 bp, Homo sapiens
tggtggctaccaggtcctgggg

SEQ ID NO: 7678975 - DNA, 22 bp, Homo sapiens
tggtggctaccaggtcctgggg

SEQ ID NO: 7678976 - DNA, 22 bp, Homo sapiens
tggtggctaccaggtcctgggg

SEQ ID NO: 7678977 - DNA, 22 bp, Homo sapiens
tggtggctaccaggtcctgggg

SEQ ID NO: 7678978 - DNA, 22 bp, Homo sapiens
tggtggcgggcagggccgtcac

SEQ ID NO: 7678979 - DNA, 22 bp, Homo sapiens
tggtggccttgatggcatctgc

SEQ ID NO: 7678980 - DNA, 22 bp, Homo sapiens
tggtggccttgatggcatctgc

SEQ ID NO: 7678981 - DNA, 22 bp, Homo sapiens
tggtggccttgatggcatctgc

SEQ ID NO: 7678982 - DNA, 22 bp, Homo sapiens
tggtggccttgatggcatctgc

SEQ ID NO: 7678983 - DNA, 22 bp, Homo sapiens
tggtggccgaagccctctctca

SEQ ID NO: 7678984 - DNA, 22 bp, Homo sapiens
tggtggccgaagccctctctca

SEQ ID NO: 7678985 - DNA, 22 bp, Homo sapiens
tgtcccactgacttcacatcca

SEQ ID NO: 7678986 - DNA, 22 bp, Homo sapiens
tgtcccactgacttcacatcca

SEQ ID NO: 7678987 - DNA, 22 bp, Homo sapiens
tgtcccactgacttcacatcca

SEQ ID NO: 7678988 - DNA, 19 bp, Homo sapiens
tgtcccagactccgtgtct

SEQ ID NO: 7678989 - DNA, 22 bp, Homo sapiens
tgtcccagacataagtggacat

SEQ ID NO: 7678990 - DNA, 22 bp, Homo sapiens
tgtcccagacataagtggacat

SEQ ID NO: 7678991 - DNA, 22 bp, Homo sapiens
tgtcccagacataagtggacat

SEQ ID NO: 7678992 - DNA, 22 bp, Homo sapiens
tgtcccagatactggacataga

SEQ ID NO: 7678993 - DNA, 23 bp, Homo sapiens
tgtcccagagggagggataggct

SEQ ID NO: 7678994 - DNA, 22 bp, Homo sapiens
tgtcccagacataagtggacat

SEQ ID NO: 7678995 - DNA, 23 bp, Homo sapiens
tgtcccagagggagggataggct

SEQ ID NO: 7678996 - DNA, 22 bp, Homo sapiens
tgtcccagcactttgggagtct

SEQ ID NO: 7678997 - DNA, 22 bp, Homo sapiens
tgtcccagatcacaggagggga

SEQ ID NO: 7678998 - DNA, 22 bp, Homo sapiens
tgtcccagcactttgggagtct

SEQ ID NO: 7678999 - DNA, 22 bp, Homo sapiens
tgtcctcatcctccagtctgtc

SEQ ID NO: 7679000 - DNA, 22 bp, Homo sapiens
tgtcctcatcctccagtctgtc

SEQ ID NO: 7679001 - DNA, 22 bp, Homo sapiens
tgtcctcaggacctggcacagt

SEQ ID NO: 7679002 - DNA, 22 bp, Homo sapiens
tgtcctccagcagcatggtatg

SEQ ID NO: 7679003 - DNA, 22 bp, Homo sapiens
tgtcctccagcagcatggtatg

SEQ ID NO: 7679004 - DNA, 22 bp, Homo sapiens
tgtcctccagcagcatggtatg

SEQ ID NO: 7679005 - DNA, 22 bp, Homo sapiens
tgtcctcgtccgcctcgaactc

SEQ ID NO: 7679006 - DNA, 22 bp, Homo sapiens
tgtcctccaggacctgcagggc

SEQ ID NO: 7679007 - DNA, 22 bp, Homo sapiens
tgtcctccaggacctgcagggc

SEQ ID NO: 7679008 - DNA, 22 bp, Homo sapiens
tgtcctccaggacctgcagggc

SEQ ID NO: 7679009 - DNA, 22 bp, Homo sapiens
tgtcctccaggacctgcagggc

SEQ ID NO: 7679010 - DNA, 22 bp, Homo sapiens
tgtccataaattcacaagtgta

SEQ ID NO: 7679011 - DNA, 22 bp, Homo sapiens
tgtccagttttctataaggttc

SEQ ID NO: 7679012 - DNA, 22 bp, Homo sapiens
tgtccagttttctataaggttc

SEQ ID NO: 7679013 - DNA, 22 bp, Homo sapiens
tgtccagttgtttgaccacggc

SEQ ID NO: 7679014 - DNA, 22 bp, Homo sapiens
tgtccagtttcggatgtaacat

SEQ ID NO: 7679015 - DNA, 22 bp, Homo sapiens
tgtccataaattcacaagtgta

SEQ ID NO: 7679016 - DNA, 22 bp, Homo sapiens
tgtccataaattcacaagtgta

SEQ ID NO: 7679017 - DNA, 22 bp, Homo sapiens
tgtccatacaatgtaacatctt

SEQ ID NO: 7679018 - DNA, 22 bp, Homo sapiens
tgtccatacctttacctgtgta

SEQ ID NO: 7679019 - DNA, 22 bp, Homo sapiens
tgtccagtgatgccaagatgaa

SEQ ID NO: 7679020 - DNA, 22 bp, Homo sapiens
tgtccagtgaaggtgttaaatt

SEQ ID NO: 7679021 - DNA, 22 bp, Homo sapiens
tgtccagtgatgccaagatgaa

SEQ ID NO: 7679022 - DNA, 19 bp, Homo sapiens
tgtccagtgatgtcaagga

SEQ ID NO: 7679023 - DNA, 19 bp, Homo sapiens
tgtccagtgatgtcaagga

SEQ ID NO: 7679024 - DNA, 22 bp, Homo sapiens
tgtccagtgattctcatgagcc

SEQ ID NO: 7679025 - DNA, 22 bp, Homo sapiens
tgtccagtgattctcatgagcc

SEQ ID NO: 7679026 - DNA, 22 bp, Homo sapiens
tgtccagtgattctcatgagcc

SEQ ID NO: 7679027 - DNA, 22 bp, Homo sapiens
tgtccagtgattctcatgagcc

SEQ ID NO: 7679028 - DNA, 22 bp, Homo sapiens
cctggccatagggcccaggaaa

SEQ ID NO: 7679029 - DNA, 22 bp, Homo sapiens
cctggccatttgaacttcagac

SEQ ID NO: 7679030 - DNA, 22 bp, Homo sapiens
cctggccatttgaacttcagac

SEQ ID NO: 7679031 - DNA, 22 bp, Homo sapiens
cctggcccacatggcttctccc

SEQ ID NO: 7679032 - DNA, 22 bp, Homo sapiens
cctggccatttgaacttcagac

SEQ ID NO: 7679033 - DNA, 22 bp, Homo sapiens
cctggcccacatggcttctccc

SEQ ID NO: 7679034 - DNA, 22 bp, Homo sapiens
cctggcccacatggcttctccc

SEQ ID NO: 7679035 - DNA, 22 bp, Homo sapiens
cctggcccacatggcttctccc

SEQ ID NO: 7679036 - DNA, 22 bp, Homo sapiens
cctggcccacatggcttctccc

SEQ ID NO: 7679037 - DNA, 22 bp, Homo sapiens
tgtccaggttagcttcaaacac

SEQ ID NO: 7679038 - DNA, 22 bp, Homo sapiens
tgtccagtccttggggtgctgt

SEQ ID NO: 7679039 - DNA, 22 bp, Homo sapiens
tgtccagtccttggggtgctgt

SEQ ID NO: 7679040 - DNA, 22 bp, Homo sapiens
tgtccattgcttatttctactt

SEQ ID NO: 7679041 - DNA, 22 bp, Homo sapiens
tgtccatttatacgccctcact

SEQ ID NO: 7679042 - DNA, 17 bp, Homo sapiens
tgtccatttgcctggag

SEQ ID NO: 7679043 - DNA, 17 bp, Homo sapiens
tgtccatttgcctggag

SEQ ID NO: 7679044 - DNA, 22 bp, Homo sapiens
tgtcccaaccctgagaagattc

SEQ ID NO: 7679045 - DNA, 22 bp, Homo sapiens
tgtcccacaacatttgaggagg

SEQ ID NO: 7679046 - DNA, 22 bp, Homo sapiens
tgtccatgggcgtcaggcagga

SEQ ID NO: 7679047 - DNA, 22 bp, Homo sapiens
tgtccatgggcgtcaggcagga

SEQ ID NO: 7679048 - DNA, 22 bp, Homo sapiens
tgtccatggagaagctcagggc

SEQ ID NO: 7679049 - DNA, 22 bp, Homo sapiens
tgtccatggatagagctgctcg

SEQ ID NO: 7679050 - DNA, 22 bp, Homo sapiens
tgtccatgcgtatccagggagc

SEQ ID NO: 7679051 - DNA, 22 bp, Homo sapiens
tgtccatggagaagctcagggc

SEQ ID NO: 7679052 - DNA, 22 bp, Homo sapiens
tgtccatcaggctgcctgtcag

SEQ ID NO: 7679053 - DNA, 22 bp, Homo sapiens
tgtccatccagatgggaggaga

SEQ ID NO: 7679054 - DNA, 22 bp, Homo sapiens
tgtccatctccatcgagtcctc

SEQ ID NO: 7679055 - DNA, 22 bp, Homo sapiens
tgtccatctgtcttagtacaaa

SEQ ID NO: 7679056 - DNA, 22 bp, Homo sapiens
tgtccatcactgggggggatga

SEQ ID NO: 7679057 - DNA, 22 bp, Homo sapiens
tgtccatcttttcagattctgt

SEQ ID NO: 7679058 - DNA, 22 bp, Homo sapiens
tgtccatggagaagctcagggc

SEQ ID NO: 7679059 - DNA, 22 bp, Homo sapiens
cctggccagctaattgcccatc

SEQ ID NO: 7679060 - DNA, 22 bp, Homo sapiens
cctggccagctaattgcccatc

SEQ ID NO: 7679061 - DNA, 22 bp, Homo sapiens
cctggccagctaattgcccatc

SEQ ID NO: 7679062 - DNA, 22 bp, Homo sapiens
cctggccagctaattgcccatc

SEQ ID NO: 7679063 - DNA, 22 bp, Homo sapiens
cctggccaggcatggagtcaca

SEQ ID NO: 7679064 - DNA, 22 bp, Homo sapiens
cctggccaggcatggagtcaca

SEQ ID NO: 7679065 - DNA, 22 bp, Homo sapiens
cctggccaggcatggagtcaca

SEQ ID NO: 7679066 - DNA, 22 bp, Homo sapiens
cctggccaggcatggagtcaca

SEQ ID NO: 7679067 - DNA, 22 bp, Homo sapiens
cctggccaggcatggagtcaca

SEQ ID NO: 7679068 - DNA, 22 bp, Homo sapiens
cctggccaggcatggagtcaca

SEQ ID NO: 7679069 - DNA, 22 bp, Homo sapiens
cctggccaggctccaagtactg

SEQ ID NO: 7679070 - DNA, 22 bp, Homo sapiens
cctggccaggctccaagtactg

SEQ ID NO: 7679071 - DNA, 22 bp, Homo sapiens
cctggccaggctccaagtactg

SEQ ID NO: 7679072 - DNA, 22 bp, Homo sapiens
cctggccaggctccaagtactg

SEQ ID NO: 7679073 - DNA, 22 bp, Homo sapiens
cctggccaggctccaagtactg

SEQ ID NO: 7679074 - DNA, 22 bp, Homo sapiens
cctggccagggtctgggctgct

SEQ ID NO: 7679075 - DNA, 22 bp, Homo sapiens
cctggccagggtctgggctgct

SEQ ID NO: 7679076 - DNA, 22 bp, Homo sapiens
cctggccaggctctcagcactg

SEQ ID NO: 7679077 - DNA, 22 bp, Homo sapiens
cctggccaggctctcagcactg

SEQ ID NO: 7679078 - DNA, 22 bp, Homo sapiens
cctggccaggctctcagcactg

SEQ ID NO: 7679079 - DNA, 22 bp, Homo sapiens
cctggccaggctctcagcactg

SEQ ID NO: 7679080 - DNA, 22 bp, Homo sapiens
cctggccagtttccaggccctg

SEQ ID NO: 7679081 - DNA, 22 bp, Homo sapiens
cctggccagtttccaggccctg

SEQ ID NO: 7679082 - DNA, 22 bp, Homo sapiens
cctggccagtttccaggccctg

SEQ ID NO: 7679083 - DNA, 22 bp, Homo sapiens
cctggccagtttccaggccctg

SEQ ID NO: 7679084 - DNA, 22 bp, Homo sapiens
cctggccatagggcccaggaaa

SEQ ID NO: 7679085 - DNA, 22 bp, Homo sapiens
cctggccatagggcccaggaaa

SEQ ID NO: 7679086 - DNA, 22 bp, Homo sapiens
cctggccatagggcccaggaaa

SEQ ID NO: 7679087 - DNA, 22 bp, Homo sapiens
cctggccatagggcccaggaaa

SEQ ID NO: 7679088 - DNA, 22 bp, Homo sapiens
cctggccatagggcccaggaaa

SEQ ID NO: 7679089 - DNA, 22 bp, Homo sapiens
cctggccagtttccaggccctg

SEQ ID NO: 7679090 - DNA, 22 bp, Homo sapiens
cctggccagtttccaggccctg

SEQ ID NO: 7679091 - DNA, 22 bp, Homo sapiens
cctggccagtttccaggccctg

SEQ ID NO: 7679092 - DNA, 22 bp, Homo sapiens
cctggccagtttccaggccctg

SEQ ID NO: 7679093 - DNA, 22 bp, Homo sapiens
cctggccagggtctgggctgct

SEQ ID NO: 7679094 - DNA, 22 bp, Homo sapiens
cctggccagggtctgggctgct

SEQ ID NO: 7679095 - DNA, 22 bp, Homo sapiens
cctggccagggtctgggctgct

SEQ ID NO: 7679096 - DNA, 22 bp, Homo sapiens
cctggccagggtctgggctgct

SEQ ID NO: 7679097 - DNA, 22 bp, Homo sapiens
cctggccagggtctgggctgct

SEQ ID NO: 7679098 - DNA, 22 bp, Homo sapiens
cctggccagcgccggctgctcg

SEQ ID NO: 7679099 - DNA, 22 bp, Homo sapiens
cctggccagcgccggctgctcg

SEQ ID NO: 7679100 - DNA, 22 bp, Homo sapiens
cctggccagcgccggctgctcg

SEQ ID NO: 7679101 - DNA, 22 bp, Homo sapiens
cctggccagcgccggctgctcg

SEQ ID NO: 7679102 - DNA, 22 bp, Homo sapiens
cctggccagcgccggctgctcg

SEQ ID NO: 7679103 - DNA, 22 bp, Homo sapiens
cctggccagccagggctggggt

SEQ ID NO: 7679104 - DNA, 22 bp, Homo sapiens
cctggccagcgccggctgctcg

SEQ ID NO: 7679105 - DNA, 22 bp, Homo sapiens
cctggccagcgccggctgctcg

SEQ ID NO: 7679106 - DNA, 22 bp, Homo sapiens
cctggccagccagggctggggt

SEQ ID NO: 7679107 - DNA, 22 bp, Homo sapiens
cctggccagccagggctggggt

SEQ ID NO: 7679108 - DNA, 22 bp, Homo sapiens
cctggccagccagggctggggt

SEQ ID NO: 7679109 - DNA, 22 bp, Homo sapiens
cctggcatctgagcctggcctg

SEQ ID NO: 7679110 - DNA, 22 bp, Homo sapiens
cctggcatggggtctccagcca

SEQ ID NO: 7679111 - DNA, 22 bp, Homo sapiens
cctggcatggggtctccagcca

SEQ ID NO: 7679112 - DNA, 22 bp, Homo sapiens
cctggcatggggtctccagcca

SEQ ID NO: 7679113 - DNA, 22 bp, Homo sapiens
cctggcatgaggagcatgaggt

SEQ ID NO: 7679114 - DNA, 22 bp, Homo sapiens
cctggcatgaggagcatgaggt

SEQ ID NO: 7679115 - DNA, 22 bp, Homo sapiens
cctggcatgaggagcatgaggt

SEQ ID NO: 7679116 - DNA, 22 bp, Homo sapiens
cctggcatccggaacctggaaa

SEQ ID NO: 7679117 - DNA, 22 bp, Homo sapiens
cctggcatccctctccttacgc

SEQ ID NO: 7679118 - DNA, 22 bp, Homo sapiens
cctggcatccctctccttacgc

SEQ ID NO: 7679119 - DNA, 22 bp, Homo sapiens
cctggcatataaatagaagatg

SEQ ID NO: 7679120 - DNA, 22 bp, Homo sapiens
cctggcattctctccagagaga

SEQ ID NO: 7679121 - DNA, 22 bp, Homo sapiens
cctggcattctctccagagaga

SEQ ID NO: 7679122 - DNA, 22 bp, Homo sapiens
cctggcatgtcctcctggcatg

SEQ ID NO: 7679123 - DNA, 22 bp, Homo sapiens
cctggcatgtcctcctggcatg

SEQ ID NO: 7679124 - DNA, 22 bp, Homo sapiens
cctggcatgtcctcctggcatg

SEQ ID NO: 7679125 - DNA, 22 bp, Homo sapiens
cctggcagttcatcaaatggca

SEQ ID NO: 7679126 - DNA, 22 bp, Homo sapiens
cctggcagttcatcaaatggca

SEQ ID NO: 7679127 - DNA, 22 bp, Homo sapiens
cctggcagtggtgaagaagagg

SEQ ID NO: 7679128 - DNA, 22 bp, Homo sapiens
cctggcagtggtgaagaagagg

SEQ ID NO: 7679129 - DNA, 22 bp, Homo sapiens
cctggcagtggtgaagaagagg

SEQ ID NO: 7679130 - DNA, 22 bp, Homo sapiens
cctggcagttttgcccaggatt

SEQ ID NO: 7679131 - DNA, 22 bp, Homo sapiens
cctggcagttttgcccaggatt

SEQ ID NO: 7679132 - DNA, 22 bp, Homo sapiens
cctggcagttttgcccaggatt

SEQ ID NO: 7679133 - DNA, 23 bp, Homo sapiens
cctggcagcaaacgaggaggtta

SEQ ID NO: 7679134 - DNA, 23 bp, Homo sapiens
cctggcagcaaacgaggaggtta

SEQ ID NO: 7679135 - DNA, 23 bp, Homo sapiens
cctggcagcaaacgaggaggtta

SEQ ID NO: 7679136 - DNA, 22 bp, Homo sapiens
cctggcagactgtgagggcagg

SEQ ID NO: 7679137 - DNA, 23 bp, Homo sapiens
cctggcagcaaacgaggaggtta

SEQ ID NO: 7679138 - DNA, 23 bp, Homo sapiens
cctggcagcaaacgaggaggtta

SEQ ID NO: 7679139 - DNA, 22 bp, Homo sapiens
cctggcagactgtgagggcagg

SEQ ID NO: 7679140 - DNA, 22 bp, Homo sapiens
cctggcagactgtgagggcagg

SEQ ID NO: 7679141 - DNA, 22 bp, Homo sapiens
cctggcagactgtgagggcagg

SEQ ID NO: 7679142 - DNA, 22 bp, Homo sapiens
cctggcagactgtgagggcagg

SEQ ID NO: 7679143 - DNA, 22 bp, Homo sapiens
cctggcagactgtgagggcagg

SEQ ID NO: 7679144 - DNA, 22 bp, Homo sapiens
cctggcagactgtgagggcagg

SEQ ID NO: 7679145 - DNA, 22 bp, Homo sapiens
cctggcagactgtgagggcagg

SEQ ID NO: 7679146 - DNA, 22 bp, Homo sapiens
tgtcatgtttcatgtttgtagg

SEQ ID NO: 7679147 - DNA, 22 bp, Homo sapiens
tgtcatgtttcatgtttgtagg

SEQ ID NO: 7679148 - DNA, 22 bp, Homo sapiens
tgtcatgtttcatgtttgtagg

SEQ ID NO: 7679149 - DNA, 22 bp, Homo sapiens
tgtcattaaaatgcttctcaaa

SEQ ID NO: 7679150 - DNA, 21 bp, Homo sapiens
tgtcattaatcgctatagaag

SEQ ID NO: 7679151 - DNA, 22 bp, Homo sapiens
tgtcattaagtcctttggcgga

SEQ ID NO: 7679152 - DNA, 22 bp, Homo sapiens
tgtcattaagtagggatttgtg

SEQ ID NO: 7679153 - DNA, 22 bp, Homo sapiens
tgtcattagtttcagccattct

SEQ ID NO: 7679154 - DNA, 22 bp, Homo sapiens
tgtcattattagagttgtgctt

SEQ ID NO: 7679155 - DNA, 22 bp, Homo sapiens
tgtcattatttgcctactgact

SEQ ID NO: 7679156 - DNA, 22 bp, Homo sapiens
tgtcattatttgcctactgact

SEQ ID NO: 7679157 - DNA, 23 bp, Homo sapiens
cctggcagcaaacgaggaggtta

SEQ ID NO: 7679158 - DNA, 22 bp, Homo sapiens
cctggcagcagcacatgccttc

SEQ ID NO: 7679159 - DNA, 22 bp, Homo sapiens
cctggcagcagcacatgccttc

SEQ ID NO: 7679160 - DNA, 22 bp, Homo sapiens
cctggcagcagcacatgccttc

SEQ ID NO: 7679161 - DNA, 22 bp, Homo sapiens
cctggcagcagcacatgccttc

SEQ ID NO: 7679162 - DNA, 23 bp, Homo sapiens
cctggcagcaaacgaggaggtta

SEQ ID NO: 7679163 - DNA, 23 bp, Homo sapiens
cctggcagcaaacgaggaggtta

SEQ ID NO: 7679164 - DNA, 23 bp, Homo sapiens
cctggcagcaaacgaggaggtta

SEQ ID NO: 7679165 - DNA, 23 bp, Homo sapiens
cctggcagcaaacgaggaggtta

SEQ ID NO: 7679166 - DNA, 22 bp, Homo sapiens
cctggcagcaggtgggcccgtg

SEQ ID NO: 7679167 - DNA, 22 bp, Homo sapiens
cctggcagcaggtgggcccgtg

SEQ ID NO: 7679168 - DNA, 22 bp, Homo sapiens
cctggcagcaggtgggcccgtg

SEQ ID NO: 7679169 - DNA, 22 bp, Homo sapiens
cctggcagcccagagcgccgct

SEQ ID NO: 7679170 - DNA, 18 bp, Homo sapiens
cctggcagccatgcgcgc

SEQ ID NO: 7679171 - DNA, 18 bp, Homo sapiens
cctggcagccatgcgcgc

SEQ ID NO: 7679172 - DNA, 18 bp, Homo sapiens
cctggcagccatgcgcgc

SEQ ID NO: 7679173 - DNA, 18 bp, Homo sapiens
cctggcagccatgcgcgc

SEQ ID NO: 7679174 - DNA, 18 bp, Homo sapiens
cctggcagccatgcgcgc

SEQ ID NO: 7679175 - DNA, 18 bp, Homo sapiens
cctggcagccatgcgcgc

SEQ ID NO: 7679176 - DNA, 22 bp, Homo sapiens
cctggcagcattggtagagatt

SEQ ID NO: 7679177 - DNA, 22 bp, Homo sapiens
cctggcagcattggtagagatt

SEQ ID NO: 7679178 - DNA, 22 bp, Homo sapiens
cctggcagcattggtagagatt

SEQ ID NO: 7679179 - DNA, 22 bp, Homo sapiens
cctggcaggctggggacagtgc

SEQ ID NO: 7679180 - DNA, 22 bp, Homo sapiens
cctggcaggctggggacagtgc

SEQ ID NO: 7679181 - DNA, 22 bp, Homo sapiens
cctggcaggctggggacagtgc

SEQ ID NO: 7679182 - DNA, 20 bp, Homo sapiens
cctggcaggcgggttactta

SEQ ID NO: 7679183 - DNA, 20 bp, Homo sapiens
cctggcaggcgggttactta

SEQ ID NO: 7679184 - DNA, 20 bp, Homo sapiens
cctggcaggcgggttactta

SEQ ID NO: 7679185 - DNA, 20 bp, Homo sapiens
cctggcaggcgggttactta

SEQ ID NO: 7679186 - DNA, 20 bp, Homo sapiens
cctggcaggcgggttactta

SEQ ID NO: 7679187 - DNA, 22 bp, Homo sapiens
cctggcaggctggggacagtgc

SEQ ID NO: 7679188 - DNA, 22 bp, Homo sapiens
cctggcaggctggggacagtgc

SEQ ID NO: 7679189 - DNA, 22 bp, Homo sapiens
cctggcaggctggggacagtgc

SEQ ID NO: 7679190 - DNA, 22 bp, Homo sapiens
cctggcaggctggggacagtgc

SEQ ID NO: 7679191 - DNA, 22 bp, Homo sapiens
cctggcaggctggggacagtgc

SEQ ID NO: 7679192 - DNA, 22 bp, Homo sapiens
cctggcaggctggggacagtgc

SEQ ID NO: 7679193 - DNA, 22 bp, Homo sapiens
cctggcaggcaagaggaaggga

SEQ ID NO: 7679194 - DNA, 22 bp, Homo sapiens
cctggcaggcaagaggaaggga

SEQ ID NO: 7679195 - DNA, 22 bp, Homo sapiens
cctggcaggcaagaggaaggga

SEQ ID NO: 7679196 - DNA, 22 bp, Homo sapiens
cctggcaggcaagaggaaggga

SEQ ID NO: 7679197 - DNA, 22 bp, Homo sapiens
cctggcaggactgttgtaagaa

SEQ ID NO: 7679198 - DNA, 22 bp, Homo sapiens
cctggcaggactgttgtaagaa

SEQ ID NO: 7679199 - DNA, 22 bp, Homo sapiens
cctggcaggcaagaggaaggga

SEQ ID NO: 7679200 - DNA, 22 bp, Homo sapiens
cctggcaggcaagaggaaggga

SEQ ID NO: 7679201 - DNA, 22 bp, Homo sapiens
cctggcaggcccctcctggatt

SEQ ID NO: 7679202 - DNA, 22 bp, Homo sapiens
cctggcaggcaagaggaaggga

SEQ ID NO: 7679203 - DNA, 22 bp, Homo sapiens
cctggcaggcccctcctggatt

SEQ ID NO: 7679204 - DNA, 22 bp, Homo sapiens
cctggcaggcccctcctggatt

SEQ ID NO: 7679205 - DNA, 22 bp, Homo sapiens
cctggcaggtagcattgaggag

SEQ ID NO: 7679206 - DNA, 22 bp, Homo sapiens
cctggcaggtagcattgaggag

SEQ ID NO: 7679207 - DNA, 22 bp, Homo sapiens
cctggcagggctgcagtaatgg

SEQ ID NO: 7679208 - DNA, 22 bp, Homo sapiens
cctggcagggctgcagtaatgg

SEQ ID NO: 7679209 - DNA, 22 bp, Homo sapiens
cctggcaggtggaggttgcagt

SEQ ID NO: 7679210 - DNA, 22 bp, Homo sapiens
cctggcaggtggaggttgcagt

SEQ ID NO: 7679211 - DNA, 22 bp, Homo sapiens
cctggcaggtggaggttgcagt

SEQ ID NO: 7679212 - DNA, 22 bp, Homo sapiens
cctggcaggtggcgccctcggc

SEQ ID NO: 7679213 - DNA, 22 bp, Homo sapiens
cctggcaggtggcgccctcggc

SEQ ID NO: 7679214 - DNA, 22 bp, Homo sapiens
cctggcaggtggcgccctcggc

SEQ ID NO: 7679215 - DNA, 22 bp, Homo sapiens
cctggcaggtggcgccctcggc

SEQ ID NO: 7679216 - DNA, 22 bp, Homo sapiens
cctggcagtcaggggagtcctt

SEQ ID NO: 7679217 - DNA, 22 bp, Homo sapiens
cctggcagtcaggggagtcctt

SEQ ID NO: 7679218 - DNA, 22 bp, Homo sapiens
cctggcagtcaggggagtcctt

SEQ ID NO: 7679219 - DNA, 22 bp, Homo sapiens
cctggcagtcaggggagtcctt

SEQ ID NO: 7679220 - DNA, 22 bp, Homo sapiens
cctggcagtcaggggagtcctt

SEQ ID NO: 7679221 - DNA, 22 bp, Homo sapiens
cctggcagtcaggggagtcctt

SEQ ID NO: 7679222 - DNA, 22 bp, Homo sapiens
cctggcaggttacaaccagtta

SEQ ID NO: 7679223 - DNA, 22 bp, Homo sapiens
cctggcaggttacaaccagtta

SEQ ID NO: 7679224 - DNA, 22 bp, Homo sapiens
cctggcaggttacaaccagtta

SEQ ID NO: 7679225 - DNA, 22 bp, Homo sapiens
cctggcaggtggcgccctcggc

SEQ ID NO: 7679226 - DNA, 22 bp, Homo sapiens
cctggctccctgcacagggctc

SEQ ID NO: 7679227 - DNA, 22 bp, Homo sapiens
cctggctccctgcacagggctc

SEQ ID NO: 7679228 - DNA, 22 bp, Homo sapiens
cctggctccctgcacagggctc

SEQ ID NO: 7679229 - DNA, 22 bp, Homo sapiens
cctggctccctgcacagggctc

SEQ ID NO: 7679230 - DNA, 22 bp, Homo sapiens
cctggctccctgcacagggctc

SEQ ID NO: 7679231 - DNA, 22 bp, Homo sapiens
cctggctccctgcacagggctc

SEQ ID NO: 7679232 - DNA, 22 bp, Homo sapiens
cctggctccctgcacagggctc

SEQ ID NO: 7679233 - DNA, 22 bp, Homo sapiens
cctggctccctgcacagggctc

SEQ ID NO: 7679234 - DNA, 22 bp, Homo sapiens
cctggctcccggaacagggtct

SEQ ID NO: 7679235 - DNA, 22 bp, Homo sapiens
cctggctccctgcacagggctc

SEQ ID NO: 7679236 - DNA, 22 bp, Homo sapiens
cctggctcccggaacagggtct

SEQ ID NO: 7679237 - DNA, 22 bp, Homo sapiens
cctggctccctggacctcatta

SEQ ID NO: 7679238 - DNA, 22 bp, Homo sapiens
cctggctccggttcaagggaaa

SEQ ID NO: 7679239 - DNA, 22 bp, Homo sapiens
cctggctccctggacctcatta

SEQ ID NO: 7679240 - DNA, 22 bp, Homo sapiens
cctggctccctggacctcatta

SEQ ID NO: 7679241 - DNA, 22 bp, Homo sapiens
cctggctccctggacctcatta

SEQ ID NO: 7679242 - DNA, 22 bp, Homo sapiens
cctggctccggttcaagggaaa

SEQ ID NO: 7679243 - DNA, 22 bp, Homo sapiens
cctggctccggttcaagggaaa

SEQ ID NO: 7679244 - DNA, 22 bp, Homo sapiens
cctggctccggttcaagggaaa

SEQ ID NO: 7679245 - DNA, 22 bp, Homo sapiens
cctggctccggttcaagggaaa

SEQ ID NO: 7679246 - DNA, 22 bp, Homo sapiens
cctggctccggttcaagggaaa

SEQ ID NO: 7679247 - DNA, 22 bp, Homo sapiens
cctggctccgtgtcacgtgccc

SEQ ID NO: 7679248 - DNA, 22 bp, Homo sapiens
cctggctccgtgtcacgtgccc

SEQ ID NO: 7679249 - DNA, 22 bp, Homo sapiens
cctggctccgtgtcacgtgccc

SEQ ID NO: 7679250 - DNA, 22 bp, Homo sapiens
cctggctccgtgtcacgtgccc

SEQ ID NO: 7679251 - DNA, 22 bp, Homo sapiens
cctggctcctgcctctgcaggg

SEQ ID NO: 7679252 - DNA, 22 bp, Homo sapiens
cctggctcctgcctctgcaggg

SEQ ID NO: 7679253 - DNA, 22 bp, Homo sapiens
cctggctcctgcctctgcaggg

SEQ ID NO: 7679254 - DNA, 22 bp, Homo sapiens
cctggctcctgcctctgcaggg

SEQ ID NO: 7679255 - DNA, 22 bp, Homo sapiens
cctggctcctgcctctgcaggg

SEQ ID NO: 7679256 - DNA, 22 bp, Homo sapiens
cctggctcctgcacagatcttt

SEQ ID NO: 7679257 - DNA, 22 bp, Homo sapiens
cctggctcctgcctctgcaggg

SEQ ID NO: 7679258 - DNA, 22 bp, Homo sapiens
cctggctcctgcctctgcaggg

SEQ ID NO: 7679259 - DNA, 22 bp, Homo sapiens
cctggctcctgcctctgcaggg

SEQ ID NO: 7679260 - DNA, 22 bp, Homo sapiens
cctggctcctgcctctgcaggg

SEQ ID NO: 7679261 - DNA, 22 bp, Homo sapiens
cctggctcctgcctctgcaggg

SEQ ID NO: 7679262 - DNA, 22 bp, Homo sapiens
cctggctcctgcacagatcttt

SEQ ID NO: 7679263 - DNA, 22 bp, Homo sapiens
cctggctcctgcacagatcttt

SEQ ID NO: 7679264 - DNA, 22 bp, Homo sapiens
cctggctcctgcacagatcttt

SEQ ID NO: 7679265 - DNA, 22 bp, Homo sapiens
cctggctcctgcacagatcttt

SEQ ID NO: 7679266 - DNA, 22 bp, Homo sapiens
cctggctcctgcacagatcttt

SEQ ID NO: 7679267 - DNA, 22 bp, Homo sapiens
cctggctcctacgggtattttg

SEQ ID NO: 7679268 - DNA, 22 bp, Homo sapiens
cctggctccgtgtcacgtgccc

SEQ ID NO: 7679269 - DNA, 22 bp, Homo sapiens
cctggctccgtgtcacgtgccc

SEQ ID NO: 7679270 - DNA, 22 bp, Homo sapiens
cctggctctctgcagatcctgg

SEQ ID NO: 7679271 - DNA, 22 bp, Homo sapiens
cctggctctctgcagatcctgg

SEQ ID NO: 7679272 - DNA, 22 bp, Homo sapiens
cctggctctagaggccactcct

SEQ ID NO: 7679273 - DNA, 22 bp, Homo sapiens
cctggctctagaggccactcct

SEQ ID NO: 7679274 - DNA, 22 bp, Homo sapiens
cctggctctagaggccactcct

SEQ ID NO: 7679275 - DNA, 22 bp, Homo sapiens
cctggctctagaggccactcct

SEQ ID NO: 7679276 - DNA, 22 bp, Homo sapiens
cctggctctagaggccactcct

SEQ ID NO: 7679277 - DNA, 22 bp, Homo sapiens
cctggctctctgcagatcctgg

SEQ ID NO: 7679278 - DNA, 22 bp, Homo sapiens
cctggctctctgcagatcctgg

SEQ ID NO: 7679279 - DNA, 22 bp, Homo sapiens
cctggctctgaagtccacatca

SEQ ID NO: 7679280 - DNA, 22 bp, Homo sapiens
cctggctctgaagtccacatca

SEQ ID NO: 7679281 - DNA, 22 bp, Homo sapiens
cctggctctgaagtccacatca

SEQ ID NO: 7679282 - DNA, 22 bp, Homo sapiens
cctggctctgaagtccacatca

SEQ ID NO: 7679283 - DNA, 22 bp, Homo sapiens
cctggctctgaagtccacatca

SEQ ID NO: 7679284 - DNA, 22 bp, Homo sapiens
cctggctctgaagtccacatca

SEQ ID NO: 7679285 - DNA, 22 bp, Homo sapiens
cctggctctgaagtccacatca

SEQ ID NO: 7679286 - DNA, 22 bp, Homo sapiens
cctggctctagaggccactcct

SEQ ID NO: 7679287 - DNA, 22 bp, Homo sapiens
cctggctcgctgacctcagggg

SEQ ID NO: 7679288 - DNA, 22 bp, Homo sapiens
cctggctcgctgacctcagggg

SEQ ID NO: 7679289 - DNA, 22 bp, Homo sapiens
cctggctctagaggccactcct

SEQ ID NO: 7679290 - DNA, 22 bp, Homo sapiens
cctggctctagaggccactcct

SEQ ID NO: 7679291 - DNA, 22 bp, Homo sapiens
cctggctctagaggccactcct

SEQ ID NO: 7679292 - DNA, 22 bp, Homo sapiens
cctggctcgctgacctcagggg

SEQ ID NO: 7679293 - DNA, 22 bp, Homo sapiens
cctggctcgctgacctcagggg

SEQ ID NO: 7679294 - DNA, 22 bp, Homo sapiens
cctggctcgctgacctcagggg

SEQ ID NO: 7679295 - DNA, 22 bp, Homo sapiens
cctggctcgctgacctcagggg

SEQ ID NO: 7679296 - DNA, 22 bp, Homo sapiens
cctggctcgctgacctcagggg

SEQ ID NO: 7679297 - DNA, 22 bp, Homo sapiens
cctggctcgctgacctcagggg

SEQ ID NO: 7679298 - DNA, 22 bp, Homo sapiens
cctggctcgctgacctcagggg

SEQ ID NO: 7679299 - DNA, 22 bp, Homo sapiens
cctggctcgctgacctcagggg

SEQ ID NO: 7679300 - DNA, 22 bp, Homo sapiens
cctggctcgctgacctcagggg

SEQ ID NO: 7679301 - DNA, 22 bp, Homo sapiens
cctggctcgctgacctcagggg

SEQ ID NO: 7679302 - DNA, 22 bp, Homo sapiens
cctggctcgctgacctcagggg

SEQ ID NO: 7679303 - DNA, 22 bp, Homo sapiens
cctggctcctgcctctgcaggg

SEQ ID NO: 7679304 - DNA, 22 bp, Homo sapiens
cctggctcctgcctctgcaggg

SEQ ID NO: 7679305 - DNA, 22 bp, Homo sapiens
cctggctcctgcctctgcaggg

SEQ ID NO: 7679306 - DNA, 19 bp, Homo sapiens
cctggccctgctgcgcggg

SEQ ID NO: 7679307 - DNA, 19 bp, Homo sapiens
cctggccctgctgcgcggg

SEQ ID NO: 7679308 - DNA, 19 bp, Homo sapiens
cctggccctgctgcgcggg

SEQ ID NO: 7679309 - DNA, 22 bp, Homo sapiens
cctggccctggaatagggcagg

SEQ ID NO: 7679310 - DNA, 22 bp, Homo sapiens
cctggccctggaatagggcagg

SEQ ID NO: 7679311 - DNA, 22 bp, Homo sapiens
cctggccctggaatagggcagg

SEQ ID NO: 7679312 - DNA, 22 bp, Homo sapiens
cctggccctggaatagggcagg

SEQ ID NO: 7679313 - DNA, 19 bp, Homo sapiens
cctggccctgctgcgcggg

SEQ ID NO: 7679314 - DNA, 19 bp, Homo sapiens
cctggccctgctgcgcggg

SEQ ID NO: 7679315 - DNA, 16 bp, Homo sapiens
cctggcccggcttcct

SEQ ID NO: 7679316 - DNA, 19 bp, Homo sapiens
cctggccctgctgcgcggg

SEQ ID NO: 7679317 - DNA, 16 bp, Homo sapiens
cctggcccggcttcct

SEQ ID NO: 7679318 - DNA, 22 bp, Homo sapiens
cctggcccagggactttcgcct

SEQ ID NO: 7679319 - DNA, 22 bp, Homo sapiens
cctggcccagggactttcgcct

SEQ ID NO: 7679320 - DNA, 22 bp, Homo sapiens
cctggcccacatggcttctccc

SEQ ID NO: 7679321 - DNA, 22 bp, Homo sapiens
cctggcccagggactttcgcct

SEQ ID NO: 7679322 - DNA, 22 bp, Homo sapiens
cctggcccagggactttcgcct

SEQ ID NO: 7679323 - DNA, 22 bp, Homo sapiens
cctggcccagggactttcgcct

SEQ ID NO: 7679324 - DNA, 22 bp, Homo sapiens
cctggcccagggactttcgcct

SEQ ID NO: 7679325 - DNA, 22 bp, Homo sapiens
cctggcctcagacagagggtgg

SEQ ID NO: 7679326 - DNA, 22 bp, Homo sapiens
cctggcctcagacagagggtgg

SEQ ID NO: 7679327 - DNA, 22 bp, Homo sapiens
cctggcctcagacagagggtgg

SEQ ID NO: 7679328 - DNA, 22 bp, Homo sapiens
cctggccggtatcccacctcct

SEQ ID NO: 7679329 - DNA, 22 bp, Homo sapiens
cctggcctcagcctagggctga

SEQ ID NO: 7679330 - DNA, 22 bp, Homo sapiens
cctggcctcagcctagggctga

SEQ ID NO: 7679331 - DNA, 22 bp, Homo sapiens
cctggccggtatcccacctcct

SEQ ID NO: 7679332 - DNA, 22 bp, Homo sapiens
cctggccgcggagcccttccag

SEQ ID NO: 7679333 - DNA, 22 bp, Homo sapiens
cctggccgcggagcccttccag

SEQ ID NO: 7679334 - DNA, 22 bp, Homo sapiens
cctggccgcggagcccttccag

SEQ ID NO: 7679335 - DNA, 22 bp, Homo sapiens
cctggccctggaatagggcagg

SEQ ID NO: 7679336 - DNA, 22 bp, Homo sapiens
cctggcctcgtgctcacggctc

SEQ ID NO: 7679337 - DNA, 22 bp, Homo sapiens
cctggcctcctggccttctcat

SEQ ID NO: 7679338 - DNA, 22 bp, Homo sapiens
cctggcctcgtgctcacggctc

SEQ ID NO: 7679339 - DNA, 22 bp, Homo sapiens
cctggcctcgtgctcacggctc

SEQ ID NO: 7679340 - DNA, 22 bp, Homo sapiens
cctggcctcctggccttctcat

SEQ ID NO: 7679341 - DNA, 22 bp, Homo sapiens
cctggcctcagcctagggctga

SEQ ID NO: 7679342 - DNA, 22 bp, Homo sapiens
cctggcctcctggccttctcat

SEQ ID NO: 7679343 - DNA, 22 bp, Homo sapiens
cctggcctcctggccttctcat

SEQ ID NO: 7679344 - DNA, 22 bp, Homo sapiens
cctggctcccggaacagggtct

SEQ ID NO: 7679345 - DNA, 22 bp, Homo sapiens
cctggctcccccatcatagctg

SEQ ID NO: 7679346 - DNA, 22 bp, Homo sapiens
cctggctcccggaacagggtct

SEQ ID NO: 7679347 - DNA, 22 bp, Homo sapiens
cctggctcccggaacagggtct

SEQ ID NO: 7679348 - DNA, 22 bp, Homo sapiens
cctggctcccggaacagggtct

SEQ ID NO: 7679349 - DNA, 22 bp, Homo sapiens
cctggctcccggaacagggtct

SEQ ID NO: 7679350 - DNA, 22 bp, Homo sapiens
cctggctcccccatcatagctg

SEQ ID NO: 7679351 - DNA, 22 bp, Homo sapiens
cctggctccagctgcctgtcct

SEQ ID NO: 7679352 - DNA, 22 bp, Homo sapiens
cctggctccagctgcctgtcct

SEQ ID NO: 7679353 - DNA, 22 bp, Homo sapiens
cctggctccagctgcctgtcct

SEQ ID NO: 7679354 - DNA, 22 bp, Homo sapiens
cctggctccagctgcctgtcct

SEQ ID NO: 7679355 - DNA, 22 bp, Homo sapiens
cctggctccagctgcctgtcct

SEQ ID NO: 7679356 - DNA, 22 bp, Homo sapiens
cctggctccagctgcctgtcct

SEQ ID NO: 7679357 - DNA, 22 bp, Homo sapiens
cctggctccagctgcctgtcct

SEQ ID NO: 7679358 - DNA, 22 bp, Homo sapiens
cctggctccagctgcctgtcct

SEQ ID NO: 7679359 - DNA, 21 bp, Homo sapiens
cctggctccagaacttccggt

SEQ ID NO: 7679360 - DNA, 22 bp, Homo sapiens
cctggctccaaagctgtgactc

SEQ ID NO: 7679361 - DNA, 21 bp, Homo sapiens
cctggctccagaacttccggt

SEQ ID NO: 7679362 - DNA, 21 bp, Homo sapiens
cctggctccagaacttccggt

SEQ ID NO: 7679363 - DNA, 22 bp, Homo sapiens
cctggctccaaagctgtgactc

SEQ ID NO: 7679364 - DNA, 22 bp, Homo sapiens
cctggccttaagggcagggagc

SEQ ID NO: 7679365 - DNA, 22 bp, Homo sapiens
cctggccttaagggcagggagc

SEQ ID NO: 7679366 - DNA, 22 bp, Homo sapiens
cctggccttaagggcagggagc

SEQ ID NO: 7679367 - DNA, 22 bp, Homo sapiens
cctggccttaagggcagggagc

SEQ ID NO: 7679368 - DNA, 22 bp, Homo sapiens
cctggcctgtgaatctgagagc

SEQ ID NO: 7679369 - DNA, 22 bp, Homo sapiens
cctggcctgtgaatctgagagc

SEQ ID NO: 7679370 - DNA, 22 bp, Homo sapiens
cctggcctgtgaatctgagagc

SEQ ID NO: 7679371 - DNA, 22 bp, Homo sapiens
cctggcctgtgaatctgagagc

SEQ ID NO: 7679372 - DNA, 22 bp, Homo sapiens
cctggcctgtgaatctgagagc

SEQ ID NO: 7679373 - DNA, 22 bp, Homo sapiens
cctggcctggcactccctctgc

SEQ ID NO: 7679374 - DNA, 22 bp, Homo sapiens
cctggcctggcactccctctgc

SEQ ID NO: 7679375 - DNA, 22 bp, Homo sapiens
cctggcctggcactccctctgc

SEQ ID NO: 7679376 - DNA, 22 bp, Homo sapiens
cctggcctggcactccctctgc

SEQ ID NO: 7679377 - DNA, 22 bp, Homo sapiens
cctggcctgctcggctcttaag

SEQ ID NO: 7679378 - DNA, 22 bp, Homo sapiens
cctggcctgctcggctcttaag

SEQ ID NO: 7679379 - DNA, 22 bp, Homo sapiens
cctggcctctccgagtaacctg

SEQ ID NO: 7679380 - DNA, 22 bp, Homo sapiens
tgtcctgcaattaaggaagaca

SEQ ID NO: 7679381 - DNA, 22 bp, Homo sapiens
tgtcctgcaattaaggaagaca

SEQ ID NO: 7679382 - DNA, 22 bp, Homo sapiens
tgtcctgcaattaaggaagaca

SEQ ID NO: 7679383 - DNA, 22 bp, Homo sapiens
tgtcctcttccagtgctccttc

SEQ ID NO: 7679384 - DNA, 22 bp, Homo sapiens
tgtcctcttccagtgctccttc

SEQ ID NO: 7679385 - DNA, 22 bp, Homo sapiens
tgtcctgcaactgaaggagaag

SEQ ID NO: 7679386 - DNA, 22 bp, Homo sapiens
tgtcctgcaagccctaatgaat

SEQ ID NO: 7679387 - DNA, 22 bp, Homo sapiens
tgtcctgcaagccctaatgaat

SEQ ID NO: 7679388 - DNA, 19 bp, Homo sapiens
tgtcctgctcgtgaaattc

SEQ ID NO: 7679389 - DNA, 22 bp, Homo sapiens
tgtcctgcggactatcaggctt

SEQ ID NO: 7679390 - DNA, 22 bp, Homo sapiens
tgtcctgcggactatcaggctt

SEQ ID NO: 7679391 - DNA, 22 bp, Homo sapiens
tgtcctggaaaaatggagagtt

SEQ ID NO: 7679392 - DNA, 22 bp, Homo sapiens
tgtcctggaaaaatggagagtt

SEQ ID NO: 7679393 - DNA, 22 bp, Homo sapiens
tgtcctggaaaaatggagagtt

SEQ ID NO: 7679394 - DNA, 22 bp, Homo sapiens
tgtcctgcaggctcataggctc

SEQ ID NO: 7679395 - DNA, 22 bp, Homo sapiens
tgtcctgcaggctcataggctc

SEQ ID NO: 7679396 - DNA, 22 bp, Homo sapiens
tgtcctgccagcccggactgtg

SEQ ID NO: 7679397 - DNA, 22 bp, Homo sapiens
tgtcctgccatttccatagcct

SEQ ID NO: 7679398 - DNA, 22 bp, Homo sapiens
tgtcctgccatttccatagcct

SEQ ID NO: 7679399 - DNA, 22 bp, Homo sapiens
tgtcctgcccaaggtcacatac

SEQ ID NO: 7679400 - DNA, 22 bp, Homo sapiens
tgtcctcttccagtgctccttc

SEQ ID NO: 7679401 - DNA, 22 bp, Homo sapiens
tgtcctcttccagtgctccttc

SEQ ID NO: 7679402 - DNA, 22 bp, Homo sapiens
tgtcctctgttaggggatagcg

SEQ ID NO: 7679403 - DNA, 22 bp, Homo sapiens
tgtcctggagacacaaggtggt

SEQ ID NO: 7679404 - DNA, 22 bp, Homo sapiens
tgtcctggagacacaaggtggt

SEQ ID NO: 7679405 - DNA, 22 bp, Homo sapiens
tgtcctggagacacaaggtggt

SEQ ID NO: 7679406 - DNA, 22 bp, Homo sapiens
tgtcctggacaacagcccctag

SEQ ID NO: 7679407 - DNA, 22 bp, Homo sapiens
tgtcctggacaacagcccctag

SEQ ID NO: 7679408 - DNA, 22 bp, Homo sapiens
tgtcctggacaacagcccctag

SEQ ID NO: 7679409 - DNA, 22 bp, Homo sapiens
tgtcctggaaaaatggagagtt

SEQ ID NO: 7679410 - DNA, 22 bp, Homo sapiens
tgtcctggaaaaatggagagtt

SEQ ID NO: 7679411 - DNA, 22 bp, Homo sapiens
tgtcctggagttataatgcctg

SEQ ID NO: 7679412 - DNA, 22 bp, Homo sapiens
tgtcctggagtgcttgggggaa

SEQ ID NO: 7679413 - DNA, 22 bp, Homo sapiens
tgtcctggagtgcttgggggaa

SEQ ID NO: 7679414 - DNA, 22 bp, Homo sapiens
tgtcctggagtgcttgggggaa

SEQ ID NO: 7679415 - DNA, 22 bp, Homo sapiens
tgtcctggagacacaaggtggt

SEQ ID NO: 7679416 - DNA, 22 bp, Homo sapiens
tgtcctggatcatgcctctgaa

SEQ ID NO: 7679417 - DNA, 22 bp, Homo sapiens
tgtcctggatcatgcctctgaa

SEQ ID NO: 7679418 - DNA, 22 bp, Homo sapiens
tgtcctggatcatgcctctgaa

SEQ ID NO: 7679419 - DNA, 22 bp, Homo sapiens
tgtcctggagttataatgcctg

SEQ ID NO: 7679420 - DNA, 22 bp, Homo sapiens
tgtctattcccccacctccgtt

SEQ ID NO: 7679421 - DNA, 22 bp, Homo sapiens
tgtctattcccccacctccgtt

SEQ ID NO: 7679422 - DNA, 22 bp, Homo sapiens
tgtctattttacagcatacatt

SEQ ID NO: 7679423 - DNA, 22 bp, Homo sapiens
tgtctcagaatggctcataata

SEQ ID NO: 7679424 - DNA, 21 bp, Homo sapiens
tgtctcaatcagaagtcatta

SEQ ID NO: 7679425 - DNA, 21 bp, Homo sapiens
tgtctcaatcagaagtcatta

SEQ ID NO: 7679426 - DNA, 22 bp, Homo sapiens
tgtctcaaggttactctatgat

SEQ ID NO: 7679427 - DNA, 22 bp, Homo sapiens
tgtctattcaatatccatttct

SEQ ID NO: 7679428 - DNA, 22 bp, Homo sapiens
tgtctattcccccacctccgtt

SEQ ID NO: 7679429 - DNA, 22 bp, Homo sapiens
tgtctattcccccacctccgtt

SEQ ID NO: 7679430 - DNA, 22 bp, Homo sapiens
tgtctattaacacaagaaagga

SEQ ID NO: 7679431 - DNA, 22 bp, Homo sapiens
tgtctattaacacaagaaagga

SEQ ID NO: 7679432 - DNA, 22 bp, Homo sapiens
tgtctattaattccacataaaa

SEQ ID NO: 7679433 - DNA, 22 bp, Homo sapiens
tgtcctggccaaggccttgctt

SEQ ID NO: 7679434 - DNA, 22 bp, Homo sapiens
tgtcctggccaaggccttgctt

SEQ ID NO: 7679435 - DNA, 22 bp, Homo sapiens
tgtcctggccaaggccttgctt

SEQ ID NO: 7679436 - DNA, 22 bp, Homo sapiens
tgtcctggatcatgcctctgaa

SEQ ID NO: 7679437 - DNA, 22 bp, Homo sapiens
tgtctcagaggcaggaagagcc

SEQ ID NO: 7679438 - DNA, 23 bp, Homo sapiens
tgtctcagactgaggggtttccc

SEQ ID NO: 7679439 - DNA, 22 bp, Homo sapiens
tgtctcagaggcaggaagagcc

SEQ ID NO: 7679440 - DNA, 23 bp, Homo sapiens
tgtctcagactgaggggtttccc

SEQ ID NO: 7679441 - DNA, 22 bp, Homo sapiens
tgtctcagaatggctcataata

SEQ ID NO: 7679442 - DNA, 22 bp, Homo sapiens
tgtctcagaatggctcataata

SEQ ID NO: 7679443 - DNA, 22 bp, Homo sapiens
tgtctcagagtatccctgaact

SEQ ID NO: 7679444 - DNA, 22 bp, Homo sapiens
tgtctcagagtatccctgaact

SEQ ID NO: 7679445 - DNA, 22 bp, Homo sapiens
tgtctcagatacgccatcaagg

SEQ ID NO: 7679446 - DNA, 22 bp, Homo sapiens
tgtctcagagtgttgtattaga

SEQ ID NO: 7679447 - DNA, 22 bp, Homo sapiens
tgtctcagagtgttgtattaga

SEQ ID NO: 7679448 - DNA, 18 bp, Homo sapiens
tgtctcaggctgaaacag

SEQ ID NO: 7679449 - DNA, 18 bp, Homo sapiens
tgtctcaggctgaaacag

SEQ ID NO: 7679450 - DNA, 18 bp, Homo sapiens
tgtctcaggctgaaacag

SEQ ID NO: 7679451 - DNA, 22 bp, Homo sapiens
tgtctcaggggcattgaaataa

SEQ ID NO: 7679452 - DNA, 22 bp, Homo sapiens
tgtctcaggtacatgcgtcctg

SEQ ID NO: 7679453 - DNA, 22 bp, Homo sapiens
tgtctcagggcagcagcagggg

SEQ ID NO: 7679454 - DNA, 22 bp, Homo sapiens
tgtctcagggcagcagcagggg

SEQ ID NO: 7679455 - DNA, 22 bp, Homo sapiens
tgtctcaggcccaagccagtaa

SEQ ID NO: 7679456 - DNA, 22 bp, Homo sapiens
tgtctcaggcccaagccagtaa

SEQ ID NO: 7679457 - DNA, 22 bp, Homo sapiens
tgtctcaggcccaagccagtaa

SEQ ID NO: 7679458 - DNA, 22 bp, Homo sapiens
tgtctcaggcccaagccagtaa

SEQ ID NO: 7679459 - DNA, 22 bp, Homo sapiens
tgtctcagctgtgcttcattgg

SEQ ID NO: 7679460 - DNA, 22 bp, Homo sapiens
tgtctcagctgtgcttcattgg

SEQ ID NO: 7679461 - DNA, 22 bp, Homo sapiens
tgtctcagatacgccatcaagg

SEQ ID NO: 7679462 - DNA, 22 bp, Homo sapiens
tgtctcttgagctgcctgatgc

SEQ ID NO: 7679463 - DNA, 22 bp, Homo sapiens
tgtctcttgagctgcctgatgc

SEQ ID NO: 7679464 - DNA, 22 bp, Homo sapiens
tgtctcttctgcctccagctgt

SEQ ID NO: 7679465 - DNA, 22 bp, Homo sapiens
tgtctcttgagctgcctgatgc

SEQ ID NO: 7679466 - DNA, 22 bp, Homo sapiens
tgtctcttgagtttgttttaat

SEQ ID NO: 7679467 - DNA, 22 bp, Homo sapiens
tgtctcttggagggtctagtga

SEQ ID NO: 7679468 - DNA, 22 bp, Homo sapiens
tgtctcttggctctatcactta

SEQ ID NO: 7679469 - DNA, 22 bp, Homo sapiens
tgtctcttggctctatcactta

SEQ ID NO: 7679470 - DNA, 22 bp, Homo sapiens
cctggcccacatggcttctccc

SEQ ID NO: 7679471 - DNA, 22 bp, Homo sapiens
cctggcccacatggcttctccc

SEQ ID NO: 7679472 - DNA, 22 bp, Homo sapiens
tgtctcttggattgcttgctct

SEQ ID NO: 7679473 - DNA, 22 bp, Homo sapiens
tgtctcttggctctatcactta

SEQ ID NO: 7679474 - DNA, 22 bp, Homo sapiens
tgtctcttggctctatcactta

SEQ ID NO: 7679475 - DNA, 22 bp, Homo sapiens
tgtctcttggctctatcactta

SEQ ID NO: 7679476 - DNA, 22 bp, Homo sapiens
tgtctcttactttgattcttgg

SEQ ID NO: 7679477 - DNA, 22 bp, Homo sapiens
tgtctctgtgcatttgtgcttc

SEQ ID NO: 7679478 - DNA, 22 bp, Homo sapiens
tgtctcttactttgattcttgg

SEQ ID NO: 7679479 - DNA, 22 bp, Homo sapiens
tgtctcttactttgattcttgg

SEQ ID NO: 7679480 - DNA, 22 bp, Homo sapiens
tgtctctgtgcatttgtgcttc

SEQ ID NO: 7679481 - DNA, 22 bp, Homo sapiens
tgtctctgtgagatctgacgat

SEQ ID NO: 7679482 - DNA, 22 bp, Homo sapiens
tgtctctgtgcatttgtgcttc

SEQ ID NO: 7679483 - DNA, 22 bp, Homo sapiens
tgtctctgtgcatttgtgcttc

SEQ ID NO: 7679484 - DNA, 22 bp, Homo sapiens
tgtctctgtgcatttgtgcttc

SEQ ID NO: 7679485 - DNA, 22 bp, Homo sapiens
tgtctcttcagcccatggcttc

SEQ ID NO: 7679486 - DNA, 22 bp, Homo sapiens
tgtctcttcagcccatggcttc

SEQ ID NO: 7679487 - DNA, 22 bp, Homo sapiens
tgtctcttcccactcagacccc

SEQ ID NO: 7679488 - DNA, 22 bp, Homo sapiens
tgtctcttctgcctccagctgt

SEQ ID NO: 7679489 - DNA, 22 bp, Homo sapiens
tgtctcttcccactcagacccc

SEQ ID NO: 7679490 - DNA, 22 bp, Homo sapiens
tgtctcttctgcctccagctgt

SEQ ID NO: 7679491 - DNA, 22 bp, Homo sapiens
tgtctcagtatacgaaacactt

SEQ ID NO: 7679492 - DNA, 22 bp, Homo sapiens
tgtctcaggtacatgcgtcctg

SEQ ID NO: 7679493 - DNA, 22 bp, Homo sapiens
tgtctcagtacactccgatgtt

SEQ ID NO: 7679494 - DNA, 22 bp, Homo sapiens
tgtctcagtacactccgatgtt

SEQ ID NO: 7679495 - DNA, 22 bp, Homo sapiens
tgtctcagtatacgaaacactt

SEQ ID NO: 7679496 - DNA, 22 bp, Homo sapiens
tgtctcagtatacgaaacactt

SEQ ID NO: 7679497 - DNA, 22 bp, Homo sapiens
tgtctcagttcccttctctgga

SEQ ID NO: 7679498 - DNA, 19 bp, Homo sapiens
tgtctcagtgtcccttcct

SEQ ID NO: 7679499 - DNA, 22 bp, Homo sapiens
tgtctcatctcttaaccccact

SEQ ID NO: 7679500 - DNA, 22 bp, Homo sapiens
tgtctcagttcccttctctgga

SEQ ID NO: 7679501 - DNA, 18 bp, Homo sapiens
tgtctcagttctgctatg

SEQ ID NO: 7679502 - DNA, 22 bp, Homo sapiens
tgtctcatctcttaaccccact

SEQ ID NO: 7679503 - DNA, 22 bp, Homo sapiens
tgtctcatctcttaaccccact

SEQ ID NO: 7679504 - DNA, 22 bp, Homo sapiens
tgtctcatctcttaaccccact

SEQ ID NO: 7679505 - DNA, 22 bp, Homo sapiens
tgtctccaaaacaatctcagat

SEQ ID NO: 7679506 - DNA, 22 bp, Homo sapiens
tgtctccaaaacaatctcagat

SEQ ID NO: 7679507 - DNA, 22 bp, Homo sapiens
tgtctctggcccatgagcagag

SEQ ID NO: 7679508 - DNA, 22 bp, Homo sapiens
tgtctctggctgcagcctgttc

SEQ ID NO: 7679509 - DNA, 22 bp, Homo sapiens
tgtctctgggtgattcagtcct

SEQ ID NO: 7679510 - DNA, 22 bp, Homo sapiens
tgtctctgggtgattcagtcct

SEQ ID NO: 7679511 - DNA, 22 bp, Homo sapiens
tgtctctgggtgattcagtcct

SEQ ID NO: 7679512 - DNA, 22 bp, Homo sapiens
tgtctctggtattaggtgaaaa

SEQ ID NO: 7679513 - DNA, 22 bp, Homo sapiens
tgtctctgggtgattcagtcct

SEQ ID NO: 7679514 - DNA, 22 bp, Homo sapiens
tgtctctgtcttccagggctgt

SEQ ID NO: 7679515 - DNA, 22 bp, Homo sapiens
tgtctctgtcttccagggctgt

SEQ ID NO: 7679516 - DNA, 22 bp, Homo sapiens
tgtctctgtctcccaggttgtg

SEQ ID NO: 7679517 - DNA, 22 bp, Homo sapiens
tgtctctgtgactccttccgcc

SEQ ID NO: 7679518 - DNA, 22 bp, Homo sapiens
tgtctctgtctcccaggttgtg

SEQ ID NO: 7679519 - DNA, 22 bp, Homo sapiens
tgtctctgtgagatctgacgat

SEQ ID NO: 7679520 - DNA, 22 bp, Homo sapiens
tgctcagtaagtaaacagtaac

SEQ ID NO: 7679521 - DNA, 22 bp, Homo sapiens
tgctcagtaagtaaacagtaac

SEQ ID NO: 7679522 - DNA, 22 bp, Homo sapiens
tgctcagtaagtaaacagtaac

SEQ ID NO: 7679523 - DNA, 22 bp, Homo sapiens
tgctcagtagcagtgtgctgct

SEQ ID NO: 7679524 - DNA, 22 bp, Homo sapiens
cccaggctgagttagaggtgtc

SEQ ID NO: 7679525 - DNA, 22 bp, Homo sapiens
cccaggctgagttagaggtgtc

SEQ ID NO: 7679526 - DNA, 22 bp, Homo sapiens
cccaggctgagttagaggtgtc

SEQ ID NO: 7679527 - DNA, 21 bp, Homo sapiens
tgctcagtaaatgctgagtga

SEQ ID NO: 7679528 - DNA, 22 bp, Homo sapiens
cccaggctcttatgtgacttgc

SEQ ID NO: 7679529 - DNA, 21 bp, Homo sapiens
cccaggctgaattaaaaatat

SEQ ID NO: 7679530 - DNA, 21 bp, Homo sapiens
cccaggctgaattaaaaatat

SEQ ID NO: 7679531 - DNA, 21 bp, Homo sapiens
cccaggctgaattaaaaatat

SEQ ID NO: 7679532 - DNA, 21 bp, Homo sapiens
cccaggctgaattaaaaatat

SEQ ID NO: 7679533 - DNA, 22 bp, Homo sapiens
cccaggctcttatgtgacttgc

SEQ ID NO: 7679534 - DNA, 22 bp, Homo sapiens
cccaggctcctgctgtgttgac

SEQ ID NO: 7679535 - DNA, 22 bp, Homo sapiens
cccaggctcttatgtgacttgc

SEQ ID NO: 7679536 - DNA, 22 bp, Homo sapiens
cccaggctcttatgtgacttgc

SEQ ID NO: 7679537 - DNA, 22 bp, Homo sapiens
cccaggctcttatgtgacttgc

SEQ ID NO: 7679538 - DNA, 22 bp, Homo sapiens
cccaggctcttatgtgacttgc

SEQ ID NO: 7679539 - DNA, 22 bp, Homo sapiens
cccaggctcctagaggcccaga

SEQ ID NO: 7679540 - DNA, 22 bp, Homo sapiens
cccaggctcctgactcattcta

SEQ ID NO: 7679541 - DNA, 22 bp, Homo sapiens
cccaggctcctgactcattcta

SEQ ID NO: 7679542 - DNA, 22 bp, Homo sapiens
cccaggctcctgactcattcta

SEQ ID NO: 7679543 - DNA, 22 bp, Homo sapiens
cccaggctcctagaggcccaga

SEQ ID NO: 7679544 - DNA, 22 bp, Homo sapiens
cccaggctcctgactcattcta

SEQ ID NO: 7679545 - DNA, 22 bp, Homo sapiens
cccaggctcctgactcattcta

SEQ ID NO: 7679546 - DNA, 22 bp, Homo sapiens
cccaggctcctgactcattcta

SEQ ID NO: 7679547 - DNA, 22 bp, Homo sapiens
cccaggctcctgactcattcta

SEQ ID NO: 7679548 - DNA, 22 bp, Homo sapiens
cccaggctcctgactcattcta

SEQ ID NO: 7679549 - DNA, 22 bp, Homo sapiens
cccaggctcctgctgtgttgac

SEQ ID NO: 7679550 - DNA, 22 bp, Homo sapiens
cccaggctcctgctgtgttgac

SEQ ID NO: 7679551 - DNA, 22 bp, Homo sapiens
cccaggctcctgactcattcta

SEQ ID NO: 7679552 - DNA, 22 bp, Homo sapiens
cccaggctcctgactcattcta

SEQ ID NO: 7679553 - DNA, 22 bp, Homo sapiens
cccaggctcctgctgtgttgac

SEQ ID NO: 7679554 - DNA, 22 bp, Homo sapiens
cccaggctcctgctgtgttgac

SEQ ID NO: 7679555 - DNA, 22 bp, Homo sapiens
cccaggctcctgctgtgttgac

SEQ ID NO: 7679556 - DNA, 22 bp, Homo sapiens
tgctccatgcgctcggccggcg

SEQ ID NO: 7679557 - DNA, 22 bp, Homo sapiens
tgctccattctctagccagtgc

SEQ ID NO: 7679558 - DNA, 22 bp, Homo sapiens
tgctccatgcgctcggccggcg

SEQ ID NO: 7679559 - DNA, 22 bp, Homo sapiens
tgctccatgcgctcggccggcg

SEQ ID NO: 7679560 - DNA, 22 bp, Homo sapiens
tgctccatgcgctcggccggcg

SEQ ID NO: 7679561 - DNA, 22 bp, Homo sapiens
tgctccattctctagccagtgc

SEQ ID NO: 7679562 - DNA, 22 bp, Homo sapiens
tgctccattctctagccagtgc

SEQ ID NO: 7679563 - DNA, 19 bp, Homo sapiens
tgctccattgaggtgtctc

SEQ ID NO: 7679564 - DNA, 22 bp, Homo sapiens
tgctcccaaacgacctactgtg

SEQ ID NO: 7679565 - DNA, 22 bp, Homo sapiens
tgctcccaaacgacctactgtg

SEQ ID NO: 7679566 - DNA, 22 bp, Homo sapiens
tgctccagtgcctgccccacag

SEQ ID NO: 7679567 - DNA, 22 bp, Homo sapiens
tgctccagtgcctgccccacag

SEQ ID NO: 7679568 - DNA, 22 bp, Homo sapiens
tgctccagtgcctgccccacag

SEQ ID NO: 7679569 - DNA, 22 bp, Homo sapiens
tgctccagtgcctgccccacag

SEQ ID NO: 7679570 - DNA, 22 bp, Homo sapiens
tgctccagtgcctgccccacag

SEQ ID NO: 7679571 - DNA, 22 bp, Homo sapiens
tgctccatgcgctcggccggcg

SEQ ID NO: 7679572 - DNA, 22 bp, Homo sapiens
tgctccatgcgctcggccggcg

SEQ ID NO: 7679573 - DNA, 22 bp, Homo sapiens
tgctccatgcgctcggccggcg

SEQ ID NO: 7679574 - DNA, 20 bp, Homo sapiens
tgctccatctaaagtgatta

SEQ ID NO: 7679575 - DNA, 20 bp, Homo sapiens
tgctccatctaaagtgatta

SEQ ID NO: 7679576 - DNA, 22 bp, Homo sapiens
tgctccatctctcgtggttcca

SEQ ID NO: 7679577 - DNA, 23 bp, Homo sapiens
tgctccaggtacagaactccagg

SEQ ID NO: 7679578 - DNA, 23 bp, Homo sapiens
tgctccaggtacagaactccagg

SEQ ID NO: 7679579 - DNA, 22 bp, Homo sapiens
tgctcagtaagtaaacagtaac

SEQ ID NO: 7679580 - DNA, 22 bp, Homo sapiens
tgctccagggctgccagaccct

SEQ ID NO: 7679581 - DNA, 22 bp, Homo sapiens
tgctcagtagcagtgtgctgct

SEQ ID NO: 7679582 - DNA, 22 bp, Homo sapiens
tgctccaggtgtgcctctcatg

SEQ ID NO: 7679583 - DNA, 22 bp, Homo sapiens
tgctccaggtgtgcctctcatg

SEQ ID NO: 7679584 - DNA, 22 bp, Homo sapiens
tgctccaggtgtgcctctcatg

SEQ ID NO: 7679585 - DNA, 22 bp, Homo sapiens
tgctccagtgagctggccatcc

SEQ ID NO: 7679586 - DNA, 22 bp, Homo sapiens
tgctccagtgagctggccatcc

SEQ ID NO: 7679587 - DNA, 22 bp, Homo sapiens
tgctccagtgagctggccatcc

SEQ ID NO: 7679588 - DNA, 22 bp, Homo sapiens
tgctccagtgagctggccatcc

SEQ ID NO: 7679589 - DNA, 22 bp, Homo sapiens
tgcctgggatctgtgccctttg

SEQ ID NO: 7679590 - DNA, 22 bp, Homo sapiens
tgcctgggatctgtgccctttg

SEQ ID NO: 7679591 - DNA, 22 bp, Homo sapiens
tgcctgggatctgtgccctttg

SEQ ID NO: 7679592 - DNA, 22 bp, Homo sapiens
tgcctgggcctctgaggaaggc

SEQ ID NO: 7679593 - DNA, 22 bp, Homo sapiens
tgcctgggcctctgaggaaggc

SEQ ID NO: 7679594 - DNA, 22 bp, Homo sapiens
tgcctgggcctctgaggaaggc

SEQ ID NO: 7679595 - DNA, 22 bp, Homo sapiens
tgcctgggcctctgaggaaggc

SEQ ID NO: 7679596 - DNA, 22 bp, Homo sapiens
tgcctgggcctctgaggaaggc

SEQ ID NO: 7679597 - DNA, 22 bp, Homo sapiens
tgcctgggcctctgaggaaggc

SEQ ID NO: 7679598 - DNA, 22 bp, Homo sapiens
tgcctgggccttcccacctctg

SEQ ID NO: 7679599 - DNA, 22 bp, Homo sapiens
tgcctgggccttcccacctctg

SEQ ID NO: 7679600 - DNA, 22 bp, Homo sapiens
tgcctgggccttcccacctctg

SEQ ID NO: 7679601 - DNA, 22 bp, Homo sapiens
tgcctgggccttcccacctctg

SEQ ID NO: 7679602 - DNA, 22 bp, Homo sapiens
tgcctgggctcaccgcctcttt

SEQ ID NO: 7679603 - DNA, 22 bp, Homo sapiens
tgcctgggctcaccgcctcttt

SEQ ID NO: 7679604 - DNA, 22 bp, Homo sapiens
tgcctgggccttcccacctctg

SEQ ID NO: 7679605 - DNA, 22 bp, Homo sapiens
tgcctgggccttcccacctctg

SEQ ID NO: 7679606 - DNA, 22 bp, Homo sapiens
tgcctgggccttcccacctctg

SEQ ID NO: 7679607 - DNA, 22 bp, Homo sapiens
tgcctgggctcaccgcctcttt

SEQ ID NO: 7679608 - DNA, 22 bp, Homo sapiens
tgcctgggctcaccgcctcttt

SEQ ID NO: 7679609 - DNA, 22 bp, Homo sapiens
cccaggctcctactgtattctg

SEQ ID NO: 7679610 - DNA, 22 bp, Homo sapiens
cccaggctcctagaggcccaga

SEQ ID NO: 7679611 - DNA, 22 bp, Homo sapiens
cccaggctcctagaggcccaga

SEQ ID NO: 7679612 - DNA, 22 bp, Homo sapiens
cccaggctcctactgtattctg

SEQ ID NO: 7679613 - DNA, 22 bp, Homo sapiens
cccaggctcctagaggcccaga

SEQ ID NO: 7679614 - DNA, 22 bp, Homo sapiens
cccaggctcctagaggcccaga

SEQ ID NO: 7679615 - DNA, 22 bp, Homo sapiens
cccaggctcctagaggcccaga

SEQ ID NO: 7679616 - DNA, 22 bp, Homo sapiens
cccaggctcctagaggcccaga

SEQ ID NO: 7679617 - DNA, 22 bp, Homo sapiens
cccaggctcctagaggcccaga

SEQ ID NO: 7679618 - DNA, 22 bp, Homo sapiens
cccaggctcctagaggcccaga

SEQ ID NO: 7679619 - DNA, 22 bp, Homo sapiens
tgcctgggagtgaccaagactc

SEQ ID NO: 7679620 - DNA, 22 bp, Homo sapiens
tgcctgggagtgaccaagactc

SEQ ID NO: 7679621 - DNA, 22 bp, Homo sapiens
tgcctgggagtgaccaagactc

SEQ ID NO: 7679622 - DNA, 22 bp, Homo sapiens
tgcctgggagtgaccaagactc

SEQ ID NO: 7679623 - DNA, 22 bp, Homo sapiens
tgcctgggagtgaccaagactc

SEQ ID NO: 7679624 - DNA, 22 bp, Homo sapiens
tgcctgggagtgaccaagactc

SEQ ID NO: 7679625 - DNA, 22 bp, Homo sapiens
tgcctgggactctgttatcttg

SEQ ID NO: 7679626 - DNA, 22 bp, Homo sapiens
tgcctgggacatgctgtggact

SEQ ID NO: 7679627 - DNA, 22 bp, Homo sapiens
tgcctgggacatgctgtggact

SEQ ID NO: 7679628 - DNA, 22 bp, Homo sapiens
tgcctgggactctgttatcttg

SEQ ID NO: 7679629 - DNA, 22 bp, Homo sapiens
tgcctgggactgtactaaattt

SEQ ID NO: 7679630 - DNA, 22 bp, Homo sapiens
tgcctgggactgtactaaattt

SEQ ID NO: 7679631 - DNA, 22 bp, Homo sapiens
tgcctgggactgtactaaattt

SEQ ID NO: 7679632 - DNA, 22 bp, Homo sapiens
tgcctgctctgtgccacagttg

SEQ ID NO: 7679633 - DNA, 22 bp, Homo sapiens
tgcctgctctgtgccacagttg

SEQ ID NO: 7679634 - DNA, 22 bp, Homo sapiens
tgcctgctctgtgccacagttg

SEQ ID NO: 7679635 - DNA, 22 bp, Homo sapiens
tgcctgctcttaccactctccc

SEQ ID NO: 7679636 - DNA, 20 bp, Homo sapiens
tgcctgggaaggcgtggagg

SEQ ID NO: 7679637 - DNA, 22 bp, Homo sapiens
tgcctgggaaccaatcctggct

SEQ ID NO: 7679638 - DNA, 20 bp, Homo sapiens
tgcctgggaaggcgtggagg

SEQ ID NO: 7679639 - DNA, 20 bp, Homo sapiens
tgcctgggaaggcgtggagg

SEQ ID NO: 7679640 - DNA, 20 bp, Homo sapiens
tgcctgggaaggcgtggagg

SEQ ID NO: 7679641 - DNA, 20 bp, Homo sapiens
tgcctgggaaggcgtggagg

SEQ ID NO: 7679642 - DNA, 20 bp, Homo sapiens
tgcctgggaaggcgtggagg

SEQ ID NO: 7679643 - DNA, 20 bp, Homo sapiens
tgcctgggaaggcgtggagg

SEQ ID NO: 7679644 - DNA, 22 bp, Homo sapiens
tgcctgggacatgctgtggact

SEQ ID NO: 7679645 - DNA, 22 bp, Homo sapiens
tgcctgggacatgctgtggact

SEQ ID NO: 7679646 - DNA, 22 bp, Homo sapiens
tgcctgggacatgctgtggact

SEQ ID NO: 7679647 - DNA, 22 bp, Homo sapiens
tgcctgggacatgctgtggact

SEQ ID NO: 7679648 - DNA, 22 bp, Homo sapiens
tgctgagatagctgactaggca

SEQ ID NO: 7679649 - DNA, 22 bp, Homo sapiens
tgctgagatagctgactaggca

SEQ ID NO: 7679650 - DNA, 22 bp, Homo sapiens
tgctgcacagcccgctggccca

SEQ ID NO: 7679651 - DNA, 22 bp, Homo sapiens
tgctgcacactattgtttagct

SEQ ID NO: 7679652 - DNA, 22 bp, Homo sapiens
tgctgcacaattggaaagtatc

SEQ ID NO: 7679653 - DNA, 22 bp, Homo sapiens
tgctgcacaattggaaagtatc

SEQ ID NO: 7679654 - DNA, 22 bp, Homo sapiens
tgctgcacagcccgctggccca

SEQ ID NO: 7679655 - DNA, 22 bp, Homo sapiens
tgctgcacagcccacttccctg

SEQ ID NO: 7679656 - DNA, 22 bp, Homo sapiens
tgctgcacgataaataatttct

SEQ ID NO: 7679657 - DNA, 22 bp, Homo sapiens
tgctgcacgataaataatttct

SEQ ID NO: 7679658 - DNA, 22 bp, Homo sapiens
tgctgcacccctaagtgtctct

SEQ ID NO: 7679659 - DNA, 22 bp, Homo sapiens
tgctgcactaggatttgctttc

SEQ ID NO: 7679660 - DNA, 22 bp, Homo sapiens
tgctgcactcaccaacagataa

SEQ ID NO: 7679661 - DNA, 22 bp, Homo sapiens
tgctgcactcaccaacagataa

SEQ ID NO: 7679662 - DNA, 20 bp, Homo sapiens
tgctgcagacagggccattg

SEQ ID NO: 7679663 - DNA, 22 bp, Homo sapiens
tgctgcagaaattctgtgagga

SEQ ID NO: 7679664 - DNA, 22 bp, Homo sapiens
tgctgcagaaattctgtgagga

SEQ ID NO: 7679665 - DNA, 22 bp, Homo sapiens
tgctgcagaaattctgtgagga

SEQ ID NO: 7679666 - DNA, 22 bp, Homo sapiens
tgctgcagaaattctgtgagga

SEQ ID NO: 7679667 - DNA, 22 bp, Homo sapiens
tgctgcacttatggctctgagg

SEQ ID NO: 7679668 - DNA, 22 bp, Homo sapiens
tgctgcagaaattctgtgagga

SEQ ID NO: 7679669 - DNA, 22 bp, Homo sapiens
tgctgcagaaattctgtgagga

SEQ ID NO: 7679670 - DNA, 22 bp, Homo sapiens
tgctgcagaaattctgtgagga

SEQ ID NO: 7679671 - DNA, 19 bp, Homo sapiens
tgctgactgggcctcaccg

SEQ ID NO: 7679672 - DNA, 19 bp, Homo sapiens
tgctgactgagctgcaaaa

SEQ ID NO: 7679673 - DNA, 22 bp, Homo sapiens
tgctgagaatcacaggttataa

SEQ ID NO: 7679674 - DNA, 22 bp, Homo sapiens
tgctgagaatcacaggttataa

SEQ ID NO: 7679675 - DNA, 22 bp, Homo sapiens
tgctgactcctggctgtgacac

SEQ ID NO: 7679676 - DNA, 22 bp, Homo sapiens
tgctgaccttgttctgtgagga

SEQ ID NO: 7679677 - DNA, 22 bp, Homo sapiens
tgctgaccttgttctgtgagga

SEQ ID NO: 7679678 - DNA, 22 bp, Homo sapiens
tgctgacctagaagctgatgtt

SEQ ID NO: 7679679 - DNA, 22 bp, Homo sapiens
tgctgaccttgttctgtgagga

SEQ ID NO: 7679680 - DNA, 22 bp, Homo sapiens
tgctgacctaaattgaggaaga

SEQ ID NO: 7679681 - DNA, 22 bp, Homo sapiens
tgctgacctaaattgaggaaga

SEQ ID NO: 7679682 - DNA, 22 bp, Homo sapiens
tgctgagataagctatgaccag

SEQ ID NO: 7679683 - DNA, 22 bp, Homo sapiens
tgctgagaggaaggtgcactgg

SEQ ID NO: 7679684 - DNA, 22 bp, Homo sapiens
tgctgagaggaaggtgcactgg

SEQ ID NO: 7679685 - DNA, 22 bp, Homo sapiens
tgctgagaggaaggtgcactgg

SEQ ID NO: 7679686 - DNA, 22 bp, Homo sapiens
tgctgagaggaaagaatgcaca

SEQ ID NO: 7679687 - DNA, 22 bp, Homo sapiens
tgctgagagatttaaagggcca

SEQ ID NO: 7679688 - DNA, 22 bp, Homo sapiens
tgctgagagccagggctggcat

SEQ ID NO: 7679689 - DNA, 22 bp, Homo sapiens
tgctgagagccagggctggcat

SEQ ID NO: 7679690 - DNA, 22 bp, Homo sapiens
tgctgagacacctaaggtaaat

SEQ ID NO: 7679691 - DNA, 22 bp, Homo sapiens
tgctgagacagtggataggggc

SEQ ID NO: 7679692 - DNA, 21 bp, Homo sapiens
tgctgacatcaggtctgctat

SEQ ID NO: 7679693 - DNA, 21 bp, Homo sapiens
tgctgacatcaggtctgctat

SEQ ID NO: 7679694 - DNA, 22 bp, Homo sapiens
tgctgacaaaggaacaatactc

SEQ ID NO: 7679695 - DNA, 19 bp, Homo sapiens
tgctgacactagatgtgca

SEQ ID NO: 7679696 - DNA, 22 bp, Homo sapiens
tgctgaattaaactctatgtgg

SEQ ID NO: 7679697 - DNA, 22 bp, Homo sapiens
tgctgaattggtagtactgttg

SEQ ID NO: 7679698 - DNA, 22 bp, Homo sapiens
tgctgaatgggatatgttgagc

SEQ ID NO: 7679699 - DNA, 22 bp, Homo sapiens
tgctgaatgggatatgttgagc

SEQ ID NO: 7679700 - DNA, 21 bp, Homo sapiens
tgctgaatctgccatattttc

SEQ ID NO: 7679701 - DNA, 22 bp, Homo sapiens
tgctgaatgggatatgttgagc

SEQ ID NO: 7679702 - DNA, 22 bp, Homo sapiens
tgctgaattaaactctatgtgg

SEQ ID NO: 7679703 - DNA, 19 bp, Homo sapiens
tgctgaagttgtcagtctg

SEQ ID NO: 7679704 - DNA, 22 bp, Homo sapiens
tgctgaataataagattactca

SEQ ID NO: 7679705 - DNA, 22 bp, Homo sapiens
tgctgaataagacgtggcttgt

SEQ ID NO: 7679706 - DNA, 22 bp, Homo sapiens
tgctgaataaagatatattttc

SEQ ID NO: 7679707 - DNA, 22 bp, Homo sapiens
tgctgaataataagattactca

SEQ ID NO: 7679708 - DNA, 21 bp, Homo sapiens
tgctgaatctgccatattttc

SEQ ID NO: 7679709 - DNA, 22 bp, Homo sapiens
tgctgaatcccaccctccagtg

SEQ ID NO: 7679710 - DNA, 22 bp, Homo sapiens
tgctgaatgctgcatgccgtat

SEQ ID NO: 7679711 - DNA, 20 bp, Homo sapiens
cccagggacctgagctccat

SEQ ID NO: 7679712 - DNA, 22 bp, Homo sapiens
tgctcccagctgtaggaatgtt

SEQ ID NO: 7679713 - DNA, 20 bp, Homo sapiens
cccagggacctgagctccat

SEQ ID NO: 7679714 - DNA, 22 bp, Homo sapiens
tgctcccagctgtaggaatgtt

SEQ ID NO: 7679715 - DNA, 17 bp, Homo sapiens
cccagggaccactgctt

SEQ ID NO: 7679716 - DNA, 22 bp, Homo sapiens
tgctcccacactactcggaggc

SEQ ID NO: 7679717 - DNA, 22 bp, Homo sapiens
tgctcccacactactcggaggc

SEQ ID NO: 7679718 - DNA, 22 bp, Homo sapiens
tgctcccacactactcggaggc

SEQ ID NO: 7679719 - DNA, 22 bp, Homo sapiens
tgctcccaaacgacctactgtg

SEQ ID NO: 7679720 - DNA, 22 bp, Homo sapiens
tgctcccacactactcggaggc

SEQ ID NO: 7679721 - DNA, 22 bp, Homo sapiens
tgctcccagctcctgcagcaac

SEQ ID NO: 7679722 - DNA, 22 bp, Homo sapiens
tgctcccagctcctgcagcaac

SEQ ID NO: 7679723 - DNA, 22 bp, Homo sapiens
tgctcccagctcctgcagcaac

SEQ ID NO: 7679724 - DNA, 22 bp, Homo sapiens
tgctcccagctcctgcagcaac

SEQ ID NO: 7679725 - DNA, 22 bp, Homo sapiens
cccagggagcttggagaacggg

SEQ ID NO: 7679726 - DNA, 22 bp, Homo sapiens
cccagggagcttggagaacggg

SEQ ID NO: 7679727 - DNA, 22 bp, Homo sapiens
cccagggagcttggagaacggg

SEQ ID NO: 7679728 - DNA, 22 bp, Homo sapiens
cccagggagcttggagaacggg

SEQ ID NO: 7679729 - DNA, 22 bp, Homo sapiens
cccagggagcttggagaacggg

SEQ ID NO: 7679730 - DNA, 22 bp, Homo sapiens
cccagggagcttggagaacggg

SEQ ID NO: 7679731 - DNA, 22 bp, Homo sapiens
cccagggaggcccaggctctgc

SEQ ID NO: 7679732 - DNA, 22 bp, Homo sapiens
cccagggaggcccaggctctgc

SEQ ID NO: 7679733 - DNA, 22 bp, Homo sapiens
cccagggaggcccaggctctgc

SEQ ID NO: 7679734 - DNA, 22 bp, Homo sapiens
cccagggaggcccaggctctgc

SEQ ID NO: 7679735 - DNA, 22 bp, Homo sapiens
cccagggactcgggattctagg

SEQ ID NO: 7679736 - DNA, 22 bp, Homo sapiens
cccagggactcgggattctagg

SEQ ID NO: 7679737 - DNA, 22 bp, Homo sapiens
cccagggactcgggattctagg

SEQ ID NO: 7679738 - DNA, 22 bp, Homo sapiens
cccagggagagcgcggaggcgg

SEQ ID NO: 7679739 - DNA, 22 bp, Homo sapiens
cccagggagagcgcggaggcgg

SEQ ID NO: 7679740 - DNA, 22 bp, Homo sapiens
cccagggagagcgcggaggcgg

SEQ ID NO: 7679741 - DNA, 22 bp, Homo sapiens
cccagggagagcgcggaggcgg

SEQ ID NO: 7679742 - DNA, 22 bp, Homo sapiens
cccagggagagcgcggaggcgg

SEQ ID NO: 7679743 - DNA, 22 bp, Homo sapiens
cccagggagagcgcggaggcgg

SEQ ID NO: 7679744 - DNA, 22 bp, Homo sapiens
cccagggatgtggcagatgtta

SEQ ID NO: 7679745 - DNA, 22 bp, Homo sapiens
cccagggatgtggcagatgtta

SEQ ID NO: 7679746 - DNA, 22 bp, Homo sapiens
cccagggatgtggcagatgtta

SEQ ID NO: 7679747 - DNA, 22 bp, Homo sapiens
cccagggaggtagcaggagaaa

SEQ ID NO: 7679748 - DNA, 22 bp, Homo sapiens
cccagggaggtagcaggagaaa

SEQ ID NO: 7679749 - DNA, 22 bp, Homo sapiens
cccagggatgtggcagatgtta

SEQ ID NO: 7679750 - DNA, 22 bp, Homo sapiens
cccagggatgtggcagatgtta

SEQ ID NO: 7679751 - DNA, 22 bp, Homo sapiens
cccagggatgtggcagatgtta

SEQ ID NO: 7679752 - DNA, 22 bp, Homo sapiens
cccagggatgtggcagatgtta

SEQ ID NO: 7679753 - DNA, 22 bp, Homo sapiens
cccagggaggtagcaggagaaa

SEQ ID NO: 7679754 - DNA, 22 bp, Homo sapiens
cccagggaggtagcaggagaaa

SEQ ID NO: 7679755 - DNA, 22 bp, Homo sapiens
cccagggaggtagcaggagaaa

SEQ ID NO: 7679756 - DNA, 22 bp, Homo sapiens
cccagggaggtagcaggagaaa

SEQ ID NO: 7679757 - DNA, 22 bp, Homo sapiens
cccagggaggtagcaggagaaa

SEQ ID NO: 7679758 - DNA, 22 bp, Homo sapiens
cccagggaggtagcaggagaaa

SEQ ID NO: 7679759 - DNA, 22 bp, Homo sapiens
cccagggaggtagcaggagaaa

SEQ ID NO: 7679760 - DNA, 22 bp, Homo sapiens
cccagggaggtagcaggagaaa

SEQ ID NO: 7679761 - DNA, 22 bp, Homo sapiens
cccagggaggtagcaggagaaa

SEQ ID NO: 7679762 - DNA, 22 bp, Homo sapiens
cccagggattataaaggtgaaa

SEQ ID NO: 7679763 - DNA, 22 bp, Homo sapiens
cccagggattataaaggtgaaa

SEQ ID NO: 7679764 - DNA, 22 bp, Homo sapiens
cccagggattataaaggtgaaa

SEQ ID NO: 7679765 - DNA, 22 bp, Homo sapiens
tgctctggagtggcttgtgcac

SEQ ID NO: 7679766 - DNA, 22 bp, Homo sapiens
cccagggattataaaggtgaaa

SEQ ID NO: 7679767 - DNA, 22 bp, Homo sapiens
cccagggaggcccaggctctgc

SEQ ID NO: 7679768 - DNA, 22 bp, Homo sapiens
cccagggatgtggcagatgtta

SEQ ID NO: 7679769 - DNA, 22 bp, Homo sapiens
tgctctggagtggcttgtgcac

SEQ ID NO: 7679770 - DNA, 22 bp, Homo sapiens
tgctctggagtggcttgtgcac

SEQ ID NO: 7679771 - DNA, 22 bp, Homo sapiens
tgctctggagtggcttgtgcac

SEQ ID NO: 7679772 - DNA, 22 bp, Homo sapiens
tgctctggagtggcttgtgcac

SEQ ID NO: 7679773 - DNA, 23 bp, Homo sapiens
tgctgaagtgttggccctgccca

SEQ ID NO: 7679774 - DNA, 22 bp, Homo sapiens
tgctgaagttactagagactat

SEQ ID NO: 7679775 - DNA, 22 bp, Homo sapiens
tgctctggctggagcaatgact

SEQ ID NO: 7679776 - DNA, 22 bp, Homo sapiens
tgctctggagtggcttgtgcac

SEQ ID NO: 7679777 - DNA, 22 bp, Homo sapiens
tgctgaagtccatctgtttgac

SEQ ID NO: 7679778 - DNA, 22 bp, Homo sapiens
tgctgaagtccatctgtttgac

SEQ ID NO: 7679779 - DNA, 22 bp, Homo sapiens
ccccagccttccatgggaattg

SEQ ID NO: 7679780 - DNA, 22 bp, Homo sapiens
ccccagccttccatgggaattg

SEQ ID NO: 7679781 - DNA, 22 bp, Homo sapiens
ccccagcccacaagcatattaa

SEQ ID NO: 7679782 - DNA, 22 bp, Homo sapiens
ccccagccttccatgggaattg

SEQ ID NO: 7679783 - DNA, 22 bp, Homo sapiens
ccccagcccacaagcatattaa

SEQ ID NO: 7679784 - DNA, 22 bp, Homo sapiens
ccccagcccacaagcatattaa

SEQ ID NO: 7679785 - DNA, 22 bp, Homo sapiens
ccccagccagcttgtagtagaa

SEQ ID NO: 7679786 - DNA, 22 bp, Homo sapiens
ccccagccttccatgggaattg

SEQ ID NO: 7679787 - DNA, 22 bp, Homo sapiens
ccccagcccacaagcatattaa

SEQ ID NO: 7679788 - DNA, 23 bp, Homo sapiens
tgctggagacaagtgtgagaagg

SEQ ID NO: 7679789 - DNA, 22 bp, Homo sapiens
ccccagccttccatgggaattg

SEQ ID NO: 7679790 - DNA, 22 bp, Homo sapiens
ccccagctcagtgcagggacat

SEQ ID NO: 7679791 - DNA, 22 bp, Homo sapiens
ccccagctcagtgcagggacat

SEQ ID NO: 7679792 - DNA, 23 bp, Homo sapiens
tgctggagacaagtgtgagaagg

SEQ ID NO: 7679793 - DNA, 23 bp, Homo sapiens
tgctggagacaagtgtgagaagg

SEQ ID NO: 7679794 - DNA, 22 bp, Homo sapiens
tgctggagacatagcaggcagc

SEQ ID NO: 7679795 - DNA, 22 bp, Homo sapiens
tgctggagacctgcttgcacca

SEQ ID NO: 7679796 - DNA, 22 bp, Homo sapiens
tgctggagacctgcttgcacca

SEQ ID NO: 7679797 - DNA, 22 bp, Homo sapiens
tgctggagacatagcaggcagc

SEQ ID NO: 7679798 - DNA, 22 bp, Homo sapiens
tgctggagacatagcaggcagc

SEQ ID NO: 7679799 - DNA, 22 bp, Homo sapiens
tgctggagacatagcaggcagc

SEQ ID NO: 7679800 - DNA, 22 bp, Homo sapiens
tgctggagacatagcaggcagc

SEQ ID NO: 7679801 - DNA, 22 bp, Homo sapiens
tgctggagagccttggccaagg

SEQ ID NO: 7679802 - DNA, 22 bp, Homo sapiens
tgctggagactcactcaggtgc

SEQ ID NO: 7679803 - DNA, 22 bp, Homo sapiens
tgctggagactcactcaggtgc

SEQ ID NO: 7679804 - DNA, 22 bp, Homo sapiens
tgctggagactcactcaggtgc

SEQ ID NO: 7679805 - DNA, 22 bp, Homo sapiens
tgctggagacctgcttgcacca

SEQ ID NO: 7679806 - DNA, 22 bp, Homo sapiens
tgctggagacctgcttgcacca

SEQ ID NO: 7679807 - DNA, 22 bp, Homo sapiens
tgctggagacctgcttgcacca

SEQ ID NO: 7679808 - DNA, 22 bp, Homo sapiens
tgctggagacctgcttgcacca

SEQ ID NO: 7679809 - DNA, 22 bp, Homo sapiens
ccccagggaagctttgcttact

SEQ ID NO: 7679810 - DNA, 22 bp, Homo sapiens
ccccaggcctgttggatggcgc

SEQ ID NO: 7679811 - DNA, 22 bp, Homo sapiens
ccccaggcctgttggatggcgc

SEQ ID NO: 7679812 - DNA, 22 bp, Homo sapiens
ccccaggcctgttggatggcgc

SEQ ID NO: 7679813 - DNA, 22 bp, Homo sapiens
tgctggagcatctgagagcatc

SEQ ID NO: 7679814 - DNA, 22 bp, Homo sapiens
tgctggagcccaggcggccttt

SEQ ID NO: 7679815 - DNA, 22 bp, Homo sapiens
tgctggagcaacattattgtgc

SEQ ID NO: 7679816 - DNA, 22 bp, Homo sapiens
tgctggagcatctgagagcatc

SEQ ID NO: 7679817 - DNA, 22 bp, Homo sapiens
tgctggagcatctgagagcatc

SEQ ID NO: 7679818 - DNA, 22 bp, Homo sapiens
tgctggagcatctgagagcatc

SEQ ID NO: 7679819 - DNA, 22 bp, Homo sapiens
tgctggagcatctgagagcatc

SEQ ID NO: 7679820 - DNA, 22 bp, Homo sapiens
tgctggagatcattaatgttca

SEQ ID NO: 7679821 - DNA, 22 bp, Homo sapiens
tgctggagatcattaatgttca

SEQ ID NO: 7679822 - DNA, 22 bp, Homo sapiens
tgctggagatcattaatgttca

SEQ ID NO: 7679823 - DNA, 22 bp, Homo sapiens
tgctggagaggaaggtggggtc

SEQ ID NO: 7679824 - DNA, 22 bp, Homo sapiens
tgctggagatgaaagggccctg

SEQ ID NO: 7679825 - DNA, 22 bp, Homo sapiens
tgctggagatgaaagggccctg

SEQ ID NO: 7679826 - DNA, 22 bp, Homo sapiens
tgctggagatgaaagggccctg

SEQ ID NO: 7679827 - DNA, 22 bp, Homo sapiens
tgctggagatgaaagggccctg

SEQ ID NO: 7679828 - DNA, 22 bp, Homo sapiens
tgctggagagctagttctgcag

SEQ ID NO: 7679829 - DNA, 22 bp, Homo sapiens
tgctggagagctagttctgcag

SEQ ID NO: 7679830 - DNA, 22 bp, Homo sapiens
tgctggagagctagttctgcag

SEQ ID NO: 7679831 - DNA, 22 bp, Homo sapiens
tgctggagaggaaggtggggtc

SEQ ID NO: 7679832 - DNA, 22 bp, Homo sapiens
tgctggagagctagttctgcag

SEQ ID NO: 7679833 - DNA, 22 bp, Homo sapiens
tgctggagagccttggccaagg

SEQ ID NO: 7679834 - DNA, 22 bp, Homo sapiens
tgctggagagctagttctgcag

SEQ ID NO: 7679835 - DNA, 22 bp, Homo sapiens
tgctggagagccttggccaagg

SEQ ID NO: 7679836 - DNA, 22 bp, Homo sapiens
ccccagccagcttgtagtagaa

SEQ ID NO: 7679837 - DNA, 22 bp, Homo sapiens
ccccagccagcttgtagtagaa

SEQ ID NO: 7679838 - DNA, 22 bp, Homo sapiens
ccccagccagcttgtagtagaa

SEQ ID NO: 7679839 - DNA, 22 bp, Homo sapiens
ccccagccagcttgtagtagaa

SEQ ID NO: 7679840 - DNA, 22 bp, Homo sapiens
ccccagccagcaggacctctga

SEQ ID NO: 7679841 - DNA, 22 bp, Homo sapiens
ccccagccagcaggacctctga

SEQ ID NO: 7679842 - DNA, 22 bp, Homo sapiens
ccccagccagcaggacctctga

SEQ ID NO: 7679843 - DNA, 22 bp, Homo sapiens
ccccagccagcaggacctctga

SEQ ID NO: 7679844 - DNA, 22 bp, Homo sapiens
ccccagccagcaggacctctga

SEQ ID NO: 7679845 - DNA, 22 bp, Homo sapiens
ccccagccagcaggacctctga

SEQ ID NO: 7679846 - DNA, 22 bp, Homo sapiens
ccccagccagcaggacctctga

SEQ ID NO: 7679847 - DNA, 22 bp, Homo sapiens
ccccagcatatcatggtttcgt

SEQ ID NO: 7679848 - DNA, 22 bp, Homo sapiens
ccccagccagcaggacctctga

SEQ ID NO: 7679849 - DNA, 22 bp, Homo sapiens
ccccagccagcaggacctctga

SEQ ID NO: 7679850 - DNA, 22 bp, Homo sapiens
ccccagccagcaggacctctga

SEQ ID NO: 7679851 - DNA, 23 bp, Homo sapiens
ccccactaccgtgatgtgcgagg

SEQ ID NO: 7679852 - DNA, 22 bp, Homo sapiens
ccccactctcggccagataggc

SEQ ID NO: 7679853 - DNA, 22 bp, Homo sapiens
ccccactctcggccagataggc

SEQ ID NO: 7679854 - DNA, 22 bp, Homo sapiens
ccccagcagactcagggcaggt

SEQ ID NO: 7679855 - DNA, 22 bp, Homo sapiens
ccccagcagactcagggcaggt

SEQ ID NO: 7679856 - DNA, 22 bp, Homo sapiens
ccccagcagactcagggcaggt

SEQ ID NO: 7679857 - DNA, 22 bp, Homo sapiens
ccccagcagactcagggcaggt

SEQ ID NO: 7679858 - DNA, 22 bp, Homo sapiens
ccccagcagcacctggggcagt

SEQ ID NO: 7679859 - DNA, 22 bp, Homo sapiens
ccccagcagcacctggggcagt

SEQ ID NO: 7679860 - DNA, 22 bp, Homo sapiens
ccccagcaggaatacaggggtc

SEQ ID NO: 7679861 - DNA, 22 bp, Homo sapiens
ccccagcaggaatacaggggtc

SEQ ID NO: 7679862 - DNA, 22 bp, Homo sapiens
ccccagcagcacctggggcagt

SEQ ID NO: 7679863 - DNA, 22 bp, Homo sapiens
ccccagcaggaatacaggggtc

SEQ ID NO: 7679864 - DNA, 22 bp, Homo sapiens
ccccagcagcacctggggcagt

SEQ ID NO: 7679865 - DNA, 22 bp, Homo sapiens
ccccagcagcacctggggcagt

SEQ ID NO: 7679866 - DNA, 18 bp, Homo sapiens
ccccagcagtgtggtgcc

SEQ ID NO: 7679867 - DNA, 18 bp, Homo sapiens
ccccagcagtgtggtgcc

SEQ ID NO: 7679868 - DNA, 18 bp, Homo sapiens
ccccagcagtgtggtgcc

SEQ ID NO: 7679869 - DNA, 22 bp, Homo sapiens
ccccagccagcaggacctctga

SEQ ID NO: 7679870 - DNA, 22 bp, Homo sapiens
ccccagcatatcatggtttcgt

SEQ ID NO: 7679871 - DNA, 22 bp, Homo sapiens
ccccagcatatcatggtttcgt

SEQ ID NO: 7679872 - DNA, 22 bp, Homo sapiens
tgctgcaggaacttaagaagct

SEQ ID NO: 7679873 - DNA, 22 bp, Homo sapiens
tgctgcagctttgtcacatgca

SEQ ID NO: 7679874 - DNA, 22 bp, Homo sapiens
tgctgcaggaacttaagaagct

SEQ ID NO: 7679875 - DNA, 22 bp, Homo sapiens
tgctgcagctttgtcacatgca

SEQ ID NO: 7679876 - DNA, 22 bp, Homo sapiens
tgctgcagctttgtcacatgca

SEQ ID NO: 7679877 - DNA, 22 bp, Homo sapiens
tgctgcagctttgtcacatgca

SEQ ID NO: 7679878 - DNA, 22 bp, Homo sapiens
tgctgcagctaaggtgaggtgc

SEQ ID NO: 7679879 - DNA, 22 bp, Homo sapiens
tgctgcaggaattctcaaggga

SEQ ID NO: 7679880 - DNA, 22 bp, Homo sapiens
tgctgcaggaattctcaaggga

SEQ ID NO: 7679881 - DNA, 22 bp, Homo sapiens
tgctgcaggaattctcaaggga

SEQ ID NO: 7679882 - DNA, 19 bp, Homo sapiens
tgctgcaggatgctgctgg

SEQ ID NO: 7679883 - DNA, 22 bp, Homo sapiens
ccccaccttgcaattgttccct

SEQ ID NO: 7679884 - DNA, 22 bp, Homo sapiens
ccccactctcggccagataggc

SEQ ID NO: 7679885 - DNA, 19 bp, Homo sapiens
tgctgcaggatgctgctgg

SEQ ID NO: 7679886 - DNA, 19 bp, Homo sapiens
tgctgcaggatgctgctgg

SEQ ID NO: 7679887 - DNA, 22 bp, Homo sapiens
tgctgcagcggcatggtctttg

SEQ ID NO: 7679888 - DNA, 22 bp, Homo sapiens
tgctgcagcggcatggtctttg

SEQ ID NO: 7679889 - DNA, 22 bp, Homo sapiens
tgctgcagcggcatggtctttg

SEQ ID NO: 7679890 - DNA, 22 bp, Homo sapiens
tgctgcagctaaggtgaggtgc

SEQ ID NO: 7679891 - DNA, 22 bp, Homo sapiens
tgctgcagctaaggtgaggtgc

SEQ ID NO: 7679892 - DNA, 22 bp, Homo sapiens
tgctgcagctaaggtgaggtgc

SEQ ID NO: 7679893 - DNA, 22 bp, Homo sapiens
tgctgcagcagtgcgggcagct

SEQ ID NO: 7679894 - DNA, 22 bp, Homo sapiens
tgctgcagcagtgcgggcagct

SEQ ID NO: 7679895 - DNA, 22 bp, Homo sapiens
tgctgcagattgcagattaact

SEQ ID NO: 7679896 - DNA, 22 bp, Homo sapiens
tgctgcagatcagctgagtcct

SEQ ID NO: 7679897 - DNA, 22 bp, Homo sapiens
tgctgcagacgaagcccatgcc

SEQ ID NO: 7679898 - DNA, 17 bp, Homo sapiens
tgctgcagacccacccc

SEQ ID NO: 7679899 - DNA, 22 bp, Homo sapiens
tgctgcagacgaagcccatgcc

SEQ ID NO: 7679900 - DNA, 22 bp, Homo sapiens
tgctgcagacgaagcccatgcc

SEQ ID NO: 7679901 - DNA, 22 bp, Homo sapiens
tgctgcagatcagctgagtcct

SEQ ID NO: 7679902 - DNA, 22 bp, Homo sapiens
tgctgcagatcagctgagtcct

SEQ ID NO: 7679903 - DNA, 22 bp, Homo sapiens
tgctgcagagaatgttttggcc

SEQ ID NO: 7679904 - DNA, 22 bp, Homo sapiens
tgctgcagatcagctgagtcct

SEQ ID NO: 7679905 - DNA, 22 bp, Homo sapiens
tgctgcagatcagctgagtcct

SEQ ID NO: 7679906 - DNA, 22 bp, Homo sapiens
tgctgcagatcagctgagtcct

SEQ ID NO: 7679907 - DNA, 22 bp, Homo sapiens
cccccaggggctccgcctcgtg

SEQ ID NO: 7679908 - DNA, 22 bp, Homo sapiens
cccccaggctctgacacaggag

SEQ ID NO: 7679909 - DNA, 22 bp, Homo sapiens
cccccaggggctccgcctcgtg

SEQ ID NO: 7679910 - DNA, 22 bp, Homo sapiens
cccccaggctctgacacaggag

SEQ ID NO: 7679911 - DNA, 22 bp, Homo sapiens
cccccaggggctccgcctcgtg

SEQ ID NO: 7679912 - DNA, 22 bp, Homo sapiens
cccccaggggctccgcctcgtg

SEQ ID NO: 7679913 - DNA, 22 bp, Homo sapiens
cccccaggggctccgcctcgtg

SEQ ID NO: 7679914 - DNA, 22 bp, Homo sapiens
cccccaggctctgacacaggag

SEQ ID NO: 7679915 - DNA, 22 bp, Homo sapiens
cccccaggctctgacacaggag

SEQ ID NO: 7679916 - DNA, 22 bp, Homo sapiens
cccccaggctctgacacaggag

SEQ ID NO: 7679917 - DNA, 22 bp, Homo sapiens
cccccaggctctgacacaggag

SEQ ID NO: 7679918 - DNA, 22 bp, Homo sapiens
cccccatccatgtcaggagagg

SEQ ID NO: 7679919 - DNA, 22 bp, Homo sapiens
cccccagtctgaacagcagctg

SEQ ID NO: 7679920 - DNA, 22 bp, Homo sapiens
cccccaggggctccgcctcgtg

SEQ ID NO: 7679921 - DNA, 22 bp, Homo sapiens
ccccctgcgcccggcacgtcat

SEQ ID NO: 7679922 - DNA, 22 bp, Homo sapiens
ccccctgcgcccggcacgtcat

SEQ ID NO: 7679923 - DNA, 22 bp, Homo sapiens
ccccctctgccggggtccttca

SEQ ID NO: 7679924 - DNA, 22 bp, Homo sapiens
ccccctctgccggggtccttca

SEQ ID NO: 7679925 - DNA, 22 bp, Homo sapiens
ccccctctgccggggtccttca

SEQ ID NO: 7679926 - DNA, 22 bp, Homo sapiens
ccccctctgccggggtccttca

SEQ ID NO: 7679927 - DNA, 22 bp, Homo sapiens
cccccatccatgtcaggagagg

SEQ ID NO: 7679928 - DNA, 22 bp, Homo sapiens
cccccggagctggggctcagct

SEQ ID NO: 7679929 - DNA, 22 bp, Homo sapiens
cccctacacacccctcttggca

SEQ ID NO: 7679930 - DNA, 17 bp, Homo sapiens
cccctacctccgtttga

SEQ ID NO: 7679931 - DNA, 22 bp, Homo sapiens
cccctaggaggcgatggtggaa

SEQ ID NO: 7679932 - DNA, 16 bp, Homo sapiens
cccctcaggaagtaca

SEQ ID NO: 7679933 - DNA, 22 bp, Homo sapiens
ccccgaggctggagtgcagtgg

SEQ ID NO: 7679934 - DNA, 22 bp, Homo sapiens
ccccctggcaggctggcctctc

SEQ ID NO: 7679935 - DNA, 22 bp, Homo sapiens
ccccctggcaggctggcctctc

SEQ ID NO: 7679936 - DNA, 22 bp, Homo sapiens
ccccctggcaggctggcctctc

SEQ ID NO: 7679937 - DNA, 22 bp, Homo sapiens
cccctcataggtcagacacgca

SEQ ID NO: 7679938 - DNA, 22 bp, Homo sapiens
cccctcattcatgtccttgctt

SEQ ID NO: 7679939 - DNA, 22 bp, Homo sapiens
cccctcattcatgtccttgctt

SEQ ID NO: 7679940 - DNA, 21 bp, Homo sapiens
cccctcatacactctccttgc

SEQ ID NO: 7679941 - DNA, 21 bp, Homo sapiens
cccctcatacactctccttgc

SEQ ID NO: 7679942 - DNA, 21 bp, Homo sapiens
cccctcatacactctccttgc

SEQ ID NO: 7679943 - DNA, 22 bp, Homo sapiens
cccctcaggtacccgtgcagca

SEQ ID NO: 7679944 - DNA, 22 bp, Homo sapiens
cccctcaggtacccgtgcagca

SEQ ID NO: 7679945 - DNA, 22 bp, Homo sapiens
cccctcaggtacccgtgcagca

SEQ ID NO: 7679946 - DNA, 22 bp, Homo sapiens
cccctcaggtacccgtgcagca

SEQ ID NO: 7679947 - DNA, 21 bp, Homo sapiens
cccctcatacactctccttgc

SEQ ID NO: 7679948 - DNA, 22 bp, Homo sapiens
cccccaggctctgacacaggag

SEQ ID NO: 7679949 - DNA, 22 bp, Homo sapiens
cccccagctctgctgggtcccg

SEQ ID NO: 7679950 - DNA, 22 bp, Homo sapiens
cccccagctctgctgggtcccg

SEQ ID NO: 7679951 - DNA, 22 bp, Homo sapiens
cccccagccagcagtgctcagc

SEQ ID NO: 7679952 - DNA, 22 bp, Homo sapiens
cccccagctctgctgggtcccg

SEQ ID NO: 7679953 - DNA, 22 bp, Homo sapiens
cccccagctctgctgggtcccg

SEQ ID NO: 7679954 - DNA, 22 bp, Homo sapiens
cccccagccagcagtgctcagc

SEQ ID NO: 7679955 - DNA, 22 bp, Homo sapiens
cccccagccagcagtgctcagc

SEQ ID NO: 7679956 - DNA, 22 bp, Homo sapiens
cccccagatgcgagccatagcc

SEQ ID NO: 7679957 - DNA, 22 bp, Homo sapiens
cccccagatgcgagccatagcc

SEQ ID NO: 7679958 - DNA, 22 bp, Homo sapiens
cccccagatgcgagccatagcc

SEQ ID NO: 7679959 - DNA, 22 bp, Homo sapiens
cccccagccagcagtgctcagc

SEQ ID NO: 7679960 - DNA, 22 bp, Homo sapiens
cccccagccagcagtgctcagc

SEQ ID NO: 7679961 - DNA, 18 bp, Homo sapiens
cccccagccaaattctct

SEQ ID NO: 7679962 - DNA, 18 bp, Homo sapiens
cccccagccaaattctct

SEQ ID NO: 7679963 - DNA, 18 bp, Homo sapiens
cccccagccaaattctct

SEQ ID NO: 7679964 - DNA, 22 bp, Homo sapiens
cccccagatgcgagccatagcc

SEQ ID NO: 7679965 - DNA, 22 bp, Homo sapiens
cccccagatgcgagccatagcc

SEQ ID NO: 7679966 - DNA, 22 bp, Homo sapiens
cccccaccgtgttcctgctcgg

SEQ ID NO: 7679967 - DNA, 22 bp, Homo sapiens
cccccaccgtgttcctgctcgg

SEQ ID NO: 7679968 - DNA, 22 bp, Homo sapiens
cccccaccgtgttcctgctcgg

SEQ ID NO: 7679969 - DNA, 22 bp, Homo sapiens
cccccaccgtgttcctgctcgg

SEQ ID NO: 7679970 - DNA, 22 bp, Homo sapiens
cccccaaggccaggctgagacc

SEQ ID NO: 7679971 - DNA, 22 bp, Homo sapiens
cccccaaggccaggctgagacc

SEQ ID NO: 7679972 - DNA, 22 bp, Homo sapiens
cccccaaagtttgcacggataa

SEQ ID NO: 7679973 - DNA, 22 bp, Homo sapiens
cccccaaagtttgcacggataa

SEQ ID NO: 7679974 - DNA, 22 bp, Homo sapiens
ccccagggaagctttgcttact

SEQ ID NO: 7679975 - DNA, 22 bp, Homo sapiens
cccccacctgaggacagtctta

SEQ ID NO: 7679976 - DNA, 22 bp, Homo sapiens
cccccacctgaggacagtctta

SEQ ID NO: 7679977 - DNA, 22 bp, Homo sapiens
cccccacctgaggacagtctta

SEQ ID NO: 7679978 - DNA, 22 bp, Homo sapiens
cccccacctgaggacagtctta

SEQ ID NO: 7679979 - DNA, 22 bp, Homo sapiens
cccccacctgaggacagtctta

SEQ ID NO: 7679980 - DNA, 22 bp, Homo sapiens
cccccaccgtgttcctgctcgg

SEQ ID NO: 7679981 - DNA, 22 bp, Homo sapiens
cccccaccgtgttcctgctcgg

SEQ ID NO: 7679982 - DNA, 22 bp, Homo sapiens
cccccaccgtgttcctgctcgg

SEQ ID NO: 7679983 - DNA, 19 bp, Homo sapiens
ccctcaggtctgagcagtc

SEQ ID NO: 7679984 - DNA, 19 bp, Homo sapiens
ccctcaggtctgagcagtc

SEQ ID NO: 7679985 - DNA, 19 bp, Homo sapiens
ccctcaggtctgagcagtc

SEQ ID NO: 7679986 - DNA, 19 bp, Homo sapiens
ccctcaggtctgagcagtc

SEQ ID NO: 7679987 - DNA, 22 bp, Homo sapiens
ccctcagggaccactgacttca

SEQ ID NO: 7679988 - DNA, 22 bp, Homo sapiens
ccctcagggaccactgacttca

SEQ ID NO: 7679989 - DNA, 19 bp, Homo sapiens
ccctcaggtctgagcagtc

SEQ ID NO: 7679990 - DNA, 19 bp, Homo sapiens
ccctcaggtctgagcagtc

SEQ ID NO: 7679991 - DNA, 19 bp, Homo sapiens
ccctcaggtctgagcagtc

SEQ ID NO: 7679992 - DNA, 19 bp, Homo sapiens
ccctcaggtctgagcagtc

SEQ ID NO: 7679993 - DNA, 19 bp, Homo sapiens
ccctcaggtctgagcagtc

SEQ ID NO: 7679994 - DNA, 22 bp, Homo sapiens
ccctcagggaccactgacttca

SEQ ID NO: 7679995 - DNA, 22 bp, Homo sapiens
ccctcagggaccactgacttca

SEQ ID NO: 7679996 - DNA, 22 bp, Homo sapiens
ccctcagggaccactgacttca

SEQ ID NO: 7679997 - DNA, 22 bp, Homo sapiens
ccctcaggatgcagtggaagtg

SEQ ID NO: 7679998 - DNA, 22 bp, Homo sapiens
ccctcaggatgcagtggaagtg

SEQ ID NO: 7679999 - DNA, 22 bp, Homo sapiens
ccctcaggatgcagtggaagtg

SEQ ID NO: 7680000 - DNA, 22 bp, Homo sapiens
ccctcaggatgcagtggaagtg

SEQ ID NO: 7680001 - DNA, 22 bp, Homo sapiens
ccctcaggatgcagtggaagtg

SEQ ID NO: 7680002 - DNA, 22 bp, Homo sapiens
ccctcaggatgcagtggaagtg

SEQ ID NO: 7680003 - DNA, 22 bp, Homo sapiens
ccctcaggagatgtcagctgga

SEQ ID NO: 7680004 - DNA, 22 bp, Homo sapiens
ccctcaggagatgtcagctgga

SEQ ID NO: 7680005 - DNA, 22 bp, Homo sapiens
ccctcaggagatgtcagctgga

SEQ ID NO: 7680006 - DNA, 22 bp, Homo sapiens
ccctcaggagatgtcagctgga

SEQ ID NO: 7680007 - DNA, 22 bp, Homo sapiens
ccctcaggagatgtcagctgga

SEQ ID NO: 7680008 - DNA, 22 bp, Homo sapiens
ccctcaggagatgtcagctgga

SEQ ID NO: 7680009 - DNA, 22 bp, Homo sapiens
ccctcaggagatgtcagctgga

SEQ ID NO: 7680010 - DNA, 21 bp, Homo sapiens
ccctcaggaaacagaatgcac

SEQ ID NO: 7680011 - DNA, 21 bp, Homo sapiens
ccctcaggaaacagaatgcac

SEQ ID NO: 7680012 - DNA, 22 bp, Homo sapiens
ccctcagcttctccctgcagct

SEQ ID NO: 7680013 - DNA, 22 bp, Homo sapiens
ccctcagcttctccctgcagct

SEQ ID NO: 7680014 - DNA, 21 bp, Homo sapiens
ccctcaggaaacagaatgcac

SEQ ID NO: 7680015 - DNA, 21 bp, Homo sapiens
ccctcaggaaacagaatgcac

SEQ ID NO: 7680016 - DNA, 22 bp, Homo sapiens
ccctcagctccaccctcagcag

SEQ ID NO: 7680017 - DNA, 22 bp, Homo sapiens
ccctcagctccaccctcagcag

SEQ ID NO: 7680018 - DNA, 22 bp, Homo sapiens
ccctcagcttctccctgcagct

SEQ ID NO: 7680019 - DNA, 22 bp, Homo sapiens
ccctaggcccaaagggtgacat

SEQ ID NO: 7680020 - DNA, 22 bp, Homo sapiens
ccctaggaattctatggccaag

SEQ ID NO: 7680021 - DNA, 22 bp, Homo sapiens
ccctaggaattctatggccaag

SEQ ID NO: 7680022 - DNA, 22 bp, Homo sapiens
ccctaggaattctatggccaag

SEQ ID NO: 7680023 - DNA, 22 bp, Homo sapiens
ccctaggcccaaagggtgacat

SEQ ID NO: 7680024 - DNA, 22 bp, Homo sapiens
ccctaggaattctatggccaag

SEQ ID NO: 7680025 - DNA, 20 bp, Homo sapiens
ccctaggaacgcagcaggag

SEQ ID NO: 7680026 - DNA, 23 bp, Homo sapiens
cccctctggtggctcagctcctg

SEQ ID NO: 7680027 - DNA, 20 bp, Homo sapiens
ccctaggaacgcagcaggag

SEQ ID NO: 7680028 - DNA, 22 bp, Homo sapiens
cccctctggtcaaccagtcaca

SEQ ID NO: 7680029 - DNA, 22 bp, Homo sapiens
cccctctggtcaaccagtcaca

SEQ ID NO: 7680030 - DNA, 23 bp, Homo sapiens
cccctctggtggctcagctcctg

SEQ ID NO: 7680031 - DNA, 22 bp, Homo sapiens
cccctctggtcaaccagtcaca

SEQ ID NO: 7680032 - DNA, 22 bp, Homo sapiens
cccctctggtcaaccagtcaca

SEQ ID NO: 7680033 - DNA, 22 bp, Homo sapiens
cccctctccctcacttatcaat

SEQ ID NO: 7680034 - DNA, 22 bp, Homo sapiens
cccctctgcaaatagccaggct

SEQ ID NO: 7680035 - DNA, 22 bp, Homo sapiens
cccctctgcaaatagccaggct

SEQ ID NO: 7680036 - DNA, 22 bp, Homo sapiens
cccctctccctcacttatcaat

SEQ ID NO: 7680037 - DNA, 22 bp, Homo sapiens
cccctctccctcacttatcaat

SEQ ID NO: 7680038 - DNA, 22 bp, Homo sapiens
cccctctccctcacttatcaat

SEQ ID NO: 7680039 - DNA, 22 bp, Homo sapiens
cccctcctggccacactgtcag

SEQ ID NO: 7680040 - DNA, 22 bp, Homo sapiens
cccctcctggccacactgtcag

SEQ ID NO: 7680041 - DNA, 22 bp, Homo sapiens
cccctcctggccacactgtcag

SEQ ID NO: 7680042 - DNA, 22 bp, Homo sapiens
cccctcctgcagcacctttctt

SEQ ID NO: 7680043 - DNA, 22 bp, Homo sapiens
cccctcctgcagcacctttctt

SEQ ID NO: 7680044 - DNA, 22 bp, Homo sapiens
cccctcctggccacactgtcag

SEQ ID NO: 7680045 - DNA, 22 bp, Homo sapiens
cccctcctggccacactgtcag

SEQ ID NO: 7680046 - DNA, 22 bp, Homo sapiens
cccctcctggccacactgtcag

SEQ ID NO: 7680047 - DNA, 22 bp, Homo sapiens
cccctcctggccacactgtcag

SEQ ID NO: 7680048 - DNA, 22 bp, Homo sapiens
cccctcctggccacactgtcag

SEQ ID NO: 7680049 - DNA, 22 bp, Homo sapiens
cccctcctggccacactgtcag

SEQ ID NO: 7680050 - DNA, 22 bp, Homo sapiens
cccctcattctctgagctagtt

SEQ ID NO: 7680051 - DNA, 22 bp, Homo sapiens
cccctcattctctgagctagtt

SEQ ID NO: 7680052 - DNA, 22 bp, Homo sapiens
cccctccctgacctggttgggc

SEQ ID NO: 7680053 - DNA, 22 bp, Homo sapiens
cccctccctgacctggttgggc

SEQ ID NO: 7680054 - DNA, 22 bp, Homo sapiens
cccctccctgacctggttgggc

SEQ ID NO: 7680055 - DNA, 22 bp, Homo sapiens
cccctccctgacctggttgggc

SEQ ID NO: 7680056 - DNA, 22 bp, Homo sapiens
cccctccctgacctggttgggc

SEQ ID NO: 7680057 - DNA, 22 bp, Homo sapiens
cccctccctgacctggttgggc

SEQ ID NO: 7680058 - DNA, 22 bp, Homo sapiens
cccctccctgacctggttgggc

SEQ ID NO: 7680059 - DNA, 22 bp, Homo sapiens
tgccaggcgtggtggtgcgcac

SEQ ID NO: 7680060 - DNA, 22 bp, Homo sapiens
tgccaggcgtggtggtgcgcac

SEQ ID NO: 7680061 - DNA, 22 bp, Homo sapiens
tgccaggcgtggtggtgcgcac

SEQ ID NO: 7680062 - DNA, 22 bp, Homo sapiens
tgccaggcgtggtggtgcgcac

SEQ ID NO: 7680063 - DNA, 22 bp, Homo sapiens
tgccaggcgtggtggtgcgcac

SEQ ID NO: 7680064 - DNA, 22 bp, Homo sapiens
tgccaggcgtggtggtgcgcac

SEQ ID NO: 7680065 - DNA, 15 bp, Homo sapiens
cccaggagttcgaga

SEQ ID NO: 7680066 - DNA, 22 bp, Homo sapiens
cccaggagttagaggttgtggt

SEQ ID NO: 7680067 - DNA, 22 bp, Homo sapiens
cccaggagttagaggttgtggt

SEQ ID NO: 7680068 - DNA, 22 bp, Homo sapiens
tgccaggctaagtggaggactt

SEQ ID NO: 7680069 - DNA, 22 bp, Homo sapiens
tgccaggcgtggtggtgcgcac

SEQ ID NO: 7680070 - DNA, 22 bp, Homo sapiens
cccaggatgtcgaggctgcagt

SEQ ID NO: 7680071 - DNA, 22 bp, Homo sapiens
cccaggatgtcgaggctgcagt

SEQ ID NO: 7680072 - DNA, 22 bp, Homo sapiens
cccaggatgtcgaggctgcagt

SEQ ID NO: 7680073 - DNA, 22 bp, Homo sapiens
cccaggatgtcgaggctgcagt

SEQ ID NO: 7680074 - DNA, 22 bp, Homo sapiens
cccaggagttcgaggctgtagt

SEQ ID NO: 7680075 - DNA, 22 bp, Homo sapiens
cccaggagttcgaggctgtagt

SEQ ID NO: 7680076 - DNA, 22 bp, Homo sapiens
cccaggagttcgaggctgtagt

SEQ ID NO: 7680077 - DNA, 22 bp, Homo sapiens
cccaggagttcgaggctgtagt

SEQ ID NO: 7680078 - DNA, 22 bp, Homo sapiens
cccaggagttcgaggctgtagt

SEQ ID NO: 7680079 - DNA, 15 bp, Homo sapiens
cccaggagttcgaga

SEQ ID NO: 7680080 - DNA, 22 bp, Homo sapiens
cccaggagttcgaggctgtagt

SEQ ID NO: 7680081 - DNA, 22 bp, Homo sapiens
cccaggagttcgaggctgtagt

SEQ ID NO: 7680082 - DNA, 22 bp, Homo sapiens
cccaggagttcgaggctgtagt

SEQ ID NO: 7680083 - DNA, 21 bp, Homo sapiens
tgccaggcctgagctggggtc

SEQ ID NO: 7680084 - DNA, 21 bp, Homo sapiens
tgccaggcctgagctggggtc

SEQ ID NO: 7680085 - DNA, 21 bp, Homo sapiens
tgccaggcctgagctggggtc

SEQ ID NO: 7680086 - DNA, 21 bp, Homo sapiens
tgccaggcctgagctggggtc

SEQ ID NO: 7680087 - DNA, 21 bp, Homo sapiens
tgccaggcctgagctggggtc

SEQ ID NO: 7680088 - DNA, 21 bp, Homo sapiens
tgccaggcctgagctggggtc

SEQ ID NO: 7680089 - DNA, 21 bp, Homo sapiens
tgccaggcctgagctggggtc

SEQ ID NO: 7680090 - DNA, 21 bp, Homo sapiens
tgccaggcctgagctggggtc

SEQ ID NO: 7680091 - DNA, 22 bp, Homo sapiens
tgccaggcgtggtggtgcgcac

SEQ ID NO: 7680092 - DNA, 22 bp, Homo sapiens
tgccaggcgtggtggtgcgcac

SEQ ID NO: 7680093 - DNA, 22 bp, Homo sapiens
tgccaggcgattgctatcagca

SEQ ID NO: 7680094 - DNA, 22 bp, Homo sapiens
tgccaggcgattgctatcagca

SEQ ID NO: 7680095 - DNA, 21 bp, Homo sapiens
tgccaggcctgagctggggtc

SEQ ID NO: 7680096 - DNA, 21 bp, Homo sapiens
tgccaggcctgagctggggtc

SEQ ID NO: 7680097 - DNA, 22 bp, Homo sapiens
tgccaggcgattgctatcagca

SEQ ID NO: 7680098 - DNA, 22 bp, Homo sapiens
tgccaggcgattgctatcagca

SEQ ID NO: 7680099 - DNA, 22 bp, Homo sapiens
cccaggcacactgaagtgacat

SEQ ID NO: 7680100 - DNA, 22 bp, Homo sapiens
cccaggcacaccccgaacggaa

SEQ ID NO: 7680101 - DNA, 22 bp, Homo sapiens
cccaggatgtcgaggctgcagt

SEQ ID NO: 7680102 - DNA, 22 bp, Homo sapiens
cccaggcacaccccgaacggaa

SEQ ID NO: 7680103 - DNA, 22 bp, Homo sapiens
cccaggcacaccccgaacggaa

SEQ ID NO: 7680104 - DNA, 22 bp, Homo sapiens
cccaggcacactgaagtgacat

SEQ ID NO: 7680105 - DNA, 22 bp, Homo sapiens
cccaggcacactgaagtgacat

SEQ ID NO: 7680106 - DNA, 22 bp, Homo sapiens
cccaggcacactgaagtgacat

SEQ ID NO: 7680107 - DNA, 22 bp, Homo sapiens
cccaggcacactgaagtgacat

SEQ ID NO: 7680108 - DNA, 22 bp, Homo sapiens
cccaggcacactgaagtgacat

SEQ ID NO: 7680109 - DNA, 22 bp, Homo sapiens
cccaggcacactgaagtgacat

SEQ ID NO: 7680110 - DNA, 22 bp, Homo sapiens
cccaggcacatccactctgtga

SEQ ID NO: 7680111 - DNA, 22 bp, Homo sapiens
cccaggcacatccactctgtga

SEQ ID NO: 7680112 - DNA, 22 bp, Homo sapiens
cccaggcacatccactctgtga

SEQ ID NO: 7680113 - DNA, 22 bp, Homo sapiens
cccaggcacatccactctgtga

SEQ ID NO: 7680114 - DNA, 22 bp, Homo sapiens
cccaggcacatccactctgtga

SEQ ID NO: 7680115 - DNA, 22 bp, Homo sapiens
cccaggcacagattatcccaat

SEQ ID NO: 7680116 - DNA, 22 bp, Homo sapiens
cccaggcacagattatcccaat

SEQ ID NO: 7680117 - DNA, 22 bp, Homo sapiens
cccaggcacagattatcccaat

SEQ ID NO: 7680118 - DNA, 22 bp, Homo sapiens
cccaggcagagagctggtgagc

SEQ ID NO: 7680119 - DNA, 22 bp, Homo sapiens
cccaggcagagagctggtgagc

SEQ ID NO: 7680120 - DNA, 22 bp, Homo sapiens
cccaggcagagagctggtgagc

SEQ ID NO: 7680121 - DNA, 22 bp, Homo sapiens
cccaggcagaattagtgtttca

SEQ ID NO: 7680122 - DNA, 22 bp, Homo sapiens
cccaggcagagagctggtgagc

SEQ ID NO: 7680123 - DNA, 22 bp, Homo sapiens
cccaggcagagagctggtgagc

SEQ ID NO: 7680124 - DNA, 22 bp, Homo sapiens
cccaggcagagagctggtgagc

SEQ ID NO: 7680125 - DNA, 20 bp, Homo sapiens
cccaggcagagctagcggca

SEQ ID NO: 7680126 - DNA, 20 bp, Homo sapiens
cccaggcagagctagcggca

SEQ ID NO: 7680127 - DNA, 22 bp, Homo sapiens
cccaggcactcttggtcatttt

SEQ ID NO: 7680128 - DNA, 22 bp, Homo sapiens
cccaggcactcttggtcatttt

SEQ ID NO: 7680129 - DNA, 22 bp, Homo sapiens
cccaggcactcttggtcatttt

SEQ ID NO: 7680130 - DNA, 22 bp, Homo sapiens
cccaggcagaattagtgtttca

SEQ ID NO: 7680131 - DNA, 22 bp, Homo sapiens
cccaggcagaattagtgtttca

SEQ ID NO: 7680132 - DNA, 22 bp, Homo sapiens
cccaggcagaattagtgtttca

SEQ ID NO: 7680133 - DNA, 22 bp, Homo sapiens
cccaggcagaattagtgtttca

SEQ ID NO: 7680134 - DNA, 22 bp, Homo sapiens
cccaggcagggacgtgctctgg

SEQ ID NO: 7680135 - DNA, 22 bp, Homo sapiens
cccaggcaggagtgtggtggct

SEQ ID NO: 7680136 - DNA, 22 bp, Homo sapiens
cccaggcaggagtgtggtggct

SEQ ID NO: 7680137 - DNA, 22 bp, Homo sapiens
cccaggcagggacgtgctctgg

SEQ ID NO: 7680138 - DNA, 22 bp, Homo sapiens
cccaggcagggacgtgctctgg

SEQ ID NO: 7680139 - DNA, 22 bp, Homo sapiens
cccaggcagggacgtgctctgg

SEQ ID NO: 7680140 - DNA, 22 bp, Homo sapiens
cccaggcagggacgtgctctgg

SEQ ID NO: 7680141 - DNA, 22 bp, Homo sapiens
cccaggcagtagaaagaagagg

SEQ ID NO: 7680142 - DNA, 22 bp, Homo sapiens
cccaggcagtagaaagaagagg

SEQ ID NO: 7680143 - DNA, 22 bp, Homo sapiens
cccaggcagtagaaagaagagg

SEQ ID NO: 7680144 - DNA, 22 bp, Homo sapiens
cccaggcagtagaaagaagagg

SEQ ID NO: 7680145 - DNA, 22 bp, Homo sapiens
cccaggcagtagaaagaagagg

SEQ ID NO: 7680146 - DNA, 22 bp, Homo sapiens
cccaggcagtagaaagaagagg

SEQ ID NO: 7680147 - DNA, 22 bp, Homo sapiens
cccaggcagtagaaagaagagg

SEQ ID NO: 7680148 - DNA, 22 bp, Homo sapiens
cccaggcagggacgtgctctgg

SEQ ID NO: 7680149 - DNA, 22 bp, Homo sapiens
cccaggcagggacgtgctctgg

SEQ ID NO: 7680150 - DNA, 22 bp, Homo sapiens
cccaggcagtgtgtgcatgcgt

SEQ ID NO: 7680151 - DNA, 22 bp, Homo sapiens
cccaggcagtgtgtgcatgcgt

SEQ ID NO: 7680152 - DNA, 22 bp, Homo sapiens
cccaggcagtgtgtgcatgcgt

SEQ ID NO: 7680153 - DNA, 22 bp, Homo sapiens
cccaggcagtgtgtgcatgcgt

SEQ ID NO: 7680154 - DNA, 22 bp, Homo sapiens
cccaggcagtgctgatccctca

SEQ ID NO: 7680155 - DNA, 22 bp, Homo sapiens
cccaggcagtgtgtgcatgcgt

SEQ ID NO: 7680156 - DNA, 22 bp, Homo sapiens
cccaggcagtgctgatccctca

SEQ ID NO: 7680157 - DNA, 22 bp, Homo sapiens
cccaggcagtgctgatccctca

SEQ ID NO: 7680158 - DNA, 22 bp, Homo sapiens
cccaggcagtgctgatccctca

SEQ ID NO: 7680159 - DNA, 22 bp, Homo sapiens
cccaggcagtctggctctaaag

SEQ ID NO: 7680160 - DNA, 22 bp, Homo sapiens
cccaggcagtctggctctaaag

SEQ ID NO: 7680161 - DNA, 22 bp, Homo sapiens
cccaggcagtctggctctaaag

SEQ ID NO: 7680162 - DNA, 22 bp, Homo sapiens
cccaggcagcggggtctccttg

SEQ ID NO: 7680163 - DNA, 22 bp, Homo sapiens
cccaggcagcggggtctccttg

SEQ ID NO: 7680164 - DNA, 22 bp, Homo sapiens
cccaggcagcggggtctccttg

SEQ ID NO: 7680165 - DNA, 22 bp, Homo sapiens
cccaggcagcggggtctccttg

SEQ ID NO: 7680166 - DNA, 22 bp, Homo sapiens
cccaggcagcggggtctccttg

SEQ ID NO: 7680167 - DNA, 22 bp, Homo sapiens
cccaggcaggagtgtggtggct

SEQ ID NO: 7680168 - DNA, 22 bp, Homo sapiens
cccaggcaggagtgtggtggct

SEQ ID NO: 7680169 - DNA, 22 bp, Homo sapiens
cccaggcagcggggtctccttg

SEQ ID NO: 7680170 - DNA, 22 bp, Homo sapiens
cccaggcagcctgcagggaagg

SEQ ID NO: 7680171 - DNA, 22 bp, Homo sapiens
cccaggcagcctgcagggaagg

SEQ ID NO: 7680172 - DNA, 22 bp, Homo sapiens
cccaggcagcctgcagggaagg

SEQ ID NO: 7680173 - DNA, 22 bp, Homo sapiens
cccaggcagcctgcagggaagg

SEQ ID NO: 7680174 - DNA, 22 bp, Homo sapiens
cccaggcagcctgcagggaagg

SEQ ID NO: 7680175 - DNA, 22 bp, Homo sapiens
cccaggcagcctgcagggaagg

SEQ ID NO: 7680176 - DNA, 22 bp, Homo sapiens
cccaggcagcctgcagggaagg

SEQ ID NO: 7680177 - DNA, 22 bp, Homo sapiens
cccaggcagcggggtctccttg

SEQ ID NO: 7680178 - DNA, 22 bp, Homo sapiens
cccaggcagcctgcagggaagg

SEQ ID NO: 7680179 - DNA, 22 bp, Homo sapiens
cccaggcagcctgcagggaagg

SEQ ID NO: 7680180 - DNA, 22 bp, Homo sapiens
cccaggcagccccagaagcttg

SEQ ID NO: 7680181 - DNA, 20 bp, Homo sapiens
cccaggcagagctagcggca

SEQ ID NO: 7680182 - DNA, 22 bp, Homo sapiens
cccaggcagccccagaagcttg

SEQ ID NO: 7680183 - DNA, 22 bp, Homo sapiens
cccaggcagccccagaagcttg

SEQ ID NO: 7680184 - DNA, 22 bp, Homo sapiens
cccaggcagccccagaagcttg

SEQ ID NO: 7680185 - DNA, 22 bp, Homo sapiens
cccaggcagccccagaagcttg

SEQ ID NO: 7680186 - DNA, 20 bp, Homo sapiens
cccaggcagagctagcggca

SEQ ID NO: 7680187 - DNA, 20 bp, Homo sapiens
cccaggcagagctagcggca

SEQ ID NO: 7680188 - DNA, 20 bp, Homo sapiens
cccaggcagagctagcggca

SEQ ID NO: 7680189 - DNA, 22 bp, Homo sapiens
cccaggcagcccttctgacgca

SEQ ID NO: 7680190 - DNA, 22 bp, Homo sapiens
cccaggcagcccttctgacgca

SEQ ID NO: 7680191 - DNA, 22 bp, Homo sapiens
cccaggcagcccttctgacgca

SEQ ID NO: 7680192 - DNA, 22 bp, Homo sapiens
cccaggcagccccagaagcttg

SEQ ID NO: 7680193 - DNA, 22 bp, Homo sapiens
cccaggcagccccagaagcttg

SEQ ID NO: 7680194 - DNA, 22 bp, Homo sapiens
cccaggcagccccagaagcttg

SEQ ID NO: 7680195 - DNA, 22 bp, Homo sapiens
cccaggcagccccagaagcttg

SEQ ID NO: 7680196 - DNA, 22 bp, Homo sapiens
cccaggaggtggaggttgcagc

SEQ ID NO: 7680197 - DNA, 22 bp, Homo sapiens
cccaggaggtggaggttgcagc

SEQ ID NO: 7680198 - DNA, 22 bp, Homo sapiens
cccaggaggtggaggttgcagc

SEQ ID NO: 7680199 - DNA, 22 bp, Homo sapiens
cccaggaggtggaggttgcagc

SEQ ID NO: 7680200 - DNA, 22 bp, Homo sapiens
cccaggaggtggaggttgcagc

SEQ ID NO: 7680201 - DNA, 22 bp, Homo sapiens
cccaggaggtggaggctgcagt

SEQ ID NO: 7680202 - DNA, 22 bp, Homo sapiens
cccaggaggtggaggctgcagt

SEQ ID NO: 7680203 - DNA, 22 bp, Homo sapiens
cccaggaggtggaggctgcagt

SEQ ID NO: 7680204 - DNA, 22 bp, Homo sapiens
cccaggaggtggaggctgcagt

SEQ ID NO: 7680205 - DNA, 22 bp, Homo sapiens
cccaggaggtggaggctgcagt

SEQ ID NO: 7680206 - DNA, 22 bp, Homo sapiens
cccaggaggtggaggctgcagt

SEQ ID NO: 7680207 - DNA, 22 bp, Homo sapiens
cccaggaggtggaggttgcagt

SEQ ID NO: 7680208 - DNA, 22 bp, Homo sapiens
cccaggaggtggaggttgcagt

SEQ ID NO: 7680209 - DNA, 22 bp, Homo sapiens
cccaggaggtggaggttgcagt

SEQ ID NO: 7680210 - DNA, 22 bp, Homo sapiens
cccaggaggtggaggttgcagt

SEQ ID NO: 7680211 - DNA, 22 bp, Homo sapiens
cccaggaggtggaggttgcagt

SEQ ID NO: 7680212 - DNA, 22 bp, Homo sapiens
cccaggaggtggaggttgcagt

SEQ ID NO: 7680213 - DNA, 22 bp, Homo sapiens
cccaggaggtggaggttgcagc

SEQ ID NO: 7680214 - DNA, 22 bp, Homo sapiens
cccaggaggtggaggttgcagc

SEQ ID NO: 7680215 - DNA, 22 bp, Homo sapiens
cccaggaggtggaggttgcagc

SEQ ID NO: 7680216 - DNA, 22 bp, Homo sapiens
cccaggagggtggcctctgccc

SEQ ID NO: 7680217 - DNA, 22 bp, Homo sapiens
cccaggagggtggcctctgccc

SEQ ID NO: 7680218 - DNA, 21 bp, Homo sapiens
cccaggaggctgagaagagca

SEQ ID NO: 7680219 - DNA, 21 bp, Homo sapiens
cccaggaggctgagaagagca

SEQ ID NO: 7680220 - DNA, 22 bp, Homo sapiens
tgccacagagcaattctgctga

SEQ ID NO: 7680221 - DNA, 22 bp, Homo sapiens
tgccacagagcaattctgctga

SEQ ID NO: 7680222 - DNA, 22 bp, Homo sapiens
tgccacagagcaattctgctga

SEQ ID NO: 7680223 - DNA, 22 bp, Homo sapiens
tgccacagagcaattctgctga

SEQ ID NO: 7680224 - DNA, 22 bp, Homo sapiens
tgccacagagcaattctgctga

SEQ ID NO: 7680225 - DNA, 22 bp, Homo sapiens
cccaggaggtggaggctgcagt

SEQ ID NO: 7680226 - DNA, 22 bp, Homo sapiens
cccaggaggtggaggctgcagt

SEQ ID NO: 7680227 - DNA, 22 bp, Homo sapiens
cccaggaggtggaggctgcagt

SEQ ID NO: 7680228 - DNA, 22 bp, Homo sapiens
cccaggaggtggaggctgcagt

SEQ ID NO: 7680229 - DNA, 22 bp, Homo sapiens
cccaggaggtggaggctgcagt

SEQ ID NO: 7680230 - DNA, 22 bp, Homo sapiens
cccaggagggtggcctctgccc

SEQ ID NO: 7680231 - DNA, 22 bp, Homo sapiens
cccaggaggtggaggctgcagt

SEQ ID NO: 7680232 - DNA, 22 bp, Homo sapiens
cccaggaggtggaggctgcagt

SEQ ID NO: 7680233 - DNA, 22 bp, Homo sapiens
cccaggaggtggaggctgcagt

SEQ ID NO: 7680234 - DNA, 22 bp, Homo sapiens
tgccaggcctcaggagtctcca

SEQ ID NO: 7680235 - DNA, 22 bp, Homo sapiens
tgccaggcctcaggagtctcca

SEQ ID NO: 7680236 - DNA, 22 bp, Homo sapiens
tgccaggcctcaggagtctcca

SEQ ID NO: 7680237 - DNA, 22 bp, Homo sapiens
tgccaggcctcaggagtctcca

SEQ ID NO: 7680238 - DNA, 22 bp, Homo sapiens
tgccaggcctcaggagtctcca

SEQ ID NO: 7680239 - DNA, 22 bp, Homo sapiens
tgccaggcctcaggagtctcca

SEQ ID NO: 7680240 - DNA, 22 bp, Homo sapiens
tgccaggcctcaggagtctcca

SEQ ID NO: 7680241 - DNA, 22 bp, Homo sapiens
cccaggaggtgtagctgcgtgg

SEQ ID NO: 7680242 - DNA, 22 bp, Homo sapiens
cccaggaggttgaggctgcagt

SEQ ID NO: 7680243 - DNA, 22 bp, Homo sapiens
cccaggaggttgaggctgcagt

SEQ ID NO: 7680244 - DNA, 22 bp, Homo sapiens
cccaggaggttgaggctgcagt

SEQ ID NO: 7680245 - DNA, 22 bp, Homo sapiens
cccaggaggttgaggctgcagt

SEQ ID NO: 7680246 - DNA, 22 bp, Homo sapiens
cccaggaggttgaggctgcagt

SEQ ID NO: 7680247 - DNA, 22 bp, Homo sapiens
cccaggaggttgaggctgcagt

SEQ ID NO: 7680248 - DNA, 22 bp, Homo sapiens
cccaggaggtgtgcccaactcg

SEQ ID NO: 7680249 - DNA, 22 bp, Homo sapiens
cccaggaggtgtgcccaactcg

SEQ ID NO: 7680250 - DNA, 22 bp, Homo sapiens
cccaggaggttgaggctgcagt

SEQ ID NO: 7680251 - DNA, 22 bp, Homo sapiens
cccaggaggtgtgcccaactcg

SEQ ID NO: 7680252 - DNA, 22 bp, Homo sapiens
cccaggaggttgaggctgcagt

SEQ ID NO: 7680253 - DNA, 22 bp, Homo sapiens
cccaggaggtgtagctgcgtgg

SEQ ID NO: 7680254 - DNA, 22 bp, Homo sapiens
cccaggaggtgtgcccaactcg

SEQ ID NO: 7680255 - DNA, 22 bp, Homo sapiens
cccaggaggtgtgcccaactcg

SEQ ID NO: 7680256 - DNA, 22 bp, Homo sapiens
cccaggaggtgtgcccaactcg

SEQ ID NO: 7680257 - DNA, 22 bp, Homo sapiens
cccaggaggtggagttcacagt

SEQ ID NO: 7680258 - DNA, 22 bp, Homo sapiens
cccaggaggtgtagctgcgtgg

SEQ ID NO: 7680259 - DNA, 22 bp, Homo sapiens
cccaggaggtgtagctgcgtgg

SEQ ID NO: 7680260 - DNA, 22 bp, Homo sapiens
cccaggaggtgtagctgcgtgg

SEQ ID NO: 7680261 - DNA, 22 bp, Homo sapiens
cccaggaggtggagttcacagt

SEQ ID NO: 7680262 - DNA, 22 bp, Homo sapiens
cccaggaggtggagttcacagt

SEQ ID NO: 7680263 - DNA, 22 bp, Homo sapiens
cccaggaggtggagttcacagt

SEQ ID NO: 7680264 - DNA, 22 bp, Homo sapiens
cccaggaggtggagttcacagt

SEQ ID NO: 7680265 - DNA, 22 bp, Homo sapiens
cccaggaggtggagttcacagt

SEQ ID NO: 7680266 - DNA, 22 bp, Homo sapiens
cccaggaggtggaggttgcggt

SEQ ID NO: 7680267 - DNA, 22 bp, Homo sapiens
cccaggaggtggagttcacagt

SEQ ID NO: 7680268 - DNA, 22 bp, Homo sapiens
cccaggaggtggagttcacagt

SEQ ID NO: 7680269 - DNA, 22 bp, Homo sapiens
cccaggaggtggaggttgcagt

SEQ ID NO: 7680270 - DNA, 22 bp, Homo sapiens
cccaggaggtggaggttgcggt

SEQ ID NO: 7680271 - DNA, 22 bp, Homo sapiens
cccaggaggtggaggttgcggt

SEQ ID NO: 7680272 - DNA, 22 bp, Homo sapiens
cccaggaggtggaggttgcggt

SEQ ID NO: 7680273 - DNA, 22 bp, Homo sapiens
cccaggaggtggaggttgcagt

SEQ ID NO: 7680274 - DNA, 22 bp, Homo sapiens
tgccacactcacttctgtggac

SEQ ID NO: 7680275 - DNA, 22 bp, Homo sapiens
tgccacaccaacatctttcagc

SEQ ID NO: 7680276 - DNA, 22 bp, Homo sapiens
tgccacacattgtcaggttagt

SEQ ID NO: 7680277 - DNA, 22 bp, Homo sapiens
tgccacacagtctggtagaata

SEQ ID NO: 7680278 - DNA, 22 bp, Homo sapiens
tgccacactcccctgctgcagt

SEQ ID NO: 7680279 - DNA, 22 bp, Homo sapiens
tgccacagacaggacagaacag

SEQ ID NO: 7680280 - DNA, 22 bp, Homo sapiens
tgccacagacaggacagaacag

SEQ ID NO: 7680281 - DNA, 22 bp, Homo sapiens
tgccacagagactttcattgta

SEQ ID NO: 7680282 - DNA, 22 bp, Homo sapiens
tgccacagagactttcattgta

SEQ ID NO: 7680283 - DNA, 22 bp, Homo sapiens
tgccaatttgcccctttgctga

SEQ ID NO: 7680284 - DNA, 22 bp, Homo sapiens
tgccaattgtgtgaatccttaa

SEQ ID NO: 7680285 - DNA, 22 bp, Homo sapiens
tgccacacaattactgctgcta

SEQ ID NO: 7680286 - DNA, 22 bp, Homo sapiens
tgccacacaattactgctgcta

SEQ ID NO: 7680287 - DNA, 22 bp, Homo sapiens
tgccacacaattactgctgcta

SEQ ID NO: 7680288 - DNA, 22 bp, Homo sapiens
tgccaattgtgtgaatccttaa

SEQ ID NO: 7680289 - DNA, 22 bp, Homo sapiens
tgccaattcgcagtgagtattt

SEQ ID NO: 7680290 - DNA, 22 bp, Homo sapiens
tgccaattcgcagtgagtattt

SEQ ID NO: 7680291 - DNA, 16 bp, Homo sapiens
tgccaattattgtgtc

SEQ ID NO: 7680292 - DNA, 22 bp, Homo sapiens
tgccaattagagacatccatct

SEQ ID NO: 7680293 - DNA, 22 bp, Homo sapiens
tgccaattagagacatccatct

SEQ ID NO: 7680294 - DNA, 22 bp, Homo sapiens
tgccaagtggagctcaggaatc

SEQ ID NO: 7680295 - DNA, 22 bp, Homo sapiens
tgccaagtttctctcagggact

SEQ ID NO: 7680296 - DNA, 22 bp, Homo sapiens
tgccaatcagctttgcaacttg

SEQ ID NO: 7680297 - DNA, 22 bp, Homo sapiens
tgccaattagagacatccatct

SEQ ID NO: 7680298 - DNA, 22 bp, Homo sapiens
tgccaatgatgctttgatatgt

SEQ ID NO: 7680299 - DNA, 22 bp, Homo sapiens
tgccaatctggtgggtgcaaat

SEQ ID NO: 7680300 - DNA, 22 bp, Homo sapiens
tgccaatctttgtgataattgc

SEQ ID NO: 7680301 - DNA, 22 bp, Homo sapiens
tgccaatctttgtgataattgc

SEQ ID NO: 7680302 - DNA, 22 bp, Homo sapiens
tgccaagggtatgggcaagata

SEQ ID NO: 7680303 - DNA, 22 bp, Homo sapiens
tgccaagggtatgggcaagata

SEQ ID NO: 7680304 - DNA, 22 bp, Homo sapiens
tgccaaggagctggatcagggc

SEQ ID NO: 7680305 - DNA, 22 bp, Homo sapiens
tgccaagggtatgggcaagata

SEQ ID NO: 7680306 - DNA, 22 bp, Homo sapiens
tgccaagggtatgggcaagata

SEQ ID NO: 7680307 - DNA, 22 bp, Homo sapiens
tgccaagggtatgggcaagata

SEQ ID NO: 7680308 - DNA, 22 bp, Homo sapiens
tgccaagtgcttacttggccct

SEQ ID NO: 7680309 - DNA, 22 bp, Homo sapiens
tgccaagtgcttacttggccct

SEQ ID NO: 7680310 - DNA, 22 bp, Homo sapiens
tgcattcatcatttgaaagccc

SEQ ID NO: 7680311 - DNA, 22 bp, Homo sapiens
tgcattcatcatttgaaagccc

SEQ ID NO: 7680312 - DNA, 22 bp, Homo sapiens
tgcattcatcatttgaaagccc

SEQ ID NO: 7680313 - DNA, 22 bp, Homo sapiens
tgcattcagttggtcagctttt

SEQ ID NO: 7680314 - DNA, 22 bp, Homo sapiens
tgcattcaatgtgccagggaaa

SEQ ID NO: 7680315 - DNA, 22 bp, Homo sapiens
tgcattcagttggtcagctttt

SEQ ID NO: 7680316 - DNA, 22 bp, Homo sapiens
tgcattcagttggtcagctttt

SEQ ID NO: 7680317 - DNA, 22 bp, Homo sapiens
tgcattcaatacagtaagaata

SEQ ID NO: 7680318 - DNA, 22 bp, Homo sapiens
tgcattcaatacagtaagaata

SEQ ID NO: 7680319 - DNA, 22 bp, Homo sapiens
tgccaaggagctggatcagggc

SEQ ID NO: 7680320 - DNA, 22 bp, Homo sapiens
tgccaaggagctggatcagggc

SEQ ID NO: 7680321 - DNA, 22 bp, Homo sapiens
tgccaaggagctggatcagggc

SEQ ID NO: 7680322 - DNA, 22 bp, Homo sapiens
tgccaagataacacagctagta

SEQ ID NO: 7680323 - DNA, 22 bp, Homo sapiens
tgccaagaggtccaggtgggaa

SEQ ID NO: 7680324 - DNA, 22 bp, Homo sapiens
tgccaagatgtaggcaggcata

SEQ ID NO: 7680325 - DNA, 22 bp, Homo sapiens
tgcattatctttaatgttctca

SEQ ID NO: 7680326 - DNA, 22 bp, Homo sapiens
tgcattatcgtcttgatcctct

SEQ ID NO: 7680327 - DNA, 23 bp, Homo sapiens
tgcattatcctctctgaagacca

SEQ ID NO: 7680328 - DNA, 23 bp, Homo sapiens
tgcattatcctctctgaagacca

SEQ ID NO: 7680329 - DNA, 22 bp, Homo sapiens
tgcattataactgaatgttgtt

SEQ ID NO: 7680330 - DNA, 22 bp, Homo sapiens
tgcattatacatggatctaaag

SEQ ID NO: 7680331 - DNA, 22 bp, Homo sapiens
tgcattatacatggatctaaag

SEQ ID NO: 7680332 - DNA, 22 bp, Homo sapiens
tgcattatacttttagaaattt

SEQ ID NO: 7680333 - DNA, 22 bp, Homo sapiens
tgcattatacttttagaaattt

SEQ ID NO: 7680334 - DNA, 22 bp, Homo sapiens
tgcattatacttttagaaattt

SEQ ID NO: 7680335 - DNA, 22 bp, Homo sapiens
tgcattatttgcatgtgcctgt

SEQ ID NO: 7680336 - DNA, 22 bp, Homo sapiens
tgcattcaaatctccaggctca

SEQ ID NO: 7680337 - DNA, 22 bp, Homo sapiens
tgcattcaaatctccaggctca

SEQ ID NO: 7680338 - DNA, 22 bp, Homo sapiens
tgcattcaaatcctgatcctgc

SEQ ID NO: 7680339 - DNA, 22 bp, Homo sapiens
tgcattatggctgagtctctca

SEQ ID NO: 7680340 - DNA, 22 bp, Homo sapiens
tgcattatgctacccagaagct

SEQ ID NO: 7680341 - DNA, 22 bp, Homo sapiens
tgcattatgcttgtgctgtata

SEQ ID NO: 7680342 - DNA, 22 bp, Homo sapiens
tgcattaaatataatctgttga

SEQ ID NO: 7680343 - DNA, 22 bp, Homo sapiens
tgcattaaatataatctgttga

SEQ ID NO: 7680344 - DNA, 22 bp, Homo sapiens
tgcattaaaatgtgcctctctt

SEQ ID NO: 7680345 - DNA, 22 bp, Homo sapiens
tgcatgttttataccaaagctt

SEQ ID NO: 7680346 - DNA, 22 bp, Homo sapiens
tgcattaaaatgatggagaaat

SEQ ID NO: 7680347 - DNA, 22 bp, Homo sapiens
tgcattaaaatgtgcctctctt

SEQ ID NO: 7680348 - DNA, 22 bp, Homo sapiens
tgcattaaaaccatcgaccatc

SEQ ID NO: 7680349 - DNA, 22 bp, Homo sapiens
tgcattaaaaccatcgaccatc

SEQ ID NO: 7680350 - DNA, 22 bp, Homo sapiens
tgcattaaaatgatggagaaat

SEQ ID NO: 7680351 - DNA, 22 bp, Homo sapiens
tgcattaaaatgatggagaaat

SEQ ID NO: 7680352 - DNA, 22 bp, Homo sapiens
tgcatcaacctaatatcagctc

SEQ ID NO: 7680353 - DNA, 22 bp, Homo sapiens
tgcatcaagaagtctaagtttg

SEQ ID NO: 7680354 - DNA, 22 bp, Homo sapiens
tgcatcacaggcaagcaaggct

SEQ ID NO: 7680355 - DNA, 22 bp, Homo sapiens
tgcatcacttagctgcacaact

SEQ ID NO: 7680356 - DNA, 22 bp, Homo sapiens
tgcatcacttagctgcacaact

SEQ ID NO: 7680357 - DNA, 22 bp, Homo sapiens
tgcatgtttgtaggttcttcta

SEQ ID NO: 7680358 - DNA, 22 bp, Homo sapiens
tgcatgtttctgtatgttaatg

SEQ ID NO: 7680359 - DNA, 22 bp, Homo sapiens
tgcatcagaggatagctgcagt

SEQ ID NO: 7680360 - DNA, 22 bp, Homo sapiens
tgcatcagaggatagctgcagt

SEQ ID NO: 7680361 - DNA, 22 bp, Homo sapiens
tgcatcagaggatagctgcagt

SEQ ID NO: 7680362 - DNA, 22 bp, Homo sapiens
tgcattaaggccattgaaattt

SEQ ID NO: 7680363 - DNA, 22 bp, Homo sapiens
tgcattaaggccattgaaattt

SEQ ID NO: 7680364 - DNA, 22 bp, Homo sapiens
tgcattaagcacacttttgaat

SEQ ID NO: 7680365 - DNA, 22 bp, Homo sapiens
tgcattaagcacacttttgaat

SEQ ID NO: 7680366 - DNA, 22 bp, Homo sapiens
tgcattaaatataatctgttga

SEQ ID NO: 7680367 - DNA, 22 bp, Homo sapiens
tgcattaagaatttctgaggat

SEQ ID NO: 7680368 - DNA, 22 bp, Homo sapiens
tgcattaagaatttctgaggat

SEQ ID NO: 7680369 - DNA, 22 bp, Homo sapiens
tgcattaaggtaattgtataat

SEQ ID NO: 7680370 - DNA, 22 bp, Homo sapiens
tgcattaagggcctggagatac

SEQ ID NO: 7680371 - DNA, 22 bp, Homo sapiens
tgcattaagggcctggagatac

SEQ ID NO: 7680372 - DNA, 22 bp, Homo sapiens
tgcattaagggcctggagatac

SEQ ID NO: 7680373 - DNA, 22 bp, Homo sapiens
tgcattaaggccattgaaattt

SEQ ID NO: 7680374 - DNA, 22 bp, Homo sapiens
tgcattaaggccattgaaattt

SEQ ID NO: 7680375 - DNA, 22 bp, Homo sapiens
tgcattaagtgtctgcatatgg

SEQ ID NO: 7680376 - DNA, 22 bp, Homo sapiens
tgcattaagtgtctgcatatgg

SEQ ID NO: 7680377 - DNA, 20 bp, Homo sapiens
tgcattaagtggcattgagc

SEQ ID NO: 7680378 - DNA, 22 bp, Homo sapiens
tgcattaatttttgccaggttc

SEQ ID NO: 7680379 - DNA, 22 bp, Homo sapiens
tgcattaagtgtctgcatatgg

SEQ ID NO: 7680380 - DNA, 22 bp, Homo sapiens
tgcattaagtgtctgcatatgg

SEQ ID NO: 7680381 - DNA, 22 bp, Homo sapiens
tgcattaagtgtctgcatatgg

SEQ ID NO: 7680382 - DNA, 22 bp, Homo sapiens
tgcattaaggtaattgtataat

SEQ ID NO: 7680383 - DNA, 22 bp, Homo sapiens
tgcattaaggtaattgtataat

SEQ ID NO: 7680384 - DNA, 20 bp, Homo sapiens
tgcattaagtggcattgagc

SEQ ID NO: 7680385 - DNA, 20 bp, Homo sapiens
tgcattaagtggcattgagc

SEQ ID NO: 7680386 - DNA, 22 bp, Homo sapiens
cccaggaaagaaagtatatggt

SEQ ID NO: 7680387 - DNA, 22 bp, Homo sapiens
cccaggaaacccgaaggcgacc

SEQ ID NO: 7680388 - DNA, 22 bp, Homo sapiens
cccaggaaaagcagtgccagca

SEQ ID NO: 7680389 - DNA, 22 bp, Homo sapiens
cccaggaaacccgaaggcgacc

SEQ ID NO: 7680390 - DNA, 22 bp, Homo sapiens
cccaggaaaagcagtgccagca

SEQ ID NO: 7680391 - DNA, 22 bp, Homo sapiens
cccaggaaaagcagtgccagca

SEQ ID NO: 7680392 - DNA, 22 bp, Homo sapiens
cccaggaaaagcagtgccagca

SEQ ID NO: 7680393 - DNA, 22 bp, Homo sapiens
cccaggaaaagcagtgccagca

SEQ ID NO: 7680394 - DNA, 22 bp, Homo sapiens
cccaggaaagaaagtatatggt

SEQ ID NO: 7680395 - DNA, 22 bp, Homo sapiens
cccaggaaagaatttagagcca

SEQ ID NO: 7680396 - DNA, 22 bp, Homo sapiens
cccaggaaagaatttagagcca

SEQ ID NO: 7680397 - DNA, 22 bp, Homo sapiens
cccaggaaagaatttagagcca

SEQ ID NO: 7680398 - DNA, 22 bp, Homo sapiens
cccaggaaagagactgctgggt

SEQ ID NO: 7680399 - DNA, 22 bp, Homo sapiens
cccaggaaagagactgctgggt

SEQ ID NO: 7680400 - DNA, 22 bp, Homo sapiens
cccaggaaagtggaggcggctg

SEQ ID NO: 7680401 - DNA, 22 bp, Homo sapiens
cccaggaaagtggaggcggctg

SEQ ID NO: 7680402 - DNA, 22 bp, Homo sapiens
cccaggaaagtgaatctaattg

SEQ ID NO: 7680403 - DNA, 22 bp, Homo sapiens
cccaggaaagtgaatctaattg

SEQ ID NO: 7680404 - DNA, 22 bp, Homo sapiens
cccaggaaaggaaatgaatggg

SEQ ID NO: 7680405 - DNA, 22 bp, Homo sapiens
cccaggaaaggaaatgaatggg

SEQ ID NO: 7680406 - DNA, 22 bp, Homo sapiens
cccaggaaaggaaatgaatggg

SEQ ID NO: 7680407 - DNA, 22 bp, Homo sapiens
cccagcttctgagggggccttg

SEQ ID NO: 7680408 - DNA, 22 bp, Homo sapiens
cccagctgtggcagaggccggg

SEQ ID NO: 7680409 - DNA, 19 bp, Homo sapiens
cccagctgttcttccacca

SEQ ID NO: 7680410 - DNA, 19 bp, Homo sapiens
cccagctgttcttccacca

SEQ ID NO: 7680411 - DNA, 19 bp, Homo sapiens
cccagctgttcttccacca

SEQ ID NO: 7680412 - DNA, 19 bp, Homo sapiens
cccagctgttcttccacca

SEQ ID NO: 7680413 - DNA, 19 bp, Homo sapiens
cccagctgttcttccacca

SEQ ID NO: 7680414 - DNA, 22 bp, Homo sapiens
cccagcttgctcaccattccca

SEQ ID NO: 7680415 - DNA, 22 bp, Homo sapiens
cccagcttgcgggcggcaggag

SEQ ID NO: 7680416 - DNA, 22 bp, Homo sapiens
cccagcttgcccaggactgagg

SEQ ID NO: 7680417 - DNA, 22 bp, Homo sapiens
cccagcttgcccaggactgagg

SEQ ID NO: 7680418 - DNA, 19 bp, Homo sapiens
cccagcttgaccacctgct

SEQ ID NO: 7680419 - DNA, 18 bp, Homo sapiens
cccagctggtgggtcagt

SEQ ID NO: 7680420 - DNA, 22 bp, Homo sapiens
cccagctgtaacgggtctgcac

SEQ ID NO: 7680421 - DNA, 22 bp, Homo sapiens
cccagctgtaacgggtctgcac

SEQ ID NO: 7680422 - DNA, 18 bp, Homo sapiens
cccagctggtgggtcagt

SEQ ID NO: 7680423 - DNA, 18 bp, Homo sapiens
cccagctggtgggtcagt

SEQ ID NO: 7680424 - DNA, 22 bp, Homo sapiens
cccagctgtggcagaggccggg

SEQ ID NO: 7680425 - DNA, 22 bp, Homo sapiens
cccagctgtggcagaggccggg

SEQ ID NO: 7680426 - DNA, 22 bp, Homo sapiens
cccagctgtggcagaggccggg

SEQ ID NO: 7680427 - DNA, 22 bp, Homo sapiens
cccagctgtaacgggtctgcac

SEQ ID NO: 7680428 - DNA, 17 bp, Homo sapiens
cccagctggcagtgccg

SEQ ID NO: 7680429 - DNA, 17 bp, Homo sapiens
cccagctggcagtgccg

SEQ ID NO: 7680430 - DNA, 17 bp, Homo sapiens
cccagctggcagtgccg

SEQ ID NO: 7680431 - DNA, 22 bp, Homo sapiens
cccagctggccaggtggctttg

SEQ ID NO: 7680432 - DNA, 22 bp, Homo sapiens
cccagctggccaggtggctttg

SEQ ID NO: 7680433 - DNA, 18 bp, Homo sapiens
cccagctggtgggtcagt

SEQ ID NO: 7680434 - DNA, 18 bp, Homo sapiens
cccagctggtgggtcagt

SEQ ID NO: 7680435 - DNA, 23 bp, Homo sapiens
cccagctgcagacaagggagggt

SEQ ID NO: 7680436 - DNA, 23 bp, Homo sapiens
cccagctggaagttagaggacca

SEQ ID NO: 7680437 - DNA, 23 bp, Homo sapiens
cccagctggaagttagaggacca

SEQ ID NO: 7680438 - DNA, 23 bp, Homo sapiens
cccagctggaagttagaggacca

SEQ ID NO: 7680439 - DNA, 17 bp, Homo sapiens
cccagctggcagtgccg

SEQ ID NO: 7680440 - DNA, 23 bp, Homo sapiens
cccagctggaagttagaggacca

SEQ ID NO: 7680441 - DNA, 17 bp, Homo sapiens
cccagctggcagtgccg

SEQ ID NO: 7680442 - DNA, 17 bp, Homo sapiens
cccagctggcagtgccg

SEQ ID NO: 7680443 - DNA, 17 bp, Homo sapiens
cccagctggcagtgccg

SEQ ID NO: 7680444 - DNA, 23 bp, Homo sapiens
cccagctgcagacaagggagggt

SEQ ID NO: 7680445 - DNA, 23 bp, Homo sapiens
cccagctgcagacaagggagggt

SEQ ID NO: 7680446 - DNA, 23 bp, Homo sapiens
cccagctgcagacaagggagggt

SEQ ID NO: 7680447 - DNA, 17 bp, Homo sapiens
cccagctgcgtctgagg

SEQ ID NO: 7680448 - DNA, 17 bp, Homo sapiens
cccagctgcgtctgagg

SEQ ID NO: 7680449 - DNA, 17 bp, Homo sapiens
cccagctgcgtctgagg

SEQ ID NO: 7680450 - DNA, 17 bp, Homo sapiens
cccagctgcgtctgagg

SEQ ID NO: 7680451 - DNA, 23 bp, Homo sapiens
cccagctgcagacaagggagggt

SEQ ID NO: 7680452 - DNA, 23 bp, Homo sapiens
cccagctgcagacaagggagggt

SEQ ID NO: 7680453 - DNA, 22 bp, Homo sapiens
cccagctgcacctctatggcct

SEQ ID NO: 7680454 - DNA, 22 bp, Homo sapiens
cccagctgcacctctatggcct

SEQ ID NO: 7680455 - DNA, 22 bp, Homo sapiens
cccagctgcacctctatggcct

SEQ ID NO: 7680456 - DNA, 22 bp, Homo sapiens
cccagctgatttttgcagagat

SEQ ID NO: 7680457 - DNA, 22 bp, Homo sapiens
cccagctgcacctctatggcct

SEQ ID NO: 7680458 - DNA, 22 bp, Homo sapiens
cccagctgcacctctatggcct

SEQ ID NO: 7680459 - DNA, 22 bp, Homo sapiens
cccagctgatttttgcagagat

SEQ ID NO: 7680460 - DNA, 22 bp, Homo sapiens
cccagctgatttttgcagagat

SEQ ID NO: 7680461 - DNA, 22 bp, Homo sapiens
cccagctgatttttgcagagat

SEQ ID NO: 7680462 - DNA, 22 bp, Homo sapiens
cccagctgatttttgcagagat

SEQ ID NO: 7680463 - DNA, 22 bp, Homo sapiens
cccagctgatttttgcagagat

SEQ ID NO: 7680464 - DNA, 22 bp, Homo sapiens
cccagctgatttttgcagagat

SEQ ID NO: 7680465 - DNA, 22 bp, Homo sapiens
cccagctgatttttgcagagat

SEQ ID NO: 7680466 - DNA, 22 bp, Homo sapiens
cccagctgatttttgcagagat

SEQ ID NO: 7680467 - DNA, 23 bp, Homo sapiens
cccagctgagacttcctgaactc

SEQ ID NO: 7680468 - DNA, 23 bp, Homo sapiens
cccagctgagacttcctgaactc

SEQ ID NO: 7680469 - DNA, 23 bp, Homo sapiens
cccagctgagacttcctgaactc

SEQ ID NO: 7680470 - DNA, 23 bp, Homo sapiens
cccagctgagacttcctgaactc

SEQ ID NO: 7680471 - DNA, 22 bp, Homo sapiens
cccagctgaacttgcattccaa

SEQ ID NO: 7680472 - DNA, 23 bp, Homo sapiens
cccagctgagacttcctgaactc

SEQ ID NO: 7680473 - DNA, 22 bp, Homo sapiens
cccagctcttcctgggagctaa

SEQ ID NO: 7680474 - DNA, 22 bp, Homo sapiens
cccagctcttcctgggagctaa

SEQ ID NO: 7680475 - DNA, 22 bp, Homo sapiens
cccagctcttcctgggagctaa

SEQ ID NO: 7680476 - DNA, 22 bp, Homo sapiens
cccagctcttcaagtcaccccc

SEQ ID NO: 7680477 - DNA, 22 bp, Homo sapiens
cccagctcttcctgggagctaa

SEQ ID NO: 7680478 - DNA, 22 bp, Homo sapiens
cccagctcttcaagtcaccccc

SEQ ID NO: 7680479 - DNA, 22 bp, Homo sapiens
cccagctcttcaagtcaccccc

SEQ ID NO: 7680480 - DNA, 22 bp, Homo sapiens
cccagctcttcaagtcaccccc

SEQ ID NO: 7680481 - DNA, 22 bp, Homo sapiens
cccagctcttttagcggcatct

SEQ ID NO: 7680482 - DNA, 22 bp, Homo sapiens
cccagctcttttagcggcatct

SEQ ID NO: 7680483 - DNA, 22 bp, Homo sapiens
cccagctgaacttgcattccaa

SEQ ID NO: 7680484 - DNA, 22 bp, Homo sapiens
cccagctgaacttgcattccaa

SEQ ID NO: 7680485 - DNA, 22 bp, Homo sapiens
cccagctgaacttgcattccaa

SEQ ID NO: 7680486 - DNA, 22 bp, Homo sapiens
cccagctcttttagcggcatct

SEQ ID NO: 7680487 - DNA, 22 bp, Homo sapiens
cccagctcttcctgggagctaa

SEQ ID NO: 7680488 - DNA, 22 bp, Homo sapiens
cccagctcttcctgggagctaa

SEQ ID NO: 7680489 - DNA, 22 bp, Homo sapiens
cccagctcttttagcggcatct

SEQ ID NO: 7680490 - DNA, 22 bp, Homo sapiens
cccagctcttttagcggcatct

SEQ ID NO: 7680491 - DNA, 22 bp, Homo sapiens
tgcagggaggccccgcagccct

SEQ ID NO: 7680492 - DNA, 22 bp, Homo sapiens
tgcagggagctctggggtgcag

SEQ ID NO: 7680493 - DNA, 22 bp, Homo sapiens
tgcagggagctctggggtgcag

SEQ ID NO: 7680494 - DNA, 22 bp, Homo sapiens
tgcagggagctctggggtgcag

SEQ ID NO: 7680495 - DNA, 22 bp, Homo sapiens
tgcagggaccccgaggctctct

SEQ ID NO: 7680496 - DNA, 22 bp, Homo sapiens
tgcagggaccccgaggctctct

SEQ ID NO: 7680497 - DNA, 22 bp, Homo sapiens
tgcagggaccccgaggctctct

SEQ ID NO: 7680498 - DNA, 22 bp, Homo sapiens
tgcagggaccccgaggctctct

SEQ ID NO: 7680499 - DNA, 22 bp, Homo sapiens
tgcagggacaggctctggggat

SEQ ID NO: 7680500 - DNA, 22 bp, Homo sapiens
tgcagggacaggctctggggat

SEQ ID NO: 7680501 - DNA, 22 bp, Homo sapiens
tgcagggacacgaagacaaata

SEQ ID NO: 7680502 - DNA, 22 bp, Homo sapiens
tgcagggacacgaagacaaata

SEQ ID NO: 7680503 - DNA, 22 bp, Homo sapiens
tgcagggacaggctctggggat

SEQ ID NO: 7680504 - DNA, 22 bp, Homo sapiens
tgcagggacaggctctggggat

SEQ ID NO: 7680505 - DNA, 22 bp, Homo sapiens
cccagctccttacagggccgaa

SEQ ID NO: 7680506 - DNA, 22 bp, Homo sapiens
cccagctccttacagggccgaa

SEQ ID NO: 7680507 - DNA, 22 bp, Homo sapiens
cccagctccgagctccgagccg

SEQ ID NO: 7680508 - DNA, 22 bp, Homo sapiens
cccagctccgagctccgagccg

SEQ ID NO: 7680509 - DNA, 22 bp, Homo sapiens
cccagctcttcaagtcaccccc

SEQ ID NO: 7680510 - DNA, 22 bp, Homo sapiens
cccagctcttcaagtcaccccc

SEQ ID NO: 7680511 - DNA, 22 bp, Homo sapiens
cccagctcttcaagtcaccccc

SEQ ID NO: 7680512 - DNA, 22 bp, Homo sapiens
cccagctcttcaagtcaccccc

SEQ ID NO: 7680513 - DNA, 22 bp, Homo sapiens
cccagctcttcaagtcaccccc

SEQ ID NO: 7680514 - DNA, 22 bp, Homo sapiens
cccagctccttacagggccgaa

SEQ ID NO: 7680515 - DNA, 22 bp, Homo sapiens
cccagctctggaaggtggggga

SEQ ID NO: 7680516 - DNA, 22 bp, Homo sapiens
cccagctccttacagggccgaa

SEQ ID NO: 7680517 - DNA, 22 bp, Homo sapiens
cccagctccttacagggccgaa

SEQ ID NO: 7680518 - DNA, 22 bp, Homo sapiens
tgcagggaggccccgcagccct

SEQ ID NO: 7680519 - DNA, 22 bp, Homo sapiens
tgcagggagggcccagcaatct

SEQ ID NO: 7680520 - DNA, 22 bp, Homo sapiens
tgcagggaggccccgcagccct

SEQ ID NO: 7680521 - DNA, 22 bp, Homo sapiens
tgcagggaggccccgcagccct

SEQ ID NO: 7680522 - DNA, 22 bp, Homo sapiens
tgcagggatcctagctgaagag

SEQ ID NO: 7680523 - DNA, 22 bp, Homo sapiens
tgcagggagggcccagcaatct

SEQ ID NO: 7680524 - DNA, 22 bp, Homo sapiens
cccagctacctctgctaggaga

SEQ ID NO: 7680525 - DNA, 22 bp, Homo sapiens
cccagctacctctgctaggaga

SEQ ID NO: 7680526 - DNA, 22 bp, Homo sapiens
cccagctcaagcagagagctaa

SEQ ID NO: 7680527 - DNA, 22 bp, Homo sapiens
cccagctcaagcagagagctaa

SEQ ID NO: 7680528 - DNA, 22 bp, Homo sapiens
cccagctcaagcagagagctaa

SEQ ID NO: 7680529 - DNA, 22 bp, Homo sapiens
cccagctcaagcagagagctaa

SEQ ID NO: 7680530 - DNA, 22 bp, Homo sapiens
cccagctacctctgctaggaga

SEQ ID NO: 7680531 - DNA, 22 bp, Homo sapiens
cccagctcaagcagagagctaa

SEQ ID NO: 7680532 - DNA, 22 bp, Homo sapiens
cccagcgagtttgccggtgaac

SEQ ID NO: 7680533 - DNA, 22 bp, Homo sapiens
cccagcgagtttgccggtgaac

SEQ ID NO: 7680534 - DNA, 22 bp, Homo sapiens
cccagcgagtttgccggtgaac

SEQ ID NO: 7680535 - DNA, 22 bp, Homo sapiens
cccagcgagtttgccggtgaac

SEQ ID NO: 7680536 - DNA, 22 bp, Homo sapiens
cccagcgagtttgccggtgaac

SEQ ID NO: 7680537 - DNA, 23 bp, Homo sapiens
cccagcgctgagccctgcaggca

SEQ ID NO: 7680538 - DNA, 23 bp, Homo sapiens
cccagcgctgagccctgcaggca

SEQ ID NO: 7680539 - DNA, 22 bp, Homo sapiens
cccagcgagtttgccggtgaac

SEQ ID NO: 7680540 - DNA, 23 bp, Homo sapiens
cccagcgctgagccctgcaggca

SEQ ID NO: 7680541 - DNA, 23 bp, Homo sapiens
cccagcgctgagccctgcaggca

SEQ ID NO: 7680542 - DNA, 22 bp, Homo sapiens
tgcagggacacgaagacaaata

SEQ ID NO: 7680543 - DNA, 22 bp, Homo sapiens
tgcagggacacgaagacaaata

SEQ ID NO: 7680544 - DNA, 22 bp, Homo sapiens
tgcagggaatgcttgcagcatg

SEQ ID NO: 7680545 - DNA, 22 bp, Homo sapiens
tgcagggaatgcttgcagcatg

SEQ ID NO: 7680546 - DNA, 22 bp, Homo sapiens
tgcagggaatgcttgcagcatg

SEQ ID NO: 7680547 - DNA, 22 bp, Homo sapiens
tgcagggaatgcttgcagcatg

SEQ ID NO: 7680548 - DNA, 22 bp, Homo sapiens
tgcagggaatctgtggctggac

SEQ ID NO: 7680549 - DNA, 22 bp, Homo sapiens
tgcagggaatctgtggctggac

SEQ ID NO: 7680550 - DNA, 22 bp, Homo sapiens
tgcagggaatctgtggctggac

SEQ ID NO: 7680551 - DNA, 22 bp, Homo sapiens
tgcagggaatctgtggctggac

SEQ ID NO: 7680552 - DNA, 22 bp, Homo sapiens
tgcagggaatgcttgcagcatg

SEQ ID NO: 7680553 - DNA, 22 bp, Homo sapiens
tgcagggaatgcttgcagcatg

SEQ ID NO: 7680554 - DNA, 22 bp, Homo sapiens
tgcagggaatgcttgcagcatg

SEQ ID NO: 7680555 - DNA, 22 bp, Homo sapiens
tgcagggaatgcttgcagcatg

SEQ ID NO: 7680556 - DNA, 22 bp, Homo sapiens
cccagccttccaccctggacta

SEQ ID NO: 7680557 - DNA, 22 bp, Homo sapiens
cccagcctgtgacagccgtcct

SEQ ID NO: 7680558 - DNA, 22 bp, Homo sapiens
cccagcctgtgacagccgtcct

SEQ ID NO: 7680559 - DNA, 22 bp, Homo sapiens
cccagcctgtgacagccgtcct

SEQ ID NO: 7680560 - DNA, 22 bp, Homo sapiens
cccagcctgtctttcccaatga

SEQ ID NO: 7680561 - DNA, 22 bp, Homo sapiens
cccagcctggtgcactgtgggg

SEQ ID NO: 7680562 - DNA, 22 bp, Homo sapiens
cccagcctggtgcactgtgggg

SEQ ID NO: 7680563 - DNA, 22 bp, Homo sapiens
cccagcctgtctttcccaatga

SEQ ID NO: 7680564 - DNA, 22 bp, Homo sapiens
cccagcctgtgacagccgtcct

SEQ ID NO: 7680565 - DNA, 22 bp, Homo sapiens
cccagcctgtgacagccgtcct

SEQ ID NO: 7680566 - DNA, 22 bp, Homo sapiens
cccagcctgtgacagccgtcct

SEQ ID NO: 7680567 - DNA, 22 bp, Homo sapiens
cccagcctgtctttcccaatga

SEQ ID NO: 7680568 - DNA, 22 bp, Homo sapiens
cccagcctgtctttcccaatga

SEQ ID NO: 7680569 - DNA, 22 bp, Homo sapiens
cccagcctttgcttcctggttc

SEQ ID NO: 7680570 - DNA, 22 bp, Homo sapiens
cccagcctttgcttcctggttc

SEQ ID NO: 7680571 - DNA, 22 bp, Homo sapiens
cccagcctttgcttcctggttc

SEQ ID NO: 7680572 - DNA, 22 bp, Homo sapiens
cccagcctttgcttcctggttc

SEQ ID NO: 7680573 - DNA, 22 bp, Homo sapiens
cccagcctttgcttcctggttc

SEQ ID NO: 7680574 - DNA, 22 bp, Homo sapiens
cccagcctttgcttcctggttc

SEQ ID NO: 7680575 - DNA, 22 bp, Homo sapiens
cccagcctttgcttcctggttc

SEQ ID NO: 7680576 - DNA, 22 bp, Homo sapiens
cccagcctttgcttcctggttc

SEQ ID NO: 7680577 - DNA, 22 bp, Homo sapiens
cccagcctttgcttcctggttc

SEQ ID NO: 7680578 - DNA, 22 bp, Homo sapiens
cccagcctttgcttcctggttc

SEQ ID NO: 7680579 - DNA, 22 bp, Homo sapiens
cccagccttccaccctggacta

SEQ ID NO: 7680580 - DNA, 22 bp, Homo sapiens
cccagccttccaccctggacta

SEQ ID NO: 7680581 - DNA, 22 bp, Homo sapiens
cccagccttccaccctggacta

SEQ ID NO: 7680582 - DNA, 22 bp, Homo sapiens
cccagccttccaccctggacta

SEQ ID NO: 7680583 - DNA, 22 bp, Homo sapiens
cccagccttccaccctggacta

SEQ ID NO: 7680584 - DNA, 22 bp, Homo sapiens
cccagccttccaccctggacta

SEQ ID NO: 7680585 - DNA, 22 bp, Homo sapiens
cccagccttccaccctggacta

SEQ ID NO: 7680586 - DNA, 22 bp, Homo sapiens
cccagccttccaccctggacta

SEQ ID NO: 7680587 - DNA, 22 bp, Homo sapiens
cccagcctactctgccatagca

SEQ ID NO: 7680588 - DNA, 21 bp, Homo sapiens
tctgtggcggactctaggccc

SEQ ID NO: 7680589 - DNA, 22 bp, Homo sapiens
cccagcctactctgccatagca

SEQ ID NO: 7680590 - DNA, 22 bp, Homo sapiens
cccagcctactctgccatagca

SEQ ID NO: 7680591 - DNA, 22 bp, Homo sapiens
cccagcctactctgccatagca

SEQ ID NO: 7680592 - DNA, 22 bp, Homo sapiens
cccagcctactctgccatagca

SEQ ID NO: 7680593 - DNA, 22 bp, Homo sapiens
cccagcctactctgccatagca

SEQ ID NO: 7680594 - DNA, 22 bp, Homo sapiens
cccagcctactctgccatagca

SEQ ID NO: 7680595 - DNA, 21 bp, Homo sapiens
tctgtggcggactctaggccc

SEQ ID NO: 7680596 - DNA, 22 bp, Homo sapiens
cccagcctactctgccatagca

SEQ ID NO: 7680597 - DNA, 22 bp, Homo sapiens
tctgtggcatagtgcttgggaa

SEQ ID NO: 7680598 - DNA, 22 bp, Homo sapiens
tctgtggcatggtatctggagg

SEQ ID NO: 7680599 - DNA, 22 bp, Homo sapiens
tctgtggcatgttgcacttgta

SEQ ID NO: 7680600 - DNA, 22 bp, Homo sapiens
tctgtggcccaagtgatggctg

SEQ ID NO: 7680601 - DNA, 22 bp, Homo sapiens
tctgtggcctgcctcctcattt

SEQ ID NO: 7680602 - DNA, 22 bp, Homo sapiens
tggcacaggagcactgccctgg

SEQ ID NO: 7680603 - DNA, 22 bp, Homo sapiens
tggcacaggagcactgccctgg

SEQ ID NO: 7680604 - DNA, 22 bp, Homo sapiens
tggcacaggagcactgccctgg

SEQ ID NO: 7680605 - DNA, 22 bp, Homo sapiens
tggcacaggagcactgccctgg

SEQ ID NO: 7680606 - DNA, 22 bp, Homo sapiens
tggcacaggaatttagatgcag

SEQ ID NO: 7680607 - DNA, 22 bp, Homo sapiens
tggcacaggagcactgccctgg

SEQ ID NO: 7680608 - DNA, 22 bp, Homo sapiens
tggcacaggatctcagcggcca

SEQ ID NO: 7680609 - DNA, 22 bp, Homo sapiens
tggcacaggagcactgccctgg

SEQ ID NO: 7680610 - DNA, 22 bp, Homo sapiens
tggcacaggatctcagcggcca

SEQ ID NO: 7680611 - DNA, 22 bp, Homo sapiens
tggcacaggatctcagcggcca

SEQ ID NO: 7680612 - DNA, 22 bp, Homo sapiens
tggcacaggagcactgccctgg

SEQ ID NO: 7680613 - DNA, 22 bp, Homo sapiens
tggcacaggatctcagcggcca

SEQ ID NO: 7680614 - DNA, 22 bp, Homo sapiens
tggcacaggatctcagcggcca

SEQ ID NO: 7680615 - DNA, 22 bp, Homo sapiens
tggcacaggcggtaagggtgtg

SEQ ID NO: 7680616 - DNA, 22 bp, Homo sapiens
tggcacaggcggtaagggtgtg

SEQ ID NO: 7680617 - DNA, 22 bp, Homo sapiens
tggcacaggcggtaagggtgtg

SEQ ID NO: 7680618 - DNA, 22 bp, Homo sapiens
tggcacaggcggtaagggtgtg

SEQ ID NO: 7680619 - DNA, 22 bp, Homo sapiens
tggcacaggatctcagcggcca

SEQ ID NO: 7680620 - DNA, 22 bp, Homo sapiens
tggcacaggatctcagcggcca

SEQ ID NO: 7680621 - DNA, 22 bp, Homo sapiens
tggcacaggatctcagcggcca

SEQ ID NO: 7680622 - DNA, 22 bp, Homo sapiens
tggcacaggatctcagcggcca

SEQ ID NO: 7680623 - DNA, 22 bp, Homo sapiens
tggcacaggatctcagcggcca

SEQ ID NO: 7680624 - DNA, 22 bp, Homo sapiens
tggcagaggtaattcaaatccc

SEQ ID NO: 7680625 - DNA, 22 bp, Homo sapiens
tggcagaggtatattgggagga

SEQ ID NO: 7680626 - DNA, 22 bp, Homo sapiens
tggcagaggtatattgggagga

SEQ ID NO: 7680627 - DNA, 22 bp, Homo sapiens
tggcacagtcctgggtgcctgc

SEQ ID NO: 7680628 - DNA, 22 bp, Homo sapiens
tggcacagtcctgggtgcctgc

SEQ ID NO: 7680629 - DNA, 22 bp, Homo sapiens
tggcacagtcctgggtgcctgc

SEQ ID NO: 7680630 - DNA, 22 bp, Homo sapiens
tggcagaggtaattcaaatccc

SEQ ID NO: 7680631 - DNA, 22 bp, Homo sapiens
tggcacagtcctgggtgcctgc

SEQ ID NO: 7680632 - DNA, 22 bp, Homo sapiens
tggcacagtcctgggtgcctgc

SEQ ID NO: 7680633 - DNA, 22 bp, Homo sapiens
tggcacagtcctgggtgcctgc

SEQ ID NO: 7680634 - DNA, 22 bp, Homo sapiens
tggcacagtcctgggtgcctgc

SEQ ID NO: 7680635 - DNA, 22 bp, Homo sapiens
tggcacagtcctgggtgcctgc

SEQ ID NO: 7680636 - DNA, 22 bp, Homo sapiens
tggcacagggcttggtcgctca

SEQ ID NO: 7680637 - DNA, 22 bp, Homo sapiens
tggcacagtcctgggtgcctgc

SEQ ID NO: 7680638 - DNA, 22 bp, Homo sapiens
tggcacagggcttggtcgctca

SEQ ID NO: 7680639 - DNA, 22 bp, Homo sapiens
tggcacagggcttggtcgctca

SEQ ID NO: 7680640 - DNA, 22 bp, Homo sapiens
tggcacagggcttggtcgctca

SEQ ID NO: 7680641 - DNA, 22 bp, Homo sapiens
tggcacagggcttggtcgctca

SEQ ID NO: 7680642 - DNA, 22 bp, Homo sapiens
tggcacagggcttggtcgctca

SEQ ID NO: 7680643 - DNA, 22 bp, Homo sapiens
tggcaaggctgtgggggcagag

SEQ ID NO: 7680644 - DNA, 22 bp, Homo sapiens
tggcaaggctgtgggggcagag

SEQ ID NO: 7680645 - DNA, 22 bp, Homo sapiens
tggcaaggctgtgggggcagag

SEQ ID NO: 7680646 - DNA, 22 bp, Homo sapiens
tggcaaggctgtgggggcagag

SEQ ID NO: 7680647 - DNA, 22 bp, Homo sapiens
tggcaaggccacaggtgcagtt

SEQ ID NO: 7680648 - DNA, 22 bp, Homo sapiens
tggcaaggccacaggtgcagtt

SEQ ID NO: 7680649 - DNA, 22 bp, Homo sapiens
tggcaaggctgtgggggcagag

SEQ ID NO: 7680650 - DNA, 22 bp, Homo sapiens
tggcaaggctgtgggggcagag

SEQ ID NO: 7680651 - DNA, 22 bp, Homo sapiens
tggcaaggctgtgggggcagag

SEQ ID NO: 7680652 - DNA, 22 bp, Homo sapiens
tggcaagggattgtggagaact

SEQ ID NO: 7680653 - DNA, 22 bp, Homo sapiens
tggcaagggattgtggagaact

SEQ ID NO: 7680654 - DNA, 22 bp, Homo sapiens
tggcaaggccacaggtgcagtt

SEQ ID NO: 7680655 - DNA, 22 bp, Homo sapiens
tggcaaggccacaggtgcagtt

SEQ ID NO: 7680656 - DNA, 22 bp, Homo sapiens
tggcaaggccacaggtgcagtt

SEQ ID NO: 7680657 - DNA, 23 bp, Homo sapiens
tggcaaggaatgggatggagact

SEQ ID NO: 7680658 - DNA, 23 bp, Homo sapiens
tggcaaggaatgggatggagact

SEQ ID NO: 7680659 - DNA, 23 bp, Homo sapiens
tggcaaggaatgggatggagact

SEQ ID NO: 7680660 - DNA, 23 bp, Homo sapiens
tggcaaggaatgggatggagact

SEQ ID NO: 7680661 - DNA, 23 bp, Homo sapiens
tggcaaggaatgggatggagact

SEQ ID NO: 7680662 - DNA, 22 bp, Homo sapiens
tggcacagcttgtcataaactc

SEQ ID NO: 7680663 - DNA, 22 bp, Homo sapiens
tggcacagcttgtcataaactc

SEQ ID NO: 7680664 - DNA, 22 bp, Homo sapiens
tggcaagttcatatggtttaag

SEQ ID NO: 7680665 - DNA, 22 bp, Homo sapiens
tggcaagttaaaatgtggtctt

SEQ ID NO: 7680666 - DNA, 22 bp, Homo sapiens
tggcacaggaatttagatgcag

SEQ ID NO: 7680667 - DNA, 22 bp, Homo sapiens
tggcacaggaatttagatgcag

SEQ ID NO: 7680668 - DNA, 22 bp, Homo sapiens
tggcacaggaatttagatgcag

SEQ ID NO: 7680669 - DNA, 22 bp, Homo sapiens
tggcaagtggcttgtatacgcc

SEQ ID NO: 7680670 - DNA, 22 bp, Homo sapiens
tggcaagttaaaatgtggtctt

SEQ ID NO: 7680671 - DNA, 22 bp, Homo sapiens
tggcaagtggcatagaatagcc

SEQ ID NO: 7680672 - DNA, 22 bp, Homo sapiens
tggcaagtggcatagaatagcc

SEQ ID NO: 7680673 - DNA, 22 bp, Homo sapiens
tggcaagtggcttgtatacgcc

SEQ ID NO: 7680674 - DNA, 15 bp, Homo sapiens
tggcaagtgctagta

SEQ ID NO: 7680675 - DNA, 22 bp, Homo sapiens
tggcaagtggcaccggctgtgg

SEQ ID NO: 7680676 - DNA, 22 bp, Homo sapiens
tggcaagtggcatagaatagcc

SEQ ID NO: 7680677 - DNA, 23 bp, Homo sapiens
tggcaagtcatttctagtaacct

SEQ ID NO: 7680678 - DNA, 22 bp, Homo sapiens
tggcaagtcttgcaggcagagg

SEQ ID NO: 7680679 - DNA, 22 bp, Homo sapiens
tggcaagtcttgcaggcagagg

SEQ ID NO: 7680680 - DNA, 18 bp, Homo sapiens
tggcaagtaatgacaaaa

SEQ ID NO: 7680681 - DNA, 23 bp, Homo sapiens
tggcaagtcatttctagtaacct

SEQ ID NO: 7680682 - DNA, 18 bp, Homo sapiens
tggcaagtaatgacaaaa

SEQ ID NO: 7680683 - DNA, 22 bp, Homo sapiens
tggcaagggattgtggagaact

SEQ ID NO: 7680684 - DNA, 18 bp, Homo sapiens
tggcaagtaatgacaaaa

SEQ ID NO: 7680685 - DNA, 22 bp, Homo sapiens
tggcagctggatcccaaggcag

SEQ ID NO: 7680686 - DNA, 22 bp, Homo sapiens
tggcagctggatcccaaggcag

SEQ ID NO: 7680687 - DNA, 22 bp, Homo sapiens
tggcagctggatcccaaggcag

SEQ ID NO: 7680688 - DNA, 22 bp, Homo sapiens
tggcagctggctctgcgcaggc

SEQ ID NO: 7680689 - DNA, 22 bp, Homo sapiens
tggcagctggctctgcgcaggc

SEQ ID NO: 7680690 - DNA, 22 bp, Homo sapiens
tggcagctggctctgcgcaggc

SEQ ID NO: 7680691 - DNA, 22 bp, Homo sapiens
tggcagctggagggcaatggcc

SEQ ID NO: 7680692 - DNA, 22 bp, Homo sapiens
tggcagctggagggcaatggcc

SEQ ID NO: 7680693 - DNA, 22 bp, Homo sapiens
tggcagctggagggcaatggcc

SEQ ID NO: 7680694 - DNA, 22 bp, Homo sapiens
tggcagctggagggcaatggcc

SEQ ID NO: 7680695 - DNA, 22 bp, Homo sapiens
tggcagcacggcatccactctc

SEQ ID NO: 7680696 - DNA, 22 bp, Homo sapiens
tggcagcacggcatccactctc

SEQ ID NO: 7680697 - DNA, 22 bp, Homo sapiens
tggcagcacggcatccactctc

SEQ ID NO: 7680698 - DNA, 22 bp, Homo sapiens
tggcagcacggcatccactctc

SEQ ID NO: 7680699 - DNA, 22 bp, Homo sapiens
tggcagcacggcatccactctc

SEQ ID NO: 7680700 - DNA, 22 bp, Homo sapiens
tggcagcacggcatccactctc

SEQ ID NO: 7680701 - DNA, 21 bp, Homo sapiens
tggcagcacccacaccctctg

SEQ ID NO: 7680702 - DNA, 22 bp, Homo sapiens
tggcagcactaggtactgagct

SEQ ID NO: 7680703 - DNA, 22 bp, Homo sapiens
tggcagcactaggtactgagct

SEQ ID NO: 7680704 - DNA, 22 bp, Homo sapiens
tggcagcacggcatccactctc

SEQ ID NO: 7680705 - DNA, 22 bp, Homo sapiens
tggcagcactaggtactgagct

SEQ ID NO: 7680706 - DNA, 22 bp, Homo sapiens
tggcagcaccagcagtgtcctt

SEQ ID NO: 7680707 - DNA, 21 bp, Homo sapiens
tggcagcacccacaccctctg

SEQ ID NO: 7680708 - DNA, 21 bp, Homo sapiens
tggcagcacccacaccctctg

SEQ ID NO: 7680709 - DNA, 21 bp, Homo sapiens
tggcagcacccacaccctctg

SEQ ID NO: 7680710 - DNA, 22 bp, Homo sapiens
tggcagcacattgacccgggct

SEQ ID NO: 7680711 - DNA, 22 bp, Homo sapiens
tggcagcacattgacccgggct

SEQ ID NO: 7680712 - DNA, 22 bp, Homo sapiens
tggcagcacattgacccgggct

SEQ ID NO: 7680713 - DNA, 22 bp, Homo sapiens
tggcagcacattgacccgggct

SEQ ID NO: 7680714 - DNA, 22 bp, Homo sapiens
tggcagcaccagcagtgtcctt

SEQ ID NO: 7680715 - DNA, 22 bp, Homo sapiens
tggcagcaccagcagtgtcctt

SEQ ID NO: 7680716 - DNA, 22 bp, Homo sapiens
tggcagcaccagcagtgtcctt

SEQ ID NO: 7680717 - DNA, 22 bp, Homo sapiens
tggcagcaatttgtgatgttga

SEQ ID NO: 7680718 - DNA, 22 bp, Homo sapiens
tggcagcaatttgtgatgttga

SEQ ID NO: 7680719 - DNA, 22 bp, Homo sapiens
tggcagcaatttgtgatgttga

SEQ ID NO: 7680720 - DNA, 22 bp, Homo sapiens
tggcagcaatttgtgatgttga

SEQ ID NO: 7680721 - DNA, 22 bp, Homo sapiens
tggcagcacaaggtggcccatg

SEQ ID NO: 7680722 - DNA, 22 bp, Homo sapiens
tggcagcacaaggtggcccatg

SEQ ID NO: 7680723 - DNA, 22 bp, Homo sapiens
tggcagcacaaggtggcccatg

SEQ ID NO: 7680724 - DNA, 22 bp, Homo sapiens
tggcagcaatttgtgatgttga

SEQ ID NO: 7680725 - DNA, 22 bp, Homo sapiens
tggcagcacaaggtggcccatg

SEQ ID NO: 7680726 - DNA, 22 bp, Homo sapiens
tggcagatgagccgcgctccaa

SEQ ID NO: 7680727 - DNA, 22 bp, Homo sapiens
tggcagaggtatattgggagga

SEQ ID NO: 7680728 - DNA, 22 bp, Homo sapiens
tggcagaggtatattgggagga

SEQ ID NO: 7680729 - DNA, 22 bp, Homo sapiens
tggcagatggcctggaaccaaa

SEQ ID NO: 7680730 - DNA, 22 bp, Homo sapiens
tggcagatgtatatcacagctt

SEQ ID NO: 7680731 - DNA, 22 bp, Homo sapiens
tggcagatgtatatcacagctt

SEQ ID NO: 7680732 - DNA, 22 bp, Homo sapiens
tggcagattttctctggaggag

SEQ ID NO: 7680733 - DNA, 22 bp, Homo sapiens
tggcagattttctctggaggag

SEQ ID NO: 7680734 - DNA, 22 bp, Homo sapiens
tggcagatttaacattggaact

SEQ ID NO: 7680735 - DNA, 22 bp, Homo sapiens
tggcagatttaacattggaact

SEQ ID NO: 7680736 - DNA, 22 bp, Homo sapiens
tggcagatgtggcatagagcat

SEQ ID NO: 7680737 - DNA, 22 bp, Homo sapiens
tggcagatgtggcatagagcat

SEQ ID NO: 7680738 - DNA, 22 bp, Homo sapiens
tggcagattctggttgatactt

SEQ ID NO: 7680739 - DNA, 22 bp, Homo sapiens
tggcagattctggttgatactt

SEQ ID NO: 7680740 - DNA, 22 bp, Homo sapiens
tggcagatttaacattggaact

SEQ ID NO: 7680741 - DNA, 22 bp, Homo sapiens
tggcagcaaaaccagaatcaga

SEQ ID NO: 7680742 - DNA, 22 bp, Homo sapiens
tggcagcaaaaccagaatcaga

SEQ ID NO: 7680743 - DNA, 22 bp, Homo sapiens
tggcagcaagttcttgggaggt

SEQ ID NO: 7680744 - DNA, 22 bp, Homo sapiens
tggcagcaaaaccagaatcaga

SEQ ID NO: 7680745 - DNA, 22 bp, Homo sapiens
tggcagcaagttcttgggaggt

SEQ ID NO: 7680746 - DNA, 22 bp, Homo sapiens
tggcagcaagttcttgggaggt

SEQ ID NO: 7680747 - DNA, 22 bp, Homo sapiens
tggcagcaaaaccagaatcaga

SEQ ID NO: 7680748 - DNA, 22 bp, Homo sapiens
tggcagcaaaaccagaatcaga

SEQ ID NO: 7680749 - DNA, 22 bp, Homo sapiens
tggcagcaaaaccagaatcaga

SEQ ID NO: 7680750 - DNA, 22 bp, Homo sapiens
tggcagcaaaaccagaatcaga

SEQ ID NO: 7680751 - DNA, 22 bp, Homo sapiens
tggcagcaattagctagagctg

SEQ ID NO: 7680752 - DNA, 22 bp, Homo sapiens
tggcagcaattagctagagctg

SEQ ID NO: 7680753 - DNA, 22 bp, Homo sapiens
tggcagcaattagctagagctg

SEQ ID NO: 7680754 - DNA, 22 bp, Homo sapiens
tggcagcaattagctagagctg

SEQ ID NO: 7680755 - DNA, 22 bp, Homo sapiens
tggcagcaattagctagagctg

SEQ ID NO: 7680756 - DNA, 22 bp, Homo sapiens
tggcagcaatagaaatataatc

SEQ ID NO: 7680757 - DNA, 22 bp, Homo sapiens
tggcagcaatagaaatataatc

SEQ ID NO: 7680758 - DNA, 22 bp, Homo sapiens
tggcagcaagttcttgggaggt

SEQ ID NO: 7680759 - DNA, 22 bp, Homo sapiens
tggcagcaagttcttgggaggt

SEQ ID NO: 7680760 - DNA, 22 bp, Homo sapiens
tggcagctgttaatgttttgtt

SEQ ID NO: 7680761 - DNA, 22 bp, Homo sapiens
tggcagctgtgtccaggtagaa

SEQ ID NO: 7680762 - DNA, 22 bp, Homo sapiens
tggcagctgtgtccaggtagaa

SEQ ID NO: 7680763 - DNA, 22 bp, Homo sapiens
tggcagctgtgtccaggtagaa

SEQ ID NO: 7680764 - DNA, 22 bp, Homo sapiens
tggcagctgtgtccaggtagaa

SEQ ID NO: 7680765 - DNA, 22 bp, Homo sapiens
tggcagctgtgtccaggtagaa

SEQ ID NO: 7680766 - DNA, 23 bp, Homo sapiens
tggcagctgtgtaagagaaagca

SEQ ID NO: 7680767 - DNA, 22 bp, Homo sapiens
tggcagctgtgtccaggtagaa

SEQ ID NO: 7680768 - DNA, 22 bp, Homo sapiens
tggcagctgtgtccaggtagaa

SEQ ID NO: 7680769 - DNA, 22 bp, Homo sapiens
tggcagcttcctgctcatagga

SEQ ID NO: 7680770 - DNA, 22 bp, Homo sapiens
tggcagcttcctgctcatagga

SEQ ID NO: 7680771 - DNA, 22 bp, Homo sapiens
tggcagcttcctgctcatagga

SEQ ID NO: 7680772 - DNA, 22 bp, Homo sapiens
tggcagcttcctgctcatagga

SEQ ID NO: 7680773 - DNA, 22 bp, Homo sapiens
tggcagcttcctgctcatagga

SEQ ID NO: 7680774 - DNA, 22 bp, Homo sapiens
tggcagcttgaatgcagtcttt

SEQ ID NO: 7680775 - DNA, 22 bp, Homo sapiens
tggcagctgttaatgttttgtt

SEQ ID NO: 7680776 - DNA, 22 bp, Homo sapiens
tggcagcttgaatgcagtcttt

SEQ ID NO: 7680777 - DNA, 22 bp, Homo sapiens
tggcagcttgaatgcagtcttt

SEQ ID NO: 7680778 - DNA, 22 bp, Homo sapiens
tggcagcttgaatgcagtcttt

SEQ ID NO: 7680779 - DNA, 22 bp, Homo sapiens
tggcagctggctctgcgcaggc

SEQ ID NO: 7680780 - DNA, 22 bp, Homo sapiens
tggcagctggtacagtgggtct

SEQ ID NO: 7680781 - DNA, 22 bp, Homo sapiens
tggcagctggtacagtgggtct

SEQ ID NO: 7680782 - DNA, 22 bp, Homo sapiens
tggcagctggctctgcgcaggc

SEQ ID NO: 7680783 - DNA, 22 bp, Homo sapiens
tggcagctgtcagaatgcaaat

SEQ ID NO: 7680784 - DNA, 22 bp, Homo sapiens
tggcagctgtcagaatgcaaat

SEQ ID NO: 7680785 - DNA, 22 bp, Homo sapiens
tggcagctgtcagaatgcaaat

SEQ ID NO: 7680786 - DNA, 22 bp, Homo sapiens
tggcagctggtacagtgggtct

SEQ ID NO: 7680787 - DNA, 22 bp, Homo sapiens
tggcagctggtacagtgggtct

SEQ ID NO: 7680788 - DNA, 22 bp, Homo sapiens
tggcagctggtacagtgggtct

SEQ ID NO: 7680789 - DNA, 23 bp, Homo sapiens
tggcagctgtgtaagagaaagca

SEQ ID NO: 7680790 - DNA, 23 bp, Homo sapiens
tggcagctgtgtaagagaaagca

SEQ ID NO: 7680791 - DNA, 22 bp, Homo sapiens
tggcagctgtgcttcattcttt

SEQ ID NO: 7680792 - DNA, 22 bp, Homo sapiens
tggcagctgtgcttcattcttt

SEQ ID NO: 7680793 - DNA, 22 bp, Homo sapiens
tggcagctgtgcttcattcttt

SEQ ID NO: 7680794 - DNA, 22 bp, Homo sapiens
tggcagctgtgcttcattcttt

SEQ ID NO: 7680795 - DNA, 22 bp, Homo sapiens
tggcagctgtctgtggggtctc

SEQ ID NO: 7680796 - DNA, 22 bp, Homo sapiens
tggcagctgtctgtggggtctc

SEQ ID NO: 7680797 - DNA, 22 bp, Homo sapiens
tggcagctgtctgtggggtctc

SEQ ID NO: 7680798 - DNA, 22 bp, Homo sapiens
tggcagctgtctgtggggtctc

SEQ ID NO: 7680799 - DNA, 22 bp, Homo sapiens
tggcagctgtctgtggggtctc

SEQ ID NO: 7680800 - DNA, 22 bp, Homo sapiens
tggcagctgtctgtggggtctc

SEQ ID NO: 7680801 - DNA, 22 bp, Homo sapiens
tggcagctgtctgtggggtctc

SEQ ID NO: 7680802 - DNA, 22 bp, Homo sapiens
tggcagctgtctgtggggtctc

SEQ ID NO: 7680803 - DNA, 22 bp, Homo sapiens
tggccacacccacctagaggag

SEQ ID NO: 7680804 - DNA, 22 bp, Homo sapiens
tggccacacccacctagaggag

SEQ ID NO: 7680805 - DNA, 22 bp, Homo sapiens
tggccacacccacctagaggag

SEQ ID NO: 7680806 - DNA, 22 bp, Homo sapiens
tggccacacccacctagaggag

SEQ ID NO: 7680807 - DNA, 22 bp, Homo sapiens
tggccacacccacctagaggag

SEQ ID NO: 7680808 - DNA, 22 bp, Homo sapiens
tggccacacccacctagaggag

SEQ ID NO: 7680809 - DNA, 22 bp, Homo sapiens
tggccacacccacctagaggag

SEQ ID NO: 7680810 - DNA, 22 bp, Homo sapiens
tggccacacccacctagaggag

SEQ ID NO: 7680811 - DNA, 22 bp, Homo sapiens
tggccacacccacctagaggag

SEQ ID NO: 7680812 - DNA, 22 bp, Homo sapiens
tggccagctgtaggttgtgcag

SEQ ID NO: 7680813 - DNA, 21 bp, Homo sapiens
tggccagctggagtctccaca

SEQ ID NO: 7680814 - DNA, 22 bp, Homo sapiens
tggccagctgtaggttgtgcag

SEQ ID NO: 7680815 - DNA, 22 bp, Homo sapiens
tggccagctgtaggttgtgcag

SEQ ID NO: 7680816 - DNA, 21 bp, Homo sapiens
tggccagctggagtctccaca

SEQ ID NO: 7680817 - DNA, 21 bp, Homo sapiens
tggccagctggagtctccaca

SEQ ID NO: 7680818 - DNA, 22 bp, Homo sapiens
tggcagcttgaatgcagtcttt

SEQ ID NO: 7680819 - DNA, 22 bp, Homo sapiens
tggcagcttgaatgcagtcttt

SEQ ID NO: 7680820 - DNA, 22 bp, Homo sapiens
tggcagcttgaatgcagtcttt

SEQ ID NO: 7680821 - DNA, 22 bp, Homo sapiens
tggcagcttgaatgcagtcttt

SEQ ID NO: 7680822 - DNA, 22 bp, Homo sapiens
tggcagcttgaatgcagtcttt

SEQ ID NO: 7680823 - DNA, 22 bp, Homo sapiens
tggcagcttgaatgcagtcttt

SEQ ID NO: 7680824 - DNA, 15 bp, Homo sapiens
tggcagcttgttaag

SEQ ID NO: 7680825 - DNA, 22 bp, Homo sapiens
tggcagctttttgtttcaggct

SEQ ID NO: 7680826 - DNA, 22 bp, Homo sapiens
tggccacaaagagaacgaggtc

SEQ ID NO: 7680827 - DNA, 22 bp, Homo sapiens
tggccacaaagagaacgaggtc

SEQ ID NO: 7680828 - DNA, 22 bp, Homo sapiens
tggccacaaagagaacgaggtc

SEQ ID NO: 7680829 - DNA, 22 bp, Homo sapiens
tggccaggaggctgcttctgac

SEQ ID NO: 7680830 - DNA, 22 bp, Homo sapiens
tggccaggaggctgcttctgac

SEQ ID NO: 7680831 - DNA, 22 bp, Homo sapiens
tggccaggcaggtagaacggcc

SEQ ID NO: 7680832 - DNA, 22 bp, Homo sapiens
tggccaggcaggtagaacggcc

SEQ ID NO: 7680833 - DNA, 22 bp, Homo sapiens
tggccaggcaggtagaacggcc

SEQ ID NO: 7680834 - DNA, 22 bp, Homo sapiens
tggccaggcaggtagaacggcc

SEQ ID NO: 7680835 - DNA, 22 bp, Homo sapiens
tggccaggaggctgcttctgac

SEQ ID NO: 7680836 - DNA, 22 bp, Homo sapiens
tggccaggaggctgcttctgac

SEQ ID NO: 7680837 - DNA, 22 bp, Homo sapiens
tggccaggaggctgcttctgac

SEQ ID NO: 7680838 - DNA, 22 bp, Homo sapiens
tggccaggaggctgcttctgac

SEQ ID NO: 7680839 - DNA, 22 bp, Homo sapiens
tggccaggaggctgcttctgac

SEQ ID NO: 7680840 - DNA, 22 bp, Homo sapiens
tggccaggaggctgcttctgac

SEQ ID NO: 7680841 - DNA, 22 bp, Homo sapiens
tggccagctttttgtagtgctc

SEQ ID NO: 7680842 - DNA, 22 bp, Homo sapiens
tggccagctttttgtagtgctc

SEQ ID NO: 7680843 - DNA, 22 bp, Homo sapiens
tggccagctttgactgtaaacc

SEQ ID NO: 7680844 - DNA, 22 bp, Homo sapiens
tggccagctttgactgtaaacc

SEQ ID NO: 7680845 - DNA, 22 bp, Homo sapiens
tggccagctttttgtagtgctc

SEQ ID NO: 7680846 - DNA, 22 bp, Homo sapiens
tggccagctttttgtagtgctc

SEQ ID NO: 7680847 - DNA, 22 bp, Homo sapiens
tggccagctttttgtagtgctc

SEQ ID NO: 7680848 - DNA, 22 bp, Homo sapiens
tggccagctttttgtagtgctc

SEQ ID NO: 7680849 - DNA, 22 bp, Homo sapiens
cctatagttttgtattctgtct

SEQ ID NO: 7680850 - DNA, 22 bp, Homo sapiens
cctatattcagggaactgaccc

SEQ ID NO: 7680851 - DNA, 22 bp, Homo sapiens
cctatgaaacgtaatggaatgt

SEQ ID NO: 7680852 - DNA, 22 bp, Homo sapiens
cctatgaaacgtaatggaatgt

SEQ ID NO: 7680853 - DNA, 20 bp, Homo sapiens
cctatcagactttttaaata

SEQ ID NO: 7680854 - DNA, 22 bp, Homo sapiens
cctatacaggcttctttacatg

SEQ ID NO: 7680855 - DNA, 22 bp, Homo sapiens
cctatgaagatgttgaggctgg

SEQ ID NO: 7680856 - DNA, 22 bp, Homo sapiens
cctatgaaacgtaatggaatgt

SEQ ID NO: 7680857 - DNA, 22 bp, Homo sapiens
cctatgaaagacaggagatgcg

SEQ ID NO: 7680858 - DNA, 22 bp, Homo sapiens
cctatgaacaggaaatggaacg

SEQ ID NO: 7680859 - DNA, 22 bp, Homo sapiens
cctatgaacaggaaatggaacg

SEQ ID NO: 7680860 - DNA, 21 bp, Homo sapiens
cctagtgttaaaacagtttaa

SEQ ID NO: 7680861 - DNA, 22 bp, Homo sapiens
cctagttttcattcagcagcct

SEQ ID NO: 7680862 - DNA, 22 bp, Homo sapiens
cctagtcttccgcgtccccacc

SEQ ID NO: 7680863 - DNA, 21 bp, Homo sapiens
cctagtgttaaaacagtttaa

SEQ ID NO: 7680864 - DNA, 22 bp, Homo sapiens
cctagtcttccgcgtccccacc

SEQ ID NO: 7680865 - DNA, 22 bp, Homo sapiens
cctaggtcccaagtcatgtttc

SEQ ID NO: 7680866 - DNA, 22 bp, Homo sapiens
cctagggagcctgagagcagtg

SEQ ID NO: 7680867 - DNA, 22 bp, Homo sapiens
cctagggagcctgagagcagtg

SEQ ID NO: 7680868 - DNA, 22 bp, Homo sapiens
cctagggagcctgagagcagtg

SEQ ID NO: 7680869 - DNA, 22 bp, Homo sapiens
cctagggatacagcagagtaca

SEQ ID NO: 7680870 - DNA, 22 bp, Homo sapiens
cctagggagcctgagagcagtg

SEQ ID NO: 7680871 - DNA, 22 bp, Homo sapiens
cctaggtcccaagtcatgtttc

SEQ ID NO: 7680872 - DNA, 20 bp, Homo sapiens
cctagggcaagtgggtgggc

SEQ ID NO: 7680873 - DNA, 20 bp, Homo sapiens
cctagggcaagtgggtgggc

SEQ ID NO: 7680874 - DNA, 22 bp, Homo sapiens
cctagggatacagcagagtaca

SEQ ID NO: 7680875 - DNA, 22 bp, Homo sapiens
cctaggccttactttcctgtgc

SEQ ID NO: 7680876 - DNA, 22 bp, Homo sapiens
cctaggccttactttcctgtgc

SEQ ID NO: 7680877 - DNA, 22 bp, Homo sapiens
cctaggccttactttcctgtgc

SEQ ID NO: 7680878 - DNA, 22 bp, Homo sapiens
cctaggctaattcagtccagta

SEQ ID NO: 7680879 - DNA, 22 bp, Homo sapiens
cctaggctaattcagtccagta

SEQ ID NO: 7680880 - DNA, 22 bp, Homo sapiens
cctaggctggctgtcttcaggt

SEQ ID NO: 7680881 - DNA, 22 bp, Homo sapiens
cctaggctggctgtcttcaggt

SEQ ID NO: 7680882 - DNA, 22 bp, Homo sapiens
cctaggcttgttttcatcagct

SEQ ID NO: 7680883 - DNA, 22 bp, Homo sapiens
cctaggcttgttttcatcagct

SEQ ID NO: 7680884 - DNA, 22 bp, Homo sapiens
cctaggctaattcagtccagta

SEQ ID NO: 7680885 - DNA, 22 bp, Homo sapiens
cctaggctggctgtcttcaggt

SEQ ID NO: 7680886 - DNA, 22 bp, Homo sapiens
cctaggctggctgtcttcaggt

SEQ ID NO: 7680887 - DNA, 22 bp, Homo sapiens
tggccaggcaggtagaacggcc

SEQ ID NO: 7680888 - DNA, 22 bp, Homo sapiens
tggccaggcaggtagaacggcc

SEQ ID NO: 7680889 - DNA, 22 bp, Homo sapiens
tggccaggcaggtagaacggcc

SEQ ID NO: 7680890 - DNA, 23 bp, Homo sapiens
tggccaggcataaaggtgggtgg

SEQ ID NO: 7680891 - DNA, 23 bp, Homo sapiens
tggccaggcataaaggtgggtgg

SEQ ID NO: 7680892 - DNA, 22 bp, Homo sapiens
tggccaggcaggtagaacggcc

SEQ ID NO: 7680893 - DNA, 23 bp, Homo sapiens
tggccaggcataaaggtgggtgg

SEQ ID NO: 7680894 - DNA, 23 bp, Homo sapiens
tggccaggcataaaggtgggtgg

SEQ ID NO: 7680895 - DNA, 23 bp, Homo sapiens
tggccaggcataaaggtgggtgg

SEQ ID NO: 7680896 - DNA, 23 bp, Homo sapiens
tggccaggcataaaggtgggtgg

SEQ ID NO: 7680897 - DNA, 23 bp, Homo sapiens
tggccaggcataaaggtgggtgg

SEQ ID NO: 7680898 - DNA, 23 bp, Homo sapiens
tggccaggcataaaggtgggtgg

SEQ ID NO: 7680899 - DNA, 23 bp, Homo sapiens
tggccaggcataaaggtgggtgg

SEQ ID NO: 7680900 - DNA, 23 bp, Homo sapiens
tggccaggcataaaggtgggtgg

SEQ ID NO: 7680901 - DNA, 22 bp, Homo sapiens
tggccaggcattcagataagac

SEQ ID NO: 7680902 - DNA, 22 bp, Homo sapiens
tggccaggcattcagataagac

SEQ ID NO: 7680903 - DNA, 22 bp, Homo sapiens
tggccaggcattcagataagac

SEQ ID NO: 7680904 - DNA, 22 bp, Homo sapiens
tggccaggcattcagataagac

SEQ ID NO: 7680905 - DNA, 22 bp, Homo sapiens
tggccaggcattcagataagac

SEQ ID NO: 7680906 - DNA, 22 bp, Homo sapiens
tggccaggcattcagataagac

SEQ ID NO: 7680907 - DNA, 22 bp, Homo sapiens
cctaggccgcccggtgcgtggg

SEQ ID NO: 7680908 - DNA, 20 bp, Homo sapiens
cctaggccctccggctgccc

SEQ ID NO: 7680909 - DNA, 22 bp, Homo sapiens
cctaggccgcccggtgcgtggg

SEQ ID NO: 7680910 - DNA, 20 bp, Homo sapiens
cctaggccctccggctgccc

SEQ ID NO: 7680911 - DNA, 22 bp, Homo sapiens
cctaggccctcaaagagcataa

SEQ ID NO: 7680912 - DNA, 22 bp, Homo sapiens
cctaggccctcaaagagcataa

SEQ ID NO: 7680913 - DNA, 22 bp, Homo sapiens
cctaggccctcaaagagcataa

SEQ ID NO: 7680914 - DNA, 22 bp, Homo sapiens
cctaggccctcaaagagcataa

SEQ ID NO: 7680915 - DNA, 22 bp, Homo sapiens
cctaggccctcaaagagcataa

SEQ ID NO: 7680916 - DNA, 22 bp, Homo sapiens
cctaggccctaggcttccatca

SEQ ID NO: 7680917 - DNA, 22 bp, Homo sapiens
cctaggccctaggcttccatca

SEQ ID NO: 7680918 - DNA, 22 bp, Homo sapiens
tggccaggcattcagataagac

SEQ ID NO: 7680919 - DNA, 22 bp, Homo sapiens
ccctggagaggactcacccctg

SEQ ID NO: 7680920 - DNA, 22 bp, Homo sapiens
ccctggagatcgggagaggaag

SEQ ID NO: 7680921 - DNA, 22 bp, Homo sapiens
ccctggagaggactcacccctg

SEQ ID NO: 7680922 - DNA, 20 bp, Homo sapiens
ccctggagagaagctccacg

SEQ ID NO: 7680923 - DNA, 20 bp, Homo sapiens
ccctggagagaagctccacg

SEQ ID NO: 7680924 - DNA, 20 bp, Homo sapiens
ccctggagagaagctccacg

SEQ ID NO: 7680925 - DNA, 20 bp, Homo sapiens
ccctggagagaagctccacg

SEQ ID NO: 7680926 - DNA, 20 bp, Homo sapiens
ccctggagagaagctccacg

SEQ ID NO: 7680927 - DNA, 20 bp, Homo sapiens
ccctggagagaagctccacg

SEQ ID NO: 7680928 - DNA, 19 bp, Homo sapiens
ccctggagaataccctgga

SEQ ID NO: 7680929 - DNA, 20 bp, Homo sapiens
ccctggagagaagctccacg

SEQ ID NO: 7680930 - DNA, 19 bp, Homo sapiens
ccctggagaataccctgga

SEQ ID NO: 7680931 - DNA, 22 bp, Homo sapiens
ccctggagcatctctgctgtct

SEQ ID NO: 7680932 - DNA, 22 bp, Homo sapiens
ccctggagcatctctgctgtct

SEQ ID NO: 7680933 - DNA, 22 bp, Homo sapiens
ccctggagcatctctgctgtct

SEQ ID NO: 7680934 - DNA, 22 bp, Homo sapiens
ccctggagatcgggagaggaag

SEQ ID NO: 7680935 - DNA, 22 bp, Homo sapiens
ccctggagatcgggagaggaag

SEQ ID NO: 7680936 - DNA, 22 bp, Homo sapiens
ccctggagatcgggagaggaag

SEQ ID NO: 7680937 - DNA, 22 bp, Homo sapiens
ccctggagatcgggagaggaag

SEQ ID NO: 7680938 - DNA, 22 bp, Homo sapiens
ccctggagatcgggagaggaag

SEQ ID NO: 7680939 - DNA, 22 bp, Homo sapiens
ccctggagatcgggagaggaag

SEQ ID NO: 7680940 - DNA, 22 bp, Homo sapiens
ccctggagctagtctgagcaga

SEQ ID NO: 7680941 - DNA, 22 bp, Homo sapiens
ccctggagctagtctgagcaga

SEQ ID NO: 7680942 - DNA, 22 bp, Homo sapiens
ccctggagctagtctgagcaga

SEQ ID NO: 7680943 - DNA, 22 bp, Homo sapiens
ccctggagcatctctgctgtct

SEQ ID NO: 7680944 - DNA, 22 bp, Homo sapiens
ccctggagcatctctgctgtct

SEQ ID NO: 7680945 - DNA, 22 bp, Homo sapiens
ccctggagctagtctgagcaga

SEQ ID NO: 7680946 - DNA, 23 bp, Homo sapiens
tggagctgacagtcagagggagg

SEQ ID NO: 7680947 - DNA, 22 bp, Homo sapiens
ccctggagctagtctgagcaga

SEQ ID NO: 7680948 - DNA, 22 bp, Homo sapiens
tggagctgactcacaccagcta

SEQ ID NO: 7680949 - DNA, 22 bp, Homo sapiens
tggagctgagaagtggagctct

SEQ ID NO: 7680950 - DNA, 22 bp, Homo sapiens
tggagctgagaagtggagctct

SEQ ID NO: 7680951 - DNA, 22 bp, Homo sapiens
tggagctgagaagtggagctct

SEQ ID NO: 7680952 - DNA, 22 bp, Homo sapiens
tggagctgagaagtggagctct

SEQ ID NO: 7680953 - DNA, 22 bp, Homo sapiens
tggagctgagaagtggagctct

SEQ ID NO: 7680954 - DNA, 22 bp, Homo sapiens
tggagctgagagccaggctggc

SEQ ID NO: 7680955 - DNA, 22 bp, Homo sapiens
tggagctgagagccaggctggc

SEQ ID NO: 7680956 - DNA, 22 bp, Homo sapiens
tggagctgagagccaggctggc

SEQ ID NO: 7680957 - DNA, 22 bp, Homo sapiens
tggagctgagagccaggctggc

SEQ ID NO: 7680958 - DNA, 22 bp, Homo sapiens
tggagctgagagccaggctggc

SEQ ID NO: 7680959 - DNA, 22 bp, Homo sapiens
tggagctgagagccaggctggc

SEQ ID NO: 7680960 - DNA, 22 bp, Homo sapiens
tggagctgagagttaataagga

SEQ ID NO: 7680961 - DNA, 22 bp, Homo sapiens
tggagctgagagccaggctggc

SEQ ID NO: 7680962 - DNA, 22 bp, Homo sapiens
tggagctgagagccaggctggc

SEQ ID NO: 7680963 - DNA, 22 bp, Homo sapiens
tggagctgagagccaggctggc

SEQ ID NO: 7680964 - DNA, 22 bp, Homo sapiens
tggagctgagaagtggagctct

SEQ ID NO: 7680965 - DNA, 22 bp, Homo sapiens
tggagctgagaagtggagctct

SEQ ID NO: 7680966 - DNA, 22 bp, Homo sapiens
ccctccagctcaaagcaaccgg

SEQ ID NO: 7680967 - DNA, 22 bp, Homo sapiens
ccctccagctcaaagcaaccgg

SEQ ID NO: 7680968 - DNA, 22 bp, Homo sapiens
ccctccagctcaaagcaaccgg

SEQ ID NO: 7680969 - DNA, 22 bp, Homo sapiens
ccctccaggcactgccctcttc

SEQ ID NO: 7680970 - DNA, 22 bp, Homo sapiens
ccctccaggcctgtcatgttcc

SEQ ID NO: 7680971 - DNA, 22 bp, Homo sapiens
ccctccaggcctgtcatgttcc

SEQ ID NO: 7680972 - DNA, 22 bp, Homo sapiens
ccctccaggcactgccctcttc

SEQ ID NO: 7680973 - DNA, 22 bp, Homo sapiens
ccctccagggagccatgctggg

SEQ ID NO: 7680974 - DNA, 22 bp, Homo sapiens
ccctccagggagccatgctggg

SEQ ID NO: 7680975 - DNA, 22 bp, Homo sapiens
ccctccagggagccatgctggg

SEQ ID NO: 7680976 - DNA, 22 bp, Homo sapiens
ccctgctgcagagagctttcca

SEQ ID NO: 7680977 - DNA, 22 bp, Homo sapiens
ccctgctgcagagagctttcca

SEQ ID NO: 7680978 - DNA, 22 bp, Homo sapiens
ccctgctgcagagagctttcca

SEQ ID NO: 7680979 - DNA, 22 bp, Homo sapiens
ccctgctgcagagagctttcca

SEQ ID NO: 7680980 - DNA, 22 bp, Homo sapiens
ccctgctgcaggcttcaggagg

SEQ ID NO: 7680981 - DNA, 20 bp, Homo sapiens
ccctggactcctgagcaaac

SEQ ID NO: 7680982 - DNA, 22 bp, Homo sapiens
ccctggactgttcagggcctga

SEQ ID NO: 7680983 - DNA, 19 bp, Homo sapiens
ccctggagaataccctgga

SEQ ID NO: 7680984 - DNA, 19 bp, Homo sapiens
ccctggagaataccctgga

SEQ ID NO: 7680985 - DNA, 22 bp, Homo sapiens
ccctggagaaggggacgcggag

SEQ ID NO: 7680986 - DNA, 22 bp, Homo sapiens
ccctggagaaggggacgcggag

SEQ ID NO: 7680987 - DNA, 22 bp, Homo sapiens
ccctggactgttcagggcctga

SEQ ID NO: 7680988 - DNA, 22 bp, Homo sapiens
ccctgctgatgccttgattttg

SEQ ID NO: 7680989 - DNA, 22 bp, Homo sapiens
ccctgctgacaacttgattttg

SEQ ID NO: 7680990 - DNA, 22 bp, Homo sapiens
ccctccagggagccatgctggg

SEQ ID NO: 7680991 - DNA, 22 bp, Homo sapiens
ccctccagggagccatgctggg

SEQ ID NO: 7680992 - DNA, 22 bp, Homo sapiens
ccctccagggagccatgctggg

SEQ ID NO: 7680993 - DNA, 22 bp, Homo sapiens
ccctccacagacaggacttgtc

SEQ ID NO: 7680994 - DNA, 22 bp, Homo sapiens
ccctccacagacaggacttgtc

SEQ ID NO: 7680995 - DNA, 22 bp, Homo sapiens
ccctcattgcctcctgcgtgca

SEQ ID NO: 7680996 - DNA, 19 bp, Homo sapiens
ccctcattcacttattctc

SEQ ID NO: 7680997 - DNA, 22 bp, Homo sapiens
ccctccaccaagcagggcgcca

SEQ ID NO: 7680998 - DNA, 22 bp, Homo sapiens
ccctccaccaagcagggcgcca

SEQ ID NO: 7680999 - DNA, 22 bp, Homo sapiens
ccctccaccaagcagggcgcca

SEQ ID NO: 7681000 - DNA, 19 bp, Homo sapiens
ccctcaggtctgagcagtc

SEQ ID NO: 7681001 - DNA, 22 bp, Homo sapiens
ccctcaggtgaaaggaaaaatt

SEQ ID NO: 7681002 - DNA, 22 bp, Homo sapiens
ccctcaggtgaaaggaaaaatt

SEQ ID NO: 7681003 - DNA, 22 bp, Homo sapiens
ccctcaggtgaaaggaaaaatt

SEQ ID NO: 7681004 - DNA, 22 bp, Homo sapiens
ccctcatgtcagtccctgccca

SEQ ID NO: 7681005 - DNA, 22 bp, Homo sapiens
ccctcatgccagacagcatgca

SEQ ID NO: 7681006 - DNA, 22 bp, Homo sapiens
ccctcatgtcagtccctgccca

SEQ ID NO: 7681007 - DNA, 22 bp, Homo sapiens
ccctcatgtcagtccctgccca

SEQ ID NO: 7681008 - DNA, 22 bp, Homo sapiens
ccctcatgccagacagcatgca

SEQ ID NO: 7681009 - DNA, 22 bp, Homo sapiens
ccctcatgccagacagcatgca

SEQ ID NO: 7681010 - DNA, 22 bp, Homo sapiens
ccctcatgccagacagcatgca

SEQ ID NO: 7681011 - DNA, 22 bp, Homo sapiens
ccctcatgccagacagcatgca

SEQ ID NO: 7681012 - DNA, 20 bp, Homo sapiens
ccctccagcaaccaggactt

SEQ ID NO: 7681013 - DNA, 20 bp, Homo sapiens
ccctccagcaaccaggactt

SEQ ID NO: 7681014 - DNA, 22 bp, Homo sapiens
ccctccagccatggacccaggt

SEQ ID NO: 7681015 - DNA, 22 bp, Homo sapiens
ccctccagccatggacccaggt

SEQ ID NO: 7681016 - DNA, 22 bp, Homo sapiens
ccctccagagcttgacctgctg

SEQ ID NO: 7681017 - DNA, 22 bp, Homo sapiens
ccctccagagcttgacctgctg

SEQ ID NO: 7681018 - DNA, 22 bp, Homo sapiens
ccctccagagcttgacctgctg

SEQ ID NO: 7681019 - DNA, 20 bp, Homo sapiens
ccctccagcaaccaggactt

SEQ ID NO: 7681020 - DNA, 22 bp, Homo sapiens
ccctggctatttttacgcaagg

SEQ ID NO: 7681021 - DNA, 23 bp, Homo sapiens
ccctggccttggggcacaggctg

SEQ ID NO: 7681022 - DNA, 22 bp, Homo sapiens
ccctggctatttttacgcaagg

SEQ ID NO: 7681023 - DNA, 22 bp, Homo sapiens
ccctggctatttttacgcaagg

SEQ ID NO: 7681024 - DNA, 22 bp, Homo sapiens
ccctggctcaggcagctttgtt

SEQ ID NO: 7681025 - DNA, 22 bp, Homo sapiens
ccctggctcaggcagctttgtt

SEQ ID NO: 7681026 - DNA, 23 bp, Homo sapiens
ccctggccttggggcacaggctg

SEQ ID NO: 7681027 - DNA, 23 bp, Homo sapiens
ccctggccttggggcacaggctg

SEQ ID NO: 7681028 - DNA, 23 bp, Homo sapiens
ccctggccttggggcacaggctg

SEQ ID NO: 7681029 - DNA, 23 bp, Homo sapiens
ccctggccttggggcacaggctg

SEQ ID NO: 7681030 - DNA, 23 bp, Homo sapiens
ccctggccttggggcacaggctg

SEQ ID NO: 7681031 - DNA, 22 bp, Homo sapiens
ccctggctctgcctcagagccc

SEQ ID NO: 7681032 - DNA, 22 bp, Homo sapiens
ccctggctctgcctcagagccc

SEQ ID NO: 7681033 - DNA, 17 bp, Homo sapiens
ccctggctctaggtgga

SEQ ID NO: 7681034 - DNA, 22 bp, Homo sapiens
ccctggctctgcctcagagccc

SEQ ID NO: 7681035 - DNA, 17 bp, Homo sapiens
ccctggctctaggtgga

SEQ ID NO: 7681036 - DNA, 17 bp, Homo sapiens
ccctggctctaggtgga

SEQ ID NO: 7681037 - DNA, 17 bp, Homo sapiens
ccctggctctaggtgga

SEQ ID NO: 7681038 - DNA, 22 bp, Homo sapiens
ccctggctcaggcagctttgtt

SEQ ID NO: 7681039 - DNA, 17 bp, Homo sapiens
ccctggctctaggtgga

SEQ ID NO: 7681040 - DNA, 17 bp, Homo sapiens
ccctggctctaggtgga

SEQ ID NO: 7681041 - DNA, 22 bp, Homo sapiens
ccctggctcaggcagctttgtt

SEQ ID NO: 7681042 - DNA, 22 bp, Homo sapiens
ccctggctcaggcagctttgtt

SEQ ID NO: 7681043 - DNA, 22 bp, Homo sapiens
ccctggctcaggcagctttgtt

SEQ ID NO: 7681044 - DNA, 17 bp, Homo sapiens
ccctggctctaggtgga

SEQ ID NO: 7681045 - DNA, 17 bp, Homo sapiens
ccctggctctaggtgga

SEQ ID NO: 7681046 - DNA, 17 bp, Homo sapiens
ccctggctctaggtgga

SEQ ID NO: 7681047 - DNA, 22 bp, Homo sapiens
ccctggctgataccggaaaggc

SEQ ID NO: 7681048 - DNA, 22 bp, Homo sapiens
ccctggctgataccggaaaggc

SEQ ID NO: 7681049 - DNA, 22 bp, Homo sapiens
ccctggctgataccggaaaggc

SEQ ID NO: 7681050 - DNA, 22 bp, Homo sapiens
ccctggctgccagtcaccagac

SEQ ID NO: 7681051 - DNA, 22 bp, Homo sapiens
ccctggctgccagtcaccagac

SEQ ID NO: 7681052 - DNA, 22 bp, Homo sapiens
ccctggctgccagtcaccagac

SEQ ID NO: 7681053 - DNA, 22 bp, Homo sapiens
tggatcatatggataggcagta

SEQ ID NO: 7681054 - DNA, 22 bp, Homo sapiens
tggatcatcttaagaagtgatt

SEQ ID NO: 7681055 - DNA, 22 bp, Homo sapiens
ccctggctgccagtcaccagac

SEQ ID NO: 7681056 - DNA, 22 bp, Homo sapiens
ccctggctgccagtcaccagac

SEQ ID NO: 7681057 - DNA, 22 bp, Homo sapiens
ccctggctgccagtcaccagac

SEQ ID NO: 7681058 - DNA, 22 bp, Homo sapiens
ccctggctgccagtcaccagac

SEQ ID NO: 7681059 - DNA, 22 bp, Homo sapiens
ccctggctgccagtcaccagac

SEQ ID NO: 7681060 - DNA, 22 bp, Homo sapiens
ccctggctcttcaccacctgcc

SEQ ID NO: 7681061 - DNA, 22 bp, Homo sapiens
ccctggctcttcaccacctgcc

SEQ ID NO: 7681062 - DNA, 22 bp, Homo sapiens
ccctggctctgcctcagagccc

SEQ ID NO: 7681063 - DNA, 22 bp, Homo sapiens
ccctggctctgcctcagagccc

SEQ ID NO: 7681064 - DNA, 22 bp, Homo sapiens
ccctggctctgcctcagagccc

SEQ ID NO: 7681065 - DNA, 22 bp, Homo sapiens
ccctggctctgcctcagagccc

SEQ ID NO: 7681066 - DNA, 22 bp, Homo sapiens
ccctggctcttcaccacctgcc

SEQ ID NO: 7681067 - DNA, 22 bp, Homo sapiens
ccctggctcttcaccacctgcc

SEQ ID NO: 7681068 - DNA, 22 bp, Homo sapiens
ccctggctcttcaccacctgcc

SEQ ID NO: 7681069 - DNA, 22 bp, Homo sapiens
ccctggctcttcaccacctgcc

SEQ ID NO: 7681070 - DNA, 22 bp, Homo sapiens
ccctggctcttcaccacctgcc

SEQ ID NO: 7681071 - DNA, 23 bp, Homo sapiens
ccctggccttggggcacaggctg

SEQ ID NO: 7681072 - DNA, 20 bp, Homo sapiens
ccctggcctgtttcatgccc

SEQ ID NO: 7681073 - DNA, 20 bp, Homo sapiens
ccctggcctgtttcatgccc

SEQ ID NO: 7681074 - DNA, 20 bp, Homo sapiens
ccctggcctgtttcatgccc

SEQ ID NO: 7681075 - DNA, 20 bp, Homo sapiens
ccctggcctgtttcatgccc

SEQ ID NO: 7681076 - DNA, 20 bp, Homo sapiens
ccctggcctgtttcatgccc

SEQ ID NO: 7681077 - DNA, 20 bp, Homo sapiens
ccctggcctgtttcatgccc

SEQ ID NO: 7681078 - DNA, 22 bp, Homo sapiens
ccctggcctccaggcagtcctg

SEQ ID NO: 7681079 - DNA, 22 bp, Homo sapiens
ccctggcctccaggcagtcctg

SEQ ID NO: 7681080 - DNA, 22 bp, Homo sapiens
ccctggcctccaggcagtcctg

SEQ ID NO: 7681081 - DNA, 22 bp, Homo sapiens
ccctggcctccaggcagtcctg

SEQ ID NO: 7681082 - DNA, 22 bp, Homo sapiens
ccctggcctccaggcagtcctg

SEQ ID NO: 7681083 - DNA, 22 bp, Homo sapiens
ccctggcctccaggcagtcctg

SEQ ID NO: 7681084 - DNA, 22 bp, Homo sapiens
ccctggcctccaggcagtcctg

SEQ ID NO: 7681085 - DNA, 22 bp, Homo sapiens
ccctggcctccaggcagtcctg

SEQ ID NO: 7681086 - DNA, 22 bp, Homo sapiens
ccctggcctccaggcagtcctg

SEQ ID NO: 7681087 - DNA, 22 bp, Homo sapiens
ccctggcctacaggcccagaga

SEQ ID NO: 7681088 - DNA, 22 bp, Homo sapiens
ccctggcctacaggcccagaga

SEQ ID NO: 7681089 - DNA, 22 bp, Homo sapiens
ccctggcctacaggcccagaga

SEQ ID NO: 7681090 - DNA, 22 bp, Homo sapiens
ccctggcctacaggcccagaga

SEQ ID NO: 7681091 - DNA, 22 bp, Homo sapiens
ccctggcctacaggcccagaga

SEQ ID NO: 7681092 - DNA, 22 bp, Homo sapiens
ccctggatttacatcattctga

SEQ ID NO: 7681093 - DNA, 22 bp, Homo sapiens
ccctggcaaaacactctcttga

SEQ ID NO: 7681094 - DNA, 18 bp, Homo sapiens
tggagctgagggcaatgc

SEQ ID NO: 7681095 - DNA, 18 bp, Homo sapiens
tggagctgagggcaatgc

SEQ ID NO: 7681096 - DNA, 22 bp, Homo sapiens
ccctggcctacaggcccagaga

SEQ ID NO: 7681097 - DNA, 22 bp, Homo sapiens
ccctggcaaaatccctggtaca

SEQ ID NO: 7681098 - DNA, 22 bp, Homo sapiens
ccctggcaaaatccctggtaca

SEQ ID NO: 7681099 - DNA, 22 bp, Homo sapiens
ccctggcaaaatccctggtaca

SEQ ID NO: 7681100 - DNA, 22 bp, Homo sapiens
tggagctgagcacctccagggc

SEQ ID NO: 7681101 - DNA, 22 bp, Homo sapiens
tggagctgagcacctccagggc

SEQ ID NO: 7681102 - DNA, 22 bp, Homo sapiens
tggagctgagcacctccagggc

SEQ ID NO: 7681103 - DNA, 18 bp, Homo sapiens
tggagctgagggcaatgc

SEQ ID NO: 7681104 - DNA, 18 bp, Homo sapiens
tggagctgagggcaatgc

SEQ ID NO: 7681105 - DNA, 22 bp, Homo sapiens
tggagctgagcacctccagggc

SEQ ID NO: 7681106 - DNA, 18 bp, Homo sapiens
tggagctgagggcaatgc

SEQ ID NO: 7681107 - DNA, 22 bp, Homo sapiens
tggatgcctgggcctccttcca

SEQ ID NO: 7681108 - DNA, 22 bp, Homo sapiens
tggatgagttcaatgaggcaga

SEQ ID NO: 7681109 - DNA, 22 bp, Homo sapiens
tggatgagttcaatgaggcaga

SEQ ID NO: 7681110 - DNA, 22 bp, Homo sapiens
tggatgagttcaatgaggcaga

SEQ ID NO: 7681111 - DNA, 22 bp, Homo sapiens
tggatgagttcaatgaggcaga

SEQ ID NO: 7681112 - DNA, 22 bp, Homo sapiens
tggatgagtctgagattgggca

SEQ ID NO: 7681113 - DNA, 22 bp, Homo sapiens
tggatgagtctgagattgggca

SEQ ID NO: 7681114 - DNA, 22 bp, Homo sapiens
tggatgagggctgagcactggg

SEQ ID NO: 7681115 - DNA, 22 bp, Homo sapiens
tggatgagggctgagcactggg

SEQ ID NO: 7681116 - DNA, 22 bp, Homo sapiens
tggcaagaaactgaggcctgct

SEQ ID NO: 7681117 - DNA, 23 bp, Homo sapiens
tggcaactccttagcacctgtgg

SEQ ID NO: 7681118 - DNA, 22 bp, Homo sapiens
tggatgcctgggcctccttcca

SEQ ID NO: 7681119 - DNA, 22 bp, Homo sapiens
tggcaagaaccgcaattacttt

SEQ ID NO: 7681120 - DNA, 22 bp, Homo sapiens
tggcaagaatattggaccagaa

SEQ ID NO: 7681121 - DNA, 17 bp, Homo sapiens
tggcaagaatggaaatg

SEQ ID NO: 7681122 - DNA, 17 bp, Homo sapiens
tggcaagaatggaaatg

SEQ ID NO: 7681123 - DNA, 22 bp, Homo sapiens
tggcaagaaactgaggcctgct

SEQ ID NO: 7681124 - DNA, 22 bp, Homo sapiens
tggcaagaatattggaccagaa

SEQ ID NO: 7681125 - DNA, 22 bp, Homo sapiens
tggcaagagcaaaatgtacagt

SEQ ID NO: 7681126 - DNA, 17 bp, Homo sapiens
tggcaagacagctcagg

SEQ ID NO: 7681127 - DNA, 17 bp, Homo sapiens
tggcaagacagctcagg

SEQ ID NO: 7681128 - DNA, 17 bp, Homo sapiens
tggcaagaatggaaatg

SEQ ID NO: 7681129 - DNA, 17 bp, Homo sapiens
tggcaagacagctcagg

SEQ ID NO: 7681130 - DNA, 22 bp, Homo sapiens
tggcaagagggatgcaaggttt

SEQ ID NO: 7681131 - DNA, 22 bp, Homo sapiens
tggcaagagggatgcaaggttt

SEQ ID NO: 7681132 - DNA, 22 bp, Homo sapiens
tggcaagagggatgcaaggttt

SEQ ID NO: 7681133 - DNA, 22 bp, Homo sapiens
tggcaagagggatgcaaggttt

SEQ ID NO: 7681134 - DNA, 22 bp, Homo sapiens
tggcaagagcaaaatgtacagt

SEQ ID NO: 7681135 - DNA, 22 bp, Homo sapiens
tggcaagagggatgcaaggttt

SEQ ID NO: 7681136 - DNA, 22 bp, Homo sapiens
tggcaaggaaattagttctcct

SEQ ID NO: 7681137 - DNA, 22 bp, Homo sapiens
tggcaaggaagagcctggtgca

SEQ ID NO: 7681138 - DNA, 22 bp, Homo sapiens
tggcaaggaagagcctggtgca

SEQ ID NO: 7681139 - DNA, 22 bp, Homo sapiens
tggcaaggaaattagttctcct

SEQ ID NO: 7681140 - DNA, 22 bp, Homo sapiens
tggcaagcagagtctggtgggg

SEQ ID NO: 7681141 - DNA, 22 bp, Homo sapiens
tggcaagctgggttgggtagcc

SEQ ID NO: 7681142 - DNA, 22 bp, Homo sapiens
tggatgaaatattgcatttatg

SEQ ID NO: 7681143 - DNA, 22 bp, Homo sapiens
tggatgagaaactctggtgact

SEQ ID NO: 7681144 - DNA, 22 bp, Homo sapiens
tggatgagattaaagtgaggtt

SEQ ID NO: 7681145 - DNA, 22 bp, Homo sapiens
tggatgagaaactctggtgact

SEQ ID NO: 7681146 - DNA, 22 bp, Homo sapiens
tggatcttgatgctccaagagt

SEQ ID NO: 7681147 - DNA, 18 bp, Homo sapiens
tggatctttatgaggctg

SEQ ID NO: 7681148 - DNA, 22 bp, Homo sapiens
tggatgagggctgagcactggg

SEQ ID NO: 7681149 - DNA, 22 bp, Homo sapiens
tggatgagggctgagcactggg

SEQ ID NO: 7681150 - DNA, 22 bp, Homo sapiens
tggatgagggctgagcactggg

SEQ ID NO: 7681151 - DNA, 22 bp, Homo sapiens
tggatgagattaaagtgaggtt

SEQ ID NO: 7681152 - DNA, 22 bp, Homo sapiens
tggatgagattaaagtgaggtt

SEQ ID NO: 7681153 - DNA, 22 bp, Homo sapiens
tggatgaggctgggttaggcag

SEQ ID NO: 7681154 - DNA, 22 bp, Homo sapiens
tggatgagattaaagtgaggtt

SEQ ID NO: 7681155 - DNA, 22 bp, Homo sapiens
tggatctggttccctgagcctt

SEQ ID NO: 7681156 - DNA, 22 bp, Homo sapiens
tggatctatctccaggggtcct

SEQ ID NO: 7681157 - DNA, 22 bp, Homo sapiens
tggatctcggcaatgcgggact

SEQ ID NO: 7681158 - DNA, 22 bp, Homo sapiens
tggatctcggcaatgcgggact

SEQ ID NO: 7681159 - DNA, 22 bp, Homo sapiens
tggatctcggcaatgcgggact

SEQ ID NO: 7681160 - DNA, 22 bp, Homo sapiens
tggatcatggctaaggcgatgg

SEQ ID NO: 7681161 - DNA, 22 bp, Homo sapiens
tggatccagctgctcctatgag

SEQ ID NO: 7681162 - DNA, 22 bp, Homo sapiens
tggatcctcttaatgtgtaagg

SEQ ID NO: 7681163 - DNA, 22 bp, Homo sapiens
tggatcatcttaagaagtgatt

SEQ ID NO: 7681164 - DNA, 22 bp, Homo sapiens
tggatcatgtgatgtcaggagt

SEQ ID NO: 7681165 - DNA, 22 bp, Homo sapiens
cctctctgtgtggcctctccat

SEQ ID NO: 7681166 - DNA, 22 bp, Homo sapiens
cctctctgtgtggcctctccat

SEQ ID NO: 7681167 - DNA, 22 bp, Homo sapiens
cctctctgtgtggcctctccat

SEQ ID NO: 7681168 - DNA, 22 bp, Homo sapiens
cctctctgtgtggcctctccat

SEQ ID NO: 7681169 - DNA, 22 bp, Homo sapiens
cctctctgtgtggcctctccat

SEQ ID NO: 7681170 - DNA, 16 bp, Homo sapiens
cctctcttattcctcc

SEQ ID NO: 7681171 - DNA, 22 bp, Homo sapiens
cctctctgtcacaccagtggcc

SEQ ID NO: 7681172 - DNA, 22 bp, Homo sapiens
cctctctgtgtggcctctccat

SEQ ID NO: 7681173 - DNA, 22 bp, Homo sapiens
cctctctgtgtggcctctccat

SEQ ID NO: 7681174 - DNA, 22 bp, Homo sapiens
cctctctgtcacaccagtggcc

SEQ ID NO: 7681175 - DNA, 22 bp, Homo sapiens
cctctctgtcacaccagtggcc

SEQ ID NO: 7681176 - DNA, 22 bp, Homo sapiens
cctctctgtcacaccagtggcc

SEQ ID NO: 7681177 - DNA, 22 bp, Homo sapiens
cctctctgtcacaccagtggcc

SEQ ID NO: 7681178 - DNA, 22 bp, Homo sapiens
cctctctgtcacaccagtggcc

SEQ ID NO: 7681179 - DNA, 22 bp, Homo sapiens
cctctctgtcacaccagtggcc

SEQ ID NO: 7681180 - DNA, 22 bp, Homo sapiens
cctctctgtaagggtccctccc

SEQ ID NO: 7681181 - DNA, 22 bp, Homo sapiens
cctctctgtaagggtccctccc

SEQ ID NO: 7681182 - DNA, 22 bp, Homo sapiens
cctctctgtagcagcccccagt

SEQ ID NO: 7681183 - DNA, 22 bp, Homo sapiens
cctctctgtagcagcccccagt

SEQ ID NO: 7681184 - DNA, 22 bp, Homo sapiens
cctctctgtagcagcccccagt

SEQ ID NO: 7681185 - DNA, 22 bp, Homo sapiens
cctctctgtaagggtccctccc

SEQ ID NO: 7681186 - DNA, 22 bp, Homo sapiens
cctctctgtagcagcccccagt

SEQ ID NO: 7681187 - DNA, 22 bp, Homo sapiens
cctctctgtagcagcccccagt

SEQ ID NO: 7681188 - DNA, 20 bp, Homo sapiens
cctctctgccctgcaaggcc

SEQ ID NO: 7681189 - DNA, 20 bp, Homo sapiens
cctctctgccctgcaaggcc

SEQ ID NO: 7681190 - DNA, 22 bp, Homo sapiens
cctctctgtaagggtccctccc

SEQ ID NO: 7681191 - DNA, 20 bp, Homo sapiens
cctctctgccctgcaaggcc

SEQ ID NO: 7681192 - DNA, 20 bp, Homo sapiens
cctctctgccctgcaaggcc

SEQ ID NO: 7681193 - DNA, 20 bp, Homo sapiens
cctctctgccctgcaaggcc

SEQ ID NO: 7681194 - DNA, 22 bp, Homo sapiens
cctctctgtaagggtccctccc

SEQ ID NO: 7681195 - DNA, 20 bp, Homo sapiens
cctctctgccctgcaaggcc

SEQ ID NO: 7681196 - DNA, 22 bp, Homo sapiens
cctctctgtaagggtccctccc

SEQ ID NO: 7681197 - DNA, 22 bp, Homo sapiens
cctctcccgggtgccgctgggc

SEQ ID NO: 7681198 - DNA, 22 bp, Homo sapiens
tggctgctactgagggggtctg

SEQ ID NO: 7681199 - DNA, 22 bp, Homo sapiens
tggctgcctttcacctcatctc

SEQ ID NO: 7681200 - DNA, 22 bp, Homo sapiens
tggctgctactgagggggtctg

SEQ ID NO: 7681201 - DNA, 22 bp, Homo sapiens
tggctgctactgagggggtctg

SEQ ID NO: 7681202 - DNA, 22 bp, Homo sapiens
tggctgccttccctgctggagg

SEQ ID NO: 7681203 - DNA, 22 bp, Homo sapiens
tggctgccttccctgctggagg

SEQ ID NO: 7681204 - DNA, 22 bp, Homo sapiens
tggctgccttccctgctggagg

SEQ ID NO: 7681205 - DNA, 22 bp, Homo sapiens
tggctgcctttcacctcatctc

SEQ ID NO: 7681206 - DNA, 22 bp, Homo sapiens
tggctgcctttcacctcatctc

SEQ ID NO: 7681207 - DNA, 19 bp, Homo sapiens
cctctccgcccaccagccc

SEQ ID NO: 7681208 - DNA, 19 bp, Homo sapiens
cctctccgcccaccagccc

SEQ ID NO: 7681209 - DNA, 22 bp, Homo sapiens
cctctcctggctgtaggacctc

SEQ ID NO: 7681210 - DNA, 22 bp, Homo sapiens
cctctcctggctgtaggacctc

SEQ ID NO: 7681211 - DNA, 22 bp, Homo sapiens
cctctcctggctgtaggacctc

SEQ ID NO: 7681212 - DNA, 22 bp, Homo sapiens
cctctctcttgtagtccctgcc

SEQ ID NO: 7681213 - DNA, 22 bp, Homo sapiens
cctctctcttgtagtccctgcc

SEQ ID NO: 7681214 - DNA, 20 bp, Homo sapiens
cctctctgcatgctccctga

SEQ ID NO: 7681215 - DNA, 20 bp, Homo sapiens
cctctctgccctgcaaggcc

SEQ ID NO: 7681216 - DNA, 20 bp, Homo sapiens
cctctctgcatgctccctga

SEQ ID NO: 7681217 - DNA, 20 bp, Homo sapiens
cctctctgcatgctccctga

SEQ ID NO: 7681218 - DNA, 20 bp, Homo sapiens
cctctctgaagaggtcatct

SEQ ID NO: 7681219 - DNA, 20 bp, Homo sapiens
cctctctgcatgctccctga

SEQ ID NO: 7681220 - DNA, 20 bp, Homo sapiens
cctctctgcatgctccctga

SEQ ID NO: 7681221 - DNA, 20 bp, Homo sapiens
cctctctgaagaggtcatct

SEQ ID NO: 7681222 - DNA, 20 bp, Homo sapiens
cctctctgaagaggtcatct

SEQ ID NO: 7681223 - DNA, 20 bp, Homo sapiens
cctctctgaagaggtcatct

SEQ ID NO: 7681224 - DNA, 20 bp, Homo sapiens
cctctctgaagaggtcatct

SEQ ID NO: 7681225 - DNA, 20 bp, Homo sapiens
cctctctgaagaggtcatct

SEQ ID NO: 7681226 - DNA, 22 bp, Homo sapiens
cctctctcttgtagtccctgcc

SEQ ID NO: 7681227 - DNA, 20 bp, Homo sapiens
cctctctgcatgctccctga

SEQ ID NO: 7681228 - DNA, 20 bp, Homo sapiens
cctctctgcatgctccctga

SEQ ID NO: 7681229 - DNA, 22 bp, Homo sapiens
cctctccagcggcctcagggcc

SEQ ID NO: 7681230 - DNA, 22 bp, Homo sapiens
cctctccagcggcctcagggcc

SEQ ID NO: 7681231 - DNA, 22 bp, Homo sapiens
cctctccagcggcctcagggcc

SEQ ID NO: 7681232 - DNA, 23 bp, Homo sapiens
cctctccagacactgggccttgt

SEQ ID NO: 7681233 - DNA, 23 bp, Homo sapiens
cctctccagacactgggccttgt

SEQ ID NO: 7681234 - DNA, 23 bp, Homo sapiens
cctctccagacactgggccttgt

SEQ ID NO: 7681235 - DNA, 22 bp, Homo sapiens
cctctcatagtctgtatccttt

SEQ ID NO: 7681236 - DNA, 22 bp, Homo sapiens
cctctcagtattgaactttata

SEQ ID NO: 7681237 - DNA, 22 bp, Homo sapiens
cctctcagtattgaactttata

SEQ ID NO: 7681238 - DNA, 22 bp, Homo sapiens
cctctcagcgattcctcttgga

SEQ ID NO: 7681239 - DNA, 22 bp, Homo sapiens
cctctcagcgattcctcttgga

SEQ ID NO: 7681240 - DNA, 22 bp, Homo sapiens
cctctcagccggactgtcaggc

SEQ ID NO: 7681241 - DNA, 22 bp, Homo sapiens
cctctcagccggactgtcaggc

SEQ ID NO: 7681242 - DNA, 22 bp, Homo sapiens
cctctcagcgattcctcttgga

SEQ ID NO: 7681243 - DNA, 18 bp, Homo sapiens
cctctacctacccctaga

SEQ ID NO: 7681244 - DNA, 18 bp, Homo sapiens
cctctacctacccctaga

SEQ ID NO: 7681245 - DNA, 22 bp, Homo sapiens
cctctacttaccactcagccag

SEQ ID NO: 7681246 - DNA, 22 bp, Homo sapiens
cctctacttaccactcagccag

SEQ ID NO: 7681247 - DNA, 22 bp, Homo sapiens
cctctacttaccactcagccag

SEQ ID NO: 7681248 - DNA, 22 bp, Homo sapiens
cctcgtgtgctaggatccaggt

SEQ ID NO: 7681249 - DNA, 22 bp, Homo sapiens
cctctaaattgtttgaagttgg

SEQ ID NO: 7681250 - DNA, 22 bp, Homo sapiens
cctctacagggcatagcccaaa

SEQ ID NO: 7681251 - DNA, 22 bp, Homo sapiens
cctctaaattgtttgaagttgg

SEQ ID NO: 7681252 - DNA, 23 bp, Homo sapiens
cctctaataaacttgaccttgtg

SEQ ID NO: 7681253 - DNA, 23 bp, Homo sapiens
cctctaggagattagggggcttc

SEQ ID NO: 7681254 - DNA, 22 bp, Homo sapiens
cctctatagatgtgtgcatcta

SEQ ID NO: 7681255 - DNA, 22 bp, Homo sapiens
cctctacttaccactcagccag

SEQ ID NO: 7681256 - DNA, 22 bp, Homo sapiens
cctctaggatgtggctggagga

SEQ ID NO: 7681257 - DNA, 22 bp, Homo sapiens
cctctcagccggactgtcaggc

SEQ ID NO: 7681258 - DNA, 22 bp, Homo sapiens
cctctcaaaagcacaacattga

SEQ ID NO: 7681259 - DNA, 22 bp, Homo sapiens
cctctcagccggactgtcaggc

SEQ ID NO: 7681260 - DNA, 22 bp, Homo sapiens
cctctcaaaagcacaacattga

SEQ ID NO: 7681261 - DNA, 22 bp, Homo sapiens
cctctcagccggactgtcaggc

SEQ ID NO: 7681262 - DNA, 21 bp, Homo sapiens
tggctgcctacatgctgcagg

SEQ ID NO: 7681263 - DNA, 21 bp, Homo sapiens
tggctgcctacatgctgcagg

SEQ ID NO: 7681264 - DNA, 22 bp, Homo sapiens
tggctgcctagtccctcagcct

SEQ ID NO: 7681265 - DNA, 21 bp, Homo sapiens
tggctgcctacatgctgcagg

SEQ ID NO: 7681266 - DNA, 22 bp, Homo sapiens
tggctgcctagtccctcagcct

SEQ ID NO: 7681267 - DNA, 22 bp, Homo sapiens
tggctgcctagtccctcagcct

SEQ ID NO: 7681268 - DNA, 22 bp, Homo sapiens
tggctgcctagtccctcagcct

SEQ ID NO: 7681269 - DNA, 22 bp, Homo sapiens
tggctgcctagtccctcagcct

SEQ ID NO: 7681270 - DNA, 22 bp, Homo sapiens
tggctgccctcatgggcctgat

SEQ ID NO: 7681271 - DNA, 22 bp, Homo sapiens
tggctgccctcatgggcctgat

SEQ ID NO: 7681272 - DNA, 22 bp, Homo sapiens
tggctgccctcatgggcctgat

SEQ ID NO: 7681273 - DNA, 22 bp, Homo sapiens
tggctgccctcatgggcctgat

SEQ ID NO: 7681274 - DNA, 22 bp, Homo sapiens
tggctgccctcatgggcctgat

SEQ ID NO: 7681275 - DNA, 22 bp, Homo sapiens
tggctgccctcatgggcctgat

SEQ ID NO: 7681276 - DNA, 21 bp, Homo sapiens
tggctgcctacatgctgcagg

SEQ ID NO: 7681277 - DNA, 21 bp, Homo sapiens
tggctgcctacatgctgcagg

SEQ ID NO: 7681278 - DNA, 22 bp, Homo sapiens
tggctgccgactggctcttggc

SEQ ID NO: 7681279 - DNA, 22 bp, Homo sapiens
tggctgccgactggctcttggc

SEQ ID NO: 7681280 - DNA, 22 bp, Homo sapiens
tggctgccgactggctcttggc

SEQ ID NO: 7681281 - DNA, 22 bp, Homo sapiens
tggctgcctcagtgtccctgca

SEQ ID NO: 7681282 - DNA, 22 bp, Homo sapiens
tggctgcctcagtgtccctgca

SEQ ID NO: 7681283 - DNA, 22 bp, Homo sapiens
tggctgcctcagtgtccctgca

SEQ ID NO: 7681284 - DNA, 22 bp, Homo sapiens
tggctgcctagtgtctgagcag

SEQ ID NO: 7681285 - DNA, 22 bp, Homo sapiens
tggctgcctagtgtctgagcag

SEQ ID NO: 7681286 - DNA, 22 bp, Homo sapiens
tggctgcctagtgtctgagcag

SEQ ID NO: 7681287 - DNA, 22 bp, Homo sapiens
tggctgcctagtgtctgagcag

SEQ ID NO: 7681288 - DNA, 22 bp, Homo sapiens
tggctgcctagtgtctgagcag

SEQ ID NO: 7681289 - DNA, 22 bp, Homo sapiens
tggctgcctgaatgcaagacag

SEQ ID NO: 7681290 - DNA, 22 bp, Homo sapiens
tggctgcctgaatgcaagacag

SEQ ID NO: 7681291 - DNA, 22 bp, Homo sapiens
tggctgcctgaatgcaagacag

SEQ ID NO: 7681292 - DNA, 22 bp, Homo sapiens
tggctgcctgatcgagcaggtg

SEQ ID NO: 7681293 - DNA, 22 bp, Homo sapiens
tggctgcctgatcgagcaggtg

SEQ ID NO: 7681294 - DNA, 22 bp, Homo sapiens
tggctgcctgatcgagcaggtg

SEQ ID NO: 7681295 - DNA, 22 bp, Homo sapiens
tggctgcctgatcgagcaggtg

SEQ ID NO: 7681296 - DNA, 21 bp, Homo sapiens
tggctgcctggctctgtggtt

SEQ ID NO: 7681297 - DNA, 22 bp, Homo sapiens
tggctgccttccctgctggagg

SEQ ID NO: 7681298 - DNA, 22 bp, Homo sapiens
tggctgccttccctgctggagg

SEQ ID NO: 7681299 - DNA, 22 bp, Homo sapiens
tggctgccttccctgctggagg

SEQ ID NO: 7681300 - DNA, 21 bp, Homo sapiens
tggctgcctggctctgtggtt

SEQ ID NO: 7681301 - DNA, 22 bp, Homo sapiens
tggctgccttccctgctggagg

SEQ ID NO: 7681302 - DNA, 22 bp, Homo sapiens
tggctgccttccctgctggagg

SEQ ID NO: 7681303 - DNA, 21 bp, Homo sapiens
tggctgcctggctctgtggtt

SEQ ID NO: 7681304 - DNA, 21 bp, Homo sapiens
tggctgcctggctctgtggtt

SEQ ID NO: 7681305 - DNA, 21 bp, Homo sapiens
tggctgcctggctctgtggtt

SEQ ID NO: 7681306 - DNA, 21 bp, Homo sapiens
tggctgcctggctctgtggtt

SEQ ID NO: 7681307 - DNA, 22 bp, Homo sapiens
cctctggctgtaccactggcac

SEQ ID NO: 7681308 - DNA, 22 bp, Homo sapiens
cctctgaggtgagcccagctgg

SEQ ID NO: 7681309 - DNA, 22 bp, Homo sapiens
cctctgaggtgagcccagctgg

SEQ ID NO: 7681310 - DNA, 22 bp, Homo sapiens
cctctggctgtaccactggcac

SEQ ID NO: 7681311 - DNA, 22 bp, Homo sapiens
cctctggctgtaccactggcac

SEQ ID NO: 7681312 - DNA, 22 bp, Homo sapiens
cctctggctgtaccactggcac

SEQ ID NO: 7681313 - DNA, 22 bp, Homo sapiens
cctctgagcctgtgtgcggcac

SEQ ID NO: 7681314 - DNA, 22 bp, Homo sapiens
cctctgagcctgtgtgcggcac

SEQ ID NO: 7681315 - DNA, 22 bp, Homo sapiens
cctctgagctggcctgtggggc

SEQ ID NO: 7681316 - DNA, 22 bp, Homo sapiens
cctctgagctggcctgtggggc

SEQ ID NO: 7681317 - DNA, 22 bp, Homo sapiens
cctctgaggtgagcccagctgg

SEQ ID NO: 7681318 - DNA, 22 bp, Homo sapiens
cctctgaggtgagcccagctgg

SEQ ID NO: 7681319 - DNA, 22 bp, Homo sapiens
cctctgagctggcctgtggggc

SEQ ID NO: 7681320 - DNA, 22 bp, Homo sapiens
cctctgaggtgagcccagctgg

SEQ ID NO: 7681321 - DNA, 22 bp, Homo sapiens
cctctgaggtgagcccagctgg

SEQ ID NO: 7681322 - DNA, 22 bp, Homo sapiens
cctctgggctgcctgcacgggt

SEQ ID NO: 7681323 - DNA, 22 bp, Homo sapiens
cctctgggctgcctgcacgggt

SEQ ID NO: 7681324 - DNA, 22 bp, Homo sapiens
cctctggcttactgttgggttt

SEQ ID NO: 7681325 - DNA, 22 bp, Homo sapiens
cctctgggctgcctgcacgggt

SEQ ID NO: 7681326 - DNA, 22 bp, Homo sapiens
cctctgggctgcctgcacgggt

SEQ ID NO: 7681327 - DNA, 22 bp, Homo sapiens
cctctgggctgcctgcacgggt

SEQ ID NO: 7681328 - DNA, 22 bp, Homo sapiens
cctctgggggcttccttaccct

SEQ ID NO: 7681329 - DNA, 22 bp, Homo sapiens
cctctggggcatcagacaaagg

SEQ ID NO: 7681330 - DNA, 22 bp, Homo sapiens
cctctggggcatcagacaaagg

SEQ ID NO: 7681331 - DNA, 22 bp, Homo sapiens
cctctgggggcttccttaccct

SEQ ID NO: 7681332 - DNA, 22 bp, Homo sapiens
cctctggggcatcagacaaagg

SEQ ID NO: 7681333 - DNA, 22 bp, Homo sapiens
cctctggggcatcagacaaagg

SEQ ID NO: 7681334 - DNA, 22 bp, Homo sapiens
cctctgagccagcgtcttctct

SEQ ID NO: 7681335 - DNA, 22 bp, Homo sapiens
cctctgagcctgtgtgcggcac

SEQ ID NO: 7681336 - DNA, 22 bp, Homo sapiens
cctctgagccacatgcgtttgt

SEQ ID NO: 7681337 - DNA, 22 bp, Homo sapiens
cctctgagagaaggccttcagc

SEQ ID NO: 7681338 - DNA, 22 bp, Homo sapiens
cctctgagaccagctctgcacc

SEQ ID NO: 7681339 - DNA, 22 bp, Homo sapiens
cctctgagaacacctggcgtcc

SEQ ID NO: 7681340 - DNA, 22 bp, Homo sapiens
cctctgagaacacctggcgtcc

SEQ ID NO: 7681341 - DNA, 22 bp, Homo sapiens
cctctgagaacacctggcgtcc

SEQ ID NO: 7681342 - DNA, 22 bp, Homo sapiens
cctctgacttctctttattggc

SEQ ID NO: 7681343 - DNA, 22 bp, Homo sapiens
cctctgagaccagctctgcacc

SEQ ID NO: 7681344 - DNA, 22 bp, Homo sapiens
cctctgagaccagctctgcacc

SEQ ID NO: 7681345 - DNA, 22 bp, Homo sapiens
cctctgagaccagctctgcacc

SEQ ID NO: 7681346 - DNA, 22 bp, Homo sapiens
cctctcttggccgcagtcttct

SEQ ID NO: 7681347 - DNA, 22 bp, Homo sapiens
cctctcttggccgcagtcttct

SEQ ID NO: 7681348 - DNA, 22 bp, Homo sapiens
cctctcttggccgcagtcttct

SEQ ID NO: 7681349 - DNA, 22 bp, Homo sapiens
cctctcttggccgcagtcttct

SEQ ID NO: 7681350 - DNA, 22 bp, Homo sapiens
cctctctttcctacaccttgga

SEQ ID NO: 7681351 - DNA, 22 bp, Homo sapiens
cctctctttcctacaccttgga

SEQ ID NO: 7681352 - DNA, 23 bp, Homo sapiens
cctctctttttaggtggtgtttg

SEQ ID NO: 7681353 - DNA, 22 bp, Homo sapiens
cctctctttcctacaccttgga

SEQ ID NO: 7681354 - DNA, 22 bp, Homo sapiens
cctctgactcctggacttgggg

SEQ ID NO: 7681355 - DNA, 22 bp, Homo sapiens
cctctgactccagaaactccag

SEQ ID NO: 7681356 - DNA, 22 bp, Homo sapiens
cctctgactcctggacttgggg

SEQ ID NO: 7681357 - DNA, 22 bp, Homo sapiens
cctctgactccagaaactccag

SEQ ID NO: 7681358 - DNA, 22 bp, Homo sapiens
cctctgactccacacttgaact

SEQ ID NO: 7681359 - DNA, 22 bp, Homo sapiens
cctctgaccctggtggtggcca

SEQ ID NO: 7681360 - DNA, 22 bp, Homo sapiens
cctctgaccctggtggtggcca

SEQ ID NO: 7681361 - DNA, 23 bp, Homo sapiens
cctctgacaatgatgtcacctgc

SEQ ID NO: 7681362 - DNA, 22 bp, Homo sapiens
cctctgacacttgtcccacaca

SEQ ID NO: 7681363 - DNA, 22 bp, Homo sapiens
cctctgacacttgtcccacaca

SEQ ID NO: 7681364 - DNA, 22 bp, Homo sapiens
cctctgacacttgtcccacaca

SEQ ID NO: 7681365 - DNA, 22 bp, Homo sapiens
cctctgacacttgtcccacaca

SEQ ID NO: 7681366 - DNA, 23 bp, Homo sapiens
cctctgacaatgatgtcacctgc

SEQ ID NO: 7681367 - DNA, 23 bp, Homo sapiens
cctctgacaatgatgtcacctgc

SEQ ID NO: 7681368 - DNA, 22 bp, Homo sapiens
cctctgaattttggctatgtag

SEQ ID NO: 7681369 - DNA, 22 bp, Homo sapiens
cctctgaattttggctatgtag

SEQ ID NO: 7681370 - DNA, 22 bp, Homo sapiens
cctctgggtgacagactcttgg

SEQ ID NO: 7681371 - DNA, 22 bp, Homo sapiens
cctctgggtgacagactcttgg

SEQ ID NO: 7681372 - DNA, 22 bp, Homo sapiens
cctctgggtgacagactcttgg

SEQ ID NO: 7681373 - DNA, 22 bp, Homo sapiens
cctctgggtatctgtggaagta

SEQ ID NO: 7681374 - DNA, 22 bp, Homo sapiens
cctctgggtatctgtggaagta

SEQ ID NO: 7681375 - DNA, 22 bp, Homo sapiens
cctctgggtatctgtggaagta

SEQ ID NO: 7681376 - DNA, 22 bp, Homo sapiens
cctctgggtatctgtggaagta

SEQ ID NO: 7681377 - DNA, 22 bp, Homo sapiens
cctctgggtatctgtggaagta

SEQ ID NO: 7681378 - DNA, 22 bp, Homo sapiens
cctctgggtatctgtggaagta

SEQ ID NO: 7681379 - DNA, 22 bp, Homo sapiens
cctctgggtgggaggccgggcg

SEQ ID NO: 7681380 - DNA, 22 bp, Homo sapiens
cctctgggtgggaggccgggcg

SEQ ID NO: 7681381 - DNA, 22 bp, Homo sapiens
cctctgggtgggaggccgggcg

SEQ ID NO: 7681382 - DNA, 22 bp, Homo sapiens
cctctgggtgggaggccgggcg

SEQ ID NO: 7681383 - DNA, 22 bp, Homo sapiens
cctctgggggtcctcagagtct

SEQ ID NO: 7681384 - DNA, 22 bp, Homo sapiens
cctctgggggtcctcagagtct

SEQ ID NO: 7681385 - DNA, 22 bp, Homo sapiens
cctctgggggtcctcagagtct

SEQ ID NO: 7681386 - DNA, 22 bp, Homo sapiens
cctctggggtgagtgggccact

SEQ ID NO: 7681387 - DNA, 22 bp, Homo sapiens
cctctggggtgagtgggccact

SEQ ID NO: 7681388 - DNA, 22 bp, Homo sapiens
cctctggggtctagcaatagca

SEQ ID NO: 7681389 - DNA, 22 bp, Homo sapiens
cctctggggtgagtgggccact

SEQ ID NO: 7681390 - DNA, 22 bp, Homo sapiens
cctctggggtgagtgggccact

SEQ ID NO: 7681391 - DNA, 22 bp, Homo sapiens
cctctgtgcaggaaatacatgt

SEQ ID NO: 7681392 - DNA, 22 bp, Homo sapiens
cctctgtgatttctgagccaat

SEQ ID NO: 7681393 - DNA, 22 bp, Homo sapiens
cctctgtgcaggaaatacatgt

SEQ ID NO: 7681394 - DNA, 22 bp, Homo sapiens
cctctgtgcaggaaatacatgt

SEQ ID NO: 7681395 - DNA, 22 bp, Homo sapiens
cctctgtgacttctaccttcac

SEQ ID NO: 7681396 - DNA, 22 bp, Homo sapiens
cctctgtgacttctaccttcac

SEQ ID NO: 7681397 - DNA, 22 bp, Homo sapiens
cctctgtgatttctgagccaat

SEQ ID NO: 7681398 - DNA, 22 bp, Homo sapiens
cctctgtgatttctgagccaat

SEQ ID NO: 7681399 - DNA, 22 bp, Homo sapiens
cctctgtgacaaacagtcctgg

SEQ ID NO: 7681400 - DNA, 22 bp, Homo sapiens
cctctgtgacaaacagtcctgg

SEQ ID NO: 7681401 - DNA, 22 bp, Homo sapiens
cctctgtccccagtgcaggcct

SEQ ID NO: 7681402 - DNA, 22 bp, Homo sapiens
cctctgtcctggggagtggagc

SEQ ID NO: 7681403 - DNA, 22 bp, Homo sapiens
cctctgtccccagtgcaggcct

SEQ ID NO: 7681404 - DNA, 22 bp, Homo sapiens
cctctgtccccagtgcaggcct

SEQ ID NO: 7681405 - DNA, 22 bp, Homo sapiens
cctctgtccccagtgcaggcct

SEQ ID NO: 7681406 - DNA, 22 bp, Homo sapiens
cctctgtagtaagagaacatat

SEQ ID NO: 7681407 - DNA, 18 bp, Homo sapiens
cctctgggttttgttccc

SEQ ID NO: 7681408 - DNA, 22 bp, Homo sapiens
cctctggtatttgcacagatat

SEQ ID NO: 7681409 - DNA, 22 bp, Homo sapiens
cctctgggttagtttagggagc

SEQ ID NO: 7681410 - DNA, 22 bp, Homo sapiens
cctctgggtgggaggccgggcg

SEQ ID NO: 7681411 - DNA, 22 bp, Homo sapiens
cctctgggtgggaggccgggcg

SEQ ID NO: 7681412 - DNA, 22 bp, Homo sapiens
cctctgggttagtttagggagc

SEQ ID NO: 7681413 - DNA, 22 bp, Homo sapiens
cctctgggttagtttagggagc

SEQ ID NO: 7681414 - DNA, 22 bp, Homo sapiens
tggctgagggggcagttcagga

SEQ ID NO: 7681415 - DNA, 22 bp, Homo sapiens
cctccagcgcgatccactccgg

SEQ ID NO: 7681416 - DNA, 22 bp, Homo sapiens
tggctgagggggcagttcagga

SEQ ID NO: 7681417 - DNA, 22 bp, Homo sapiens
tggctgagggggcagttcagga

SEQ ID NO: 7681418 - DNA, 22 bp, Homo sapiens
tggctgagggggcagttcagga

SEQ ID NO: 7681419 - DNA, 22 bp, Homo sapiens
tggctgagagcaattgactctg

SEQ ID NO: 7681420 - DNA, 22 bp, Homo sapiens
tggctgagggggcagttcagga

SEQ ID NO: 7681421 - DNA, 22 bp, Homo sapiens
tggctgagggggcagttcagga

SEQ ID NO: 7681422 - DNA, 22 bp, Homo sapiens
tggctgagggggcagttcagga

SEQ ID NO: 7681423 - DNA, 22 bp, Homo sapiens
tggctgagagcaattgactctg

SEQ ID NO: 7681424 - DNA, 22 bp, Homo sapiens
tggctgagagcaattgactctg

SEQ ID NO: 7681425 - DNA, 22 bp, Homo sapiens
cctccagcgcgatccactccgg

SEQ ID NO: 7681426 - DNA, 22 bp, Homo sapiens
cctccagcgcgatccactccgg

SEQ ID NO: 7681427 - DNA, 22 bp, Homo sapiens
cctccagcgcgatccactccgg

SEQ ID NO: 7681428 - DNA, 22 bp, Homo sapiens
cctccagccttcctgaagagcc

SEQ ID NO: 7681429 - DNA, 22 bp, Homo sapiens
cctccagccttcctgaagagcc

SEQ ID NO: 7681430 - DNA, 22 bp, Homo sapiens
cctccagccttcctgaagagcc

SEQ ID NO: 7681431 - DNA, 22 bp, Homo sapiens
cctccagccttcctgaagagcc

SEQ ID NO: 7681432 - DNA, 22 bp, Homo sapiens
cctccagcgcgatccactccgg

SEQ ID NO: 7681433 - DNA, 22 bp, Homo sapiens
tggctgaggtaactatgaataa

SEQ ID NO: 7681434 - DNA, 23 bp, Homo sapiens
tggctgaggtccaggtagtttca

SEQ ID NO: 7681435 - DNA, 23 bp, Homo sapiens
tggctgaggtccaggtagtttca

SEQ ID NO: 7681436 - DNA, 23 bp, Homo sapiens
tggctgaggtccaggtagtttca

SEQ ID NO: 7681437 - DNA, 22 bp, Homo sapiens
tggctgaggtctggggcttctg

SEQ ID NO: 7681438 - DNA, 23 bp, Homo sapiens
tggctgaggtccaggtagtttca

SEQ ID NO: 7681439 - DNA, 22 bp, Homo sapiens
tggctgagggggctctgctcag

SEQ ID NO: 7681440 - DNA, 22 bp, Homo sapiens
tggctgagggggctctgctcag

SEQ ID NO: 7681441 - DNA, 22 bp, Homo sapiens
tggctgaggtaactatgaataa

SEQ ID NO: 7681442 - DNA, 22 bp, Homo sapiens
tggctgaggtaactatgaataa

SEQ ID NO: 7681443 - DNA, 22 bp, Homo sapiens
tggctgagggggcagttcagga

SEQ ID NO: 7681444 - DNA, 22 bp, Homo sapiens
tggctgagggggctctgctcag

SEQ ID NO: 7681445 - DNA, 22 bp, Homo sapiens
tggctgagggggctctgctcag

SEQ ID NO: 7681446 - DNA, 22 bp, Homo sapiens
tggctgagggggcagttcagga

SEQ ID NO: 7681447 - DNA, 22 bp, Homo sapiens
tggctgagggggctctgctcag

SEQ ID NO: 7681448 - DNA, 22 bp, Homo sapiens
cctccagcattactggcccatg

SEQ ID NO: 7681449 - DNA, 22 bp, Homo sapiens
cctccagcattactggcccatg

SEQ ID NO: 7681450 - DNA, 22 bp, Homo sapiens
cctccagcattactggcccatg

SEQ ID NO: 7681451 - DNA, 22 bp, Homo sapiens
cctccagcattactggcccatg

SEQ ID NO: 7681452 - DNA, 22 bp, Homo sapiens
cctccagcattactggcccatg

SEQ ID NO: 7681453 - DNA, 22 bp, Homo sapiens
cctccagcattactggcccatg

SEQ ID NO: 7681454 - DNA, 22 bp, Homo sapiens
cctccagcattactggcccatg

SEQ ID NO: 7681455 - DNA, 22 bp, Homo sapiens
cctccagagggtttcccatgaa

SEQ ID NO: 7681456 - DNA, 22 bp, Homo sapiens
cctccagagggtttcccatgaa

SEQ ID NO: 7681457 - DNA, 22 bp, Homo sapiens
cctccagactttggccatcctc

SEQ ID NO: 7681458 - DNA, 22 bp, Homo sapiens
cctccagactttggccatcctc

SEQ ID NO: 7681459 - DNA, 22 bp, Homo sapiens
cctccagactttggccatcctc

SEQ ID NO: 7681460 - DNA, 22 bp, Homo sapiens
cctccagactttggccatcctc

SEQ ID NO: 7681461 - DNA, 22 bp, Homo sapiens
cctccagactttggccatcctc

SEQ ID NO: 7681462 - DNA, 22 bp, Homo sapiens
cctccactgcttcccagctttg

SEQ ID NO: 7681463 - DNA, 20 bp, Homo sapiens
cctccactgtcactgacctg

SEQ ID NO: 7681464 - DNA, 22 bp, Homo sapiens
cctccaagtttgactcaggaca

SEQ ID NO: 7681465 - DNA, 22 bp, Homo sapiens
cctccacaggagctgcagtgct

SEQ ID NO: 7681466 - DNA, 22 bp, Homo sapiens
cctccacaggagctgcagtgct

SEQ ID NO: 7681467 - DNA, 22 bp, Homo sapiens
cctccacaggagctgcagtgct

SEQ ID NO: 7681468 - DNA, 22 bp, Homo sapiens
cctccacaggagctgcagtgct

SEQ ID NO: 7681469 - DNA, 22 bp, Homo sapiens
cctccaagtttgactcaggaca

SEQ ID NO: 7681470 - DNA, 22 bp, Homo sapiens
cctccaagtttgactcaggaca

SEQ ID NO: 7681471 - DNA, 22 bp, Homo sapiens
tggctcatctttttagacttat

SEQ ID NO: 7681472 - DNA, 22 bp, Homo sapiens
cctccaagtttgactcaggaca

SEQ ID NO: 7681473 - DNA, 22 bp, Homo sapiens
cctccaagtttgactcaggaca

SEQ ID NO: 7681474 - DNA, 22 bp, Homo sapiens
cctccactctggcctctcaggt

SEQ ID NO: 7681475 - DNA, 22 bp, Homo sapiens
cctccactctggcctctcaggt

SEQ ID NO: 7681476 - DNA, 22 bp, Homo sapiens
cctccacaggagctgcagtgct

SEQ ID NO: 7681477 - DNA, 22 bp, Homo sapiens
cctccacaggagctgcagtgct

SEQ ID NO: 7681478 - DNA, 22 bp, Homo sapiens
cctccactctggcctctcaggt

SEQ ID NO: 7681479 - DNA, 22 bp, Homo sapiens
cctcccttcagtagagcccaat

SEQ ID NO: 7681480 - DNA, 22 bp, Homo sapiens
cctcccttcagtagagcccaat

SEQ ID NO: 7681481 - DNA, 22 bp, Homo sapiens
cctcccttcagtagagcccaat

SEQ ID NO: 7681482 - DNA, 22 bp, Homo sapiens
cctccctgtctacctgttgtgg

SEQ ID NO: 7681483 - DNA, 22 bp, Homo sapiens
cctccctgtctacctgttgtgg

SEQ ID NO: 7681484 - DNA, 22 bp, Homo sapiens
cctccctgtctacctgttgtgg

SEQ ID NO: 7681485 - DNA, 22 bp, Homo sapiens
cctccctgtctacctgttgtgg

SEQ ID NO: 7681486 - DNA, 22 bp, Homo sapiens
cctccctggtggctctggtcta

SEQ ID NO: 7681487 - DNA, 22 bp, Homo sapiens
cctccctggtggctctggtcta

SEQ ID NO: 7681488 - DNA, 22 bp, Homo sapiens
cctccctgtctacctgttgtgg

SEQ ID NO: 7681489 - DNA, 22 bp, Homo sapiens
cctccctgtctacctgttgtgg

SEQ ID NO: 7681490 - DNA, 22 bp, Homo sapiens
cctcctagaggaaccccagggc

SEQ ID NO: 7681491 - DNA, 22 bp, Homo sapiens
cctcccttttggtgtctgcata

SEQ ID NO: 7681492 - DNA, 22 bp, Homo sapiens
cctcccttttggtgtctgcata

SEQ ID NO: 7681493 - DNA, 22 bp, Homo sapiens
cctcccttttggtgtctgcata

SEQ ID NO: 7681494 - DNA, 22 bp, Homo sapiens
cctcccttttggtgtctgcata

SEQ ID NO: 7681495 - DNA, 22 bp, Homo sapiens
cctcccttccccagtagtcaag

SEQ ID NO: 7681496 - DNA, 22 bp, Homo sapiens
cctcccttggccatagccagcc

SEQ ID NO: 7681497 - DNA, 22 bp, Homo sapiens
cctcccttggccatagccagcc

SEQ ID NO: 7681498 - DNA, 22 bp, Homo sapiens
cctccctttgttgcaagggaaa

SEQ ID NO: 7681499 - DNA, 22 bp, Homo sapiens
cctccctttgttgcaagggaaa

SEQ ID NO: 7681500 - DNA, 22 bp, Homo sapiens
tggctgaggtctggggcttctg

SEQ ID NO: 7681501 - DNA, 22 bp, Homo sapiens
cctccctgctcctcaactggca

SEQ ID NO: 7681502 - DNA, 22 bp, Homo sapiens
cctccctggccagagcagcagc

SEQ ID NO: 7681503 - DNA, 22 bp, Homo sapiens
cctccctggccagagcagcagc

SEQ ID NO: 7681504 - DNA, 22 bp, Homo sapiens
cctccctggccagagcagcagc

SEQ ID NO: 7681505 - DNA, 22 bp, Homo sapiens
cctccctggccagagcagcagc

SEQ ID NO: 7681506 - DNA, 22 bp, Homo sapiens
cctccctggccagagcagcagc

SEQ ID NO: 7681507 - DNA, 22 bp, Homo sapiens
cctccctgggtgacgggctcct

SEQ ID NO: 7681508 - DNA, 22 bp, Homo sapiens
cctccctgggtgacgggctcct

SEQ ID NO: 7681509 - DNA, 22 bp, Homo sapiens
cctccctgggtgacgggctcct

SEQ ID NO: 7681510 - DNA, 22 bp, Homo sapiens
cctccctgggtgacgggctcct

SEQ ID NO: 7681511 - DNA, 22 bp, Homo sapiens
cctccctgggtgctgggattgc

SEQ ID NO: 7681512 - DNA, 22 bp, Homo sapiens
cctccctggtggctctggtcta

SEQ ID NO: 7681513 - DNA, 22 bp, Homo sapiens
cctccctggtggctctggtcta

SEQ ID NO: 7681514 - DNA, 22 bp, Homo sapiens
cctccctgggtgctgggattgc

SEQ ID NO: 7681515 - DNA, 22 bp, Homo sapiens
cctccctgggtgctgggattgc

SEQ ID NO: 7681516 - DNA, 22 bp, Homo sapiens
cctcggagcacgccggccgccc

SEQ ID NO: 7681517 - DNA, 18 bp, Homo sapiens
cctcggagcctccgtgtc

SEQ ID NO: 7681518 - DNA, 22 bp, Homo sapiens
cctcggagcgggtcagagaggg

SEQ ID NO: 7681519 - DNA, 22 bp, Homo sapiens
cctcggaggcggaggctgcagt

SEQ ID NO: 7681520 - DNA, 22 bp, Homo sapiens
cctcggagcgggtcagagaggg

SEQ ID NO: 7681521 - DNA, 22 bp, Homo sapiens
cctcggaggcggaggctgcagt

SEQ ID NO: 7681522 - DNA, 22 bp, Homo sapiens
cctcggctgcccagcccagctg

SEQ ID NO: 7681523 - DNA, 22 bp, Homo sapiens
cctcgtggtgtcagacctgtgc

SEQ ID NO: 7681524 - DNA, 22 bp, Homo sapiens
cctcgtgtgctaggatccaggt

SEQ ID NO: 7681525 - DNA, 22 bp, Homo sapiens
cctcggctgggccttggccact

SEQ ID NO: 7681526 - DNA, 22 bp, Homo sapiens
cctcggctgcccagcccagctg

SEQ ID NO: 7681527 - DNA, 22 bp, Homo sapiens
cctcggctgggccttggccact

SEQ ID NO: 7681528 - DNA, 22 bp, Homo sapiens
cctcggctgggccttggccact

SEQ ID NO: 7681529 - DNA, 22 bp, Homo sapiens
cctcggggcaccgcggcctgct

SEQ ID NO: 7681530 - DNA, 22 bp, Homo sapiens
cctcggggcaccgcggcctgct

SEQ ID NO: 7681531 - DNA, 22 bp, Homo sapiens
cctcctctggtgctgccaaccc

SEQ ID NO: 7681532 - DNA, 22 bp, Homo sapiens
cctcctctggtgctgccaaccc

SEQ ID NO: 7681533 - DNA, 22 bp, Homo sapiens
cctcctggtccagcatctcttt

SEQ ID NO: 7681534 - DNA, 22 bp, Homo sapiens
cctcctctgggaagattcagag

SEQ ID NO: 7681535 - DNA, 22 bp, Homo sapiens
cctcctctgggaagattcagag

SEQ ID NO: 7681536 - DNA, 22 bp, Homo sapiens
cctcctctggtgctgccaaccc

SEQ ID NO: 7681537 - DNA, 22 bp, Homo sapiens
cctcctctggtgctgccaaccc

SEQ ID NO: 7681538 - DNA, 22 bp, Homo sapiens
cctcctggtccagcatctcttt

SEQ ID NO: 7681539 - DNA, 22 bp, Homo sapiens
cctcctggtccagcatctcttt

SEQ ID NO: 7681540 - DNA, 22 bp, Homo sapiens
cctcctggtccagcatctcttt

SEQ ID NO: 7681541 - DNA, 22 bp, Homo sapiens
cctcctccttatggtggcccag

SEQ ID NO: 7681542 - DNA, 22 bp, Homo sapiens
cctcctccttatggtggcccag

SEQ ID NO: 7681543 - DNA, 22 bp, Homo sapiens
cctcctccttatggtggcccag

SEQ ID NO: 7681544 - DNA, 23 bp, Homo sapiens
cctcctcatatctttgactagtg

SEQ ID NO: 7681545 - DNA, 23 bp, Homo sapiens
cctcctcatatctttgactagtg

SEQ ID NO: 7681546 - DNA, 22 bp, Homo sapiens
cctcctagaggaaccccagggc

SEQ ID NO: 7681547 - DNA, 23 bp, Homo sapiens
cctcctcatatctttgactagtg

SEQ ID NO: 7681548 - DNA, 22 bp, Homo sapiens
tggcccagtgcttatgctctga

SEQ ID NO: 7681549 - DNA, 22 bp, Homo sapiens
tggcccagtgcttatgctctga

SEQ ID NO: 7681550 - DNA, 22 bp, Homo sapiens
tggcccagtgcttatgctctga

SEQ ID NO: 7681551 - DNA, 22 bp, Homo sapiens
tggcccagtgcttatgctctga

SEQ ID NO: 7681552 - DNA, 22 bp, Homo sapiens
tggcccagtgcttatgctctga

SEQ ID NO: 7681553 - DNA, 22 bp, Homo sapiens
tggcccagtgcttatgctctga

SEQ ID NO: 7681554 - DNA, 22 bp, Homo sapiens
tggcccagtgcttatgctctga

SEQ ID NO: 7681555 - DNA, 22 bp, Homo sapiens
tggcccagtgcttatgctctga

SEQ ID NO: 7681556 - DNA, 22 bp, Homo sapiens
tggcccagtgcttatgctctga

SEQ ID NO: 7681557 - DNA, 22 bp, Homo sapiens
tggcccagcagttctgccccag

SEQ ID NO: 7681558 - DNA, 21 bp, Homo sapiens
cctatgtcgcactcctaggat

SEQ ID NO: 7681559 - DNA, 22 bp, Homo sapiens
tggcccagccctgctctagggc

SEQ ID NO: 7681560 - DNA, 22 bp, Homo sapiens
tggcccagccctgctctagggc

SEQ ID NO: 7681561 - DNA, 22 bp, Homo sapiens
tggcccagccctgctctagggc

SEQ ID NO: 7681562 - DNA, 22 bp, Homo sapiens
tggcccagccctgctctagggc

SEQ ID NO: 7681563 - DNA, 22 bp, Homo sapiens
tggcccagcagttctgccccag

SEQ ID NO: 7681564 - DNA, 22 bp, Homo sapiens
tggccccattttacagatgaaa

SEQ ID NO: 7681565 - DNA, 22 bp, Homo sapiens
tggccccattttacagatgaaa

SEQ ID NO: 7681566 - DNA, 22 bp, Homo sapiens
tggccccatcaagggatgagtt

SEQ ID NO: 7681567 - DNA, 22 bp, Homo sapiens
tggcccatcatggaaaataaag

SEQ ID NO: 7681568 - DNA, 22 bp, Homo sapiens
tggccccacagggccttttcag

SEQ ID NO: 7681569 - DNA, 22 bp, Homo sapiens
tggccccacagggccttttcag

SEQ ID NO: 7681570 - DNA, 20 bp, Homo sapiens
tggcccagtggggcagggtg

SEQ ID NO: 7681571 - DNA, 20 bp, Homo sapiens
tggcccagtggggcagggtg

SEQ ID NO: 7681572 - DNA, 20 bp, Homo sapiens
tggcccagtggggcagggtg

SEQ ID NO: 7681573 - DNA, 20 bp, Homo sapiens
tggcccagtggggcagggtg

SEQ ID NO: 7681574 - DNA, 20 bp, Homo sapiens
tggcccagtggggcagggtg

SEQ ID NO: 7681575 - DNA, 20 bp, Homo sapiens
tggcccagtggggcagggtg

SEQ ID NO: 7681576 - DNA, 20 bp, Homo sapiens
tggcccagtggggcagggtg

SEQ ID NO: 7681577 - DNA, 20 bp, Homo sapiens
tggcccagtggggcagggtg

SEQ ID NO: 7681578 - DNA, 20 bp, Homo sapiens
tggcccagtggggcagggtg

SEQ ID NO: 7681579 - DNA, 20 bp, Homo sapiens
tggcccagtggggcagggtg

SEQ ID NO: 7681580 - DNA, 20 bp, Homo sapiens
tggcccagtggggcagggtg

SEQ ID NO: 7681581 - DNA, 18 bp, Homo sapiens
tggccccttatcagtcct

SEQ ID NO: 7681582 - DNA, 18 bp, Homo sapiens
tggccccttatcagtcct

SEQ ID NO: 7681583 - DNA, 22 bp, Homo sapiens
tggcccctggcacacggaggat

SEQ ID NO: 7681584 - DNA, 22 bp, Homo sapiens
tggcccctggcacacggaggat

SEQ ID NO: 7681585 - DNA, 22 bp, Homo sapiens
tggcccgacctctgctcatgca

SEQ ID NO: 7681586 - DNA, 22 bp, Homo sapiens
tggcccgaagatccgagggtca

SEQ ID NO: 7681587 - DNA, 22 bp, Homo sapiens
tggcccgaagatccgagggtca

SEQ ID NO: 7681588 - DNA, 22 bp, Homo sapiens
tggcccctgaggagcgtcagcc

SEQ ID NO: 7681589 - DNA, 22 bp, Homo sapiens
tggcccctgaggagcgtcagcc

SEQ ID NO: 7681590 - DNA, 22 bp, Homo sapiens
tggccccccagagctggaggac

SEQ ID NO: 7681591 - DNA, 22 bp, Homo sapiens
tggccccctgattgtcaccttt

SEQ ID NO: 7681592 - DNA, 22 bp, Homo sapiens
tggccccctgattgtcaccttt

SEQ ID NO: 7681593 - DNA, 22 bp, Homo sapiens
tggccccctgattgtcaccttt

SEQ ID NO: 7681594 - DNA, 22 bp, Homo sapiens
tggcccctgaggagcatcagcc

SEQ ID NO: 7681595 - DNA, 22 bp, Homo sapiens
tggcccctgaggagcatcagcc

SEQ ID NO: 7681596 - DNA, 22 bp, Homo sapiens
tggccctgctatgatcctgcaa

SEQ ID NO: 7681597 - DNA, 22 bp, Homo sapiens
tggcccgcagcacgcgcaccat

SEQ ID NO: 7681598 - DNA, 22 bp, Homo sapiens
tggccctgctatgatcctgcaa

SEQ ID NO: 7681599 - DNA, 22 bp, Homo sapiens
tggccctgctatgatcctgcaa

SEQ ID NO: 7681600 - DNA, 22 bp, Homo sapiens
tggccctgctatgatcctgcaa

SEQ ID NO: 7681601 - DNA, 22 bp, Homo sapiens
tggccctgctatgatcctgcaa

SEQ ID NO: 7681602 - DNA, 22 bp, Homo sapiens
tggccctgctggacacgcctgc

SEQ ID NO: 7681603 - DNA, 22 bp, Homo sapiens
tggccctgctggacacgcctgc

SEQ ID NO: 7681604 - DNA, 22 bp, Homo sapiens
tggccctgctggacacgcctgc

SEQ ID NO: 7681605 - DNA, 22 bp, Homo sapiens
tggccctgctggacacgcctgc

SEQ ID NO: 7681606 - DNA, 22 bp, Homo sapiens
tggccctgctggacacgcctgc

SEQ ID NO: 7681607 - DNA, 22 bp, Homo sapiens
tggccctgctggccaaaggcta

SEQ ID NO: 7681608 - DNA, 22 bp, Homo sapiens
tggccctgctggccaaaggcta

SEQ ID NO: 7681609 - DNA, 22 bp, Homo sapiens
tggccctgctggccaaaggcta

SEQ ID NO: 7681610 - DNA, 22 bp, Homo sapiens
tggccctgctggccaaaggcta

SEQ ID NO: 7681611 - DNA, 22 bp, Homo sapiens
tggctcatattgagtgatttct

SEQ ID NO: 7681612 - DNA, 22 bp, Homo sapiens
tggctcatctatcagaaagtcc

SEQ ID NO: 7681613 - DNA, 22 bp, Homo sapiens
tggctcagtttgggggattgaa

SEQ ID NO: 7681614 - DNA, 22 bp, Homo sapiens
tggctcagtttgggggattgaa

SEQ ID NO: 7681615 - DNA, 22 bp, Homo sapiens
tggctcatgcctgtaatcttag

SEQ ID NO: 7681616 - DNA, 22 bp, Homo sapiens
tggctcatgcatcttttctaca

SEQ ID NO: 7681617 - DNA, 22 bp, Homo sapiens
tggctcatctttttagacttat

SEQ ID NO: 7681618 - DNA, 20 bp, Homo sapiens
tggctcatcctttctgcgcc

SEQ ID NO: 7681619 - DNA, 22 bp, Homo sapiens
tggctcatctatcagaaagtcc

SEQ ID NO: 7681620 - DNA, 22 bp, Homo sapiens
tggctcagtttgggggattgaa

SEQ ID NO: 7681621 - DNA, 22 bp, Homo sapiens
tggctcagtttgggggattgaa

SEQ ID NO: 7681622 - DNA, 22 bp, Homo sapiens
tggctcagtttgggggattgaa

SEQ ID NO: 7681623 - DNA, 22 bp, Homo sapiens
tggctcagtttgggggattgaa

SEQ ID NO: 7681624 - DNA, 22 bp, Homo sapiens
tggctcagtttgggggattgaa

SEQ ID NO: 7681625 - DNA, 22 bp, Homo sapiens
tggctcagtttgggggattgaa

SEQ ID NO: 7681626 - DNA, 22 bp, Homo sapiens
tggctcagtttctgcccagctg

SEQ ID NO: 7681627 - DNA, 22 bp, Homo sapiens
tggctcagtttctgcccagctg

SEQ ID NO: 7681628 - DNA, 22 bp, Homo sapiens
tggctcagtttctgcccagctg

SEQ ID NO: 7681629 - DNA, 22 bp, Homo sapiens
tggctcagtttctgcccagctg

SEQ ID NO: 7681630 - DNA, 22 bp, Homo sapiens
tggctcagtttctgcccagctg

SEQ ID NO: 7681631 - DNA, 22 bp, Homo sapiens
tggctcagtttctgcccagctg

SEQ ID NO: 7681632 - DNA, 22 bp, Homo sapiens
tggctcagtttcagtcctggtt

SEQ ID NO: 7681633 - DNA, 22 bp, Homo sapiens
tggctcagtttctgcccagctg

SEQ ID NO: 7681634 - DNA, 22 bp, Homo sapiens
tggctcagtttcagtcctggtt

SEQ ID NO: 7681635 - DNA, 22 bp, Homo sapiens
tggctcagtttcagtcctggtt

SEQ ID NO: 7681636 - DNA, 22 bp, Homo sapiens
tggctcagtttcagtcctggtt

SEQ ID NO: 7681637 - DNA, 22 bp, Homo sapiens
tggctcagtttcagtcctggtt

SEQ ID NO: 7681638 - DNA, 22 bp, Homo sapiens
tggctcagtttcagtcctggtt

SEQ ID NO: 7681639 - DNA, 22 bp, Homo sapiens
tggctcagtttcagtcctggtt

SEQ ID NO: 7681640 - DNA, 22 bp, Homo sapiens
tggctcagtttcagtcctggtt

SEQ ID NO: 7681641 - DNA, 22 bp, Homo sapiens
tggctcagtttcagtcctggtt

SEQ ID NO: 7681642 - DNA, 22 bp, Homo sapiens
tggctcagtttagcagctcagt

SEQ ID NO: 7681643 - DNA, 22 bp, Homo sapiens
tggctcagtttagcagctcagt

SEQ ID NO: 7681644 - DNA, 22 bp, Homo sapiens
tggccctgctgtatcatctgct

SEQ ID NO: 7681645 - DNA, 22 bp, Homo sapiens
tggccctgctgtatcatctgct

SEQ ID NO: 7681646 - DNA, 22 bp, Homo sapiens
tggccctgctgtatcatctgct

SEQ ID NO: 7681647 - DNA, 22 bp, Homo sapiens
tggccctgcttatgtctctctt

SEQ ID NO: 7681648 - DNA, 22 bp, Homo sapiens
tggccctgcttatgtctctctt

SEQ ID NO: 7681649 - DNA, 22 bp, Homo sapiens
tggccctgctgtatcatctgct

SEQ ID NO: 7681650 - DNA, 22 bp, Homo sapiens
tggccctgctgtatcatctgct

SEQ ID NO: 7681651 - DNA, 22 bp, Homo sapiens
tggccctgctgggtcagagctg

SEQ ID NO: 7681652 - DNA, 22 bp, Homo sapiens
tggccctgctggccaaaggcta

SEQ ID NO: 7681653 - DNA, 22 bp, Homo sapiens
tggccctgctggccaaaggcta

SEQ ID NO: 7681654 - DNA, 22 bp, Homo sapiens
tggccctgctgggtcagagctg

SEQ ID NO: 7681655 - DNA, 22 bp, Homo sapiens
tggccctgctgggtcagagctg

SEQ ID NO: 7681656 - DNA, 22 bp, Homo sapiens
tggccctgctgggtcagagctg

SEQ ID NO: 7681657 - DNA, 22 bp, Homo sapiens
tggccctgctgggtcagagctg

SEQ ID NO: 7681658 - DNA, 22 bp, Homo sapiens
tggccctgctgggtcagagctg

SEQ ID NO: 7681659 - DNA, 22 bp, Homo sapiens
tggccctgcttatgtctctctt

SEQ ID NO: 7681660 - DNA, 22 bp, Homo sapiens
tggccctgcttatgtctctctt

SEQ ID NO: 7681661 - DNA, 22 bp, Homo sapiens
tggccctgcttatgtctctctt

SEQ ID NO: 7681662 - DNA, 22 bp, Homo sapiens
tggctcagctgtcacagcctgg

SEQ ID NO: 7681663 - DNA, 22 bp, Homo sapiens
tggctcagctgtcacagcctgg

SEQ ID NO: 7681664 - DNA, 22 bp, Homo sapiens
tggctcagctgtcacagcctgg

SEQ ID NO: 7681665 - DNA, 22 bp, Homo sapiens
tggctcagctgtcacagcctgg

SEQ ID NO: 7681666 - DNA, 22 bp, Homo sapiens
tggctcagctgtcacagcctgg

SEQ ID NO: 7681667 - DNA, 22 bp, Homo sapiens
tggctcagctgactcggcttct

SEQ ID NO: 7681668 - DNA, 22 bp, Homo sapiens
tggctcagctgactcggcttct

SEQ ID NO: 7681669 - DNA, 21 bp, Homo sapiens
tggctcagttgctgggcacag

SEQ ID NO: 7681670 - DNA, 21 bp, Homo sapiens
tggctcagttgctgggcacag

SEQ ID NO: 7681671 - DNA, 21 bp, Homo sapiens
tggctcagttgctgggcacag

SEQ ID NO: 7681672 - DNA, 22 bp, Homo sapiens
tggctcagtttagcagctcagt

SEQ ID NO: 7681673 - DNA, 21 bp, Homo sapiens
tggctcagttgctgggcacag

SEQ ID NO: 7681674 - DNA, 22 bp, Homo sapiens
tggctcagtttagcagctcagt

SEQ ID NO: 7681675 - DNA, 22 bp, Homo sapiens
tggctcagtttagcagctcagt

SEQ ID NO: 7681676 - DNA, 22 bp, Homo sapiens
tggctcagtttagcagctcagt

SEQ ID NO: 7681677 - DNA, 23 bp, Homo sapiens
ttttattgatatgtagctgttgt

SEQ ID NO: 7681678 - DNA, 23 bp, Homo sapiens
ttttattgatatgtagctgttgt

SEQ ID NO: 7681679 - DNA, 23 bp, Homo sapiens
ttttattgatatgtagctgttgt

SEQ ID NO: 7681680 - DNA, 23 bp, Homo sapiens
ttttattgatatgtagctgttgt

SEQ ID NO: 7681681 - DNA, 23 bp, Homo sapiens
ttttattgatatgtagctgttgt

SEQ ID NO: 7681682 - DNA, 23 bp, Homo sapiens
ttttattgatatgtagctgttgt

SEQ ID NO: 7681683 - DNA, 23 bp, Homo sapiens
ttttattgatatgtagctgttgt

SEQ ID NO: 7681684 - DNA, 23 bp, Homo sapiens
ttttattgatatgtagctgttgt

SEQ ID NO: 7681685 - DNA, 23 bp, Homo sapiens
ttttattgatatgtagctgttgt

SEQ ID NO: 7681686 - DNA, 23 bp, Homo sapiens
ttttattgatatgtagctgttgt

SEQ ID NO: 7681687 - DNA, 22 bp, Homo sapiens
ttttattctcagctccagagag

SEQ ID NO: 7681688 - DNA, 22 bp, Homo sapiens
ttttattctcaagacaatggga

SEQ ID NO: 7681689 - DNA, 22 bp, Homo sapiens
ttttattctcaagacaatggga

SEQ ID NO: 7681690 - DNA, 22 bp, Homo sapiens
ttttattctcagctccagagag

SEQ ID NO: 7681691 - DNA, 22 bp, Homo sapiens
ttttattctcagctccagagag

SEQ ID NO: 7681692 - DNA, 22 bp, Homo sapiens
ttttattctcagctccagagag

SEQ ID NO: 7681693 - DNA, 22 bp, Homo sapiens
ttttattcatagggatggagag

SEQ ID NO: 7681694 - DNA, 22 bp, Homo sapiens
ttttattcaaatagttcacact

SEQ ID NO: 7681695 - DNA, 22 bp, Homo sapiens
ttttattcaaatagttcacact

SEQ ID NO: 7681696 - DNA, 22 bp, Homo sapiens
ttttattcaaatagttcacact

SEQ ID NO: 7681697 - DNA, 22 bp, Homo sapiens
ttttattatctttgaatgggac

SEQ ID NO: 7681698 - DNA, 22 bp, Homo sapiens
ttttattctcaagacaatggga

SEQ ID NO: 7681699 - DNA, 22 bp, Homo sapiens
ttttattctcaagacaatggga

SEQ ID NO: 7681700 - DNA, 22 bp, Homo sapiens
ttttattctaagtatgatggga

SEQ ID NO: 7681701 - DNA, 22 bp, Homo sapiens
ttttattctaagtatgatggga

SEQ ID NO: 7681702 - DNA, 22 bp, Homo sapiens
ttttattcatagggatggagag

SEQ ID NO: 7681703 - DNA, 22 bp, Homo sapiens
ttttattcatagggatggagag

SEQ ID NO: 7681704 - DNA, 22 bp, Homo sapiens
ctctgggcggcccaggccaacc

SEQ ID NO: 7681705 - DNA, 21 bp, Homo sapiens
ctctgggccattttcttccac

SEQ ID NO: 7681706 - DNA, 21 bp, Homo sapiens
ctctgggccattttcttccac

SEQ ID NO: 7681707 - DNA, 22 bp, Homo sapiens
ctctgggccatgctactgctct

SEQ ID NO: 7681708 - DNA, 22 bp, Homo sapiens
ctctgggccatgctactgctct

SEQ ID NO: 7681709 - DNA, 23 bp, Homo sapiens
ctctgggcgggcaggtcagcctc

SEQ ID NO: 7681710 - DNA, 22 bp, Homo sapiens
ctctgggcggcccaggccaacc

SEQ ID NO: 7681711 - DNA, 22 bp, Homo sapiens
ctctgggcggcccaggccaacc

SEQ ID NO: 7681712 - DNA, 22 bp, Homo sapiens
ctctgggcggcccaggccaacc

SEQ ID NO: 7681713 - DNA, 22 bp, Homo sapiens
ctctgggctccttcagcccttt

SEQ ID NO: 7681714 - DNA, 22 bp, Homo sapiens
ttttagttgtactgtcaacagt

SEQ ID NO: 7681715 - DNA, 22 bp, Homo sapiens
ttttagttgctcaggtattctc

SEQ ID NO: 7681716 - DNA, 22 bp, Homo sapiens
ttttagttgtactgtcaacagt

SEQ ID NO: 7681717 - DNA, 22 bp, Homo sapiens
ttttattatctttgaatgggac

SEQ ID NO: 7681718 - DNA, 23 bp, Homo sapiens
ctctgggcgggcaggtcagcctc

SEQ ID NO: 7681719 - DNA, 22 bp, Homo sapiens
ctctgggctccttcagcccttt

SEQ ID NO: 7681720 - DNA, 22 bp, Homo sapiens
ctctgggctccttcagcccttt

SEQ ID NO: 7681721 - DNA, 22 bp, Homo sapiens
ctctgggctgaatggctgaacc

SEQ ID NO: 7681722 - DNA, 22 bp, Homo sapiens
ttttagttactgcagtagcaaa

SEQ ID NO: 7681723 - DNA, 22 bp, Homo sapiens
ctctgggctgaatggctgaacc

SEQ ID NO: 7681724 - DNA, 22 bp, Homo sapiens
ctctgggctgaatggctgaacc

SEQ ID NO: 7681725 - DNA, 17 bp, Homo sapiens
ctctgggcagcctgggg

SEQ ID NO: 7681726 - DNA, 17 bp, Homo sapiens
ctctgggcagcctgggg

SEQ ID NO: 7681727 - DNA, 17 bp, Homo sapiens
ctctgggcagcctgggg

SEQ ID NO: 7681728 - DNA, 22 bp, Homo sapiens
ctctgggcaccaaagagcagct

SEQ ID NO: 7681729 - DNA, 22 bp, Homo sapiens
ctctgggcaccaaagagcagct

SEQ ID NO: 7681730 - DNA, 22 bp, Homo sapiens
ctctgggcaccaaagagcagct

SEQ ID NO: 7681731 - DNA, 22 bp, Homo sapiens
ctctgggcaccaaagagcagct

SEQ ID NO: 7681732 - DNA, 22 bp, Homo sapiens
ctctgggcaccaaagagcagct

SEQ ID NO: 7681733 - DNA, 22 bp, Homo sapiens
ctctgggcaccaaagagcagct

SEQ ID NO: 7681734 - DNA, 22 bp, Homo sapiens
ctctgggcaggaccagtggacc

SEQ ID NO: 7681735 - DNA, 22 bp, Homo sapiens
ctctgggcaggaccagtggacc

SEQ ID NO: 7681736 - DNA, 22 bp, Homo sapiens
ctctgggcaggaccagtggacc

SEQ ID NO: 7681737 - DNA, 22 bp, Homo sapiens
ctctgggcaggaccagtggacc

SEQ ID NO: 7681738 - DNA, 22 bp, Homo sapiens
ctctgggcaggaccagtggacc

SEQ ID NO: 7681739 - DNA, 22 bp, Homo sapiens
ctctgggcaggacgccaggcct

SEQ ID NO: 7681740 - DNA, 22 bp, Homo sapiens
ctctgggcaggaccagtggacc

SEQ ID NO: 7681741 - DNA, 22 bp, Homo sapiens
ctctgggcaggaccagtggacc

SEQ ID NO: 7681742 - DNA, 22 bp, Homo sapiens
ctctgggcaggacgccaggcct

SEQ ID NO: 7681743 - DNA, 22 bp, Homo sapiens
ctctgggccaccgctggtgtat

SEQ ID NO: 7681744 - DNA, 22 bp, Homo sapiens
ctctgggccaccgctggtgtat

SEQ ID NO: 7681745 - DNA, 22 bp, Homo sapiens
ctctgggccaccgctggtgtat

SEQ ID NO: 7681746 - DNA, 22 bp, Homo sapiens
ctctgggcaggacgccaggcct

SEQ ID NO: 7681747 - DNA, 22 bp, Homo sapiens
ctctgggcaggacgccaggcct

SEQ ID NO: 7681748 - DNA, 22 bp, Homo sapiens
ctctgggcaggacgccaggcct

SEQ ID NO: 7681749 - DNA, 22 bp, Homo sapiens
ctctgggcaggacgccaggcct

SEQ ID NO: 7681750 - DNA, 22 bp, Homo sapiens
ctctgggcaggacgccaggcct

SEQ ID NO: 7681751 - DNA, 22 bp, Homo sapiens
ctctgggcaaagatgcctcatc

SEQ ID NO: 7681752 - DNA, 22 bp, Homo sapiens
ctctgggcaaagatgcctcatc

SEQ ID NO: 7681753 - DNA, 22 bp, Homo sapiens
ctctgggatgaggcctaggcac

SEQ ID NO: 7681754 - DNA, 22 bp, Homo sapiens
ctctgggatgaggcctaggcac

SEQ ID NO: 7681755 - DNA, 22 bp, Homo sapiens
ctctgggatgaggcctaggcac

SEQ ID NO: 7681756 - DNA, 22 bp, Homo sapiens
ctctgggatgaggcctaggcac

SEQ ID NO: 7681757 - DNA, 22 bp, Homo sapiens
ctctgggatgaggcctaggcac

SEQ ID NO: 7681758 - DNA, 22 bp, Homo sapiens
ctctgggatagagcctcggtct

SEQ ID NO: 7681759 - DNA, 22 bp, Homo sapiens
ctctgggatgaggcctaggcac

SEQ ID NO: 7681760 - DNA, 22 bp, Homo sapiens
ctctgggagtggccacttctca

SEQ ID NO: 7681761 - DNA, 22 bp, Homo sapiens
ctctgggatagagcctcggtct

SEQ ID NO: 7681762 - DNA, 22 bp, Homo sapiens
ctctgggatagagcctcggtct

SEQ ID NO: 7681763 - DNA, 22 bp, Homo sapiens
ctctggcttctaccttgcagtt

SEQ ID NO: 7681764 - DNA, 18 bp, Homo sapiens
ctctgggagaggcataca

SEQ ID NO: 7681765 - DNA, 18 bp, Homo sapiens
ctctgggagaggcataca

SEQ ID NO: 7681766 - DNA, 18 bp, Homo sapiens
ctctgggagaggcataca

SEQ ID NO: 7681767 - DNA, 22 bp, Homo sapiens
ctctgggcaaagatgcctcatc

SEQ ID NO: 7681768 - DNA, 22 bp, Homo sapiens
ctctgggcaaagatgcctcatc

SEQ ID NO: 7681769 - DNA, 22 bp, Homo sapiens
ctctgggcaagtatgatagaaa

SEQ ID NO: 7681770 - DNA, 22 bp, Homo sapiens
ctctgggcaaagatgcctcatc

SEQ ID NO: 7681771 - DNA, 22 bp, Homo sapiens
ctctgggcacattttccaggac

SEQ ID NO: 7681772 - DNA, 19 bp, Homo sapiens
ctctgggcaagtcacttaa

SEQ ID NO: 7681773 - DNA, 19 bp, Homo sapiens
ctctgggcaagtcacttaa

SEQ ID NO: 7681774 - DNA, 22 bp, Homo sapiens
ctctgggcaagtttcttcatga

SEQ ID NO: 7681775 - DNA, 22 bp, Homo sapiens
ctctgggcaagtttcttcatga

SEQ ID NO: 7681776 - DNA, 22 bp, Homo sapiens
ctctggctggcacctgatctga

SEQ ID NO: 7681777 - DNA, 22 bp, Homo sapiens
ctctggctggcacctgatctga

SEQ ID NO: 7681778 - DNA, 22 bp, Homo sapiens
ctctggctggcacctgatctga

SEQ ID NO: 7681779 - DNA, 22 bp, Homo sapiens
ctctggctgcctctcaggcctg

SEQ ID NO: 7681780 - DNA, 22 bp, Homo sapiens
ctctggctgcggggcgcgtgga

SEQ ID NO: 7681781 - DNA, 22 bp, Homo sapiens
ctctggctgcggggcgcgtgga

SEQ ID NO: 7681782 - DNA, 22 bp, Homo sapiens
ctctggctgcctctcaggcctg

SEQ ID NO: 7681783 - DNA, 22 bp, Homo sapiens
ctctggctcttgggaaacaggt

SEQ ID NO: 7681784 - DNA, 22 bp, Homo sapiens
ctctggctgcctctcaggcctg

SEQ ID NO: 7681785 - DNA, 22 bp, Homo sapiens
ctctggctgcctctcaggcctg

SEQ ID NO: 7681786 - DNA, 22 bp, Homo sapiens
ctctggctgcctctcaggcctg

SEQ ID NO: 7681787 - DNA, 22 bp, Homo sapiens
ctctggctcttgggaaacaggt

SEQ ID NO: 7681788 - DNA, 22 bp, Homo sapiens
ctctggctctgttgagatttgt

SEQ ID NO: 7681789 - DNA, 22 bp, Homo sapiens
ctctggctctgttgagatttgt

SEQ ID NO: 7681790 - DNA, 22 bp, Homo sapiens
ctctggctctgacagttgatcc

SEQ ID NO: 7681791 - DNA, 22 bp, Homo sapiens
tttgtgaataggttggcttcca

SEQ ID NO: 7681792 - DNA, 22 bp, Homo sapiens
tttgtgaataggttggcttcca

SEQ ID NO: 7681793 - DNA, 22 bp, Homo sapiens
tttgtgaatgccttataagcat

SEQ ID NO: 7681794 - DNA, 22 bp, Homo sapiens
tttgtgaataggttggcttcca

SEQ ID NO: 7681795 - DNA, 22 bp, Homo sapiens
tttgtgaataggttggcttcca

SEQ ID NO: 7681796 - DNA, 22 bp, Homo sapiens
tttgtgaataggttggcttcca

SEQ ID NO: 7681797 - DNA, 22 bp, Homo sapiens
tttgtgaatggaatccacagac

SEQ ID NO: 7681798 - DNA, 22 bp, Homo sapiens
tttgtgaattcttggaagattg

SEQ ID NO: 7681799 - DNA, 22 bp, Homo sapiens
tttgtgacttgcttctcagaat

SEQ ID NO: 7681800 - DNA, 22 bp, Homo sapiens
tttgtgaatggaatccacagac

SEQ ID NO: 7681801 - DNA, 22 bp, Homo sapiens
tttgtgaatgccttataagcat

SEQ ID NO: 7681802 - DNA, 22 bp, Homo sapiens
tttgtgaatggaatccacagac

SEQ ID NO: 7681803 - DNA, 19 bp, Homo sapiens
ctctggctcctgggctgcc

SEQ ID NO: 7681804 - DNA, 20 bp, Homo sapiens
ctctggctccgcgtgaccgc

SEQ ID NO: 7681805 - DNA, 19 bp, Homo sapiens
ctctggctcctgggctgcc

SEQ ID NO: 7681806 - DNA, 19 bp, Homo sapiens
ctctggcttccaaagcatc

SEQ ID NO: 7681807 - DNA, 19 bp, Homo sapiens
ctctggcttccaaagcatc

SEQ ID NO: 7681808 - DNA, 19 bp, Homo sapiens
ctctggcttccaaagcatc

SEQ ID NO: 7681809 - DNA, 19 bp, Homo sapiens
ctctggcttccaaagcatc

SEQ ID NO: 7681810 - DNA, 19 bp, Homo sapiens
ctctggcttccaaagcatc

SEQ ID NO: 7681811 - DNA, 22 bp, Homo sapiens
ctctggcttctaccttgcagtt

SEQ ID NO: 7681812 - DNA, 22 bp, Homo sapiens
ctctggcttctaccttgcagtt

SEQ ID NO: 7681813 - DNA, 22 bp, Homo sapiens
ctctggcttctaccttgcagtt

SEQ ID NO: 7681814 - DNA, 22 bp, Homo sapiens
ctctggcttctaccttgcagtt

SEQ ID NO: 7681815 - DNA, 22 bp, Homo sapiens
ctctggcttagtatgctccaaa

SEQ ID NO: 7681816 - DNA, 22 bp, Homo sapiens
ctctggctgtttgcagctcaag

SEQ ID NO: 7681817 - DNA, 22 bp, Homo sapiens
ctctggcttagtatgctccaaa

SEQ ID NO: 7681818 - DNA, 22 bp, Homo sapiens
ctctggcttagtatgctccaaa

SEQ ID NO: 7681819 - DNA, 22 bp, Homo sapiens
ctctggcttagtatgctccaaa

SEQ ID NO: 7681820 - DNA, 22 bp, Homo sapiens
ctctggctgtttgcagctcaag

SEQ ID NO: 7681821 - DNA, 22 bp, Homo sapiens
ctctggctgtcccgatgagcag

SEQ ID NO: 7681822 - DNA, 22 bp, Homo sapiens
ctctggctgtcccgatgagcag

SEQ ID NO: 7681823 - DNA, 22 bp, Homo sapiens
ctctggctgtcccgatgagcag

SEQ ID NO: 7681824 - DNA, 22 bp, Homo sapiens
ctctggctgtcccgatgagcag

SEQ ID NO: 7681825 - DNA, 22 bp, Homo sapiens
ctctggctggctgggcctcagt

SEQ ID NO: 7681826 - DNA, 22 bp, Homo sapiens
ctctggctgtcccgatgagcag

SEQ ID NO: 7681827 - DNA, 22 bp, Homo sapiens
ctctggctgtcccgatgagcag

SEQ ID NO: 7681828 - DNA, 22 bp, Homo sapiens
ctctggctggctgggcctcagt

SEQ ID NO: 7681829 - DNA, 22 bp, Homo sapiens
ctctggctggctgggcctcagt

SEQ ID NO: 7681830 - DNA, 22 bp, Homo sapiens
ctctggctggcattgctggact

SEQ ID NO: 7681831 - DNA, 22 bp, Homo sapiens
ctctggctggcattgctggact

SEQ ID NO: 7681832 - DNA, 22 bp, Homo sapiens
ctctggctggcattgctggact

SEQ ID NO: 7681833 - DNA, 22 bp, Homo sapiens
ctctggctggcattgctggact

SEQ ID NO: 7681834 - DNA, 22 bp, Homo sapiens
ctctggctggcattgctggact

SEQ ID NO: 7681835 - DNA, 22 bp, Homo sapiens
ctctggctggctgggcctcagt

SEQ ID NO: 7681836 - DNA, 22 bp, Homo sapiens
ctctggctggctgggcctcagt

SEQ ID NO: 7681837 - DNA, 22 bp, Homo sapiens
ctctggctggctgggcctcagt

SEQ ID NO: 7681838 - DNA, 22 bp, Homo sapiens
ctctggctggctgggcctcagt

SEQ ID NO: 7681839 - DNA, 22 bp, Homo sapiens
ctctggctggcattgctggact

SEQ ID NO: 7681840 - DNA, 22 bp, Homo sapiens
ctctggctggcattgctggact

SEQ ID NO: 7681841 - DNA, 22 bp, Homo sapiens
ctctggctggcattgctggact

SEQ ID NO: 7681842 - DNA, 22 bp, Homo sapiens
tttgtcttgtgtccttaggacc

SEQ ID NO: 7681843 - DNA, 22 bp, Homo sapiens
tttgtctttcccctcctcattg

SEQ ID NO: 7681844 - DNA, 22 bp, Homo sapiens
tttgtcttgtgtccttaggacc

SEQ ID NO: 7681845 - DNA, 22 bp, Homo sapiens
tttgtctttcccctcctcattg

SEQ ID NO: 7681846 - DNA, 22 bp, Homo sapiens
tttgtctttcccctcctcattg

SEQ ID NO: 7681847 - DNA, 22 bp, Homo sapiens
tttgtctttcccctcctcattg

SEQ ID NO: 7681848 - DNA, 22 bp, Homo sapiens
tttgtcttgtgtccttaggacc

SEQ ID NO: 7681849 - DNA, 22 bp, Homo sapiens
tttgtcttgtgtccttaggacc

SEQ ID NO: 7681850 - DNA, 22 bp, Homo sapiens
tttgtcttgtgtccttaggacc

SEQ ID NO: 7681851 - DNA, 22 bp, Homo sapiens
tttgtcttgtgtccttaggacc

SEQ ID NO: 7681852 - DNA, 22 bp, Homo sapiens
tttgtcttgtgtccttaggacc

SEQ ID NO: 7681853 - DNA, 22 bp, Homo sapiens
tttgtcttgtaagttaaattca

SEQ ID NO: 7681854 - DNA, 22 bp, Homo sapiens
tttgtcttgtaagttaaattca

SEQ ID NO: 7681855 - DNA, 22 bp, Homo sapiens
tttgtcttgtaagttaaattca

SEQ ID NO: 7681856 - DNA, 22 bp, Homo sapiens
tttgtctttcccctcctcattg

SEQ ID NO: 7681857 - DNA, 22 bp, Homo sapiens
tttgtctttcccctcctcattg

SEQ ID NO: 7681858 - DNA, 23 bp, Homo sapiens
tttgtgaaagtgttgagaggaga

SEQ ID NO: 7681859 - DNA, 22 bp, Homo sapiens
tttgtctttcccctcctcattg

SEQ ID NO: 7681860 - DNA, 22 bp, Homo sapiens
tttgtctttcccctcctcattg

SEQ ID NO: 7681861 - DNA, 22 bp, Homo sapiens
tttgtgaacaaacatgaagatg

SEQ ID NO: 7681862 - DNA, 22 bp, Homo sapiens
tttgtgaaatgaagtcacaact

SEQ ID NO: 7681863 - DNA, 22 bp, Homo sapiens
tttgtgaaatgaagtcacaact

SEQ ID NO: 7681864 - DNA, 23 bp, Homo sapiens
tttgtgaaagtgttgagaggaga

SEQ ID NO: 7681865 - DNA, 22 bp, Homo sapiens
tttgtgaaatgaagtcacaact

SEQ ID NO: 7681866 - DNA, 22 bp, Homo sapiens
tttgtgaataggttggcttcca

SEQ ID NO: 7681867 - DNA, 22 bp, Homo sapiens
tttgtgaataggttggcttcca

SEQ ID NO: 7681868 - DNA, 22 bp, Homo sapiens
tttgtgaataggttggcttcca

SEQ ID NO: 7681869 - DNA, 22 bp, Homo sapiens
tttgtgaagggaacagaagtgt

SEQ ID NO: 7681870 - DNA, 22 bp, Homo sapiens
tttgtgaagggaacagaagtgt

SEQ ID NO: 7681871 - DNA, 19 bp, Homo sapiens
tttgtgaagaaaatgatgc

SEQ ID NO: 7681872 - DNA, 19 bp, Homo sapiens
tttgtgaagaaaatgatgc

SEQ ID NO: 7681873 - DNA, 22 bp, Homo sapiens
tttgtgaacttaggcaattagg

SEQ ID NO: 7681874 - DNA, 22 bp, Homo sapiens
tttgtgaacttaggcaattagg

SEQ ID NO: 7681875 - DNA, 22 bp, Homo sapiens
tttgtgaacttaggcaattagg

SEQ ID NO: 7681876 - DNA, 22 bp, Homo sapiens
tttgtgaacactgcgcagaact

SEQ ID NO: 7681877 - DNA, 22 bp, Homo sapiens
tttgtgaacaaacatgaagatg

SEQ ID NO: 7681878 - DNA, 22 bp, Homo sapiens
tttgtcttgtaagttaaattca

SEQ ID NO: 7681879 - DNA, 22 bp, Homo sapiens
tttgtcttgtaagttaaattca

SEQ ID NO: 7681880 - DNA, 22 bp, Homo sapiens
tttgtcttggcctcagttttct

SEQ ID NO: 7681881 - DNA, 22 bp, Homo sapiens
tttgtcttggcctcagttttct

SEQ ID NO: 7681882 - DNA, 22 bp, Homo sapiens
tttgtcttggcctcagttttct

SEQ ID NO: 7681883 - DNA, 22 bp, Homo sapiens
tttgtcttggcctcagttttct

SEQ ID NO: 7681884 - DNA, 22 bp, Homo sapiens
tttgtcttggcctcagttttct

SEQ ID NO: 7681885 - DNA, 22 bp, Homo sapiens
tttgtcttggcctcagttttct

SEQ ID NO: 7681886 - DNA, 22 bp, Homo sapiens
ctctcctggggagcacacacac

SEQ ID NO: 7681887 - DNA, 22 bp, Homo sapiens
tttgtcttggcctcagttttct

SEQ ID NO: 7681888 - DNA, 22 bp, Homo sapiens
tttgtcttggcctcagttttct

SEQ ID NO: 7681889 - DNA, 22 bp, Homo sapiens
tttgtcttggcctcagttttct

SEQ ID NO: 7681890 - DNA, 22 bp, Homo sapiens
tttgtcttgaggctggggaagt

SEQ ID NO: 7681891 - DNA, 22 bp, Homo sapiens
tttgtcttggccaaggttctga

SEQ ID NO: 7681892 - DNA, 22 bp, Homo sapiens
tttgtcttggccaaggttctga

SEQ ID NO: 7681893 - DNA, 22 bp, Homo sapiens
ctctcctggggagcacacacac

SEQ ID NO: 7681894 - DNA, 22 bp, Homo sapiens
tttgtacatcctaattctgagt

SEQ ID NO: 7681895 - DNA, 22 bp, Homo sapiens
tttgtacatcctaattctgagt

SEQ ID NO: 7681896 - DNA, 22 bp, Homo sapiens
tttgtacatcctaattctgagt

SEQ ID NO: 7681897 - DNA, 22 bp, Homo sapiens
ctctcctggggagcacacacac

SEQ ID NO: 7681898 - DNA, 22 bp, Homo sapiens
tttgtacatcctaattctgagt

SEQ ID NO: 7681899 - DNA, 22 bp, Homo sapiens
tttgtacatcctaattctgagt

SEQ ID NO: 7681900 - DNA, 23 bp, Homo sapiens
ctctcctgaaggacaagctgccg

SEQ ID NO: 7681901 - DNA, 23 bp, Homo sapiens
ctctcctgaaggacaagctgccg

SEQ ID NO: 7681902 - DNA, 23 bp, Homo sapiens
ctctcctgaaggacaagctgccg

SEQ ID NO: 7681903 - DNA, 23 bp, Homo sapiens
ctctcctgaaggacaagctgccg

SEQ ID NO: 7681904 - DNA, 22 bp, Homo sapiens
ctctcctgggctgaccgtccga

SEQ ID NO: 7681905 - DNA, 22 bp, Homo sapiens
ctctcctgggctgaccgtccga

SEQ ID NO: 7681906 - DNA, 22 bp, Homo sapiens
ctctcctgggctgaccgtccga

SEQ ID NO: 7681907 - DNA, 22 bp, Homo sapiens
ctctcctctgaagtggtgaccc

SEQ ID NO: 7681908 - DNA, 23 bp, Homo sapiens
ctctcctgaaggacaagctgccg

SEQ ID NO: 7681909 - DNA, 22 bp, Homo sapiens
ctctcctctgaagtggtgaccc

SEQ ID NO: 7681910 - DNA, 22 bp, Homo sapiens
ctctcctctgaagtggtgaccc

SEQ ID NO: 7681911 - DNA, 22 bp, Homo sapiens
ctctcctctgaagtggtgaccc

SEQ ID NO: 7681912 - DNA, 22 bp, Homo sapiens
ctctcctctgaagtggtgaccc

SEQ ID NO: 7681913 - DNA, 22 bp, Homo sapiens
ctctcctctgaagtggtgaccc

SEQ ID NO: 7681914 - DNA, 22 bp, Homo sapiens
ctctcctcccatgtaggagatg

SEQ ID NO: 7681915 - DNA, 22 bp, Homo sapiens
ctctcctcccatgtaggagatg

SEQ ID NO: 7681916 - DNA, 22 bp, Homo sapiens
ctctcctcccatgtaggagatg

SEQ ID NO: 7681917 - DNA, 21 bp, Homo sapiens
ttttattgatgaatggccact

SEQ ID NO: 7681918 - DNA, 21 bp, Homo sapiens
ttttattgatgaatggccact

SEQ ID NO: 7681919 - DNA, 21 bp, Homo sapiens
ttttattgatgaatggccact

SEQ ID NO: 7681920 - DNA, 21 bp, Homo sapiens
ttttattgatgaatggccact

SEQ ID NO: 7681921 - DNA, 21 bp, Homo sapiens
ttttattgatgaatggccact

SEQ ID NO: 7681922 - DNA, 21 bp, Homo sapiens
ttttattgatgaatggccact

SEQ ID NO: 7681923 - DNA, 23 bp, Homo sapiens
ttttattgatatgtagctgttgt

SEQ ID NO: 7681924 - DNA, 23 bp, Homo sapiens
ttttattgatatgtagctgttgt

SEQ ID NO: 7681925 - DNA, 22 bp, Homo sapiens
ctctgggttcactgaggctctg

SEQ ID NO: 7681926 - DNA, 22 bp, Homo sapiens
ctctgggttcactgaggctctg

SEQ ID NO: 7681927 - DNA, 22 bp, Homo sapiens
ctctgggttcactgaggctctg

SEQ ID NO: 7681928 - DNA, 21 bp, Homo sapiens
ttttattgatgaatggccact

SEQ ID NO: 7681929 - DNA, 22 bp, Homo sapiens
ctctgggttcactgaggctctg

SEQ ID NO: 7681930 - DNA, 21 bp, Homo sapiens
ctctggtcctgtctggcaggc

SEQ ID NO: 7681931 - DNA, 21 bp, Homo sapiens
ctctggtcctgtctggcaggc

SEQ ID NO: 7681932 - DNA, 21 bp, Homo sapiens
ctctggtcctgtctggcaggc

SEQ ID NO: 7681933 - DNA, 21 bp, Homo sapiens
ctctggtcctgtctggcaggc

SEQ ID NO: 7681934 - DNA, 22 bp, Homo sapiens
ctctggtcccctgtcaccagtt

SEQ ID NO: 7681935 - DNA, 22 bp, Homo sapiens
ctctggtcccctgtcaccagtt

SEQ ID NO: 7681936 - DNA, 22 bp, Homo sapiens
ctctgggttctggcctgcaccc

SEQ ID NO: 7681937 - DNA, 22 bp, Homo sapiens
ctctgggttcagccccggccct

SEQ ID NO: 7681938 - DNA, 22 bp, Homo sapiens
ctctgggttctggcctgcaccc

SEQ ID NO: 7681939 - DNA, 22 bp, Homo sapiens
ctctgggttttgtcagctgagg

SEQ ID NO: 7681940 - DNA, 22 bp, Homo sapiens
ctctgggttttgtcagctgagg

SEQ ID NO: 7681941 - DNA, 22 bp, Homo sapiens
ctctggtcatttggaagagcat

SEQ ID NO: 7681942 - DNA, 22 bp, Homo sapiens
ctctggtcatttggaagagcat

SEQ ID NO: 7681943 - DNA, 22 bp, Homo sapiens
ctctggtcaagcaaagaggttt

SEQ ID NO: 7681944 - DNA, 22 bp, Homo sapiens
ctctgggttttgtcagctgagg

SEQ ID NO: 7681945 - DNA, 22 bp, Homo sapiens
ctctttgtggaacggcagtgtc

SEQ ID NO: 7681946 - DNA, 22 bp, Homo sapiens
ctctttgtggaacggcagtgtc

SEQ ID NO: 7681947 - DNA, 21 bp, Homo sapiens
ctctttgtggcaatgtatttt

SEQ ID NO: 7681948 - DNA, 20 bp, Homo sapiens
ctctttgttggcaaactctt

SEQ ID NO: 7681949 - DNA, 22 bp, Homo sapiens
ctctttgtggccacctaatctt

SEQ ID NO: 7681950 - DNA, 22 bp, Homo sapiens
ctcttttaattgtcataacaac

SEQ ID NO: 7681951 - DNA, 22 bp, Homo sapiens
ctcttttaattgtcataacaac

SEQ ID NO: 7681952 - DNA, 22 bp, Homo sapiens
ctctttgtgctattatgatcct

SEQ ID NO: 7681953 - DNA, 22 bp, Homo sapiens
ctctttgtcactcatacagtca

SEQ ID NO: 7681954 - DNA, 22 bp, Homo sapiens
ctctttgtcactcatacagtca

SEQ ID NO: 7681955 - DNA, 22 bp, Homo sapiens
ctctttgtatttctttgggcca

SEQ ID NO: 7681956 - DNA, 22 bp, Homo sapiens
ctctttggttaatcacacagat

SEQ ID NO: 7681957 - DNA, 22 bp, Homo sapiens
ctctttggttaatcacacagat

SEQ ID NO: 7681958 - DNA, 22 bp, Homo sapiens
ctctttgtagcctttgcatatt

SEQ ID NO: 7681959 - DNA, 22 bp, Homo sapiens
ctctttggcccccgatgattca

SEQ ID NO: 7681960 - DNA, 22 bp, Homo sapiens
ctctttggcccccgatgattca

SEQ ID NO: 7681961 - DNA, 22 bp, Homo sapiens
ctctttggccagaaaatgtttt

SEQ ID NO: 7681962 - DNA, 22 bp, Homo sapiens
ctctggttcagggctccctggc

SEQ ID NO: 7681963 - DNA, 22 bp, Homo sapiens
ctctggttcagggctccctggc

SEQ ID NO: 7681964 - DNA, 23 bp, Homo sapiens
ctctggttagatatcatatgctg

SEQ ID NO: 7681965 - DNA, 22 bp, Homo sapiens
ctctggtcttcaaggccacctc

SEQ ID NO: 7681966 - DNA, 22 bp, Homo sapiens
ctctggtcttcaaggccacctc

SEQ ID NO: 7681967 - DNA, 22 bp, Homo sapiens
ctctggtcctttatggtttcca

SEQ ID NO: 7681968 - DNA, 22 bp, Homo sapiens
ctctggtcctttatggtttcca

SEQ ID NO: 7681969 - DNA, 22 bp, Homo sapiens
ctctggtgtcctttagaattta

SEQ ID NO: 7681970 - DNA, 22 bp, Homo sapiens
ctctggtgtctcccctaagcta

SEQ ID NO: 7681971 - DNA, 22 bp, Homo sapiens
tttttaacctaccttaagagca

SEQ ID NO: 7681972 - DNA, 22 bp, Homo sapiens
tttttaagagattctccagtct

SEQ ID NO: 7681973 - DNA, 22 bp, Homo sapiens
tttttaagagattctccagtct

SEQ ID NO: 7681974 - DNA, 22 bp, Homo sapiens
tttttaagagattctccagtct

SEQ ID NO: 7681975 - DNA, 22 bp, Homo sapiens
tttttaagagattctccagtct

SEQ ID NO: 7681976 - DNA, 22 bp, Homo sapiens
tttttaacctaccttaagagca

SEQ ID NO: 7681977 - DNA, 22 bp, Homo sapiens
tttttaacctaccttaagagca

SEQ ID NO: 7681978 - DNA, 22 bp, Homo sapiens
tttttaacctaccttaagagca

SEQ ID NO: 7681979 - DNA, 22 bp, Homo sapiens
tttttaacctaccttaagagca

SEQ ID NO: 7681980 - DNA, 22 bp, Homo sapiens
ttttgttttcttagaaacctgg

SEQ ID NO: 7681981 - DNA, 22 bp, Homo sapiens
ttttgttttcttagaaacctgg

SEQ ID NO: 7681982 - DNA, 19 bp, Homo sapiens
ctgaaaaacattctcagga

SEQ ID NO: 7681983 - DNA, 22 bp, Homo sapiens
ttttgtttgtgtccactgcagt

SEQ ID NO: 7681984 - DNA, 22 bp, Homo sapiens
ttttgtttgtgtccactgcagt

SEQ ID NO: 7681985 - DNA, 19 bp, Homo sapiens
ctgaaaaacattctcagga

SEQ ID NO: 7681986 - DNA, 19 bp, Homo sapiens
ctgaaaaacattctcagga

SEQ ID NO: 7681987 - DNA, 22 bp, Homo sapiens
ttttgttttcttagaaacctgg

SEQ ID NO: 7681988 - DNA, 22 bp, Homo sapiens
ttttgttttcttagaaacctgg

SEQ ID NO: 7681989 - DNA, 22 bp, Homo sapiens
ttttgttttcttagaaacctgg

SEQ ID NO: 7681990 - DNA, 22 bp, Homo sapiens
ttttgttttcttagaaacctgg

SEQ ID NO: 7681991 - DNA, 22 bp, Homo sapiens
ttttgttttcttagaaacctgg

SEQ ID NO: 7681992 - DNA, 22 bp, Homo sapiens
ttttgttttcttagaaacctgg

SEQ ID NO: 7681993 - DNA, 22 bp, Homo sapiens
tttttaatgcagtctgagacat

SEQ ID NO: 7681994 - DNA, 22 bp, Homo sapiens
tttttaatgcagtctgagacat

SEQ ID NO: 7681995 - DNA, 22 bp, Homo sapiens
tttttaatgcagtctgagacat

SEQ ID NO: 7681996 - DNA, 22 bp, Homo sapiens
tttttaatgcagtctgagacat

SEQ ID NO: 7681997 - DNA, 22 bp, Homo sapiens
tttttaatgcagtctgagacat

SEQ ID NO: 7681998 - DNA, 22 bp, Homo sapiens
tttttaagctcctttgatgtca

SEQ ID NO: 7681999 - DNA, 22 bp, Homo sapiens
tttttaagctcctttgatgtca

SEQ ID NO: 7682000 - DNA, 22 bp, Homo sapiens
tttttaagctcctttgatgtca

SEQ ID NO: 7682001 - DNA, 22 bp, Homo sapiens
tttttaagctcctttgatgtca

SEQ ID NO: 7682002 - DNA, 22 bp, Homo sapiens
tttttaagctcctttgatgtca

SEQ ID NO: 7682003 - DNA, 22 bp, Homo sapiens
tttttaagctcctttgatgtca

SEQ ID NO: 7682004 - DNA, 22 bp, Homo sapiens
tttttaagctcctttgatgtca

SEQ ID NO: 7682005 - DNA, 22 bp, Homo sapiens
tttttaagctcctttgatgtca

SEQ ID NO: 7682006 - DNA, 22 bp, Homo sapiens
tttttaagagtctggaaatagt

SEQ ID NO: 7682007 - DNA, 22 bp, Homo sapiens
tttttaagagtctggaaatagt

SEQ ID NO: 7682008 - DNA, 22 bp, Homo sapiens
tttttaagagtctggaaatagt

SEQ ID NO: 7682009 - DNA, 22 bp, Homo sapiens
tttttaagagtctggaaatagt

SEQ ID NO: 7682010 - DNA, 22 bp, Homo sapiens
tttttaagagtctggaaatagt

SEQ ID NO: 7682011 - DNA, 22 bp, Homo sapiens
tttttaagagattctccagtct

SEQ ID NO: 7682012 - DNA, 22 bp, Homo sapiens
tttttaagagtctggaaatagt

SEQ ID NO: 7682013 - DNA, 22 bp, Homo sapiens
tttttaagagtctggaaatagt

SEQ ID NO: 7682014 - DNA, 17 bp, Homo sapiens
ctcttttgtcttcttcc

SEQ ID NO: 7682015 - DNA, 17 bp, Homo sapiens
ctcttttgtcttcttcc

SEQ ID NO: 7682016 - DNA, 17 bp, Homo sapiens
ctcttttgtcttcttcc

SEQ ID NO: 7682017 - DNA, 20 bp, Homo sapiens
ctcttttcactctcagtggt

SEQ ID NO: 7682018 - DNA, 20 bp, Homo sapiens
ctcttttcactctcagtggt

SEQ ID NO: 7682019 - DNA, 20 bp, Homo sapiens
ctcttttgactctttgcaag

SEQ ID NO: 7682020 - DNA, 22 bp, Homo sapiens
ctcttttcaaacctgtttatgg

SEQ ID NO: 7682021 - DNA, 22 bp, Homo sapiens
ctcttttcaaaatttcactgca

SEQ ID NO: 7682022 - DNA, 22 bp, Homo sapiens
ctcttttcaaaatttcactgca

SEQ ID NO: 7682023 - DNA, 20 bp, Homo sapiens
ctcttttcactctcagtggt

SEQ ID NO: 7682024 - DNA, 22 bp, Homo sapiens
ctcttttcaaacctgtttatgg

SEQ ID NO: 7682025 - DNA, 22 bp, Homo sapiens
ctcttttcaaacctgtttatgg

SEQ ID NO: 7682026 - DNA, 22 bp, Homo sapiens
ctcttttacaccaaaaggccta

SEQ ID NO: 7682027 - DNA, 22 bp, Homo sapiens
ctcttttagagatgaaaattgg

SEQ ID NO: 7682028 - DNA, 22 bp, Homo sapiens
ctcttttaattgtcataacaac

SEQ ID NO: 7682029 - DNA, 22 bp, Homo sapiens
ctcttttaattgtcataacaac

SEQ ID NO: 7682030 - DNA, 22 bp, Homo sapiens
ctcttttatgtgacgtgtgtga

SEQ ID NO: 7682031 - DNA, 22 bp, Homo sapiens
ctcttttagagatgaaaattgg

SEQ ID NO: 7682032 - DNA, 22 bp, Homo sapiens
ctcttttagagatgaaaattgg

SEQ ID NO: 7682033 - DNA, 22 bp, Homo sapiens
ctcttttagagatgaaaattgg

SEQ ID NO: 7682034 - DNA, 22 bp, Homo sapiens
ctcttttagagatgaaaattgg

SEQ ID NO: 7682035 - DNA, 22 bp, Homo sapiens
ctctttttcagccttaccaaag

SEQ ID NO: 7682036 - DNA, 22 bp, Homo sapiens
ctctttttcagccttaccaaag

SEQ ID NO: 7682037 - DNA, 22 bp, Homo sapiens
ctctttttcagccttaccaaag

SEQ ID NO: 7682038 - DNA, 19 bp, Homo sapiens
ctgaaaaacattctcagga

SEQ ID NO: 7682039 - DNA, 19 bp, Homo sapiens
ctgaaaaacattctcagga

SEQ ID NO: 7682040 - DNA, 19 bp, Homo sapiens
ctgaaaaacattctcagga

SEQ ID NO: 7682041 - DNA, 22 bp, Homo sapiens
ctctttttcagccttaccaaag

SEQ ID NO: 7682042 - DNA, 22 bp, Homo sapiens
ctctttttcagccttaccaaag

SEQ ID NO: 7682043 - DNA, 22 bp, Homo sapiens
ctctttttcacctctgtcagcg

SEQ ID NO: 7682044 - DNA, 22 bp, Homo sapiens
ctctttttcagccttaccaaag

SEQ ID NO: 7682045 - DNA, 22 bp, Homo sapiens
ctctttttcagccttaccaaag

SEQ ID NO: 7682046 - DNA, 22 bp, Homo sapiens
ctctttttcagccttaccaaag

SEQ ID NO: 7682047 - DNA, 22 bp, Homo sapiens
ctctttttcagccttaccaaag

SEQ ID NO: 7682048 - DNA, 22 bp, Homo sapiens
ctctttttcacctctgtcagcg

SEQ ID NO: 7682049 - DNA, 17 bp, Homo sapiens
ctcttttgtcttcttcc

SEQ ID NO: 7682050 - DNA, 20 bp, Homo sapiens
ctcttttgactctttgcaag

SEQ ID NO: 7682051 - DNA, 22 bp, Homo sapiens
ctctttttcacctctgtcagcg

SEQ ID NO: 7682052 - DNA, 22 bp, Homo sapiens
ctctttttcacctctgtcagcg

SEQ ID NO: 7682053 - DNA, 22 bp, Homo sapiens
ctctttttcacctctgtcagcg

SEQ ID NO: 7682054 - DNA, 22 bp, Homo sapiens
ctctttttcacctctgtcagcg

SEQ ID NO: 7682055 - DNA, 22 bp, Homo sapiens
tttttaatgcagtctgagacat

SEQ ID NO: 7682056 - DNA, 19 bp, Homo sapiens
tttttaatgggctggagca

SEQ ID NO: 7682057 - DNA, 19 bp, Homo sapiens
tttttaatgggctggagca

SEQ ID NO: 7682058 - DNA, 19 bp, Homo sapiens
tttttaatgggctggagca

SEQ ID NO: 7682059 - DNA, 22 bp, Homo sapiens
tttttaatgcagtctgagacat

SEQ ID NO: 7682060 - DNA, 22 bp, Homo sapiens
ctgaaagcattaactccacttc

SEQ ID NO: 7682061 - DNA, 19 bp, Homo sapiens
tttttaatgggctggagca

SEQ ID NO: 7682062 - DNA, 19 bp, Homo sapiens
tttttaatgggctggagca

SEQ ID NO: 7682063 - DNA, 19 bp, Homo sapiens
tttttaatgggctggagca

SEQ ID NO: 7682064 - DNA, 22 bp, Homo sapiens
ctgaaattctgcctctgcacaa

SEQ ID NO: 7682065 - DNA, 20 bp, Homo sapiens
ctgaaaggagtcgggatgtc

SEQ ID NO: 7682066 - DNA, 22 bp, Homo sapiens
ctgaaaggcagtgggtagtgtg

SEQ ID NO: 7682067 - DNA, 22 bp, Homo sapiens
ctgaaagcattaactccacttc

SEQ ID NO: 7682068 - DNA, 22 bp, Homo sapiens
ctgaaagcaaatacatgaatct

SEQ ID NO: 7682069 - DNA, 22 bp, Homo sapiens
ctgaaagcattaactccacttc

SEQ ID NO: 7682070 - DNA, 22 bp, Homo sapiens
ctgaaaggaataaggctctttg

SEQ ID NO: 7682071 - DNA, 22 bp, Homo sapiens
ctgaaaggagagctgcaaggat

SEQ ID NO: 7682072 - DNA, 22 bp, Homo sapiens
ctgaaaggagagctgcaaggat

SEQ ID NO: 7682073 - DNA, 22 bp, Homo sapiens
ctgaacagtacttggccagttt

SEQ ID NO: 7682074 - DNA, 22 bp, Homo sapiens
ctgaacatcccgcagtgcacga

SEQ ID NO: 7682075 - DNA, 22 bp, Homo sapiens
ctgaacaaagaaatagtcatgg

SEQ ID NO: 7682076 - DNA, 22 bp, Homo sapiens
ctgaacaaagaaatagtcatgg

SEQ ID NO: 7682077 - DNA, 22 bp, Homo sapiens
ctgaaattctttggagttttct

SEQ ID NO: 7682078 - DNA, 22 bp, Homo sapiens
ctgaaattgatgacagggatgg

SEQ ID NO: 7682079 - DNA, 20 bp, Homo sapiens
ctgaacacagaataagcaca

SEQ ID NO: 7682080 - DNA, 22 bp, Homo sapiens
ctgaacaaagttcttttgagct

SEQ ID NO: 7682081 - DNA, 20 bp, Homo sapiens
ctgaacacagaataagcaca

SEQ ID NO: 7682082 - DNA, 22 bp, Homo sapiens
ctgaacaacttgtcattccaag

SEQ ID NO: 7682083 - DNA, 22 bp, Homo sapiens
ctgaactatcctgcaactgcag

SEQ ID NO: 7682084 - DNA, 22 bp, Homo sapiens
ctgaaccatctctgttctgtat

SEQ ID NO: 7682085 - DNA, 22 bp, Homo sapiens
ctgaacattcttgaacatctgt

SEQ ID NO: 7682086 - DNA, 22 bp, Homo sapiens
ctgaaccactaatattttgatt

SEQ ID NO: 7682087 - DNA, 22 bp, Homo sapiens
ctgaacattcttgaacatctgt

SEQ ID NO: 7682088 - DNA, 20 bp, Homo sapiens
ctgaaccaaggctttctcag

SEQ ID NO: 7682089 - DNA, 22 bp, Homo sapiens
ctgaagagaaatgtacacatgg

SEQ ID NO: 7682090 - DNA, 20 bp, Homo sapiens
ctgaagagactggaggggca

SEQ ID NO: 7682091 - DNA, 20 bp, Homo sapiens
ctgaagagactggaggggca

SEQ ID NO: 7682092 - DNA, 22 bp, Homo sapiens
ctgaagagaaatgtacacatgg

SEQ ID NO: 7682093 - DNA, 22 bp, Homo sapiens
ctgaagagaaagggagctcttc

SEQ ID NO: 7682094 - DNA, 22 bp, Homo sapiens
ctgaagagaaagggagctcttc

SEQ ID NO: 7682095 - DNA, 22 bp, Homo sapiens
ctgaagagaaagggagctcttc

SEQ ID NO: 7682096 - DNA, 22 bp, Homo sapiens
ctgaagagaaagggagctcttc

SEQ ID NO: 7682097 - DNA, 22 bp, Homo sapiens
ctgaagagactggagggggcat

SEQ ID NO: 7682098 - DNA, 22 bp, Homo sapiens
ctgaagagatgtcaatattggc

SEQ ID NO: 7682099 - DNA, 22 bp, Homo sapiens
ctgaagagactggagggggcat

SEQ ID NO: 7682100 - DNA, 20 bp, Homo sapiens
ctgaagagactggaggggca

SEQ ID NO: 7682101 - DNA, 20 bp, Homo sapiens
ctgaagagactggaggggca

SEQ ID NO: 7682102 - DNA, 22 bp, Homo sapiens
ctgaagagcaaaccaactggac

SEQ ID NO: 7682103 - DNA, 22 bp, Homo sapiens
ctgaagagcaaaccaactggac

SEQ ID NO: 7682104 - DNA, 22 bp, Homo sapiens
ctgaagagcaaaccaactggac

SEQ ID NO: 7682105 - DNA, 22 bp, Homo sapiens
ctgaagagatgtcaatattggc

SEQ ID NO: 7682106 - DNA, 22 bp, Homo sapiens
ctgaagagaaagggagctcttc

SEQ ID NO: 7682107 - DNA, 22 bp, Homo sapiens
ctgaagagcaaaccaactggac

SEQ ID NO: 7682108 - DNA, 22 bp, Homo sapiens
ctgaacttctctgagcctcagt

SEQ ID NO: 7682109 - DNA, 22 bp, Homo sapiens
ctgaacttattgagtgcttgct

SEQ ID NO: 7682110 - DNA, 22 bp, Homo sapiens
ctgaagaaatatgattgcttaa

SEQ ID NO: 7682111 - DNA, 22 bp, Homo sapiens
ctgaagaaatatgattgcttaa

SEQ ID NO: 7682112 - DNA, 22 bp, Homo sapiens
ctgaagaaatatgattgcttaa

SEQ ID NO: 7682113 - DNA, 22 bp, Homo sapiens
ctgaacttattgagtgcttgct

SEQ ID NO: 7682114 - DNA, 22 bp, Homo sapiens
ctgaactgacagactgcctgct

SEQ ID NO: 7682115 - DNA, 22 bp, Homo sapiens
ctgaacttattgagtgcttgct

SEQ ID NO: 7682116 - DNA, 22 bp, Homo sapiens
ctgaacttattgagtgcttgct

SEQ ID NO: 7682117 - DNA, 22 bp, Homo sapiens
ctgaacttattgagtgcttgct

SEQ ID NO: 7682118 - DNA, 22 bp, Homo sapiens
ctgaacttattgagtgcttgct

SEQ ID NO: 7682119 - DNA, 22 bp, Homo sapiens
ctgaagaatgacagtgctttga

SEQ ID NO: 7682120 - DNA, 22 bp, Homo sapiens
ctgaagaatgacagtgctttga

SEQ ID NO: 7682121 - DNA, 22 bp, Homo sapiens
ctgaagaatgacagtgctttga

SEQ ID NO: 7682122 - DNA, 22 bp, Homo sapiens
ctgaagaagtctctaggctatt

SEQ ID NO: 7682123 - DNA, 22 bp, Homo sapiens
ctgaagaagtctctaggctatt

SEQ ID NO: 7682124 - DNA, 22 bp, Homo sapiens
ctgaagaagctgcagcctggag

SEQ ID NO: 7682125 - DNA, 22 bp, Homo sapiens
ctgaagagaaagggagctcttc

SEQ ID NO: 7682126 - DNA, 22 bp, Homo sapiens
ctgaagaatagcaggtgggcac

SEQ ID NO: 7682127 - DNA, 18 bp, Homo sapiens
ctgaagacaaaatgtcca

SEQ ID NO: 7682128 - DNA, 22 bp, Homo sapiens
ctgaagaatgacagtgctttga

SEQ ID NO: 7682129 - DNA, 22 bp, Homo sapiens
ctgaagactgctgagaagttac

SEQ ID NO: 7682130 - DNA, 22 bp, Homo sapiens
ctgaagatgtctgagatgctca

SEQ ID NO: 7682131 - DNA, 22 bp, Homo sapiens
ctgaagatgtctgagatgctca

SEQ ID NO: 7682132 - DNA, 22 bp, Homo sapiens
ctgaagatgtctgagatgctca

SEQ ID NO: 7682133 - DNA, 22 bp, Homo sapiens
ctgaagatgatgatactaagga

SEQ ID NO: 7682134 - DNA, 22 bp, Homo sapiens
ctgaagatgatgatactaagga

SEQ ID NO: 7682135 - DNA, 22 bp, Homo sapiens
ctgaagatgctggagcatgggt

SEQ ID NO: 7682136 - DNA, 22 bp, Homo sapiens
ctgaagatgctggagcatgggt

SEQ ID NO: 7682137 - DNA, 22 bp, Homo sapiens
ctgactgtctcttctcccatga

SEQ ID NO: 7682138 - DNA, 22 bp, Homo sapiens
ctgaagatgtctgagatgctca

SEQ ID NO: 7682139 - DNA, 22 bp, Homo sapiens
ctgactgtctcttctcccatga

SEQ ID NO: 7682140 - DNA, 22 bp, Homo sapiens
ctgactgtgagagcaggaatgg

SEQ ID NO: 7682141 - DNA, 17 bp, Homo sapiens
ctgaagataatggcaac

SEQ ID NO: 7682142 - DNA, 17 bp, Homo sapiens
ctgaagataatggcaac

SEQ ID NO: 7682143 - DNA, 17 bp, Homo sapiens
ctgaagagtcctggcta

SEQ ID NO: 7682144 - DNA, 20 bp, Homo sapiens
ctgaagagtggcctgatctg

SEQ ID NO: 7682145 - DNA, 17 bp, Homo sapiens
ctgaagataatggcaac

SEQ ID NO: 7682146 - DNA, 17 bp, Homo sapiens
ctgaagataatggcaac

SEQ ID NO: 7682147 - DNA, 22 bp, Homo sapiens
ctgaagatagtgtctgatcatg

SEQ ID NO: 7682148 - DNA, 22 bp, Homo sapiens
ctgaagatagtgtctgatcatg

SEQ ID NO: 7682149 - DNA, 22 bp, Homo sapiens
ctgaagatagtgtctgatcatg

SEQ ID NO: 7682150 - DNA, 22 bp, Homo sapiens
ctgaagaggactgggttggagg

SEQ ID NO: 7682151 - DNA, 22 bp, Homo sapiens
ctgaagaggagaccgcgcccac

SEQ ID NO: 7682152 - DNA, 22 bp, Homo sapiens
ctgaagaggactgggttggagg

SEQ ID NO: 7682153 - DNA, 22 bp, Homo sapiens
ctgaagaggttgttgaggaata

SEQ ID NO: 7682154 - DNA, 22 bp, Homo sapiens
ctgaagaggttgttgaggaata

SEQ ID NO: 7682155 - DNA, 22 bp, Homo sapiens
ctgaagaggttgttgaggaata

SEQ ID NO: 7682156 - DNA, 22 bp, Homo sapiens
ctgaagaggctccgcccacaag

SEQ ID NO: 7682157 - DNA, 22 bp, Homo sapiens
ctgaagagcactgtggccagtt

SEQ ID NO: 7682158 - DNA, 22 bp, Homo sapiens
ctgaagagcactgtggccagtt

SEQ ID NO: 7682159 - DNA, 22 bp, Homo sapiens
ctgaagagcactgtggccagtt

SEQ ID NO: 7682160 - DNA, 23 bp, Homo sapiens
ctgaagagccaacaaaaagcttg

SEQ ID NO: 7682161 - DNA, 23 bp, Homo sapiens
ctgaagagccaacaaaaagcttg

SEQ ID NO: 7682162 - DNA, 23 bp, Homo sapiens
ctgaagagccaacaaaaagcttg

SEQ ID NO: 7682163 - DNA, 22 bp, Homo sapiens
ctgaagagctctcctgtcccct

SEQ ID NO: 7682164 - DNA, 22 bp, Homo sapiens
ctgaagaggacgcagcagcaag

SEQ ID NO: 7682165 - DNA, 22 bp, Homo sapiens
ctgaagaggacgcagcagcaag

SEQ ID NO: 7682166 - DNA, 22 bp, Homo sapiens
ctgaagaggacgcagcagcaag

SEQ ID NO: 7682167 - DNA, 22 bp, Homo sapiens
ctgaagaggacgcagcagcaag

SEQ ID NO: 7682168 - DNA, 22 bp, Homo sapiens
ctgagaagagggtatgtggcgc

SEQ ID NO: 7682169 - DNA, 22 bp, Homo sapiens
ctgagaaatttattggttggaa

SEQ ID NO: 7682170 - DNA, 22 bp, Homo sapiens
ctgagaagcactgtctgcaaga

SEQ ID NO: 7682171 - DNA, 22 bp, Homo sapiens
ctgagaagcactgtctgcaaga

SEQ ID NO: 7682172 - DNA, 22 bp, Homo sapiens
ctgagaagcactgtctgcaaga

SEQ ID NO: 7682173 - DNA, 22 bp, Homo sapiens
ctgagaagcaaagaactgcact

SEQ ID NO: 7682174 - DNA, 22 bp, Homo sapiens
ctgagaaggaagcctccactct

SEQ ID NO: 7682175 - DNA, 22 bp, Homo sapiens
ctgagaaggaagcctccactct

SEQ ID NO: 7682176 - DNA, 22 bp, Homo sapiens
ctgagaaggtgtggagatgggc

SEQ ID NO: 7682177 - DNA, 22 bp, Homo sapiens
ctgagaatggacagcagggcag

SEQ ID NO: 7682178 - DNA, 19 bp, Homo sapiens
ctgagaatcctacttattt

SEQ ID NO: 7682179 - DNA, 19 bp, Homo sapiens
ctgagaatcctacttattt

SEQ ID NO: 7682180 - DNA, 22 bp, Homo sapiens
ctgagaataaagccagcaggag

SEQ ID NO: 7682181 - DNA, 22 bp, Homo sapiens
ctgagaataaagccagcaggag

SEQ ID NO: 7682182 - DNA, 22 bp, Homo sapiens
ctgagaaattctttctttcact

SEQ ID NO: 7682183 - DNA, 22 bp, Homo sapiens
ctgagaaatgcatttttccagc

SEQ ID NO: 7682184 - DNA, 22 bp, Homo sapiens
ctgagaaattctttctttcact

SEQ ID NO: 7682185 - DNA, 22 bp, Homo sapiens
ctgagaaattctttctttcact

SEQ ID NO: 7682186 - DNA, 22 bp, Homo sapiens
ctgagaaattctttctttcact

SEQ ID NO: 7682187 - DNA, 22 bp, Homo sapiens
ctgagaaatgcatttttccagc

SEQ ID NO: 7682188 - DNA, 22 bp, Homo sapiens
ctgagaaatacccaagtctggt

SEQ ID NO: 7682189 - DNA, 22 bp, Homo sapiens
ctgagaaatacccaagtctggt

SEQ ID NO: 7682190 - DNA, 22 bp, Homo sapiens
ctgagaaatacccaagtctggt

SEQ ID NO: 7682191 - DNA, 22 bp, Homo sapiens
ctgagaaatacccaagtctggt

SEQ ID NO: 7682192 - DNA, 22 bp, Homo sapiens
ctgagaaatacccaagtctggt

SEQ ID NO: 7682193 - DNA, 22 bp, Homo sapiens
ctgagaaatacccaagtctggt

SEQ ID NO: 7682194 - DNA, 22 bp, Homo sapiens
ctgagaaatacccaagtctggt

SEQ ID NO: 7682195 - DNA, 22 bp, Homo sapiens
ctgagaaagtttatgtttattt

SEQ ID NO: 7682196 - DNA, 22 bp, Homo sapiens
ctgagaaagtttatgtttattt

SEQ ID NO: 7682197 - DNA, 22 bp, Homo sapiens
ctgacttcagggataaaaagta

SEQ ID NO: 7682198 - DNA, 22 bp, Homo sapiens
ctgacttcagggataaaaagta

SEQ ID NO: 7682199 - DNA, 22 bp, Homo sapiens
ctgactgtttgctgaaaggtct

SEQ ID NO: 7682200 - DNA, 22 bp, Homo sapiens
ctgactgttgctgttgatgagg

SEQ ID NO: 7682201 - DNA, 22 bp, Homo sapiens
ctgactgttgctgttgatgagg

SEQ ID NO: 7682202 - DNA, 22 bp, Homo sapiens
ctgactgtttgctgaaaggtct

SEQ ID NO: 7682203 - DNA, 22 bp, Homo sapiens
ctgatggagactccactgtgat

SEQ ID NO: 7682204 - DNA, 22 bp, Homo sapiens
ctgatggagactccactgtgat

SEQ ID NO: 7682205 - DNA, 22 bp, Homo sapiens
ctgatgctctggatgtagtcaa

SEQ ID NO: 7682206 - DNA, 22 bp, Homo sapiens
ctgatgctctggatgtagtcaa

SEQ ID NO: 7682207 - DNA, 22 bp, Homo sapiens
ctgatgcttgcaacaaagaacc

SEQ ID NO: 7682208 - DNA, 22 bp, Homo sapiens
ctgatggagagtgtgatttggg

SEQ ID NO: 7682209 - DNA, 22 bp, Homo sapiens
ctgatggagtgatggagaaatt

SEQ ID NO: 7682210 - DNA, 22 bp, Homo sapiens
ctgatggagagtgtgatttggg

SEQ ID NO: 7682211 - DNA, 22 bp, Homo sapiens
ctgatgcccctggacctgtgac

SEQ ID NO: 7682212 - DNA, 22 bp, Homo sapiens
ctgatgcctctcttcttggctt

SEQ ID NO: 7682213 - DNA, 22 bp, Homo sapiens
ctgatgcctctcttcttggctt

SEQ ID NO: 7682214 - DNA, 22 bp, Homo sapiens
ctgatgctataagccacagtgg

SEQ ID NO: 7682215 - DNA, 22 bp, Homo sapiens
ctgatgcaaccagcatatggaa

SEQ ID NO: 7682216 - DNA, 22 bp, Homo sapiens
ctgatgcaggtggtttaaaaac

SEQ ID NO: 7682217 - DNA, 22 bp, Homo sapiens
ctgatgcatggttacatataca

SEQ ID NO: 7682218 - DNA, 22 bp, Homo sapiens
ctgatgcatggttacatataca

SEQ ID NO: 7682219 - DNA, 19 bp, Homo sapiens
ctgatgttccagagaagct

SEQ ID NO: 7682220 - DNA, 22 bp, Homo sapiens
ctgatgttcatttcttttgtac

SEQ ID NO: 7682221 - DNA, 22 bp, Homo sapiens
ctgatggatggacaggggtagt

SEQ ID NO: 7682222 - DNA, 22 bp, Homo sapiens
ctgatgggagcaacagcaacag

SEQ ID NO: 7682223 - DNA, 22 bp, Homo sapiens
ctgatgtatgggtgacaggcaa

SEQ ID NO: 7682224 - DNA, 22 bp, Homo sapiens
ctgatgtcccaagcattcgcag

SEQ ID NO: 7682225 - DNA, 22 bp, Homo sapiens
ctgatggatgctacgtaagagg

SEQ ID NO: 7682226 - DNA, 22 bp, Homo sapiens
ctgatggatggacaggggtagt

SEQ ID NO: 7682227 - DNA, 17 bp, Homo sapiens
ctgatggattttttcca

SEQ ID NO: 7682228 - DNA, 22 bp, Homo sapiens
ctgattaattagctataaaact

SEQ ID NO: 7682229 - DNA, 22 bp, Homo sapiens
ctgattaattagctataaaact

SEQ ID NO: 7682230 - DNA, 22 bp, Homo sapiens
ctgattagagtgttaatgagga

SEQ ID NO: 7682231 - DNA, 22 bp, Homo sapiens
ctgattattactttccaggcgg

SEQ ID NO: 7682232 - DNA, 22 bp, Homo sapiens
ctgattaggctaagcaagaggg

SEQ ID NO: 7682233 - DNA, 22 bp, Homo sapiens
ctgatgtttctagatgcttgcc

SEQ ID NO: 7682234 - DNA, 20 bp, Homo sapiens
ctgatgttcgtgcttcctgg

SEQ ID NO: 7682235 - DNA, 19 bp, Homo sapiens
ctgatgttccagagaagct

SEQ ID NO: 7682236 - DNA, 22 bp, Homo sapiens
ctgatgtttctagatgcttgcc

SEQ ID NO: 7682237 - DNA, 18 bp, Homo sapiens
ctgatgtttgctattgct

SEQ ID NO: 7682238 - DNA, 22 bp, Homo sapiens
ctgattaaaaacaggttctgag

SEQ ID NO: 7682239 - DNA, 22 bp, Homo sapiens
ctgattaactgaactgaattta

SEQ ID NO: 7682240 - DNA, 22 bp, Homo sapiens
ctgattaactgaactgaattta

SEQ ID NO: 7682241 - DNA, 22 bp, Homo sapiens
ctgatgagtcggctgccaccag

SEQ ID NO: 7682242 - DNA, 22 bp, Homo sapiens
ctgatgagcccaggtgaccatg

SEQ ID NO: 7682243 - DNA, 22 bp, Homo sapiens
ctgatgaccttggcaagtcaca

SEQ ID NO: 7682244 - DNA, 22 bp, Homo sapiens
ctgatgaccttggcaagtcaca

SEQ ID NO: 7682245 - DNA, 22 bp, Homo sapiens
ctgatgaccttggcaagtcaca

SEQ ID NO: 7682246 - DNA, 22 bp, Homo sapiens
ctgatcttaagtaacattattt

SEQ ID NO: 7682247 - DNA, 22 bp, Homo sapiens
ctgatctatttacaggaaccaa

SEQ ID NO: 7682248 - DNA, 22 bp, Homo sapiens
ctgatctcaagtgatccaccca

SEQ ID NO: 7682249 - DNA, 22 bp, Homo sapiens
ctgatctgtcctcctcagagcc

SEQ ID NO: 7682250 - DNA, 21 bp, Homo sapiens
ctgatctaattgaagagcgtg

SEQ ID NO: 7682251 - DNA, 22 bp, Homo sapiens
ctgatctaggttaggcctatat

SEQ ID NO: 7682252 - DNA, 22 bp, Homo sapiens
ctgatctatttacaggaaccaa

SEQ ID NO: 7682253 - DNA, 22 bp, Homo sapiens
ctgatcctcctttaagtagctg

SEQ ID NO: 7682254 - DNA, 22 bp, Homo sapiens
ctgatcctcctttaagtagctg

SEQ ID NO: 7682255 - DNA, 22 bp, Homo sapiens
ctgatcctcctttaagtagctg

SEQ ID NO: 7682256 - DNA, 22 bp, Homo sapiens
ctgatcctcctttaagtagctg

SEQ ID NO: 7682257 - DNA, 22 bp, Homo sapiens
ctgatcctcctttaagtagctg

SEQ ID NO: 7682258 - DNA, 22 bp, Homo sapiens
ctgatccctccatagggcacag

SEQ ID NO: 7682259 - DNA, 22 bp, Homo sapiens
ctgatccctccatagggcacag

SEQ ID NO: 7682260 - DNA, 22 bp, Homo sapiens
ctgagtccttgggcttagagtg

SEQ ID NO: 7682261 - DNA, 22 bp, Homo sapiens
ctgagtccagggacagaggcgt

SEQ ID NO: 7682262 - DNA, 22 bp, Homo sapiens
ctgagtccttgggcttagagtg

SEQ ID NO: 7682263 - DNA, 22 bp, Homo sapiens
ctgaggcagagaatgagtttgt

SEQ ID NO: 7682264 - DNA, 22 bp, Homo sapiens
ctgaggcagagaatgagtttgt

SEQ ID NO: 7682265 - DNA, 22 bp, Homo sapiens
ctgaggcagagagaacccgggc

SEQ ID NO: 7682266 - DNA, 22 bp, Homo sapiens
ctgaggcagagagaacccgggc

SEQ ID NO: 7682267 - DNA, 22 bp, Homo sapiens
ctgaggcagagaatgagtttgt

SEQ ID NO: 7682268 - DNA, 22 bp, Homo sapiens
ctgaggcagaaaaagcaagggt

SEQ ID NO: 7682269 - DNA, 22 bp, Homo sapiens
ctgaggcagagaatgagtttgt

SEQ ID NO: 7682270 - DNA, 22 bp, Homo sapiens
ctgaggcagaaaaagcaagggt

SEQ ID NO: 7682271 - DNA, 22 bp, Homo sapiens
ctgagtccagggacagaggcgt

SEQ ID NO: 7682272 - DNA, 22 bp, Homo sapiens
ctgagtccagggacagaggcgt

SEQ ID NO: 7682273 - DNA, 22 bp, Homo sapiens
ctgagtcattgcagatgtggag

SEQ ID NO: 7682274 - DNA, 22 bp, Homo sapiens
ctgagtccagggacagaggcgt

SEQ ID NO: 7682275 - DNA, 22 bp, Homo sapiens
ctgagtccagggacagaggcgt

SEQ ID NO: 7682276 - DNA, 22 bp, Homo sapiens
ctgagtcattgcagatgtggag

SEQ ID NO: 7682277 - DNA, 19 bp, Homo sapiens
ctgagtcaaaggttgtggg

SEQ ID NO: 7682278 - DNA, 22 bp, Homo sapiens
ctgagtcattgcagatgtggag

SEQ ID NO: 7682279 - DNA, 19 bp, Homo sapiens
ctgagtcaaaggttgtggg

SEQ ID NO: 7682280 - DNA, 22 bp, Homo sapiens
ctgagtaagatacagaagctcc

SEQ ID NO: 7682281 - DNA, 22 bp, Homo sapiens
ctgcaaaagtaattgcaggttt

SEQ ID NO: 7682282 - DNA, 22 bp, Homo sapiens
ctgcaaaagtaattggggcttt

SEQ ID NO: 7682283 - DNA, 22 bp, Homo sapiens
ctgcaaaagtcattgtggtttt

SEQ ID NO: 7682284 - DNA, 22 bp, Homo sapiens
ctgcacttgacatgctctcaga

SEQ ID NO: 7682285 - DNA, 22 bp, Homo sapiens
ctgcaaaagtcattgtggtttt

SEQ ID NO: 7682286 - DNA, 22 bp, Homo sapiens
ctgcacttgacatgctctcaga

SEQ ID NO: 7682287 - DNA, 22 bp, Homo sapiens
ctgcagaaagctgagatgatta

SEQ ID NO: 7682288 - DNA, 22 bp, Homo sapiens
ctgcacttgacatgctctcaga

SEQ ID NO: 7682289 - DNA, 22 bp, Homo sapiens
ctgcagaaagctgagatgatta

SEQ ID NO: 7682290 - DNA, 22 bp, Homo sapiens
ctgcagaatggggccaagtgga

SEQ ID NO: 7682291 - DNA, 22 bp, Homo sapiens
ctgcagaatggggccaagtgga

SEQ ID NO: 7682292 - DNA, 22 bp, Homo sapiens
ctgcagacctctgaggtccatg

SEQ ID NO: 7682293 - DNA, 22 bp, Homo sapiens
ctgcagacctctgaggtccatg

SEQ ID NO: 7682294 - DNA, 22 bp, Homo sapiens
ctgcagacctctgaggtccatg

SEQ ID NO: 7682295 - DNA, 22 bp, Homo sapiens
ctgcagacctctgaggtccatg

SEQ ID NO: 7682296 - DNA, 22 bp, Homo sapiens
ctgcagagcatgaggaggtctg

SEQ ID NO: 7682297 - DNA, 22 bp, Homo sapiens
ctgcagagcatgaggaggtctg

SEQ ID NO: 7682298 - DNA, 22 bp, Homo sapiens
ctgcagagctaggctgagtgaa

SEQ ID NO: 7682299 - DNA, 22 bp, Homo sapiens
ctgcagagctaggctgagtgaa

SEQ ID NO: 7682300 - DNA, 21 bp, Homo sapiens
ctgcagagcatgcaaaatgtt

SEQ ID NO: 7682301 - DNA, 22 bp, Homo sapiens
ctgcagagctaggctgagtgaa

SEQ ID NO: 7682302 - DNA, 22 bp, Homo sapiens
ctgcagagcataaatctgaata

SEQ ID NO: 7682303 - DNA, 22 bp, Homo sapiens
ctgcagagcataaatctgaata

SEQ ID NO: 7682304 - DNA, 23 bp, Homo sapiens
ctgcagagaactgagggacagcc

SEQ ID NO: 7682305 - DNA, 23 bp, Homo sapiens
ctgcagagaactgagggacagcc

SEQ ID NO: 7682306 - DNA, 22 bp, Homo sapiens
ctgcagactagatagaaactga

SEQ ID NO: 7682307 - DNA, 22 bp, Homo sapiens
ctgcagagcatgaggaggtctg

SEQ ID NO: 7682308 - DNA, 22 bp, Homo sapiens
ctgcagagcatgaggaggtctg

SEQ ID NO: 7682309 - DNA, 22 bp, Homo sapiens
ctgcagagcatgaggaggtctg

SEQ ID NO: 7682310 - DNA, 22 bp, Homo sapiens
ctgcagagcatgaggaggtctg

SEQ ID NO: 7682311 - DNA, 22 bp, Homo sapiens
ctgcagagcataaatctgaata

SEQ ID NO: 7682312 - DNA, 22 bp, Homo sapiens
ctgattgagaaggaaggggatc

SEQ ID NO: 7682313 - DNA, 22 bp, Homo sapiens
ctgattgatgagggagcataaa

SEQ ID NO: 7682314 - DNA, 21 bp, Homo sapiens
ctgattgtgaaagtcatcatt

SEQ ID NO: 7682315 - DNA, 22 bp, Homo sapiens
ctgattgtcagctgagctgaag

SEQ ID NO: 7682316 - DNA, 22 bp, Homo sapiens
ctgattgtcttggcacttgaag

SEQ ID NO: 7682317 - DNA, 22 bp, Homo sapiens
ctgattgctaacctgttagaat

SEQ ID NO: 7682318 - DNA, 21 bp, Homo sapiens
ctgattgattgtcctgactct

SEQ ID NO: 7682319 - DNA, 22 bp, Homo sapiens
ctgattgtagctcacactattt

SEQ ID NO: 7682320 - DNA, 22 bp, Homo sapiens
ctgattctgtaatttttcctaa

SEQ ID NO: 7682321 - DNA, 22 bp, Homo sapiens
ctgattctctgactcttggctt

SEQ ID NO: 7682322 - DNA, 22 bp, Homo sapiens
ctgattctgtctctcgggcctt

SEQ ID NO: 7682323 - DNA, 22 bp, Homo sapiens
ctgattctgtctctcgggcctt

SEQ ID NO: 7682324 - DNA, 22 bp, Homo sapiens
ctgattctgttgaacaccttcc

SEQ ID NO: 7682325 - DNA, 22 bp, Homo sapiens
ctgattctttcttcttgccagg

SEQ ID NO: 7682326 - DNA, 22 bp, Homo sapiens
ctgattctttgaagatgcaccc

SEQ ID NO: 7682327 - DNA, 22 bp, Homo sapiens
ctgattctttgaagatgcaccc

SEQ ID NO: 7682328 - DNA, 22 bp, Homo sapiens
ctgattctctgactcttggctt

SEQ ID NO: 7682329 - DNA, 22 bp, Homo sapiens
ctgattctccttgtctggtata

SEQ ID NO: 7682330 - DNA, 22 bp, Homo sapiens
ctgattctaggcgttcctctca

SEQ ID NO: 7682331 - DNA, 22 bp, Homo sapiens
ctgattctcctcaagactttcg

SEQ ID NO: 7682332 - DNA, 22 bp, Homo sapiens
ctgattctcctcaagactttcg

SEQ ID NO: 7682333 - DNA, 22 bp, Homo sapiens
ctgattagagtgttaatgagga

SEQ ID NO: 7682334 - DNA, 22 bp, Homo sapiens
ctgattccagagtctgtgttct

SEQ ID NO: 7682335 - DNA, 22 bp, Homo sapiens
ctgattccagagtctgtgttct

SEQ ID NO: 7682336 - DNA, 22 bp, Homo sapiens
ctgattattactttccaggcgg

SEQ ID NO: 7682337 - DNA, 22 bp, Homo sapiens
ctgatttcacttagctaggttt

SEQ ID NO: 7682338 - DNA, 17 bp, Homo sapiens
ctgatttattagcagac

SEQ ID NO: 7682339 - DNA, 17 bp, Homo sapiens
ctgatttattagcagac

SEQ ID NO: 7682340 - DNA, 17 bp, Homo sapiens
ctgatttattagcagac

SEQ ID NO: 7682341 - DNA, 17 bp, Homo sapiens
ctgatttattagcagac

SEQ ID NO: 7682342 - DNA, 22 bp, Homo sapiens
ctgatttagatttcacacgtga

SEQ ID NO: 7682343 - DNA, 22 bp, Homo sapiens
ctgatttacatatacaaaagat

SEQ ID NO: 7682344 - DNA, 22 bp, Homo sapiens
ctgatttagatttcacacgtga

SEQ ID NO: 7682345 - DNA, 22 bp, Homo sapiens
ctgattgtgttcctgggagctg

SEQ ID NO: 7682346 - DNA, 22 bp, Homo sapiens
ctgatttacatatacaaaagat

SEQ ID NO: 7682347 - DNA, 22 bp, Homo sapiens
ctgatttctcagttctaggaag

SEQ ID NO: 7682348 - DNA, 22 bp, Homo sapiens
ctgatttctcagttctaggaag

SEQ ID NO: 7682349 - DNA, 22 bp, Homo sapiens
ctgatttctacatggaccacat

SEQ ID NO: 7682350 - DNA, 23 bp, Homo sapiens
ctgatttgagcagaataaaatag

SEQ ID NO: 7682351 - DNA, 22 bp, Homo sapiens
ctgattttcaaaatgtgttaaa

SEQ ID NO: 7682352 - DNA, 23 bp, Homo sapiens
ctgatttgagcagaataaaatag

SEQ ID NO: 7682353 - DNA, 22 bp, Homo sapiens
ctgattttcaaaatgtgttaaa

SEQ ID NO: 7682354 - DNA, 22 bp, Homo sapiens
ctgcaaaagtaattgcaggttt

SEQ ID NO: 7682355 - DNA, 22 bp, Homo sapiens
ctgcaaaagtaattgcaggttt

SEQ ID NO: 7682356 - DNA, 22 bp, Homo sapiens
ctgaggcactggtaatgggcat

SEQ ID NO: 7682357 - DNA, 22 bp, Homo sapiens
ctgaggcactggtaatgggcat

SEQ ID NO: 7682358 - DNA, 22 bp, Homo sapiens
ctgaggcactggtaatgggcat

SEQ ID NO: 7682359 - DNA, 22 bp, Homo sapiens
ctgaggcactgtcagctgaggc

SEQ ID NO: 7682360 - DNA, 22 bp, Homo sapiens
ctgaggcactggtaatgggcat

SEQ ID NO: 7682361 - DNA, 22 bp, Homo sapiens
ctgaggcactgtcagctgaggc

SEQ ID NO: 7682362 - DNA, 22 bp, Homo sapiens
ctgaggcactgtcagctgaggc

SEQ ID NO: 7682363 - DNA, 22 bp, Homo sapiens
ctgaggcactgtcagctgaggc

SEQ ID NO: 7682364 - DNA, 22 bp, Homo sapiens
ctgaggcactgtcagctgaggc

SEQ ID NO: 7682365 - DNA, 22 bp, Homo sapiens
ctgaggcagaaaaagcaagggt

SEQ ID NO: 7682366 - DNA, 22 bp, Homo sapiens
ctgaggcactgtcagctgaggc

SEQ ID NO: 7682367 - DNA, 22 bp, Homo sapiens
ctgaggcagaaaaagcaagggt

SEQ ID NO: 7682368 - DNA, 22 bp, Homo sapiens
ctgaggcagaaaaagcaagggt

SEQ ID NO: 7682369 - DNA, 22 bp, Homo sapiens
ctgaggcactgtcagctgaggc

SEQ ID NO: 7682370 - DNA, 22 bp, Homo sapiens
ctgaggcagaaaaagcaagggt

SEQ ID NO: 7682371 - DNA, 22 bp, Homo sapiens
ctgaggcagaaaaagcaagggt

SEQ ID NO: 7682372 - DNA, 22 bp, Homo sapiens
ctgaggcactgtcagctgaggc

SEQ ID NO: 7682373 - DNA, 22 bp, Homo sapiens
ctgaggcactgtcagctgaggc

SEQ ID NO: 7682374 - DNA, 22 bp, Homo sapiens
ctgaggcactgtcagctgaggc

SEQ ID NO: 7682375 - DNA, 22 bp, Homo sapiens
ctgaggcacccatcttctcctg

SEQ ID NO: 7682376 - DNA, 22 bp, Homo sapiens
ctgaggcacccatcttctcctg

SEQ ID NO: 7682377 - DNA, 22 bp, Homo sapiens
ctgaggcacccatcttctcctg

SEQ ID NO: 7682378 - DNA, 22 bp, Homo sapiens
ctgaggcaccggcaatgttctg

SEQ ID NO: 7682379 - DNA, 22 bp, Homo sapiens
ctgaggcacccatcttctcctg

SEQ ID NO: 7682380 - DNA, 22 bp, Homo sapiens
ctgaggcaccggcaatgttctg

SEQ ID NO: 7682381 - DNA, 22 bp, Homo sapiens
ctgaggcacccatcttctcctg

SEQ ID NO: 7682382 - DNA, 22 bp, Homo sapiens
ctgaggcacctacagtctcggg

SEQ ID NO: 7682383 - DNA, 22 bp, Homo sapiens
ctgaggcacctacagtctcggg

SEQ ID NO: 7682384 - DNA, 22 bp, Homo sapiens
ctgaggcactaacaaggacaag

SEQ ID NO: 7682385 - DNA, 22 bp, Homo sapiens
ctgaggcactaacaaggacaag

SEQ ID NO: 7682386 - DNA, 22 bp, Homo sapiens
ctgaggcactaacaaggacaag

SEQ ID NO: 7682387 - DNA, 22 bp, Homo sapiens
ctgaggcacctacagtctcggg

SEQ ID NO: 7682388 - DNA, 22 bp, Homo sapiens
ctgaggcactaacaaggacaag

SEQ ID NO: 7682389 - DNA, 22 bp, Homo sapiens
ctgaggcactggtaatgggcat

SEQ ID NO: 7682390 - DNA, 22 bp, Homo sapiens
ctgaggcactaacaaggacaag

SEQ ID NO: 7682391 - DNA, 22 bp, Homo sapiens
ctgaggagtgggtgggcagtga

SEQ ID NO: 7682392 - DNA, 22 bp, Homo sapiens
ctgaggagtgggtgggcagtga

SEQ ID NO: 7682393 - DNA, 22 bp, Homo sapiens
ctgaggagtgggtgggcagtga

SEQ ID NO: 7682394 - DNA, 22 bp, Homo sapiens
ctgaggagtgggtgggcagtga

SEQ ID NO: 7682395 - DNA, 22 bp, Homo sapiens
ctgaggagtcagttccactcag

SEQ ID NO: 7682396 - DNA, 22 bp, Homo sapiens
ctgaggagtgggtgggcagtga

SEQ ID NO: 7682397 - DNA, 22 bp, Homo sapiens
ctgaggagtgggtgggcagtga

SEQ ID NO: 7682398 - DNA, 22 bp, Homo sapiens
ctgaggagttggtgaataagcc

SEQ ID NO: 7682399 - DNA, 22 bp, Homo sapiens
ctgaggagttggtgaataagcc

SEQ ID NO: 7682400 - DNA, 22 bp, Homo sapiens
ctgaggagttggtgaataagcc

SEQ ID NO: 7682401 - DNA, 22 bp, Homo sapiens
ctgaggagtgggtgggcagtga

SEQ ID NO: 7682402 - DNA, 22 bp, Homo sapiens
ctgaggagtgggtgggcagtga

SEQ ID NO: 7682403 - DNA, 22 bp, Homo sapiens
ctgaggagtgggtgggcagtga

SEQ ID NO: 7682404 - DNA, 22 bp, Homo sapiens
ctgaggaggggcctgagtgaga

SEQ ID NO: 7682405 - DNA, 22 bp, Homo sapiens
ctgaggaggggcctgagtgaga

SEQ ID NO: 7682406 - DNA, 22 bp, Homo sapiens
ctgaggaggctaatttgaggat

SEQ ID NO: 7682407 - DNA, 22 bp, Homo sapiens
ctgaggaggggcctgagtgaga

SEQ ID NO: 7682408 - DNA, 22 bp, Homo sapiens
ctgaggaggggcctgagtgaga

SEQ ID NO: 7682409 - DNA, 22 bp, Homo sapiens
ctgaggaggggcctgagtgaga

SEQ ID NO: 7682410 - DNA, 22 bp, Homo sapiens
ctgaggaggggcctgagtgaga

SEQ ID NO: 7682411 - DNA, 22 bp, Homo sapiens
ctgaggaggggcctgagtgaga

SEQ ID NO: 7682412 - DNA, 22 bp, Homo sapiens
ctgaggagtcagcttactcact

SEQ ID NO: 7682413 - DNA, 22 bp, Homo sapiens
ctgaggagtcagcttactcact

SEQ ID NO: 7682414 - DNA, 22 bp, Homo sapiens
ctgaggagtcagcttactcact

SEQ ID NO: 7682415 - DNA, 22 bp, Homo sapiens
ctgaggagtcagcttactcact

SEQ ID NO: 7682416 - DNA, 22 bp, Homo sapiens
ctgaggagtcagttccactcag

SEQ ID NO: 7682417 - DNA, 22 bp, Homo sapiens
ctgaggagtcagttccactcag

SEQ ID NO: 7682418 - DNA, 22 bp, Homo sapiens
ctgaggagtcagttccactcag

SEQ ID NO: 7682419 - DNA, 22 bp, Homo sapiens
ctgaggcacagtgaacttctcc

SEQ ID NO: 7682420 - DNA, 19 bp, Homo sapiens
ctgaggcaagtggtggtca

SEQ ID NO: 7682421 - DNA, 19 bp, Homo sapiens
ctgaggcaagtggtggtca

SEQ ID NO: 7682422 - DNA, 22 bp, Homo sapiens
ctgaggcacagtgaacttctcc

SEQ ID NO: 7682423 - DNA, 19 bp, Homo sapiens
ctgaggcaagtggtggtca

SEQ ID NO: 7682424 - DNA, 19 bp, Homo sapiens
ctgaggcaagtggtggtca

SEQ ID NO: 7682425 - DNA, 17 bp, Homo sapiens
ctgaggattatggttgt

SEQ ID NO: 7682426 - DNA, 22 bp, Homo sapiens
ctgaggagtttgggttgttcaa

SEQ ID NO: 7682427 - DNA, 22 bp, Homo sapiens
ctgaggagtttcttatatgtgt

SEQ ID NO: 7682428 - DNA, 22 bp, Homo sapiens
ctgaggagtttcttatatgtgt

SEQ ID NO: 7682429 - DNA, 22 bp, Homo sapiens
ctgaggagtttcttatatgtgt

SEQ ID NO: 7682430 - DNA, 22 bp, Homo sapiens
ctgaggagttggtgaataagcc

SEQ ID NO: 7682431 - DNA, 22 bp, Homo sapiens
ctgaggagttggtgaataagcc

SEQ ID NO: 7682432 - DNA, 22 bp, Homo sapiens
ctgaggatctactgtgggctca

SEQ ID NO: 7682433 - DNA, 22 bp, Homo sapiens
ctgaggagtttgggttgttcaa

SEQ ID NO: 7682434 - DNA, 22 bp, Homo sapiens
ctgaggatctaattattgggtc

SEQ ID NO: 7682435 - DNA, 22 bp, Homo sapiens
ctgaggagtttgggttgttcaa

SEQ ID NO: 7682436 - DNA, 22 bp, Homo sapiens
ctgagacacggagaggctgtgt

SEQ ID NO: 7682437 - DNA, 22 bp, Homo sapiens
ctgagacacggagaggctgtgt

SEQ ID NO: 7682438 - DNA, 22 bp, Homo sapiens
ctgagaattactctgatgagta

SEQ ID NO: 7682439 - DNA, 22 bp, Homo sapiens
ctgagaattactctgatgagta

SEQ ID NO: 7682440 - DNA, 22 bp, Homo sapiens
ctgagaattactctgatgagta

SEQ ID NO: 7682441 - DNA, 22 bp, Homo sapiens
ctgagaatgttttctgattgat

SEQ ID NO: 7682442 - DNA, 22 bp, Homo sapiens
ctgagacacggagaggctgtgt

SEQ ID NO: 7682443 - DNA, 22 bp, Homo sapiens
ctgagacacggagaggctgtgt

SEQ ID NO: 7682444 - DNA, 22 bp, Homo sapiens
ctgagacaggagaatggcgtga

SEQ ID NO: 7682445 - DNA, 22 bp, Homo sapiens
ctgagacatggtttgactggca

SEQ ID NO: 7682446 - DNA, 22 bp, Homo sapiens
ctgagacatggtttgactggca

SEQ ID NO: 7682447 - DNA, 22 bp, Homo sapiens
ctgagacatggtttgactggca

SEQ ID NO: 7682448 - DNA, 21 bp, Homo sapiens
ctgagacctgcattagagagg

SEQ ID NO: 7682449 - DNA, 22 bp, Homo sapiens
ctgagactgtaccacttcctcc

SEQ ID NO: 7682450 - DNA, 22 bp, Homo sapiens
ctgagacccagacacctgagga

SEQ ID NO: 7682451 - DNA, 22 bp, Homo sapiens
ctgagactttcatgtgctttta

SEQ ID NO: 7682452 - DNA, 22 bp, Homo sapiens
ctgagactttcatgtgctttta

SEQ ID NO: 7682453 - DNA, 22 bp, Homo sapiens
ctgagacccagacacctgagga

SEQ ID NO: 7682454 - DNA, 22 bp, Homo sapiens
ctgagacattatgacaagtgga

SEQ ID NO: 7682455 - DNA, 22 bp, Homo sapiens
ctgagacccagacacctgagga

SEQ ID NO: 7682456 - DNA, 22 bp, Homo sapiens
ctgagacattatgacaagtgga

SEQ ID NO: 7682457 - DNA, 22 bp, Homo sapiens
ctgagacattatgacaagtgga

SEQ ID NO: 7682458 - DNA, 22 bp, Homo sapiens
ctgagacattatgacaagtgga

SEQ ID NO: 7682459 - DNA, 22 bp, Homo sapiens
ctgagagaatcatgctgcaggt

SEQ ID NO: 7682460 - DNA, 22 bp, Homo sapiens
ctgagagaatcatgctgcaggt

SEQ ID NO: 7682461 - DNA, 22 bp, Homo sapiens
ctgagagaatcatgctgcaggt

SEQ ID NO: 7682462 - DNA, 22 bp, Homo sapiens
ctgagagaaacatgactcagga

SEQ ID NO: 7682463 - DNA, 22 bp, Homo sapiens
ctgagagaaacatgactcagga

SEQ ID NO: 7682464 - DNA, 22 bp, Homo sapiens
ctgagagaaacatgactcagga

SEQ ID NO: 7682465 - DNA, 22 bp, Homo sapiens
ctgagagaaacatgactcagga

SEQ ID NO: 7682466 - DNA, 22 bp, Homo sapiens
ctgagagaaacatgactcagga

SEQ ID NO: 7682467 - DNA, 22 bp, Homo sapiens
ctgagagaaacatgactcagga

SEQ ID NO: 7682468 - DNA, 22 bp, Homo sapiens
ctgagagaaacatgactcagga

SEQ ID NO: 7682469 - DNA, 22 bp, Homo sapiens
ctgagagaaacatgactcagga

SEQ ID NO: 7682470 - DNA, 22 bp, Homo sapiens
ctgagagagtaaagtagaatta

SEQ ID NO: 7682471 - DNA, 22 bp, Homo sapiens
ctgagagagtaaagtagaatta

SEQ ID NO: 7682472 - DNA, 22 bp, Homo sapiens
ctgagagactgtttgtaatatt

SEQ ID NO: 7682473 - DNA, 22 bp, Homo sapiens
ctgagagaatcatgctgcaggt

SEQ ID NO: 7682474 - DNA, 22 bp, Homo sapiens
ctgagagactgtttgtaatatt

SEQ ID NO: 7682475 - DNA, 22 bp, Homo sapiens
ctgagagaatcatgctgcaggt

SEQ ID NO: 7682476 - DNA, 22 bp, Homo sapiens
ctgaggaccccacaggaggccc

SEQ ID NO: 7682477 - DNA, 22 bp, Homo sapiens
ctgaggaccccacaggaggccc

SEQ ID NO: 7682478 - DNA, 22 bp, Homo sapiens
ctgaggaccccacaggaggccc

SEQ ID NO: 7682479 - DNA, 22 bp, Homo sapiens
ctgaggaccccacaggaggccc

SEQ ID NO: 7682480 - DNA, 22 bp, Homo sapiens
ctgaggagaaagatggtccaag

SEQ ID NO: 7682481 - DNA, 22 bp, Homo sapiens
ctgaggagaaagatggtccaag

SEQ ID NO: 7682482 - DNA, 22 bp, Homo sapiens
ctgaggagaaagatggtccaag

SEQ ID NO: 7682483 - DNA, 22 bp, Homo sapiens
ctgaggagaaagatggtccaag

SEQ ID NO: 7682484 - DNA, 22 bp, Homo sapiens
ctgaggagaaagatggtccaag

SEQ ID NO: 7682485 - DNA, 22 bp, Homo sapiens
ctgaggaccccacaggaggccc

SEQ ID NO: 7682486 - DNA, 22 bp, Homo sapiens
ctgaggaggctaatttgaggat

SEQ ID NO: 7682487 - DNA, 22 bp, Homo sapiens
ctgaggaggctaatttgaggat

SEQ ID NO: 7682488 - DNA, 22 bp, Homo sapiens
ctgaggaggggcctgagtgaga

SEQ ID NO: 7682489 - DNA, 22 bp, Homo sapiens
ctgaggaggggcctgagtgaga

SEQ ID NO: 7682490 - DNA, 22 bp, Homo sapiens
ctgaggagggaagtccccaaag

SEQ ID NO: 7682491 - DNA, 22 bp, Homo sapiens
ctgaggagggaagtccccaaag

SEQ ID NO: 7682492 - DNA, 22 bp, Homo sapiens
ctgaggagggaagtccccaaag

SEQ ID NO: 7682493 - DNA, 22 bp, Homo sapiens
ctgaggagaacaatgagatcaa

SEQ ID NO: 7682494 - DNA, 22 bp, Homo sapiens
ctgaggagaaatgggatggttc

SEQ ID NO: 7682495 - DNA, 22 bp, Homo sapiens
ctgaggagaaatgggatggttc

SEQ ID NO: 7682496 - DNA, 22 bp, Homo sapiens
ctgaggagaacaatgagatcaa

SEQ ID NO: 7682497 - DNA, 22 bp, Homo sapiens
ctgaggagaacaatgagatcaa

SEQ ID NO: 7682498 - DNA, 22 bp, Homo sapiens
ctgaggagaacaatgagatcaa

SEQ ID NO: 7682499 - DNA, 22 bp, Homo sapiens
ctgaggagaacaatgagatcaa

SEQ ID NO: 7682500 - DNA, 22 bp, Homo sapiens
ctgaggagaaatgggatggttc

SEQ ID NO: 7682501 - DNA, 22 bp, Homo sapiens
ctgaggagaaatgggatggttc

SEQ ID NO: 7682502 - DNA, 22 bp, Homo sapiens
ctgaggagaaagatggtccaag

SEQ ID NO: 7682503 - DNA, 22 bp, Homo sapiens
ctgaggagaaagatggtccaag

SEQ ID NO: 7682504 - DNA, 22 bp, Homo sapiens
ctgaggagaaatgggatggttc

SEQ ID NO: 7682505 - DNA, 22 bp, Homo sapiens
ctgaggagaaatgggatggttc

SEQ ID NO: 7682506 - DNA, 22 bp, Homo sapiens
ctgaggagaaatgggatggttc

SEQ ID NO: 7682507 - DNA, 22 bp, Homo sapiens
ctgccaggtgcctttgtgcagt

SEQ ID NO: 7682508 - DNA, 22 bp, Homo sapiens
ctgccaggtgcctttgtgcagt

SEQ ID NO: 7682509 - DNA, 22 bp, Homo sapiens
ctgccaggttggcgctcgctct

SEQ ID NO: 7682510 - DNA, 22 bp, Homo sapiens
ctgccaggttggcgctcgctct

SEQ ID NO: 7682511 - DNA, 22 bp, Homo sapiens
ctgccaggttggcgctcgctct

SEQ ID NO: 7682512 - DNA, 22 bp, Homo sapiens
ctgccaggttggcgctcgctct

SEQ ID NO: 7682513 - DNA, 22 bp, Homo sapiens
ctgccaggtgagctccaggcct

SEQ ID NO: 7682514 - DNA, 22 bp, Homo sapiens
ctgccaggtgagctccaggcct

SEQ ID NO: 7682515 - DNA, 22 bp, Homo sapiens
ctgccaggtaaactgcaggaat

SEQ ID NO: 7682516 - DNA, 22 bp, Homo sapiens
ctgccaggtgccagggcgcggc

SEQ ID NO: 7682517 - DNA, 22 bp, Homo sapiens
ctgccaggtgccagggcgcggc

SEQ ID NO: 7682518 - DNA, 22 bp, Homo sapiens
ctgccaggtgccagggcgcggc

SEQ ID NO: 7682519 - DNA, 22 bp, Homo sapiens
ctgccaggtgagctccaggcct

SEQ ID NO: 7682520 - DNA, 22 bp, Homo sapiens
ctgccaggtgagctccaggcct

SEQ ID NO: 7682521 - DNA, 22 bp, Homo sapiens
ctgccatcctcaccagagcagc

SEQ ID NO: 7682522 - DNA, 22 bp, Homo sapiens
ctgccatctgagccaaaagtgc

SEQ ID NO: 7682523 - DNA, 22 bp, Homo sapiens
ctgccatcgggggccccactgc

SEQ ID NO: 7682524 - DNA, 22 bp, Homo sapiens
ctgccatctgagccaaaagtgc

SEQ ID NO: 7682525 - DNA, 22 bp, Homo sapiens
ctgccatctgagggtccagcct

SEQ ID NO: 7682526 - DNA, 22 bp, Homo sapiens
ctgccatctgagggtccagcct

SEQ ID NO: 7682527 - DNA, 20 bp, Homo sapiens
ctgccatgattgatagagtg

SEQ ID NO: 7682528 - DNA, 22 bp, Homo sapiens
ctgccatcctcaccagagcagc

SEQ ID NO: 7682529 - DNA, 22 bp, Homo sapiens
ctgccatcctcaccagagcagc

SEQ ID NO: 7682530 - DNA, 22 bp, Homo sapiens
ctgccatcctcaccagagcagc

SEQ ID NO: 7682531 - DNA, 22 bp, Homo sapiens
ctgccatccacggcccactcat

SEQ ID NO: 7682532 - DNA, 22 bp, Homo sapiens
ctgccatgctcaagaagtcttt

SEQ ID NO: 7682533 - DNA, 22 bp, Homo sapiens
ctgccatgctcaagaagtcttt

SEQ ID NO: 7682534 - DNA, 22 bp, Homo sapiens
ctgccatgcagttagtccctca

SEQ ID NO: 7682535 - DNA, 22 bp, Homo sapiens
ctgccatgcagttagtccctca

SEQ ID NO: 7682536 - DNA, 22 bp, Homo sapiens
ctgccctggggggcctccttgc

SEQ ID NO: 7682537 - DNA, 22 bp, Homo sapiens
ctgccctggggggcctccttgc

SEQ ID NO: 7682538 - DNA, 22 bp, Homo sapiens
ctgccctggggggcctccttgc

SEQ ID NO: 7682539 - DNA, 18 bp, Homo sapiens
ctgccatgtcctactgtc

SEQ ID NO: 7682540 - DNA, 22 bp, Homo sapiens
ctgccatgctcttttatgaaga

SEQ ID NO: 7682541 - DNA, 22 bp, Homo sapiens
ctgccatggtgtcccttttgca

SEQ ID NO: 7682542 - DNA, 22 bp, Homo sapiens
ctgccctggggggcctccttgc

SEQ ID NO: 7682543 - DNA, 22 bp, Homo sapiens
ctgccctggggggcctccttgc

SEQ ID NO: 7682544 - DNA, 22 bp, Homo sapiens
ctgccctggggggcctccttgc

SEQ ID NO: 7682545 - DNA, 22 bp, Homo sapiens
ctgccctgggtgctggggatcc

SEQ ID NO: 7682546 - DNA, 22 bp, Homo sapiens
ctgccctgggttttatgggagt

SEQ ID NO: 7682547 - DNA, 22 bp, Homo sapiens
ctgccctgggttttatgggagt

SEQ ID NO: 7682548 - DNA, 22 bp, Homo sapiens
ctgccctgggtgctggggatcc

SEQ ID NO: 7682549 - DNA, 22 bp, Homo sapiens
ctgccctgggtgctggggatcc

SEQ ID NO: 7682550 - DNA, 22 bp, Homo sapiens
ctgccctgggtgctggggatcc

SEQ ID NO: 7682551 - DNA, 22 bp, Homo sapiens
ctgccgttgtgaagctcttaga

SEQ ID NO: 7682552 - DNA, 22 bp, Homo sapiens
ctgccgttgtgaagctcttaga

SEQ ID NO: 7682553 - DNA, 22 bp, Homo sapiens
ctgccgttgtgaagctcttaga

SEQ ID NO: 7682554 - DNA, 22 bp, Homo sapiens
ctgccgttgtgaagctcttaga

SEQ ID NO: 7682555 - DNA, 22 bp, Homo sapiens
ctgccgtgtttttcatgttaaa

SEQ ID NO: 7682556 - DNA, 22 bp, Homo sapiens
ctgccgtgtttttcatgttaaa

SEQ ID NO: 7682557 - DNA, 22 bp, Homo sapiens
ctgccgtgtttttcatgttaaa

SEQ ID NO: 7682558 - DNA, 22 bp, Homo sapiens
ctgccgtgtttttcatgttaaa

SEQ ID NO: 7682559 - DNA, 22 bp, Homo sapiens
ctgccgttgtgaagctcttaga

SEQ ID NO: 7682560 - DNA, 22 bp, Homo sapiens
ctgcctagaaaaccaggctcct

SEQ ID NO: 7682561 - DNA, 22 bp, Homo sapiens
ctgcctagatttgaatcctggc

SEQ ID NO: 7682562 - DNA, 22 bp, Homo sapiens
ctgccgttgtgaagctcttaga

SEQ ID NO: 7682563 - DNA, 22 bp, Homo sapiens
ctgcctagaaaaccaggctcct

SEQ ID NO: 7682564 - DNA, 22 bp, Homo sapiens
ctgccgtgtttttcatgttaaa

SEQ ID NO: 7682565 - DNA, 22 bp, Homo sapiens
ctgccgtgtttttcatgttaaa

SEQ ID NO: 7682566 - DNA, 22 bp, Homo sapiens
ctgccgtccatctacgtctcag

SEQ ID NO: 7682567 - DNA, 22 bp, Homo sapiens
ctgccgggccctggatttggca

SEQ ID NO: 7682568 - DNA, 22 bp, Homo sapiens
ctgccgtgagctttcgcgagcc

SEQ ID NO: 7682569 - DNA, 22 bp, Homo sapiens
ctgccctgggttttatgggagt

SEQ ID NO: 7682570 - DNA, 22 bp, Homo sapiens
ctgccgagtgggtcatgaggca

SEQ ID NO: 7682571 - DNA, 22 bp, Homo sapiens
ctgccgggccctggatttggca

SEQ ID NO: 7682572 - DNA, 22 bp, Homo sapiens
ctgccgagtacagccatagaaa

SEQ ID NO: 7682573 - DNA, 22 bp, Homo sapiens
ctgcctattccctgggccgaga

SEQ ID NO: 7682574 - DNA, 22 bp, Homo sapiens
ctgcctatctacaaagtgggat

SEQ ID NO: 7682575 - DNA, 22 bp, Homo sapiens
ctgcctatcaaatggggagggc

SEQ ID NO: 7682576 - DNA, 22 bp, Homo sapiens
ctgcctatcaaatggggagggc

SEQ ID NO: 7682577 - DNA, 22 bp, Homo sapiens
ctgcctcacattggctgtgtga

SEQ ID NO: 7682578 - DNA, 22 bp, Homo sapiens
ctgcctcacattggctgtgtga

SEQ ID NO: 7682579 - DNA, 22 bp, Homo sapiens
ctgcctagggtctggtaccaca

SEQ ID NO: 7682580 - DNA, 22 bp, Homo sapiens
ctgcctcagcgttgtggcccta

SEQ ID NO: 7682581 - DNA, 22 bp, Homo sapiens
ctgcctcagcgttgtggcccta

SEQ ID NO: 7682582 - DNA, 22 bp, Homo sapiens
ctgcctcagcgttgtggcccta

SEQ ID NO: 7682583 - DNA, 22 bp, Homo sapiens
ctgcctcagcgttgtggcccta

SEQ ID NO: 7682584 - DNA, 22 bp, Homo sapiens
ctgcctcagccttctgggtgac

SEQ ID NO: 7682585 - DNA, 22 bp, Homo sapiens
ctgcctcagccttctgggtgac

SEQ ID NO: 7682586 - DNA, 22 bp, Homo sapiens
ctgcctcagccttctgggtgac

SEQ ID NO: 7682587 - DNA, 22 bp, Homo sapiens
ctgcctcagccttctgggtgac

SEQ ID NO: 7682588 - DNA, 22 bp, Homo sapiens
ctgcctatctacaaagtgggat

SEQ ID NO: 7682589 - DNA, 22 bp, Homo sapiens
ctgcctcagccttctgggtgac

SEQ ID NO: 7682590 - DNA, 22 bp, Homo sapiens
ctgcctccaggctcaccttgac

SEQ ID NO: 7682591 - DNA, 22 bp, Homo sapiens
ctgcctccaggctcaccttgac

SEQ ID NO: 7682592 - DNA, 22 bp, Homo sapiens
ctgcctccaggctcaccttgac

SEQ ID NO: 7682593 - DNA, 22 bp, Homo sapiens
ctgcctccaggctcaccttgac

SEQ ID NO: 7682594 - DNA, 22 bp, Homo sapiens
ctgcctccaggctcaccttgac

SEQ ID NO: 7682595 - DNA, 22 bp, Homo sapiens
ctgcctccaggctcaccttgac

SEQ ID NO: 7682596 - DNA, 22 bp, Homo sapiens
ctgcctcatgctgcctgcagcc

SEQ ID NO: 7682597 - DNA, 22 bp, Homo sapiens
ctgcctcatgctgcctgcagcc

SEQ ID NO: 7682598 - DNA, 22 bp, Homo sapiens
ctgcctcatgctgcctgcagcc

SEQ ID NO: 7682599 - DNA, 22 bp, Homo sapiens
ctgcctcatgctgcctgcagcc

SEQ ID NO: 7682600 - DNA, 22 bp, Homo sapiens
ctgcctcagcgttgtggcccta

SEQ ID NO: 7682601 - DNA, 22 bp, Homo sapiens
ctgcctcagcgttgtggcccta

SEQ ID NO: 7682602 - DNA, 22 bp, Homo sapiens
ctgcctcatgctgcctgcagcc

SEQ ID NO: 7682603 - DNA, 22 bp, Homo sapiens
ctgcctcatgctgcctgcagcc

SEQ ID NO: 7682604 - DNA, 22 bp, Homo sapiens
ctgcctcatgctgcctgcagcc

SEQ ID NO: 7682605 - DNA, 22 bp, Homo sapiens
ctgcctcatgctgcctgcagcc

SEQ ID NO: 7682606 - DNA, 22 bp, Homo sapiens
ctgcctcatgctgcctgcagcc

SEQ ID NO: 7682607 - DNA, 22 bp, Homo sapiens
ctgcctcatgctgcctgcagcc

SEQ ID NO: 7682608 - DNA, 22 bp, Homo sapiens
ctgcctcatgctgcctgcagcc

SEQ ID NO: 7682609 - DNA, 22 bp, Homo sapiens
ctgcctcctggctgatgggtag

SEQ ID NO: 7682610 - DNA, 22 bp, Homo sapiens
ctgcctcctggctgatgggtag

SEQ ID NO: 7682611 - DNA, 22 bp, Homo sapiens
ctgcctcctggctgatgggtag

SEQ ID NO: 7682612 - DNA, 22 bp, Homo sapiens
ctgcctcctggctgatgggtag

SEQ ID NO: 7682613 - DNA, 22 bp, Homo sapiens
ctgcctcctggctgatgggtag

SEQ ID NO: 7682614 - DNA, 22 bp, Homo sapiens
ctgcctcctggctgatgggtag

SEQ ID NO: 7682615 - DNA, 22 bp, Homo sapiens
ctgcctctataggagtccacca

SEQ ID NO: 7682616 - DNA, 22 bp, Homo sapiens
ctgcctctataggagtccacca

SEQ ID NO: 7682617 - DNA, 22 bp, Homo sapiens
ctgcctctataggagtccacca

SEQ ID NO: 7682618 - DNA, 22 bp, Homo sapiens
ctgcctcctggctgatgggtag

SEQ ID NO: 7682619 - DNA, 22 bp, Homo sapiens
ctgcctctataggagtccacca

SEQ ID NO: 7682620 - DNA, 22 bp, Homo sapiens
ctgcctgcgttgcctcgtgcct

SEQ ID NO: 7682621 - DNA, 22 bp, Homo sapiens
ctgcctgcgttgcctcgtgcct

SEQ ID NO: 7682622 - DNA, 22 bp, Homo sapiens
ctgcctgcgttgcctcgtgcct

SEQ ID NO: 7682623 - DNA, 22 bp, Homo sapiens
ctgcctgcgttgcctcgtgcct

SEQ ID NO: 7682624 - DNA, 22 bp, Homo sapiens
ctgcctcctgccgtgcagcttc

SEQ ID NO: 7682625 - DNA, 22 bp, Homo sapiens
ctgcctcctgccgtgcagcttc

SEQ ID NO: 7682626 - DNA, 22 bp, Homo sapiens
ctgcctcctggctgatgggtag

SEQ ID NO: 7682627 - DNA, 22 bp, Homo sapiens
ctgcctcctgccgtgcagcttc

SEQ ID NO: 7682628 - DNA, 22 bp, Homo sapiens
ctgcctcctgccgtgcagcttc

SEQ ID NO: 7682629 - DNA, 22 bp, Homo sapiens
ctgcctcctgccgtgcagcttc

SEQ ID NO: 7682630 - DNA, 22 bp, Homo sapiens
ctgcctcctgccgtgcagcttc

SEQ ID NO: 7682631 - DNA, 22 bp, Homo sapiens
ctgcctcctgccgtgcagcttc

SEQ ID NO: 7682632 - DNA, 22 bp, Homo sapiens
ctgcctcctgccgtgcagcttc

SEQ ID NO: 7682633 - DNA, 22 bp, Homo sapiens
ctgcctcctgccgtgcagcttc

SEQ ID NO: 7682634 - DNA, 22 bp, Homo sapiens
ctgcctcctcacgtccacagtg

SEQ ID NO: 7682635 - DNA, 22 bp, Homo sapiens
ctgcctcctgccgtgcagcttc

SEQ ID NO: 7682636 - DNA, 22 bp, Homo sapiens
ctgcctcctgccgtgcagcttc

SEQ ID NO: 7682637 - DNA, 22 bp, Homo sapiens
ctgcctcctcacgtccacagtg

SEQ ID NO: 7682638 - DNA, 22 bp, Homo sapiens
ctgcctcctcacgtccacagtg

SEQ ID NO: 7682639 - DNA, 22 bp, Homo sapiens
ctgcctcctcacgtccacagtg

SEQ ID NO: 7682640 - DNA, 22 bp, Homo sapiens
ctgcctcctcacgtccacagtg

SEQ ID NO: 7682641 - DNA, 22 bp, Homo sapiens
ctgcctccaggctcaccttgac

SEQ ID NO: 7682642 - DNA, 22 bp, Homo sapiens
ctgcctcctcacgtccacagtg

SEQ ID NO: 7682643 - DNA, 22 bp, Homo sapiens
ctgcctccaggctcaccttgac

SEQ ID NO: 7682644 - DNA, 22 bp, Homo sapiens
ctgcctccaggctcaccttgac

SEQ ID NO: 7682645 - DNA, 22 bp, Homo sapiens
ctgcctccaggctcaccttgac

SEQ ID NO: 7682646 - DNA, 22 bp, Homo sapiens
ctgcctcctcacgtccacagtg

SEQ ID NO: 7682647 - DNA, 22 bp, Homo sapiens
ctgcctcctcacgtccacagtg

SEQ ID NO: 7682648 - DNA, 22 bp, Homo sapiens
ctgcctcctcacgtccacagtg

SEQ ID NO: 7682649 - DNA, 22 bp, Homo sapiens
ctgcctcctcacgtccacagtg

SEQ ID NO: 7682650 - DNA, 22 bp, Homo sapiens
ctgcctcctcacgtccacagtg

SEQ ID NO: 7682651 - DNA, 22 bp, Homo sapiens
ctgcctcctcacgtccacagtg

SEQ ID NO: 7682652 - DNA, 22 bp, Homo sapiens
ctgcctcctcacgtccacagtg

SEQ ID NO: 7682653 - DNA, 22 bp, Homo sapiens
ctgcctcctcacgtccacagtg

SEQ ID NO: 7682654 - DNA, 22 bp, Homo sapiens
ctgcctcctcacgtccacagtg

SEQ ID NO: 7682655 - DNA, 22 bp, Homo sapiens
ctgccaggcgatggattggctg

SEQ ID NO: 7682656 - DNA, 22 bp, Homo sapiens
ctgccaggcgatggattggctg

SEQ ID NO: 7682657 - DNA, 22 bp, Homo sapiens
ctgccaggcgatggattggctg

SEQ ID NO: 7682658 - DNA, 22 bp, Homo sapiens
ctgccaggcgatggattggctg

SEQ ID NO: 7682659 - DNA, 22 bp, Homo sapiens
ctgccaggctgtcccaggtccg

SEQ ID NO: 7682660 - DNA, 22 bp, Homo sapiens
ctgccaggcgatggattggctg

SEQ ID NO: 7682661 - DNA, 22 bp, Homo sapiens
ctgccaggcctggggtgctgtc

SEQ ID NO: 7682662 - DNA, 22 bp, Homo sapiens
ctgccaggcctggggtgctgtc

SEQ ID NO: 7682663 - DNA, 22 bp, Homo sapiens
ctgccaggcctggggtgctgtc

SEQ ID NO: 7682664 - DNA, 22 bp, Homo sapiens
ctgccagggaggctgggaagtt

SEQ ID NO: 7682665 - DNA, 22 bp, Homo sapiens
ctgccaggctgtcccaggtccg

SEQ ID NO: 7682666 - DNA, 22 bp, Homo sapiens
ctgccagggaggctgggaagtt

SEQ ID NO: 7682667 - DNA, 22 bp, Homo sapiens
ctgccagggaggctgggaagtt

SEQ ID NO: 7682668 - DNA, 22 bp, Homo sapiens
ctgccagggaggctgggaagtt

SEQ ID NO: 7682669 - DNA, 22 bp, Homo sapiens
ctgccagggaggctgggaagtt

SEQ ID NO: 7682670 - DNA, 22 bp, Homo sapiens
ctgccaggctgtcccaggtccg

SEQ ID NO: 7682671 - DNA, 22 bp, Homo sapiens
ctgccaggctgtcccaggtccg

SEQ ID NO: 7682672 - DNA, 22 bp, Homo sapiens
ctgccagggaggctgggaagtt

SEQ ID NO: 7682673 - DNA, 22 bp, Homo sapiens
ctgccagggccctactcagttt

SEQ ID NO: 7682674 - DNA, 22 bp, Homo sapiens
ctgccagggccctactcagttt

SEQ ID NO: 7682675 - DNA, 22 bp, Homo sapiens
ctgccagggccctactcagttt

SEQ ID NO: 7682676 - DNA, 22 bp, Homo sapiens
ctgccagggcatcctgtggtgg

SEQ ID NO: 7682677 - DNA, 22 bp, Homo sapiens
ctgccagggcatcctgtggtgg

SEQ ID NO: 7682678 - DNA, 22 bp, Homo sapiens
ctgccagggcatcctgtggtgg

SEQ ID NO: 7682679 - DNA, 22 bp, Homo sapiens
ctgccagggcatcctgtggtgg

SEQ ID NO: 7682680 - DNA, 22 bp, Homo sapiens
ctgccagggcatcctgtggtgg

SEQ ID NO: 7682681 - DNA, 22 bp, Homo sapiens
ctgccagggcatcctgtggtgg

SEQ ID NO: 7682682 - DNA, 22 bp, Homo sapiens
ctgccaggggcctcacaggcca

SEQ ID NO: 7682683 - DNA, 22 bp, Homo sapiens
ctgccaggggcctcacaggcca

SEQ ID NO: 7682684 - DNA, 22 bp, Homo sapiens
ctgccaggggcctcacaggcca

SEQ ID NO: 7682685 - DNA, 22 bp, Homo sapiens
ctgccaggggcctcacaggcca

SEQ ID NO: 7682686 - DNA, 22 bp, Homo sapiens
ctgccaggtaaactgcaggaat

SEQ ID NO: 7682687 - DNA, 22 bp, Homo sapiens
ctgccaggtaaactgcaggaat

SEQ ID NO: 7682688 - DNA, 22 bp, Homo sapiens
ctgccaggtaaactgcaggaat

SEQ ID NO: 7682689 - DNA, 22 bp, Homo sapiens
ctgccaggggcctcacaggcca

SEQ ID NO: 7682690 - DNA, 22 bp, Homo sapiens
ctgccaggggcctcacaggcca

SEQ ID NO: 7682691 - DNA, 22 bp, Homo sapiens
ctgccaggggcctcacaggcca

SEQ ID NO: 7682692 - DNA, 22 bp, Homo sapiens
ctgccaggggcctcacaggcca

SEQ ID NO: 7682693 - DNA, 22 bp, Homo sapiens
ctgccaggggcctcacaggcca

SEQ ID NO: 7682694 - DNA, 22 bp, Homo sapiens
ctgccaggcctggggtgctgtc

SEQ ID NO: 7682695 - DNA, 22 bp, Homo sapiens
ctgccaggcctggggtgctgtc

SEQ ID NO: 7682696 - DNA, 22 bp, Homo sapiens
ctgccaggcctggggtgctgtc

SEQ ID NO: 7682697 - DNA, 22 bp, Homo sapiens
ctgccaggcctggggtgctgtc

SEQ ID NO: 7682698 - DNA, 22 bp, Homo sapiens
ctgccaggcctggggtgctgtc

SEQ ID NO: 7682699 - DNA, 22 bp, Homo sapiens
ctgccaggcctggggtgctgtc

SEQ ID NO: 7682700 - DNA, 22 bp, Homo sapiens
ctgccaggcctggggtgctgtc

SEQ ID NO: 7682701 - DNA, 22 bp, Homo sapiens
ctgccaggcctccgctgtcccc

SEQ ID NO: 7682702 - DNA, 22 bp, Homo sapiens
ctgccaggcctccgctgtcccc

SEQ ID NO: 7682703 - DNA, 22 bp, Homo sapiens
ctgccaggcctccgctgtcccc

SEQ ID NO: 7682704 - DNA, 22 bp, Homo sapiens
ctgccaggcctccgctgtcccc

SEQ ID NO: 7682705 - DNA, 22 bp, Homo sapiens
ctgccaggcctccgctgtcccc

SEQ ID NO: 7682706 - DNA, 22 bp, Homo sapiens
ctgccaggcctccgctgtcccc

SEQ ID NO: 7682707 - DNA, 22 bp, Homo sapiens
ctgccaggcctccgctgtcccc

SEQ ID NO: 7682708 - DNA, 22 bp, Homo sapiens
ctgccagctggagaccaaggaa

SEQ ID NO: 7682709 - DNA, 22 bp, Homo sapiens
ctgccagctggagaccaaggaa

SEQ ID NO: 7682710 - DNA, 22 bp, Homo sapiens
ctgccagctggagaccaaggaa

SEQ ID NO: 7682711 - DNA, 22 bp, Homo sapiens
ctgccagctggagaccaaggaa

SEQ ID NO: 7682712 - DNA, 22 bp, Homo sapiens
ctgccaggactgacgtcttcag

SEQ ID NO: 7682713 - DNA, 22 bp, Homo sapiens
ctgccagctctctggaggctct

SEQ ID NO: 7682714 - DNA, 22 bp, Homo sapiens
ctgccagctctctggaggctct

SEQ ID NO: 7682715 - DNA, 23 bp, Homo sapiens
ctgcagccgcgtggggacgtgga

SEQ ID NO: 7682716 - DNA, 23 bp, Homo sapiens
ctgcagccgcgtggggacgtgga

SEQ ID NO: 7682717 - DNA, 23 bp, Homo sapiens
ctgcagccgcgtggggacgtgga

SEQ ID NO: 7682718 - DNA, 22 bp, Homo sapiens
ctgcagccacgagtcacagccc

SEQ ID NO: 7682719 - DNA, 22 bp, Homo sapiens
ctgcagccacgagtcacagccc

SEQ ID NO: 7682720 - DNA, 22 bp, Homo sapiens
ctgcagcatcgccacctgcctc

SEQ ID NO: 7682721 - DNA, 22 bp, Homo sapiens
ctgcagcatcctagggtctgtg

SEQ ID NO: 7682722 - DNA, 22 bp, Homo sapiens
ctgcagcatcgccacctgcctc

SEQ ID NO: 7682723 - DNA, 22 bp, Homo sapiens
ctgcagcatcgccacctgcctc

SEQ ID NO: 7682724 - DNA, 22 bp, Homo sapiens
ctgcagcatcgccacctgcctc

SEQ ID NO: 7682725 - DNA, 22 bp, Homo sapiens
ctgcagcagtagtccccaagtg

SEQ ID NO: 7682726 - DNA, 22 bp, Homo sapiens
ctgcagcagtgtgtctcatttt

SEQ ID NO: 7682727 - DNA, 22 bp, Homo sapiens
ctgcagcagtactcagcagcca

SEQ ID NO: 7682728 - DNA, 22 bp, Homo sapiens
ctgcagcagtgtgtctcatttt

SEQ ID NO: 7682729 - DNA, 22 bp, Homo sapiens
ctgcagcatcctagggtctgtg

SEQ ID NO: 7682730 - DNA, 22 bp, Homo sapiens
ctgcagcatcctagggtctgtg

SEQ ID NO: 7682731 - DNA, 22 bp, Homo sapiens
ctgcagcatcctagggtctgtg

SEQ ID NO: 7682732 - DNA, 22 bp, Homo sapiens
ctgcagatttggtgtctggtga

SEQ ID NO: 7682733 - DNA, 21 bp, Homo sapiens
ctgcagcaaaactttgctcct

SEQ ID NO: 7682734 - DNA, 22 bp, Homo sapiens
ctgcagcaagagaagtgctgac

SEQ ID NO: 7682735 - DNA, 22 bp, Homo sapiens
ctgcagcaaatgttaagtgact

SEQ ID NO: 7682736 - DNA, 22 bp, Homo sapiens
ctgcagcaagagaagtgctgac

SEQ ID NO: 7682737 - DNA, 22 bp, Homo sapiens
ctgcagcagaataatctgctca

SEQ ID NO: 7682738 - DNA, 22 bp, Homo sapiens
ctgcagcagaataatctgctca

SEQ ID NO: 7682739 - DNA, 22 bp, Homo sapiens
ctgcagcagaataatctgctca

SEQ ID NO: 7682740 - DNA, 22 bp, Homo sapiens
ctgcagcagaataatctgctca

SEQ ID NO: 7682741 - DNA, 22 bp, Homo sapiens
ctgcagcagcctccagccttgg

SEQ ID NO: 7682742 - DNA, 22 bp, Homo sapiens
ctgcagcagcctccagccttgg

SEQ ID NO: 7682743 - DNA, 22 bp, Homo sapiens
ctgcagcagcctccagccttgg

SEQ ID NO: 7682744 - DNA, 22 bp, Homo sapiens
ctgcagcagtactcagcagcca

SEQ ID NO: 7682745 - DNA, 22 bp, Homo sapiens
ctgcagcagtactcagcagcca

SEQ ID NO: 7682746 - DNA, 22 bp, Homo sapiens
ctgcagcagtactcagcagcca

SEQ ID NO: 7682747 - DNA, 22 bp, Homo sapiens
ctgcagcagtactcagcagcca

SEQ ID NO: 7682748 - DNA, 22 bp, Homo sapiens
ctgcagcagggcttgcccacct

SEQ ID NO: 7682749 - DNA, 22 bp, Homo sapiens
ctgcagcagtactcagcagcca

SEQ ID NO: 7682750 - DNA, 22 bp, Homo sapiens
ctgcagcagggcttgcccacct

SEQ ID NO: 7682751 - DNA, 22 bp, Homo sapiens
ctgcagcagggcttgcccacct

SEQ ID NO: 7682752 - DNA, 22 bp, Homo sapiens
ctgcagcaggaggctcctgcag

SEQ ID NO: 7682753 - DNA, 22 bp, Homo sapiens
ctgcagcaggaggctcctgcag

SEQ ID NO: 7682754 - DNA, 22 bp, Homo sapiens
ctgcagcaggaggctcctgcag

SEQ ID NO: 7682755 - DNA, 22 bp, Homo sapiens
ctgcagcaggaggctcctgcag

SEQ ID NO: 7682756 - DNA, 22 bp, Homo sapiens
ctgcagcagcctccagccttgg

SEQ ID NO: 7682757 - DNA, 22 bp, Homo sapiens
ctgcagatcttgtgtacttgtc

SEQ ID NO: 7682758 - DNA, 22 bp, Homo sapiens
ctgcagatcttgtgtacttgtc

SEQ ID NO: 7682759 - DNA, 22 bp, Homo sapiens
ctgcagatggctcagtggggca

SEQ ID NO: 7682760 - DNA, 22 bp, Homo sapiens
ctgcagatggctcagtggggca

SEQ ID NO: 7682761 - DNA, 22 bp, Homo sapiens
ctgcagatggtattgttctggt

SEQ ID NO: 7682762 - DNA, 22 bp, Homo sapiens
ctgcagaggttggttctaagat

SEQ ID NO: 7682763 - DNA, 22 bp, Homo sapiens
ctgcagaggttggttctaagat

SEQ ID NO: 7682764 - DNA, 22 bp, Homo sapiens
ctgcagaggtcttgctgatggt

SEQ ID NO: 7682765 - DNA, 22 bp, Homo sapiens
ctgcagaggtcttgctgatggt

SEQ ID NO: 7682766 - DNA, 22 bp, Homo sapiens
ctgcagagtatagcgagttggg

SEQ ID NO: 7682767 - DNA, 22 bp, Homo sapiens
ctgcagagtatagcgagttggg

SEQ ID NO: 7682768 - DNA, 22 bp, Homo sapiens
ctgcagagtggagcctcggctg

SEQ ID NO: 7682769 - DNA, 22 bp, Homo sapiens
ctgcagagtggagcctcggctg

SEQ ID NO: 7682770 - DNA, 22 bp, Homo sapiens
ctgcagagtatagcgagttggg

SEQ ID NO: 7682771 - DNA, 22 bp, Homo sapiens
ctgcagagtggagcctcggctg

SEQ ID NO: 7682772 - DNA, 22 bp, Homo sapiens
ctgcagagctaggctgagtgaa

SEQ ID NO: 7682773 - DNA, 22 bp, Homo sapiens
ctgcagagcttgtctggatgtg

SEQ ID NO: 7682774 - DNA, 22 bp, Homo sapiens
ctgcagagcttgtctggatgtg

SEQ ID NO: 7682775 - DNA, 22 bp, Homo sapiens
ctgcagagcttgtctggatgtg

SEQ ID NO: 7682776 - DNA, 22 bp, Homo sapiens
ctgcagagctaggctgagtgaa

SEQ ID NO: 7682777 - DNA, 22 bp, Homo sapiens
ctgcagagctaggctgagtgaa

SEQ ID NO: 7682778 - DNA, 22 bp, Homo sapiens
ctgcagagctaggctgagtgaa

SEQ ID NO: 7682779 - DNA, 22 bp, Homo sapiens
ctgcagagctaggctgagtgaa

SEQ ID NO: 7682780 - DNA, 22 bp, Homo sapiens
ctgcagagcttgtctggatgtg

SEQ ID NO: 7682781 - DNA, 22 bp, Homo sapiens
ctgcagagcttgtctggatgtg

SEQ ID NO: 7682782 - DNA, 22 bp, Homo sapiens
ctgcagagcttgtctggatgtg

SEQ ID NO: 7682783 - DNA, 22 bp, Homo sapiens
ctgcagagctttctgaatgaag

SEQ ID NO: 7682784 - DNA, 22 bp, Homo sapiens
ctgcagagctttctgaatgaag

SEQ ID NO: 7682785 - DNA, 22 bp, Homo sapiens
ctgcagagctttctgaatgaag

SEQ ID NO: 7682786 - DNA, 22 bp, Homo sapiens
ctgcagaggcctcgcctcctct

SEQ ID NO: 7682787 - DNA, 22 bp, Homo sapiens
ctgcagaggggttgaagggtcc

SEQ ID NO: 7682788 - DNA, 22 bp, Homo sapiens
ctgcagaggggttgaagggtcc

SEQ ID NO: 7682789 - DNA, 22 bp, Homo sapiens
ctgcagaggcctcgcctcctct

SEQ ID NO: 7682790 - DNA, 22 bp, Homo sapiens
ctgcagaggcctcgcctcctct

SEQ ID NO: 7682791 - DNA, 22 bp, Homo sapiens
ctgcagaggggttgaagggtcc

SEQ ID NO: 7682792 - DNA, 22 bp, Homo sapiens
ctgcagaggggttgaagggtcc

SEQ ID NO: 7682793 - DNA, 22 bp, Homo sapiens
ctgcagaggggttgaagggtcc

SEQ ID NO: 7682794 - DNA, 22 bp, Homo sapiens
ctgcagagggtttgagcatcct

SEQ ID NO: 7682795 - DNA, 22 bp, Homo sapiens
ctgcagagggtttgagcatcct

SEQ ID NO: 7682796 - DNA, 22 bp, Homo sapiens
ctgcagagggtttgagcatcct

SEQ ID NO: 7682797 - DNA, 22 bp, Homo sapiens
ctgcagagggtttgagcatcct

SEQ ID NO: 7682798 - DNA, 22 bp, Homo sapiens
ctgcagaggtcttgctgatggt

SEQ ID NO: 7682799 - DNA, 22 bp, Homo sapiens
ctgcagaggtcttgctgatggt

SEQ ID NO: 7682800 - DNA, 23 bp, Homo sapiens
ctggaagtgcttttatagctttg

SEQ ID NO: 7682801 - DNA, 23 bp, Homo sapiens
ctggaagtgcttttatagctttg

SEQ ID NO: 7682802 - DNA, 22 bp, Homo sapiens
ctggaagtggagagtggccctc

SEQ ID NO: 7682803 - DNA, 22 bp, Homo sapiens
ctggaagtggagagtggccctc

SEQ ID NO: 7682804 - DNA, 19 bp, Homo sapiens
ctggaatgtggctggtgca

SEQ ID NO: 7682805 - DNA, 22 bp, Homo sapiens
ctggaagtataggggagatgat

SEQ ID NO: 7682806 - DNA, 22 bp, Homo sapiens
ctggaagtataggggagatgat

SEQ ID NO: 7682807 - DNA, 23 bp, Homo sapiens
ctggaagtgcttttatagctttg

SEQ ID NO: 7682808 - DNA, 22 bp, Homo sapiens
ctggaagtataggggagatgat

SEQ ID NO: 7682809 - DNA, 22 bp, Homo sapiens
ctggaagtataggggagatgat

SEQ ID NO: 7682810 - DNA, 22 bp, Homo sapiens
ctggaagtatttaacccagaga

SEQ ID NO: 7682811 - DNA, 22 bp, Homo sapiens
ctggaaagtagacaatctaaaa

SEQ ID NO: 7682812 - DNA, 22 bp, Homo sapiens
ctggaaagtacagtgtgtcaca

SEQ ID NO: 7682813 - DNA, 22 bp, Homo sapiens
ctggaaagtacagtgtgtcaca

SEQ ID NO: 7682814 - DNA, 22 bp, Homo sapiens
ctggaaagtagatgtactaagg

SEQ ID NO: 7682815 - DNA, 22 bp, Homo sapiens
ctggaaggttctttgtgtgcct

SEQ ID NO: 7682816 - DNA, 22 bp, Homo sapiens
ctggaaggttctttgtgtgcct

SEQ ID NO: 7682817 - DNA, 22 bp, Homo sapiens
ctggacactggggatgcgcagt

SEQ ID NO: 7682818 - DNA, 16 bp, Homo sapiens
ctggacagaaaaacct

SEQ ID NO: 7682819 - DNA, 22 bp, Homo sapiens
ctggacactggggatgcgcagt

SEQ ID NO: 7682820 - DNA, 22 bp, Homo sapiens
ctggacacactggagtctggca

SEQ ID NO: 7682821 - DNA, 22 bp, Homo sapiens
ctggacaaccacaaggccaata

SEQ ID NO: 7682822 - DNA, 22 bp, Homo sapiens
ctggacaaccacaaggccaata

SEQ ID NO: 7682823 - DNA, 22 bp, Homo sapiens
ctggacaaccactcagcctcag

SEQ ID NO: 7682824 - DNA, 22 bp, Homo sapiens
ctggacacaaacatctcctctg

SEQ ID NO: 7682825 - DNA, 22 bp, Homo sapiens
ctggacacaaacatctcctctg

SEQ ID NO: 7682826 - DNA, 16 bp, Homo sapiens
ctggacagaaaaacct

SEQ ID NO: 7682827 - DNA, 22 bp, Homo sapiens
ctggacagaaaaggccactgga

SEQ ID NO: 7682828 - DNA, 22 bp, Homo sapiens
ctggacagaaaaggccactgga

SEQ ID NO: 7682829 - DNA, 22 bp, Homo sapiens
ctggacagaaaaggccactgga

SEQ ID NO: 7682830 - DNA, 22 bp, Homo sapiens
ctggacagaaaaggccactgga

SEQ ID NO: 7682831 - DNA, 22 bp, Homo sapiens
ctggacagaaaaggccactgga

SEQ ID NO: 7682832 - DNA, 22 bp, Homo sapiens
ctggaagtggcagtggaaaaga

SEQ ID NO: 7682833 - DNA, 22 bp, Homo sapiens
ctggaatgttctccagcatggc

SEQ ID NO: 7682834 - DNA, 22 bp, Homo sapiens
ctggaattatgaccaaaggtcc

SEQ ID NO: 7682835 - DNA, 22 bp, Homo sapiens
ctggaatgttctccagcatggc

SEQ ID NO: 7682836 - DNA, 22 bp, Homo sapiens
ctggaattgcataatatgtcct

SEQ ID NO: 7682837 - DNA, 22 bp, Homo sapiens
ctggaattgcataatatgtcct

SEQ ID NO: 7682838 - DNA, 22 bp, Homo sapiens
ctggaattgcataatatgtcct

SEQ ID NO: 7682839 - DNA, 22 bp, Homo sapiens
ctggacaaaggactcacaggat

SEQ ID NO: 7682840 - DNA, 22 bp, Homo sapiens
ctggacaaaggactcacaggat

SEQ ID NO: 7682841 - DNA, 22 bp, Homo sapiens
ctggacaaccactcagcctcag

SEQ ID NO: 7682842 - DNA, 22 bp, Homo sapiens
ctggacagaagtggctgggcag

SEQ ID NO: 7682843 - DNA, 22 bp, Homo sapiens
ctggacagaagtggctgggcag

SEQ ID NO: 7682844 - DNA, 22 bp, Homo sapiens
ctggacagaagtggctgggcag

SEQ ID NO: 7682845 - DNA, 22 bp, Homo sapiens
ctggacagaagtggctgggcag

SEQ ID NO: 7682846 - DNA, 22 bp, Homo sapiens
ctggacagaaagggctgctgtg

SEQ ID NO: 7682847 - DNA, 22 bp, Homo sapiens
ctggacagaaagggctgctgtg

SEQ ID NO: 7682848 - DNA, 22 bp, Homo sapiens
ctggacagaagtggctgggcag

SEQ ID NO: 7682849 - DNA, 22 bp, Homo sapiens
ctggacagaagtggctgggcag

SEQ ID NO: 7682850 - DNA, 22 bp, Homo sapiens
ctggacagaagtggctgggcag

SEQ ID NO: 7682851 - DNA, 22 bp, Homo sapiens
ctggacagaaaccagtcctggg

SEQ ID NO: 7682852 - DNA, 22 bp, Homo sapiens
ctggacagaaagggctgctgtg

SEQ ID NO: 7682853 - DNA, 22 bp, Homo sapiens
ctggacagaaaccagtcctggg

SEQ ID NO: 7682854 - DNA, 22 bp, Homo sapiens
ctggacagaaaccagtcctggg

SEQ ID NO: 7682855 - DNA, 22 bp, Homo sapiens
ctggacagaaaccagtcctggg

SEQ ID NO: 7682856 - DNA, 22 bp, Homo sapiens
ctggacaggctggggactgcaa

SEQ ID NO: 7682857 - DNA, 22 bp, Homo sapiens
ctggacaggctggggactgcaa

SEQ ID NO: 7682858 - DNA, 22 bp, Homo sapiens
ctggacaggctggggactgcaa

SEQ ID NO: 7682859 - DNA, 22 bp, Homo sapiens
ctggacagtgctgcttgagatg

SEQ ID NO: 7682860 - DNA, 22 bp, Homo sapiens
ctggacagtgggcagaggagac

SEQ ID NO: 7682861 - DNA, 22 bp, Homo sapiens
ctggacagtgctgcttgagatg

SEQ ID NO: 7682862 - DNA, 22 bp, Homo sapiens
ctggacagtgctgcttgagatg

SEQ ID NO: 7682863 - DNA, 22 bp, Homo sapiens
ctggacagtgctgcttgagatg

SEQ ID NO: 7682864 - DNA, 22 bp, Homo sapiens
ctggacagatcccttgtagctt

SEQ ID NO: 7682865 - DNA, 22 bp, Homo sapiens
ctggacagccctcactgtgtgc

SEQ ID NO: 7682866 - DNA, 22 bp, Homo sapiens
ctggacagccctcactgtgtgc

SEQ ID NO: 7682867 - DNA, 22 bp, Homo sapiens
ctggacagccctcactgtgtgc

SEQ ID NO: 7682868 - DNA, 22 bp, Homo sapiens
ctggacaggaagaattgggagc

SEQ ID NO: 7682869 - DNA, 22 bp, Homo sapiens
ctggacaggctggggactgcaa

SEQ ID NO: 7682870 - DNA, 22 bp, Homo sapiens
ctggacaggctggggactgcaa

SEQ ID NO: 7682871 - DNA, 22 bp, Homo sapiens
ctggacaggaagaattgggagc

SEQ ID NO: 7682872 - DNA, 22 bp, Homo sapiens
ctggacagccctcactgtgtgc

SEQ ID NO: 7682873 - DNA, 22 bp, Homo sapiens
ctggacaggaagaattgggagc

SEQ ID NO: 7682874 - DNA, 20 bp, Homo sapiens
ctggaaaccctgctgatggt

SEQ ID NO: 7682875 - DNA, 22 bp, Homo sapiens
ctggaaagacagagggcatggg

SEQ ID NO: 7682876 - DNA, 22 bp, Homo sapiens
ctggaaagacagagggcatggg

SEQ ID NO: 7682877 - DNA, 22 bp, Homo sapiens
ctggaaagacagagggcatggg

SEQ ID NO: 7682878 - DNA, 22 bp, Homo sapiens
ctggaaaccaggcagttaagag

SEQ ID NO: 7682879 - DNA, 22 bp, Homo sapiens
ctggaaaatgaagaagcagagg

SEQ ID NO: 7682880 - DNA, 22 bp, Homo sapiens
ctggaaaatgaagaagcagagg

SEQ ID NO: 7682881 - DNA, 22 bp, Homo sapiens
ctggaaaatgaagaagcagagg

SEQ ID NO: 7682882 - DNA, 22 bp, Homo sapiens
ctgctttttctaggaggacaat

SEQ ID NO: 7682883 - DNA, 22 bp, Homo sapiens
ctgctttttctaggaggacaat

SEQ ID NO: 7682884 - DNA, 22 bp, Homo sapiens
ctgctttttgtaggtcccagag

SEQ ID NO: 7682885 - DNA, 22 bp, Homo sapiens
ctgcttttgagcccagtgctca

SEQ ID NO: 7682886 - DNA, 22 bp, Homo sapiens
ctgctttgtgtggtccctccag

SEQ ID NO: 7682887 - DNA, 22 bp, Homo sapiens
ctggaaagatttacacggggaa

SEQ ID NO: 7682888 - DNA, 22 bp, Homo sapiens
ctggaaagagatggcagggttt

SEQ ID NO: 7682889 - DNA, 22 bp, Homo sapiens
ctggaaagagatggcagggttt

SEQ ID NO: 7682890 - DNA, 22 bp, Homo sapiens
ctggaaagacagagggcatggg

SEQ ID NO: 7682891 - DNA, 22 bp, Homo sapiens
ctggaaagacagagggcatggg

SEQ ID NO: 7682892 - DNA, 22 bp, Homo sapiens
ctggaaagggtcctcattctgt

SEQ ID NO: 7682893 - DNA, 16 bp, Homo sapiens
ctggaaaggctagctc

SEQ ID NO: 7682894 - DNA, 16 bp, Homo sapiens
ctggaaaggctagctc

SEQ ID NO: 7682895 - DNA, 22 bp, Homo sapiens
ctggaaagatttctttggagtc

SEQ ID NO: 7682896 - DNA, 22 bp, Homo sapiens
ctggaaagctgcaggacccaga

SEQ ID NO: 7682897 - DNA, 22 bp, Homo sapiens
ctggaaagctgcaggacccaga

SEQ ID NO: 7682898 - DNA, 22 bp, Homo sapiens
ctggaaagatttctttggagtc

SEQ ID NO: 7682899 - DNA, 22 bp, Homo sapiens
ctggaaagatttctttggagtc

SEQ ID NO: 7682900 - DNA, 22 bp, Homo sapiens
ctgctttcttgttgcatcttaa

SEQ ID NO: 7682901 - DNA, 22 bp, Homo sapiens
ctgctttgaaaataaacttgtc

SEQ ID NO: 7682902 - DNA, 22 bp, Homo sapiens
ctgctttgaaaataaacttgtc

SEQ ID NO: 7682903 - DNA, 22 bp, Homo sapiens
ctgctttgaaaataaacttgtc

SEQ ID NO: 7682904 - DNA, 22 bp, Homo sapiens
ctgctttcttgttgcatcttaa

SEQ ID NO: 7682905 - DNA, 22 bp, Homo sapiens
ctgctttgaggggctctgtata

SEQ ID NO: 7682906 - DNA, 22 bp, Homo sapiens
ctgctttgaggggctctgtata

SEQ ID NO: 7682907 - DNA, 22 bp, Homo sapiens
ctgctttgattagaagagtaca

SEQ ID NO: 7682908 - DNA, 22 bp, Homo sapiens
ctgctttgcatagctgccagag

SEQ ID NO: 7682909 - DNA, 22 bp, Homo sapiens
ctgctttgattagaagagtaca

SEQ ID NO: 7682910 - DNA, 22 bp, Homo sapiens
ctgctttgactgttaagaacca

SEQ ID NO: 7682911 - DNA, 22 bp, Homo sapiens
ctgctttgactgttaagaacca

SEQ ID NO: 7682912 - DNA, 22 bp, Homo sapiens
ctgctttggcagaagtcagcta

SEQ ID NO: 7682913 - DNA, 22 bp, Homo sapiens
ctgctttgggcagctttgtggc

SEQ ID NO: 7682914 - DNA, 22 bp, Homo sapiens
ctgctttgcatagctgccagag

SEQ ID NO: 7682915 - DNA, 18 bp, Homo sapiens
ctgctttgccttcattcc

SEQ ID NO: 7682916 - DNA, 18 bp, Homo sapiens
ctgctttgccttcattcc

SEQ ID NO: 7682917 - DNA, 18 bp, Homo sapiens
ctgctttgccttcattcc

SEQ ID NO: 7682918 - DNA, 22 bp, Homo sapiens
ctgctttgcatagctgccagag

SEQ ID NO: 7682919 - DNA, 17 bp, Homo sapiens
ctgctttgtgcaacgct

SEQ ID NO: 7682920 - DNA, 22 bp, Homo sapiens
ctgctttgtggaatcacactgg

SEQ ID NO: 7682921 - DNA, 22 bp, Homo sapiens
ctgctttgtggaatcacactgg

SEQ ID NO: 7682922 - DNA, 22 bp, Homo sapiens
ctgctttgtaaaatagacataa

SEQ ID NO: 7682923 - DNA, 23 bp, Homo sapiens
ctgcttccttgcttcattgctgg

SEQ ID NO: 7682924 - DNA, 23 bp, Homo sapiens
ctgcttccttgcttcattgctgg

SEQ ID NO: 7682925 - DNA, 19 bp, Homo sapiens
ctgcttccttccctcactg

SEQ ID NO: 7682926 - DNA, 23 bp, Homo sapiens
ctgcttccttgcttcattgctgg

SEQ ID NO: 7682927 - DNA, 22 bp, Homo sapiens
ctgcttctaagaacctgcagct

SEQ ID NO: 7682928 - DNA, 22 bp, Homo sapiens
ctgcttctaagaacctgcagct

SEQ ID NO: 7682929 - DNA, 22 bp, Homo sapiens
ctgcttctaagaacctgcagct

SEQ ID NO: 7682930 - DNA, 22 bp, Homo sapiens
ctgcctggctaaactcaagtcg

SEQ ID NO: 7682931 - DNA, 22 bp, Homo sapiens
ctgcctgggccggccaccctct

SEQ ID NO: 7682932 - DNA, 22 bp, Homo sapiens
ctgcctgggccggccaccctct

SEQ ID NO: 7682933 - DNA, 22 bp, Homo sapiens
ctgcctgggccatgcccagtcc

SEQ ID NO: 7682934 - DNA, 22 bp, Homo sapiens
ctgcctgggccatgcccagtcc

SEQ ID NO: 7682935 - DNA, 22 bp, Homo sapiens
ctgcctgggccatgcccagtcc

SEQ ID NO: 7682936 - DNA, 22 bp, Homo sapiens
ctgcctggggaatgtgaggatt

SEQ ID NO: 7682937 - DNA, 22 bp, Homo sapiens
ctgcctgggccggccaccctct

SEQ ID NO: 7682938 - DNA, 22 bp, Homo sapiens
ctgcctgggccggccaccctct

SEQ ID NO: 7682939 - DNA, 22 bp, Homo sapiens
ctgcctgggccggccaccctct

SEQ ID NO: 7682940 - DNA, 22 bp, Homo sapiens
ctgcctgggccggccaccctct

SEQ ID NO: 7682941 - DNA, 22 bp, Homo sapiens
ctgcctggcccagggatgggcc

SEQ ID NO: 7682942 - DNA, 22 bp, Homo sapiens
ctgcctggcccagggatgggcc

SEQ ID NO: 7682943 - DNA, 22 bp, Homo sapiens
ctgcctggcccagggatgggcc

SEQ ID NO: 7682944 - DNA, 22 bp, Homo sapiens
ctgcctggcccagggatgggcc

SEQ ID NO: 7682945 - DNA, 22 bp, Homo sapiens
ctgcctggcccagggatgggcc

SEQ ID NO: 7682946 - DNA, 22 bp, Homo sapiens
ctgcctggcccagggatgggcc

SEQ ID NO: 7682947 - DNA, 22 bp, Homo sapiens
ctgcctggcccagggatgggcc

SEQ ID NO: 7682948 - DNA, 22 bp, Homo sapiens
ctgcctggcccagggatgggcc

SEQ ID NO: 7682949 - DNA, 22 bp, Homo sapiens
ctgcctggcctgatctccacgc

SEQ ID NO: 7682950 - DNA, 22 bp, Homo sapiens
ctgcctgggccatgcccagtcc

SEQ ID NO: 7682951 - DNA, 22 bp, Homo sapiens
ctgcctggctaaactcaagtcg

SEQ ID NO: 7682952 - DNA, 22 bp, Homo sapiens
ctgcctggcctgatctccacgc

SEQ ID NO: 7682953 - DNA, 22 bp, Homo sapiens
ctgcctggcctgatctccacgc

SEQ ID NO: 7682954 - DNA, 22 bp, Homo sapiens
ctgcctggcctgatctccacgc

SEQ ID NO: 7682955 - DNA, 22 bp, Homo sapiens
ctgcctggctaaactcaagtcg

SEQ ID NO: 7682956 - DNA, 22 bp, Homo sapiens
ctgcctggctaaactcaagtcg

SEQ ID NO: 7682957 - DNA, 22 bp, Homo sapiens
ctgctttatattgagcttgaaa

SEQ ID NO: 7682958 - DNA, 22 bp, Homo sapiens
ctgctttatagggcttccatgt

SEQ ID NO: 7682959 - DNA, 22 bp, Homo sapiens
ctgctttatagggcttccatgt

SEQ ID NO: 7682960 - DNA, 22 bp, Homo sapiens
ctgctttatctgagacaagtca

SEQ ID NO: 7682961 - DNA, 22 bp, Homo sapiens
ctgctttatctgagacaagtca

SEQ ID NO: 7682962 - DNA, 22 bp, Homo sapiens
ctgctttatctgagacaagtca

SEQ ID NO: 7682963 - DNA, 22 bp, Homo sapiens
ctgctttatattgagcttgaaa

SEQ ID NO: 7682964 - DNA, 22 bp, Homo sapiens
ctgctttatattgagcttgaaa

SEQ ID NO: 7682965 - DNA, 23 bp, Homo sapiens
ctgctttcccactccatgctctt

SEQ ID NO: 7682966 - DNA, 22 bp, Homo sapiens
ctgctttatctgagacaagtca

SEQ ID NO: 7682967 - DNA, 23 bp, Homo sapiens
ctgctttcccactccatgctctt

SEQ ID NO: 7682968 - DNA, 23 bp, Homo sapiens
ctgctttcccactccatgctctt

SEQ ID NO: 7682969 - DNA, 23 bp, Homo sapiens
ctgctttcccactccatgctctt

SEQ ID NO: 7682970 - DNA, 22 bp, Homo sapiens
ctgctttagctagtgctcttag

SEQ ID NO: 7682971 - DNA, 19 bp, Homo sapiens
ctgctttaggccttaaaag

SEQ ID NO: 7682972 - DNA, 19 bp, Homo sapiens
ctgctttaggccttaaaag

SEQ ID NO: 7682973 - DNA, 22 bp, Homo sapiens
ctgctttaggtggaatgttcta

SEQ ID NO: 7682974 - DNA, 22 bp, Homo sapiens
ctgctttaggtggaatgttcta

SEQ ID NO: 7682975 - DNA, 22 bp, Homo sapiens
ctgctttaggtggaatgttcta

SEQ ID NO: 7682976 - DNA, 22 bp, Homo sapiens
ctgctttaggtggaatgttcta

SEQ ID NO: 7682977 - DNA, 22 bp, Homo sapiens
ctgctttaggtggaatgttcta

SEQ ID NO: 7682978 - DNA, 22 bp, Homo sapiens
ctgctttagtgtggtgttagag

SEQ ID NO: 7682979 - DNA, 22 bp, Homo sapiens
ctgctttatagggcttccatgt

SEQ ID NO: 7682980 - DNA, 22 bp, Homo sapiens
ctgctttatagggcttccatgt

SEQ ID NO: 7682981 - DNA, 22 bp, Homo sapiens
ctgctttatagggcttccatgt

SEQ ID NO: 7682982 - DNA, 22 bp, Homo sapiens
ctgctttaggtggaatgttcta

SEQ ID NO: 7682983 - DNA, 22 bp, Homo sapiens
ctgctttagtgtggtgttagag

SEQ ID NO: 7682984 - DNA, 22 bp, Homo sapiens
ctgctttagtgtggtgttagag

SEQ ID NO: 7682985 - DNA, 22 bp, Homo sapiens
ctgcttctaagaacctgcagct

SEQ ID NO: 7682986 - DNA, 22 bp, Homo sapiens
ctgcttctaagaacctgcagct

SEQ ID NO: 7682987 - DNA, 22 bp, Homo sapiens
ctgctttaccaaactcttggat

SEQ ID NO: 7682988 - DNA, 22 bp, Homo sapiens
ctgctttactcatagggtttca

SEQ ID NO: 7682989 - DNA, 22 bp, Homo sapiens
ctgctttactcatagggtttca

SEQ ID NO: 7682990 - DNA, 21 bp, Homo sapiens
ctgctttacttcagaggatct

SEQ ID NO: 7682991 - DNA, 21 bp, Homo sapiens
ctgctttacttcagaggatct

SEQ ID NO: 7682992 - DNA, 21 bp, Homo sapiens
ctgctttacttcagaggatct

SEQ ID NO: 7682993 - DNA, 21 bp, Homo sapiens
ctgctttacttcagaggatct

SEQ ID NO: 7682994 - DNA, 22 bp, Homo sapiens
ctgctttagacaactgctggga

SEQ ID NO: 7682995 - DNA, 22 bp, Homo sapiens
ctgctttagacaactgctggga

SEQ ID NO: 7682996 - DNA, 21 bp, Homo sapiens
ctgctttacttcagaggatct

SEQ ID NO: 7682997 - DNA, 21 bp, Homo sapiens
ctgctttacttcagaggatct

SEQ ID NO: 7682998 - DNA, 21 bp, Homo sapiens
ctgctttacttcagaggatct

SEQ ID NO: 7682999 - DNA, 22 bp, Homo sapiens
ctgctttagacggctttcgctg

SEQ ID NO: 7683000 - DNA, 22 bp, Homo sapiens
ctgctttagacaactgctggga

SEQ ID NO: 7683001 - DNA, 22 bp, Homo sapiens
ctgctttagacggctttcgctg

SEQ ID NO: 7683002 - DNA, 22 bp, Homo sapiens
ctgctttagagctgagcctcag

SEQ ID NO: 7683003 - DNA, 22 bp, Homo sapiens
ctgctttagagctgagcctcag

SEQ ID NO: 7683004 - DNA, 22 bp, Homo sapiens
ctgctttagctagtgctcttag

SEQ ID NO: 7683005 - DNA, 22 bp, Homo sapiens
ctgcctggccacaacccagggt

SEQ ID NO: 7683006 - DNA, 22 bp, Homo sapiens
ctgcctggccacaacccagggt

SEQ ID NO: 7683007 - DNA, 22 bp, Homo sapiens
ctgcctggcatggagaagagaa

SEQ ID NO: 7683008 - DNA, 22 bp, Homo sapiens
ctgcctggcatggagaagagaa

SEQ ID NO: 7683009 - DNA, 22 bp, Homo sapiens
ctgcctggcatggagaagagaa

SEQ ID NO: 7683010 - DNA, 22 bp, Homo sapiens
ctgcctggccacaacccagggt

SEQ ID NO: 7683011 - DNA, 22 bp, Homo sapiens
ctgcctggccacaacccagggt

SEQ ID NO: 7683012 - DNA, 22 bp, Homo sapiens
ctgcctggccacaacccagggt

SEQ ID NO: 7683013 - DNA, 22 bp, Homo sapiens
ctgcctggccacaacccagggt

SEQ ID NO: 7683014 - DNA, 22 bp, Homo sapiens
ctgcctggcatagtctggtcga

SEQ ID NO: 7683015 - DNA, 22 bp, Homo sapiens
ctgcctggcatagtctggtcga

SEQ ID NO: 7683016 - DNA, 22 bp, Homo sapiens
ctgcctggcatagtctggtcga

SEQ ID NO: 7683017 - DNA, 22 bp, Homo sapiens
ctgcctggcatagtctggtcga

SEQ ID NO: 7683018 - DNA, 22 bp, Homo sapiens
ctgcctggcatagtctggtcga

SEQ ID NO: 7683019 - DNA, 22 bp, Homo sapiens
ctgcctggcatggagaagagaa

SEQ ID NO: 7683020 - DNA, 22 bp, Homo sapiens
ctgcctggcatggagaagagaa

SEQ ID NO: 7683021 - DNA, 22 bp, Homo sapiens
ctgcctggcatggagaagagaa

SEQ ID NO: 7683022 - DNA, 22 bp, Homo sapiens
ctgcctggcatggagaagagaa

SEQ ID NO: 7683023 - DNA, 22 bp, Homo sapiens
ctgcctggcatggagaagagaa

SEQ ID NO: 7683024 - DNA, 17 bp, Homo sapiens
ctgcctggagtcccatc

SEQ ID NO: 7683025 - DNA, 17 bp, Homo sapiens
ctgcctggagtcccatc

SEQ ID NO: 7683026 - DNA, 17 bp, Homo sapiens
ctgcctggagtcccatc

SEQ ID NO: 7683027 - DNA, 17 bp, Homo sapiens
ctgcctggagtcccatc

SEQ ID NO: 7683028 - DNA, 20 bp, Homo sapiens
ctgcctggaggcctctacct

SEQ ID NO: 7683029 - DNA, 20 bp, Homo sapiens
ctgcctggaggcctctacct

SEQ ID NO: 7683030 - DNA, 20 bp, Homo sapiens
ctgcctggaggcctctacct

SEQ ID NO: 7683031 - DNA, 20 bp, Homo sapiens
ctgcctggaggcctctacct

SEQ ID NO: 7683032 - DNA, 20 bp, Homo sapiens
ctgcctggaggcctctacct

SEQ ID NO: 7683033 - DNA, 20 bp, Homo sapiens
ctgcctggaggcctctacct

SEQ ID NO: 7683034 - DNA, 22 bp, Homo sapiens
ctgcctggatgaatggcgcctt

SEQ ID NO: 7683035 - DNA, 17 bp, Homo sapiens
ctgcctggagtcccatc

SEQ ID NO: 7683036 - DNA, 17 bp, Homo sapiens
ctgcctggagtcccatc

SEQ ID NO: 7683037 - DNA, 22 bp, Homo sapiens
ctgcctggatgaatggcgcctt

SEQ ID NO: 7683038 - DNA, 22 bp, Homo sapiens
ctgcctggatgaatggcgcctt

SEQ ID NO: 7683039 - DNA, 22 bp, Homo sapiens
ctgcctggatgaatggcgcctt

SEQ ID NO: 7683040 - DNA, 22 bp, Homo sapiens
ctgcctggatgaatggcgcctt

SEQ ID NO: 7683041 - DNA, 22 bp, Homo sapiens
ctgcctggatgaatggcgcctt

SEQ ID NO: 7683042 - DNA, 22 bp, Homo sapiens
ctgcctggatgaatggcgcctt

SEQ ID NO: 7683043 - DNA, 22 bp, Homo sapiens
ctgcctggatgaatggcgcctt

SEQ ID NO: 7683044 - DNA, 22 bp, Homo sapiens
ctgcctggaccggcagccctcc

SEQ ID NO: 7683045 - DNA, 22 bp, Homo sapiens
ctgcctggagcattctgaaggt

SEQ ID NO: 7683046 - DNA, 22 bp, Homo sapiens
ctgcctggagcattctgaaggt

SEQ ID NO: 7683047 - DNA, 22 bp, Homo sapiens
ctgcctggagcattctgaaggt

SEQ ID NO: 7683048 - DNA, 22 bp, Homo sapiens
ctgcctggagcattctgaaggt

SEQ ID NO: 7683049 - DNA, 22 bp, Homo sapiens
ctgcctggaccggcagccctcc

SEQ ID NO: 7683050 - DNA, 22 bp, Homo sapiens
ctgcctggaccggcagccctcc

SEQ ID NO: 7683051 - DNA, 22 bp, Homo sapiens
ctgcctggaccggcagccctcc

SEQ ID NO: 7683052 - DNA, 22 bp, Homo sapiens
ctgcctggaccggcagccctcc

SEQ ID NO: 7683053 - DNA, 22 bp, Homo sapiens
ctgcctggaccggcagccctcc

SEQ ID NO: 7683054 - DNA, 22 bp, Homo sapiens
ctgcctggacagctcttacctt

SEQ ID NO: 7683055 - DNA, 22 bp, Homo sapiens
ctgcctggaatgccagcttctc

SEQ ID NO: 7683056 - DNA, 22 bp, Homo sapiens
ctgcctggacagctcttacctt

SEQ ID NO: 7683057 - DNA, 22 bp, Homo sapiens
ctgcctggacagctcttacctt

SEQ ID NO: 7683058 - DNA, 22 bp, Homo sapiens
ctgcctgctctatccaggcctg

SEQ ID NO: 7683059 - DNA, 22 bp, Homo sapiens
ctgcctgctctatccaggcctg

SEQ ID NO: 7683060 - DNA, 22 bp, Homo sapiens
ctgcctgctctatccaggcctg

SEQ ID NO: 7683061 - DNA, 22 bp, Homo sapiens
ctgcctggaatgccagcttctc

SEQ ID NO: 7683062 - DNA, 22 bp, Homo sapiens
ctgcctggaatgccagcttctc

SEQ ID NO: 7683063 - DNA, 22 bp, Homo sapiens
ctgcctggaatgccagcttctc

SEQ ID NO: 7683064 - DNA, 22 bp, Homo sapiens
ctgcctggaatgccagcttctc

SEQ ID NO: 7683065 - DNA, 22 bp, Homo sapiens
ctgcctgctcaccagggctctg

SEQ ID NO: 7683066 - DNA, 22 bp, Homo sapiens
ctgcctgctcaccagggctctg

SEQ ID NO: 7683067 - DNA, 22 bp, Homo sapiens
ctgcctgctcaccagggctctg

SEQ ID NO: 7683068 - DNA, 22 bp, Homo sapiens
ctgcctgcgttgcctcgtgcct

SEQ ID NO: 7683069 - DNA, 22 bp, Homo sapiens
ctgcctgcgttgcctcgtgcct

SEQ ID NO: 7683070 - DNA, 22 bp, Homo sapiens
ctgcctgctacctgaaatgcca

SEQ ID NO: 7683071 - DNA, 22 bp, Homo sapiens
ctgcctgctacctgaaatgcca

SEQ ID NO: 7683072 - DNA, 22 bp, Homo sapiens
ctgcctgctcaccagggctctg

SEQ ID NO: 7683073 - DNA, 22 bp, Homo sapiens
ctggaccagcctccgccttcac

SEQ ID NO: 7683074 - DNA, 22 bp, Homo sapiens
ctggaccctgtttccctaggtc

SEQ ID NO: 7683075 - DNA, 22 bp, Homo sapiens
ctggactcactatggcttcaga

SEQ ID NO: 7683076 - DNA, 22 bp, Homo sapiens
ctggactaggcgctggcgggcg

SEQ ID NO: 7683077 - DNA, 22 bp, Homo sapiens
ctggaccctgtttccctaggtc

SEQ ID NO: 7683078 - DNA, 19 bp, Homo sapiens
ctggacctggaggcccgga

SEQ ID NO: 7683079 - DNA, 22 bp, Homo sapiens
ctggactaataacttcagtggg

SEQ ID NO: 7683080 - DNA, 23 bp, Homo sapiens
ctggactcaggggatgtgaagga

SEQ ID NO: 7683081 - DNA, 22 bp, Homo sapiens
ctggactaataacttcagtggg

SEQ ID NO: 7683082 - DNA, 22 bp, Homo sapiens
ctggactcactatggcttcaga

SEQ ID NO: 7683083 - DNA, 22 bp, Homo sapiens
ctggactcactatggcttcaga

SEQ ID NO: 7683084 - DNA, 22 bp, Homo sapiens
ctggaccagaaaggacatggct

SEQ ID NO: 7683085 - DNA, 22 bp, Homo sapiens
ctggacatcagtgtgcctggct

SEQ ID NO: 7683086 - DNA, 22 bp, Homo sapiens
ctggaccagaaaggacatggct

SEQ ID NO: 7683087 - DNA, 22 bp, Homo sapiens
ctggaccagaaaggacatggct

SEQ ID NO: 7683088 - DNA, 22 bp, Homo sapiens
ctggacagtgggcagaggagac

SEQ ID NO: 7683089 - DNA, 22 bp, Homo sapiens
ctggacagtgggcagaggagac

SEQ ID NO: 7683090 - DNA, 22 bp, Homo sapiens
ctggacagtgggcagaggagac

SEQ ID NO: 7683091 - DNA, 22 bp, Homo sapiens
ctggacagtgggcagaggagac

SEQ ID NO: 7683092 - DNA, 22 bp, Homo sapiens
ctggactctgcagagaaaagta

SEQ ID NO: 7683093 - DNA, 22 bp, Homo sapiens
ctggactcatccatagaggtga

SEQ ID NO: 7683094 - DNA, 22 bp, Homo sapiens
ctggactcatccatagaggtga

SEQ ID NO: 7683095 - DNA, 23 bp, Homo sapiens
ctggactcaggggatgtgaagga

SEQ ID NO: 7683096 - DNA, 22 bp, Homo sapiens
ctggactcagggtgctccagcg

SEQ ID NO: 7683097 - DNA, 22 bp, Homo sapiens
ctggactcagggtgctccagcg

SEQ ID NO: 7683098 - DNA, 22 bp, Homo sapiens
ctggactcagggtgctccagcg

SEQ ID NO: 7683099 - DNA, 22 bp, Homo sapiens
ctggactttggcccatctgcca

SEQ ID NO: 7683100 - DNA, 22 bp, Homo sapiens
ctggactttggcccatctgcca

SEQ ID NO: 7683101 - DNA, 20 bp, Homo sapiens
ctggacttgctgctcacctg

SEQ ID NO: 7683102 - DNA, 22 bp, Homo sapiens
ctggacttggagtcagaaaact

SEQ ID NO: 7683103 - DNA, 22 bp, Homo sapiens
ctggacttaggcaggcaccccg

SEQ ID NO: 7683104 - DNA, 22 bp, Homo sapiens
ctggaggaccacagaagctggt

SEQ ID NO: 7683105 - DNA, 22 bp, Homo sapiens
ctggaggaccacagaagctggt

SEQ ID NO: 7683106 - DNA, 22 bp, Homo sapiens
ctggaggaccacagaagctggt

SEQ ID NO: 7683107 - DNA, 22 bp, Homo sapiens
ctggaggaccacagaagctggt

SEQ ID NO: 7683108 - DNA, 22 bp, Homo sapiens
ctggaggaccacagaagctggt

SEQ ID NO: 7683109 - DNA, 22 bp, Homo sapiens
ctggaggacagaggccatgtct

SEQ ID NO: 7683110 - DNA, 22 bp, Homo sapiens
ctggaggacagaggccatgtct

SEQ ID NO: 7683111 - DNA, 22 bp, Homo sapiens
ctggaggacagaggccatgtct

SEQ ID NO: 7683112 - DNA, 22 bp, Homo sapiens
ctggaggacagaggccatgtct

SEQ ID NO: 7683113 - DNA, 22 bp, Homo sapiens
ctggaggacagaggccatgtct

SEQ ID NO: 7683114 - DNA, 22 bp, Homo sapiens
ctggaggaatcacagaaggctt

SEQ ID NO: 7683115 - DNA, 22 bp, Homo sapiens
ctggaggaatcacagaaggctt

SEQ ID NO: 7683116 - DNA, 22 bp, Homo sapiens
ctggaggaatcacagaaggctt

SEQ ID NO: 7683117 - DNA, 22 bp, Homo sapiens
ctggaggaatcacagaaggctt

SEQ ID NO: 7683118 - DNA, 22 bp, Homo sapiens
ctggaggaatcacagaaggctt

SEQ ID NO: 7683119 - DNA, 22 bp, Homo sapiens
ctggaggaatcacagaaggctt

SEQ ID NO: 7683120 - DNA, 22 bp, Homo sapiens
ctggaggaataatggcatcttg

SEQ ID NO: 7683121 - DNA, 22 bp, Homo sapiens
ctggaggaataatggcatcttg

SEQ ID NO: 7683122 - DNA, 22 bp, Homo sapiens
ctggaggaataatctcctaccc

SEQ ID NO: 7683123 - DNA, 22 bp, Homo sapiens
ctggaggaataatggcatcttg

SEQ ID NO: 7683124 - DNA, 22 bp, Homo sapiens
ctggaggaataatggcatcttg

SEQ ID NO: 7683125 - DNA, 22 bp, Homo sapiens
ctggaggaataatggcatcttg

SEQ ID NO: 7683126 - DNA, 22 bp, Homo sapiens
ctggaggaataatggcatcttg

SEQ ID NO: 7683127 - DNA, 22 bp, Homo sapiens
ctggaggaataatggcatcttg

SEQ ID NO: 7683128 - DNA, 22 bp, Homo sapiens
ctggaggaataatctcctaccc

SEQ ID NO: 7683129 - DNA, 22 bp, Homo sapiens
ctggagctcttctgagtgtgct

SEQ ID NO: 7683130 - DNA, 22 bp, Homo sapiens
ctggagctcttctgagtgtgct

SEQ ID NO: 7683131 - DNA, 22 bp, Homo sapiens
ctggagctcttctgagtgtgct

SEQ ID NO: 7683132 - DNA, 22 bp, Homo sapiens
ctggagctcttctgagtgtgct

SEQ ID NO: 7683133 - DNA, 22 bp, Homo sapiens
ctggagctctccagagccccgt

SEQ ID NO: 7683134 - DNA, 22 bp, Homo sapiens
ctggaggagagtctgaatgaca

SEQ ID NO: 7683135 - DNA, 22 bp, Homo sapiens
ctggaggagaacttgaggaagg

SEQ ID NO: 7683136 - DNA, 22 bp, Homo sapiens
ctggaggagaacttgaggaagg

SEQ ID NO: 7683137 - DNA, 22 bp, Homo sapiens
ctggaggagaacttgaggaagg

SEQ ID NO: 7683138 - DNA, 22 bp, Homo sapiens
ctggaggagagtctgaatgaca

SEQ ID NO: 7683139 - DNA, 22 bp, Homo sapiens
ctggaggagagtctgaatgaca

SEQ ID NO: 7683140 - DNA, 22 bp, Homo sapiens
ctggaggagagtctgaatgaca

SEQ ID NO: 7683141 - DNA, 22 bp, Homo sapiens
ctggaggagagtctgaatgaca

SEQ ID NO: 7683142 - DNA, 22 bp, Homo sapiens
ctggaggagcaatatggttagg

SEQ ID NO: 7683143 - DNA, 22 bp, Homo sapiens
ctggaggaccacagaagctggt

SEQ ID NO: 7683144 - DNA, 22 bp, Homo sapiens
ctggaggacccctgcctggaag

SEQ ID NO: 7683145 - DNA, 22 bp, Homo sapiens
ctggaggagaacttgaggaagg

SEQ ID NO: 7683146 - DNA, 22 bp, Homo sapiens
ctggaggacccctgcctggaag

SEQ ID NO: 7683147 - DNA, 22 bp, Homo sapiens
ctggaggacccctgcctggaag

SEQ ID NO: 7683148 - DNA, 22 bp, Homo sapiens
ctggaggacccctgcctggaag

SEQ ID NO: 7683149 - DNA, 22 bp, Homo sapiens
ctggaggacccctgcctggaag

SEQ ID NO: 7683150 - DNA, 22 bp, Homo sapiens
ctggaggcaaagcagaggcatg

SEQ ID NO: 7683151 - DNA, 22 bp, Homo sapiens
ctggaggcaaagcagaggcatg

SEQ ID NO: 7683152 - DNA, 22 bp, Homo sapiens
ctggaggcacccttagagaggc

SEQ ID NO: 7683153 - DNA, 22 bp, Homo sapiens
ctggaggcacccttagagaggc

SEQ ID NO: 7683154 - DNA, 22 bp, Homo sapiens
ctggaggcacccttagagaggc

SEQ ID NO: 7683155 - DNA, 22 bp, Homo sapiens
ctggaggcaaagcagaggcatg

SEQ ID NO: 7683156 - DNA, 22 bp, Homo sapiens
ctggaggcaaagcagaggcatg

SEQ ID NO: 7683157 - DNA, 22 bp, Homo sapiens
ctggaggcaaagcagaggcatg

SEQ ID NO: 7683158 - DNA, 22 bp, Homo sapiens
ctggaggagcatggactggagt

SEQ ID NO: 7683159 - DNA, 22 bp, Homo sapiens
ctggaggagcatggactggagt

SEQ ID NO: 7683160 - DNA, 22 bp, Homo sapiens
ctggaggagcatggactggagt

SEQ ID NO: 7683161 - DNA, 22 bp, Homo sapiens
ctggaggagcaatatggttagg

SEQ ID NO: 7683162 - DNA, 22 bp, Homo sapiens
ctggaggagcatggactggagt

SEQ ID NO: 7683163 - DNA, 22 bp, Homo sapiens
ctggaggagcatggactggagt

SEQ ID NO: 7683164 - DNA, 22 bp, Homo sapiens
ctggaggaggaagtctacaatg

SEQ ID NO: 7683165 - DNA, 22 bp, Homo sapiens
ctggaggaggaagtctacaatg

SEQ ID NO: 7683166 - DNA, 22 bp, Homo sapiens
ctggaggcaaagcagaggcatg

SEQ ID NO: 7683167 - DNA, 22 bp, Homo sapiens
ctggaggcaaagcagaggcatg

SEQ ID NO: 7683168 - DNA, 22 bp, Homo sapiens
ctggaggcaaagcagaggcatg

SEQ ID NO: 7683169 - DNA, 22 bp, Homo sapiens
ctggaggcaaagcagaggcatg

SEQ ID NO: 7683170 - DNA, 22 bp, Homo sapiens
ctggaggaggaagtctacaatg

SEQ ID NO: 7683171 - DNA, 22 bp, Homo sapiens
ctggaggctggcttcccctggc

SEQ ID NO: 7683172 - DNA, 22 bp, Homo sapiens
ctggaggctggcttcccctggc

SEQ ID NO: 7683173 - DNA, 22 bp, Homo sapiens
ctggagggacaaggtatgcatt

SEQ ID NO: 7683174 - DNA, 22 bp, Homo sapiens
ctggagggacaaggtatgcatt

SEQ ID NO: 7683175 - DNA, 22 bp, Homo sapiens
ctggagggacaaggtatgcatt

SEQ ID NO: 7683176 - DNA, 22 bp, Homo sapiens
ctggaggctgagttgggtctcc

SEQ ID NO: 7683177 - DNA, 22 bp, Homo sapiens
ctggaggctggcttcccctggc

SEQ ID NO: 7683178 - DNA, 22 bp, Homo sapiens
ctggaggctggcttcccctggc

SEQ ID NO: 7683179 - DNA, 22 bp, Homo sapiens
ctggaggctggcttcccctggc

SEQ ID NO: 7683180 - DNA, 22 bp, Homo sapiens
ctggaggccactgtacagattg

SEQ ID NO: 7683181 - DNA, 22 bp, Homo sapiens
ctggaggctgagttgggtctcc

SEQ ID NO: 7683182 - DNA, 22 bp, Homo sapiens
ctggaggcagttgccccagtca

SEQ ID NO: 7683183 - DNA, 22 bp, Homo sapiens
ctggaggctgagttgggtctcc

SEQ ID NO: 7683184 - DNA, 22 bp, Homo sapiens
ctggaggctgagttgggtctcc

SEQ ID NO: 7683185 - DNA, 22 bp, Homo sapiens
ctggaggcagttgccccagtca

SEQ ID NO: 7683186 - DNA, 22 bp, Homo sapiens
ctggaggcagttgccccagtca

SEQ ID NO: 7683187 - DNA, 21 bp, Homo sapiens
ctggaggcaggtggtgccagg

SEQ ID NO: 7683188 - DNA, 21 bp, Homo sapiens
ctggaggcaggtggtgccagg

SEQ ID NO: 7683189 - DNA, 21 bp, Homo sapiens
ctggaggcaggtggtgccagg

SEQ ID NO: 7683190 - DNA, 21 bp, Homo sapiens
ctggaggcaggtggtgccagg

SEQ ID NO: 7683191 - DNA, 21 bp, Homo sapiens
ctggaggcaggtggtgccagg

SEQ ID NO: 7683192 - DNA, 21 bp, Homo sapiens
ctggaggcaggtggtgccagg

SEQ ID NO: 7683193 - DNA, 22 bp, Homo sapiens
ctggaggcacccttagagaggc

SEQ ID NO: 7683194 - DNA, 22 bp, Homo sapiens
ctggaggcacccttagagaggc

SEQ ID NO: 7683195 - DNA, 22 bp, Homo sapiens
ctggaggcacccttagagaggc

SEQ ID NO: 7683196 - DNA, 21 bp, Homo sapiens
ctggaggcaggtggtgccagg

SEQ ID NO: 7683197 - DNA, 21 bp, Homo sapiens
ctggaggcaggtggtgccagg

SEQ ID NO: 7683198 - DNA, 21 bp, Homo sapiens
ctggaggcaggtggtgccagg

SEQ ID NO: 7683199 - DNA, 21 bp, Homo sapiens
ctggaggcaggtggtgccagg

SEQ ID NO: 7683200 - DNA, 21 bp, Homo sapiens
ctggaggcaggtggtgccagg

SEQ ID NO: 7683201 - DNA, 21 bp, Homo sapiens
ctggaggcaggtggtgccagg

SEQ ID NO: 7683202 - DNA, 22 bp, Homo sapiens
ctggagtttttggccataacgt

SEQ ID NO: 7683203 - DNA, 22 bp, Homo sapiens
ctggagttttggaaaaatgctt

SEQ ID NO: 7683204 - DNA, 22 bp, Homo sapiens
ctggagtttgtggcttgctcaa

SEQ ID NO: 7683205 - DNA, 22 bp, Homo sapiens
ctggagttgggatgtgcctgga

SEQ ID NO: 7683206 - DNA, 22 bp, Homo sapiens
ctggagttgggatgtgcctgga

SEQ ID NO: 7683207 - DNA, 22 bp, Homo sapiens
ctggagttgggatgtgcctgga

SEQ ID NO: 7683208 - DNA, 22 bp, Homo sapiens
ctggagtttgtggcttgctcaa

SEQ ID NO: 7683209 - DNA, 22 bp, Homo sapiens
ctggagtttgcggggacagaga

SEQ ID NO: 7683210 - DNA, 22 bp, Homo sapiens
ctggagttcgactgagttgaat

SEQ ID NO: 7683211 - DNA, 22 bp, Homo sapiens
ctggagttctatgtgcttgtga

SEQ ID NO: 7683212 - DNA, 22 bp, Homo sapiens
ctggagttctatgtgcttgtga

SEQ ID NO: 7683213 - DNA, 22 bp, Homo sapiens
ctggagttcttgttttgcctac

SEQ ID NO: 7683214 - DNA, 22 bp, Homo sapiens
ctggagttcagtggcgtgaaca

SEQ ID NO: 7683215 - DNA, 22 bp, Homo sapiens
ctggagttagagtagacactga

SEQ ID NO: 7683216 - DNA, 22 bp, Homo sapiens
ctggagttagagtagacactga

SEQ ID NO: 7683217 - DNA, 22 bp, Homo sapiens
ctggagtgttatggtcaagtca

SEQ ID NO: 7683218 - DNA, 22 bp, Homo sapiens
ctggagtgttatggtcaagtca

SEQ ID NO: 7683219 - DNA, 20 bp, Homo sapiens
ctggagtgtagcagtggctg

SEQ ID NO: 7683220 - DNA, 20 bp, Homo sapiens
ctggagtgtagcagtggctg

SEQ ID NO: 7683221 - DNA, 20 bp, Homo sapiens
ctggagtgtagcagtggctg

SEQ ID NO: 7683222 - DNA, 20 bp, Homo sapiens
ctggagtgtagcagtggctg

SEQ ID NO: 7683223 - DNA, 22 bp, Homo sapiens
ctggagtgtaaagagcatagaa

SEQ ID NO: 7683224 - DNA, 22 bp, Homo sapiens
ctggagtgtaaagagcatagaa

SEQ ID NO: 7683225 - DNA, 20 bp, Homo sapiens
ctggagtgtagcagtggctg

SEQ ID NO: 7683226 - DNA, 22 bp, Homo sapiens
ctggagtctcttctgtagctac

SEQ ID NO: 7683227 - DNA, 22 bp, Homo sapiens
ctggagtctcttctgtagctac

SEQ ID NO: 7683228 - DNA, 20 bp, Homo sapiens
ctggagtctaggagtactgg

SEQ ID NO: 7683229 - DNA, 22 bp, Homo sapiens
ctggagtctccccaggagcgtg

SEQ ID NO: 7683230 - DNA, 22 bp, Homo sapiens
ctggagtgtaaagagcatagaa

SEQ ID NO: 7683231 - DNA, 22 bp, Homo sapiens
ctggagtgtaaagagcatagaa

SEQ ID NO: 7683232 - DNA, 22 bp, Homo sapiens
ctggagtgtaaagagcatagaa

SEQ ID NO: 7683233 - DNA, 22 bp, Homo sapiens
ctggagtctccccaggagcgtg

SEQ ID NO: 7683234 - DNA, 22 bp, Homo sapiens
ctggaggtgggggcaagagtgt

SEQ ID NO: 7683235 - DNA, 22 bp, Homo sapiens
ctggaggtgggggcaagagtgt

SEQ ID NO: 7683236 - DNA, 22 bp, Homo sapiens
ctggaggtgcttcgctggccac

SEQ ID NO: 7683237 - DNA, 22 bp, Homo sapiens
ctggaggtgcttcgctggccac

SEQ ID NO: 7683238 - DNA, 22 bp, Homo sapiens
ctggaggtgcctagatgagctc

SEQ ID NO: 7683239 - DNA, 22 bp, Homo sapiens
ctggaggtctacagtggtagct

SEQ ID NO: 7683240 - DNA, 22 bp, Homo sapiens
ctggaggtgcctagatgagctc

SEQ ID NO: 7683241 - DNA, 22 bp, Homo sapiens
ctggaggtgcctagatgagctc

SEQ ID NO: 7683242 - DNA, 22 bp, Homo sapiens
ctggaggtgcctagatgagctc

SEQ ID NO: 7683243 - DNA, 22 bp, Homo sapiens
ctggaggtgggggcaagagtgt

SEQ ID NO: 7683244 - DNA, 22 bp, Homo sapiens
ctggaggttgggtccaggccag

SEQ ID NO: 7683245 - DNA, 22 bp, Homo sapiens
ctggaggttgggtccaggccag

SEQ ID NO: 7683246 - DNA, 22 bp, Homo sapiens
ctggaggtgggggcaagagtgt

SEQ ID NO: 7683247 - DNA, 22 bp, Homo sapiens
ctggaggtttattattttagat

SEQ ID NO: 7683248 - DNA, 22 bp, Homo sapiens
ctggagtagccggacgggtctg

SEQ ID NO: 7683249 - DNA, 22 bp, Homo sapiens
ctggagtagccggacgggtctg

SEQ ID NO: 7683250 - DNA, 22 bp, Homo sapiens
ctggagtcacacacaccaaggt

SEQ ID NO: 7683251 - DNA, 18 bp, Homo sapiens
ctggagtcacagtgggga

SEQ ID NO: 7683252 - DNA, 18 bp, Homo sapiens
ctggagtcacagtgggga

SEQ ID NO: 7683253 - DNA, 22 bp, Homo sapiens
ctggagtcactcatgtagctgc

SEQ ID NO: 7683254 - DNA, 22 bp, Homo sapiens
ctggagtcagcaaggacgaggc

SEQ ID NO: 7683255 - DNA, 22 bp, Homo sapiens
ctggagtcactcatgtagctgc

SEQ ID NO: 7683256 - DNA, 22 bp, Homo sapiens
ctggagtcactcatgtagctgc

SEQ ID NO: 7683257 - DNA, 22 bp, Homo sapiens
ctggagtctccccaggagcgtg

SEQ ID NO: 7683258 - DNA, 20 bp, Homo sapiens
ctggagtctaggagtactgg

SEQ ID NO: 7683259 - DNA, 21 bp, Homo sapiens
ctggagtcattttctgagtag

SEQ ID NO: 7683260 - DNA, 21 bp, Homo sapiens
ctggagtcattttctgagtag

SEQ ID NO: 7683261 - DNA, 22 bp, Homo sapiens
ctggagtcagcaaggacgaggc

SEQ ID NO: 7683262 - DNA, 22 bp, Homo sapiens
ctggaggtcatgtaatatggaa

SEQ ID NO: 7683263 - DNA, 22 bp, Homo sapiens
ctggaggtctacagtggtagct

SEQ ID NO: 7683264 - DNA, 22 bp, Homo sapiens
ctggaggtctacagtggtagct

SEQ ID NO: 7683265 - DNA, 22 bp, Homo sapiens
ctggaggtctacagtggtagct

SEQ ID NO: 7683266 - DNA, 22 bp, Homo sapiens
ctggaggtctacagtggtagct

SEQ ID NO: 7683267 - DNA, 22 bp, Homo sapiens
ctggaggtagatggtggtaatg

SEQ ID NO: 7683268 - DNA, 19 bp, Homo sapiens
ctggaggtagagggttagt

SEQ ID NO: 7683269 - DNA, 22 bp, Homo sapiens
ctggaggtcaagtccccccttg

SEQ ID NO: 7683270 - DNA, 22 bp, Homo sapiens
ctggaggtcacccttagaacat

SEQ ID NO: 7683271 - DNA, 22 bp, Homo sapiens
ctggaggtcacccttagaacat

SEQ ID NO: 7683272 - DNA, 22 bp, Homo sapiens
ctggaggtaagaggccctgggc

SEQ ID NO: 7683273 - DNA, 22 bp, Homo sapiens
ctggaggtaagaggccctgggc

SEQ ID NO: 7683274 - DNA, 22 bp, Homo sapiens
ctggagggtggagagaagtctc

SEQ ID NO: 7683275 - DNA, 22 bp, Homo sapiens
ctggaggtaagaggccctgggc

SEQ ID NO: 7683276 - DNA, 22 bp, Homo sapiens
ctggaggtaatgttatttttgt

SEQ ID NO: 7683277 - DNA, 19 bp, Homo sapiens
ctggaggtagagggttagt

SEQ ID NO: 7683278 - DNA, 19 bp, Homo sapiens
ctggaggtagagggttagt

SEQ ID NO: 7683279 - DNA, 22 bp, Homo sapiens
ctggagggtgagcctcatctct

SEQ ID NO: 7683280 - DNA, 22 bp, Homo sapiens
ctggagggtggagagaagtctc

SEQ ID NO: 7683281 - DNA, 22 bp, Homo sapiens
ctggagggtggagagaagtctc

SEQ ID NO: 7683282 - DNA, 22 bp, Homo sapiens
ctggagggtggagagaagtctc

SEQ ID NO: 7683283 - DNA, 22 bp, Homo sapiens
ctggagggtggagagaagtctc

SEQ ID NO: 7683284 - DNA, 21 bp, Homo sapiens
ctggagggtagagttgggctg

SEQ ID NO: 7683285 - DNA, 21 bp, Homo sapiens
ctggagggtagagttgggctg

SEQ ID NO: 7683286 - DNA, 21 bp, Homo sapiens
ctggagggtagagttgggctg

SEQ ID NO: 7683287 - DNA, 21 bp, Homo sapiens
ctggagggtagagttgggctg

SEQ ID NO: 7683288 - DNA, 21 bp, Homo sapiens
ctggagggtagagttgggctg

SEQ ID NO: 7683289 - DNA, 21 bp, Homo sapiens
ctggagggtagagttgggctg

SEQ ID NO: 7683290 - DNA, 22 bp, Homo sapiens
ctggagggtgagcctcatctct

SEQ ID NO: 7683291 - DNA, 22 bp, Homo sapiens
ctggagggtgagcctcatctct

SEQ ID NO: 7683292 - DNA, 22 bp, Homo sapiens
ctggagggtgagcctcatctct

SEQ ID NO: 7683293 - DNA, 22 bp, Homo sapiens
ctggagggggaaatgttcattg

SEQ ID NO: 7683294 - DNA, 22 bp, Homo sapiens
ctggagggggaaatgttcattg

SEQ ID NO: 7683295 - DNA, 22 bp, Homo sapiens
ctggagggggaaatgttcattg

SEQ ID NO: 7683296 - DNA, 22 bp, Homo sapiens
ctggagggggaaatgttcattg

SEQ ID NO: 7683297 - DNA, 21 bp, Homo sapiens
ctggagggtagagttgggctg

SEQ ID NO: 7683298 - DNA, 21 bp, Homo sapiens
ctggagggtagagttgggctg

SEQ ID NO: 7683299 - DNA, 21 bp, Homo sapiens
ctggagggtagagttgggctg

SEQ ID NO: 7683300 - DNA, 21 bp, Homo sapiens
ctggagggtagagttgggctg

SEQ ID NO: 7683301 - DNA, 22 bp, Homo sapiens
ctggaggggccatccacagtct

SEQ ID NO: 7683302 - DNA, 22 bp, Homo sapiens
ctggaggggccatccacagtct

SEQ ID NO: 7683303 - DNA, 22 bp, Homo sapiens
ctggaggggccatccacagtct

SEQ ID NO: 7683304 - DNA, 22 bp, Homo sapiens
ctggaggggccatccacagtct

SEQ ID NO: 7683305 - DNA, 22 bp, Homo sapiens
ctggaggggccatccacagtct

SEQ ID NO: 7683306 - DNA, 22 bp, Homo sapiens
ctggaggggccatccacagtct

SEQ ID NO: 7683307 - DNA, 22 bp, Homo sapiens
ctggagggcttctgcaggttac

SEQ ID NO: 7683308 - DNA, 22 bp, Homo sapiens
ctggagggcttctgcaggttac

SEQ ID NO: 7683309 - DNA, 22 bp, Homo sapiens
ctggagggcttctgcaggttac

SEQ ID NO: 7683310 - DNA, 22 bp, Homo sapiens
ctggagggcttctgcaggttac

SEQ ID NO: 7683311 - DNA, 22 bp, Homo sapiens
ctggaggggctggcatggtagc

SEQ ID NO: 7683312 - DNA, 22 bp, Homo sapiens
ctggaggggctggcatggtagc

SEQ ID NO: 7683313 - DNA, 22 bp, Homo sapiens
ctggaggggctggcatggtagc

SEQ ID NO: 7683314 - DNA, 22 bp, Homo sapiens
ctggaggggctggcatggtagc

SEQ ID NO: 7683315 - DNA, 22 bp, Homo sapiens
ctggaggggctggcatggtagc

SEQ ID NO: 7683316 - DNA, 22 bp, Homo sapiens
ctggaggggctggcatggtagc

SEQ ID NO: 7683317 - DNA, 22 bp, Homo sapiens
ctggaggggctggcatggtagc

SEQ ID NO: 7683318 - DNA, 22 bp, Homo sapiens
ctggaggggctggcatggtagc

SEQ ID NO: 7683319 - DNA, 22 bp, Homo sapiens
ctggagggctggactaaggaaa

SEQ ID NO: 7683320 - DNA, 22 bp, Homo sapiens
ctggagggcttctgcaggttac

SEQ ID NO: 7683321 - DNA, 22 bp, Homo sapiens
ctggagggctggactaaggaaa

SEQ ID NO: 7683322 - DNA, 22 bp, Homo sapiens
ctggagggcttctgcaggttac

SEQ ID NO: 7683323 - DNA, 22 bp, Homo sapiens
ctggagggcttctgcaggttac

SEQ ID NO: 7683324 - DNA, 22 bp, Homo sapiens
ctggagggcttctgcaggttac

SEQ ID NO: 7683325 - DNA, 22 bp, Homo sapiens
ctggagggctggactaaggaaa

SEQ ID NO: 7683326 - DNA, 22 bp, Homo sapiens
ctggagggctggactaaggaaa

SEQ ID NO: 7683327 - DNA, 22 bp, Homo sapiens
ctggagggctggactaaggaaa

SEQ ID NO: 7683328 - DNA, 22 bp, Homo sapiens
ctggagggagattcaaaggagg

SEQ ID NO: 7683329 - DNA, 22 bp, Homo sapiens
ctggagggagattcaaaggagg

SEQ ID NO: 7683330 - DNA, 22 bp, Homo sapiens
ctggagggactttctcacggat

SEQ ID NO: 7683331 - DNA, 22 bp, Homo sapiens
ctggagggactttctcacggat

SEQ ID NO: 7683332 - DNA, 22 bp, Homo sapiens
ctggagggactttctcacggat

SEQ ID NO: 7683333 - DNA, 22 bp, Homo sapiens
ctggagggactttctcacggat

SEQ ID NO: 7683334 - DNA, 22 bp, Homo sapiens
ctggagggacaaggtatgcatt

SEQ ID NO: 7683335 - DNA, 22 bp, Homo sapiens
ctggagggacaaggtatgcatt

SEQ ID NO: 7683336 - DNA, 22 bp, Homo sapiens
ctggagggactttctcacggat

SEQ ID NO: 7683337 - DNA, 22 bp, Homo sapiens
ctggagggactttctcacggat

SEQ ID NO: 7683338 - DNA, 22 bp, Homo sapiens
ctggcaagtactgggccagctc

SEQ ID NO: 7683339 - DNA, 22 bp, Homo sapiens
ctggcacatagtcagcactcaa

SEQ ID NO: 7683340 - DNA, 22 bp, Homo sapiens
ctggcacatagtcagcactcaa

SEQ ID NO: 7683341 - DNA, 22 bp, Homo sapiens
ctggcacatagtcagcactcaa

SEQ ID NO: 7683342 - DNA, 22 bp, Homo sapiens
ctggcacatagtcagcactcaa

SEQ ID NO: 7683343 - DNA, 22 bp, Homo sapiens
ctggcacatagtcagcactcaa

SEQ ID NO: 7683344 - DNA, 22 bp, Homo sapiens
ctggcacatcactcctagttta

SEQ ID NO: 7683345 - DNA, 22 bp, Homo sapiens
ctggcacatagtcagcactcaa

SEQ ID NO: 7683346 - DNA, 22 bp, Homo sapiens
ctggcacatagtcagcactcaa

SEQ ID NO: 7683347 - DNA, 22 bp, Homo sapiens
ctggcacatagtcagcactcaa

SEQ ID NO: 7683348 - DNA, 22 bp, Homo sapiens
ctggcacatagtcagcactcaa

SEQ ID NO: 7683349 - DNA, 22 bp, Homo sapiens
ctggcacatgtgagccacatca

SEQ ID NO: 7683350 - DNA, 22 bp, Homo sapiens
ctggcacatgtgagccacatca

SEQ ID NO: 7683351 - DNA, 22 bp, Homo sapiens
ctggcacatgtgagccacatca

SEQ ID NO: 7683352 - DNA, 22 bp, Homo sapiens
ctggcacatgtgagccacatca

SEQ ID NO: 7683353 - DNA, 22 bp, Homo sapiens
ctggcacatgtgagccacatca

SEQ ID NO: 7683354 - DNA, 22 bp, Homo sapiens
ctggcacatgtgagccacatca

SEQ ID NO: 7683355 - DNA, 22 bp, Homo sapiens
ctggcacatgctccctgagtgg

SEQ ID NO: 7683356 - DNA, 22 bp, Homo sapiens
ctggcacatcactcctagttta

SEQ ID NO: 7683357 - DNA, 22 bp, Homo sapiens
ctggcacatcactcctagttta

SEQ ID NO: 7683358 - DNA, 22 bp, Homo sapiens
ctggcacatgctccctgagtgg

SEQ ID NO: 7683359 - DNA, 22 bp, Homo sapiens
ctggcactggatcgtgcatatc

SEQ ID NO: 7683360 - DNA, 22 bp, Homo sapiens
ctggcactgtgtctgcggaggg

SEQ ID NO: 7683361 - DNA, 22 bp, Homo sapiens
ctggcactcataggccagttca

SEQ ID NO: 7683362 - DNA, 22 bp, Homo sapiens
ctggcactcataggccagttca

SEQ ID NO: 7683363 - DNA, 22 bp, Homo sapiens
ctggcactcataggccagttca

SEQ ID NO: 7683364 - DNA, 22 bp, Homo sapiens
ctggcactcataggccagttca

SEQ ID NO: 7683365 - DNA, 22 bp, Homo sapiens
ctggcactgagtggcttatgac

SEQ ID NO: 7683366 - DNA, 22 bp, Homo sapiens
ctggcaccccacactgtccacg

SEQ ID NO: 7683367 - DNA, 22 bp, Homo sapiens
ctggcaccaggcatgctgggag

SEQ ID NO: 7683368 - DNA, 22 bp, Homo sapiens
ctggcacattgtaatatataca

SEQ ID NO: 7683369 - DNA, 22 bp, Homo sapiens
ctggcacattgtaatatataca

SEQ ID NO: 7683370 - DNA, 22 bp, Homo sapiens
ctggcaccaggcatgctgggag

SEQ ID NO: 7683371 - DNA, 22 bp, Homo sapiens
ctggcaccccacactgtccacg

SEQ ID NO: 7683372 - DNA, 22 bp, Homo sapiens
ctggcacctccagctcatggcc

SEQ ID NO: 7683373 - DNA, 22 bp, Homo sapiens
ctggcacctccagctcatggcc

SEQ ID NO: 7683374 - DNA, 22 bp, Homo sapiens
ctggcacctccagctcatggcc

SEQ ID NO: 7683375 - DNA, 22 bp, Homo sapiens
ctggcacctccagctcatggcc

SEQ ID NO: 7683376 - DNA, 22 bp, Homo sapiens
ctggcacctccagctcatggcc

SEQ ID NO: 7683377 - DNA, 22 bp, Homo sapiens
ctggcagagtctgctgtctgca

SEQ ID NO: 7683378 - DNA, 22 bp, Homo sapiens
ctggcagaggatggggacccag

SEQ ID NO: 7683379 - DNA, 22 bp, Homo sapiens
ctggcacttggcacccatgaaa

SEQ ID NO: 7683380 - DNA, 22 bp, Homo sapiens
ctggcagaggatggggacccag

SEQ ID NO: 7683381 - DNA, 22 bp, Homo sapiens
ctggcagaggatggggacccag

SEQ ID NO: 7683382 - DNA, 22 bp, Homo sapiens
ctggcagagtctgctgtctgca

SEQ ID NO: 7683383 - DNA, 22 bp, Homo sapiens
ctggcagagtctgctgtctgca

SEQ ID NO: 7683384 - DNA, 22 bp, Homo sapiens
ctggcagagttgggtctcaaat

SEQ ID NO: 7683385 - DNA, 22 bp, Homo sapiens
ctggcagatagccacgcctgtc

SEQ ID NO: 7683386 - DNA, 22 bp, Homo sapiens
ctggcagatagccacgcctgtc

SEQ ID NO: 7683387 - DNA, 22 bp, Homo sapiens
ctggcagatagtaagtgatcaa

SEQ ID NO: 7683388 - DNA, 22 bp, Homo sapiens
ctggcagatagccacgcctgtc

SEQ ID NO: 7683389 - DNA, 22 bp, Homo sapiens
ctggcagatagccacgcctgtc

SEQ ID NO: 7683390 - DNA, 22 bp, Homo sapiens
ctggcagatatttgcagacatg

SEQ ID NO: 7683391 - DNA, 22 bp, Homo sapiens
ctggcagatagtaagtgatcaa

SEQ ID NO: 7683392 - DNA, 22 bp, Homo sapiens
ctggcagatatttgcagacatg

SEQ ID NO: 7683393 - DNA, 22 bp, Homo sapiens
ctggcagatagtaagtgatcaa

SEQ ID NO: 7683394 - DNA, 22 bp, Homo sapiens
ctggcagatatttgcagacatg

SEQ ID NO: 7683395 - DNA, 22 bp, Homo sapiens
ctggcagcaggtcacacgcaga

SEQ ID NO: 7683396 - DNA, 22 bp, Homo sapiens
ctggcagcaggtcacacgcaga

SEQ ID NO: 7683397 - DNA, 22 bp, Homo sapiens
ctggcagcaggtcacacgcaga

SEQ ID NO: 7683398 - DNA, 22 bp, Homo sapiens
ctggcagcagcttctggatcga

SEQ ID NO: 7683399 - DNA, 22 bp, Homo sapiens
ctggcagcagcttctggatcga

SEQ ID NO: 7683400 - DNA, 22 bp, Homo sapiens
ctggcagcagcttctggatcga

SEQ ID NO: 7683401 - DNA, 22 bp, Homo sapiens
ctggcagcagcttctggatcga

SEQ ID NO: 7683402 - DNA, 22 bp, Homo sapiens
ctggcagcagcttctggatcga

SEQ ID NO: 7683403 - DNA, 22 bp, Homo sapiens
ctggcagcagctggtaccttat

SEQ ID NO: 7683404 - DNA, 22 bp, Homo sapiens
ctggcagcagagctcaacatag

SEQ ID NO: 7683405 - DNA, 22 bp, Homo sapiens
ctggcagcagctggtaccttat

SEQ ID NO: 7683406 - DNA, 22 bp, Homo sapiens
ctggcagattggggtcagcagt

SEQ ID NO: 7683407 - DNA, 22 bp, Homo sapiens
ctggcagattggggtcagcagt

SEQ ID NO: 7683408 - DNA, 22 bp, Homo sapiens
ctggcagatatttgcagacatg

SEQ ID NO: 7683409 - DNA, 22 bp, Homo sapiens
ctggcagatatttgcagacatg

SEQ ID NO: 7683410 - DNA, 22 bp, Homo sapiens
ctggcagatatttgcagacatg

SEQ ID NO: 7683411 - DNA, 22 bp, Homo sapiens
ctggcagattggggtcagcagt

SEQ ID NO: 7683412 - DNA, 22 bp, Homo sapiens
ctggcagattggggtcagcagt

SEQ ID NO: 7683413 - DNA, 18 bp, Homo sapiens
ctggattaagacagtgct

SEQ ID NO: 7683414 - DNA, 22 bp, Homo sapiens
ctggattaagtaaaatagagga

SEQ ID NO: 7683415 - DNA, 22 bp, Homo sapiens
ctggatttactgagttttatca

SEQ ID NO: 7683416 - DNA, 22 bp, Homo sapiens
ctggattctttcataaaagtca

SEQ ID NO: 7683417 - DNA, 22 bp, Homo sapiens
ctggatgtttatgaaggaccca

SEQ ID NO: 7683418 - DNA, 22 bp, Homo sapiens
ctggatgttcttctgcaattat

SEQ ID NO: 7683419 - DNA, 22 bp, Homo sapiens
ctggatgtggtaatgactttga

SEQ ID NO: 7683420 - DNA, 22 bp, Homo sapiens
ctggatgtcttggggactcctg

SEQ ID NO: 7683421 - DNA, 22 bp, Homo sapiens
ctggatgtccttcccctgaagc

SEQ ID NO: 7683422 - DNA, 22 bp, Homo sapiens
ctggatgtccaggtagaagttt

SEQ ID NO: 7683423 - DNA, 22 bp, Homo sapiens
ctggatgtaacgaaggtttcac

SEQ ID NO: 7683424 - DNA, 22 bp, Homo sapiens
ctggcaagaaatatatatctta

SEQ ID NO: 7683425 - DNA, 22 bp, Homo sapiens
ctggcaagaaatatatatctta

SEQ ID NO: 7683426 - DNA, 22 bp, Homo sapiens
ctggcaagaaatatatatctta

SEQ ID NO: 7683427 - DNA, 22 bp, Homo sapiens
ctggcaagaaatatatatctta

SEQ ID NO: 7683428 - DNA, 22 bp, Homo sapiens
ctggcacatagtaggtgcacag

SEQ ID NO: 7683429 - DNA, 22 bp, Homo sapiens
ctggcaagaaatatatatctta

SEQ ID NO: 7683430 - DNA, 22 bp, Homo sapiens
ctggatttgcctatggtgcttt

SEQ ID NO: 7683431 - DNA, 22 bp, Homo sapiens
ctggattttaaattttctctgt

SEQ ID NO: 7683432 - DNA, 19 bp, Homo sapiens
ctggcaaatgctttggcca

SEQ ID NO: 7683433 - DNA, 19 bp, Homo sapiens
ctggcaaatgctttggcca

SEQ ID NO: 7683434 - DNA, 22 bp, Homo sapiens
ctggattttatcattgtagttt

SEQ ID NO: 7683435 - DNA, 22 bp, Homo sapiens
ctggatccatcgggtcccgagt

SEQ ID NO: 7683436 - DNA, 22 bp, Homo sapiens
ctggatccaacagagttgggtt

SEQ ID NO: 7683437 - DNA, 22 bp, Homo sapiens
ctggatccatcgggtcccgagt

SEQ ID NO: 7683438 - DNA, 22 bp, Homo sapiens
ctggatcatgcattgcttgtcc

SEQ ID NO: 7683439 - DNA, 22 bp, Homo sapiens
ctggatagcaagcaaaaaattt

SEQ ID NO: 7683440 - DNA, 22 bp, Homo sapiens
ctggatccttctctgtgtattt

SEQ ID NO: 7683441 - DNA, 22 bp, Homo sapiens
ctggatcccgtctgagcctcct

SEQ ID NO: 7683442 - DNA, 22 bp, Homo sapiens
ctggatgcttcctctctgctag

SEQ ID NO: 7683443 - DNA, 22 bp, Homo sapiens
ctggatggaaggaggatagtat

SEQ ID NO: 7683444 - DNA, 22 bp, Homo sapiens
ctggatggaaggaggatagtat

SEQ ID NO: 7683445 - DNA, 22 bp, Homo sapiens
ctggatggtcccatgagcagct

SEQ ID NO: 7683446 - DNA, 22 bp, Homo sapiens
ctggatggtcccatgagcagct

SEQ ID NO: 7683447 - DNA, 22 bp, Homo sapiens
ctggatggtcccatgagcagct

SEQ ID NO: 7683448 - DNA, 22 bp, Homo sapiens
ctggatggtcccatgagcagct

SEQ ID NO: 7683449 - DNA, 22 bp, Homo sapiens
ctggatgtaaagggtgaagaaa

SEQ ID NO: 7683450 - DNA, 22 bp, Homo sapiens
ctggatgctgagaggtaccaag

SEQ ID NO: 7683451 - DNA, 22 bp, Homo sapiens
ctggataatcacagaggagcat

SEQ ID NO: 7683452 - DNA, 22 bp, Homo sapiens
ctggatctgtttgtgcttgtgg

SEQ ID NO: 7683453 - DNA, 22 bp, Homo sapiens
ctggcatgaaatggcatctcat

SEQ ID NO: 7683454 - DNA, 22 bp, Homo sapiens
ctggcatgaaatggcatctcat

SEQ ID NO: 7683455 - DNA, 22 bp, Homo sapiens
ctggcatgaaatggcatctcat

SEQ ID NO: 7683456 - DNA, 22 bp, Homo sapiens
ctggcatcatttagcacagtgt

SEQ ID NO: 7683457 - DNA, 22 bp, Homo sapiens
ctggcatcatttagcacagtgt

SEQ ID NO: 7683458 - DNA, 22 bp, Homo sapiens
ctggcagtttgccaggagctcg

SEQ ID NO: 7683459 - DNA, 22 bp, Homo sapiens
ctggcagtttgccaggagctcg

SEQ ID NO: 7683460 - DNA, 22 bp, Homo sapiens
ctggcagtgtgaccctggacag

SEQ ID NO: 7683461 - DNA, 22 bp, Homo sapiens
ctggcagtgtccagctcgtgat

SEQ ID NO: 7683462 - DNA, 22 bp, Homo sapiens
ctggcagtgtccagctcgtgat

SEQ ID NO: 7683463 - DNA, 22 bp, Homo sapiens
ctggcagtggggcctcagtgtt

SEQ ID NO: 7683464 - DNA, 22 bp, Homo sapiens
ctggcagtggggcctcagtgtt

SEQ ID NO: 7683465 - DNA, 22 bp, Homo sapiens
ctggcagtttgccaggagctcg

SEQ ID NO: 7683466 - DNA, 22 bp, Homo sapiens
ctggcagttggcattggcatct

SEQ ID NO: 7683467 - DNA, 22 bp, Homo sapiens
ctggcagttggcagggctgcca

SEQ ID NO: 7683468 - DNA, 22 bp, Homo sapiens
ctggcagtgcccagtcactgtt

SEQ ID NO: 7683469 - DNA, 22 bp, Homo sapiens
ctggcagtgagctggccactca

SEQ ID NO: 7683470 - DNA, 22 bp, Homo sapiens
ctggcagtgagctggccactca

SEQ ID NO: 7683471 - DNA, 22 bp, Homo sapiens
ctggcagtgacattgcaggtgc

SEQ ID NO: 7683472 - DNA, 22 bp, Homo sapiens
ctggcagtgacattgcaggtgc

SEQ ID NO: 7683473 - DNA, 22 bp, Homo sapiens
ctggcagtgcccagtcactgtt

SEQ ID NO: 7683474 - DNA, 22 bp, Homo sapiens
ctggcagtgcccagtcactgtt

SEQ ID NO: 7683475 - DNA, 22 bp, Homo sapiens
ctggcagtgccctcagccccca

SEQ ID NO: 7683476 - DNA, 22 bp, Homo sapiens
ctggcagtggggcctcagtgtt

SEQ ID NO: 7683477 - DNA, 22 bp, Homo sapiens
ctggcagtgacattgcaggtgc

SEQ ID NO: 7683478 - DNA, 22 bp, Homo sapiens
ctggcagtctggtggaaggcct

SEQ ID NO: 7683479 - DNA, 22 bp, Homo sapiens
ctggcagtctggtggaaggcct

SEQ ID NO: 7683480 - DNA, 22 bp, Homo sapiens
ctggcagtctggtggaaggcct

SEQ ID NO: 7683481 - DNA, 22 bp, Homo sapiens
ctggcagtctgcctcttcactg

SEQ ID NO: 7683482 - DNA, 22 bp, Homo sapiens
ctggcagtctggtggaaggcct

SEQ ID NO: 7683483 - DNA, 22 bp, Homo sapiens
ctggcagtctggtggaaggcct

SEQ ID NO: 7683484 - DNA, 22 bp, Homo sapiens
ctggcagcattaacagagagca

SEQ ID NO: 7683485 - DNA, 22 bp, Homo sapiens
ctggcagcattaacagagagca

SEQ ID NO: 7683486 - DNA, 22 bp, Homo sapiens
ctggcagcattaacagagagca

SEQ ID NO: 7683487 - DNA, 22 bp, Homo sapiens
ctggcagcattaacagagagca

SEQ ID NO: 7683488 - DNA, 22 bp, Homo sapiens
ctggcagcattaacagagagca

SEQ ID NO: 7683489 - DNA, 22 bp, Homo sapiens
ctggcagcattaacagagagca

SEQ ID NO: 7683490 - DNA, 22 bp, Homo sapiens
ctggcagcatggagcctgtgct

SEQ ID NO: 7683491 - DNA, 22 bp, Homo sapiens
ctggcagcatggagcctgtgct

SEQ ID NO: 7683492 - DNA, 22 bp, Homo sapiens
ctggcagcatggagcctgtgct

SEQ ID NO: 7683493 - DNA, 22 bp, Homo sapiens
ctggcagcatggagcctgtgct

SEQ ID NO: 7683494 - DNA, 22 bp, Homo sapiens
ctggcagcatggagcctgtgct

SEQ ID NO: 7683495 - DNA, 22 bp, Homo sapiens
ctggcagcagttatgaaacaat

SEQ ID NO: 7683496 - DNA, 22 bp, Homo sapiens
ctggcagcaggtcacacgcaga

SEQ ID NO: 7683497 - DNA, 22 bp, Homo sapiens
ctggcagcaggtcacacgcaga

SEQ ID NO: 7683498 - DNA, 22 bp, Homo sapiens
ctggcagcagttatgaaacaat

SEQ ID NO: 7683499 - DNA, 22 bp, Homo sapiens
ctggcagcatggagcctgtgct

SEQ ID NO: 7683500 - DNA, 22 bp, Homo sapiens
ctggcagcatggagcctgtgct

SEQ ID NO: 7683501 - DNA, 22 bp, Homo sapiens
ctggcagcatggagcctgtgct

SEQ ID NO: 7683502 - DNA, 22 bp, Homo sapiens
ctggcagcatggagcctgtgct

SEQ ID NO: 7683503 - DNA, 22 bp, Homo sapiens
ctggcaggtccagctggactca

SEQ ID NO: 7683504 - DNA, 22 bp, Homo sapiens
ctggcaggtccagctggactca

SEQ ID NO: 7683505 - DNA, 22 bp, Homo sapiens
ctggcagtcacggccatgtgct

SEQ ID NO: 7683506 - DNA, 22 bp, Homo sapiens
ctggcaggtatctaaagttgtc

SEQ ID NO: 7683507 - DNA, 22 bp, Homo sapiens
ctggcaggtccagctggactca

SEQ ID NO: 7683508 - DNA, 22 bp, Homo sapiens
ctggcagggtgggctttgcttt

SEQ ID NO: 7683509 - DNA, 22 bp, Homo sapiens
ctggcagggctggtattcaaaa

SEQ ID NO: 7683510 - DNA, 22 bp, Homo sapiens
ctggcagggtgggctttgcttt

SEQ ID NO: 7683511 - DNA, 22 bp, Homo sapiens
ctggcagggctctttgggtgct

SEQ ID NO: 7683512 - DNA, 22 bp, Homo sapiens
ctggcagggctctttgggtgct

SEQ ID NO: 7683513 - DNA, 22 bp, Homo sapiens
ctggcagggctctttgggtgct

SEQ ID NO: 7683514 - DNA, 22 bp, Homo sapiens
ctggcagcattaacagagagca

SEQ ID NO: 7683515 - DNA, 22 bp, Homo sapiens
ctggcagcattaacagagagca

SEQ ID NO: 7683516 - DNA, 22 bp, Homo sapiens
ctggcagcattaacagagagca

SEQ ID NO: 7683517 - DNA, 22 bp, Homo sapiens
ctggcagcattaacagagagca

SEQ ID NO: 7683518 - DNA, 22 bp, Homo sapiens
ctggcagggctctttgggtgct

SEQ ID NO: 7683519 - DNA, 22 bp, Homo sapiens
ctggcagggctctttgggtgct

SEQ ID NO: 7683520 - DNA, 22 bp, Homo sapiens
ctggcagggctctttgggtgct

SEQ ID NO: 7683521 - DNA, 17 bp, Homo sapiens
ctggccagtgtacttgg

SEQ ID NO: 7683522 - DNA, 17 bp, Homo sapiens
ctggccagtgtacttgg

SEQ ID NO: 7683523 - DNA, 22 bp, Homo sapiens
ctggccaggctctcacgtggtc

SEQ ID NO: 7683524 - DNA, 22 bp, Homo sapiens
ctggccagtgcctgtgggcccc

SEQ ID NO: 7683525 - DNA, 22 bp, Homo sapiens
ctggccaggcggcccctgcatg

SEQ ID NO: 7683526 - DNA, 22 bp, Homo sapiens
ctggccaggcggcccctgcatg

SEQ ID NO: 7683527 - DNA, 22 bp, Homo sapiens
ctggccaggctctcacgtggtc

SEQ ID NO: 7683528 - DNA, 22 bp, Homo sapiens
ctggccaggctctcacgtggtc

SEQ ID NO: 7683529 - DNA, 22 bp, Homo sapiens
ctggccaggctctcacgtggtc

SEQ ID NO: 7683530 - DNA, 22 bp, Homo sapiens
ctggccaggctctcacgtggtc

SEQ ID NO: 7683531 - DNA, 22 bp, Homo sapiens
ctggccaggctctcacgtggtc

SEQ ID NO: 7683532 - DNA, 22 bp, Homo sapiens
ctggccaggctctcacgtggtc

SEQ ID NO: 7683533 - DNA, 22 bp, Homo sapiens
ctggccaggcggcccctgcatg

SEQ ID NO: 7683534 - DNA, 22 bp, Homo sapiens
ctggccaggcggcccctgcatg

SEQ ID NO: 7683535 - DNA, 22 bp, Homo sapiens
ctggccaggcggcccctgcatg

SEQ ID NO: 7683536 - DNA, 22 bp, Homo sapiens
ctggccacccatgcctccctga

SEQ ID NO: 7683537 - DNA, 22 bp, Homo sapiens
ctggccaggcggcccctgcatg

SEQ ID NO: 7683538 - DNA, 22 bp, Homo sapiens
ctggccaggcggcccctgcatg

SEQ ID NO: 7683539 - DNA, 22 bp, Homo sapiens
ctggccacccatgcctccctga

SEQ ID NO: 7683540 - DNA, 22 bp, Homo sapiens
ctggccacccatgcctccctga

SEQ ID NO: 7683541 - DNA, 22 bp, Homo sapiens
ctggccaggcggcccctgcatg

SEQ ID NO: 7683542 - DNA, 22 bp, Homo sapiens
ctggccaggcggcccctgcatg

SEQ ID NO: 7683543 - DNA, 22 bp, Homo sapiens
ctggccaggcggcccctgcatg

SEQ ID NO: 7683544 - DNA, 22 bp, Homo sapiens
ctggccaggcggcccctgcatg

SEQ ID NO: 7683545 - DNA, 22 bp, Homo sapiens
ctggccaccaagagcttgctca

SEQ ID NO: 7683546 - DNA, 22 bp, Homo sapiens
ctggccaccaagagcttgctca

SEQ ID NO: 7683547 - DNA, 23 bp, Homo sapiens
ctggccaccatctttctggcttc

SEQ ID NO: 7683548 - DNA, 23 bp, Homo sapiens
ctggccaccatctttctggcttc

SEQ ID NO: 7683549 - DNA, 23 bp, Homo sapiens
ctggccaccatctttctggcttc

SEQ ID NO: 7683550 - DNA, 23 bp, Homo sapiens
ctggccaccatctttctggcttc

SEQ ID NO: 7683551 - DNA, 23 bp, Homo sapiens
ctggccaccatctttctggcttc

SEQ ID NO: 7683552 - DNA, 23 bp, Homo sapiens
ctggccaccatctttctggcttc

SEQ ID NO: 7683553 - DNA, 22 bp, Homo sapiens
ctggccaccaagagcttgctca

SEQ ID NO: 7683554 - DNA, 22 bp, Homo sapiens
ctggccaccaagagcttgctca

SEQ ID NO: 7683555 - DNA, 22 bp, Homo sapiens
ctggccacatgtgtgctgagca

SEQ ID NO: 7683556 - DNA, 22 bp, Homo sapiens
ctggccaccaagagcttgctca

SEQ ID NO: 7683557 - DNA, 22 bp, Homo sapiens
ctggccaccaagagcttgctca

SEQ ID NO: 7683558 - DNA, 19 bp, Homo sapiens
ctggccacacctgctggtt

SEQ ID NO: 7683559 - DNA, 22 bp, Homo sapiens
ctggccacaactagcccaggac

SEQ ID NO: 7683560 - DNA, 19 bp, Homo sapiens
ctggccacacctgctggtt

SEQ ID NO: 7683561 - DNA, 19 bp, Homo sapiens
ctggccacacctgctggtt

SEQ ID NO: 7683562 - DNA, 19 bp, Homo sapiens
ctggccacacctgctggtt

SEQ ID NO: 7683563 - DNA, 19 bp, Homo sapiens
ctggccacacctgctggtt

SEQ ID NO: 7683564 - DNA, 19 bp, Homo sapiens
ctggccacacctgctggtt

SEQ ID NO: 7683565 - DNA, 19 bp, Homo sapiens
ctggccacacctgctggtt

SEQ ID NO: 7683566 - DNA, 22 bp, Homo sapiens
ctggccacatgtgtgctgagca

SEQ ID NO: 7683567 - DNA, 22 bp, Homo sapiens
ctggccacatgtgtgctgagca

SEQ ID NO: 7683568 - DNA, 22 bp, Homo sapiens
ctggccacatgtgtgctgagca

SEQ ID NO: 7683569 - DNA, 22 bp, Homo sapiens
ctggccacatgtgtgctgagca

SEQ ID NO: 7683570 - DNA, 19 bp, Homo sapiens
ctggccacacctgctggtt

SEQ ID NO: 7683571 - DNA, 19 bp, Homo sapiens
ctggccacacctgctggtt

SEQ ID NO: 7683572 - DNA, 22 bp, Homo sapiens
ctggccacatgtgtgctgagca

SEQ ID NO: 7683573 - DNA, 22 bp, Homo sapiens
ctggccacatgtgtgctgagca

SEQ ID NO: 7683574 - DNA, 22 bp, Homo sapiens
ctggccacatgtgtgctgagca

SEQ ID NO: 7683575 - DNA, 22 bp, Homo sapiens
ctggcatgtgtttggctcctgt

SEQ ID NO: 7683576 - DNA, 18 bp, Homo sapiens
ctggcattcttccctgga

SEQ ID NO: 7683577 - DNA, 22 bp, Homo sapiens
ctggcatggtgtatttgttcaa

SEQ ID NO: 7683578 - DNA, 22 bp, Homo sapiens
ctggcatggaggactactgagc

SEQ ID NO: 7683579 - DNA, 22 bp, Homo sapiens
ctggcatggaggactactgagc

SEQ ID NO: 7683580 - DNA, 22 bp, Homo sapiens
ctggcatgtgtttggctcctgt

SEQ ID NO: 7683581 - DNA, 22 bp, Homo sapiens
ctggcatgtgtttggctcctgt

SEQ ID NO: 7683582 - DNA, 22 bp, Homo sapiens
ctggcatgtgtttggctcctgt

SEQ ID NO: 7683583 - DNA, 22 bp, Homo sapiens
ctggcatgctaatacagcctgt

SEQ ID NO: 7683584 - DNA, 22 bp, Homo sapiens
ctggcatgctaatacagcctgt

SEQ ID NO: 7683585 - DNA, 22 bp, Homo sapiens
ctggcatgctaatacagcctgt

SEQ ID NO: 7683586 - DNA, 22 bp, Homo sapiens
ctggcatgccttgggtgcctct

SEQ ID NO: 7683587 - DNA, 22 bp, Homo sapiens
ctggcatgccttgggtgcctct

SEQ ID NO: 7683588 - DNA, 22 bp, Homo sapiens
ctggcatgcccagggtatgtgg

SEQ ID NO: 7683589 - DNA, 21 bp, Homo sapiens
ctggcatgaggagctttgttt

SEQ ID NO: 7683590 - DNA, 22 bp, Homo sapiens
ctggcatgccttgggtgcctct

SEQ ID NO: 7683591 - DNA, 22 bp, Homo sapiens
ctggcatgccttgggtgcctct

SEQ ID NO: 7683592 - DNA, 22 bp, Homo sapiens
ctggcatgccttgggtgcctct

SEQ ID NO: 7683593 - DNA, 22 bp, Homo sapiens
ctggcatgccttgggtgcctct

SEQ ID NO: 7683594 - DNA, 22 bp, Homo sapiens
ctggccaatgcctggggaatag

SEQ ID NO: 7683595 - DNA, 22 bp, Homo sapiens
ctggccacaactagcccaggac

SEQ ID NO: 7683596 - DNA, 22 bp, Homo sapiens
ctggccacaactagcccaggac

SEQ ID NO: 7683597 - DNA, 22 bp, Homo sapiens
ctggccacaactagcccaggac

SEQ ID NO: 7683598 - DNA, 22 bp, Homo sapiens
ctggccaatatagggaaatctt

SEQ ID NO: 7683599 - DNA, 22 bp, Homo sapiens
ctggccaatatagggaaatctt

SEQ ID NO: 7683600 - DNA, 22 bp, Homo sapiens
ctggccaatatagggaaatctt

SEQ ID NO: 7683601 - DNA, 22 bp, Homo sapiens
ctggccaagcttctctaagcag

SEQ ID NO: 7683602 - DNA, 22 bp, Homo sapiens
ctggccacaactagcccaggac

SEQ ID NO: 7683603 - DNA, 19 bp, Homo sapiens
ctggccacacctgctggtt

SEQ ID NO: 7683604 - DNA, 22 bp, Homo sapiens
ctggccaagcactggggtcaaa

SEQ ID NO: 7683605 - DNA, 22 bp, Homo sapiens
ctggccaagcactggggtcaaa

SEQ ID NO: 7683606 - DNA, 22 bp, Homo sapiens
ctggccaagcactggggtcaaa

SEQ ID NO: 7683607 - DNA, 22 bp, Homo sapiens
ctggccaagatggtgaaacccc

SEQ ID NO: 7683608 - DNA, 22 bp, Homo sapiens
ctggccaacatctggggcacat

SEQ ID NO: 7683609 - DNA, 22 bp, Homo sapiens
ctggccaacatctggggcacat

SEQ ID NO: 7683610 - DNA, 22 bp, Homo sapiens
ctggcatttttggaaagaagaa

SEQ ID NO: 7683611 - DNA, 22 bp, Homo sapiens
ctggccaacatctggggcacat

SEQ ID NO: 7683612 - DNA, 22 bp, Homo sapiens
ctggcattgagggtcacaaggc

SEQ ID NO: 7683613 - DNA, 22 bp, Homo sapiens
ctggcatttagacccacagcaa

SEQ ID NO: 7683614 - DNA, 22 bp, Homo sapiens
ctggcatttagacccacagcaa

SEQ ID NO: 7683615 - DNA, 22 bp, Homo sapiens
ctggctctgggcctcagacact

SEQ ID NO: 7683616 - DNA, 22 bp, Homo sapiens
ctggctctgggcctcagacact

SEQ ID NO: 7683617 - DNA, 22 bp, Homo sapiens
ctggctctgggcctcagacact

SEQ ID NO: 7683618 - DNA, 22 bp, Homo sapiens
ctggctctgggcctcagacact

SEQ ID NO: 7683619 - DNA, 22 bp, Homo sapiens
ctggctctgggcctcagacact

SEQ ID NO: 7683620 - DNA, 22 bp, Homo sapiens
ctggctctgggcctcagacact

SEQ ID NO: 7683621 - DNA, 22 bp, Homo sapiens
ctggctctgcaacccccacaca

SEQ ID NO: 7683622 - DNA, 22 bp, Homo sapiens
ctggctctgcaacccccacaca

SEQ ID NO: 7683623 - DNA, 22 bp, Homo sapiens
ctggctctgagtggctctaatt

SEQ ID NO: 7683624 - DNA, 22 bp, Homo sapiens
ctggctctgagtggctctaatt

SEQ ID NO: 7683625 - DNA, 22 bp, Homo sapiens
ctggctctgagtggtatcttga

SEQ ID NO: 7683626 - DNA, 22 bp, Homo sapiens
ctggctctgagtggtatcttga

SEQ ID NO: 7683627 - DNA, 22 bp, Homo sapiens
ctggctctgagcccacctccag

SEQ ID NO: 7683628 - DNA, 22 bp, Homo sapiens
ctggctctgactccgcatattt

SEQ ID NO: 7683629 - DNA, 22 bp, Homo sapiens
ctggctctgagcccacctccag

SEQ ID NO: 7683630 - DNA, 22 bp, Homo sapiens
ctggctctgagcccacctccag

SEQ ID NO: 7683631 - DNA, 22 bp, Homo sapiens
ctggctctgactccgcatattt

SEQ ID NO: 7683632 - DNA, 22 bp, Homo sapiens
ctggctctgaccgcgctggcct

SEQ ID NO: 7683633 - DNA, 22 bp, Homo sapiens
ctggctctgaccgcgctggcct

SEQ ID NO: 7683634 - DNA, 22 bp, Homo sapiens
ctggctctgaccgcgctggcct

SEQ ID NO: 7683635 - DNA, 22 bp, Homo sapiens
ctggctctgagcccacctccag

SEQ ID NO: 7683636 - DNA, 22 bp, Homo sapiens
ctggctctgagtggctctaatt

SEQ ID NO: 7683637 - DNA, 22 bp, Homo sapiens
ctggctctgagcccacctccag

SEQ ID NO: 7683638 - DNA, 22 bp, Homo sapiens
ctggctctgagcccacctccag

SEQ ID NO: 7683639 - DNA, 22 bp, Homo sapiens
ctggctctgggctaagctccca

SEQ ID NO: 7683640 - DNA, 22 bp, Homo sapiens
ctggctctgggctaagctccca

SEQ ID NO: 7683641 - DNA, 22 bp, Homo sapiens
ctggctctgggctaagctccca

SEQ ID NO: 7683642 - DNA, 23 bp, Homo sapiens
ctggctctgtaggtggcatcctt

SEQ ID NO: 7683643 - DNA, 23 bp, Homo sapiens
ctggctctgtaggtggcatcctt

SEQ ID NO: 7683644 - DNA, 22 bp, Homo sapiens
ctggctctgtcaccctttctcc

SEQ ID NO: 7683645 - DNA, 23 bp, Homo sapiens
ctggctctgtaggtggcatcctt

SEQ ID NO: 7683646 - DNA, 22 bp, Homo sapiens
ctggctctgtcaccctttctcc

SEQ ID NO: 7683647 - DNA, 22 bp, Homo sapiens
ctggctctgtgggacctggcct

SEQ ID NO: 7683648 - DNA, 22 bp, Homo sapiens
ctggctctgtgggacctggcct

SEQ ID NO: 7683649 - DNA, 22 bp, Homo sapiens
ctggctctgtgggacctggcct

SEQ ID NO: 7683650 - DNA, 22 bp, Homo sapiens
ctggctctgtgggacctggcct

SEQ ID NO: 7683651 - DNA, 22 bp, Homo sapiens
ctggctctgtgggacctggcct

SEQ ID NO: 7683652 - DNA, 22 bp, Homo sapiens
ctggctctgtgggacctggcct

SEQ ID NO: 7683653 - DNA, 22 bp, Homo sapiens
ctggctctgtggcttccttcat

SEQ ID NO: 7683654 - DNA, 22 bp, Homo sapiens
ctggctctgtcaccctttctcc

SEQ ID NO: 7683655 - DNA, 22 bp, Homo sapiens
ctggctctgtcaccctttctcc

SEQ ID NO: 7683656 - DNA, 22 bp, Homo sapiens
ctggctctgtggcttccttcat

SEQ ID NO: 7683657 - DNA, 22 bp, Homo sapiens
ctggctctgtggcttccttcat

SEQ ID NO: 7683658 - DNA, 22 bp, Homo sapiens
ctggctcctgtttaaccagctg

SEQ ID NO: 7683659 - DNA, 22 bp, Homo sapiens
ctggctcctgtttaaccagctg

SEQ ID NO: 7683660 - DNA, 22 bp, Homo sapiens
ctggctcctgaggcttggcccc

SEQ ID NO: 7683661 - DNA, 22 bp, Homo sapiens
ctggctcctgaggcttggcccc

SEQ ID NO: 7683662 - DNA, 22 bp, Homo sapiens
ctggctcctgaggcttggcccc

SEQ ID NO: 7683663 - DNA, 22 bp, Homo sapiens
ctggctcctgaggcttggcccc

SEQ ID NO: 7683664 - DNA, 22 bp, Homo sapiens
ctggctcctctacacacccaaa

SEQ ID NO: 7683665 - DNA, 22 bp, Homo sapiens
ctggctcctctacacacccaaa

SEQ ID NO: 7683666 - DNA, 22 bp, Homo sapiens
ctggctcctctacacacccaaa

SEQ ID NO: 7683667 - DNA, 22 bp, Homo sapiens
ctggctctatctccaaggctgg

SEQ ID NO: 7683668 - DNA, 22 bp, Homo sapiens
ctggctctatctccaaggctgg

SEQ ID NO: 7683669 - DNA, 22 bp, Homo sapiens
ctggctctatctccaaggctgg

SEQ ID NO: 7683670 - DNA, 22 bp, Homo sapiens
ctggctctaagtgtcagctccc

SEQ ID NO: 7683671 - DNA, 22 bp, Homo sapiens
ctggctctaagtgtcagctccc

SEQ ID NO: 7683672 - DNA, 22 bp, Homo sapiens
ctggctctaagtgtcagctccc

SEQ ID NO: 7683673 - DNA, 22 bp, Homo sapiens
ctggctctaagtgtcagctccc

SEQ ID NO: 7683674 - DNA, 22 bp, Homo sapiens
ctggctctattccctaaggatg

SEQ ID NO: 7683675 - DNA, 22 bp, Homo sapiens
ctggctctattccctaaggatg

SEQ ID NO: 7683676 - DNA, 22 bp, Homo sapiens
ctggctctattccctaaggatg

SEQ ID NO: 7683677 - DNA, 22 bp, Homo sapiens
ctggctctattccctaaggatg

SEQ ID NO: 7683678 - DNA, 22 bp, Homo sapiens
ctggctctatctccaaggctgg

SEQ ID NO: 7683679 - DNA, 22 bp, Homo sapiens
ctggctctatctccaaggctgg

SEQ ID NO: 7683680 - DNA, 22 bp, Homo sapiens
ctggctctatctccaaggctgg

SEQ ID NO: 7683681 - DNA, 22 bp, Homo sapiens
ctggctctatctccaaggctgg

SEQ ID NO: 7683682 - DNA, 22 bp, Homo sapiens
ctggctctcgctgggagtactt

SEQ ID NO: 7683683 - DNA, 22 bp, Homo sapiens
ctggctctcgctgggagtactt

SEQ ID NO: 7683684 - DNA, 22 bp, Homo sapiens
ctggctctcgctgggagtactt

SEQ ID NO: 7683685 - DNA, 22 bp, Homo sapiens
ctggctctcaggctggtcccca

SEQ ID NO: 7683686 - DNA, 22 bp, Homo sapiens
ctggctctcaggctggtcccca

SEQ ID NO: 7683687 - DNA, 22 bp, Homo sapiens
ctggctctcaggctggtcccca

SEQ ID NO: 7683688 - DNA, 22 bp, Homo sapiens
ctggctctctgatttcacattc

SEQ ID NO: 7683689 - DNA, 22 bp, Homo sapiens
ctggctctctgatttcacattc

SEQ ID NO: 7683690 - DNA, 22 bp, Homo sapiens
ctggctctctgagatattgagt

SEQ ID NO: 7683691 - DNA, 22 bp, Homo sapiens
ctggctctctgagatattgagt

SEQ ID NO: 7683692 - DNA, 22 bp, Homo sapiens
ctggctctcgctgggagtactt

SEQ ID NO: 7683693 - DNA, 22 bp, Homo sapiens
ctggctctgaccgcgctggcct

SEQ ID NO: 7683694 - DNA, 22 bp, Homo sapiens
ctggctctgaccgcgctggcct

SEQ ID NO: 7683695 - DNA, 22 bp, Homo sapiens
ctggctctgaccgcgctggcct

SEQ ID NO: 7683696 - DNA, 22 bp, Homo sapiens
ctggctctgaccgcgctggcct

SEQ ID NO: 7683697 - DNA, 22 bp, Homo sapiens
ctggctctgaccgcgctggcct

SEQ ID NO: 7683698 - DNA, 22 bp, Homo sapiens
ctggctctctgatttcacattc

SEQ ID NO: 7683699 - DNA, 22 bp, Homo sapiens
ctggctctctgatttcacattc

SEQ ID NO: 7683700 - DNA, 22 bp, Homo sapiens
ctggctctctgatttcacattc

SEQ ID NO: 7683701 - DNA, 22 bp, Homo sapiens
ctggcctggtctggcctctcca

SEQ ID NO: 7683702 - DNA, 22 bp, Homo sapiens
ctggcctggtctggcctctcca

SEQ ID NO: 7683703 - DNA, 22 bp, Homo sapiens
ctggcctggtctggcctctcca

SEQ ID NO: 7683704 - DNA, 22 bp, Homo sapiens
ctggctccaccccaggaggatg

SEQ ID NO: 7683705 - DNA, 22 bp, Homo sapiens
ctggctccaccccaggaggatg

SEQ ID NO: 7683706 - DNA, 22 bp, Homo sapiens
ctggcctggtctggcctctcca

SEQ ID NO: 7683707 - DNA, 22 bp, Homo sapiens
ctggcctggtctggcctctcca

SEQ ID NO: 7683708 - DNA, 22 bp, Homo sapiens
ctggcctggtctggcctctcca

SEQ ID NO: 7683709 - DNA, 22 bp, Homo sapiens
ctggcctggtctggcctctcca

SEQ ID NO: 7683710 - DNA, 22 bp, Homo sapiens
ctggcctggtctggcctctcca

SEQ ID NO: 7683711 - DNA, 22 bp, Homo sapiens
ctggcctggggggacacatccc

SEQ ID NO: 7683712 - DNA, 22 bp, Homo sapiens
ctggcctggggggacacatccc

SEQ ID NO: 7683713 - DNA, 22 bp, Homo sapiens
ctggcctggggggacacatccc

SEQ ID NO: 7683714 - DNA, 22 bp, Homo sapiens
ctggcctggggggacacatccc

SEQ ID NO: 7683715 - DNA, 22 bp, Homo sapiens
ctggcctggggcctcagctgct

SEQ ID NO: 7683716 - DNA, 22 bp, Homo sapiens
ctggcctggggcctcagctgct

SEQ ID NO: 7683717 - DNA, 22 bp, Homo sapiens
ctggcctggggcctcagctgct

SEQ ID NO: 7683718 - DNA, 22 bp, Homo sapiens
ctggcctggggcctcagctgct

SEQ ID NO: 7683719 - DNA, 22 bp, Homo sapiens
ctggcctggggcctcagctgct

SEQ ID NO: 7683720 - DNA, 22 bp, Homo sapiens
ctggcctggggcctcagctgct

SEQ ID NO: 7683721 - DNA, 22 bp, Homo sapiens
ctggcctggggcctcagctgct

SEQ ID NO: 7683722 - DNA, 22 bp, Homo sapiens
ctggcctggggcctcagctgct

SEQ ID NO: 7683723 - DNA, 22 bp, Homo sapiens
ctggcctggggcctcagctgct

SEQ ID NO: 7683724 - DNA, 22 bp, Homo sapiens
ctggcctggggcctcagctgct

SEQ ID NO: 7683725 - DNA, 22 bp, Homo sapiens
ctggcctgggagctgctagcgt

SEQ ID NO: 7683726 - DNA, 22 bp, Homo sapiens
ctggcctgggagctgctagcgt

SEQ ID NO: 7683727 - DNA, 22 bp, Homo sapiens
ctggcctgggagctgctagcgt

SEQ ID NO: 7683728 - DNA, 22 bp, Homo sapiens
ctggcctgggagctgctagcgt

SEQ ID NO: 7683729 - DNA, 22 bp, Homo sapiens
ctggcctgggagctgctagcgt

SEQ ID NO: 7683730 - DNA, 22 bp, Homo sapiens
ctggcctgggagctgctagcgt

SEQ ID NO: 7683731 - DNA, 22 bp, Homo sapiens
ctggcctgggagctgctagcgt

SEQ ID NO: 7683732 - DNA, 22 bp, Homo sapiens
ctggcctggcgcagtggctcac

SEQ ID NO: 7683733 - DNA, 22 bp, Homo sapiens
ctggcctggcgcagtggctcac

SEQ ID NO: 7683734 - DNA, 22 bp, Homo sapiens
ctggcctggcgcagtggctcac

SEQ ID NO: 7683735 - DNA, 22 bp, Homo sapiens
ctggcctggcgcagtggctcac

SEQ ID NO: 7683736 - DNA, 22 bp, Homo sapiens
ctggcctggcgcagtggctcac

SEQ ID NO: 7683737 - DNA, 22 bp, Homo sapiens
ctggcctggcgcagtggctcac

SEQ ID NO: 7683738 - DNA, 22 bp, Homo sapiens
ctggcctggcgcagtggctcac

SEQ ID NO: 7683739 - DNA, 22 bp, Homo sapiens
ctggcctggcgcagtggctcac

SEQ ID NO: 7683740 - DNA, 22 bp, Homo sapiens
ctggcctggcgcagtggctcac

SEQ ID NO: 7683741 - DNA, 22 bp, Homo sapiens
ctggcctggcaggggacctcta

SEQ ID NO: 7683742 - DNA, 22 bp, Homo sapiens
ctggctcctcagtattccactt

SEQ ID NO: 7683743 - DNA, 22 bp, Homo sapiens
ctggctcctcaggactgcggga

SEQ ID NO: 7683744 - DNA, 22 bp, Homo sapiens
ctggctcctcaggactgcggga

SEQ ID NO: 7683745 - DNA, 22 bp, Homo sapiens
ctggctcctcaggactgcggga

SEQ ID NO: 7683746 - DNA, 22 bp, Homo sapiens
ctggctcctcaggactgcggga

SEQ ID NO: 7683747 - DNA, 22 bp, Homo sapiens
ctggctcctccaaggcctggag

SEQ ID NO: 7683748 - DNA, 22 bp, Homo sapiens
ctggctcctccaaggcctggag

SEQ ID NO: 7683749 - DNA, 22 bp, Homo sapiens
ctggctcctcagtattccactt

SEQ ID NO: 7683750 - DNA, 22 bp, Homo sapiens
ctggctcctcagtattccactt

SEQ ID NO: 7683751 - DNA, 22 bp, Homo sapiens
ctggctcctcagtattccactt

SEQ ID NO: 7683752 - DNA, 22 bp, Homo sapiens
ctggctcctccaaggcctggag

SEQ ID NO: 7683753 - DNA, 22 bp, Homo sapiens
ctggctcctccaaggcctggag

SEQ ID NO: 7683754 - DNA, 23 bp, Homo sapiens
ctggctccgaagactccaggatc

SEQ ID NO: 7683755 - DNA, 23 bp, Homo sapiens
ctggctccgaagactccaggatc

SEQ ID NO: 7683756 - DNA, 23 bp, Homo sapiens
ctggctccgaagactccaggatc

SEQ ID NO: 7683757 - DNA, 23 bp, Homo sapiens
ctggctccgaagactccaggatc

SEQ ID NO: 7683758 - DNA, 22 bp, Homo sapiens
ctggctccctggacatggggcc

SEQ ID NO: 7683759 - DNA, 22 bp, Homo sapiens
ctggctccctggacatggggcc

SEQ ID NO: 7683760 - DNA, 22 bp, Homo sapiens
ctggctccctggacatggggcc

SEQ ID NO: 7683761 - DNA, 22 bp, Homo sapiens
ctggctccctggacatggggcc

SEQ ID NO: 7683762 - DNA, 22 bp, Homo sapiens
ctggctccctggacatggggcc

SEQ ID NO: 7683763 - DNA, 22 bp, Homo sapiens
ctggctccctggacatggggcc

SEQ ID NO: 7683764 - DNA, 22 bp, Homo sapiens
ctggctccctggacatggggcc

SEQ ID NO: 7683765 - DNA, 22 bp, Homo sapiens
ctggctccctctccctgagtca

SEQ ID NO: 7683766 - DNA, 22 bp, Homo sapiens
ctggctccctctccctgagtca

SEQ ID NO: 7683767 - DNA, 22 bp, Homo sapiens
ctggctccctctccctgagtca

SEQ ID NO: 7683768 - DNA, 22 bp, Homo sapiens
ctggctccctctccctgagtca

SEQ ID NO: 7683769 - DNA, 22 bp, Homo sapiens
ctggctccctcgctgaggtgct

SEQ ID NO: 7683770 - DNA, 22 bp, Homo sapiens
ctggctccctcgctgaggtgct

SEQ ID NO: 7683771 - DNA, 22 bp, Homo sapiens
ctggctccagtgacaagtcgat

SEQ ID NO: 7683772 - DNA, 22 bp, Homo sapiens
ctggctccaggtcatgcactca

SEQ ID NO: 7683773 - DNA, 22 bp, Homo sapiens
ctggctccaggtcatgcactca

SEQ ID NO: 7683774 - DNA, 22 bp, Homo sapiens
ctggctccactccctgcctgac

SEQ ID NO: 7683775 - DNA, 22 bp, Homo sapiens
ctggctccactccctgcctgac

SEQ ID NO: 7683776 - DNA, 22 bp, Homo sapiens
ctggctccaggtcatgcactca

SEQ ID NO: 7683777 - DNA, 22 bp, Homo sapiens
ctggctccaggtcatgcactca

SEQ ID NO: 7683778 - DNA, 22 bp, Homo sapiens
ctggctccaggtcatgcactca

SEQ ID NO: 7683779 - DNA, 22 bp, Homo sapiens
ctggctccaggtcatgcactca

SEQ ID NO: 7683780 - DNA, 22 bp, Homo sapiens
ctggctccactccctgcctgac

SEQ ID NO: 7683781 - DNA, 22 bp, Homo sapiens
ctggctccactccctgcctgac

SEQ ID NO: 7683782 - DNA, 22 bp, Homo sapiens
ctggctccactccctgcctgac

SEQ ID NO: 7683783 - DNA, 22 bp, Homo sapiens
ctggctccactccctgcctgac

SEQ ID NO: 7683784 - DNA, 22 bp, Homo sapiens
ctggcctgatctcatgctgtcc

SEQ ID NO: 7683785 - DNA, 22 bp, Homo sapiens
ctggcctgatctcatgctgtcc

SEQ ID NO: 7683786 - DNA, 22 bp, Homo sapiens
ctggcctgatctcatgctgtcc

SEQ ID NO: 7683787 - DNA, 22 bp, Homo sapiens
ctggcctgatctcatgctgtcc

SEQ ID NO: 7683788 - DNA, 22 bp, Homo sapiens
ctggcctgaggtcggctgtagg

SEQ ID NO: 7683789 - DNA, 22 bp, Homo sapiens
ctggcctgcagatcccagggtc

SEQ ID NO: 7683790 - DNA, 22 bp, Homo sapiens
ctggcctgcagatcccagggtc

SEQ ID NO: 7683791 - DNA, 22 bp, Homo sapiens
ctggcctgcagatcccagggtc

SEQ ID NO: 7683792 - DNA, 22 bp, Homo sapiens
ctggcctgcagatcccagggtc

SEQ ID NO: 7683793 - DNA, 22 bp, Homo sapiens
ctggcctgatctcatgctgtcc

SEQ ID NO: 7683794 - DNA, 22 bp, Homo sapiens
ctggcctgatctcatgctgtcc

SEQ ID NO: 7683795 - DNA, 22 bp, Homo sapiens
ctggcctgcagatcccagggtc

SEQ ID NO: 7683796 - DNA, 22 bp, Homo sapiens
ctggcctgcagatcccagggtc

SEQ ID NO: 7683797 - DNA, 22 bp, Homo sapiens
ctggcctgcagatcccagggtc

SEQ ID NO: 7683798 - DNA, 22 bp, Homo sapiens
ctggcctgcagatcccagggtc

SEQ ID NO: 7683799 - DNA, 22 bp, Homo sapiens
ctggcctgcctgccggttgtcg

SEQ ID NO: 7683800 - DNA, 22 bp, Homo sapiens
ctggcctgcctgccggttgtcg

SEQ ID NO: 7683801 - DNA, 22 bp, Homo sapiens
ctggcctgcctgccggttgtcg

SEQ ID NO: 7683802 - DNA, 22 bp, Homo sapiens
ctggcctgctgggtgaggtcct

SEQ ID NO: 7683803 - DNA, 22 bp, Homo sapiens
ctggcctgctgggtgaggtcct

SEQ ID NO: 7683804 - DNA, 22 bp, Homo sapiens
ctggcctgctgggtgaggtcct

SEQ ID NO: 7683805 - DNA, 22 bp, Homo sapiens
ctggcctgctgggtgaggtcct

SEQ ID NO: 7683806 - DNA, 22 bp, Homo sapiens
ctggcctgctgggtgaggtcct

SEQ ID NO: 7683807 - DNA, 22 bp, Homo sapiens
ctggcctggcaggggacctcta

SEQ ID NO: 7683808 - DNA, 22 bp, Homo sapiens
ctggcctggcaggggacctcta

SEQ ID NO: 7683809 - DNA, 22 bp, Homo sapiens
ctggcctggcaggggacctcta

SEQ ID NO: 7683810 - DNA, 22 bp, Homo sapiens
ctggcctggcaggggacctcta

SEQ ID NO: 7683811 - DNA, 22 bp, Homo sapiens
ctggcctggcaggggacctcta

SEQ ID NO: 7683812 - DNA, 22 bp, Homo sapiens
ctggcctggcagggagggcatg

SEQ ID NO: 7683813 - DNA, 22 bp, Homo sapiens
ctggcctggcagggagggcatg

SEQ ID NO: 7683814 - DNA, 22 bp, Homo sapiens
ctggcctggcagggagggcatg

SEQ ID NO: 7683815 - DNA, 22 bp, Homo sapiens
ctggcctggcagggagggcatg

SEQ ID NO: 7683816 - DNA, 22 bp, Homo sapiens
ctggcctggcagggagggcatg

SEQ ID NO: 7683817 - DNA, 22 bp, Homo sapiens
ctggcctggcagggagggcatg

SEQ ID NO: 7683818 - DNA, 22 bp, Homo sapiens
ctggcctggcagggagggcatg

SEQ ID NO: 7683819 - DNA, 22 bp, Homo sapiens
ctggcctggcagggagggcatg

SEQ ID NO: 7683820 - DNA, 22 bp, Homo sapiens
ctggcctggcagggagggcatg

SEQ ID NO: 7683821 - DNA, 22 bp, Homo sapiens
ctggcctggagcctctgggtgg

SEQ ID NO: 7683822 - DNA, 22 bp, Homo sapiens
ctggcctgctgggtgaggtcct

SEQ ID NO: 7683823 - DNA, 22 bp, Homo sapiens
ctggcctggagcctctgggtgg

SEQ ID NO: 7683824 - DNA, 22 bp, Homo sapiens
ctggcctggagcctctgggtgg

SEQ ID NO: 7683825 - DNA, 22 bp, Homo sapiens
ctggcctggagcctctgggtgg

SEQ ID NO: 7683826 - DNA, 22 bp, Homo sapiens
ctggcctggagcctctgggtgg

SEQ ID NO: 7683827 - DNA, 22 bp, Homo sapiens
ctggcctggagcctctgggtgg

SEQ ID NO: 7683828 - DNA, 22 bp, Homo sapiens
ctggccctgtggaggcaggaac

SEQ ID NO: 7683829 - DNA, 21 bp, Homo sapiens
ctggcccagggatctgcattt

SEQ ID NO: 7683830 - DNA, 22 bp, Homo sapiens
ctggccctgtggaggcaggaac

SEQ ID NO: 7683831 - DNA, 22 bp, Homo sapiens
ctggccctgtggaggcaggaac

SEQ ID NO: 7683832 - DNA, 22 bp, Homo sapiens
ctggccctgtggcctaaggact

SEQ ID NO: 7683833 - DNA, 22 bp, Homo sapiens
ctggcccttaggaaaacaaagt

SEQ ID NO: 7683834 - DNA, 22 bp, Homo sapiens
ctggccctgtggcctaaggact

SEQ ID NO: 7683835 - DNA, 22 bp, Homo sapiens
ctggccctgtggcctaaggact

SEQ ID NO: 7683836 - DNA, 22 bp, Homo sapiens
ctggccctgtggcctaaggact

SEQ ID NO: 7683837 - DNA, 22 bp, Homo sapiens
ctggcctgagaatgctaccctt

SEQ ID NO: 7683838 - DNA, 22 bp, Homo sapiens
ctggcctgagaatgctaccctt

SEQ ID NO: 7683839 - DNA, 22 bp, Homo sapiens
ctggcctgagaatgctaccctt

SEQ ID NO: 7683840 - DNA, 22 bp, Homo sapiens
ctggcctgagaatgctaccctt

SEQ ID NO: 7683841 - DNA, 22 bp, Homo sapiens
ctggcctgagaatgctaccctt

SEQ ID NO: 7683842 - DNA, 22 bp, Homo sapiens
ctggcctgagaatgctaccctt

SEQ ID NO: 7683843 - DNA, 22 bp, Homo sapiens
ctggcctgagaatgctaccctt

SEQ ID NO: 7683844 - DNA, 22 bp, Homo sapiens
ctggcccttctcttgcttcctg

SEQ ID NO: 7683845 - DNA, 22 bp, Homo sapiens
ctggcccttctcttgcttcctg

SEQ ID NO: 7683846 - DNA, 22 bp, Homo sapiens
ctggcccttctcttgcttcctg

SEQ ID NO: 7683847 - DNA, 22 bp, Homo sapiens
ctggccctgtggcctaaggact

SEQ ID NO: 7683848 - DNA, 22 bp, Homo sapiens
ctggcccttaggaaaacaaagt

SEQ ID NO: 7683849 - DNA, 22 bp, Homo sapiens
ctggcctctgtgttcaccatag

SEQ ID NO: 7683850 - DNA, 22 bp, Homo sapiens
ctggcctctgtgttcaccatag

SEQ ID NO: 7683851 - DNA, 22 bp, Homo sapiens
ctggcctctgtgttcaccatag

SEQ ID NO: 7683852 - DNA, 22 bp, Homo sapiens
ctggcctgaggccgccttcaga

SEQ ID NO: 7683853 - DNA, 22 bp, Homo sapiens
ctggcctgagcacagcggctgc

SEQ ID NO: 7683854 - DNA, 22 bp, Homo sapiens
ctggcctgagcacagcggctgc

SEQ ID NO: 7683855 - DNA, 22 bp, Homo sapiens
ctggcctgagaatgctaccctt

SEQ ID NO: 7683856 - DNA, 22 bp, Homo sapiens
ctggcctgagcacagcggctgc

SEQ ID NO: 7683857 - DNA, 22 bp, Homo sapiens
ctggcctgagcacagcggctgc

SEQ ID NO: 7683858 - DNA, 22 bp, Homo sapiens
ctggcctgagcacagcggctgc

SEQ ID NO: 7683859 - DNA, 22 bp, Homo sapiens
ctggcctgagcacagcggctgc

SEQ ID NO: 7683860 - DNA, 22 bp, Homo sapiens
ctggcctgagcacagcggctgc

SEQ ID NO: 7683861 - DNA, 22 bp, Homo sapiens
ctggcctgaggtcggctgtagg

SEQ ID NO: 7683862 - DNA, 22 bp, Homo sapiens
ctggcctgaggtcggctgtagg

SEQ ID NO: 7683863 - DNA, 22 bp, Homo sapiens
ctggcctgaggtcggctgtagg

SEQ ID NO: 7683864 - DNA, 22 bp, Homo sapiens
ctggcctgaggccgccttcaga

SEQ ID NO: 7683865 - DNA, 22 bp, Homo sapiens
ctggcctgaggccgccttcaga

SEQ ID NO: 7683866 - DNA, 22 bp, Homo sapiens
ctggcctgaggccgccttcaga

SEQ ID NO: 7683867 - DNA, 22 bp, Homo sapiens
ctggcctgaggccgccttcaga

SEQ ID NO: 7683868 - DNA, 22 bp, Homo sapiens
ctggcctgaggccgccttcaga

SEQ ID NO: 7683869 - DNA, 22 bp, Homo sapiens
ctggcctgaggccgccttcaga

SEQ ID NO: 7683870 - DNA, 22 bp, Homo sapiens
ctggcctgaggccgccttcaga

SEQ ID NO: 7683871 - DNA, 22 bp, Homo sapiens
ctggcctgaggccgccttcaga

SEQ ID NO: 7683872 - DNA, 22 bp, Homo sapiens
ctggcctgaggccgccttcaga

SEQ ID NO: 7683873 - DNA, 22 bp, Homo sapiens
ctggccatgttgcctctgagac

SEQ ID NO: 7683874 - DNA, 22 bp, Homo sapiens
ctggccatatccaccagatgga

SEQ ID NO: 7683875 - DNA, 22 bp, Homo sapiens
ctggccatctcctgccagcggt

SEQ ID NO: 7683876 - DNA, 22 bp, Homo sapiens
ctggccatggagaaggtgaagc

SEQ ID NO: 7683877 - DNA, 22 bp, Homo sapiens
ctggccatggagaaggtgaagc

SEQ ID NO: 7683878 - DNA, 22 bp, Homo sapiens
ctggccagttgtcctggcttgg

SEQ ID NO: 7683879 - DNA, 22 bp, Homo sapiens
ctggccagttgtcctggcttgg

SEQ ID NO: 7683880 - DNA, 22 bp, Homo sapiens
ctggccataggttctcagtgtg

SEQ ID NO: 7683881 - DNA, 22 bp, Homo sapiens
ctggccataggttctcagtgtg

SEQ ID NO: 7683882 - DNA, 22 bp, Homo sapiens
ctggccataggttctcagtgtg

SEQ ID NO: 7683883 - DNA, 22 bp, Homo sapiens
ctggcccagagagcagagctta

SEQ ID NO: 7683884 - DNA, 22 bp, Homo sapiens
ctggcccagagagcagagctta

SEQ ID NO: 7683885 - DNA, 22 bp, Homo sapiens
ctggcccagagagcagagctta

SEQ ID NO: 7683886 - DNA, 22 bp, Homo sapiens
ctggcccagagagcagagctta

SEQ ID NO: 7683887 - DNA, 22 bp, Homo sapiens
ctggcccagagagcagagctta

SEQ ID NO: 7683888 - DNA, 22 bp, Homo sapiens
ctggcccagagagcagagctta

SEQ ID NO: 7683889 - DNA, 22 bp, Homo sapiens
ctggcccagagagcagagctta

SEQ ID NO: 7683890 - DNA, 22 bp, Homo sapiens
ctggccagttgccttcctgggt

SEQ ID NO: 7683891 - DNA, 22 bp, Homo sapiens
ctggccagttgccttcctgggt

SEQ ID NO: 7683892 - DNA, 22 bp, Homo sapiens
ctggccagttgccttcctgggt

SEQ ID NO: 7683893 - DNA, 22 bp, Homo sapiens
ctggccagttgccttcctgggt

SEQ ID NO: 7683894 - DNA, 22 bp, Homo sapiens
ctggccagttgtcctggcttgg

SEQ ID NO: 7683895 - DNA, 22 bp, Homo sapiens
ctggccagttgtcctggcttgg

SEQ ID NO: 7683896 - DNA, 22 bp, Homo sapiens
ctggccagttgtcctggcttgg

SEQ ID NO: 7683897 - DNA, 22 bp, Homo sapiens
ctggccagttgtcctggcttgg

SEQ ID NO: 7683898 - DNA, 22 bp, Homo sapiens
ctggccagtgtggctctgatct

SEQ ID NO: 7683899 - DNA, 22 bp, Homo sapiens
ctggccagtgtggctctgatct

SEQ ID NO: 7683900 - DNA, 22 bp, Homo sapiens
ctggccagtgtggctctgatct

SEQ ID NO: 7683901 - DNA, 22 bp, Homo sapiens
ctggccagttactgctattggc

SEQ ID NO: 7683902 - DNA, 22 bp, Homo sapiens
ctggccagttactgctattggc

SEQ ID NO: 7683903 - DNA, 22 bp, Homo sapiens
ctggccagtgtggctctgatct

SEQ ID NO: 7683904 - DNA, 22 bp, Homo sapiens
ctggccagtgtggctctgatct

SEQ ID NO: 7683905 - DNA, 17 bp, Homo sapiens
ctggccagtgtacttgg

SEQ ID NO: 7683906 - DNA, 22 bp, Homo sapiens
ctggcccaggctcctggggcac

SEQ ID NO: 7683907 - DNA, 22 bp, Homo sapiens
ctggcccaggctcctggggcac

SEQ ID NO: 7683908 - DNA, 22 bp, Homo sapiens
ctggcccaggctcctggggcac

SEQ ID NO: 7683909 - DNA, 22 bp, Homo sapiens
ctggcccaggctcctggggcac

SEQ ID NO: 7683910 - DNA, 22 bp, Homo sapiens
ctggcccaggctcctggggcac

SEQ ID NO: 7683911 - DNA, 20 bp, Homo sapiens
ctggcccaggatgatggcgc

SEQ ID NO: 7683912 - DNA, 20 bp, Homo sapiens
ctggcccaggatgatggcgc

SEQ ID NO: 7683913 - DNA, 22 bp, Homo sapiens
ctggcccaggctcctggggcac

SEQ ID NO: 7683914 - DNA, 22 bp, Homo sapiens
ctggcccaggctcctggggcac

SEQ ID NO: 7683915 - DNA, 22 bp, Homo sapiens
ctggcccaggctcctggggcac

SEQ ID NO: 7683916 - DNA, 20 bp, Homo sapiens
ctggcccaggatgatggcgc

SEQ ID NO: 7683917 - DNA, 21 bp, Homo sapiens
ctggcccagggatctgcattt

SEQ ID NO: 7683918 - DNA, 21 bp, Homo sapiens
ctggcccagggatctgcattt

SEQ ID NO: 7683919 - DNA, 21 bp, Homo sapiens
ctggcccagggatctgcattt

SEQ ID NO: 7683920 - DNA, 21 bp, Homo sapiens
ctggcccagggatctgcattt

SEQ ID NO: 7683921 - DNA, 21 bp, Homo sapiens
ctggcccagggatctgcattt

SEQ ID NO: 7683922 - DNA, 23 bp, Homo sapiens
ctggcccaggtgagaggttggtg

SEQ ID NO: 7683923 - DNA, 23 bp, Homo sapiens
ctggcccaggtgagaggttggtg

SEQ ID NO: 7683924 - DNA, 23 bp, Homo sapiens
ctggcccaggtgagaggttggtg

SEQ ID NO: 7683925 - DNA, 21 bp, Homo sapiens
ctggcccagggatctgcattt

SEQ ID NO: 7683926 - DNA, 23 bp, Homo sapiens
ctggcccaggtgagaggttggtg

SEQ ID NO: 7683927 - DNA, 23 bp, Homo sapiens
ctggcccaggtgagaggttggtg

SEQ ID NO: 7683928 - DNA, 22 bp, Homo sapiens
ctggcccagagctctggccttt

SEQ ID NO: 7683929 - DNA, 22 bp, Homo sapiens
ctggcccagagctctggccttt

SEQ ID NO: 7683930 - DNA, 22 bp, Homo sapiens
ctggcccagagctctggccttt

SEQ ID NO: 7683931 - DNA, 22 bp, Homo sapiens
ctggcccagagctctggccttt

SEQ ID NO: 7683932 - DNA, 22 bp, Homo sapiens
ctggcccagagctctggccttt

SEQ ID NO: 7683933 - DNA, 22 bp, Homo sapiens
ctggcccaggaagacgtgtccc

SEQ ID NO: 7683934 - DNA, 22 bp, Homo sapiens
ctggcccagagctctggccttt

SEQ ID NO: 7683935 - DNA, 22 bp, Homo sapiens
ctggcccagagctctggccttt

SEQ ID NO: 7683936 - DNA, 22 bp, Homo sapiens
ctggcccaggaagacgtgtccc

SEQ ID NO: 7683937 - DNA, 22 bp, Homo sapiens
ctggcccaggaagacgtgtccc

SEQ ID NO: 7683938 - DNA, 22 bp, Homo sapiens
ctggcccaggagagcaggcatt

SEQ ID NO: 7683939 - DNA, 22 bp, Homo sapiens
ctggcccaggagagcaggcatt

SEQ ID NO: 7683940 - DNA, 22 bp, Homo sapiens
ctggcccaggagagcaggcatt

SEQ ID NO: 7683941 - DNA, 22 bp, Homo sapiens
ctggcccaggagagcaggcatt

SEQ ID NO: 7683942 - DNA, 22 bp, Homo sapiens
ctggcccaggagagcaggcatt

SEQ ID NO: 7683943 - DNA, 22 bp, Homo sapiens
ctggcccaggagagcaggcatt

SEQ ID NO: 7683944 - DNA, 22 bp, Homo sapiens
ctggcccaggagagcaggcatt

SEQ ID NO: 7683945 - DNA, 20 bp, Homo sapiens
ctggcccaggatgatggcgc

SEQ ID NO: 7683946 - DNA, 20 bp, Homo sapiens
ctggcccaggatgatggcgc

SEQ ID NO: 7683947 - DNA, 20 bp, Homo sapiens
ctggcccaggatgatggcgc

SEQ ID NO: 7683948 - DNA, 20 bp, Homo sapiens
ctggcccaggatgatggcgc

SEQ ID NO: 7683949 - DNA, 22 bp, Homo sapiens
ttcctttccctcacagcctcgg

SEQ ID NO: 7683950 - DNA, 22 bp, Homo sapiens
ttcctttccctcacagcctcgg

SEQ ID NO: 7683951 - DNA, 22 bp, Homo sapiens
ttcctttcccttgcttctgtgc

SEQ ID NO: 7683952 - DNA, 22 bp, Homo sapiens
ttcctttccctcacagcctcgg

SEQ ID NO: 7683953 - DNA, 22 bp, Homo sapiens
ttcctttcacgttttaatgcac

SEQ ID NO: 7683954 - DNA, 22 bp, Homo sapiens
ttcctttccctcacagcctcgg

SEQ ID NO: 7683955 - DNA, 22 bp, Homo sapiens
ttcctttccctcacagcctcgg

SEQ ID NO: 7683956 - DNA, 22 bp, Homo sapiens
ttcctttcacgttttaatgcac

SEQ ID NO: 7683957 - DNA, 22 bp, Homo sapiens
ttccttctaattttacacctga

SEQ ID NO: 7683958 - DNA, 22 bp, Homo sapiens
ttccttctaattttacacctga

SEQ ID NO: 7683959 - DNA, 22 bp, Homo sapiens
ttccttctaattttacacctga

SEQ ID NO: 7683960 - DNA, 22 bp, Homo sapiens
ttccttctaatattctgcctgt

SEQ ID NO: 7683961 - DNA, 22 bp, Homo sapiens
ttccttctaatattctgcctgt

SEQ ID NO: 7683962 - DNA, 22 bp, Homo sapiens
ttccttcctgtcttccttactg

SEQ ID NO: 7683963 - DNA, 22 bp, Homo sapiens
ttccttttatttgtccaggctt

SEQ ID NO: 7683964 - DNA, 22 bp, Homo sapiens
ttccttttatttgtccaggctt

SEQ ID NO: 7683965 - DNA, 20 bp, Homo sapiens
ttccttttcgcctctctccc

SEQ ID NO: 7683966 - DNA, 22 bp, Homo sapiens
ttccttttcatatgccccgcgt

SEQ ID NO: 7683967 - DNA, 22 bp, Homo sapiens
ttccttttacaaatagcctcct

SEQ ID NO: 7683968 - DNA, 22 bp, Homo sapiens
ttccttttacaaatagcctcct

SEQ ID NO: 7683969 - DNA, 22 bp, Homo sapiens
ttcctttgggttaagacatctg

SEQ ID NO: 7683970 - DNA, 22 bp, Homo sapiens
ttccttttacaaatagcctcct

SEQ ID NO: 7683971 - DNA, 22 bp, Homo sapiens
ttccttttacaaatagcctcct

SEQ ID NO: 7683972 - DNA, 22 bp, Homo sapiens
ttccttttagaatcatgaagac

SEQ ID NO: 7683973 - DNA, 22 bp, Homo sapiens
ttccttttagaatcatgaagac

SEQ ID NO: 7683974 - DNA, 22 bp, Homo sapiens
ttccttttagaatcatgaagac

SEQ ID NO: 7683975 - DNA, 22 bp, Homo sapiens
ttccttttagaatcatgaagac

SEQ ID NO: 7683976 - DNA, 22 bp, Homo sapiens
ttcctttctctggactgcagcc

SEQ ID NO: 7683977 - DNA, 22 bp, Homo sapiens
ttcctttctctggactgcagcc

SEQ ID NO: 7683978 - DNA, 22 bp, Homo sapiens
ttcctttcccttgcttctgtgc

SEQ ID NO: 7683979 - DNA, 22 bp, Homo sapiens
ttcctttctctggactgcagcc

SEQ ID NO: 7683980 - DNA, 22 bp, Homo sapiens
ttcctttgggaaatcactaagg

SEQ ID NO: 7683981 - DNA, 22 bp, Homo sapiens
ttcctttctgtcagcctgagtg

SEQ ID NO: 7683982 - DNA, 22 bp, Homo sapiens
ctagcccttggtgagaacagcg

SEQ ID NO: 7683983 - DNA, 22 bp, Homo sapiens
ctagcccagttcttctcattag

SEQ ID NO: 7683984 - DNA, 22 bp, Homo sapiens
ctagcccaggaatgccgtggcc

SEQ ID NO: 7683985 - DNA, 22 bp, Homo sapiens
ctagcctgggatttgaacttat

SEQ ID NO: 7683986 - DNA, 22 bp, Homo sapiens
ctagcctgggatttgaacttat

SEQ ID NO: 7683987 - DNA, 22 bp, Homo sapiens
ctagcctgggatttgaacttat

SEQ ID NO: 7683988 - DNA, 22 bp, Homo sapiens
ctagcccaggaatgccgtggcc

SEQ ID NO: 7683989 - DNA, 22 bp, Homo sapiens
ctagcccaggaatgccgtggcc

SEQ ID NO: 7683990 - DNA, 22 bp, Homo sapiens
ctagcccaggaatgccgtggcc

SEQ ID NO: 7683991 - DNA, 22 bp, Homo sapiens
ttccttttgcaaggtcctctag

SEQ ID NO: 7683992 - DNA, 22 bp, Homo sapiens
ctaggcagatggagaagtggct

SEQ ID NO: 7683993 - DNA, 22 bp, Homo sapiens
ctaggcagatggagaagtggct

SEQ ID NO: 7683994 - DNA, 22 bp, Homo sapiens
ctaggcagactgagctctaggg

SEQ ID NO: 7683995 - DNA, 22 bp, Homo sapiens
ctaggcagactgagctctaggg

SEQ ID NO: 7683996 - DNA, 22 bp, Homo sapiens
ctaggcagctttgggtgtgaag

SEQ ID NO: 7683997 - DNA, 20 bp, Homo sapiens
ctaggcagcgagtgactgag

SEQ ID NO: 7683998 - DNA, 20 bp, Homo sapiens
ctaggcagcgagtgactgag

SEQ ID NO: 7683999 - DNA, 20 bp, Homo sapiens
ctaggcagcgagtgactgag

SEQ ID NO: 7684000 - DNA, 20 bp, Homo sapiens
ctaggcagcgagtgactgag

SEQ ID NO: 7684001 - DNA, 22 bp, Homo sapiens
ttccttttcttaaacatatgtg

SEQ ID NO: 7684002 - DNA, 22 bp, Homo sapiens
ttccttttcttaaacatatgtg

SEQ ID NO: 7684003 - DNA, 22 bp, Homo sapiens
ttccttttcttaaacatatgtg

SEQ ID NO: 7684004 - DNA, 22 bp, Homo sapiens
ttccttttcttaaacatatgtg

SEQ ID NO: 7684005 - DNA, 22 bp, Homo sapiens
ttccttttcttaaacatatgtg

SEQ ID NO: 7684006 - DNA, 22 bp, Homo sapiens
ttccttttcttaaacatatgtg

SEQ ID NO: 7684007 - DNA, 22 bp, Homo sapiens
ttccttttcttaaacatatgtg

SEQ ID NO: 7684008 - DNA, 22 bp, Homo sapiens
ttccttttctcacggggatcca

SEQ ID NO: 7684009 - DNA, 20 bp, Homo sapiens
ttccttttcgcctctctccc

SEQ ID NO: 7684010 - DNA, 20 bp, Homo sapiens
ttccttttcgcctctctccc

SEQ ID NO: 7684011 - DNA, 20 bp, Homo sapiens
ttccttttcgcctctctccc

SEQ ID NO: 7684012 - DNA, 20 bp, Homo sapiens
ttccttttcgcctctctccc

SEQ ID NO: 7684013 - DNA, 20 bp, Homo sapiens
ttccttttcgcctctctccc

SEQ ID NO: 7684014 - DNA, 22 bp, Homo sapiens
ttccttttcttatgcatcatta

SEQ ID NO: 7684015 - DNA, 22 bp, Homo sapiens
ttccttttcttatgcatcatta

SEQ ID NO: 7684016 - DNA, 22 bp, Homo sapiens
ttccttttcttatgcatcatta

SEQ ID NO: 7684017 - DNA, 22 bp, Homo sapiens
ttccttttcttaaacatatgtg

SEQ ID NO: 7684018 - DNA, 22 bp, Homo sapiens
ttccttttcttaaacatatgtg

SEQ ID NO: 7684019 - DNA, 22 bp, Homo sapiens
ttccttttcttctaccacatgt

SEQ ID NO: 7684020 - DNA, 22 bp, Homo sapiens
ttccttttcttctaccacatgt

SEQ ID NO: 7684021 - DNA, 22 bp, Homo sapiens
ttccttttcttctaccacatgt

SEQ ID NO: 7684022 - DNA, 22 bp, Homo sapiens
ttccttttcttctaccacatgt

SEQ ID NO: 7684023 - DNA, 22 bp, Homo sapiens
ttccttttcttctaccacatgt

SEQ ID NO: 7684024 - DNA, 22 bp, Homo sapiens
ttccttttgcaaggtcctctag

SEQ ID NO: 7684025 - DNA, 22 bp, Homo sapiens
ttccttttgcaaggtcctctag

SEQ ID NO: 7684026 - DNA, 22 bp, Homo sapiens
ttccttttcttctaccacatgt

SEQ ID NO: 7684027 - DNA, 22 bp, Homo sapiens
ctaggcagtcctgacggtacta

SEQ ID NO: 7684028 - DNA, 22 bp, Homo sapiens
ctaggcagggtgctgtgccatg

SEQ ID NO: 7684029 - DNA, 22 bp, Homo sapiens
ctaggcagggtgctgtgccatg

SEQ ID NO: 7684030 - DNA, 22 bp, Homo sapiens
ctaggccagagagacctcatga

SEQ ID NO: 7684031 - DNA, 22 bp, Homo sapiens
ctaggccacagggcaaaaagga

SEQ ID NO: 7684032 - DNA, 22 bp, Homo sapiens
ctaggccagagagacctcatga

SEQ ID NO: 7684033 - DNA, 22 bp, Homo sapiens
ctaggcagggtgctgtgccatg

SEQ ID NO: 7684034 - DNA, 22 bp, Homo sapiens
ctaggcagggtgctgtgccatg

SEQ ID NO: 7684035 - DNA, 23 bp, Homo sapiens
ctaggcaggattgtaggcgggta

SEQ ID NO: 7684036 - DNA, 23 bp, Homo sapiens
ctaggcaggattgtaggcgggta

SEQ ID NO: 7684037 - DNA, 22 bp, Homo sapiens
ctaggcagctttgggtgtgaag

SEQ ID NO: 7684038 - DNA, 22 bp, Homo sapiens
ctaggctgagctgggctgagct

SEQ ID NO: 7684039 - DNA, 22 bp, Homo sapiens
ctaggctgcacctaggatggct

SEQ ID NO: 7684040 - DNA, 22 bp, Homo sapiens
ctaggctgcacctaggatggct

SEQ ID NO: 7684041 - DNA, 22 bp, Homo sapiens
ctaggctgagctgggctgagct

SEQ ID NO: 7684042 - DNA, 22 bp, Homo sapiens
ctaggctgagctgggctgagct

SEQ ID NO: 7684043 - DNA, 22 bp, Homo sapiens
ctaggctctgccagcactgtcg

SEQ ID NO: 7684044 - DNA, 22 bp, Homo sapiens
ctaggctcagtctctggtctgt

SEQ ID NO: 7684045 - DNA, 22 bp, Homo sapiens
ctaggctcttctggaaggttgt

SEQ ID NO: 7684046 - DNA, 22 bp, Homo sapiens
ctaggctctgccagcactgtcg

SEQ ID NO: 7684047 - DNA, 22 bp, Homo sapiens
ctaggctgagctgggctgagct

SEQ ID NO: 7684048 - DNA, 22 bp, Homo sapiens
ctaggctgagctgggctgagct

SEQ ID NO: 7684049 - DNA, 22 bp, Homo sapiens
ctaggctcaggtgactccaagc

SEQ ID NO: 7684050 - DNA, 22 bp, Homo sapiens
ctaggctcaggtgactccaagc

SEQ ID NO: 7684051 - DNA, 22 bp, Homo sapiens
ctaggctcagtctctggtctgt

SEQ ID NO: 7684052 - DNA, 22 bp, Homo sapiens
ctaggctcagtctctggtctgt

SEQ ID NO: 7684053 - DNA, 22 bp, Homo sapiens
ctaggccttcataggcatggaa

SEQ ID NO: 7684054 - DNA, 22 bp, Homo sapiens
ctaggccttcataggcatggaa

SEQ ID NO: 7684055 - DNA, 22 bp, Homo sapiens
ctaggccttcataggcatggaa

SEQ ID NO: 7684056 - DNA, 22 bp, Homo sapiens
ctaggcccatgaggtttgctgg

SEQ ID NO: 7684057 - DNA, 22 bp, Homo sapiens
ctaggccatattttgagaactg

SEQ ID NO: 7684058 - DNA, 22 bp, Homo sapiens
ctaggccagttaggaagagaag

SEQ ID NO: 7684059 - DNA, 22 bp, Homo sapiens
ctaggccagttaggaagagaag

SEQ ID NO: 7684060 - DNA, 22 bp, Homo sapiens
ctagggaagtctgtattttgtg

SEQ ID NO: 7684061 - DNA, 22 bp, Homo sapiens
ctagggaacaagatgcccaggg

SEQ ID NO: 7684062 - DNA, 22 bp, Homo sapiens
ctaggcttgcagggtggacatg

SEQ ID NO: 7684063 - DNA, 17 bp, Homo sapiens
ctaggcttggcagctcg

SEQ ID NO: 7684064 - DNA, 22 bp, Homo sapiens
ctagggaaataaactgagtggt

SEQ ID NO: 7684065 - DNA, 22 bp, Homo sapiens
ctagggaaagtggacatggctt

SEQ ID NO: 7684066 - DNA, 22 bp, Homo sapiens
ctagggactgggaccttagtta

SEQ ID NO: 7684067 - DNA, 22 bp, Homo sapiens
ctagggaatgagagactggatc

SEQ ID NO: 7684068 - DNA, 22 bp, Homo sapiens
ctagggacagaaagagggtaga

SEQ ID NO: 7684069 - DNA, 22 bp, Homo sapiens
ctagggagactcgcaggactca

SEQ ID NO: 7684070 - DNA, 22 bp, Homo sapiens
ctagggagactcgcaggactca

SEQ ID NO: 7684071 - DNA, 22 bp, Homo sapiens
ctagggagactcgcaggactca

SEQ ID NO: 7684072 - DNA, 22 bp, Homo sapiens
ctagggagcactagctgccttg

SEQ ID NO: 7684073 - DNA, 22 bp, Homo sapiens
ctagggagcactagctgccttg

SEQ ID NO: 7684074 - DNA, 22 bp, Homo sapiens
ctaggctgtaacccctgccagg

SEQ ID NO: 7684075 - DNA, 22 bp, Homo sapiens
ctaggctgtaaagagctaggag

SEQ ID NO: 7684076 - DNA, 22 bp, Homo sapiens
ctaggctgtgcattgcatgaca

SEQ ID NO: 7684077 - DNA, 22 bp, Homo sapiens
ctaggctgttcatgctcagacc

SEQ ID NO: 7684078 - DNA, 22 bp, Homo sapiens
ctaggctgttcatgctcagacc

SEQ ID NO: 7684079 - DNA, 22 bp, Homo sapiens
ctaggctggagtgcattggcgt

SEQ ID NO: 7684080 - DNA, 22 bp, Homo sapiens
ctaggctggagtgcattggcgt

SEQ ID NO: 7684081 - DNA, 22 bp, Homo sapiens
ctaggctgtaaagagctaggag

SEQ ID NO: 7684082 - DNA, 22 bp, Homo sapiens
ctaggctgcagatgcatggaat

SEQ ID NO: 7684083 - DNA, 22 bp, Homo sapiens
ctaggctgcacctaggatggct

SEQ ID NO: 7684084 - DNA, 22 bp, Homo sapiens
ctaggctgcacctaggatggct

SEQ ID NO: 7684085 - DNA, 22 bp, Homo sapiens
ctaggctgcacctaggatggct

SEQ ID NO: 7684086 - DNA, 22 bp, Homo sapiens
ctaggctggagtgcagtggcac

SEQ ID NO: 7684087 - DNA, 22 bp, Homo sapiens
ctaggctggagtgcagtggcac

SEQ ID NO: 7684088 - DNA, 22 bp, Homo sapiens
ctaggctgcagatgcatggaat

SEQ ID NO: 7684089 - DNA, 22 bp, Homo sapiens
ctaggctgcagatgcatggaat

SEQ ID NO: 7684090 - DNA, 22 bp, Homo sapiens
ctaggctggagtgcattggcgt

SEQ ID NO: 7684091 - DNA, 22 bp, Homo sapiens
ctaggctggagtgcagtggcat

SEQ ID NO: 7684092 - DNA, 22 bp, Homo sapiens
ctaggctggagtgcagtggcat

SEQ ID NO: 7684093 - DNA, 22 bp, Homo sapiens
ctaggctggagtgcagtggcac

SEQ ID NO: 7684094 - DNA, 22 bp, Homo sapiens
ctaggctggagtgcagtggcat

SEQ ID NO: 7684095 - DNA, 22 bp, Homo sapiens
ctattttaacttgattacctct

SEQ ID NO: 7684096 - DNA, 22 bp, Homo sapiens
ctattttaacttgattacctct

SEQ ID NO: 7684097 - DNA, 22 bp, Homo sapiens
ctattttaacttgattacctct

SEQ ID NO: 7684098 - DNA, 22 bp, Homo sapiens
ttctgtacttcaggggctctgt

SEQ ID NO: 7684099 - DNA, 22 bp, Homo sapiens
ttctgtaggcacacagtttcaa

SEQ ID NO: 7684100 - DNA, 21 bp, Homo sapiens
ttctgtagctgttagcttttc

SEQ ID NO: 7684101 - DNA, 22 bp, Homo sapiens
ttctgtaggacttctgccaact

SEQ ID NO: 7684102 - DNA, 22 bp, Homo sapiens
ttctgtaggcatggaacaggga

SEQ ID NO: 7684103 - DNA, 22 bp, Homo sapiens
ttctgtaggcatggaacaggga

SEQ ID NO: 7684104 - DNA, 22 bp, Homo sapiens
ttctgtatacgttacaattgag

SEQ ID NO: 7684105 - DNA, 22 bp, Homo sapiens
ctattttaacttgattacctct

SEQ ID NO: 7684106 - DNA, 22 bp, Homo sapiens
ctattttaacttgattacctct

SEQ ID NO: 7684107 - DNA, 22 bp, Homo sapiens
ctattttaacttgattacctct

SEQ ID NO: 7684108 - DNA, 22 bp, Homo sapiens
ctattttaacttgattacctct

SEQ ID NO: 7684109 - DNA, 22 bp, Homo sapiens
ctattttaacttgattacctct

SEQ ID NO: 7684110 - DNA, 22 bp, Homo sapiens
ctattttaacttgattacctct

SEQ ID NO: 7684111 - DNA, 22 bp, Homo sapiens
ctattttaacttgattacctct

SEQ ID NO: 7684112 - DNA, 22 bp, Homo sapiens
ctatttgtacagcattagtaat

SEQ ID NO: 7684113 - DNA, 22 bp, Homo sapiens
ctatttgtacagcattcgagtt

SEQ ID NO: 7684114 - DNA, 22 bp, Homo sapiens
ctatttgtacagcattcgagtt

SEQ ID NO: 7684115 - DNA, 22 bp, Homo sapiens
ttctgtcaaactcacaggccga

SEQ ID NO: 7684116 - DNA, 22 bp, Homo sapiens
ttctgtatttcaatgtctttat

SEQ ID NO: 7684117 - DNA, 22 bp, Homo sapiens
ttctgtatttcaatgtctttat

SEQ ID NO: 7684118 - DNA, 22 bp, Homo sapiens
ttctgtatttagtttgaggaca

SEQ ID NO: 7684119 - DNA, 22 bp, Homo sapiens
ttctgtatttagtttgaggaca

SEQ ID NO: 7684120 - DNA, 22 bp, Homo sapiens
ttctgtatgtatgccagagcat

SEQ ID NO: 7684121 - DNA, 22 bp, Homo sapiens
ttctgtatgtacatatgtgtat

SEQ ID NO: 7684122 - DNA, 22 bp, Homo sapiens
ttctgtatgtacatatgtgtat

SEQ ID NO: 7684123 - DNA, 22 bp, Homo sapiens
ttctgtatgtacatatgtgtat

SEQ ID NO: 7684124 - DNA, 22 bp, Homo sapiens
ttctgtatattgaggttatagt

SEQ ID NO: 7684125 - DNA, 22 bp, Homo sapiens
ttctgtatctctgtgtttcttg

SEQ ID NO: 7684126 - DNA, 22 bp, Homo sapiens
ttctgtatctctgtgtttcttg

SEQ ID NO: 7684127 - DNA, 22 bp, Homo sapiens
ttctgtatgccaatgggttttt

SEQ ID NO: 7684128 - DNA, 22 bp, Homo sapiens
ttctgtatgccaatgggttttt

SEQ ID NO: 7684129 - DNA, 22 bp, Homo sapiens
ttctgtatgctctgggtccaga

SEQ ID NO: 7684130 - DNA, 22 bp, Homo sapiens
ttctgtatcttcagtgcccagc

SEQ ID NO: 7684131 - DNA, 22 bp, Homo sapiens
ttctgtatctttcttcaagatt

SEQ ID NO: 7684132 - DNA, 22 bp, Homo sapiens
ttctgtccactgctggggcctc

SEQ ID NO: 7684133 - DNA, 22 bp, Homo sapiens
ttctgtccactgctggggcctc

SEQ ID NO: 7684134 - DNA, 22 bp, Homo sapiens
ttctgtcatttagcattgtcat

SEQ ID NO: 7684135 - DNA, 22 bp, Homo sapiens
ttctgtccaaagagaggttctt

SEQ ID NO: 7684136 - DNA, 22 bp, Homo sapiens
ttctgtccaaagagaggttctt

SEQ ID NO: 7684137 - DNA, 22 bp, Homo sapiens
ttctgtcccactggtctgtttg

SEQ ID NO: 7684138 - DNA, 22 bp, Homo sapiens
ttctgtccaggcgcccagctat

SEQ ID NO: 7684139 - DNA, 22 bp, Homo sapiens
ttctgtccaggcgcccagctat

SEQ ID NO: 7684140 - DNA, 22 bp, Homo sapiens
ttctgtccaggcgcccagctat

SEQ ID NO: 7684141 - DNA, 21 bp, Homo sapiens
ttcttcctaaatacagatctc

SEQ ID NO: 7684142 - DNA, 21 bp, Homo sapiens
ttcttcctaaatacagatctc

SEQ ID NO: 7684143 - DNA, 21 bp, Homo sapiens
ttcttcctaaatacagatctc

SEQ ID NO: 7684144 - DNA, 21 bp, Homo sapiens
ttcttcctaaatacagatctc

SEQ ID NO: 7684145 - DNA, 22 bp, Homo sapiens
ttcttggaaatacattcaataa

SEQ ID NO: 7684146 - DNA, 22 bp, Homo sapiens
ttcttcctcacactctcaccca

SEQ ID NO: 7684147 - DNA, 22 bp, Homo sapiens
ttcttcctcacactctcaccca

SEQ ID NO: 7684148 - DNA, 22 bp, Homo sapiens
ttcttcctcacactctcaccca

SEQ ID NO: 7684149 - DNA, 22 bp, Homo sapiens
ttcttcctcacactctcaccca

SEQ ID NO: 7684150 - DNA, 22 bp, Homo sapiens
ttcttcctcacactctcaccca

SEQ ID NO: 7684151 - DNA, 22 bp, Homo sapiens
ttcttggagataaattcttaca

SEQ ID NO: 7684152 - DNA, 22 bp, Homo sapiens
ttcttggaaatacattcaataa

SEQ ID NO: 7684153 - DNA, 22 bp, Homo sapiens
ttcttggatgccctcatgcctt

SEQ ID NO: 7684154 - DNA, 22 bp, Homo sapiens
ttcttggagataaattcttaca

SEQ ID NO: 7684155 - DNA, 22 bp, Homo sapiens
ttcttggagataaattcttaca

SEQ ID NO: 7684156 - DNA, 22 bp, Homo sapiens
ttcttggatgccctcatgcctt

SEQ ID NO: 7684157 - DNA, 22 bp, Homo sapiens
ttctgtcatgctcatgtaattg

SEQ ID NO: 7684158 - DNA, 22 bp, Homo sapiens
ttctgtcatgctcatgtaattg

SEQ ID NO: 7684159 - DNA, 22 bp, Homo sapiens
ttctgtcagcgtcagaaattct

SEQ ID NO: 7684160 - DNA, 22 bp, Homo sapiens
ttctgtcagcgtcagaaattct

SEQ ID NO: 7684161 - DNA, 22 bp, Homo sapiens
ttctgtcagctgctttgtctca

SEQ ID NO: 7684162 - DNA, 22 bp, Homo sapiens
ttctgtcagaagctagctcctg

SEQ ID NO: 7684163 - DNA, 20 bp, Homo sapiens
ttctgtcagattatatggga

SEQ ID NO: 7684164 - DNA, 22 bp, Homo sapiens
ttctgtcacagtgctggtatca

SEQ ID NO: 7684165 - DNA, 22 bp, Homo sapiens
ttctgtcaaatgccagtagaga

SEQ ID NO: 7684166 - DNA, 22 bp, Homo sapiens
ttctgtcacttttttggaatct

SEQ ID NO: 7684167 - DNA, 22 bp, Homo sapiens
ttctgtcacttgcaatcaagag

SEQ ID NO: 7684168 - DNA, 22 bp, Homo sapiens
ttctgtcacttttttggaatct

SEQ ID NO: 7684169 - DNA, 22 bp, Homo sapiens
ttctgtcacttgcaatcaagag

SEQ ID NO: 7684170 - DNA, 22 bp, Homo sapiens
ttctgtcacttgcaatcaagag

SEQ ID NO: 7684171 - DNA, 22 bp, Homo sapiens
ttctgtcacttgcaatcaagag

SEQ ID NO: 7684172 - DNA, 22 bp, Homo sapiens
ctatttattgtgggtatccagg

SEQ ID NO: 7684173 - DNA, 22 bp, Homo sapiens
ctatttatgtgctattttgtat

SEQ ID NO: 7684174 - DNA, 22 bp, Homo sapiens
ctatttattgtgggtatccagg

SEQ ID NO: 7684175 - DNA, 22 bp, Homo sapiens
ctatttcaaggcccagatatga

SEQ ID NO: 7684176 - DNA, 22 bp, Homo sapiens
ctatttcaaggcccagatatga

SEQ ID NO: 7684177 - DNA, 22 bp, Homo sapiens
ctatttattgtgggtatccagg

SEQ ID NO: 7684178 - DNA, 22 bp, Homo sapiens
ctatttcaaggcccagatatga

SEQ ID NO: 7684179 - DNA, 22 bp, Homo sapiens
ctatttatgtgctattttgtat

SEQ ID NO: 7684180 - DNA, 22 bp, Homo sapiens
ctatttatgtgctattttgtat

SEQ ID NO: 7684181 - DNA, 22 bp, Homo sapiens
ctattccattccatagtagaaa

SEQ ID NO: 7684182 - DNA, 22 bp, Homo sapiens
ctattccattccatagtagaaa

SEQ ID NO: 7684183 - DNA, 22 bp, Homo sapiens
ctattccacttttggcaaagcc

SEQ ID NO: 7684184 - DNA, 22 bp, Homo sapiens
ctattcaattttgctattgtag

SEQ ID NO: 7684185 - DNA, 22 bp, Homo sapiens
ctagggctcgcaagggctggag

SEQ ID NO: 7684186 - DNA, 22 bp, Homo sapiens
ctattcagttgtgggcaacaat

SEQ ID NO: 7684187 - DNA, 22 bp, Homo sapiens
ctattcagttgtgggcaacaat

SEQ ID NO: 7684188 - DNA, 22 bp, Homo sapiens
ctattcactgtggcagagggag

SEQ ID NO: 7684189 - DNA, 22 bp, Homo sapiens
ctattcagtaagccaaaaccat

SEQ ID NO: 7684190 - DNA, 22 bp, Homo sapiens
ctattcagcctctaagacaagt

SEQ ID NO: 7684191 - DNA, 22 bp, Homo sapiens
ctattcagcctctaagacaagt

SEQ ID NO: 7684192 - DNA, 22 bp, Homo sapiens
ctattcagcctctaagacaagt

SEQ ID NO: 7684193 - DNA, 22 bp, Homo sapiens
ctattcactgtggcagagggag

SEQ ID NO: 7684194 - DNA, 22 bp, Homo sapiens
ctagggagtggcagagctggga

SEQ ID NO: 7684195 - DNA, 22 bp, Homo sapiens
ctagggagtggcagagctggga

SEQ ID NO: 7684196 - DNA, 22 bp, Homo sapiens
ctagggagtggcagagctggga

SEQ ID NO: 7684197 - DNA, 22 bp, Homo sapiens
ctagggagggatgttggcatga

SEQ ID NO: 7684198 - DNA, 22 bp, Homo sapiens
ctagggagggatgttggcatga

SEQ ID NO: 7684199 - DNA, 22 bp, Homo sapiens
ctagggagggatgttggcatga

SEQ ID NO: 7684200 - DNA, 22 bp, Homo sapiens
ctagggagtggcagagctggga

SEQ ID NO: 7684201 - DNA, 22 bp, Homo sapiens
ctagggagtggcagagctggga

SEQ ID NO: 7684202 - DNA, 22 bp, Homo sapiens
ctagggagtggcagagctggga

SEQ ID NO: 7684203 - DNA, 22 bp, Homo sapiens
ctagggcactaggactcatgtg

SEQ ID NO: 7684204 - DNA, 22 bp, Homo sapiens
ctagggcactaggactcatgtg

SEQ ID NO: 7684205 - DNA, 23 bp, Homo sapiens
ctagggcagtatttcacagacac

SEQ ID NO: 7684206 - DNA, 22 bp, Homo sapiens
ctagggcagggagtgtttgcgc

SEQ ID NO: 7684207 - DNA, 23 bp, Homo sapiens
ctagggcagtatttcacagacac

SEQ ID NO: 7684208 - DNA, 23 bp, Homo sapiens
ctagggcagtatttcacagacac

SEQ ID NO: 7684209 - DNA, 23 bp, Homo sapiens
ctagggcagtatttcacagacac

SEQ ID NO: 7684210 - DNA, 23 bp, Homo sapiens
ctagggcagtatttcacagacac

SEQ ID NO: 7684211 - DNA, 22 bp, Homo sapiens
ctagggccaaaggctgtgatgc

SEQ ID NO: 7684212 - DNA, 22 bp, Homo sapiens
ctagggccaaaggctgtgatgc

SEQ ID NO: 7684213 - DNA, 22 bp, Homo sapiens
ctagggctccaaagctgagaag

SEQ ID NO: 7684214 - DNA, 22 bp, Homo sapiens
ctagggctccaaagctgagaag

SEQ ID NO: 7684215 - DNA, 22 bp, Homo sapiens
ctagggctccaaagctgagaag

SEQ ID NO: 7684216 - DNA, 22 bp, Homo sapiens
ctatttggatgttagcctcagt

SEQ ID NO: 7684217 - DNA, 22 bp, Homo sapiens
ctatttgagaggtgaaggaatt

SEQ ID NO: 7684218 - DNA, 22 bp, Homo sapiens
ctatttgagaacaatggctgaa

SEQ ID NO: 7684219 - DNA, 22 bp, Homo sapiens
ctatttctgcctaatgacctgt

SEQ ID NO: 7684220 - DNA, 22 bp, Homo sapiens
ctatttctgcctaatgacctgt

SEQ ID NO: 7684221 - DNA, 22 bp, Homo sapiens
ctatttgaagttgcagagatga

SEQ ID NO: 7684222 - DNA, 22 bp, Homo sapiens
ctatttgaaaccaagaatgccg

SEQ ID NO: 7684223 - DNA, 22 bp, Homo sapiens
ctatttctgcctaatgacctgt

SEQ ID NO: 7684224 - DNA, 22 bp, Homo sapiens
ctatttggggtagaagatggat

SEQ ID NO: 7684225 - DNA, 22 bp, Homo sapiens
ctatttggccaagctgcccaca

SEQ ID NO: 7684226 - DNA, 22 bp, Homo sapiens
ctatttgtacagcattagtaat

SEQ ID NO: 7684227 - DNA, 22 bp, Homo sapiens
ctatttgtacagcattagtaat

SEQ ID NO: 7684228 - DNA, 22 bp, Homo sapiens
ctatttctaaacctataagtga

SEQ ID NO: 7684229 - DNA, 22 bp, Homo sapiens
ctatttctaaacctataagtga

SEQ ID NO: 7684230 - DNA, 23 bp, Homo sapiens
ctatttctcatagttcaggtctt

SEQ ID NO: 7684231 - DNA, 22 bp, Homo sapiens
ctatttctgcctaatgacctgt

SEQ ID NO: 7684232 - DNA, 22 bp, Homo sapiens
ctatttctgcctaatgacctgt

SEQ ID NO: 7684233 - DNA, 22 bp, Homo sapiens
ctatttcatgttcctatggccg

SEQ ID NO: 7684234 - DNA, 22 bp, Homo sapiens
ctatttcattgtgctgagtctg

SEQ ID NO: 7684235 - DNA, 22 bp, Homo sapiens
ctatttctaaacctataagtga

SEQ ID NO: 7684236 - DNA, 22 bp, Homo sapiens
ctatttctaaacctataagtga

SEQ ID NO: 7684237 - DNA, 22 bp, Homo sapiens
ctatttcagcagaagccggaga

SEQ ID NO: 7684238 - DNA, 22 bp, Homo sapiens
ctatttcagctgcctttgactg

SEQ ID NO: 7684239 - DNA, 22 bp, Homo sapiens
ctatttcagctgcctttgactg

SEQ ID NO: 7684240 - DNA, 22 bp, Homo sapiens
ctatttcaaggcccagatatga

SEQ ID NO: 7684241 - DNA, 22 bp, Homo sapiens
ctatttcagctgcctttgactg

SEQ ID NO: 7684242 - DNA, 22 bp, Homo sapiens
ctatttcagctgcctttgactg

SEQ ID NO: 7684243 - DNA, 22 bp, Homo sapiens
ctatttcagctgcctttgactg

SEQ ID NO: 7684244 - DNA, 15 bp, Homo sapiens
ctatttcatccttct

SEQ ID NO: 7684245 - DNA, 22 bp, Homo sapiens
ctatttcatgttcctatggccg

SEQ ID NO: 7684246 - DNA, 22 bp, Homo sapiens
ctatttcatgttcctatggccg

SEQ ID NO: 7684247 - DNA, 20 bp, Homo sapiens
ttgacctgcaagtcatcatt

SEQ ID NO: 7684248 - DNA, 22 bp, Homo sapiens
ttgacctggaaggtgcttcctg

SEQ ID NO: 7684249 - DNA, 22 bp, Homo sapiens
ttgacccagttgtaaaagagct

SEQ ID NO: 7684250 - DNA, 22 bp, Homo sapiens
ctcagcagtaaacgtccggaac

SEQ ID NO: 7684251 - DNA, 22 bp, Homo sapiens
ctcagcagtatactctgaagat

SEQ ID NO: 7684252 - DNA, 22 bp, Homo sapiens
ctcagcagtatactctgaagat

SEQ ID NO: 7684253 - DNA, 22 bp, Homo sapiens
ctcagcagtatactctgaagat

SEQ ID NO: 7684254 - DNA, 22 bp, Homo sapiens
ttgactctaaatttacttttcc

SEQ ID NO: 7684255 - DNA, 22 bp, Homo sapiens
ttgactgtacaaccttttgtag

SEQ ID NO: 7684256 - DNA, 22 bp, Homo sapiens
ttgacctttgtttttacagagt

SEQ ID NO: 7684257 - DNA, 19 bp, Homo sapiens
ttgacctgggttggaaggg

SEQ ID NO: 7684258 - DNA, 22 bp, Homo sapiens
ttgacgtcctcgatggggaact

SEQ ID NO: 7684259 - DNA, 22 bp, Homo sapiens
ttgactttaaagctttgtctct

SEQ ID NO: 7684260 - DNA, 22 bp, Homo sapiens
ttgactttaaagctttgtctct

SEQ ID NO: 7684261 - DNA, 22 bp, Homo sapiens
ttgacttcccagacttgtgttt

SEQ ID NO: 7684262 - DNA, 22 bp, Homo sapiens
ttgactttacagttttcttagg

SEQ ID NO: 7684263 - DNA, 22 bp, Homo sapiens
ttgactttaaagctttgtctct

SEQ ID NO: 7684264 - DNA, 22 bp, Homo sapiens
ttgactttacagttttcttagg

SEQ ID NO: 7684265 - DNA, 22 bp, Homo sapiens
ttgactttatgtgtatgtttac

SEQ ID NO: 7684266 - DNA, 22 bp, Homo sapiens
ttgactttatgtgtatgtttac

SEQ ID NO: 7684267 - DNA, 22 bp, Homo sapiens
ttgactttatgtgtatgtttac

SEQ ID NO: 7684268 - DNA, 22 bp, Homo sapiens
ttgactttacagttttcttagg

SEQ ID NO: 7684269 - DNA, 22 bp, Homo sapiens
ttgactttacagttttcttagg

SEQ ID NO: 7684270 - DNA, 22 bp, Homo sapiens
ttgactgttgctgccattctgg

SEQ ID NO: 7684271 - DNA, 22 bp, Homo sapiens
ttgactgcaccactcagccctc

SEQ ID NO: 7684272 - DNA, 22 bp, Homo sapiens
ttgactgttaagacttggctct

SEQ ID NO: 7684273 - DNA, 22 bp, Homo sapiens
ttgactgtgaatctaagttact

SEQ ID NO: 7684274 - DNA, 22 bp, Homo sapiens
ttgactgtgatgggctcagctg

SEQ ID NO: 7684275 - DNA, 22 bp, Homo sapiens
ttgacttcagcctgtacttgta

SEQ ID NO: 7684276 - DNA, 22 bp, Homo sapiens
ttgacttcagcctgtacttgta

SEQ ID NO: 7684277 - DNA, 22 bp, Homo sapiens
ttgacttcccagacttgtgttt

SEQ ID NO: 7684278 - DNA, 22 bp, Homo sapiens
ttgagctttgaagttcaatatt

SEQ ID NO: 7684279 - DNA, 20 bp, Homo sapiens
ttgagcttttagtacagaca

SEQ ID NO: 7684280 - DNA, 22 bp, Homo sapiens
ttgagctttgaagttcaatatt

SEQ ID NO: 7684281 - DNA, 22 bp, Homo sapiens
ttgagctttacaacagctgtta

SEQ ID NO: 7684282 - DNA, 22 bp, Homo sapiens
ttgagcttgaggagttatttga

SEQ ID NO: 7684283 - DNA, 22 bp, Homo sapiens
ttgagcttgaggagttatttga

SEQ ID NO: 7684284 - DNA, 20 bp, Homo sapiens
ttgagcttccaagtctttgt

SEQ ID NO: 7684285 - DNA, 22 bp, Homo sapiens
ttgagctgtatacctatgactg

SEQ ID NO: 7684286 - DNA, 22 bp, Homo sapiens
ttgagaaacatctaatctttgt

SEQ ID NO: 7684287 - DNA, 22 bp, Homo sapiens
ttgagctcccgcttcttctttg

SEQ ID NO: 7684288 - DNA, 22 bp, Homo sapiens
ttgagaaacctggcagtagaga

SEQ ID NO: 7684289 - DNA, 22 bp, Homo sapiens
ttgagaaacctggcagtagaga

SEQ ID NO: 7684290 - DNA, 22 bp, Homo sapiens
ttgagaaacctggcagtagaga

SEQ ID NO: 7684291 - DNA, 22 bp, Homo sapiens
ttgagctgcctggctgtggctc

SEQ ID NO: 7684292 - DNA, 22 bp, Homo sapiens
ttgagaaaacacagagtttatt

SEQ ID NO: 7684293 - DNA, 22 bp, Homo sapiens
ttgagaaaaccatcgtaagaat

SEQ ID NO: 7684294 - DNA, 22 bp, Homo sapiens
ttgagaaaaccatcgtaagaat

SEQ ID NO: 7684295 - DNA, 22 bp, Homo sapiens
ttgagaaaacattgagggccat

SEQ ID NO: 7684296 - DNA, 22 bp, Homo sapiens
ttgagaaaacacagagtttatt

SEQ ID NO: 7684297 - DNA, 22 bp, Homo sapiens
ttgacttttcttggtcacatga

SEQ ID NO: 7684298 - DNA, 22 bp, Homo sapiens
ttgacttttcttggtcacatga

SEQ ID NO: 7684299 - DNA, 22 bp, Homo sapiens
ttgagaaaatagttcgaatgtt

SEQ ID NO: 7684300 - DNA, 22 bp, Homo sapiens
ttgagaaacagattggcaccgt

SEQ ID NO: 7684301 - DNA, 22 bp, Homo sapiens
ttgagaaacatctaatctttgt

SEQ ID NO: 7684302 - DNA, 22 bp, Homo sapiens
ttgagaaaatagttcgaatgtt

SEQ ID NO: 7684303 - DNA, 22 bp, Homo sapiens
ttgagaaacatctaatctttgt

SEQ ID NO: 7684304 - DNA, 22 bp, Homo sapiens
ttgagaaacatctaatctttgt

SEQ ID NO: 7684305 - DNA, 22 bp, Homo sapiens
ttgagaaaaccatcgtaagaat

SEQ ID NO: 7684306 - DNA, 22 bp, Homo sapiens
ttgagaaaagctgtgtaaggat

SEQ ID NO: 7684307 - DNA, 22 bp, Homo sapiens
ttgagaaaagctgtgtaaggat

SEQ ID NO: 7684308 - DNA, 22 bp, Homo sapiens
ttgagaaaagctgtgtaaggat

SEQ ID NO: 7684309 - DNA, 22 bp, Homo sapiens
ttgagaaaagctgtgtaaggat

SEQ ID NO: 7684310 - DNA, 22 bp, Homo sapiens
ttgagaaaagctgtgtaaggat

SEQ ID NO: 7684311 - DNA, 22 bp, Homo sapiens
ttgaggagtagaagctttgaat

SEQ ID NO: 7684312 - DNA, 22 bp, Homo sapiens
ttgaggagtacaaagcatgctt

SEQ ID NO: 7684313 - DNA, 22 bp, Homo sapiens
ttgaggagtcaggggcacggaa

SEQ ID NO: 7684314 - DNA, 22 bp, Homo sapiens
ttgaggagtagaagctttgaat

SEQ ID NO: 7684315 - DNA, 22 bp, Homo sapiens
ttgaggagtcaggggcacggaa

SEQ ID NO: 7684316 - DNA, 22 bp, Homo sapiens
ttgaggagtcaggggcacggaa

SEQ ID NO: 7684317 - DNA, 22 bp, Homo sapiens
ttgaggaggtatgactaggtac

SEQ ID NO: 7684318 - DNA, 22 bp, Homo sapiens
ttgaggaggtatgactaggtac

SEQ ID NO: 7684319 - DNA, 22 bp, Homo sapiens
ttgaggaggaactgtgaggcaa

SEQ ID NO: 7684320 - DNA, 22 bp, Homo sapiens
ttgaggaggtatgactaggtac

SEQ ID NO: 7684321 - DNA, 22 bp, Homo sapiens
ttgaggaggtagtacagagtat

SEQ ID NO: 7684322 - DNA, 22 bp, Homo sapiens
ttgaggaggtagtacagagtat

SEQ ID NO: 7684323 - DNA, 22 bp, Homo sapiens
ttgaggagtacaaagcatgctt

SEQ ID NO: 7684324 - DNA, 22 bp, Homo sapiens
ttgaggagtacaaagcatgctt

SEQ ID NO: 7684325 - DNA, 22 bp, Homo sapiens
ttgaggagtacaaagcatgctt

SEQ ID NO: 7684326 - DNA, 22 bp, Homo sapiens
ttgaggaggtcctgggtttact

SEQ ID NO: 7684327 - DNA, 22 bp, Homo sapiens
ttgaggaggtagtacagagtat

SEQ ID NO: 7684328 - DNA, 22 bp, Homo sapiens
ttgaggaggtagtacagagtat

SEQ ID NO: 7684329 - DNA, 22 bp, Homo sapiens
ttgaggaggcctttcagggctt

SEQ ID NO: 7684330 - DNA, 22 bp, Homo sapiens
ttgaggaggcctttcagggctt

SEQ ID NO: 7684331 - DNA, 22 bp, Homo sapiens
ttgaggaggcctttcagggctt

SEQ ID NO: 7684332 - DNA, 22 bp, Homo sapiens
ttgaggaggcctttcagggctt

SEQ ID NO: 7684333 - DNA, 22 bp, Homo sapiens
ttgaggaggaactgtgaggcaa

SEQ ID NO: 7684334 - DNA, 22 bp, Homo sapiens
ttgaggaggacagaaacattta

SEQ ID NO: 7684335 - DNA, 22 bp, Homo sapiens
ttgaggaggacagaaacattta

SEQ ID NO: 7684336 - DNA, 22 bp, Homo sapiens
ttgaggaggaactgtgaggcaa

SEQ ID NO: 7684337 - DNA, 22 bp, Homo sapiens
ttgaggaggaaaagggggtacc

SEQ ID NO: 7684338 - DNA, 20 bp, Homo sapiens
ttgagcttttagtacagaca

SEQ ID NO: 7684339 - DNA, 20 bp, Homo sapiens
ttgagcttttagtacagaca

SEQ ID NO: 7684340 - DNA, 20 bp, Homo sapiens
ttgagcttttagtacagaca

SEQ ID NO: 7684341 - DNA, 20 bp, Homo sapiens
ttgagcttttagtacagaca

SEQ ID NO: 7684342 - DNA, 22 bp, Homo sapiens
ttgaggaaaggaatttatttta

SEQ ID NO: 7684343 - DNA, 23 bp, Homo sapiens
ttgaggacaatttacatggtgtt

SEQ ID NO: 7684344 - DNA, 22 bp, Homo sapiens
ttgaggaaaggaatttatttta

SEQ ID NO: 7684345 - DNA, 22 bp, Homo sapiens
ttgaggaaaggaatttatttta

SEQ ID NO: 7684346 - DNA, 23 bp, Homo sapiens
ttgaggacaatttacatggtgtt

SEQ ID NO: 7684347 - DNA, 22 bp, Homo sapiens
ttgaggaggaaaagggggtacc

SEQ ID NO: 7684348 - DNA, 22 bp, Homo sapiens
ttgaggagcaggatgggaggct

SEQ ID NO: 7684349 - DNA, 22 bp, Homo sapiens
ttgaggagcactagtcaggtat

SEQ ID NO: 7684350 - DNA, 22 bp, Homo sapiens
ttgaggagcaggatgggaggct

SEQ ID NO: 7684351 - DNA, 22 bp, Homo sapiens
ttgaggagcaggatgggaggct

SEQ ID NO: 7684352 - DNA, 22 bp, Homo sapiens
ttgaggagcactagtcaggtat

SEQ ID NO: 7684353 - DNA, 23 bp, Homo sapiens
ttgaggagcagcgctttttaccg

SEQ ID NO: 7684354 - DNA, 20 bp, Homo sapiens
ttgaggagatattgaatact

SEQ ID NO: 7684355 - DNA, 22 bp, Homo sapiens
ttgaggagcactagtcaggtat

SEQ ID NO: 7684356 - DNA, 23 bp, Homo sapiens
ttgaggacaatttacatggtgtt

SEQ ID NO: 7684357 - DNA, 22 bp, Homo sapiens
ttgaggacagtgcttggggccc

SEQ ID NO: 7684358 - DNA, 22 bp, Homo sapiens
ttgaggacagtgcttggggccc

SEQ ID NO: 7684359 - DNA, 22 bp, Homo sapiens
ttgaggagaagactttgcttcc

SEQ ID NO: 7684360 - DNA, 22 bp, Homo sapiens
ttgataaaatgatgaaatcact

SEQ ID NO: 7684361 - DNA, 22 bp, Homo sapiens
ttgataaaatgatgaaatcact

SEQ ID NO: 7684362 - DNA, 22 bp, Homo sapiens
ttgataaaatgatatcttcttt

SEQ ID NO: 7684363 - DNA, 22 bp, Homo sapiens
ttgataaaatgatatcttcttt

SEQ ID NO: 7684364 - DNA, 22 bp, Homo sapiens
ttgagtttacattgtattagcc

SEQ ID NO: 7684365 - DNA, 22 bp, Homo sapiens
ttgagtttcctgacagcgaagg

SEQ ID NO: 7684366 - DNA, 22 bp, Homo sapiens
ttgaggagtggcgctggactta

SEQ ID NO: 7684367 - DNA, 22 bp, Homo sapiens
ttgaggagtgtgaggtctccca

SEQ ID NO: 7684368 - DNA, 22 bp, Homo sapiens
ttgaggagtggcgctggactta

SEQ ID NO: 7684369 - DNA, 23 bp, Homo sapiens
ttgaggagtgctttttctatcca

SEQ ID NO: 7684370 - DNA, 21 bp, Homo sapiens
ttgaggagtgagagtgggttt

SEQ ID NO: 7684371 - DNA, 21 bp, Homo sapiens
ttgaggagtgagagtgggttt

SEQ ID NO: 7684372 - DNA, 18 bp, Homo sapiens
ttgataaacaatttcatt

SEQ ID NO: 7684373 - DNA, 18 bp, Homo sapiens
ttgataaacaatttcatt

SEQ ID NO: 7684374 - DNA, 18 bp, Homo sapiens
ttgataaacaatttcatt

SEQ ID NO: 7684375 - DNA, 18 bp, Homo sapiens
ttgataaacaatttcatt

SEQ ID NO: 7684376 - DNA, 22 bp, Homo sapiens
ttgatacacaatggaacaatgt

SEQ ID NO: 7684377 - DNA, 18 bp, Homo sapiens
ttgataaacaatttcatt

SEQ ID NO: 7684378 - DNA, 22 bp, Homo sapiens
ttgatacaggctctatttcatc

SEQ ID NO: 7684379 - DNA, 22 bp, Homo sapiens
ttgatacaggctctatttcatc

SEQ ID NO: 7684380 - DNA, 22 bp, Homo sapiens
ttgatacaggccttctagatga

SEQ ID NO: 7684381 - DNA, 22 bp, Homo sapiens
ttgatacaggccttctagatga

SEQ ID NO: 7684382 - DNA, 23 bp, Homo sapiens
ttgatacagaagaatcagtttgt

SEQ ID NO: 7684383 - DNA, 22 bp, Homo sapiens
ttgatacagcagcctgtgatcc

SEQ ID NO: 7684384 - DNA, 22 bp, Homo sapiens
ttgatacagcagcctgtgatcc

SEQ ID NO: 7684385 - DNA, 22 bp, Homo sapiens
ttgatacaggccttctagatga

SEQ ID NO: 7684386 - DNA, 22 bp, Homo sapiens
ttgatacaggccttctagatga

SEQ ID NO: 7684387 - DNA, 22 bp, Homo sapiens
ttgatacacaatggaacaatgt

SEQ ID NO: 7684388 - DNA, 22 bp, Homo sapiens
ttgatacacaatggaacaatgt

SEQ ID NO: 7684389 - DNA, 23 bp, Homo sapiens
ttgatacagaagaatcagtttgt

SEQ ID NO: 7684390 - DNA, 22 bp, Homo sapiens
ttgatacacaatggaacaatgt

SEQ ID NO: 7684391 - DNA, 22 bp, Homo sapiens
ttgatacacaatggaacaatgt

SEQ ID NO: 7684392 - DNA, 23 bp, Homo sapiens
ttgatacagaagaatcagtttgt

SEQ ID NO: 7684393 - DNA, 22 bp, Homo sapiens
ttcttgtctttgttatgtagga

SEQ ID NO: 7684394 - DNA, 22 bp, Homo sapiens
ttcttgtatgtatgcaaaatca

SEQ ID NO: 7684395 - DNA, 22 bp, Homo sapiens
ttcttgtatgtatgcaaaatca

SEQ ID NO: 7684396 - DNA, 22 bp, Homo sapiens
ttcttgttctcctcatttagag

SEQ ID NO: 7684397 - DNA, 22 bp, Homo sapiens
ttcttgttctcctcatttagag

SEQ ID NO: 7684398 - DNA, 22 bp, Homo sapiens
ttcttgttctcctcatttagag

SEQ ID NO: 7684399 - DNA, 22 bp, Homo sapiens
ttcttgttccatgaaagacaga

SEQ ID NO: 7684400 - DNA, 22 bp, Homo sapiens
ttcttgttctggttctgttagc

SEQ ID NO: 7684401 - DNA, 22 bp, Homo sapiens
ttcttgttctggttctgttagc

SEQ ID NO: 7684402 - DNA, 22 bp, Homo sapiens
ttcttgttctcctcatttagag

SEQ ID NO: 7684403 - DNA, 22 bp, Homo sapiens
ttcttgttctcctcatttagag

SEQ ID NO: 7684404 - DNA, 22 bp, Homo sapiens
ttcttgttctggttctgttagc

SEQ ID NO: 7684405 - DNA, 22 bp, Homo sapiens
ttcttgttggcctcaggtttgc

SEQ ID NO: 7684406 - DNA, 22 bp, Homo sapiens
ttcttgttggcctcaggtttgc

SEQ ID NO: 7684407 - DNA, 22 bp, Homo sapiens
ttcttgttctggttctgttagc

SEQ ID NO: 7684408 - DNA, 22 bp, Homo sapiens
ttcttgttctggttctgttagc

SEQ ID NO: 7684409 - DNA, 22 bp, Homo sapiens
ttcttgttctggttctgttagc

SEQ ID NO: 7684410 - DNA, 22 bp, Homo sapiens
ttcttgttctggttctgttagc

SEQ ID NO: 7684411 - DNA, 22 bp, Homo sapiens
ttcttggcatcatgaaaaatta

SEQ ID NO: 7684412 - DNA, 22 bp, Homo sapiens
ttcttgggctccaccccagact

SEQ ID NO: 7684413 - DNA, 22 bp, Homo sapiens
ttcttgggctccaccccagact

SEQ ID NO: 7684414 - DNA, 22 bp, Homo sapiens
ttcttggctgttcatggtcagg

SEQ ID NO: 7684415 - DNA, 22 bp, Homo sapiens
ttcttggctgttcatggtcagg

SEQ ID NO: 7684416 - DNA, 22 bp, Homo sapiens
ttcttgtatataaaaatcattt

SEQ ID NO: 7684417 - DNA, 22 bp, Homo sapiens
ttcttgtatgtatgcaaaatca

SEQ ID NO: 7684418 - DNA, 22 bp, Homo sapiens
ttcttgtatgtatgcaaaatca

SEQ ID NO: 7684419 - DNA, 22 bp, Homo sapiens
ttcttgtactggagatacatga

SEQ ID NO: 7684420 - DNA, 22 bp, Homo sapiens
ttcttgtactggagatacatga

SEQ ID NO: 7684421 - DNA, 22 bp, Homo sapiens
ttcttgtatataaaaatcattt

SEQ ID NO: 7684422 - DNA, 22 bp, Homo sapiens
ttcttgtatataaaaatcattt

SEQ ID NO: 7684423 - DNA, 22 bp, Homo sapiens
ttcttgtaatttggagaaatga

SEQ ID NO: 7684424 - DNA, 21 bp, Homo sapiens
ttcttggttacgctgtagtgc

SEQ ID NO: 7684425 - DNA, 22 bp, Homo sapiens
ttcttgtactggagatacatga

SEQ ID NO: 7684426 - DNA, 22 bp, Homo sapiens
ttcttgtactggagatacatga

SEQ ID NO: 7684427 - DNA, 22 bp, Homo sapiens
ctattttaagaggccattaggt

SEQ ID NO: 7684428 - DNA, 22 bp, Homo sapiens
ctattttaagaggccattaggt

SEQ ID NO: 7684429 - DNA, 22 bp, Homo sapiens
ctattttaagaggccattaggt

SEQ ID NO: 7684430 - DNA, 22 bp, Homo sapiens
ctattttaagaggccattaggt

SEQ ID NO: 7684431 - DNA, 22 bp, Homo sapiens
ctattttaagaggccattaggt

SEQ ID NO: 7684432 - DNA, 22 bp, Homo sapiens
ctattttaagaggccattaggt

SEQ ID NO: 7684433 - DNA, 22 bp, Homo sapiens
ctattttaagaggccattaggt

SEQ ID NO: 7684434 - DNA, 22 bp, Homo sapiens
ctattttaacttgattacctct

SEQ ID NO: 7684435 - DNA, 22 bp, Homo sapiens
ttctttaaaatagtgagaaaga

SEQ ID NO: 7684436 - DNA, 22 bp, Homo sapiens
ctattttaacttgattacctct

SEQ ID NO: 7684437 - DNA, 22 bp, Homo sapiens
ttcttgtttattaagatataaa

SEQ ID NO: 7684438 - DNA, 22 bp, Homo sapiens
ttcttgtttattaagatataaa

SEQ ID NO: 7684439 - DNA, 22 bp, Homo sapiens
ttcttgtttattaagatataaa

SEQ ID NO: 7684440 - DNA, 22 bp, Homo sapiens
ttcttgtttattaagatataaa

SEQ ID NO: 7684441 - DNA, 22 bp, Homo sapiens
ttcttgttttgcccaagttgta

SEQ ID NO: 7684442 - DNA, 22 bp, Homo sapiens
ttctttaaaatagtgagaaaga

SEQ ID NO: 7684443 - DNA, 22 bp, Homo sapiens
ttctttaaaatagtgagaaaga

SEQ ID NO: 7684444 - DNA, 22 bp, Homo sapiens
ttctttaaaatagtgagaaaga

SEQ ID NO: 7684445 - DNA, 22 bp, Homo sapiens
ttctttaaaatagtgagaaaga

SEQ ID NO: 7684446 - DNA, 22 bp, Homo sapiens
ttcttgttttgcccaagttgta

SEQ ID NO: 7684447 - DNA, 22 bp, Homo sapiens
ctattttgcctgcctagaaatc

SEQ ID NO: 7684448 - DNA, 22 bp, Homo sapiens
ctattttctgtctctatagagt

SEQ ID NO: 7684449 - DNA, 22 bp, Homo sapiens
ctattttctgtctctatagagt

SEQ ID NO: 7684450 - DNA, 22 bp, Homo sapiens
ctattttccgcagcaggaagta

SEQ ID NO: 7684451 - DNA, 22 bp, Homo sapiens
ctattttctgtctctatagagt

SEQ ID NO: 7684452 - DNA, 22 bp, Homo sapiens
ctattttctgtctctatagagt

SEQ ID NO: 7684453 - DNA, 22 bp, Homo sapiens
ctattttctgtctctatagagt

SEQ ID NO: 7684454 - DNA, 22 bp, Homo sapiens
ctattttctgtctctatagagt

SEQ ID NO: 7684455 - DNA, 22 bp, Homo sapiens
ctattttctgtctctatagagt

SEQ ID NO: 7684456 - DNA, 22 bp, Homo sapiens
ctattttaagaggccattaggt

SEQ ID NO: 7684457 - DNA, 22 bp, Homo sapiens
ctattttcattcttacattgtc

SEQ ID NO: 7684458 - DNA, 22 bp, Homo sapiens
ctattttcattcttacattgtc

SEQ ID NO: 7684459 - DNA, 22 bp, Homo sapiens
ctattttcattcttacattgtc

SEQ ID NO: 7684460 - DNA, 22 bp, Homo sapiens
ctattttcattcttacattgtc

SEQ ID NO: 7684461 - DNA, 22 bp, Homo sapiens
ctattttcccatatggttgaca

SEQ ID NO: 7684462 - DNA, 22 bp, Homo sapiens
ctattttcattcttacattgtc

SEQ ID NO: 7684463 - DNA, 22 bp, Homo sapiens
ctcagaggggatgcttggagaa

SEQ ID NO: 7684464 - DNA, 22 bp, Homo sapiens
ctcagaggggatgcttggagaa

SEQ ID NO: 7684465 - DNA, 22 bp, Homo sapiens
ctcagaggggatgcaatcttgc

SEQ ID NO: 7684466 - DNA, 22 bp, Homo sapiens
ctcagagggaggactgggctgg

SEQ ID NO: 7684467 - DNA, 22 bp, Homo sapiens
ctcagaggggatgcaatcttgc

SEQ ID NO: 7684468 - DNA, 22 bp, Homo sapiens
ctcagagggaggactgggctgg

SEQ ID NO: 7684469 - DNA, 22 bp, Homo sapiens
ctcagagggaggactgggctgg

SEQ ID NO: 7684470 - DNA, 22 bp, Homo sapiens
ctcagagggaggactgggctgg

SEQ ID NO: 7684471 - DNA, 22 bp, Homo sapiens
ctcagaggggatgcttggagaa

SEQ ID NO: 7684472 - DNA, 22 bp, Homo sapiens
ctcagaggggatgcttggagaa

SEQ ID NO: 7684473 - DNA, 22 bp, Homo sapiens
ctcagcaccccgacaggacatt

SEQ ID NO: 7684474 - DNA, 22 bp, Homo sapiens
ctcagcaccccgacaggacatt

SEQ ID NO: 7684475 - DNA, 22 bp, Homo sapiens
ctcagcaccccgacaggacatt

SEQ ID NO: 7684476 - DNA, 22 bp, Homo sapiens
ctcagcagagaccagggaggaa

SEQ ID NO: 7684477 - DNA, 19 bp, Homo sapiens
ctcagcacttttacacagg

SEQ ID NO: 7684478 - DNA, 19 bp, Homo sapiens
ctcagcacttttacacagg

SEQ ID NO: 7684479 - DNA, 22 bp, Homo sapiens
ctcagcaccccgacaggacatt

SEQ ID NO: 7684480 - DNA, 22 bp, Homo sapiens
ctcagcacccgggcctttcctc

SEQ ID NO: 7684481 - DNA, 22 bp, Homo sapiens
ctattttgtccttagtgcaggg

SEQ ID NO: 7684482 - DNA, 22 bp, Homo sapiens
ctattttgtccttagtgcaggg

SEQ ID NO: 7684483 - DNA, 17 bp, Homo sapiens
ctattttggagattaaa

SEQ ID NO: 7684484 - DNA, 22 bp, Homo sapiens
ctatttttctgtaccctaattt

SEQ ID NO: 7684485 - DNA, 22 bp, Homo sapiens
ctatttttctgtaccctaattt

SEQ ID NO: 7684486 - DNA, 17 bp, Homo sapiens
ctattttggagattaaa

SEQ ID NO: 7684487 - DNA, 17 bp, Homo sapiens
ctattttggagattaaa

SEQ ID NO: 7684488 - DNA, 22 bp, Homo sapiens
ctattttgcctgcctagaaatc

SEQ ID NO: 7684489 - DNA, 22 bp, Homo sapiens
ctattttgcctgcctagaaatc

SEQ ID NO: 7684490 - DNA, 22 bp, Homo sapiens
ctatttttctgtaccctaattt

SEQ ID NO: 7684491 - DNA, 23 bp, Homo sapiens
ctcagaggcctgtccagggtggt

SEQ ID NO: 7684492 - DNA, 22 bp, Homo sapiens
ctcagagggaggactgggctgg

SEQ ID NO: 7684493 - DNA, 22 bp, Homo sapiens
ctcagagggaggactgggctgg

SEQ ID NO: 7684494 - DNA, 22 bp, Homo sapiens
ctcagagggaggactgggctgg

SEQ ID NO: 7684495 - DNA, 22 bp, Homo sapiens
ctcagagggaggactgggctgg

SEQ ID NO: 7684496 - DNA, 22 bp, Homo sapiens
ctatttttctgtaccctaattt

SEQ ID NO: 7684497 - DNA, 22 bp, Homo sapiens
ctatttttctgtaccctaattt

SEQ ID NO: 7684498 - DNA, 22 bp, Homo sapiens
ctatttttctgtaccctaattt

SEQ ID NO: 7684499 - DNA, 22 bp, Homo sapiens
ctatttttctgtaccctaattt

SEQ ID NO: 7684500 - DNA, 22 bp, Homo sapiens
ctatttttctgtaccctaattt

SEQ ID NO: 7684501 - DNA, 22 bp, Homo sapiens
ctcagcaggtaccacatgatct

SEQ ID NO: 7684502 - DNA, 23 bp, Homo sapiens
ctcagcaggtcaggccccttcct

SEQ ID NO: 7684503 - DNA, 23 bp, Homo sapiens
ctcagcaggtcaggccccttcct

SEQ ID NO: 7684504 - DNA, 22 bp, Homo sapiens
ctcagcaggtcttgggtagggg

SEQ ID NO: 7684505 - DNA, 23 bp, Homo sapiens
ctcagcaggtcaggccccttcct

SEQ ID NO: 7684506 - DNA, 22 bp, Homo sapiens
ctcagcagtaaacgtccggaac

SEQ ID NO: 7684507 - DNA, 23 bp, Homo sapiens
ctcagcaggtcaggccccttcct

SEQ ID NO: 7684508 - DNA, 22 bp, Homo sapiens
ctcagcaggtcttgggtagggg

SEQ ID NO: 7684509 - DNA, 22 bp, Homo sapiens
ctcagcaggcactgtgccttac

SEQ ID NO: 7684510 - DNA, 22 bp, Homo sapiens
ctcagcaggcactgtgccttac

SEQ ID NO: 7684511 - DNA, 22 bp, Homo sapiens
ctcagcaggcactgtgccttac

SEQ ID NO: 7684512 - DNA, 22 bp, Homo sapiens
ctcagcaggcactgtgccttac

SEQ ID NO: 7684513 - DNA, 17 bp, Homo sapiens
ctcagcagggctcactt

SEQ ID NO: 7684514 - DNA, 17 bp, Homo sapiens
ctcagcagggctcactt

SEQ ID NO: 7684515 - DNA, 17 bp, Homo sapiens
ctcagcagggctcactt

SEQ ID NO: 7684516 - DNA, 17 bp, Homo sapiens
ctcagcagggctcactt

SEQ ID NO: 7684517 - DNA, 22 bp, Homo sapiens
ctcagcaggtaccacatgatct

SEQ ID NO: 7684518 - DNA, 22 bp, Homo sapiens
ctcagcaggtaccacatgatct

SEQ ID NO: 7684519 - DNA, 23 bp, Homo sapiens
ctcagcagcctgctgcagataag

SEQ ID NO: 7684520 - DNA, 23 bp, Homo sapiens
ctcagcagcctgctgcagataag

SEQ ID NO: 7684521 - DNA, 20 bp, Homo sapiens
ctcagcagattcttctagaa

SEQ ID NO: 7684522 - DNA, 22 bp, Homo sapiens
ctcagcagctgctgctggtggg

SEQ ID NO: 7684523 - DNA, 22 bp, Homo sapiens
ctcagcagctacaggattcggg

SEQ ID NO: 7684524 - DNA, 22 bp, Homo sapiens
ctcagcagctgctgctggtggg

SEQ ID NO: 7684525 - DNA, 22 bp, Homo sapiens
ctcagcagctgctgctggtggg

SEQ ID NO: 7684526 - DNA, 22 bp, Homo sapiens
ctcagcagctgctgctggtggg

SEQ ID NO: 7684527 - DNA, 22 bp, Homo sapiens
ctcagcagctgctgctggtggg

SEQ ID NO: 7684528 - DNA, 22 bp, Homo sapiens
ctcagcagctgctgctggtggg

SEQ ID NO: 7684529 - DNA, 22 bp, Homo sapiens
ctcagcagctgctgctggtggg

SEQ ID NO: 7684530 - DNA, 22 bp, Homo sapiens
ctcagcagctgctgctggtggg

SEQ ID NO: 7684531 - DNA, 22 bp, Homo sapiens
ctcagcagctacaggattcggg

SEQ ID NO: 7684532 - DNA, 20 bp, Homo sapiens
ctcagcagattcttctagaa

SEQ ID NO: 7684533 - DNA, 22 bp, Homo sapiens
ctcagcagcagggaagaggtca

SEQ ID NO: 7684534 - DNA, 20 bp, Homo sapiens
ctcagcagattcttctagaa

SEQ ID NO: 7684535 - DNA, 22 bp, Homo sapiens
ctcagcagaggcagtattcagt

SEQ ID NO: 7684536 - DNA, 22 bp, Homo sapiens
ctcagcagcagggaagaggtca

SEQ ID NO: 7684537 - DNA, 22 bp, Homo sapiens
ctcagcagagaccagggaggaa

SEQ ID NO: 7684538 - DNA, 22 bp, Homo sapiens
ctcagcagaggcagtattcagt

SEQ ID NO: 7684539 - DNA, 22 bp, Homo sapiens
ttcagaaaggtaaatggatttc

SEQ ID NO: 7684540 - DNA, 22 bp, Homo sapiens
ttcagaaaggtaaatggatttc

SEQ ID NO: 7684541 - DNA, 22 bp, Homo sapiens
ttcagaaaggataattggaagg

SEQ ID NO: 7684542 - DNA, 22 bp, Homo sapiens
ttcagaaaggataattggaagg

SEQ ID NO: 7684543 - DNA, 22 bp, Homo sapiens
ttcagaaaggctgtgccagcca

SEQ ID NO: 7684544 - DNA, 22 bp, Homo sapiens
ttcagaaaggttaatctggatt

SEQ ID NO: 7684545 - DNA, 22 bp, Homo sapiens
ttcagaaaggttaatctggatt

SEQ ID NO: 7684546 - DNA, 22 bp, Homo sapiens
ttcagaaaggtaaatggatttc

SEQ ID NO: 7684547 - DNA, 22 bp, Homo sapiens
ttcagaaaggtaaatggatttc

SEQ ID NO: 7684548 - DNA, 22 bp, Homo sapiens
ttcagaaaggtaaatggatttc

SEQ ID NO: 7684549 - DNA, 22 bp, Homo sapiens
ttcagaaaggtaaatggatttc

SEQ ID NO: 7684550 - DNA, 22 bp, Homo sapiens
ttcagaaaggttaatctggatt

SEQ ID NO: 7684551 - DNA, 22 bp, Homo sapiens
ttcagaaaggttaatctggatt

SEQ ID NO: 7684552 - DNA, 22 bp, Homo sapiens
ttcagaaaggttaatctggatt

SEQ ID NO: 7684553 - DNA, 22 bp, Homo sapiens
ttcagaaaggttaatctggatt

SEQ ID NO: 7684554 - DNA, 21 bp, Homo sapiens
ttcatgagataaccagctgta

SEQ ID NO: 7684555 - DNA, 22 bp, Homo sapiens
ttcatgaggtacctgtgatcat

SEQ ID NO: 7684556 - DNA, 22 bp, Homo sapiens
ttcatgaggtacctgtgatcat

SEQ ID NO: 7684557 - DNA, 22 bp, Homo sapiens
ttcatgagcagaagggaggggt

SEQ ID NO: 7684558 - DNA, 20 bp, Homo sapiens
ttcattcattccacaacttc

SEQ ID NO: 7684559 - DNA, 20 bp, Homo sapiens
ttcattcattccacaacttc

SEQ ID NO: 7684560 - DNA, 22 bp, Homo sapiens
ttcatgatagtatctattcaat

SEQ ID NO: 7684561 - DNA, 22 bp, Homo sapiens
ttcatgatagtatctattcaat

SEQ ID NO: 7684562 - DNA, 22 bp, Homo sapiens
ttcattcccaagagtaaacata

SEQ ID NO: 7684563 - DNA, 22 bp, Homo sapiens
ttcattccttctgtaccttgcc

SEQ ID NO: 7684564 - DNA, 22 bp, Homo sapiens
ttcattccttccctaagcaact

SEQ ID NO: 7684565 - DNA, 22 bp, Homo sapiens
ttcattccttccctaagcaact

SEQ ID NO: 7684566 - DNA, 22 bp, Homo sapiens
ttcattccttctgtaccttgcc

SEQ ID NO: 7684567 - DNA, 22 bp, Homo sapiens
ttcattccttccctaagcaact

SEQ ID NO: 7684568 - DNA, 22 bp, Homo sapiens
ttcattcccttatattagcatt

SEQ ID NO: 7684569 - DNA, 22 bp, Homo sapiens
ttcattcctgagcccatattta

SEQ ID NO: 7684570 - DNA, 22 bp, Homo sapiens
ttcattctgcagttctcagctc

SEQ ID NO: 7684571 - DNA, 22 bp, Homo sapiens
ttcattctgcagttctcagctc

SEQ ID NO: 7684572 - DNA, 22 bp, Homo sapiens
ttcattctgcagttctcagctc

SEQ ID NO: 7684573 - DNA, 22 bp, Homo sapiens
ttcattctgcagttctcagctc

SEQ ID NO: 7684574 - DNA, 22 bp, Homo sapiens
ttcattctgtttggaaaggtgg

SEQ ID NO: 7684575 - DNA, 22 bp, Homo sapiens
ttcattctcttagcatagtcct

SEQ ID NO: 7684576 - DNA, 22 bp, Homo sapiens
ttcattctcttagcatagtcct

SEQ ID NO: 7684577 - DNA, 19 bp, Homo sapiens
ttcattctcttattgttgt

SEQ ID NO: 7684578 - DNA, 19 bp, Homo sapiens
ttcattctcttattgttgt

SEQ ID NO: 7684579 - DNA, 19 bp, Homo sapiens
ttcattctcttattgttgt

SEQ ID NO: 7684580 - DNA, 22 bp, Homo sapiens
ttccaaaatgccttgatatgat

SEQ ID NO: 7684581 - DNA, 22 bp, Homo sapiens
ttccaaacctcaaataattaat

SEQ ID NO: 7684582 - DNA, 22 bp, Homo sapiens
ttccaaacctcaaataattaat

SEQ ID NO: 7684583 - DNA, 22 bp, Homo sapiens
ttccaaactcatagtatggtgt

SEQ ID NO: 7684584 - DNA, 22 bp, Homo sapiens
ttccaaactgccaattcagaag

SEQ ID NO: 7684585 - DNA, 22 bp, Homo sapiens
ttccaaaatgccttgatatgat

SEQ ID NO: 7684586 - DNA, 22 bp, Homo sapiens
ttcattcttgtctttgtatagt

SEQ ID NO: 7684587 - DNA, 22 bp, Homo sapiens
ttcattcttgtctttgtatagt

SEQ ID NO: 7684588 - DNA, 22 bp, Homo sapiens
ttcattcttgtctttgtatagt

SEQ ID NO: 7684589 - DNA, 22 bp, Homo sapiens
ttcattcttgtctttgtatagt

SEQ ID NO: 7684590 - DNA, 22 bp, Homo sapiens
ttcattcttatttgtgatctgg

SEQ ID NO: 7684591 - DNA, 22 bp, Homo sapiens
ttcattcttgggatcagagagt

SEQ ID NO: 7684592 - DNA, 22 bp, Homo sapiens
ttcattcttgggatcagagagt

SEQ ID NO: 7684593 - DNA, 22 bp, Homo sapiens
ttcagaaaaagaccattgcaat

SEQ ID NO: 7684594 - DNA, 22 bp, Homo sapiens
ttcagaaaaagaccattgcaat

SEQ ID NO: 7684595 - DNA, 22 bp, Homo sapiens
ttcagaaaaagaccattgcaat

SEQ ID NO: 7684596 - DNA, 22 bp, Homo sapiens
ttcagaaaaagaccattgcaat

SEQ ID NO: 7684597 - DNA, 22 bp, Homo sapiens
ttcagaaaaagaccattgcaat

SEQ ID NO: 7684598 - DNA, 22 bp, Homo sapiens
ttcagaaaaagaccattgcaat

SEQ ID NO: 7684599 - DNA, 22 bp, Homo sapiens
ttcagaaacagagtgagtgagt

SEQ ID NO: 7684600 - DNA, 22 bp, Homo sapiens
ttcagaaacagagtgagtgagt

SEQ ID NO: 7684601 - DNA, 22 bp, Homo sapiens
ttcagaaacagagtgagtgagt

SEQ ID NO: 7684602 - DNA, 22 bp, Homo sapiens
ttcagaaaggataattggaagg

SEQ ID NO: 7684603 - DNA, 22 bp, Homo sapiens
ttcagaaaggataattggaagg

SEQ ID NO: 7684604 - DNA, 22 bp, Homo sapiens
ttcagaaacccattgggtctct

SEQ ID NO: 7684605 - DNA, 22 bp, Homo sapiens
ttcagaaacccattgggtctct

SEQ ID NO: 7684606 - DNA, 22 bp, Homo sapiens
ttcagaaacccattgggtctct

SEQ ID NO: 7684607 - DNA, 22 bp, Homo sapiens
ttcagaaacatcagtggatgga

SEQ ID NO: 7684608 - DNA, 22 bp, Homo sapiens
ttcagaaacccattgggtctct

SEQ ID NO: 7684609 - DNA, 22 bp, Homo sapiens
ttcagaaaggataattggaagg

SEQ ID NO: 7684610 - DNA, 22 bp, Homo sapiens
ttcagaaaggataattggaagg

SEQ ID NO: 7684611 - DNA, 22 bp, Homo sapiens
ttcagaaaggataattggaagg

SEQ ID NO: 7684612 - DNA, 22 bp, Homo sapiens
ttcagaaacatcagtggatgga

SEQ ID NO: 7684613 - DNA, 22 bp, Homo sapiens
ttcagaaacatcagtggatgga

SEQ ID NO: 7684614 - DNA, 22 bp, Homo sapiens
ttcagaaacatcagtggatgga

SEQ ID NO: 7684615 - DNA, 22 bp, Homo sapiens
ttcacttaacatcatatcatga

SEQ ID NO: 7684616 - DNA, 22 bp, Homo sapiens
ttcacttaaaggttttagcatc

SEQ ID NO: 7684617 - DNA, 22 bp, Homo sapiens
ttcactgttgttagcagaggcg

SEQ ID NO: 7684618 - DNA, 22 bp, Homo sapiens
ttcacttatagggatgttattg

SEQ ID NO: 7684619 - DNA, 22 bp, Homo sapiens
ttcacttaacatttaccaagga

SEQ ID NO: 7684620 - DNA, 22 bp, Homo sapiens
ttcacttaacatcatatcatga

SEQ ID NO: 7684621 - DNA, 22 bp, Homo sapiens
ttcagaaaaaacttcaataagt

SEQ ID NO: 7684622 - DNA, 22 bp, Homo sapiens
ttcagaaaaaacttcaataagt

SEQ ID NO: 7684623 - DNA, 21 bp, Homo sapiens
ttcacttgaagatcttgcccc

SEQ ID NO: 7684624 - DNA, 22 bp, Homo sapiens
ttcagaaaaaacttcaataagt

SEQ ID NO: 7684625 - DNA, 22 bp, Homo sapiens
ttcagaaaaaacttcaataagt

SEQ ID NO: 7684626 - DNA, 22 bp, Homo sapiens
cggctgagacggccatagacac

SEQ ID NO: 7684627 - DNA, 22 bp, Homo sapiens
cggctgagcagtgctgatggaa

SEQ ID NO: 7684628 - DNA, 22 bp, Homo sapiens
cggctgagcagtgctgatggaa

SEQ ID NO: 7684629 - DNA, 22 bp, Homo sapiens
cggctgaggatctccaggcctg

SEQ ID NO: 7684630 - DNA, 22 bp, Homo sapiens
cggctgaggatctccaggcctg

SEQ ID NO: 7684631 - DNA, 23 bp, Homo sapiens
cggctgctcggccgagtcctcgg

SEQ ID NO: 7684632 - DNA, 22 bp, Homo sapiens
cggctgaggatctccaggcctg

SEQ ID NO: 7684633 - DNA, 23 bp, Homo sapiens
cggctgctcggccgagtcctcgg

SEQ ID NO: 7684634 - DNA, 21 bp, Homo sapiens
cggctcagtgcctgctccttc

SEQ ID NO: 7684635 - DNA, 22 bp, Homo sapiens
cggctctgtcctcagcactgct

SEQ ID NO: 7684636 - DNA, 22 bp, Homo sapiens
cggctgagacggccatagacac

SEQ ID NO: 7684637 - DNA, 22 bp, Homo sapiens
cggctgagacggccatagacac

SEQ ID NO: 7684638 - DNA, 22 bp, Homo sapiens
cggctggggctgtccccatgac

SEQ ID NO: 7684639 - DNA, 22 bp, Homo sapiens
cggctggggctgtccccatgac

SEQ ID NO: 7684640 - DNA, 22 bp, Homo sapiens
cggctgggtagaggtgccgggt

SEQ ID NO: 7684641 - DNA, 22 bp, Homo sapiens
cggctgggtagaggtgccgggt

SEQ ID NO: 7684642 - DNA, 22 bp, Homo sapiens
cggctgggtagaggtgccgggt

SEQ ID NO: 7684643 - DNA, 22 bp, Homo sapiens
cggctgggtagaggtgccgggt

SEQ ID NO: 7684644 - DNA, 22 bp, Homo sapiens
cggctggggctgtccccatgac

SEQ ID NO: 7684645 - DNA, 22 bp, Homo sapiens
cggctggggctgtccccatgac

SEQ ID NO: 7684646 - DNA, 22 bp, Homo sapiens
cggctggagctgagaaaggagc

SEQ ID NO: 7684647 - DNA, 22 bp, Homo sapiens
cggctggagctttgaacctgat

SEQ ID NO: 7684648 - DNA, 22 bp, Homo sapiens
cggctggagctttgaacctgat

SEQ ID NO: 7684649 - DNA, 22 bp, Homo sapiens
cggctgcttctgagccccggcg

SEQ ID NO: 7684650 - DNA, 22 bp, Homo sapiens
cggctggaagctggacaggccg

SEQ ID NO: 7684651 - DNA, 22 bp, Homo sapiens
cggctggaagctggacaggccg

SEQ ID NO: 7684652 - DNA, 22 bp, Homo sapiens
cggctgcttctgagccccggcg

SEQ ID NO: 7684653 - DNA, 22 bp, Homo sapiens
cggctgcttctgagccccggcg

SEQ ID NO: 7684654 - DNA, 22 bp, Homo sapiens
cggctgctgcctgagtcgctgt

SEQ ID NO: 7684655 - DNA, 22 bp, Homo sapiens
cggctgctgcctgagtcgctgt

SEQ ID NO: 7684656 - DNA, 22 bp, Homo sapiens
ttcacagtggtagtgcatttag

SEQ ID NO: 7684657 - DNA, 22 bp, Homo sapiens
ttcacagtggtaagggttgtga

SEQ ID NO: 7684658 - DNA, 22 bp, Homo sapiens
ttcacagtgtgatctatgggca

SEQ ID NO: 7684659 - DNA, 22 bp, Homo sapiens
ttcacagtggtagtgcatttag

SEQ ID NO: 7684660 - DNA, 22 bp, Homo sapiens
ttcacagtggtagtgcatttag

SEQ ID NO: 7684661 - DNA, 22 bp, Homo sapiens
ttcacagtgtgatctatgggca

SEQ ID NO: 7684662 - DNA, 22 bp, Homo sapiens
ttcacagtgttgtgccttttgt

SEQ ID NO: 7684663 - DNA, 22 bp, Homo sapiens
ttcacagtgtttctcacggtta

SEQ ID NO: 7684664 - DNA, 22 bp, Homo sapiens
ttcacagactttccatagattg

SEQ ID NO: 7684665 - DNA, 22 bp, Homo sapiens
ttcacagactgcagactttttg

SEQ ID NO: 7684666 - DNA, 22 bp, Homo sapiens
ttcacagaccaggaggctgtga

SEQ ID NO: 7684667 - DNA, 22 bp, Homo sapiens
ttcacagtggtagtgcatttag

SEQ ID NO: 7684668 - DNA, 22 bp, Homo sapiens
ttcacagtggtagtgcatttag

SEQ ID NO: 7684669 - DNA, 22 bp, Homo sapiens
ttcacagtggtaagggttgtga

SEQ ID NO: 7684670 - DNA, 22 bp, Homo sapiens
ttcacagtggcttaggctatgg

SEQ ID NO: 7684671 - DNA, 22 bp, Homo sapiens
ttcacagtggcttaggctatgg

SEQ ID NO: 7684672 - DNA, 22 bp, Homo sapiens
cctgggtggttccggcaaggag

SEQ ID NO: 7684673 - DNA, 22 bp, Homo sapiens
cctgggtggttccggcaaggag

SEQ ID NO: 7684674 - DNA, 22 bp, Homo sapiens
cctgggtgtcatgggcagctgg

SEQ ID NO: 7684675 - DNA, 22 bp, Homo sapiens
ttcacagacattgcagactgaa

SEQ ID NO: 7684676 - DNA, 22 bp, Homo sapiens
ttcacagaccaggaggctgtga

SEQ ID NO: 7684677 - DNA, 22 bp, Homo sapiens
ttcacagaccaggaggctgtga

SEQ ID NO: 7684678 - DNA, 22 bp, Homo sapiens
ttcacagaccaggaggctgtga

SEQ ID NO: 7684679 - DNA, 22 bp, Homo sapiens
cctgggtggttccggcaaggag

SEQ ID NO: 7684680 - DNA, 22 bp, Homo sapiens
cctgggtggttccggcaaggag

SEQ ID NO: 7684681 - DNA, 22 bp, Homo sapiens
cctgggtggttccggcaaggag

SEQ ID NO: 7684682 - DNA, 21 bp, Homo sapiens
cctgggtgggacccctcttcc

SEQ ID NO: 7684683 - DNA, 21 bp, Homo sapiens
cctgggtgggacccctcttcc

SEQ ID NO: 7684684 - DNA, 21 bp, Homo sapiens
cctgggtgggacccctcttcc

SEQ ID NO: 7684685 - DNA, 22 bp, Homo sapiens
cctgggtggctgcctgcctttc

SEQ ID NO: 7684686 - DNA, 22 bp, Homo sapiens
cctgggtggctgcctgcctttc

SEQ ID NO: 7684687 - DNA, 22 bp, Homo sapiens
cctgggtggcagaggttgcagt

SEQ ID NO: 7684688 - DNA, 22 bp, Homo sapiens
cctgggtggcagaggttgcagt

SEQ ID NO: 7684689 - DNA, 22 bp, Homo sapiens
ttcacatataatgtctttaaaa

SEQ ID NO: 7684690 - DNA, 22 bp, Homo sapiens
ttcacatataatgtctttaaaa

SEQ ID NO: 7684691 - DNA, 22 bp, Homo sapiens
ttcacatctataacttagataa

SEQ ID NO: 7684692 - DNA, 22 bp, Homo sapiens
ttcacatgacagggtgaagcat

SEQ ID NO: 7684693 - DNA, 22 bp, Homo sapiens
ttcacatgacagggtgaagcat

SEQ ID NO: 7684694 - DNA, 22 bp, Homo sapiens
ttcacataggagcatggttttt

SEQ ID NO: 7684695 - DNA, 22 bp, Homo sapiens
ttcacataggagcatggttttt

SEQ ID NO: 7684696 - DNA, 22 bp, Homo sapiens
ttcacataatgatacaaagctt

SEQ ID NO: 7684697 - DNA, 22 bp, Homo sapiens
ttcacataatgatacaaagctt

SEQ ID NO: 7684698 - DNA, 22 bp, Homo sapiens
ttcacataaatagatcacatca

SEQ ID NO: 7684699 - DNA, 22 bp, Homo sapiens
ttcacataaatagatcacatca

SEQ ID NO: 7684700 - DNA, 22 bp, Homo sapiens
ttcacataatctgcagcaagcg

SEQ ID NO: 7684701 - DNA, 22 bp, Homo sapiens
ttcacataatctgcagcaagcg

SEQ ID NO: 7684702 - DNA, 22 bp, Homo sapiens
ttcacataatgatacaaagctt

SEQ ID NO: 7684703 - DNA, 22 bp, Homo sapiens
ttcacataatgatacaaagctt

SEQ ID NO: 7684704 - DNA, 22 bp, Homo sapiens
ttcacataaatagatcacatca

SEQ ID NO: 7684705 - DNA, 22 bp, Homo sapiens
ttcacataaatagatcacatca

SEQ ID NO: 7684706 - DNA, 22 bp, Homo sapiens
ttcacataaatagatcacatca

SEQ ID NO: 7684707 - DNA, 22 bp, Homo sapiens
ttcacataaatagatcacatca

SEQ ID NO: 7684708 - DNA, 22 bp, Homo sapiens
ttcacataaatagatcacatca

SEQ ID NO: 7684709 - DNA, 22 bp, Homo sapiens
ttcacagtttgctgggacagga

SEQ ID NO: 7684710 - DNA, 22 bp, Homo sapiens
ttcacataaaagctccaaagaa

SEQ ID NO: 7684711 - DNA, 22 bp, Homo sapiens
ttcacataaaagctccaaagaa

SEQ ID NO: 7684712 - DNA, 22 bp, Homo sapiens
ttcacataaaagctccaaagaa

SEQ ID NO: 7684713 - DNA, 22 bp, Homo sapiens
ttcacagttcctgggaaaacag

SEQ ID NO: 7684714 - DNA, 22 bp, Homo sapiens
ttcacagtttaatggcaaggat

SEQ ID NO: 7684715 - DNA, 22 bp, Homo sapiens
ttcacagtttgctgggacagga

SEQ ID NO: 7684716 - DNA, 22 bp, Homo sapiens
ttcacagtttaatggcaaggat

SEQ ID NO: 7684717 - DNA, 22 bp, Homo sapiens
ttcacagttcctgggaaaacag

SEQ ID NO: 7684718 - DNA, 22 bp, Homo sapiens
ttcacagttcctgggaaaacag

SEQ ID NO: 7684719 - DNA, 22 bp, Homo sapiens
ttcacagttgggcaggttgtgt

SEQ ID NO: 7684720 - DNA, 22 bp, Homo sapiens
cgctgggggaacagcgagggtg

SEQ ID NO: 7684721 - DNA, 22 bp, Homo sapiens
cgctgggggaacagcgagggtg

SEQ ID NO: 7684722 - DNA, 22 bp, Homo sapiens
cgctgggggaacagcgagggtg

SEQ ID NO: 7684723 - DNA, 22 bp, Homo sapiens
cgctgggcgcgctccgaacccg

SEQ ID NO: 7684724 - DNA, 22 bp, Homo sapiens
cgctgggcgcgctccgaacccg

SEQ ID NO: 7684725 - DNA, 22 bp, Homo sapiens
cgctggggctttttgcttgaga

SEQ ID NO: 7684726 - DNA, 22 bp, Homo sapiens
cgctggggctttttgcttgaga

SEQ ID NO: 7684727 - DNA, 22 bp, Homo sapiens
cgctgggggaacttcagccaat

SEQ ID NO: 7684728 - DNA, 22 bp, Homo sapiens
cgctgggggaacttcagccaat

SEQ ID NO: 7684729 - DNA, 22 bp, Homo sapiens
cgctgggggaacagcgagggtg

SEQ ID NO: 7684730 - DNA, 22 bp, Homo sapiens
cgctgggggaacagcgagggtg

SEQ ID NO: 7684731 - DNA, 22 bp, Homo sapiens
cgctgggggaacagcgagggtg

SEQ ID NO: 7684732 - DNA, 22 bp, Homo sapiens
cgctgggggaacagcgagggtg

SEQ ID NO: 7684733 - DNA, 22 bp, Homo sapiens
cgctgggcaggtccacttgtta

SEQ ID NO: 7684734 - DNA, 22 bp, Homo sapiens
cgctgggcaggtccacttgtta

SEQ ID NO: 7684735 - DNA, 22 bp, Homo sapiens
cgctgggcatggtgccttattt

SEQ ID NO: 7684736 - DNA, 22 bp, Homo sapiens
cgctgggcatggtgccttattt

SEQ ID NO: 7684737 - DNA, 22 bp, Homo sapiens
cgctgggcgccgacctgctggc

SEQ ID NO: 7684738 - DNA, 22 bp, Homo sapiens
cgctgggcgccgacctgctggc

SEQ ID NO: 7684739 - DNA, 22 bp, Homo sapiens
cgctgggcgccgacctgctggc

SEQ ID NO: 7684740 - DNA, 22 bp, Homo sapiens
cgctgggcgccgacctgctggc

SEQ ID NO: 7684741 - DNA, 22 bp, Homo sapiens
cgctgggcgccgacctgctggc

SEQ ID NO: 7684742 - DNA, 22 bp, Homo sapiens
ttcacattaagcctcctcctac

SEQ ID NO: 7684743 - DNA, 22 bp, Homo sapiens
ttcacatgttggacatagagga

SEQ ID NO: 7684744 - DNA, 22 bp, Homo sapiens
ttcacattaagcctcctcctac

SEQ ID NO: 7684745 - DNA, 22 bp, Homo sapiens
ttcacatgttggacatagagga

SEQ ID NO: 7684746 - DNA, 22 bp, Homo sapiens
ttcacatgttggacatagagga

SEQ ID NO: 7684747 - DNA, 22 bp, Homo sapiens
ttcacatgttggacatagagga

SEQ ID NO: 7684748 - DNA, 22 bp, Homo sapiens
ttcacatgttggacatagagga

SEQ ID NO: 7684749 - DNA, 22 bp, Homo sapiens
cgctgggtgcagtgattggcat

SEQ ID NO: 7684750 - DNA, 22 bp, Homo sapiens
cgctgggggaacttcagccaat

SEQ ID NO: 7684751 - DNA, 22 bp, Homo sapiens
cgctggtgaaggctaggctagc

SEQ ID NO: 7684752 - DNA, 22 bp, Homo sapiens
cgctggtcaccatggcgtcctg

SEQ ID NO: 7684753 - DNA, 21 bp, Homo sapiens
cgcttgtccccgttatcgccc

SEQ ID NO: 7684754 - DNA, 22 bp, Homo sapiens
cggaaacttgagaaccagccag

SEQ ID NO: 7684755 - DNA, 22 bp, Homo sapiens
cggaagacagtccgctctttca

SEQ ID NO: 7684756 - DNA, 22 bp, Homo sapiens
cggaagagggacagcgccagcc

SEQ ID NO: 7684757 - DNA, 22 bp, Homo sapiens
cggaagagggacagcgccagcc

SEQ ID NO: 7684758 - DNA, 21 bp, Homo sapiens
cggaaactcggctctggttcc

SEQ ID NO: 7684759 - DNA, 22 bp, Homo sapiens
cggaaactacgtgacacccgtt

SEQ ID NO: 7684760 - DNA, 22 bp, Homo sapiens
cgctttggatttcgctttccaa

SEQ ID NO: 7684761 - DNA, 20 bp, Homo sapiens
cgctttcctcaaactctgtt

SEQ ID NO: 7684762 - DNA, 22 bp, Homo sapiens
cgcttgttagatgccgttagcc

SEQ ID NO: 7684763 - DNA, 22 bp, Homo sapiens
cgctttaacgtgagaagaaggg

SEQ ID NO: 7684764 - DNA, 22 bp, Homo sapiens
cgctttggagtccctgctttac

SEQ ID NO: 7684765 - DNA, 22 bp, Homo sapiens
cggacaggctcctggagctcct

SEQ ID NO: 7684766 - DNA, 22 bp, Homo sapiens
cggacaggctcctggagctcct

SEQ ID NO: 7684767 - DNA, 22 bp, Homo sapiens
cggacaggctcctggagctcct

SEQ ID NO: 7684768 - DNA, 22 bp, Homo sapiens
cggcaggtgtgctcactctgcc

SEQ ID NO: 7684769 - DNA, 22 bp, Homo sapiens
cggacaggctcctggagctcct

SEQ ID NO: 7684770 - DNA, 22 bp, Homo sapiens
cggacaggctcctggagctcct

SEQ ID NO: 7684771 - DNA, 22 bp, Homo sapiens
cggacaggctcctggagctcct

SEQ ID NO: 7684772 - DNA, 21 bp, Homo sapiens
cggacacctgtgatgtgcctg

SEQ ID NO: 7684773 - DNA, 22 bp, Homo sapiens
cggaatgtccttcttaaggtgt

SEQ ID NO: 7684774 - DNA, 22 bp, Homo sapiens
cggaatgtcccaggtcctgatc

SEQ ID NO: 7684775 - DNA, 22 bp, Homo sapiens
cggaagagggacagcgccagcc

SEQ ID NO: 7684776 - DNA, 21 bp, Homo sapiens
cggctcagtgcctgctccttc

SEQ ID NO: 7684777 - DNA, 22 bp, Homo sapiens
cggctcaggccacaggacggca

SEQ ID NO: 7684778 - DNA, 22 bp, Homo sapiens
cggctcaggccacaggacggca

SEQ ID NO: 7684779 - DNA, 22 bp, Homo sapiens
cggcatgggcgtccccctcact

SEQ ID NO: 7684780 - DNA, 22 bp, Homo sapiens
cggcatgggcgtccccctcact

SEQ ID NO: 7684781 - DNA, 22 bp, Homo sapiens
cggcatgggcgtccccctcact

SEQ ID NO: 7684782 - DNA, 22 bp, Homo sapiens
cggcatccccacttcctcctgc

SEQ ID NO: 7684783 - DNA, 22 bp, Homo sapiens
cggcatgggcgtccccctcact

SEQ ID NO: 7684784 - DNA, 22 bp, Homo sapiens
cggcatgggcgtccccctcact

SEQ ID NO: 7684785 - DNA, 22 bp, Homo sapiens
cggcatccccacttcctcctgc

SEQ ID NO: 7684786 - DNA, 22 bp, Homo sapiens
cggcatccccacttcctcctgc

SEQ ID NO: 7684787 - DNA, 22 bp, Homo sapiens
ctacaaaagtaattgtggtttt

SEQ ID NO: 7684788 - DNA, 22 bp, Homo sapiens
ctacaaaagtaattgtggtttt

SEQ ID NO: 7684789 - DNA, 22 bp, Homo sapiens
ctacaaaagtaattgtggtttt

SEQ ID NO: 7684790 - DNA, 22 bp, Homo sapiens
ctacaaaagtaattgtggtttt

SEQ ID NO: 7684791 - DNA, 22 bp, Homo sapiens
ctacaaagtaccacagactggg

SEQ ID NO: 7684792 - DNA, 22 bp, Homo sapiens
ctacaaagctcttctacaggca

SEQ ID NO: 7684793 - DNA, 22 bp, Homo sapiens
ctacaaagctcttctacaggca

SEQ ID NO: 7684794 - DNA, 22 bp, Homo sapiens
ctacaaatataaaacacagata

SEQ ID NO: 7684795 - DNA, 22 bp, Homo sapiens
ctacaaatataaaacacagata

SEQ ID NO: 7684796 - DNA, 22 bp, Homo sapiens
ctacaaatataaaacacagata

SEQ ID NO: 7684797 - DNA, 22 bp, Homo sapiens
ttcctggggacttaccgtcatt

SEQ ID NO: 7684798 - DNA, 22 bp, Homo sapiens
ttcctggggacttaccgtcatt

SEQ ID NO: 7684799 - DNA, 20 bp, Homo sapiens
ttcctggggaatgatagaag

SEQ ID NO: 7684800 - DNA, 20 bp, Homo sapiens
ttcctggggaatgatagaag

SEQ ID NO: 7684801 - DNA, 22 bp, Homo sapiens
ttccttccacttcaggattttg

SEQ ID NO: 7684802 - DNA, 22 bp, Homo sapiens
ttccttccacttcaggattttg

SEQ ID NO: 7684803 - DNA, 22 bp, Homo sapiens
ttccttcagcaagtcctgagca

SEQ ID NO: 7684804 - DNA, 22 bp, Homo sapiens
ttccttcagttcagggaaccct

SEQ ID NO: 7684805 - DNA, 22 bp, Homo sapiens
ctacaaatataaaacacagata

SEQ ID NO: 7684806 - DNA, 22 bp, Homo sapiens
ctacaaatatgttaaggtgttt

SEQ ID NO: 7684807 - DNA, 22 bp, Homo sapiens
ctacaaatatgttaaggtgttt

SEQ ID NO: 7684808 - DNA, 22 bp, Homo sapiens
ctacaaatataaaacacagata

SEQ ID NO: 7684809 - DNA, 22 bp, Homo sapiens
ctacaaatataaaacacagata

SEQ ID NO: 7684810 - DNA, 22 bp, Homo sapiens
ctacaaatccacaaggcacttt

SEQ ID NO: 7684811 - DNA, 22 bp, Homo sapiens
ctacaaatccacaaggcacttt

SEQ ID NO: 7684812 - DNA, 22 bp, Homo sapiens
ctacaaatccacaaggcacttt

SEQ ID NO: 7684813 - DNA, 21 bp, Homo sapiens
ttcctggggaaggagctgcct

SEQ ID NO: 7684814 - DNA, 21 bp, Homo sapiens
ttcctggggaaggagctgcct

SEQ ID NO: 7684815 - DNA, 22 bp, Homo sapiens
ttccttcctgtcttccttactg

SEQ ID NO: 7684816 - DNA, 22 bp, Homo sapiens
ttccttcctgtcttccttactg

SEQ ID NO: 7684817 - DNA, 22 bp, Homo sapiens
ttccttcctgtcttccttactg

SEQ ID NO: 7684818 - DNA, 22 bp, Homo sapiens
ttccttctaatattctgcctgt

SEQ ID NO: 7684819 - DNA, 22 bp, Homo sapiens
ttccttcctgtcttccttactg

SEQ ID NO: 7684820 - DNA, 22 bp, Homo sapiens
ttccttcctgtcttccttactg

SEQ ID NO: 7684821 - DNA, 22 bp, Homo sapiens
ttccttcctggggatttatcat

SEQ ID NO: 7684822 - DNA, 22 bp, Homo sapiens
ttccttcctggggatttatcat

SEQ ID NO: 7684823 - DNA, 22 bp, Homo sapiens
ttccttcctggggatttatcat

SEQ ID NO: 7684824 - DNA, 22 bp, Homo sapiens
ttccttcctctttcacaacagc

SEQ ID NO: 7684825 - DNA, 22 bp, Homo sapiens
ttccttcctctttcacaacagc

SEQ ID NO: 7684826 - DNA, 22 bp, Homo sapiens
ttccttcctcctccagttctgg

SEQ ID NO: 7684827 - DNA, 22 bp, Homo sapiens
ttccttcctctttcacaacagc

SEQ ID NO: 7684828 - DNA, 22 bp, Homo sapiens
ttccttcctctttcacaacagc

SEQ ID NO: 7684829 - DNA, 22 bp, Homo sapiens
ttccttcctctttcacaacagc

SEQ ID NO: 7684830 - DNA, 22 bp, Homo sapiens
ttccttcctcctccagttctgg

SEQ ID NO: 7684831 - DNA, 22 bp, Homo sapiens
ttccttcctcctccagttctgg

SEQ ID NO: 7684832 - DNA, 22 bp, Homo sapiens
ttccttcctcctccagttctgg

SEQ ID NO: 7684833 - DNA, 22 bp, Homo sapiens
ttccttcctcctccagttctgg

SEQ ID NO: 7684834 - DNA, 22 bp, Homo sapiens
ttccttccgggcaccaggcact

SEQ ID NO: 7684835 - DNA, 22 bp, Homo sapiens
ttccttccctcagtggctgaag

SEQ ID NO: 7684836 - DNA, 22 bp, Homo sapiens
ttccttcccctagctgagaaac

SEQ ID NO: 7684837 - DNA, 22 bp, Homo sapiens
ttccttccatagcaaaacatgc

SEQ ID NO: 7684838 - DNA, 22 bp, Homo sapiens
ttccttcccctagctgagaaac

SEQ ID NO: 7684839 - DNA, 22 bp, Homo sapiens
ttccttcccctagctgagaaac

SEQ ID NO: 7684840 - DNA, 22 bp, Homo sapiens
ttccttcccctagctgagaaac

SEQ ID NO: 7684841 - DNA, 22 bp, Homo sapiens
ttccttccgggcaccaggcact

SEQ ID NO: 7684842 - DNA, 22 bp, Homo sapiens
ttccttccgggcaccaggcact

SEQ ID NO: 7684843 - DNA, 22 bp, Homo sapiens
ttccttccgggcaccaggcact

SEQ ID NO: 7684844 - DNA, 22 bp, Homo sapiens
ttccttccgggcaccaggcact

SEQ ID NO: 7684845 - DNA, 22 bp, Homo sapiens
ttccttccgggcaccaggcact

SEQ ID NO: 7684846 - DNA, 22 bp, Homo sapiens
ttccttccgggcaccaggcact

SEQ ID NO: 7684847 - DNA, 22 bp, Homo sapiens
ttccttccctcagtggctgaag

SEQ ID NO: 7684848 - DNA, 22 bp, Homo sapiens
ttccttccctcagtggctgaag

SEQ ID NO: 7684849 - DNA, 22 bp, Homo sapiens
ttccttccagcttgtgacagtc

SEQ ID NO: 7684850 - DNA, 22 bp, Homo sapiens
ttccttccagcttgtgacagtc

SEQ ID NO: 7684851 - DNA, 22 bp, Homo sapiens
ttccttccagcttgtgacagtc

SEQ ID NO: 7684852 - DNA, 22 bp, Homo sapiens
ttccttccatagcaaaacatgc

SEQ ID NO: 7684853 - DNA, 22 bp, Homo sapiens
ttccttccatagcaaaacatgc

SEQ ID NO: 7684854 - DNA, 22 bp, Homo sapiens
ttccttccatagcaaaacatgc

SEQ ID NO: 7684855 - DNA, 22 bp, Homo sapiens
ttccttccagcttgtgacagtc

SEQ ID NO: 7684856 - DNA, 22 bp, Homo sapiens
ttccttccagcttgtgacagtc

SEQ ID NO: 7684857 - DNA, 22 bp, Homo sapiens
ttccttccagcttgtgacagtc

SEQ ID NO: 7684858 - DNA, 22 bp, Homo sapiens
ttccttccagcttgtgacagtc

SEQ ID NO: 7684859 - DNA, 22 bp, Homo sapiens
ttccttccacttcaggattttg

SEQ ID NO: 7684860 - DNA, 22 bp, Homo sapiens
ttccttccacttcaggattttg

SEQ ID NO: 7684861 - DNA, 22 bp, Homo sapiens
ttccttccacttcaggattttg

SEQ ID NO: 7684862 - DNA, 22 bp, Homo sapiens
ctaattctgaaacagtgtcaat

SEQ ID NO: 7684863 - DNA, 22 bp, Homo sapiens
ctaattctgtacctggcacata

SEQ ID NO: 7684864 - DNA, 22 bp, Homo sapiens
ctaattctcagcatgaactggt

SEQ ID NO: 7684865 - DNA, 22 bp, Homo sapiens
ctaattctgaaacagtgtcaat

SEQ ID NO: 7684866 - DNA, 22 bp, Homo sapiens
ctaattctcagcatgaactggt

SEQ ID NO: 7684867 - DNA, 22 bp, Homo sapiens
ctaattatgttgttataatcaa

SEQ ID NO: 7684868 - DNA, 22 bp, Homo sapiens
ctaattatgttgttataatcaa

SEQ ID NO: 7684869 - DNA, 22 bp, Homo sapiens
ctaatgtggactctatcaaagt

SEQ ID NO: 7684870 - DNA, 22 bp, Homo sapiens
ctaattctttggagacaatctg

SEQ ID NO: 7684871 - DNA, 22 bp, Homo sapiens
ctaattctttggagacaatctg

SEQ ID NO: 7684872 - DNA, 22 bp, Homo sapiens
ctaattctgtatttggtcattg

SEQ ID NO: 7684873 - DNA, 22 bp, Homo sapiens
ctaattctgtatttggtcattg

SEQ ID NO: 7684874 - DNA, 22 bp, Homo sapiens
ctaattctttggagacaatctg

SEQ ID NO: 7684875 - DNA, 22 bp, Homo sapiens
ctaattgtaagctccttgaggg

SEQ ID NO: 7684876 - DNA, 22 bp, Homo sapiens
ctaattgtaagctccttgaggg

SEQ ID NO: 7684877 - DNA, 22 bp, Homo sapiens
ctaattgtaccagatttctctt

SEQ ID NO: 7684878 - DNA, 22 bp, Homo sapiens
ctaattgtaagctccttgaggg

SEQ ID NO: 7684879 - DNA, 22 bp, Homo sapiens
ctaattgtttgtgttgtcacct

SEQ ID NO: 7684880 - DNA, 22 bp, Homo sapiens
ctaatttaatgaatgagtctta

SEQ ID NO: 7684881 - DNA, 22 bp, Homo sapiens
ctaatttaatgaatgagtctta

SEQ ID NO: 7684882 - DNA, 22 bp, Homo sapiens
ctaatttaatgaatgagtctta

SEQ ID NO: 7684883 - DNA, 22 bp, Homo sapiens
ctacaaaagtaattgtggtttt

SEQ ID NO: 7684884 - DNA, 22 bp, Homo sapiens
ctacaaaagtaattgtggtttt

SEQ ID NO: 7684885 - DNA, 22 bp, Homo sapiens
ctacaaaagtaattgtggtttt

SEQ ID NO: 7684886 - DNA, 22 bp, Homo sapiens
ctacaaaagtaattgtggtttt

SEQ ID NO: 7684887 - DNA, 22 bp, Homo sapiens
ctacaaaagtaattgtggtttt

SEQ ID NO: 7684888 - DNA, 22 bp, Homo sapiens
ctacaaaagtaattgtggtttt

SEQ ID NO: 7684889 - DNA, 22 bp, Homo sapiens
ctacaaaagtaattgtggtttt

SEQ ID NO: 7684890 - DNA, 22 bp, Homo sapiens
ctacaaaagtaattgtggtttt

SEQ ID NO: 7684891 - DNA, 22 bp, Homo sapiens
ctacaaaagtaattgtggtttt

SEQ ID NO: 7684892 - DNA, 22 bp, Homo sapiens
ctacaaaagtaattgtggtttt

SEQ ID NO: 7684893 - DNA, 22 bp, Homo sapiens
ctaatttttgttctgcattgaa

SEQ ID NO: 7684894 - DNA, 22 bp, Homo sapiens
ctaattttcccaaggccttcta

SEQ ID NO: 7684895 - DNA, 22 bp, Homo sapiens
ctaattttcccaaggccttcta

SEQ ID NO: 7684896 - DNA, 22 bp, Homo sapiens
ctaattttcccaaggccttcta

SEQ ID NO: 7684897 - DNA, 22 bp, Homo sapiens
ctaatttttgttctgcattgaa

SEQ ID NO: 7684898 - DNA, 22 bp, Homo sapiens
ctaatttttgttctgcattgaa

SEQ ID NO: 7684899 - DNA, 22 bp, Homo sapiens
ctaatttttgttctgcattgaa

SEQ ID NO: 7684900 - DNA, 22 bp, Homo sapiens
ctaatttttgttctgcattgaa

SEQ ID NO: 7684901 - DNA, 22 bp, Homo sapiens
ctaatttaatgaatgagtctta

SEQ ID NO: 7684902 - DNA, 22 bp, Homo sapiens
ctaatttaatgaatgagtctta

SEQ ID NO: 7684903 - DNA, 22 bp, Homo sapiens
ctaagttaattttctaaaacta

SEQ ID NO: 7684904 - DNA, 22 bp, Homo sapiens
ctaagtttatgtagttctttca

SEQ ID NO: 7684905 - DNA, 22 bp, Homo sapiens
ctaataacatgaactactttct

SEQ ID NO: 7684906 - DNA, 22 bp, Homo sapiens
ctaataatagaggtggcatttg

SEQ ID NO: 7684907 - DNA, 22 bp, Homo sapiens
ctaataacatgaactactttct

SEQ ID NO: 7684908 - DNA, 22 bp, Homo sapiens
ctaataacatgaactactttct

SEQ ID NO: 7684909 - DNA, 22 bp, Homo sapiens
ctaagtcatggaaagtgtgtgt

SEQ ID NO: 7684910 - DNA, 22 bp, Homo sapiens
ctaagtctgcagaaataaatgt

SEQ ID NO: 7684911 - DNA, 19 bp, Homo sapiens
ctaagtctgtcaaggaatt

SEQ ID NO: 7684912 - DNA, 22 bp, Homo sapiens
ctaagttaagttagagtgaatt

SEQ ID NO: 7684913 - DNA, 22 bp, Homo sapiens
ctaagttaagttagagtgaatt

SEQ ID NO: 7684914 - DNA, 22 bp, Homo sapiens
ctaagggttgaaacagcaagaa

SEQ ID NO: 7684915 - DNA, 22 bp, Homo sapiens
ctaaggctaatcaggcttaaaa

SEQ ID NO: 7684916 - DNA, 22 bp, Homo sapiens
ctaaggcttggcttaattaatt

SEQ ID NO: 7684917 - DNA, 22 bp, Homo sapiens
ctaaggcaggtccattccagga

SEQ ID NO: 7684918 - DNA, 22 bp, Homo sapiens
ctaaggcaggtccattccagga

SEQ ID NO: 7684919 - DNA, 22 bp, Homo sapiens
ctaaggctaagaaattgtgtgt

SEQ ID NO: 7684920 - DNA, 22 bp, Homo sapiens
ctaaggcaccgaggcaggagcg

SEQ ID NO: 7684921 - DNA, 22 bp, Homo sapiens
ctaatactcatttctgtaactc

SEQ ID NO: 7684922 - DNA, 22 bp, Homo sapiens
ctaataatagaggtggcatttg

SEQ ID NO: 7684923 - DNA, 22 bp, Homo sapiens
ctaatacaccctattgcttgtt

SEQ ID NO: 7684924 - DNA, 22 bp, Homo sapiens
ctaatacaccctattgcttgtt

SEQ ID NO: 7684925 - DNA, 22 bp, Homo sapiens
ctaatacaccctattgcttgtt

SEQ ID NO: 7684926 - DNA, 22 bp, Homo sapiens
ctaatactcatttctgtaactc

SEQ ID NO: 7684927 - DNA, 22 bp, Homo sapiens
ctaatatttttagaaatcacga

SEQ ID NO: 7684928 - DNA, 20 bp, Homo sapiens
ctaatattctactctaagga

SEQ ID NO: 7684929 - DNA, 22 bp, Homo sapiens
ctaatagataccacattggaca

SEQ ID NO: 7684930 - DNA, 22 bp, Homo sapiens
ctaatactcatttctgtaactc

SEQ ID NO: 7684931 - DNA, 22 bp, Homo sapiens
ctaatcatctttctcttaaagc

SEQ ID NO: 7684932 - DNA, 22 bp, Homo sapiens
ctaatcatctttctcttaaagc

SEQ ID NO: 7684933 - DNA, 22 bp, Homo sapiens
ctaatcttgcctcatcaagtct

SEQ ID NO: 7684934 - DNA, 22 bp, Homo sapiens
ttcccttcaaggtggcctaaag

SEQ ID NO: 7684935 - DNA, 22 bp, Homo sapiens
ttcccttcaaggtggcctaaag

SEQ ID NO: 7684936 - DNA, 22 bp, Homo sapiens
ttcccttcctcactctacttgt

SEQ ID NO: 7684937 - DNA, 22 bp, Homo sapiens
ttcccttcctcactctacttgt

SEQ ID NO: 7684938 - DNA, 22 bp, Homo sapiens
ttcccttaaattatggcatcta

SEQ ID NO: 7684939 - DNA, 22 bp, Homo sapiens
ttcccttaaattatggcatcta

SEQ ID NO: 7684940 - DNA, 22 bp, Homo sapiens
ttcccttaaattatggcatcta

SEQ ID NO: 7684941 - DNA, 22 bp, Homo sapiens
ttcccttaaattatggcatcta

SEQ ID NO: 7684942 - DNA, 22 bp, Homo sapiens
ttcccttaaattatggcatcta

SEQ ID NO: 7684943 - DNA, 22 bp, Homo sapiens
ttcccttaaattatggcatcta

SEQ ID NO: 7684944 - DNA, 22 bp, Homo sapiens
ttccctggttaaccattttctg

SEQ ID NO: 7684945 - DNA, 22 bp, Homo sapiens
ttccctggttaaccattttctg

SEQ ID NO: 7684946 - DNA, 22 bp, Homo sapiens
ttccctggtgggtgagaacctg

SEQ ID NO: 7684947 - DNA, 22 bp, Homo sapiens
ttccctggttaaccattttctg

SEQ ID NO: 7684948 - DNA, 22 bp, Homo sapiens
ttccctggttaaccattttctg

SEQ ID NO: 7684949 - DNA, 22 bp, Homo sapiens
ttccctggtctatcctggttca

SEQ ID NO: 7684950 - DNA, 22 bp, Homo sapiens
ttccctggtctatcctggttca

SEQ ID NO: 7684951 - DNA, 22 bp, Homo sapiens
ttccctggtgggtgagaacctg

SEQ ID NO: 7684952 - DNA, 22 bp, Homo sapiens
ttcccagaatgaatggatggag

SEQ ID NO: 7684953 - DNA, 22 bp, Homo sapiens
ttcccagaatgaatggatggag

SEQ ID NO: 7684954 - DNA, 22 bp, Homo sapiens
ttcccacttttacagttgtctg

SEQ ID NO: 7684955 - DNA, 22 bp, Homo sapiens
ttcccacttttacagttgtctg

SEQ ID NO: 7684956 - DNA, 22 bp, Homo sapiens
ttcccacagtcactgggagaag

SEQ ID NO: 7684957 - DNA, 22 bp, Homo sapiens
ttcccacagagattacattgaa

SEQ ID NO: 7684958 - DNA, 22 bp, Homo sapiens
ttcccacaggatgagagctgag

SEQ ID NO: 7684959 - DNA, 22 bp, Homo sapiens
ttcccacaggatgagagctgag

SEQ ID NO: 7684960 - DNA, 22 bp, Homo sapiens
ttcccacaggatgagagctgag

SEQ ID NO: 7684961 - DNA, 22 bp, Homo sapiens
ttcccacacaattaagtcattt

SEQ ID NO: 7684962 - DNA, 22 bp, Homo sapiens
ttcccacacccatattgtgatt

SEQ ID NO: 7684963 - DNA, 22 bp, Homo sapiens
ttcccacacccatattgtgatt

SEQ ID NO: 7684964 - DNA, 22 bp, Homo sapiens
ttcccacagagattacattgaa

SEQ ID NO: 7684965 - DNA, 22 bp, Homo sapiens
ttcccacagagattacattgaa

SEQ ID NO: 7684966 - DNA, 22 bp, Homo sapiens
ttcccacagtgactccagagaa

SEQ ID NO: 7684967 - DNA, 22 bp, Homo sapiens
ttcccacagttcagaacaaagg

SEQ ID NO: 7684968 - DNA, 23 bp, Homo sapiens
ttcccacatcttccacagctatg

SEQ ID NO: 7684969 - DNA, 22 bp, Homo sapiens
ttcccactgtggcagagcctcg

SEQ ID NO: 7684970 - DNA, 22 bp, Homo sapiens
ttcccactgtggcagagcctcg

SEQ ID NO: 7684971 - DNA, 22 bp, Homo sapiens
ttcccacattctttacattcat

SEQ ID NO: 7684972 - DNA, 22 bp, Homo sapiens
ttcccacattctttacattcat

SEQ ID NO: 7684973 - DNA, 22 bp, Homo sapiens
ctaagaaaatagaagcatgcta

SEQ ID NO: 7684974 - DNA, 22 bp, Homo sapiens
ctaactttttgattcttgggga

SEQ ID NO: 7684975 - DNA, 22 bp, Homo sapiens
ctaactttttgattcttgggga

SEQ ID NO: 7684976 - DNA, 22 bp, Homo sapiens
ctaagaaaatagaagcatgcta

SEQ ID NO: 7684977 - DNA, 22 bp, Homo sapiens
ctaagaaaatagaagcatgcta

SEQ ID NO: 7684978 - DNA, 22 bp, Homo sapiens
ctaaggcaccgaggcaggagcg

SEQ ID NO: 7684979 - DNA, 22 bp, Homo sapiens
ctaaggatgcatatgttttgtt

SEQ ID NO: 7684980 - DNA, 22 bp, Homo sapiens
ctaaggatgcatatgttttgtt

SEQ ID NO: 7684981 - DNA, 22 bp, Homo sapiens
ctaagaaagtattgttttgtgg

SEQ ID NO: 7684982 - DNA, 22 bp, Homo sapiens
ctaagaaagtattgttttgtgg

SEQ ID NO: 7684983 - DNA, 22 bp, Homo sapiens
ctaacttttacagtcatgttgc

SEQ ID NO: 7684984 - DNA, 22 bp, Homo sapiens
ttccggaaggttctctagaatt

SEQ ID NO: 7684985 - DNA, 22 bp, Homo sapiens
ttccggacgcccgtcttccagc

SEQ ID NO: 7684986 - DNA, 22 bp, Homo sapiens
ttccgctgtttagttgaagttt

SEQ ID NO: 7684987 - DNA, 22 bp, Homo sapiens
ttccggggatagtgtttcccat

SEQ ID NO: 7684988 - DNA, 22 bp, Homo sapiens
ttccgctgtttagttgaagttt

SEQ ID NO: 7684989 - DNA, 22 bp, Homo sapiens
ttccggaaggttctctagaatt

SEQ ID NO: 7684990 - DNA, 22 bp, Homo sapiens
ttcccttctagttttgagagac

SEQ ID NO: 7684991 - DNA, 22 bp, Homo sapiens
ttcccttctagttttgagagac

SEQ ID NO: 7684992 - DNA, 22 bp, Homo sapiens
ttcccttctagttttgagagac

SEQ ID NO: 7684993 - DNA, 22 bp, Homo sapiens
ttccctttcttaaagagttagg

SEQ ID NO: 7684994 - DNA, 21 bp, Homo sapiens
ttcccttctggttttgagaga

SEQ ID NO: 7684995 - DNA, 22 bp, Homo sapiens
ttcccttgaccccagaccctgg

SEQ ID NO: 7684996 - DNA, 21 bp, Homo sapiens
ttcccttctggttttgagaga

SEQ ID NO: 7684997 - DNA, 21 bp, Homo sapiens
ttcccttctggttttgagaga

SEQ ID NO: 7684998 - DNA, 22 bp, Homo sapiens
ttccgctggggccgcctggcgg

SEQ ID NO: 7684999 - DNA, 22 bp, Homo sapiens
ttccgctggaggctaatgctct

SEQ ID NO: 7685000 - DNA, 22 bp, Homo sapiens
ttccgagggctcggcggccgcc

SEQ ID NO: 7685001 - DNA, 22 bp, Homo sapiens
ttccctttgttaaattggaaga

SEQ ID NO: 7685002 - DNA, 22 bp, Homo sapiens
ttccctttggcagccttctcct

SEQ ID NO: 7685003 - DNA, 22 bp, Homo sapiens
ttccctttggcagccttctcct

SEQ ID NO: 7685004 - DNA, 22 bp, Homo sapiens
ttccctttggcagccttctcct

SEQ ID NO: 7685005 - DNA, 22 bp, Homo sapiens
ttccctttgttaaattggaaga

SEQ ID NO: 7685006 - DNA, 22 bp, Homo sapiens
ttccaaagaagttcacatttac

SEQ ID NO: 7685007 - DNA, 22 bp, Homo sapiens
ttccaaagcacttgatgtaaag

SEQ ID NO: 7685008 - DNA, 22 bp, Homo sapiens
ttccaaagaagttcacatttac

SEQ ID NO: 7685009 - DNA, 22 bp, Homo sapiens
ttccaaagaagttcacatttac

SEQ ID NO: 7685010 - DNA, 22 bp, Homo sapiens
ttccaaagaaattgaccaagac

SEQ ID NO: 7685011 - DNA, 22 bp, Homo sapiens
ttccaaagaaattgaccaagac

SEQ ID NO: 7685012 - DNA, 22 bp, Homo sapiens
ttccaaactgccaattcagaag

SEQ ID NO: 7685013 - DNA, 22 bp, Homo sapiens
ttccaaactgccaattcagaag

SEQ ID NO: 7685014 - DNA, 22 bp, Homo sapiens
ttccaaactgccaattcagaag

SEQ ID NO: 7685015 - DNA, 22 bp, Homo sapiens
ttccaaagctgctttatttagt

SEQ ID NO: 7685016 - DNA, 22 bp, Homo sapiens
ttccaaagctgctttatttagt

SEQ ID NO: 7685017 - DNA, 22 bp, Homo sapiens
ttccaaagcacttgatgtaaag

SEQ ID NO: 7685018 - DNA, 22 bp, Homo sapiens
ttccaaagctgctttatttagt

SEQ ID NO: 7685019 - DNA, 22 bp, Homo sapiens
ttccaaagtcatgttgctgata

SEQ ID NO: 7685020 - DNA, 22 bp, Homo sapiens
ttccaaaggctgcaccttgccc

SEQ ID NO: 7685021 - DNA, 22 bp, Homo sapiens
ttccaaaggaatggggagctat

SEQ ID NO: 7685022 - DNA, 22 bp, Homo sapiens
ttccaaaggaatggggagctat

SEQ ID NO: 7685023 - DNA, 22 bp, Homo sapiens
ttccaaagttagttattagaaa

SEQ ID NO: 7685024 - DNA, 22 bp, Homo sapiens
ttccaaagttagttattagaaa

SEQ ID NO: 7685025 - DNA, 22 bp, Homo sapiens
ttccaaagtcatgttgctgata

SEQ ID NO: 7685026 - DNA, 22 bp, Homo sapiens
ttccaaagtcatgttgctgata

SEQ ID NO: 7685027 - DNA, 22 bp, Homo sapiens
ttccaaagtgctggaattacat

SEQ ID NO: 7685028 - DNA, 22 bp, Homo sapiens
ttccaaagtcatgttgctgata

SEQ ID NO: 7685029 - DNA, 22 bp, Homo sapiens
ttccaaatgcccatctacacag

SEQ ID NO: 7685030 - DNA, 22 bp, Homo sapiens
ttccaaatgcccatctacacag

SEQ ID NO: 7685031 - DNA, 22 bp, Homo sapiens
ttccaaatggagaagatgagtt

SEQ ID NO: 7685032 - DNA, 22 bp, Homo sapiens
ttccaaatgagttccatcgaat

SEQ ID NO: 7685033 - DNA, 22 bp, Homo sapiens
ttccaaagttattcaagcagta

SEQ ID NO: 7685034 - DNA, 22 bp, Homo sapiens
ttccaaatgagttccatcgaat

SEQ ID NO: 7685035 - DNA, 22 bp, Homo sapiens
ttccaaatgagttccatcgaat

SEQ ID NO: 7685036 - DNA, 22 bp, Homo sapiens
ttccaaagttattcaagcagta

SEQ ID NO: 7685037 - DNA, 22 bp, Homo sapiens
ttccaaagttattcaagcagta

SEQ ID NO: 7685038 - DNA, 22 bp, Homo sapiens
ttccaaagttagttattagaaa

SEQ ID NO: 7685039 - DNA, 22 bp, Homo sapiens
ttcccaagtctccaatgtggga

SEQ ID NO: 7685040 - DNA, 22 bp, Homo sapiens
ttcccaaagctttgtctgtgaa

SEQ ID NO: 7685041 - DNA, 22 bp, Homo sapiens
ttcccaaagctttgtctgtgaa

SEQ ID NO: 7685042 - DNA, 22 bp, Homo sapiens
ttcccacaacagatctgtatta

SEQ ID NO: 7685043 - DNA, 22 bp, Homo sapiens
ttcccacaatctgcgtgtgtat

SEQ ID NO: 7685044 - DNA, 22 bp, Homo sapiens
ttccatttggcacttcactgag

SEQ ID NO: 7685045 - DNA, 22 bp, Homo sapiens
ttccatttggcacttcactgag

SEQ ID NO: 7685046 - DNA, 22 bp, Homo sapiens
ttccatttttctaactctcaga

SEQ ID NO: 7685047 - DNA, 22 bp, Homo sapiens
ttccatttttctaactctcaga

SEQ ID NO: 7685048 - DNA, 22 bp, Homo sapiens
ttcccaaaatataacagttaac

SEQ ID NO: 7685049 - DNA, 22 bp, Homo sapiens
ttccatttttctaactctcaga

SEQ ID NO: 7685050 - DNA, 22 bp, Homo sapiens
ttccatttttctaactctcaga

SEQ ID NO: 7685051 - DNA, 22 bp, Homo sapiens
ttccatttattcttgtccagat

SEQ ID NO: 7685052 - DNA, 22 bp, Homo sapiens
ttccaggcacatcccaactcca

SEQ ID NO: 7685053 - DNA, 22 bp, Homo sapiens
ttccatttggcacttcactgag

SEQ ID NO: 7685054 - DNA, 22 bp, Homo sapiens
ttccatttggcacttcactgag

SEQ ID NO: 7685055 - DNA, 22 bp, Homo sapiens
ttccaaatgttggacaactgta

SEQ ID NO: 7685056 - DNA, 22 bp, Homo sapiens
ttccaaatggagaagatgagtt

SEQ ID NO: 7685057 - DNA, 22 bp, Homo sapiens
ttccaaatggagaagatgagtt

SEQ ID NO: 7685058 - DNA, 22 bp, Homo sapiens
ttccaaatgttggacaactgta

SEQ ID NO: 7685059 - DNA, 22 bp, Homo sapiens
ttccaaatgttggacaactgta

SEQ ID NO: 7685060 - DNA, 21 bp, Homo sapiens
ttccaggattgcttattttta

SEQ ID NO: 7685061 - DNA, 22 bp, Homo sapiens
ttccaggatgggctgtcctact

SEQ ID NO: 7685062 - DNA, 21 bp, Homo sapiens
ttccaggattgcttattttta

SEQ ID NO: 7685063 - DNA, 22 bp, Homo sapiens
ttccaggcaaaggaagcagctt

SEQ ID NO: 7685064 - DNA, 22 bp, Homo sapiens
ttccaggcaaaggaagcagctt

SEQ ID NO: 7685065 - DNA, 22 bp, Homo sapiens
ttccaggcaaaggaagcagctt

SEQ ID NO: 7685066 - DNA, 22 bp, Homo sapiens
ttccaggcaaaggaagcagctt

SEQ ID NO: 7685067 - DNA, 22 bp, Homo sapiens
tttagacacactttgtatattt

SEQ ID NO: 7685068 - DNA, 22 bp, Homo sapiens
tttagacacactttgtatattt

SEQ ID NO: 7685069 - DNA, 22 bp, Homo sapiens
tttagacacactttgtatattt

SEQ ID NO: 7685070 - DNA, 22 bp, Homo sapiens
tttagacacactttgtatattt

SEQ ID NO: 7685071 - DNA, 22 bp, Homo sapiens
tttagacacactttgtatattt

SEQ ID NO: 7685072 - DNA, 22 bp, Homo sapiens
tttagacaagatccttctgaat

SEQ ID NO: 7685073 - DNA, 22 bp, Homo sapiens
tttagaattggctagtgggaat

SEQ ID NO: 7685074 - DNA, 22 bp, Homo sapiens
tttagaatgttagcgttaaagg

SEQ ID NO: 7685075 - DNA, 22 bp, Homo sapiens
tttagaatgttagcgttaaagg

SEQ ID NO: 7685076 - DNA, 22 bp, Homo sapiens
tttagaatgttagcgttaaagg

SEQ ID NO: 7685077 - DNA, 22 bp, Homo sapiens
tttagaatgttagcgttaaagg

SEQ ID NO: 7685078 - DNA, 22 bp, Homo sapiens
tttagaatgtgactgtatttga

SEQ ID NO: 7685079 - DNA, 22 bp, Homo sapiens
tttagaatgtgactgtatttga

SEQ ID NO: 7685080 - DNA, 22 bp, Homo sapiens
tttagaatgtgactgtatttga

SEQ ID NO: 7685081 - DNA, 22 bp, Homo sapiens
tttagaatgtgactgtatttga

SEQ ID NO: 7685082 - DNA, 22 bp, Homo sapiens
tttagacatctataattgctaa

SEQ ID NO: 7685083 - DNA, 22 bp, Homo sapiens
tttagacatctataattgctaa

SEQ ID NO: 7685084 - DNA, 22 bp, Homo sapiens
tttagacatagctgaaatcatt

SEQ ID NO: 7685085 - DNA, 22 bp, Homo sapiens
tttagacatagctgaaatcatt

SEQ ID NO: 7685086 - DNA, 22 bp, Homo sapiens
tttagacaggggcaaaataagg

SEQ ID NO: 7685087 - DNA, 22 bp, Homo sapiens
tttagacaggggcaaaataagg

SEQ ID NO: 7685088 - DNA, 22 bp, Homo sapiens
tttagacatagctgaaatcatt

SEQ ID NO: 7685089 - DNA, 22 bp, Homo sapiens
tttagacaggggcaaaataagg

SEQ ID NO: 7685090 - DNA, 22 bp, Homo sapiens
tttagacaggggcaaaataagg

SEQ ID NO: 7685091 - DNA, 22 bp, Homo sapiens
tttagacagcggctctgaacca

SEQ ID NO: 7685092 - DNA, 22 bp, Homo sapiens
tttagacaggggcaaaataagg

SEQ ID NO: 7685093 - DNA, 22 bp, Homo sapiens
tttagacagcatctggtgactt

SEQ ID NO: 7685094 - DNA, 22 bp, Homo sapiens
tttagacactagggatgcagtg

SEQ ID NO: 7685095 - DNA, 22 bp, Homo sapiens
tttagacagcggctctgaacca

SEQ ID NO: 7685096 - DNA, 22 bp, Homo sapiens
tttagacactagggatgcagtg

SEQ ID NO: 7685097 - DNA, 22 bp, Homo sapiens
tttagacagatgtgaggtgggt

SEQ ID NO: 7685098 - DNA, 22 bp, Homo sapiens
tttagacagcatctggtgactt

SEQ ID NO: 7685099 - DNA, 22 bp, Homo sapiens
ctcctctgcccaaatttgtata

SEQ ID NO: 7685100 - DNA, 17 bp, Homo sapiens
ctcctctctgggttact

SEQ ID NO: 7685101 - DNA, 22 bp, Homo sapiens
ctcctctctggagttatgcaga

SEQ ID NO: 7685102 - DNA, 22 bp, Homo sapiens
ctcctctctggagttatgcaga

SEQ ID NO: 7685103 - DNA, 16 bp, Homo sapiens
ctcctctccttcagga

SEQ ID NO: 7685104 - DNA, 16 bp, Homo sapiens
ctcctctccttcagga

SEQ ID NO: 7685105 - DNA, 16 bp, Homo sapiens
ctcctctccttcagga

SEQ ID NO: 7685106 - DNA, 22 bp, Homo sapiens
ctcctctccatcagcgccaccc

SEQ ID NO: 7685107 - DNA, 22 bp, Homo sapiens
ctcctcccacggtctcaggaag

SEQ ID NO: 7685108 - DNA, 22 bp, Homo sapiens
ctcctcccaattgccaagtgct

SEQ ID NO: 7685109 - DNA, 22 bp, Homo sapiens
ctcctcccaattgccaagtgct

SEQ ID NO: 7685110 - DNA, 22 bp, Homo sapiens
tttagacatggcttgctcactt

SEQ ID NO: 7685111 - DNA, 22 bp, Homo sapiens
ctcctctggcttcctggaggca

SEQ ID NO: 7685112 - DNA, 22 bp, Homo sapiens
ctcctctggcttcctggaggca

SEQ ID NO: 7685113 - DNA, 22 bp, Homo sapiens
ctcctctggcttcctggaggca

SEQ ID NO: 7685114 - DNA, 22 bp, Homo sapiens
ctcctctggcttcctggaggca

SEQ ID NO: 7685115 - DNA, 22 bp, Homo sapiens
ctcctctggcttcctggaggca

SEQ ID NO: 7685116 - DNA, 22 bp, Homo sapiens
ctcctctggcttcctggaggca

SEQ ID NO: 7685117 - DNA, 22 bp, Homo sapiens
ctcctctggcttcctggaggca

SEQ ID NO: 7685118 - DNA, 15 bp, Homo sapiens
ctcctctggcctccc

SEQ ID NO: 7685119 - DNA, 15 bp, Homo sapiens
ctcctctggcctccc

SEQ ID NO: 7685120 - DNA, 22 bp, Homo sapiens
ctcctctggcttcctggaggca

SEQ ID NO: 7685121 - DNA, 22 bp, Homo sapiens
ctcctctggcttcctggaggca

SEQ ID NO: 7685122 - DNA, 22 bp, Homo sapiens
ctcctctggaaattcctctgcc

SEQ ID NO: 7685123 - DNA, 22 bp, Homo sapiens
ctcctctgcccaaatttgtata

SEQ ID NO: 7685124 - DNA, 22 bp, Homo sapiens
ctcctctggaaattcctctgcc

SEQ ID NO: 7685125 - DNA, 22 bp, Homo sapiens
ctcctctggaaattcctctgcc

SEQ ID NO: 7685126 - DNA, 22 bp, Homo sapiens
ctcctctgcccaaatttgtata

SEQ ID NO: 7685127 - DNA, 22 bp, Homo sapiens
ctcctctggaaattcctctgcc

SEQ ID NO: 7685128 - DNA, 22 bp, Homo sapiens
ctcctctggaaattcctctgcc

SEQ ID NO: 7685129 - DNA, 22 bp, Homo sapiens
ctcctctggaaattcctctgcc

SEQ ID NO: 7685130 - DNA, 22 bp, Homo sapiens
ctcctctggaaattcctctgcc

SEQ ID NO: 7685131 - DNA, 22 bp, Homo sapiens
ctcctctggaaattcctctgcc

SEQ ID NO: 7685132 - DNA, 22 bp, Homo sapiens
ctcctctgtctggccctgagcc

SEQ ID NO: 7685133 - DNA, 22 bp, Homo sapiens
ctcctctgtctggccctgagcc

SEQ ID NO: 7685134 - DNA, 22 bp, Homo sapiens
ctcctctgtctggccctgagcc

SEQ ID NO: 7685135 - DNA, 22 bp, Homo sapiens
ctcctctgtctggccctgagcc

SEQ ID NO: 7685136 - DNA, 22 bp, Homo sapiens
ctcctctgtctaccacgagggt

SEQ ID NO: 7685137 - DNA, 22 bp, Homo sapiens
ctcctctgtctaccacgagggt

SEQ ID NO: 7685138 - DNA, 22 bp, Homo sapiens
ctcctctgtctaccacgagggt

SEQ ID NO: 7685139 - DNA, 22 bp, Homo sapiens
ctcctctgtctaccacgagggt

SEQ ID NO: 7685140 - DNA, 22 bp, Homo sapiens
ctcctctgtctaccacgagggt

SEQ ID NO: 7685141 - DNA, 22 bp, Homo sapiens
ctcctcttggaatgcgtggctc

SEQ ID NO: 7685142 - DNA, 22 bp, Homo sapiens
ctcctctttacccgcatggtct

SEQ ID NO: 7685143 - DNA, 22 bp, Homo sapiens
ctcctctgtctggccctgagcc

SEQ ID NO: 7685144 - DNA, 22 bp, Homo sapiens
ctcctctgtctggccctgagcc

SEQ ID NO: 7685145 - DNA, 22 bp, Homo sapiens
ctcctctgtctggccctgagcc

SEQ ID NO: 7685146 - DNA, 22 bp, Homo sapiens
ctcctctgtctggccctgagcc

SEQ ID NO: 7685147 - DNA, 22 bp, Homo sapiens
ctcctctgtctggccctgagcc

SEQ ID NO: 7685148 - DNA, 22 bp, Homo sapiens
ctcctctgggtcctggtggcca

SEQ ID NO: 7685149 - DNA, 22 bp, Homo sapiens
ctcctctgggtcctggtggcca

SEQ ID NO: 7685150 - DNA, 22 bp, Homo sapiens
ctcctctgggtcctggtggcca

SEQ ID NO: 7685151 - DNA, 22 bp, Homo sapiens
ctcctctgggtcctggtggcca

SEQ ID NO: 7685152 - DNA, 22 bp, Homo sapiens
ctcctctggcttcctggaggca

SEQ ID NO: 7685153 - DNA, 22 bp, Homo sapiens
ctcctctgggtcctggtggcca

SEQ ID NO: 7685154 - DNA, 22 bp, Homo sapiens
ctcctctggcttcctggaggca

SEQ ID NO: 7685155 - DNA, 22 bp, Homo sapiens
ctcctctgtctaccacgagggt

SEQ ID NO: 7685156 - DNA, 22 bp, Homo sapiens
ctcctctgtctaccacgagggt

SEQ ID NO: 7685157 - DNA, 22 bp, Homo sapiens
ctcctctgtctaccacgagggt

SEQ ID NO: 7685158 - DNA, 22 bp, Homo sapiens
ctcctctgtctaccacgagggt

SEQ ID NO: 7685159 - DNA, 22 bp, Homo sapiens
ctcctctgtctaccacgagggt

SEQ ID NO: 7685160 - DNA, 22 bp, Homo sapiens
ctcctctgtctaccacgagggt

SEQ ID NO: 7685161 - DNA, 22 bp, Homo sapiens
ctcctctgggtcctggtggcca

SEQ ID NO: 7685162 - DNA, 22 bp, Homo sapiens
ctcctctgtattgattgggact

SEQ ID NO: 7685163 - DNA, 22 bp, Homo sapiens
ctcctctgtattgattgggact

SEQ ID NO: 7685164 - DNA, 22 bp, Homo sapiens
ctcctctgtattgattgggact

SEQ ID NO: 7685165 - DNA, 22 bp, Homo sapiens
ctcctctgtattgattgggact

SEQ ID NO: 7685166 - DNA, 22 bp, Homo sapiens
ctcctctttagccccagctgga

SEQ ID NO: 7685167 - DNA, 22 bp, Homo sapiens
ctcctctttagccccagctgga

SEQ ID NO: 7685168 - DNA, 22 bp, Homo sapiens
ctcctctttagccccagctgga

SEQ ID NO: 7685169 - DNA, 22 bp, Homo sapiens
ctcctctttagccccagctgga

SEQ ID NO: 7685170 - DNA, 22 bp, Homo sapiens
ctcctctttggggatttacaca

SEQ ID NO: 7685171 - DNA, 22 bp, Homo sapiens
ctcctgacttgtgagcccctcc

SEQ ID NO: 7685172 - DNA, 22 bp, Homo sapiens
ctcctgaattgtccctcacagc

SEQ ID NO: 7685173 - DNA, 22 bp, Homo sapiens
ctcctgaattgtccctcacagc

SEQ ID NO: 7685174 - DNA, 22 bp, Homo sapiens
ctcctgacacagtccacacttg

SEQ ID NO: 7685175 - DNA, 22 bp, Homo sapiens
ctcctgagaaataagcaagtaa

SEQ ID NO: 7685176 - DNA, 22 bp, Homo sapiens
ctcctgagaaataagcaagtaa

SEQ ID NO: 7685177 - DNA, 22 bp, Homo sapiens
ctcctgagaaataagcaagtaa

SEQ ID NO: 7685178 - DNA, 22 bp, Homo sapiens
ctcctgagaattttcagttgga

SEQ ID NO: 7685179 - DNA, 22 bp, Homo sapiens
ctcctgagaattttcagttgga

SEQ ID NO: 7685180 - DNA, 22 bp, Homo sapiens
ctcctgagaattttcagttgga

SEQ ID NO: 7685181 - DNA, 22 bp, Homo sapiens
ctcctgagaattttcagttgga

SEQ ID NO: 7685182 - DNA, 22 bp, Homo sapiens
ctcctgagaggatctctgttgt

SEQ ID NO: 7685183 - DNA, 22 bp, Homo sapiens
ctcctgagaggatctctgttgt

SEQ ID NO: 7685184 - DNA, 22 bp, Homo sapiens
ctcctgagaggatctctgttgt

SEQ ID NO: 7685185 - DNA, 22 bp, Homo sapiens
ctcctgagctctgaggaagctt

SEQ ID NO: 7685186 - DNA, 22 bp, Homo sapiens
ctcctgagaggatctctgttgt

SEQ ID NO: 7685187 - DNA, 22 bp, Homo sapiens
ctcctgagaggatctctgttgt

SEQ ID NO: 7685188 - DNA, 22 bp, Homo sapiens
ctcctggccctgagctcccagg

SEQ ID NO: 7685189 - DNA, 22 bp, Homo sapiens
ctcctggctatgactacatttc

SEQ ID NO: 7685190 - DNA, 22 bp, Homo sapiens
ctcctgagaggatctctgttgt

SEQ ID NO: 7685191 - DNA, 22 bp, Homo sapiens
ctcctgagaggatctctgttgt

SEQ ID NO: 7685192 - DNA, 22 bp, Homo sapiens
ctcctgagctctgaggaagctt

SEQ ID NO: 7685193 - DNA, 22 bp, Homo sapiens
ctcctggctatgactacatttc

SEQ ID NO: 7685194 - DNA, 22 bp, Homo sapiens
ctcctggctcgcccccagctga

SEQ ID NO: 7685195 - DNA, 22 bp, Homo sapiens
ctcctggctcgcccccagctga

SEQ ID NO: 7685196 - DNA, 22 bp, Homo sapiens
tttaaatttgtgtttagagggt

SEQ ID NO: 7685197 - DNA, 22 bp, Homo sapiens
tttaaatttgtgtttagagggt

SEQ ID NO: 7685198 - DNA, 22 bp, Homo sapiens
tttaaatttgtgtttagagggt

SEQ ID NO: 7685199 - DNA, 22 bp, Homo sapiens
tttaaatttgtgtttagagggt

SEQ ID NO: 7685200 - DNA, 22 bp, Homo sapiens
tttaaatttagaagaaacactg

SEQ ID NO: 7685201 - DNA, 22 bp, Homo sapiens
tttaaatttgtgtttagagggt

SEQ ID NO: 7685202 - DNA, 22 bp, Homo sapiens
tttaaatttagaagaaacactg

SEQ ID NO: 7685203 - DNA, 22 bp, Homo sapiens
tttaaatttgtgtttagagggt

SEQ ID NO: 7685204 - DNA, 22 bp, Homo sapiens
tttaacacccaggtagttctga

SEQ ID NO: 7685205 - DNA, 22 bp, Homo sapiens
tttaacagatgctatgtctacc

SEQ ID NO: 7685206 - DNA, 22 bp, Homo sapiens
tttaacagatgaggaggtgagg

SEQ ID NO: 7685207 - DNA, 22 bp, Homo sapiens
tttaacagatgaggaggtgagg

SEQ ID NO: 7685208 - DNA, 22 bp, Homo sapiens
tttaacagatagtttcttctgt

SEQ ID NO: 7685209 - DNA, 22 bp, Homo sapiens
tttaacactcagtttaatagcc

SEQ ID NO: 7685210 - DNA, 22 bp, Homo sapiens
tttaacactcagtttaatagcc

SEQ ID NO: 7685211 - DNA, 22 bp, Homo sapiens
tttaacagatagtttcttctgt

SEQ ID NO: 7685212 - DNA, 22 bp, Homo sapiens
tttaaattctgtctgccgctta

SEQ ID NO: 7685213 - DNA, 22 bp, Homo sapiens
tttaaattctgtctgccgctta

SEQ ID NO: 7685214 - DNA, 22 bp, Homo sapiens
tttaaattctgtctgccgctta

SEQ ID NO: 7685215 - DNA, 22 bp, Homo sapiens
tttaaattctgtctgccgctta

SEQ ID NO: 7685216 - DNA, 22 bp, Homo sapiens
tttaaattatagttaatgtctg

SEQ ID NO: 7685217 - DNA, 22 bp, Homo sapiens
tttaaattatagttaatgtctg

SEQ ID NO: 7685218 - DNA, 22 bp, Homo sapiens
tttaaattctgtctgccgctta

SEQ ID NO: 7685219 - DNA, 22 bp, Homo sapiens
tttaaatttagaagaaacactg

SEQ ID NO: 7685220 - DNA, 22 bp, Homo sapiens
tttaaatttagaagaaacactg

SEQ ID NO: 7685221 - DNA, 22 bp, Homo sapiens
tttaaatttagaagaaacactg

SEQ ID NO: 7685222 - DNA, 22 bp, Homo sapiens
tttaaatttagaagaaacactg

SEQ ID NO: 7685223 - DNA, 22 bp, Homo sapiens
tttaaatttagaagaaacactg

SEQ ID NO: 7685224 - DNA, 22 bp, Homo sapiens
tttaaatttagaagaaacactg

SEQ ID NO: 7685225 - DNA, 22 bp, Homo sapiens
tttaaatttagaagaaacactg

SEQ ID NO: 7685226 - DNA, 22 bp, Homo sapiens
tttaaaaggcagcttcttttgt

SEQ ID NO: 7685227 - DNA, 22 bp, Homo sapiens
tttaaaaggggtattaagtcca

SEQ ID NO: 7685228 - DNA, 22 bp, Homo sapiens
tttaaaaggcagcttcttttgt

SEQ ID NO: 7685229 - DNA, 22 bp, Homo sapiens
tttaaaaggggtattaagtcca

SEQ ID NO: 7685230 - DNA, 22 bp, Homo sapiens
tttaaaaggggtattaagtcca

SEQ ID NO: 7685231 - DNA, 22 bp, Homo sapiens
tttaaaaggcagcttcttttgt

SEQ ID NO: 7685232 - DNA, 22 bp, Homo sapiens
tttaaaaggcagcttcttttgt

SEQ ID NO: 7685233 - DNA, 22 bp, Homo sapiens
tttaaaaggcagcttcttttgt

SEQ ID NO: 7685234 - DNA, 22 bp, Homo sapiens
tttaaaaggcagcttcttttgt

SEQ ID NO: 7685235 - DNA, 22 bp, Homo sapiens
tttaaaaggcagcttcttttgt

SEQ ID NO: 7685236 - DNA, 22 bp, Homo sapiens
tttaaaaggcagcttcttttgt

SEQ ID NO: 7685237 - DNA, 22 bp, Homo sapiens
tttaaaaggggtattaagtcca

SEQ ID NO: 7685238 - DNA, 22 bp, Homo sapiens
tttaaaaggggtattaagtcca

SEQ ID NO: 7685239 - DNA, 22 bp, Homo sapiens
tttaaaagttatcatctgtcca

SEQ ID NO: 7685240 - DNA, 22 bp, Homo sapiens
tttaaaagttatcatctgtcca

SEQ ID NO: 7685241 - DNA, 22 bp, Homo sapiens
tttaaaagttatcatctgtcca

SEQ ID NO: 7685242 - DNA, 22 bp, Homo sapiens
tttaaaaggggtattaagtcca

SEQ ID NO: 7685243 - DNA, 22 bp, Homo sapiens
tttaaaaggggtattaagtcca

SEQ ID NO: 7685244 - DNA, 22 bp, Homo sapiens
tttaaaaggggtattaagtcca

SEQ ID NO: 7685245 - DNA, 22 bp, Homo sapiens
tttaaaaaactagtctgagtct

SEQ ID NO: 7685246 - DNA, 22 bp, Homo sapiens
tttaaaaaactagtctgagtct

SEQ ID NO: 7685247 - DNA, 22 bp, Homo sapiens
tttaaaaaactagtctgagtct

SEQ ID NO: 7685248 - DNA, 22 bp, Homo sapiens
tttaaaaaactagtctgagtct

SEQ ID NO: 7685249 - DNA, 22 bp, Homo sapiens
tttaaaaaactagtctgagtct

SEQ ID NO: 7685250 - DNA, 22 bp, Homo sapiens
tttaaaaaactagtctgagtct

SEQ ID NO: 7685251 - DNA, 22 bp, Homo sapiens
tttaaaaaactagtctgagtct

SEQ ID NO: 7685252 - DNA, 22 bp, Homo sapiens
tttaaaaccaaagaaagcctct

SEQ ID NO: 7685253 - DNA, 22 bp, Homo sapiens
tttaaaaccaaagaaagcctct

SEQ ID NO: 7685254 - DNA, 22 bp, Homo sapiens
tttaaaaccaaagaaagcctct

SEQ ID NO: 7685255 - DNA, 22 bp, Homo sapiens
tttaaaaaactagtctgagtct

SEQ ID NO: 7685256 - DNA, 22 bp, Homo sapiens
tttaaaaaactagtctgagtct

SEQ ID NO: 7685257 - DNA, 22 bp, Homo sapiens
tttaaaaaactagtctgagtct

SEQ ID NO: 7685258 - DNA, 22 bp, Homo sapiens
tttaaaaaactagtctgagtct

SEQ ID NO: 7685259 - DNA, 22 bp, Homo sapiens
tttaaaaaactagtctgagtct

SEQ ID NO: 7685260 - DNA, 22 bp, Homo sapiens
tttaaaaaactagtctgagtct

SEQ ID NO: 7685261 - DNA, 22 bp, Homo sapiens
tttaaaaaactagtctgagtct

SEQ ID NO: 7685262 - DNA, 22 bp, Homo sapiens
tttaaaaaactagtctgagtct

SEQ ID NO: 7685263 - DNA, 22 bp, Homo sapiens
tttaaaaaactagtctgagtct

SEQ ID NO: 7685264 - DNA, 22 bp, Homo sapiens
tttacagttaagaaatgttacc

SEQ ID NO: 7685265 - DNA, 22 bp, Homo sapiens
tttacagtgtcttgttgactgt

SEQ ID NO: 7685266 - DNA, 22 bp, Homo sapiens
tttacagttaagaaatgttacc

SEQ ID NO: 7685267 - DNA, 22 bp, Homo sapiens
tttacagttaagaaatgttacc

SEQ ID NO: 7685268 - DNA, 22 bp, Homo sapiens
tttacagttaagaaatgttacc

SEQ ID NO: 7685269 - DNA, 22 bp, Homo sapiens
tttacagttaagaaatgttacc

SEQ ID NO: 7685270 - DNA, 22 bp, Homo sapiens
tttacagttaagaaatgttacc

SEQ ID NO: 7685271 - DNA, 22 bp, Homo sapiens
tttacacatacctctttaaagt

SEQ ID NO: 7685272 - DNA, 22 bp, Homo sapiens
tttaacagatgctatgtctacc

SEQ ID NO: 7685273 - DNA, 22 bp, Homo sapiens
tttaacagatgctatgtctacc

SEQ ID NO: 7685274 - DNA, 22 bp, Homo sapiens
tttacacatacctctttaaagt

SEQ ID NO: 7685275 - DNA, 22 bp, Homo sapiens
tttaacagatgctatgtctacc

SEQ ID NO: 7685276 - DNA, 22 bp, Homo sapiens
tttaacagatgctatgtctacc

SEQ ID NO: 7685277 - DNA, 22 bp, Homo sapiens
tttaacagatgctatgtctacc

SEQ ID NO: 7685278 - DNA, 22 bp, Homo sapiens
tttacatgagtagcagatgttc

SEQ ID NO: 7685279 - DNA, 22 bp, Homo sapiens
tttacatgagtagcagatgttc

SEQ ID NO: 7685280 - DNA, 22 bp, Homo sapiens
tttacatgagtagcagatgttc

SEQ ID NO: 7685281 - DNA, 22 bp, Homo sapiens
tttacatctcaccagattcata

SEQ ID NO: 7685282 - DNA, 22 bp, Homo sapiens
tttacatgagtagcagatgttc

SEQ ID NO: 7685283 - DNA, 20 bp, Homo sapiens
tttacatccccaccagcaat

SEQ ID NO: 7685284 - DNA, 22 bp, Homo sapiens
tttacatctcaccagattcata

SEQ ID NO: 7685285 - DNA, 22 bp, Homo sapiens
tttacatagtgctttcccacta

SEQ ID NO: 7685286 - DNA, 22 bp, Homo sapiens
tttacagttaagaaatgttacc

SEQ ID NO: 7685287 - DNA, 22 bp, Homo sapiens
tttacagttaagaaatgttacc

SEQ ID NO: 7685288 - DNA, 22 bp, Homo sapiens
tttacatagtgctttcccacta

SEQ ID NO: 7685289 - DNA, 22 bp, Homo sapiens
tttacagttaagaaatgttacc

SEQ ID NO: 7685290 - DNA, 22 bp, Homo sapiens
tttacagttccatgtgataggc

SEQ ID NO: 7685291 - DNA, 22 bp, Homo sapiens
tttacagttccatgtgataggc

SEQ ID NO: 7685292 - DNA, 22 bp, Homo sapiens
tttacatttccctctgtcagtt

SEQ ID NO: 7685293 - DNA, 22 bp, Homo sapiens
tttacatttccctctgtcagtt

SEQ ID NO: 7685294 - DNA, 17 bp, Homo sapiens
tttacattgctcgcagt

SEQ ID NO: 7685295 - DNA, 17 bp, Homo sapiens
tttacattgctcgcagt

SEQ ID NO: 7685296 - DNA, 22 bp, Homo sapiens
tttacattgcattaggtattat

SEQ ID NO: 7685297 - DNA, 22 bp, Homo sapiens
tttacattgcattaggtattat

SEQ ID NO: 7685298 - DNA, 17 bp, Homo sapiens
tttagaatacaatgttt

SEQ ID NO: 7685299 - DNA, 17 bp, Homo sapiens
tttagaatacaatgttt

SEQ ID NO: 7685300 - DNA, 17 bp, Homo sapiens
tttagaatacaatgttt

SEQ ID NO: 7685301 - DNA, 17 bp, Homo sapiens
tttagaatacaatgttt

SEQ ID NO: 7685302 - DNA, 17 bp, Homo sapiens
tttagaatacaatgttt

SEQ ID NO: 7685303 - DNA, 17 bp, Homo sapiens
tttagaatacaatgttt

SEQ ID NO: 7685304 - DNA, 22 bp, Homo sapiens
tttacatttccctctgtcagtt

SEQ ID NO: 7685305 - DNA, 22 bp, Homo sapiens
tttacatggaatattgtcttgt

SEQ ID NO: 7685306 - DNA, 22 bp, Homo sapiens
tttacatggaatattgtcttgt

SEQ ID NO: 7685307 - DNA, 22 bp, Homo sapiens
tttacatggaatattgtcttgt

SEQ ID NO: 7685308 - DNA, 22 bp, Homo sapiens
tttacatgtaatgttatacaaa

SEQ ID NO: 7685309 - DNA, 22 bp, Homo sapiens
tttacatgtaatgttatacaaa

SEQ ID NO: 7685310 - DNA, 22 bp, Homo sapiens
tttacatgtaatgttatacaaa

SEQ ID NO: 7685311 - DNA, 22 bp, Homo sapiens
tttacatgtaatgttatacaaa

SEQ ID NO: 7685312 - DNA, 22 bp, Homo sapiens
tttacatgtaatgttatacaaa

SEQ ID NO: 7685313 - DNA, 22 bp, Homo sapiens
tttacatgtaatgttatacaaa

SEQ ID NO: 7685314 - DNA, 22 bp, Homo sapiens
tttacatgtaatgttatacaaa

SEQ ID NO: 7685315 - DNA, 22 bp, Homo sapiens
tttacatgtaatgttatacaaa

SEQ ID NO: 7685316 - DNA, 22 bp, Homo sapiens
tttacatgtaatgttatacaaa

SEQ ID NO: 7685317 - DNA, 22 bp, Homo sapiens
tttacatgtaatgttatacaaa

SEQ ID NO: 7685318 - DNA, 22 bp, Homo sapiens
tttcagttactgctatatcatt

SEQ ID NO: 7685319 - DNA, 22 bp, Homo sapiens
tttcagttaagtggctagtccc

SEQ ID NO: 7685320 - DNA, 22 bp, Homo sapiens
tttcagttactgctatatcatt

SEQ ID NO: 7685321 - DNA, 22 bp, Homo sapiens
tttcagttactgctatatcatt

SEQ ID NO: 7685322 - DNA, 22 bp, Homo sapiens
tttcagttactgctatatcatt

SEQ ID NO: 7685323 - DNA, 22 bp, Homo sapiens
tttcagttactgctatatcatt

SEQ ID NO: 7685324 - DNA, 22 bp, Homo sapiens
tttcagttactgctatatcatt

SEQ ID NO: 7685325 - DNA, 22 bp, Homo sapiens
tttcagtgttatgactttcatt

SEQ ID NO: 7685326 - DNA, 22 bp, Homo sapiens
tttcagtgttatgactttcatt

SEQ ID NO: 7685327 - DNA, 22 bp, Homo sapiens
tttcagttaagtggctagtccc

SEQ ID NO: 7685328 - DNA, 22 bp, Homo sapiens
tttcagttaagtggctagtccc

SEQ ID NO: 7685329 - DNA, 22 bp, Homo sapiens
tttcagttcagtttattatatc

SEQ ID NO: 7685330 - DNA, 22 bp, Homo sapiens
tttcagttcagtttattatatc

SEQ ID NO: 7685331 - DNA, 22 bp, Homo sapiens
tttcagttcacctgggaacccg

SEQ ID NO: 7685332 - DNA, 22 bp, Homo sapiens
tttcagttcagtttattatatc

SEQ ID NO: 7685333 - DNA, 22 bp, Homo sapiens
tttcagttcagtttattatatc

SEQ ID NO: 7685334 - DNA, 22 bp, Homo sapiens
tttcagttcagtttattatatc

SEQ ID NO: 7685335 - DNA, 20 bp, Homo sapiens
tttcagttatcttgaccttc

SEQ ID NO: 7685336 - DNA, 20 bp, Homo sapiens
tttcagttatcttgaccttc

SEQ ID NO: 7685337 - DNA, 22 bp, Homo sapiens
tttcagttcacctgggaacccg

SEQ ID NO: 7685338 - DNA, 22 bp, Homo sapiens
tttcagttcacctgggaacccg

SEQ ID NO: 7685339 - DNA, 20 bp, Homo sapiens
tttcagttatcttgaccttc

SEQ ID NO: 7685340 - DNA, 22 bp, Homo sapiens
tttcagttagctgagacccagg

SEQ ID NO: 7685341 - DNA, 22 bp, Homo sapiens
tttcagttactgctatatcatt

SEQ ID NO: 7685342 - DNA, 22 bp, Homo sapiens
ctctccaggagagcactttgag

SEQ ID NO: 7685343 - DNA, 22 bp, Homo sapiens
tttcagtgtgtaaattgaaata

SEQ ID NO: 7685344 - DNA, 22 bp, Homo sapiens
tttcagtgtgtaaattgaaata

SEQ ID NO: 7685345 - DNA, 22 bp, Homo sapiens
tttcagtgtgctcctgagggct

SEQ ID NO: 7685346 - DNA, 22 bp, Homo sapiens
tttcagtgtgctcctgagggct

SEQ ID NO: 7685347 - DNA, 22 bp, Homo sapiens
ctctccaggagagcactttgag

SEQ ID NO: 7685348 - DNA, 22 bp, Homo sapiens
ctctccaggagagcactttgag

SEQ ID NO: 7685349 - DNA, 22 bp, Homo sapiens
ctctccaggactttggcccaat

SEQ ID NO: 7685350 - DNA, 22 bp, Homo sapiens
ctctccaggactttggcccaat

SEQ ID NO: 7685351 - DNA, 22 bp, Homo sapiens
ctctccaggactttggcccaat

SEQ ID NO: 7685352 - DNA, 22 bp, Homo sapiens
ctctccaggactttggcccaat

SEQ ID NO: 7685353 - DNA, 22 bp, Homo sapiens
ctctccaggactttggcccaat

SEQ ID NO: 7685354 - DNA, 19 bp, Homo sapiens
ctctccagctccagtagct

SEQ ID NO: 7685355 - DNA, 22 bp, Homo sapiens
tttcagttgtcctgttaatagc

SEQ ID NO: 7685356 - DNA, 22 bp, Homo sapiens
tttcagttgtcctgttaatagc

SEQ ID NO: 7685357 - DNA, 20 bp, Homo sapiens
tttcagttggttaatggcat

SEQ ID NO: 7685358 - DNA, 22 bp, Homo sapiens
tttcagttgtcctgttaatagc

SEQ ID NO: 7685359 - DNA, 22 bp, Homo sapiens
tttcagttgtcctgttaatagc

SEQ ID NO: 7685360 - DNA, 22 bp, Homo sapiens
tttcagttgttttagctctgtg

SEQ ID NO: 7685361 - DNA, 22 bp, Homo sapiens
tttcagttgtgccggcccctct

SEQ ID NO: 7685362 - DNA, 22 bp, Homo sapiens
tttcagtttaagtaactgctat

SEQ ID NO: 7685363 - DNA, 22 bp, Homo sapiens
tttcagttgttttagctctgtg

SEQ ID NO: 7685364 - DNA, 22 bp, Homo sapiens
tttcagttgttttagctctgtg

SEQ ID NO: 7685365 - DNA, 22 bp, Homo sapiens
tttcagttgtgccggcccctct

SEQ ID NO: 7685366 - DNA, 22 bp, Homo sapiens
tttcagttgttttagctctgtg

SEQ ID NO: 7685367 - DNA, 22 bp, Homo sapiens
ctctccagttatagctgatttg

SEQ ID NO: 7685368 - DNA, 22 bp, Homo sapiens
ctctcccccacagcagccttct

SEQ ID NO: 7685369 - DNA, 22 bp, Homo sapiens
ctctcccccacagcagccttct

SEQ ID NO: 7685370 - DNA, 22 bp, Homo sapiens
ctctccagttacctaggtctga

SEQ ID NO: 7685371 - DNA, 21 bp, Homo sapiens
ctctccagtggttcctgattc

SEQ ID NO: 7685372 - DNA, 22 bp, Homo sapiens
ctctccagttacctaggtctga

SEQ ID NO: 7685373 - DNA, 22 bp, Homo sapiens
ctctccagttacctaggtctga

SEQ ID NO: 7685374 - DNA, 22 bp, Homo sapiens
ctctccagttacctaggtctga

SEQ ID NO: 7685375 - DNA, 22 bp, Homo sapiens
ctctccagttacctaggtctga

SEQ ID NO: 7685376 - DNA, 22 bp, Homo sapiens
tttcagtttagactaaaggtag

SEQ ID NO: 7685377 - DNA, 22 bp, Homo sapiens
tttcagtttaagtaactgctat

SEQ ID NO: 7685378 - DNA, 22 bp, Homo sapiens
tttcagtttaagtaactgctat

SEQ ID NO: 7685379 - DNA, 21 bp, Homo sapiens
ctctccagtggttcctgattc

SEQ ID NO: 7685380 - DNA, 22 bp, Homo sapiens
tttcagttcatgtattccgagt

SEQ ID NO: 7685381 - DNA, 22 bp, Homo sapiens
tttcagttcatgtattccgagt

SEQ ID NO: 7685382 - DNA, 22 bp, Homo sapiens
tttcagttcatctgtgaagatt

SEQ ID NO: 7685383 - DNA, 22 bp, Homo sapiens
tttcagttcatctgtgaagatt

SEQ ID NO: 7685384 - DNA, 22 bp, Homo sapiens
tttcagttcatgtattccgagt

SEQ ID NO: 7685385 - DNA, 22 bp, Homo sapiens
tttcagttctgtacaagtccag

SEQ ID NO: 7685386 - DNA, 23 bp, Homo sapiens
tttcagttccagaaaaggggagc

SEQ ID NO: 7685387 - DNA, 23 bp, Homo sapiens
tttcagttgagaatgcacggacc

SEQ ID NO: 7685388 - DNA, 23 bp, Homo sapiens
tttcagttgagaatgcacggacc

SEQ ID NO: 7685389 - DNA, 23 bp, Homo sapiens
tttcagttccagaaaaggggagc

SEQ ID NO: 7685390 - DNA, 23 bp, Homo sapiens
tttcagttccagaaaaggggagc

SEQ ID NO: 7685391 - DNA, 22 bp, Homo sapiens
tttcagttgccaagctaattct

SEQ ID NO: 7685392 - DNA, 22 bp, Homo sapiens
tttcagttgccaagctaattct

SEQ ID NO: 7685393 - DNA, 20 bp, Homo sapiens
tttcagttggttaatggcat

SEQ ID NO: 7685394 - DNA, 22 bp, Homo sapiens
tttcagttgccaagctaattct

SEQ ID NO: 7685395 - DNA, 22 bp, Homo sapiens
tttcagttgccaagctaattct

SEQ ID NO: 7685396 - DNA, 22 bp, Homo sapiens
tttcagttgcagtggttgtcta

SEQ ID NO: 7685397 - DNA, 22 bp, Homo sapiens
tttcagttgcagtggttgtcta

SEQ ID NO: 7685398 - DNA, 22 bp, Homo sapiens
tttcagttgattgcttgggtta

SEQ ID NO: 7685399 - DNA, 22 bp, Homo sapiens
tttcagttgcagtggttgtcta

SEQ ID NO: 7685400 - DNA, 23 bp, Homo sapiens
tttcagttgagaatgcacggacc

SEQ ID NO: 7685401 - DNA, 22 bp, Homo sapiens
tttcagttgattgcttgggtta

SEQ ID NO: 7685402 - DNA, 23 bp, Homo sapiens
ctctccccctttgatgttagctc

SEQ ID NO: 7685403 - DNA, 23 bp, Homo sapiens
ctctccccctttgatgttagctc

SEQ ID NO: 7685404 - DNA, 22 bp, Homo sapiens
ctctcccccacagcagccttct

SEQ ID NO: 7685405 - DNA, 22 bp, Homo sapiens
ctctcccccacagcagccttct

SEQ ID NO: 7685406 - DNA, 22 bp, Homo sapiens
ctctcccccacagcagccttct

SEQ ID NO: 7685407 - DNA, 22 bp, Homo sapiens
ctctcccccacagcagccttct

SEQ ID NO: 7685408 - DNA, 22 bp, Homo sapiens
ctctcccccacagcagccttct

SEQ ID NO: 7685409 - DNA, 22 bp, Homo sapiens
ctctccccggtacgagcggccg

SEQ ID NO: 7685410 - DNA, 22 bp, Homo sapiens
ctctccccggtacgagcggccg

SEQ ID NO: 7685411 - DNA, 22 bp, Homo sapiens
ctctccccggtacgagcggccg

SEQ ID NO: 7685412 - DNA, 22 bp, Homo sapiens
ctctccccggtacgagcggccg

SEQ ID NO: 7685413 - DNA, 22 bp, Homo sapiens
ctctccccggtacgagcggccg

SEQ ID NO: 7685414 - DNA, 23 bp, Homo sapiens
ctctccccctttgatgttagctc

SEQ ID NO: 7685415 - DNA, 22 bp, Homo sapiens
ctctccctaggttagcggtcag

SEQ ID NO: 7685416 - DNA, 22 bp, Homo sapiens
ctctccctaggttagcggtcag

SEQ ID NO: 7685417 - DNA, 22 bp, Homo sapiens
ctctccccggtacgagcggccg

SEQ ID NO: 7685418 - DNA, 22 bp, Homo sapiens
ctctccccggtacgagcggccg

SEQ ID NO: 7685419 - DNA, 22 bp, Homo sapiens
ctctccccggtacgagcggccg

SEQ ID NO: 7685420 - DNA, 22 bp, Homo sapiens
ctctccctaggttagcggtcag

SEQ ID NO: 7685421 - DNA, 22 bp, Homo sapiens
ctctccctatgcctcccaggag

SEQ ID NO: 7685422 - DNA, 22 bp, Homo sapiens
ctctccctaggttagcggtcag

SEQ ID NO: 7685423 - DNA, 22 bp, Homo sapiens
ctctccctaggttagcggtcag

SEQ ID NO: 7685424 - DNA, 22 bp, Homo sapiens
ctctccctaggttagcggtcag

SEQ ID NO: 7685425 - DNA, 22 bp, Homo sapiens
ctctccctaggttagcggtcag

SEQ ID NO: 7685426 - DNA, 22 bp, Homo sapiens
ctctccctaggttagcggtcag

SEQ ID NO: 7685427 - DNA, 22 bp, Homo sapiens
ctctccctaggttagcggtcag

SEQ ID NO: 7685428 - DNA, 22 bp, Homo sapiens
ctctccctatgcctcccaggag

SEQ ID NO: 7685429 - DNA, 22 bp, Homo sapiens
ctctccctatgcctcccaggag

SEQ ID NO: 7685430 - DNA, 22 bp, Homo sapiens
ctctccctatgcctcccaggag

SEQ ID NO: 7685431 - DNA, 22 bp, Homo sapiens
ctctccctatgcctcccaggag

SEQ ID NO: 7685432 - DNA, 22 bp, Homo sapiens
ctctccctatgcctcccaggag

SEQ ID NO: 7685433 - DNA, 22 bp, Homo sapiens
ctctccctatgcctcccaggag

SEQ ID NO: 7685434 - DNA, 22 bp, Homo sapiens
ctctccctatgcctcccaggag

SEQ ID NO: 7685435 - DNA, 22 bp, Homo sapiens
ctctccctcattgggttccatt

SEQ ID NO: 7685436 - DNA, 22 bp, Homo sapiens
ctctccctcattgggttccatt

SEQ ID NO: 7685437 - DNA, 22 bp, Homo sapiens
ctctccctcattgggttccatt

SEQ ID NO: 7685438 - DNA, 22 bp, Homo sapiens
ctctccctggccagctgtgcag

SEQ ID NO: 7685439 - DNA, 22 bp, Homo sapiens
ctctccctggccagctgtgcag

SEQ ID NO: 7685440 - DNA, 22 bp, Homo sapiens
ctctccctatgcctcccaggag

SEQ ID NO: 7685441 - DNA, 22 bp, Homo sapiens
ctctccctatgcctcccaggag

SEQ ID NO: 7685442 - DNA, 23 bp, Homo sapiens
ctctccccctttgatgttagctc

SEQ ID NO: 7685443 - DNA, 22 bp, Homo sapiens
ctctccctatgcctcccaggag

SEQ ID NO: 7685444 - DNA, 22 bp, Homo sapiens
ctctcctcagaacaggccctct

SEQ ID NO: 7685445 - DNA, 20 bp, Homo sapiens
ctctcctcacccgtgtcagg

SEQ ID NO: 7685446 - DNA, 22 bp, Homo sapiens
ctctcctcagaacaggccctct

SEQ ID NO: 7685447 - DNA, 22 bp, Homo sapiens
ctctcctcagaacaggccctct

SEQ ID NO: 7685448 - DNA, 22 bp, Homo sapiens
ctctcctcagaacaggccctct

SEQ ID NO: 7685449 - DNA, 20 bp, Homo sapiens
ctctcctcacccgtgtcagg

SEQ ID NO: 7685450 - DNA, 20 bp, Homo sapiens
ctctcctcacccgtgtcagg

SEQ ID NO: 7685451 - DNA, 20 bp, Homo sapiens
ctctcctcacccgtgtcagg

SEQ ID NO: 7685452 - DNA, 20 bp, Homo sapiens
ctctcctcacccgtgtcagg

SEQ ID NO: 7685453 - DNA, 22 bp, Homo sapiens
ctctcccttgggtgggctttgg

SEQ ID NO: 7685454 - DNA, 22 bp, Homo sapiens
ctctcccttgggtgggctttgg

SEQ ID NO: 7685455 - DNA, 22 bp, Homo sapiens
ctctcctattgtgtggtaagga

SEQ ID NO: 7685456 - DNA, 22 bp, Homo sapiens
ctctccctggccagctgtgcag

SEQ ID NO: 7685457 - DNA, 22 bp, Homo sapiens
ctctccctcattgggttccatt

SEQ ID NO: 7685458 - DNA, 22 bp, Homo sapiens
ctctccctggccagctgtgcag

SEQ ID NO: 7685459 - DNA, 22 bp, Homo sapiens
ctctccctggccagctgtgcag

SEQ ID NO: 7685460 - DNA, 22 bp, Homo sapiens
ctctccctggccagctgtgcag

SEQ ID NO: 7685461 - DNA, 22 bp, Homo sapiens
ctctccctggccagctgtgcag

SEQ ID NO: 7685462 - DNA, 22 bp, Homo sapiens
ctctccctggccagctgtgcag

SEQ ID NO: 7685463 - DNA, 22 bp, Homo sapiens
ctctccctggccagctgtgcag

SEQ ID NO: 7685464 - DNA, 22 bp, Homo sapiens
ctctcccttgggtgggctttgg

SEQ ID NO: 7685465 - DNA, 22 bp, Homo sapiens
ctctcctccaacagccctgccg

SEQ ID NO: 7685466 - DNA, 22 bp, Homo sapiens
ctctcctcagaacaggccctct

SEQ ID NO: 7685467 - DNA, 22 bp, Homo sapiens
ctctcctcagaacaggccctct

SEQ ID NO: 7685468 - DNA, 22 bp, Homo sapiens
ctctcctccaacagccctgccg

SEQ ID NO: 7685469 - DNA, 22 bp, Homo sapiens
ctctcctccaacagccctgccg

SEQ ID NO: 7685470 - DNA, 22 bp, Homo sapiens
ctctcctccaacagccctgccg

SEQ ID NO: 7685471 - DNA, 22 bp, Homo sapiens
ctctcctccaacagccctgccg

SEQ ID NO: 7685472 - DNA, 22 bp, Homo sapiens
ctctcctcccatgtaggagatg

SEQ ID NO: 7685473 - DNA, 22 bp, Homo sapiens
ctctcctcccatgtaggagatg

SEQ ID NO: 7685474 - DNA, 22 bp, Homo sapiens
ctctcctccaggaactcacagt

SEQ ID NO: 7685475 - DNA, 22 bp, Homo sapiens
ctctcctccaggaactcacagt

SEQ ID NO: 7685476 - DNA, 22 bp, Homo sapiens
ctctcctccaggaactcacagt

SEQ ID NO: 7685477 - DNA, 22 bp, Homo sapiens
ctctcctccaggaactcacagt

SEQ ID NO: 7685478 - DNA, 22 bp, Homo sapiens
ctctcctccaggaactcacagt

SEQ ID NO: 7685479 - DNA, 22 bp, Homo sapiens
ctctcctccaggaactcacagt

SEQ ID NO: 7685480 - DNA, 22 bp, Homo sapiens
ctctcctccaggaactcacagt

SEQ ID NO: 7685481 - DNA, 22 bp, Homo sapiens
ctctcctccaggaactcacagt

SEQ ID NO: 7685482 - DNA, 22 bp, Homo sapiens
ctcctgggctatgtctgcttgg

SEQ ID NO: 7685483 - DNA, 22 bp, Homo sapiens
ctcctgggctcaagtgatcctc

SEQ ID NO: 7685484 - DNA, 22 bp, Homo sapiens
ctcctgggctatgtctgcttgg

SEQ ID NO: 7685485 - DNA, 22 bp, Homo sapiens
ctcctgggctatgtctgcttgg

SEQ ID NO: 7685486 - DNA, 22 bp, Homo sapiens
ctcctgggctatgtctgcttgg

SEQ ID NO: 7685487 - DNA, 22 bp, Homo sapiens
ctcctgggatgactctttcttt

SEQ ID NO: 7685488 - DNA, 22 bp, Homo sapiens
ctcctgggatgactctttcttt

SEQ ID NO: 7685489 - DNA, 22 bp, Homo sapiens
ctcctgggatgactctttcttt

SEQ ID NO: 7685490 - DNA, 21 bp, Homo sapiens
ctcctgggctaagatatagtg

SEQ ID NO: 7685491 - DNA, 21 bp, Homo sapiens
ctcctgggctaagatatagtg

SEQ ID NO: 7685492 - DNA, 21 bp, Homo sapiens
ctcctgggctaagatatagtg

SEQ ID NO: 7685493 - DNA, 18 bp, Homo sapiens
ctcctgggctgcagatgc

SEQ ID NO: 7685494 - DNA, 18 bp, Homo sapiens
ctcctgggctgcagatgc

SEQ ID NO: 7685495 - DNA, 18 bp, Homo sapiens
ctcctgggctgcagatgc

SEQ ID NO: 7685496 - DNA, 18 bp, Homo sapiens
ctcctgggctgcagatgc

SEQ ID NO: 7685497 - DNA, 18 bp, Homo sapiens
ctcctgggctgcagatgc

SEQ ID NO: 7685498 - DNA, 18 bp, Homo sapiens
ctcctgggctgcagatgc

SEQ ID NO: 7685499 - DNA, 18 bp, Homo sapiens
ctcctgggctgcagatgc

SEQ ID NO: 7685500 - DNA, 22 bp, Homo sapiens
ctcctgggctcatatcattcag

SEQ ID NO: 7685501 - DNA, 22 bp, Homo sapiens
ctcctgggctcatatcattcag

SEQ ID NO: 7685502 - DNA, 18 bp, Homo sapiens
ctcctgggctgcagatgc

SEQ ID NO: 7685503 - DNA, 22 bp, Homo sapiens
ctcctgggctcaagtgatcctc

SEQ ID NO: 7685504 - DNA, 22 bp, Homo sapiens
ctcctgggctcaagtgatcctc

SEQ ID NO: 7685505 - DNA, 22 bp, Homo sapiens
ctcctgggctcaagtgatcctc

SEQ ID NO: 7685506 - DNA, 22 bp, Homo sapiens
ctcctgggctcaagtgatcctc

SEQ ID NO: 7685507 - DNA, 22 bp, Homo sapiens
ctcctgggctcatatcattcag

SEQ ID NO: 7685508 - DNA, 22 bp, Homo sapiens
ctcctgggagctgtggcagagc

SEQ ID NO: 7685509 - DNA, 22 bp, Homo sapiens
ctcctgggagctgtggcagagc

SEQ ID NO: 7685510 - DNA, 22 bp, Homo sapiens
ctcctgggagctgtggcagagc

SEQ ID NO: 7685511 - DNA, 22 bp, Homo sapiens
ctcctgggagctgtggcagagc

SEQ ID NO: 7685512 - DNA, 22 bp, Homo sapiens
ctcctgggagctgtggcagagc

SEQ ID NO: 7685513 - DNA, 22 bp, Homo sapiens
ctcctgggagctgtggcagagc

SEQ ID NO: 7685514 - DNA, 22 bp, Homo sapiens
ctcctgggagctgtggcagagc

SEQ ID NO: 7685515 - DNA, 22 bp, Homo sapiens
ctcctgggagctgtggcagagc

SEQ ID NO: 7685516 - DNA, 22 bp, Homo sapiens
ctcctgggagcagggatggatg

SEQ ID NO: 7685517 - DNA, 22 bp, Homo sapiens
ctcctgggagcagggatggatg

SEQ ID NO: 7685518 - DNA, 22 bp, Homo sapiens
ctcctgggagcagggatggatg

SEQ ID NO: 7685519 - DNA, 22 bp, Homo sapiens
ctcctgggagcagggatggatg

SEQ ID NO: 7685520 - DNA, 22 bp, Homo sapiens
ctcctgggagcagggatggatg

SEQ ID NO: 7685521 - DNA, 22 bp, Homo sapiens
ctcctgggagcagggatggatg

SEQ ID NO: 7685522 - DNA, 22 bp, Homo sapiens
ctcctgggaggatgcggacccg

SEQ ID NO: 7685523 - DNA, 22 bp, Homo sapiens
ctcctgggaggatgcggacccg

SEQ ID NO: 7685524 - DNA, 22 bp, Homo sapiens
ctcctgggagctgtggcagagc

SEQ ID NO: 7685525 - DNA, 22 bp, Homo sapiens
ctcctgggagctgtggcagagc

SEQ ID NO: 7685526 - DNA, 22 bp, Homo sapiens
ctcctgggaggatgcggacccg

SEQ ID NO: 7685527 - DNA, 22 bp, Homo sapiens
ctcctgggagtcttcctggatg

SEQ ID NO: 7685528 - DNA, 22 bp, Homo sapiens
ctcctgggagtcttcctggatg

SEQ ID NO: 7685529 - DNA, 22 bp, Homo sapiens
ctcctgggagtcttcctggatg

SEQ ID NO: 7685530 - DNA, 22 bp, Homo sapiens
ctcctgggagtcttcctggatg

SEQ ID NO: 7685531 - DNA, 22 bp, Homo sapiens
ctcctgggagtcttcctggatg

SEQ ID NO: 7685532 - DNA, 22 bp, Homo sapiens
ctcctgggagtcttcctggatg

SEQ ID NO: 7685533 - DNA, 22 bp, Homo sapiens
ctcctgggaggatgcggacccg

SEQ ID NO: 7685534 - DNA, 22 bp, Homo sapiens
ctcctgggaggatgcggacccg

SEQ ID NO: 7685535 - DNA, 19 bp, Homo sapiens
ctctccagctccagtagct

SEQ ID NO: 7685536 - DNA, 19 bp, Homo sapiens
ctctccagctccagtagct

SEQ ID NO: 7685537 - DNA, 19 bp, Homo sapiens
ctctccagctccagtagct

SEQ ID NO: 7685538 - DNA, 19 bp, Homo sapiens
ctctccagctccagtagct

SEQ ID NO: 7685539 - DNA, 19 bp, Homo sapiens
ctctccagctccagtagct

SEQ ID NO: 7685540 - DNA, 22 bp, Homo sapiens
ctctccagcctttagcccacgc

SEQ ID NO: 7685541 - DNA, 22 bp, Homo sapiens
ctctccagccacagaagctgct

SEQ ID NO: 7685542 - DNA, 22 bp, Homo sapiens
ctctccagccaggggcttcctg

SEQ ID NO: 7685543 - DNA, 22 bp, Homo sapiens
ctctccagccacagaagctgct

SEQ ID NO: 7685544 - DNA, 22 bp, Homo sapiens
ctctccagcctttagcccacgc

SEQ ID NO: 7685545 - DNA, 22 bp, Homo sapiens
ctctccagccaggggcttcctg

SEQ ID NO: 7685546 - DNA, 22 bp, Homo sapiens
ctctccagccaggggcttcctg

SEQ ID NO: 7685547 - DNA, 22 bp, Homo sapiens
ctctccagcagatgtagtctgt

SEQ ID NO: 7685548 - DNA, 22 bp, Homo sapiens
ctctccagcagatgtagtctgt

SEQ ID NO: 7685549 - DNA, 22 bp, Homo sapiens
ctctccagcagatgtagtctgt

SEQ ID NO: 7685550 - DNA, 22 bp, Homo sapiens
ctctccagatctgctgagccag

SEQ ID NO: 7685551 - DNA, 22 bp, Homo sapiens
ctctccagccacagaagctgct

SEQ ID NO: 7685552 - DNA, 22 bp, Homo sapiens
ctctccagccacagaagctgct

SEQ ID NO: 7685553 - DNA, 22 bp, Homo sapiens
ctctccagccacagaagctgct

SEQ ID NO: 7685554 - DNA, 22 bp, Homo sapiens
ctctccagcagatgtagtctgt

SEQ ID NO: 7685555 - DNA, 22 bp, Homo sapiens
ctctccagatctgctgagccag

SEQ ID NO: 7685556 - DNA, 22 bp, Homo sapiens
ctctccagagcccttccggccc

SEQ ID NO: 7685557 - DNA, 22 bp, Homo sapiens
ctctccagagcccttccggccc

SEQ ID NO: 7685558 - DNA, 22 bp, Homo sapiens
ctctccagatctgctgagccag

SEQ ID NO: 7685559 - DNA, 22 bp, Homo sapiens
ctctccagatctgctgagccag

SEQ ID NO: 7685560 - DNA, 22 bp, Homo sapiens
ctctccagatctgctgagccag

SEQ ID NO: 7685561 - DNA, 22 bp, Homo sapiens
ctctccagatctgctgagccag

SEQ ID NO: 7685562 - DNA, 22 bp, Homo sapiens
ctcctgggctgggaactcagcc

SEQ ID NO: 7685563 - DNA, 22 bp, Homo sapiens
ctcctgggctgggaactcagcc

SEQ ID NO: 7685564 - DNA, 18 bp, Homo sapiens
ctcctgggctgcagatgc

SEQ ID NO: 7685565 - DNA, 22 bp, Homo sapiens
ctcctgggctgtcggcgctctg

SEQ ID NO: 7685566 - DNA, 22 bp, Homo sapiens
ctcctgggctgtcggcgctctg

SEQ ID NO: 7685567 - DNA, 22 bp, Homo sapiens
ctcctgggctgtcggcgctctg

SEQ ID NO: 7685568 - DNA, 22 bp, Homo sapiens
ctcctgggctgtcggcgctctg

SEQ ID NO: 7685569 - DNA, 22 bp, Homo sapiens
ctcctgggctgtcggcgctctg

SEQ ID NO: 7685570 - DNA, 22 bp, Homo sapiens
ctctccactgtcctttgctggt

SEQ ID NO: 7685571 - DNA, 22 bp, Homo sapiens
ctctccagaatatgccgccgtg

SEQ ID NO: 7685572 - DNA, 22 bp, Homo sapiens
ctctccactgtcctttgctggt

SEQ ID NO: 7685573 - DNA, 22 bp, Homo sapiens
ctctccagaattattactatta

SEQ ID NO: 7685574 - DNA, 22 bp, Homo sapiens
ctctccagaattattactatta

SEQ ID NO: 7685575 - DNA, 19 bp, Homo sapiens
ctctcactcgccacatcct

SEQ ID NO: 7685576 - DNA, 22 bp, Homo sapiens
ctcctgggctgtcggcgctctg

SEQ ID NO: 7685577 - DNA, 20 bp, Homo sapiens
ctctcacagctccctcagcc

SEQ ID NO: 7685578 - DNA, 22 bp, Homo sapiens
ctctcagaagtagcacgtgggc

SEQ ID NO: 7685579 - DNA, 22 bp, Homo sapiens
ctctcagaagcttccagtatgg

SEQ ID NO: 7685580 - DNA, 22 bp, Homo sapiens
ctctcagaagcttccagtatgg

SEQ ID NO: 7685581 - DNA, 22 bp, Homo sapiens
ctctcagaagcttccagtatgg

SEQ ID NO: 7685582 - DNA, 22 bp, Homo sapiens
ctctccactcagcgtcatgtcc

SEQ ID NO: 7685583 - DNA, 22 bp, Homo sapiens
ctctccactcagcgtcatgtcc

SEQ ID NO: 7685584 - DNA, 19 bp, Homo sapiens
ctctcactcgccacatcct

SEQ ID NO: 7685585 - DNA, 22 bp, Homo sapiens
ctctccactcagcgtcatgtcc

SEQ ID NO: 7685586 - DNA, 22 bp, Homo sapiens
ttggcatttattctaaggtcaa

SEQ ID NO: 7685587 - DNA, 22 bp, Homo sapiens
ttggcatttattctaaggtcaa

SEQ ID NO: 7685588 - DNA, 22 bp, Homo sapiens
ttggcatttatctttaatcaaa

SEQ ID NO: 7685589 - DNA, 22 bp, Homo sapiens
ttggcatttatctttaatcaaa

SEQ ID NO: 7685590 - DNA, 22 bp, Homo sapiens
ttggcatttattctaaggtcaa

SEQ ID NO: 7685591 - DNA, 22 bp, Homo sapiens
ttggatgaggttgagaatcatt

SEQ ID NO: 7685592 - DNA, 20 bp, Homo sapiens
ttggatcttatgggaggggg

SEQ ID NO: 7685593 - DNA, 22 bp, Homo sapiens
ttggatgagagggtgtggtaca

SEQ ID NO: 7685594 - DNA, 22 bp, Homo sapiens
ttggcattgaagtttcattggt

SEQ ID NO: 7685595 - DNA, 22 bp, Homo sapiens
ttggaaaagcgttctctgtagc

SEQ ID NO: 7685596 - DNA, 22 bp, Homo sapiens
ttggaaaacttacacagagctg

SEQ ID NO: 7685597 - DNA, 22 bp, Homo sapiens
ttggaaaacttacacagagctg

SEQ ID NO: 7685598 - DNA, 22 bp, Homo sapiens
ttggaaaagcgttctctgtagc

SEQ ID NO: 7685599 - DNA, 22 bp, Homo sapiens
ttggaaaagcgttctctgtagc

SEQ ID NO: 7685600 - DNA, 20 bp, Homo sapiens
ttggatctaaaatgtgggga

SEQ ID NO: 7685601 - DNA, 22 bp, Homo sapiens
ttggatctgtactctaggggat

SEQ ID NO: 7685602 - DNA, 20 bp, Homo sapiens
ttggatctaaaatgtgggga

SEQ ID NO: 7685603 - DNA, 22 bp, Homo sapiens
ttggatcttatgaaggtggcat

SEQ ID NO: 7685604 - DNA, 22 bp, Homo sapiens
ttggatctcatctaagtgcgtg

SEQ ID NO: 7685605 - DNA, 22 bp, Homo sapiens
ttgctttttaattaggaggcag

SEQ ID NO: 7685606 - DNA, 22 bp, Homo sapiens
ttgctttttaattaggaggcag

SEQ ID NO: 7685607 - DNA, 22 bp, Homo sapiens
ttggaaaaacacgatagtggtt

SEQ ID NO: 7685608 - DNA, 22 bp, Homo sapiens
ttggaaaacttacacagagctg

SEQ ID NO: 7685609 - DNA, 22 bp, Homo sapiens
ttggaaaaattgcctgatgtct

SEQ ID NO: 7685610 - DNA, 22 bp, Homo sapiens
ttggaaaacttacacagagctg

SEQ ID NO: 7685611 - DNA, 22 bp, Homo sapiens
ttggaaaacttacacagagctg

SEQ ID NO: 7685612 - DNA, 22 bp, Homo sapiens
ttggaaaacttacacagagctg

SEQ ID NO: 7685613 - DNA, 22 bp, Homo sapiens
ttgcttttgggaaaacatgcct

SEQ ID NO: 7685614 - DNA, 17 bp, Homo sapiens
ttgcttttgaaattgtc

SEQ ID NO: 7685615 - DNA, 17 bp, Homo sapiens
ttgcttttgaaattgtc

SEQ ID NO: 7685616 - DNA, 22 bp, Homo sapiens
ttgcttttgggaaaacatgcct

SEQ ID NO: 7685617 - DNA, 22 bp, Homo sapiens
ttgcttttgtctcgggtttgga

SEQ ID NO: 7685618 - DNA, 22 bp, Homo sapiens
ttgcttttgggaaaacatgcct

SEQ ID NO: 7685619 - DNA, 22 bp, Homo sapiens
ttgcttttgtgtgctctctgga

SEQ ID NO: 7685620 - DNA, 22 bp, Homo sapiens
ttgcttttgtgtgctctctgga

SEQ ID NO: 7685621 - DNA, 22 bp, Homo sapiens
ttgcttttgtgtgctctctgga

SEQ ID NO: 7685622 - DNA, 22 bp, Homo sapiens
ttgcttttaattaatcattgct

SEQ ID NO: 7685623 - DNA, 22 bp, Homo sapiens
ttgcttttaattaatcattgct

SEQ ID NO: 7685624 - DNA, 22 bp, Homo sapiens
ttgcttttaattaatcattgct

SEQ ID NO: 7685625 - DNA, 22 bp, Homo sapiens
ttgcttttaattaatcattgct

SEQ ID NO: 7685626 - DNA, 22 bp, Homo sapiens
ttgcttttaattaatcattgct

SEQ ID NO: 7685627 - DNA, 22 bp, Homo sapiens
ttgcttttaattaatcattgct

SEQ ID NO: 7685628 - DNA, 22 bp, Homo sapiens
ttgcttttaattaatcattgct

SEQ ID NO: 7685629 - DNA, 22 bp, Homo sapiens
ttgcttttccctgtctctgatt

SEQ ID NO: 7685630 - DNA, 22 bp, Homo sapiens
ttgcttttccctgtctctgatt

SEQ ID NO: 7685631 - DNA, 22 bp, Homo sapiens
ttgcttttccctgtctctgatt

SEQ ID NO: 7685632 - DNA, 22 bp, Homo sapiens
ttgctttgtggtggttcttcca

SEQ ID NO: 7685633 - DNA, 18 bp, Homo sapiens
ttgctttgtaagcttgca

SEQ ID NO: 7685634 - DNA, 22 bp, Homo sapiens
ttgctttgcagtgcctatagga

SEQ ID NO: 7685635 - DNA, 18 bp, Homo sapiens
ttgctttgtaagcttgca

SEQ ID NO: 7685636 - DNA, 22 bp, Homo sapiens
ttgcttttaatctttgtacatc

SEQ ID NO: 7685637 - DNA, 22 bp, Homo sapiens
ttgcttttaatctttgtacatc

SEQ ID NO: 7685638 - DNA, 22 bp, Homo sapiens
ttgcttttaatctttgtacatc

SEQ ID NO: 7685639 - DNA, 22 bp, Homo sapiens
ttgcttttaatctttgtacatc

SEQ ID NO: 7685640 - DNA, 22 bp, Homo sapiens
ttgctttgtttaaaagtggtat

SEQ ID NO: 7685641 - DNA, 22 bp, Homo sapiens
ttgcttttaatctttgtacatc

SEQ ID NO: 7685642 - DNA, 22 bp, Homo sapiens
ttgcttttaatctttgtacatc

SEQ ID NO: 7685643 - DNA, 22 bp, Homo sapiens
ttgcttttaatctttgtacatc

SEQ ID NO: 7685644 - DNA, 22 bp, Homo sapiens
ttgcttttaatctttgtacatc

SEQ ID NO: 7685645 - DNA, 22 bp, Homo sapiens
ttgcttttaatctttgtacatc

SEQ ID NO: 7685646 - DNA, 22 bp, Homo sapiens
ttgatattagagtatttgtttg

SEQ ID NO: 7685647 - DNA, 22 bp, Homo sapiens
ttgatatctctgctgtgttagg

SEQ ID NO: 7685648 - DNA, 22 bp, Homo sapiens
ttgatattagagtatttgtttg

SEQ ID NO: 7685649 - DNA, 22 bp, Homo sapiens
ttgatacccaagtgttatgggt

SEQ ID NO: 7685650 - DNA, 22 bp, Homo sapiens
ttgatacatttttaggataaac

SEQ ID NO: 7685651 - DNA, 22 bp, Homo sapiens
ttgatacatgctctagagttga

SEQ ID NO: 7685652 - DNA, 22 bp, Homo sapiens
ttgatacatagcacagtttagg

SEQ ID NO: 7685653 - DNA, 22 bp, Homo sapiens
ttgatacatgctctagagttga

SEQ ID NO: 7685654 - DNA, 22 bp, Homo sapiens
ttgatacaggctctatttcatc

SEQ ID NO: 7685655 - DNA, 22 bp, Homo sapiens
ttgatacaggctctatttcatc

SEQ ID NO: 7685656 - DNA, 22 bp, Homo sapiens
ttgatacatagcacagtttagg

SEQ ID NO: 7685657 - DNA, 22 bp, Homo sapiens
ttgatacatagcacagtttagg

SEQ ID NO: 7685658 - DNA, 20 bp, Homo sapiens
ctcagtgctttcattgcctc

SEQ ID NO: 7685659 - DNA, 20 bp, Homo sapiens
ctcagtgctttcattgcctc

SEQ ID NO: 7685660 - DNA, 22 bp, Homo sapiens
ctcagtgctttggatcctggat

SEQ ID NO: 7685661 - DNA, 22 bp, Homo sapiens
ttgatattctgagaagctgaag

SEQ ID NO: 7685662 - DNA, 22 bp, Homo sapiens
ttgatattctgagaagctgaag

SEQ ID NO: 7685663 - DNA, 22 bp, Homo sapiens
ctcagtttccccggcctgggcg

SEQ ID NO: 7685664 - DNA, 22 bp, Homo sapiens
ctcagtgctttggatcctggat

SEQ ID NO: 7685665 - DNA, 20 bp, Homo sapiens
ctcagtgctttcattgcctc

SEQ ID NO: 7685666 - DNA, 22 bp, Homo sapiens
ctcagtttccccggcctgggcg

SEQ ID NO: 7685667 - DNA, 22 bp, Homo sapiens
ctcagtttccccggcctgggcg

SEQ ID NO: 7685668 - DNA, 22 bp, Homo sapiens
ctcagtttcctcaactgcaaaa

SEQ ID NO: 7685669 - DNA, 22 bp, Homo sapiens
ctcagtttcctcaactgcaaaa

SEQ ID NO: 7685670 - DNA, 22 bp, Homo sapiens
ctcagtttcctcaactgcaaaa

SEQ ID NO: 7685671 - DNA, 22 bp, Homo sapiens
ctcagtttcctcaactgcaaaa

SEQ ID NO: 7685672 - DNA, 20 bp, Homo sapiens
ctcagtttcctcatggctca

SEQ ID NO: 7685673 - DNA, 20 bp, Homo sapiens
ctcagtttcctcatggctca

SEQ ID NO: 7685674 - DNA, 22 bp, Homo sapiens
ctcagtttcctcttctgttgaa

SEQ ID NO: 7685675 - DNA, 22 bp, Homo sapiens
ctcagtttcctcttctgttgaa

SEQ ID NO: 7685676 - DNA, 22 bp, Homo sapiens
ctcagtttcctcaactgcaaaa

SEQ ID NO: 7685677 - DNA, 22 bp, Homo sapiens
ctcagtttcctcttctgttgaa

SEQ ID NO: 7685678 - DNA, 22 bp, Homo sapiens
ctcagttttgaaaaggtaagct

SEQ ID NO: 7685679 - DNA, 22 bp, Homo sapiens
ctcagttttcccttgggagcgt

SEQ ID NO: 7685680 - DNA, 22 bp, Homo sapiens
ctcagttttgaaaaggtaagct

SEQ ID NO: 7685681 - DNA, 22 bp, Homo sapiens
ctcagttttcccttgggagcgt

SEQ ID NO: 7685682 - DNA, 22 bp, Homo sapiens
ctcagttttcccttgggagcgt

SEQ ID NO: 7685683 - DNA, 22 bp, Homo sapiens
ctcagttttaagactactcttt

SEQ ID NO: 7685684 - DNA, 22 bp, Homo sapiens
ctcagttttaagactactcttt

SEQ ID NO: 7685685 - DNA, 22 bp, Homo sapiens
ctcagttttgaaaaggtaagct

SEQ ID NO: 7685686 - DNA, 22 bp, Homo sapiens
ctcagttttgctagctggagtt

SEQ ID NO: 7685687 - DNA, 22 bp, Homo sapiens
ctcagtttttttaagagccatg

SEQ ID NO: 7685688 - DNA, 22 bp, Homo sapiens
ctcagtttttgtgggcatcagc

SEQ ID NO: 7685689 - DNA, 22 bp, Homo sapiens
ctcagtttttttaagagccatg

SEQ ID NO: 7685690 - DNA, 22 bp, Homo sapiens
ctcagtttttttaagagccatg

SEQ ID NO: 7685691 - DNA, 22 bp, Homo sapiens
ttgctttgccaccagaagtcta

SEQ ID NO: 7685692 - DNA, 22 bp, Homo sapiens
ttgctttgccaccagaagtcta

SEQ ID NO: 7685693 - DNA, 22 bp, Homo sapiens
ttgctttgccaccagaagtcta

SEQ ID NO: 7685694 - DNA, 22 bp, Homo sapiens
ctcagttttaagactactcttt

SEQ ID NO: 7685695 - DNA, 22 bp, Homo sapiens
ctcagtttttgctgtctggttc

SEQ ID NO: 7685696 - DNA, 22 bp, Homo sapiens
ctcagttttgctagctggagtt

SEQ ID NO: 7685697 - DNA, 22 bp, Homo sapiens
ctcagttttgctagctggagtt

SEQ ID NO: 7685698 - DNA, 22 bp, Homo sapiens
ctcagtttttgctgtctggttc

SEQ ID NO: 7685699 - DNA, 22 bp, Homo sapiens
ctcagtttttgctgtctggttc

SEQ ID NO: 7685700 - DNA, 22 bp, Homo sapiens
ctcagtttctggataagctggg

SEQ ID NO: 7685701 - DNA, 22 bp, Homo sapiens
ctcagtttctgacattaaaatc

SEQ ID NO: 7685702 - DNA, 22 bp, Homo sapiens
ctcagtttcttactctgtataa

SEQ ID NO: 7685703 - DNA, 22 bp, Homo sapiens
ctcagtttcttactctgtataa

SEQ ID NO: 7685704 - DNA, 22 bp, Homo sapiens
ctcagtttctggataagctggg

SEQ ID NO: 7685705 - DNA, 22 bp, Homo sapiens
ctcagtttcttactctgtataa

SEQ ID NO: 7685706 - DNA, 22 bp, Homo sapiens
ctcagtttctgacattaaaatc

SEQ ID NO: 7685707 - DNA, 22 bp, Homo sapiens
ctcagtttctgacattaaaatc

SEQ ID NO: 7685708 - DNA, 22 bp, Homo sapiens
ctcagtttctgaagtggacagg

SEQ ID NO: 7685709 - DNA, 22 bp, Homo sapiens
ctcagtttctgaagtggacagg

SEQ ID NO: 7685710 - DNA, 22 bp, Homo sapiens
ctcagtttctgacattaaaatc

SEQ ID NO: 7685711 - DNA, 22 bp, Homo sapiens
ctcagtttctgacattaaaatc

SEQ ID NO: 7685712 - DNA, 22 bp, Homo sapiens
ctcagtttctgacattaaaatc

SEQ ID NO: 7685713 - DNA, 22 bp, Homo sapiens
ctcagtttcttcatattgtagg

SEQ ID NO: 7685714 - DNA, 22 bp, Homo sapiens
ctcagtttcttactctgtataa

SEQ ID NO: 7685715 - DNA, 22 bp, Homo sapiens
ctcagtttgaggggtaggtgtt

SEQ ID NO: 7685716 - DNA, 22 bp, Homo sapiens
ctcagtttgaggggtaggtgtt

SEQ ID NO: 7685717 - DNA, 22 bp, Homo sapiens
ctcagtttcttcatattgtagg

SEQ ID NO: 7685718 - DNA, 22 bp, Homo sapiens
ctcagtttgaggggtaggtgtt

SEQ ID NO: 7685719 - DNA, 22 bp, Homo sapiens
ctcagtttgtgtgatattgtct

SEQ ID NO: 7685720 - DNA, 22 bp, Homo sapiens
ctcagtttgtgtgatattgtct

SEQ ID NO: 7685721 - DNA, 22 bp, Homo sapiens
ctcagtttgtgtgatattgtct

SEQ ID NO: 7685722 - DNA, 22 bp, Homo sapiens
ctcagtttcttcatattgtagg

SEQ ID NO: 7685723 - DNA, 22 bp, Homo sapiens
ctcagtttgaatgctgacactg

SEQ ID NO: 7685724 - DNA, 22 bp, Homo sapiens
ctcagtttgtgtgatattgtct

SEQ ID NO: 7685725 - DNA, 22 bp, Homo sapiens
ttggccagaggtttctctcatg

SEQ ID NO: 7685726 - DNA, 22 bp, Homo sapiens
ttggccagaggtttctctcatg

SEQ ID NO: 7685727 - DNA, 22 bp, Homo sapiens
ttggccagaggtttctctcatg

SEQ ID NO: 7685728 - DNA, 22 bp, Homo sapiens
ttggccagaggtttctctcatg

SEQ ID NO: 7685729 - DNA, 22 bp, Homo sapiens
ttggccagagaccagagcaggg

SEQ ID NO: 7685730 - DNA, 22 bp, Homo sapiens
ttggccagagaccagagcaggg

SEQ ID NO: 7685731 - DNA, 22 bp, Homo sapiens
ttggccagactgaggtgctggg

SEQ ID NO: 7685732 - DNA, 22 bp, Homo sapiens
ttggccagactgaggtgctggg

SEQ ID NO: 7685733 - DNA, 22 bp, Homo sapiens
ttggccagactgaggtgctggg

SEQ ID NO: 7685734 - DNA, 22 bp, Homo sapiens
ttggccagacactacccccctt

SEQ ID NO: 7685735 - DNA, 22 bp, Homo sapiens
ttggccagacactacccccctt

SEQ ID NO: 7685736 - DNA, 22 bp, Homo sapiens
ttggccacactcactagagccc

SEQ ID NO: 7685737 - DNA, 21 bp, Homo sapiens
ttggccacgtctctccttccc

SEQ ID NO: 7685738 - DNA, 21 bp, Homo sapiens
ttggccacgtctctccttccc

SEQ ID NO: 7685739 - DNA, 22 bp, Homo sapiens
ttggccagaatcttcctagtga

SEQ ID NO: 7685740 - DNA, 22 bp, Homo sapiens
ttggccagaatcttcctagtga

SEQ ID NO: 7685741 - DNA, 22 bp, Homo sapiens
ttggccacaatccaagccttgg

SEQ ID NO: 7685742 - DNA, 22 bp, Homo sapiens
ttggccacaatccaagccttgg

SEQ ID NO: 7685743 - DNA, 22 bp, Homo sapiens
ttggccacaatccaagccttgg

SEQ ID NO: 7685744 - DNA, 22 bp, Homo sapiens
ttggccacactcactagagccc

SEQ ID NO: 7685745 - DNA, 22 bp, Homo sapiens
ttggccacactcactagagccc

SEQ ID NO: 7685746 - DNA, 22 bp, Homo sapiens
ttggccacactcactagagccc

SEQ ID NO: 7685747 - DNA, 22 bp, Homo sapiens
ttggccacactcactagagccc

SEQ ID NO: 7685748 - DNA, 22 bp, Homo sapiens
ttggccaacatggtgaaacccc

SEQ ID NO: 7685749 - DNA, 22 bp, Homo sapiens
ttggccaaaggaaagactactg

SEQ ID NO: 7685750 - DNA, 22 bp, Homo sapiens
ttggccaagtcactggttaatg

SEQ ID NO: 7685751 - DNA, 22 bp, Homo sapiens
ttggccaaggaagtagcaacgg

SEQ ID NO: 7685752 - DNA, 22 bp, Homo sapiens
ttggccaagggctctttaggct

SEQ ID NO: 7685753 - DNA, 22 bp, Homo sapiens
ctcatcagaaatacctgacaaa

SEQ ID NO: 7685754 - DNA, 22 bp, Homo sapiens
ctcatcaccacatataacaaag

SEQ ID NO: 7685755 - DNA, 22 bp, Homo sapiens
ctcatattgctggtggtctaag

SEQ ID NO: 7685756 - DNA, 22 bp, Homo sapiens
ctcatcatgtcacccatgtgct

SEQ ID NO: 7685757 - DNA, 22 bp, Homo sapiens
ctcatcataaccctgtgaggat

SEQ ID NO: 7685758 - DNA, 22 bp, Homo sapiens
ctcatccaccctcactaggaaa

SEQ ID NO: 7685759 - DNA, 22 bp, Homo sapiens
ctcatccaccgcagcccctcag

SEQ ID NO: 7685760 - DNA, 22 bp, Homo sapiens
ctcatccaccgcagcccctcag

SEQ ID NO: 7685761 - DNA, 22 bp, Homo sapiens
ctcatagggtgaggataaaaga

SEQ ID NO: 7685762 - DNA, 22 bp, Homo sapiens
ctcatagatttagatagatcga

SEQ ID NO: 7685763 - DNA, 22 bp, Homo sapiens
ctcataggtttggaaccaggta

SEQ ID NO: 7685764 - DNA, 22 bp, Homo sapiens
ctcatagatttagatagatcga

SEQ ID NO: 7685765 - DNA, 22 bp, Homo sapiens
ctcatattcagtcactgatgca

SEQ ID NO: 7685766 - DNA, 22 bp, Homo sapiens
ctcatactcccagccagctgtc

SEQ ID NO: 7685767 - DNA, 22 bp, Homo sapiens
ctcatagacaagcctcttttaa

SEQ ID NO: 7685768 - DNA, 22 bp, Homo sapiens
ctcatagacaagcctcttttaa

SEQ ID NO: 7685769 - DNA, 22 bp, Homo sapiens
ctcataatgtgactgtatttga

SEQ ID NO: 7685770 - DNA, 22 bp, Homo sapiens
ctcataagccctgggtaggcga

SEQ ID NO: 7685771 - DNA, 22 bp, Homo sapiens
ctcataagccttgctcaggtct

SEQ ID NO: 7685772 - DNA, 22 bp, Homo sapiens
ctcataatgtgactgtatttga

SEQ ID NO: 7685773 - DNA, 22 bp, Homo sapiens
ctcataaagtgagaatatgacc

SEQ ID NO: 7685774 - DNA, 22 bp, Homo sapiens
ctcataaagtgagaatatgacc

SEQ ID NO: 7685775 - DNA, 22 bp, Homo sapiens
ctcataaagtgagaatatgacc

SEQ ID NO: 7685776 - DNA, 22 bp, Homo sapiens
ctcataaagtgagaatatgacc

SEQ ID NO: 7685777 - DNA, 22 bp, Homo sapiens
ctcataaacattattcattatt

SEQ ID NO: 7685778 - DNA, 22 bp, Homo sapiens
ctcataaacattattcattatt

SEQ ID NO: 7685779 - DNA, 22 bp, Homo sapiens
ttggccagaggtttctctcatg

SEQ ID NO: 7685780 - DNA, 22 bp, Homo sapiens
ttggccagaggtttctctcatg

SEQ ID NO: 7685781 - DNA, 22 bp, Homo sapiens
ttggccagatctgaggatactg

SEQ ID NO: 7685782 - DNA, 22 bp, Homo sapiens
ttgggcaggctggcagactgct

SEQ ID NO: 7685783 - DNA, 22 bp, Homo sapiens
ttgggcaggctggcagactgct

SEQ ID NO: 7685784 - DNA, 22 bp, Homo sapiens
ttgggcaggctggcagactgct

SEQ ID NO: 7685785 - DNA, 22 bp, Homo sapiens
ttgggcaggctggcagactgct

SEQ ID NO: 7685786 - DNA, 22 bp, Homo sapiens
ttgggcaggcacatagagttta

SEQ ID NO: 7685787 - DNA, 22 bp, Homo sapiens
ttgggcaggcacatagagttta

SEQ ID NO: 7685788 - DNA, 22 bp, Homo sapiens
ttgggcaggatgacaccacttg

SEQ ID NO: 7685789 - DNA, 22 bp, Homo sapiens
ttgggcaggatgacaccacttg

SEQ ID NO: 7685790 - DNA, 22 bp, Homo sapiens
ttgggcaggcacatagagttta

SEQ ID NO: 7685791 - DNA, 23 bp, Homo sapiens
ttgggcaggagagtaatgtgatc

SEQ ID NO: 7685792 - DNA, 22 bp, Homo sapiens
ttgggcaggaacagatgcttga

SEQ ID NO: 7685793 - DNA, 22 bp, Homo sapiens
ttgggcaggaacagatgcttga

SEQ ID NO: 7685794 - DNA, 22 bp, Homo sapiens
ttgggcaggaacagatgcttga

SEQ ID NO: 7685795 - DNA, 22 bp, Homo sapiens
ttgggcaggaacagatgcttga

SEQ ID NO: 7685796 - DNA, 22 bp, Homo sapiens
ttgggcaggaacagatgcttga

SEQ ID NO: 7685797 - DNA, 23 bp, Homo sapiens
ttgggcaggagagtaatgtgatc

SEQ ID NO: 7685798 - DNA, 22 bp, Homo sapiens
ttgggcagcattgcagttccct

SEQ ID NO: 7685799 - DNA, 22 bp, Homo sapiens
ttgggcagcattgcagttccct

SEQ ID NO: 7685800 - DNA, 22 bp, Homo sapiens
ttgggcagcattgcagttccct

SEQ ID NO: 7685801 - DNA, 22 bp, Homo sapiens
ttgggcagatgtttcctgtgga

SEQ ID NO: 7685802 - DNA, 22 bp, Homo sapiens
ttgggcagaggctgtgcagagg

SEQ ID NO: 7685803 - DNA, 22 bp, Homo sapiens
ttgggcagaggctgtgcagagg

SEQ ID NO: 7685804 - DNA, 22 bp, Homo sapiens
ttgggcagaggctgtgcagagg

SEQ ID NO: 7685805 - DNA, 22 bp, Homo sapiens
ttgggcagatgtttcctgtgga

SEQ ID NO: 7685806 - DNA, 22 bp, Homo sapiens
ttgggcagatgtttcctgtgga

SEQ ID NO: 7685807 - DNA, 22 bp, Homo sapiens
ttgggcagatgtttcctgtgga

SEQ ID NO: 7685808 - DNA, 22 bp, Homo sapiens
ttgggcagatgtttcctgtgga

SEQ ID NO: 7685809 - DNA, 22 bp, Homo sapiens
ttgggcagaggctgtgcagagg

SEQ ID NO: 7685810 - DNA, 22 bp, Homo sapiens
ttgggcagaggctgtgcagagg

SEQ ID NO: 7685811 - DNA, 22 bp, Homo sapiens
ttgggcagaggctgtgcagagg

SEQ ID NO: 7685812 - DNA, 22 bp, Homo sapiens
ttgggcagaggctgtgcagagg

SEQ ID NO: 7685813 - DNA, 22 bp, Homo sapiens
ttgggcagaggccaggaggatg

SEQ ID NO: 7685814 - DNA, 22 bp, Homo sapiens
ttgggcagaggccaggaggatg

SEQ ID NO: 7685815 - DNA, 22 bp, Homo sapiens
ttgggcagaggccaggaggatg

SEQ ID NO: 7685816 - DNA, 22 bp, Homo sapiens
ttgggcagaggccaggaggatg

SEQ ID NO: 7685817 - DNA, 22 bp, Homo sapiens
ttgggcagaggccaggaggatg

SEQ ID NO: 7685818 - DNA, 22 bp, Homo sapiens
ttgggcagaggccaggaggatg

SEQ ID NO: 7685819 - DNA, 22 bp, Homo sapiens
ttgggcacactttgctggggag

SEQ ID NO: 7685820 - DNA, 22 bp, Homo sapiens
ttgggcacggacaggtggggat

SEQ ID NO: 7685821 - DNA, 22 bp, Homo sapiens
ttgggcactgtgggttgtctgt

SEQ ID NO: 7685822 - DNA, 21 bp, Homo sapiens
ttgggatctgagaagtgaaaa

SEQ ID NO: 7685823 - DNA, 22 bp, Homo sapiens
ttgggcaaagtgtttctggagc

SEQ ID NO: 7685824 - DNA, 23 bp, Homo sapiens
ttgggcaaatcactaacgtctcc

SEQ ID NO: 7685825 - DNA, 22 bp, Homo sapiens
ttgggagtaataaaaaattcca

SEQ ID NO: 7685826 - DNA, 22 bp, Homo sapiens
ttgggagttcctactgcggttt

SEQ ID NO: 7685827 - DNA, 22 bp, Homo sapiens
ttgggaggtcataaatctgttc

SEQ ID NO: 7685828 - DNA, 22 bp, Homo sapiens
ttgggaggtcataaatctgttc

SEQ ID NO: 7685829 - DNA, 22 bp, Homo sapiens
ttgggaggtcataaatctgttc

SEQ ID NO: 7685830 - DNA, 22 bp, Homo sapiens
ttggctgctgaaatatgttctg

SEQ ID NO: 7685831 - DNA, 22 bp, Homo sapiens
ctcatctgactgtaaggtaatg

SEQ ID NO: 7685832 - DNA, 22 bp, Homo sapiens
ctcatctgataaatcactctta

SEQ ID NO: 7685833 - DNA, 22 bp, Homo sapiens
ctcatctgataaatcactctta

SEQ ID NO: 7685834 - DNA, 22 bp, Homo sapiens
ctcatctggcttcagtaacagt

SEQ ID NO: 7685835 - DNA, 22 bp, Homo sapiens
ctcatctggcttcagtaacagt

SEQ ID NO: 7685836 - DNA, 22 bp, Homo sapiens
ctcatctgctcttattatctta

SEQ ID NO: 7685837 - DNA, 22 bp, Homo sapiens
ctcatctcccacctgcgtgcag

SEQ ID NO: 7685838 - DNA, 22 bp, Homo sapiens
ctcatctcccacctgcgtgcag

SEQ ID NO: 7685839 - DNA, 20 bp, Homo sapiens
ctcatctctgagcctcctgg

SEQ ID NO: 7685840 - DNA, 20 bp, Homo sapiens
ctcatctctgagcctcctgg

SEQ ID NO: 7685841 - DNA, 22 bp, Homo sapiens
ctcatccaccgcagcccctcag

SEQ ID NO: 7685842 - DNA, 22 bp, Homo sapiens
ttgttacacataataacatttt

SEQ ID NO: 7685843 - DNA, 22 bp, Homo sapiens
ttgttacagatcacatttctgc

SEQ ID NO: 7685844 - DNA, 22 bp, Homo sapiens
ttgttacagatcacatttctgc

SEQ ID NO: 7685845 - DNA, 22 bp, Homo sapiens
ttgttacagcacttaacctttt

SEQ ID NO: 7685846 - DNA, 22 bp, Homo sapiens
ttgttacagcacttaacctttt

SEQ ID NO: 7685847 - DNA, 22 bp, Homo sapiens
ttgttacagatcacatttctgc

SEQ ID NO: 7685848 - DNA, 22 bp, Homo sapiens
ttgttacacataataacatttt

SEQ ID NO: 7685849 - DNA, 22 bp, Homo sapiens
ttgttacacataataacatttt

SEQ ID NO: 7685850 - DNA, 22 bp, Homo sapiens
ttgttacacataataacatttt

SEQ ID NO: 7685851 - DNA, 22 bp, Homo sapiens
ttgttacacataataacatttt

SEQ ID NO: 7685852 - DNA, 21 bp, Homo sapiens
ttgttacaatgcaagagtatg

SEQ ID NO: 7685853 - DNA, 22 bp, Homo sapiens
ctccaggtagctaagtcctggg

SEQ ID NO: 7685854 - DNA, 18 bp, Homo sapiens
ctccaggtaattctgata

SEQ ID NO: 7685855 - DNA, 22 bp, Homo sapiens
ctccaggtagctaagtcctggg

SEQ ID NO: 7685856 - DNA, 22 bp, Homo sapiens
ctccaggtagctaagtcctggg

SEQ ID NO: 7685857 - DNA, 22 bp, Homo sapiens
ctccagggttccccgatccact

SEQ ID NO: 7685858 - DNA, 22 bp, Homo sapiens
ttgttacagcagcaatagaaaa

SEQ ID NO: 7685859 - DNA, 22 bp, Homo sapiens
ttgttacagcacttaacctttt

SEQ ID NO: 7685860 - DNA, 22 bp, Homo sapiens
ttgttacagcagcaatagaaaa

SEQ ID NO: 7685861 - DNA, 22 bp, Homo sapiens
ttgttacagcagcaatagaaaa

SEQ ID NO: 7685862 - DNA, 22 bp, Homo sapiens
ttgttacagcagcaatagaaaa

SEQ ID NO: 7685863 - DNA, 22 bp, Homo sapiens
ttgttaaatggatgcagaataa

SEQ ID NO: 7685864 - DNA, 22 bp, Homo sapiens
ttgttaaatggatgcagaataa

SEQ ID NO: 7685865 - DNA, 21 bp, Homo sapiens
ttgttacaatgcaagagtatg

SEQ ID NO: 7685866 - DNA, 21 bp, Homo sapiens
ttgttacaatgcaagagtatg

SEQ ID NO: 7685867 - DNA, 23 bp, Homo sapiens
ttgttaactttcctgcccctaca

SEQ ID NO: 7685868 - DNA, 22 bp, Homo sapiens
ttgttaaatggatgcagaataa

SEQ ID NO: 7685869 - DNA, 22 bp, Homo sapiens
ttgttaaagatgcagattccat

SEQ ID NO: 7685870 - DNA, 22 bp, Homo sapiens
ttgttaaagatgcagattccat

SEQ ID NO: 7685871 - DNA, 22 bp, Homo sapiens
ttgttaaaggcaaaacaagcac

SEQ ID NO: 7685872 - DNA, 22 bp, Homo sapiens
ttgttaaaggcaaaacaagcac

SEQ ID NO: 7685873 - DNA, 22 bp, Homo sapiens
ttgttaaaggcaaaacaagcac

SEQ ID NO: 7685874 - DNA, 22 bp, Homo sapiens
ttgttaaaggcaaaacaagcac

SEQ ID NO: 7685875 - DNA, 22 bp, Homo sapiens
ttgttaaaggcaaaacaagcac

SEQ ID NO: 7685876 - DNA, 22 bp, Homo sapiens
ttgtgtactgttggttgatatt

SEQ ID NO: 7685877 - DNA, 22 bp, Homo sapiens
ttgttaaaactccattggtttg

SEQ ID NO: 7685878 - DNA, 22 bp, Homo sapiens
ttgttaaaactccattggtttg

SEQ ID NO: 7685879 - DNA, 22 bp, Homo sapiens
ttgttaaaactccattggtttg

SEQ ID NO: 7685880 - DNA, 22 bp, Homo sapiens
ttgtattttgttatgctactgc

SEQ ID NO: 7685881 - DNA, 22 bp, Homo sapiens
ttgtattttgttatgctactgc

SEQ ID NO: 7685882 - DNA, 22 bp, Homo sapiens
ttgtattttgttatgctactgc

SEQ ID NO: 7685883 - DNA, 22 bp, Homo sapiens
ttgtattttgttatgctactgc

SEQ ID NO: 7685884 - DNA, 22 bp, Homo sapiens
ttgtattttgttatgctactgc

SEQ ID NO: 7685885 - DNA, 22 bp, Homo sapiens
ttgtgtacaggtgtttccaagt

SEQ ID NO: 7685886 - DNA, 22 bp, Homo sapiens
ttgtgtacacgcctttaaatga

SEQ ID NO: 7685887 - DNA, 22 bp, Homo sapiens
ttgtgtactacagtatgccaca

SEQ ID NO: 7685888 - DNA, 22 bp, Homo sapiens
ttgtattttgttatgctactgc

SEQ ID NO: 7685889 - DNA, 22 bp, Homo sapiens
ttgtattttgttatgctactgc

SEQ ID NO: 7685890 - DNA, 22 bp, Homo sapiens
ttgttaaagatgcagattccat

SEQ ID NO: 7685891 - DNA, 22 bp, Homo sapiens
ttgttaaagatgcagattccat

SEQ ID NO: 7685892 - DNA, 22 bp, Homo sapiens
ttgttaaaatgcatattctggt

SEQ ID NO: 7685893 - DNA, 22 bp, Homo sapiens
ttgttaaaatgcatattctggt

SEQ ID NO: 7685894 - DNA, 22 bp, Homo sapiens
ttgttaaaatgcatattctggt

SEQ ID NO: 7685895 - DNA, 22 bp, Homo sapiens
ttgttaaaatgcatattctggt

SEQ ID NO: 7685896 - DNA, 22 bp, Homo sapiens
ttgttaaaatgcatattctggt

SEQ ID NO: 7685897 - DNA, 22 bp, Homo sapiens
ttgttaaaatgcatattctggt

SEQ ID NO: 7685898 - DNA, 22 bp, Homo sapiens
ttgttaaaatgcatattctggt

SEQ ID NO: 7685899 - DNA, 22 bp, Homo sapiens
ttgttaaaatgcatattctggt

SEQ ID NO: 7685900 - DNA, 22 bp, Homo sapiens
ttgttaaaatgaggtcattctg

SEQ ID NO: 7685901 - DNA, 22 bp, Homo sapiens
ttgttaaaatgaggtcattctg

SEQ ID NO: 7685902 - DNA, 22 bp, Homo sapiens
ttgttaaaatgaggtcattctg

SEQ ID NO: 7685903 - DNA, 22 bp, Homo sapiens
ttgttaaaatgaggtcattctg

SEQ ID NO: 7685904 - DNA, 22 bp, Homo sapiens
ttgttaaaatgaggtcattctg

SEQ ID NO: 7685905 - DNA, 22 bp, Homo sapiens
ctccagtcatagcctcttgagt

SEQ ID NO: 7685906 - DNA, 22 bp, Homo sapiens
ctccagtcatagcctcttgagt

SEQ ID NO: 7685907 - DNA, 22 bp, Homo sapiens
ctccaggttttacaaggtctat

SEQ ID NO: 7685908 - DNA, 22 bp, Homo sapiens
ctccagtatctgtaggaaaagg

SEQ ID NO: 7685909 - DNA, 22 bp, Homo sapiens
ctccagtcctagtctcttgctt

SEQ ID NO: 7685910 - DNA, 22 bp, Homo sapiens
ctccagtcatgtttactgtgca

SEQ ID NO: 7685911 - DNA, 22 bp, Homo sapiens
ctccagtcctagtctcttgctt

SEQ ID NO: 7685912 - DNA, 22 bp, Homo sapiens
ctccagtcctagtctcttgctt

SEQ ID NO: 7685913 - DNA, 22 bp, Homo sapiens
ctccagtcatgtttactgtgca

SEQ ID NO: 7685914 - DNA, 22 bp, Homo sapiens
ctccagtcatgtttactgtgca

SEQ ID NO: 7685915 - DNA, 22 bp, Homo sapiens
ctccagtcatagtctgtcttgt

SEQ ID NO: 7685916 - DNA, 22 bp, Homo sapiens
ctccaggtagctaagtcctggg

SEQ ID NO: 7685917 - DNA, 22 bp, Homo sapiens
ctccaggtagttatttcaagaa

SEQ ID NO: 7685918 - DNA, 22 bp, Homo sapiens
ctccaggttacttagcctagct

SEQ ID NO: 7685919 - DNA, 22 bp, Homo sapiens
ctccaggttacttagcctagct

SEQ ID NO: 7685920 - DNA, 22 bp, Homo sapiens
ctccaggttacttagcctagct

SEQ ID NO: 7685921 - DNA, 22 bp, Homo sapiens
ctccaggtgcagaaggactcag

SEQ ID NO: 7685922 - DNA, 22 bp, Homo sapiens
ctccagtctagtagagcctgct

SEQ ID NO: 7685923 - DNA, 22 bp, Homo sapiens
ctccagtctctttcggagacac

SEQ ID NO: 7685924 - DNA, 22 bp, Homo sapiens
ctccagtctctttcggagacac

SEQ ID NO: 7685925 - DNA, 22 bp, Homo sapiens
ctccagtcttctcatgtatccc

SEQ ID NO: 7685926 - DNA, 22 bp, Homo sapiens
ctccagtctttcagatgtccct

SEQ ID NO: 7685927 - DNA, 22 bp, Homo sapiens
ctccagtgagcgcggggcatgg

SEQ ID NO: 7685928 - DNA, 22 bp, Homo sapiens
ctccagtgagcgcggggcatgg

SEQ ID NO: 7685929 - DNA, 22 bp, Homo sapiens
ctccagtctagtagagcctgct

SEQ ID NO: 7685930 - DNA, 22 bp, Homo sapiens
ctccagtctagtagagcctgct

SEQ ID NO: 7685931 - DNA, 22 bp, Homo sapiens
ctccagtctagtagagcctgct

SEQ ID NO: 7685932 - DNA, 22 bp, Homo sapiens
ctccagtctaggtcctacttat

SEQ ID NO: 7685933 - DNA, 22 bp, Homo sapiens
ctccagtcatagcctcttgagt

SEQ ID NO: 7685934 - DNA, 22 bp, Homo sapiens
ctccagtctaggtcctacttat

SEQ ID NO: 7685935 - DNA, 22 bp, Homo sapiens
ctccagtctaggtcctacttat

SEQ ID NO: 7685936 - DNA, 22 bp, Homo sapiens
ctccagtgagcgcggggcatgg

SEQ ID NO: 7685937 - DNA, 22 bp, Homo sapiens
ctccagtgagcgcggggcatgg

SEQ ID NO: 7685938 - DNA, 22 bp, Homo sapiens
ctccagtgagcgcggggcatgg

SEQ ID NO: 7685939 - DNA, 22 bp, Homo sapiens
ctccagtgagtgagcaggcgac

SEQ ID NO: 7685940 - DNA, 22 bp, Homo sapiens
ctccagtgagtgagcaggcgac

SEQ ID NO: 7685941 - DNA, 22 bp, Homo sapiens
ctccagtgagtgagcaggcgac

SEQ ID NO: 7685942 - DNA, 22 bp, Homo sapiens
ctccagtgagtgagcaggcgac

SEQ ID NO: 7685943 - DNA, 22 bp, Homo sapiens
ctccagtgagtgagcaggcgac

SEQ ID NO: 7685944 - DNA, 22 bp, Homo sapiens
ctccagtgagtgagcaggcgac

SEQ ID NO: 7685945 - DNA, 22 bp, Homo sapiens
ctccagtgagtgagcaggcgac

SEQ ID NO: 7685946 - DNA, 22 bp, Homo sapiens
ctccagtgcacccagaggattt

SEQ ID NO: 7685947 - DNA, 22 bp, Homo sapiens
tttaaaaaactagtctgagtct

SEQ ID NO: 7685948 - DNA, 22 bp, Homo sapiens
tttaaaaaactagtctgagtct

SEQ ID NO: 7685949 - DNA, 22 bp, Homo sapiens
tttaaaaaactagtctgagtct

SEQ ID NO: 7685950 - DNA, 22 bp, Homo sapiens
tttaaaaaactagtctgagtct

SEQ ID NO: 7685951 - DNA, 22 bp, Homo sapiens
tttaaaaaactagtctgagtct

SEQ ID NO: 7685952 - DNA, 22 bp, Homo sapiens
tttaaaaaactagtctgagtct

SEQ ID NO: 7685953 - DNA, 22 bp, Homo sapiens
tttaaaaaactagtctgagtct

SEQ ID NO: 7685954 - DNA, 22 bp, Homo sapiens
tttaaaaaactagtctgagtct

SEQ ID NO: 7685955 - DNA, 22 bp, Homo sapiens
tttaaaaaactagtctgagtct

SEQ ID NO: 7685956 - DNA, 22 bp, Homo sapiens
tttaaaaaactagtctgagtct

SEQ ID NO: 7685957 - DNA, 22 bp, Homo sapiens
tttaaaaaactagtctgagtct

SEQ ID NO: 7685958 - DNA, 22 bp, Homo sapiens
tttaaaaaactagtctgagtct

SEQ ID NO: 7685959 - DNA, 22 bp, Homo sapiens
tttaaaaaactagtctgagtct

SEQ ID NO: 7685960 - DNA, 22 bp, Homo sapiens
tttaaaaaactagtctgagtct

SEQ ID NO: 7685961 - DNA, 22 bp, Homo sapiens
tttaaaaaactagtctgagtct

SEQ ID NO: 7685962 - DNA, 22 bp, Homo sapiens
tttaaaaaactagtctgagtct

SEQ ID NO: 7685963 - DNA, 22 bp, Homo sapiens
tttaaaaaactagtctgagtct

SEQ ID NO: 7685964 - DNA, 22 bp, Homo sapiens
tttaaaaaactagtctgagtct

SEQ ID NO: 7685965 - DNA, 22 bp, Homo sapiens
tttaaaaaactagtctgagtct

SEQ ID NO: 7685966 - DNA, 22 bp, Homo sapiens
tttaaaaaactagtctgagtct

SEQ ID NO: 7685967 - DNA, 22 bp, Homo sapiens
tttaaaaaactagtctgagtct

SEQ ID NO: 7685968 - DNA, 22 bp, Homo sapiens
ttgtttcatggggatgtttatt

SEQ ID NO: 7685969 - DNA, 22 bp, Homo sapiens
ttgtttcatggggatgtttatt

SEQ ID NO: 7685970 - DNA, 22 bp, Homo sapiens
ttgtttcatggggatgtttatt

SEQ ID NO: 7685971 - DNA, 22 bp, Homo sapiens
ttgtttcatgagtgtaaaggga

SEQ ID NO: 7685972 - DNA, 22 bp, Homo sapiens
ttgtttcaggatggtttgttac

SEQ ID NO: 7685973 - DNA, 22 bp, Homo sapiens
ttgtttcaggatggtttgttac

SEQ ID NO: 7685974 - DNA, 22 bp, Homo sapiens
tttaaaaaactagtctgagtct

SEQ ID NO: 7685975 - DNA, 22 bp, Homo sapiens
tttaaaaaactagtctgagtct

SEQ ID NO: 7685976 - DNA, 22 bp, Homo sapiens
ttgtttcatggggatgtttatt

SEQ ID NO: 7685977 - DNA, 22 bp, Homo sapiens
tttaaaaaactagtctgagtct

SEQ ID NO: 7685978 - DNA, 22 bp, Homo sapiens
tttaaaaaactagtctgagtct

SEQ ID NO: 7685979 - DNA, 22 bp, Homo sapiens
tttaaaaaactagtctgagtct

SEQ ID NO: 7685980 - DNA, 22 bp, Homo sapiens
tttaaaaaactagtctgagtct

SEQ ID NO: 7685981 - DNA, 22 bp, Homo sapiens
tttaaaaaactagtctgagtct

SEQ ID NO: 7685982 - DNA, 22 bp, Homo sapiens
ctccagtgcgcaggacagcccc

SEQ ID NO: 7685983 - DNA, 22 bp, Homo sapiens
ttgtttcaggatggtttgttac

SEQ ID NO: 7685984 - DNA, 22 bp, Homo sapiens
ttgtttcagctgtatgctatgt

SEQ ID NO: 7685985 - DNA, 22 bp, Homo sapiens
ttgtttcagctgtatgctatgt

SEQ ID NO: 7685986 - DNA, 22 bp, Homo sapiens
ctccagtgcactggtcttttca

SEQ ID NO: 7685987 - DNA, 22 bp, Homo sapiens
ctccagtgccctccttgggggc

SEQ ID NO: 7685988 - DNA, 22 bp, Homo sapiens
ctccagtgccctccttgggggc

SEQ ID NO: 7685989 - DNA, 22 bp, Homo sapiens
ctccagtgccctccttgggggc

SEQ ID NO: 7685990 - DNA, 22 bp, Homo sapiens
ctccagtgcacccagaggattt

SEQ ID NO: 7685991 - DNA, 22 bp, Homo sapiens
ctccagtgcacccagaggattt

SEQ ID NO: 7685992 - DNA, 22 bp, Homo sapiens
ttggtattttacaatgtcagtg

SEQ ID NO: 7685993 - DNA, 22 bp, Homo sapiens
ttggtatttcctcaggcatgtc

SEQ ID NO: 7685994 - DNA, 22 bp, Homo sapiens
ttggtatacaaatatttagcac

SEQ ID NO: 7685995 - DNA, 22 bp, Homo sapiens
ttggtatacaaatatttagcac

SEQ ID NO: 7685996 - DNA, 22 bp, Homo sapiens
ttggtagaatgaacattcattg

SEQ ID NO: 7685997 - DNA, 22 bp, Homo sapiens
ttggtacatgcagatatttagt

SEQ ID NO: 7685998 - DNA, 22 bp, Homo sapiens
ttggtaggggactagagtccag

SEQ ID NO: 7685999 - DNA, 22 bp, Homo sapiens
ttggtacatgttaaggaagagt

SEQ ID NO: 7686000 - DNA, 22 bp, Homo sapiens
ttggtcaaggacattacagttt

SEQ ID NO: 7686001 - DNA, 22 bp, Homo sapiens
ttggtattttacaatgtcagtg

SEQ ID NO: 7686002 - DNA, 22 bp, Homo sapiens
ttggtcaagtcttaaagaaaaa

SEQ ID NO: 7686003 - DNA, 22 bp, Homo sapiens
ttggtcaagtcttaaagaaaaa

SEQ ID NO: 7686004 - DNA, 22 bp, Homo sapiens
ttggtcacctgctgtcctttgt

SEQ ID NO: 7686005 - DNA, 22 bp, Homo sapiens
ttggtcacatgagtataaaacg

SEQ ID NO: 7686006 - DNA, 22 bp, Homo sapiens
ttggtcaagtcttaaagaaaaa

SEQ ID NO: 7686007 - DNA, 22 bp, Homo sapiens
ctccagggagctgtggaggttt

SEQ ID NO: 7686008 - DNA, 22 bp, Homo sapiens
ctccagggagctgtggaggttt

SEQ ID NO: 7686009 - DNA, 22 bp, Homo sapiens
ctccagggagctgtggaggttt

SEQ ID NO: 7686010 - DNA, 22 bp, Homo sapiens
ctccagggagctgcgggagcca

SEQ ID NO: 7686011 - DNA, 22 bp, Homo sapiens
ctccaggcgcttaccaagcgct

SEQ ID NO: 7686012 - DNA, 22 bp, Homo sapiens
ctccaggcgcttaccaagcgct

SEQ ID NO: 7686013 - DNA, 22 bp, Homo sapiens
ctccaggcgccgcttttgcagt

SEQ ID NO: 7686014 - DNA, 22 bp, Homo sapiens
ctccaggcgcttaccaagcgct

SEQ ID NO: 7686015 - DNA, 22 bp, Homo sapiens
ctccagggagcttggaaagacc

SEQ ID NO: 7686016 - DNA, 22 bp, Homo sapiens
ctccagggagctgtggaggttt

SEQ ID NO: 7686017 - DNA, 22 bp, Homo sapiens
ctccagggaggagcacgggttc

SEQ ID NO: 7686018 - DNA, 22 bp, Homo sapiens
ctccagggagcttggaaagacc

SEQ ID NO: 7686019 - DNA, 22 bp, Homo sapiens
ctccagggaggagcacgggttc

SEQ ID NO: 7686020 - DNA, 22 bp, Homo sapiens
ctccagggaggagcacgggttc

SEQ ID NO: 7686021 - DNA, 22 bp, Homo sapiens
ctccagggagcttggaaagacc

SEQ ID NO: 7686022 - DNA, 22 bp, Homo sapiens
ctccagggagcttggaaagacc

SEQ ID NO: 7686023 - DNA, 22 bp, Homo sapiens
ttgggtgggtcaggactcggag

SEQ ID NO: 7686024 - DNA, 22 bp, Homo sapiens
ttgggtgggtcaggactcggag

SEQ ID NO: 7686025 - DNA, 22 bp, Homo sapiens
ttgggtgggtcaggactcggag

SEQ ID NO: 7686026 - DNA, 22 bp, Homo sapiens
ttgggtggtggggagagttcag

SEQ ID NO: 7686027 - DNA, 22 bp, Homo sapiens
ttgggtgggtcaggactcggag

SEQ ID NO: 7686028 - DNA, 22 bp, Homo sapiens
ttgggtgctgtcatggggcacg

SEQ ID NO: 7686029 - DNA, 22 bp, Homo sapiens
ttgggtgggtcaggactcggag

SEQ ID NO: 7686030 - DNA, 22 bp, Homo sapiens
ttgggtgggtcaggactcggag

SEQ ID NO: 7686031 - DNA, 22 bp, Homo sapiens
ttgggtggtggggagagttcag

SEQ ID NO: 7686032 - DNA, 22 bp, Homo sapiens
ttgggtggtggggagagttcag

SEQ ID NO: 7686033 - DNA, 22 bp, Homo sapiens
ttgggtcatgggatcccagcat

SEQ ID NO: 7686034 - DNA, 22 bp, Homo sapiens
ttgggtctacgtagaaagaaca

SEQ ID NO: 7686035 - DNA, 22 bp, Homo sapiens
ttgggtaggattcagcagtgtg

SEQ ID NO: 7686036 - DNA, 22 bp, Homo sapiens
ttgggtaggattcagcagtgtg

SEQ ID NO: 7686037 - DNA, 22 bp, Homo sapiens
ttgggtaggagaaagaacagat

SEQ ID NO: 7686038 - DNA, 22 bp, Homo sapiens
ttggtaaattatttcttccaat

SEQ ID NO: 7686039 - DNA, 22 bp, Homo sapiens
ttggtaaattatttcttccaat

SEQ ID NO: 7686040 - DNA, 22 bp, Homo sapiens
ttggtaattgtgtttattaaat

SEQ ID NO: 7686041 - DNA, 22 bp, Homo sapiens
ttggtacaaaagtaactgtggt

SEQ ID NO: 7686042 - DNA, 22 bp, Homo sapiens
ttggtacaaaaccatgaaagaa

SEQ ID NO: 7686043 - DNA, 22 bp, Homo sapiens
ttggtacaatgtgctaggtagg

SEQ ID NO: 7686044 - DNA, 22 bp, Homo sapiens
ttggtacatgttaaggaagagt

SEQ ID NO: 7686045 - DNA, 22 bp, Homo sapiens
ttggtacatgcagatatttagt

SEQ ID NO: 7686046 - DNA, 22 bp, Homo sapiens
ttggtaaatccccttacacaaa

SEQ ID NO: 7686047 - DNA, 22 bp, Homo sapiens
ttggtaaatactctttggagac

SEQ ID NO: 7686048 - DNA, 22 bp, Homo sapiens
ttggtaaatccccttacacaaa

SEQ ID NO: 7686049 - DNA, 22 bp, Homo sapiens
ttggtaaatccccttacacaaa

SEQ ID NO: 7686050 - DNA, 22 bp, Homo sapiens
ttggtaaatactataatcaaat

SEQ ID NO: 7686051 - DNA, 22 bp, Homo sapiens
ttggtaaacttgacagagaatc

SEQ ID NO: 7686052 - DNA, 22 bp, Homo sapiens
ttggtaaataacaatcacagtg

SEQ ID NO: 7686053 - DNA, 22 bp, Homo sapiens
ttgggttttcccttgaaactga

SEQ ID NO: 7686054 - DNA, 22 bp, Homo sapiens
ttgggttttgatacatgtctaa

SEQ ID NO: 7686055 - DNA, 22 bp, Homo sapiens
ttgggttttgatacatgtctaa

SEQ ID NO: 7686056 - DNA, 22 bp, Homo sapiens
ttggtaaaatcatagtggtaac

SEQ ID NO: 7686057 - DNA, 22 bp, Homo sapiens
ttggtaaaatcatagtggtaac

SEQ ID NO: 7686058 - DNA, 22 bp, Homo sapiens
ttggtaaaatcatagtggtaac

SEQ ID NO: 7686059 - DNA, 22 bp, Homo sapiens
ttgtatttgggtagtatagaga

SEQ ID NO: 7686060 - DNA, 22 bp, Homo sapiens
ttgtatttgggtagtatagaga

SEQ ID NO: 7686061 - DNA, 22 bp, Homo sapiens
ttgtatttgggtagtatagaga

SEQ ID NO: 7686062 - DNA, 22 bp, Homo sapiens
ttgtatttgggtagtatagaga

SEQ ID NO: 7686063 - DNA, 22 bp, Homo sapiens
ttgtatttgggtagtatagaga

SEQ ID NO: 7686064 - DNA, 22 bp, Homo sapiens
ttgtatttgggtagtatagaga

SEQ ID NO: 7686065 - DNA, 22 bp, Homo sapiens
ttgtattttgttatgctactgc

SEQ ID NO: 7686066 - DNA, 22 bp, Homo sapiens
ttgtattttgttatgctactgc

SEQ ID NO: 7686067 - DNA, 22 bp, Homo sapiens
ttgtattttgttatgctactgc

SEQ ID NO: 7686068 - DNA, 22 bp, Homo sapiens
ttgtatttgattgtcatatcgt

SEQ ID NO: 7686069 - DNA, 22 bp, Homo sapiens
ttgtatttgattgtcatatcgt

SEQ ID NO: 7686070 - DNA, 22 bp, Homo sapiens
ttgtatttgggtagtatagaga

SEQ ID NO: 7686071 - DNA, 22 bp, Homo sapiens
ttgtatttgggtagtatagaga

SEQ ID NO: 7686072 - DNA, 22 bp, Homo sapiens
ttgtatttgggtagtatagaga

SEQ ID NO: 7686073 - DNA, 22 bp, Homo sapiens
ttgtatttgggtagtatagaga

SEQ ID NO: 7686074 - DNA, 22 bp, Homo sapiens
ttgtatttgggtagtatagaga

SEQ ID NO: 7686075 - DNA, 22 bp, Homo sapiens
ttgtatttgattgtcatatcgt

SEQ ID NO: 7686076 - DNA, 22 bp, Homo sapiens
ttgtatttcttccggtctcatt

SEQ ID NO: 7686077 - DNA, 22 bp, Homo sapiens
ttgtatttcttccggtctcatt

SEQ ID NO: 7686078 - DNA, 22 bp, Homo sapiens
ttgtatttcttccggtctcatt

SEQ ID NO: 7686079 - DNA, 22 bp, Homo sapiens
ttgtatttcttccggtctcatt

SEQ ID NO: 7686080 - DNA, 22 bp, Homo sapiens
ttgtatttgattgtcatatcgt

SEQ ID NO: 7686081 - DNA, 22 bp, Homo sapiens
ttgtatttgattgtcatatcgt

SEQ ID NO: 7686082 - DNA, 22 bp, Homo sapiens
ttgtatttgattgtcatatcgt

SEQ ID NO: 7686083 - DNA, 22 bp, Homo sapiens
ttgtatttgattgtcatatcgt

SEQ ID NO: 7686084 - DNA, 22 bp, Homo sapiens
ttgtatttgattgtcatatcgt

SEQ ID NO: 7686085 - DNA, 22 bp, Homo sapiens
ttgtatttgattgtcatatcgt

SEQ ID NO: 7686086 - DNA, 22 bp, Homo sapiens
ctccagggttccccgatccact

SEQ ID NO: 7686087 - DNA, 22 bp, Homo sapiens
ctccagggttccccgatccact

SEQ ID NO: 7686088 - DNA, 22 bp, Homo sapiens
ctccagggggcatccacacagc

SEQ ID NO: 7686089 - DNA, 22 bp, Homo sapiens
ctccagggggcatccacacagc

SEQ ID NO: 7686090 - DNA, 22 bp, Homo sapiens
ttgtatttctccactttctgtt

SEQ ID NO: 7686091 - DNA, 22 bp, Homo sapiens
ctccaggggccagaagcctggc

SEQ ID NO: 7686092 - DNA, 22 bp, Homo sapiens
ctccaggggccagaagcctggc

SEQ ID NO: 7686093 - DNA, 20 bp, Homo sapiens
ctccaggggaagagccttcc

SEQ ID NO: 7686094 - DNA, 20 bp, Homo sapiens
ctccaggggaagagccttcc

SEQ ID NO: 7686095 - DNA, 22 bp, Homo sapiens
ctccagggggcatccacacagc

SEQ ID NO: 7686096 - DNA, 22 bp, Homo sapiens
ctccagggggcatccacacagc

SEQ ID NO: 7686097 - DNA, 22 bp, Homo sapiens
ctccaggggccagaagcctggc

SEQ ID NO: 7686098 - DNA, 22 bp, Homo sapiens
ctccagggctaccaggttttag

SEQ ID NO: 7686099 - DNA, 22 bp, Homo sapiens
ctccagggctaccaggttttag

SEQ ID NO: 7686100 - DNA, 22 bp, Homo sapiens
ctccagggctaccaggttttag

SEQ ID NO: 7686101 - DNA, 20 bp, Homo sapiens
ctccaggggaagagccttcc

SEQ ID NO: 7686102 - DNA, 20 bp, Homo sapiens
ctccaggggaagagccttcc

SEQ ID NO: 7686103 - DNA, 20 bp, Homo sapiens
ctccaggggaagagccttcc

SEQ ID NO: 7686104 - DNA, 22 bp, Homo sapiens
ctccagggcagcatggcagtgg

SEQ ID NO: 7686105 - DNA, 22 bp, Homo sapiens
ctccagggaggtctgcaggact

SEQ ID NO: 7686106 - DNA, 22 bp, Homo sapiens
ctccagggaggtctgcaggact

SEQ ID NO: 7686107 - DNA, 22 bp, Homo sapiens
ctccagggaggtctgcaggact

SEQ ID NO: 7686108 - DNA, 22 bp, Homo sapiens
ctccagggaggagcacgggttc

SEQ ID NO: 7686109 - DNA, 22 bp, Homo sapiens
ctccagggaggtctgcaggact

SEQ ID NO: 7686110 - DNA, 22 bp, Homo sapiens
ctccagggaggtctgcaggact

SEQ ID NO: 7686111 - DNA, 22 bp, Homo sapiens
ctccagggcagcatggcagtgg

SEQ ID NO: 7686112 - DNA, 22 bp, Homo sapiens
ctccagggcagcatggcagtgg

SEQ ID NO: 7686113 - DNA, 22 bp, Homo sapiens
ctccagggatgagacagagtag

SEQ ID NO: 7686114 - DNA, 22 bp, Homo sapiens
ctccagggatgagacagagtag

SEQ ID NO: 7686115 - DNA, 22 bp, Homo sapiens
ctccagggatgagacagagtag

SEQ ID NO: 7686116 - DNA, 22 bp, Homo sapiens
ctccagggaggtctgcaggact

SEQ ID NO: 7686117 - DNA, 22 bp, Homo sapiens
ctccagggatgagacagagtag

SEQ ID NO: 7686118 - DNA, 22 bp, Homo sapiens
ctccagggatgagacagagtag

SEQ ID NO: 7686119 - DNA, 22 bp, Homo sapiens
ctccagggatgagacagagtag

SEQ ID NO: 7686120 - DNA, 22 bp, Homo sapiens
tacatattcaacgttcagtatt

SEQ ID NO: 7686121 - DNA, 22 bp, Homo sapiens
tacatattcaacgttcagtatt

SEQ ID NO: 7686122 - DNA, 22 bp, Homo sapiens
tacatattcaacgttcagtatt

SEQ ID NO: 7686123 - DNA, 22 bp, Homo sapiens
tacatattcaacgttcagtatt

SEQ ID NO: 7686124 - DNA, 22 bp, Homo sapiens
tacatattcaacgttcagtatt

SEQ ID NO: 7686125 - DNA, 22 bp, Homo sapiens
tacatattcaacgttcagtatt

SEQ ID NO: 7686126 - DNA, 22 bp, Homo sapiens
tacatattcaacgttcagtatt

SEQ ID NO: 7686127 - DNA, 20 bp, Homo sapiens
tacatattatatcagctgca

SEQ ID NO: 7686128 - DNA, 20 bp, Homo sapiens
tacatattatatcagctgca

SEQ ID NO: 7686129 - DNA, 22 bp, Homo sapiens
tacatattgtccatagttgctt

SEQ ID NO: 7686130 - DNA, 22 bp, Homo sapiens
tacatattctacccctttttct

SEQ ID NO: 7686131 - DNA, 22 bp, Homo sapiens
tacatattcaacgttcagtatt

SEQ ID NO: 7686132 - DNA, 22 bp, Homo sapiens
tacatattcaacgttcagtatt

SEQ ID NO: 7686133 - DNA, 22 bp, Homo sapiens
tacatatttgtctttgtactgt

SEQ ID NO: 7686134 - DNA, 22 bp, Homo sapiens
tacatatttgtctttgtactgt

SEQ ID NO: 7686135 - DNA, 22 bp, Homo sapiens
tacatattgtccatagttgctt

SEQ ID NO: 7686136 - DNA, 22 bp, Homo sapiens
tacatatttgtctttgtactgt

SEQ ID NO: 7686137 - DNA, 22 bp, Homo sapiens
tacatatttgtctttgtactgt

SEQ ID NO: 7686138 - DNA, 22 bp, Homo sapiens
tacatatttgtctttgtactgt

SEQ ID NO: 7686139 - DNA, 22 bp, Homo sapiens
tacatatttgtctttgtactgt

SEQ ID NO: 7686140 - DNA, 22 bp, Homo sapiens
tacatattgtccatagttgctt

SEQ ID NO: 7686141 - DNA, 22 bp, Homo sapiens
tacatattctacccctttttct

SEQ ID NO: 7686142 - DNA, 22 bp, Homo sapiens
tacatatttgtctttgtactgt

SEQ ID NO: 7686143 - DNA, 22 bp, Homo sapiens
tacatatttgtctttgtactgt

SEQ ID NO: 7686144 - DNA, 22 bp, Homo sapiens
tacatatttgtctttgtactgt

SEQ ID NO: 7686145 - DNA, 22 bp, Homo sapiens
tacatatttgtctttgtactgt

SEQ ID NO: 7686146 - DNA, 22 bp, Homo sapiens
tacatatagacagttactctag

SEQ ID NO: 7686147 - DNA, 22 bp, Homo sapiens
tacagtttgttacattgttagt

SEQ ID NO: 7686148 - DNA, 22 bp, Homo sapiens
tacagtttgttacattgttagt

SEQ ID NO: 7686149 - DNA, 22 bp, Homo sapiens
tacagtttgttacattgttagt

SEQ ID NO: 7686150 - DNA, 22 bp, Homo sapiens
tacagtttgttacattgttagt

SEQ ID NO: 7686151 - DNA, 22 bp, Homo sapiens
tacagtttgttacattgttagt

SEQ ID NO: 7686152 - DNA, 22 bp, Homo sapiens
tacagtttgttacattgttagt

SEQ ID NO: 7686153 - DNA, 22 bp, Homo sapiens
tacatatgaactttataacttg

SEQ ID NO: 7686154 - DNA, 22 bp, Homo sapiens
tacatatccaggctgagaagat

SEQ ID NO: 7686155 - DNA, 22 bp, Homo sapiens
tacatatccaggctgagaagat

SEQ ID NO: 7686156 - DNA, 22 bp, Homo sapiens
tacatatgaactttataacttg

SEQ ID NO: 7686157 - DNA, 22 bp, Homo sapiens
tacatatgtaaacatgtataaa

SEQ ID NO: 7686158 - DNA, 22 bp, Homo sapiens
tacatatgtaaacatgtataaa

SEQ ID NO: 7686159 - DNA, 22 bp, Homo sapiens
tacatatgagttcgttctatgc

SEQ ID NO: 7686160 - DNA, 22 bp, Homo sapiens
tacatatgtaaacatgtataaa

SEQ ID NO: 7686161 - DNA, 22 bp, Homo sapiens
tacatatgtaaacatgtataaa

SEQ ID NO: 7686162 - DNA, 22 bp, Homo sapiens
tacatatgtaaacatgtataaa

SEQ ID NO: 7686163 - DNA, 22 bp, Homo sapiens
tacatatgtaaacatgtataaa

SEQ ID NO: 7686164 - DNA, 22 bp, Homo sapiens
tacatatgtaaacatgtataaa

SEQ ID NO: 7686165 - DNA, 22 bp, Homo sapiens
tacatatgtaaacatgtataaa

SEQ ID NO: 7686166 - DNA, 22 bp, Homo sapiens
tacatatgtatttgtgtatacg

SEQ ID NO: 7686167 - DNA, 22 bp, Homo sapiens
tacatatgtatttgtgtatacg

SEQ ID NO: 7686168 - DNA, 20 bp, Homo sapiens
tacatattatatcagctgca

SEQ ID NO: 7686169 - DNA, 22 bp, Homo sapiens
tacatatgtatttgtgtatacg

SEQ ID NO: 7686170 - DNA, 22 bp, Homo sapiens
tacatcataataatacttagaa

SEQ ID NO: 7686171 - DNA, 22 bp, Homo sapiens
tacatcataataatacttagaa

SEQ ID NO: 7686172 - DNA, 22 bp, Homo sapiens
tacatcatgaaagcatacatca

SEQ ID NO: 7686173 - DNA, 22 bp, Homo sapiens
tacatcatgaaagcatacatca

SEQ ID NO: 7686174 - DNA, 22 bp, Homo sapiens
tacatcatgaaagcatacatca

SEQ ID NO: 7686175 - DNA, 22 bp, Homo sapiens
tacatcatgaaagcatacatca

SEQ ID NO: 7686176 - DNA, 22 bp, Homo sapiens
tacatcatgaaagcatacatca

SEQ ID NO: 7686177 - DNA, 22 bp, Homo sapiens
tacatcaaatcaatgttccagt

SEQ ID NO: 7686178 - DNA, 22 bp, Homo sapiens
tacatcaaatcaatgttccagt

SEQ ID NO: 7686179 - DNA, 22 bp, Homo sapiens
tacatatttgtctttgtactgt

SEQ ID NO: 7686180 - DNA, 22 bp, Homo sapiens
tacatatttgtctttgtactgt

SEQ ID NO: 7686181 - DNA, 22 bp, Homo sapiens
tacatcaagataaaaactgtca

SEQ ID NO: 7686182 - DNA, 22 bp, Homo sapiens
tacatcaagataaaaactgtca

SEQ ID NO: 7686183 - DNA, 22 bp, Homo sapiens
tacatcaagataaaaactgtca

SEQ ID NO: 7686184 - DNA, 22 bp, Homo sapiens
tacatcaaggaacacctggtat

SEQ ID NO: 7686185 - DNA, 22 bp, Homo sapiens
tacatcaaggaacacctggtat

SEQ ID NO: 7686186 - DNA, 22 bp, Homo sapiens
tacatcaaggaacacctggtat

SEQ ID NO: 7686187 - DNA, 22 bp, Homo sapiens
tacatgtggagataactgaagc

SEQ ID NO: 7686188 - DNA, 22 bp, Homo sapiens
tacatgtggagataactgaagc

SEQ ID NO: 7686189 - DNA, 22 bp, Homo sapiens
tacatcatggcttcatgctgca

SEQ ID NO: 7686190 - DNA, 22 bp, Homo sapiens
tacatcatggcttcatgctgca

SEQ ID NO: 7686191 - DNA, 21 bp, Homo sapiens
tacatcatgctacttctctga

SEQ ID NO: 7686192 - DNA, 21 bp, Homo sapiens
tacatcatgctacttctctga

SEQ ID NO: 7686193 - DNA, 22 bp, Homo sapiens
tacatgtgataaattgattaaa

SEQ ID NO: 7686194 - DNA, 22 bp, Homo sapiens
tacatgtgatcagaaagtgaaa

SEQ ID NO: 7686195 - DNA, 22 bp, Homo sapiens
tacatgtgatcagaaagtgaaa

SEQ ID NO: 7686196 - DNA, 22 bp, Homo sapiens
tacatgtgcacgtgtgactttg

SEQ ID NO: 7686197 - DNA, 19 bp, Homo sapiens
caggccctggacccatctg

SEQ ID NO: 7686198 - DNA, 19 bp, Homo sapiens
caggccctggacccatctg

SEQ ID NO: 7686199 - DNA, 22 bp, Homo sapiens
caggccctggcagggctgagtc

SEQ ID NO: 7686200 - DNA, 22 bp, Homo sapiens
caggccctgctgctgagacctt

SEQ ID NO: 7686201 - DNA, 22 bp, Homo sapiens
caggccctgctgctgagacctt

SEQ ID NO: 7686202 - DNA, 22 bp, Homo sapiens
tacagtaaccttatttgtcatt

SEQ ID NO: 7686203 - DNA, 22 bp, Homo sapiens
tacagtaaccttatttgtcatt

SEQ ID NO: 7686204 - DNA, 22 bp, Homo sapiens
tacagtaaccttatttgtcatt

SEQ ID NO: 7686205 - DNA, 22 bp, Homo sapiens
tacagtaaccagtctacttaga

SEQ ID NO: 7686206 - DNA, 22 bp, Homo sapiens
tacagtaacatgttgtacaagc

SEQ ID NO: 7686207 - DNA, 22 bp, Homo sapiens
tacagtaacatgttgtacaagc

SEQ ID NO: 7686208 - DNA, 22 bp, Homo sapiens
tacagtaacatgttgtacaagc

SEQ ID NO: 7686209 - DNA, 22 bp, Homo sapiens
tacagtaacatgttgtacaagc

SEQ ID NO: 7686210 - DNA, 22 bp, Homo sapiens
tacagtaacatgttgtacaagc

SEQ ID NO: 7686211 - DNA, 22 bp, Homo sapiens
tacagtaaccagtctacttaga

SEQ ID NO: 7686212 - DNA, 22 bp, Homo sapiens
tacagtaaccagtctacttaga

SEQ ID NO: 7686213 - DNA, 22 bp, Homo sapiens
tacagtaaccagtctacttaga

SEQ ID NO: 7686214 - DNA, 22 bp, Homo sapiens
tacagtaaccagtctacttaga

SEQ ID NO: 7686215 - DNA, 22 bp, Homo sapiens
tacagtaacatgttgtacaagc

SEQ ID NO: 7686216 - DNA, 22 bp, Homo sapiens
tacagtaacatgttgtacaagc

SEQ ID NO: 7686217 - DNA, 22 bp, Homo sapiens
tacagtaacatgttgtacaagc

SEQ ID NO: 7686218 - DNA, 22 bp, Homo sapiens
tacagtaaagctgctatgaatt

SEQ ID NO: 7686219 - DNA, 22 bp, Homo sapiens
tacaggttacacttttaaaagt

SEQ ID NO: 7686220 - DNA, 22 bp, Homo sapiens
tacagtaaagctgctatgaatt

SEQ ID NO: 7686221 - DNA, 22 bp, Homo sapiens
tacagtaaagctgctatgaatt

SEQ ID NO: 7686222 - DNA, 22 bp, Homo sapiens
tacagtaaagctgctatgaatt

SEQ ID NO: 7686223 - DNA, 22 bp, Homo sapiens
tacagtaaatgtggtagaaact

SEQ ID NO: 7686224 - DNA, 22 bp, Homo sapiens
tacaggtggtaaaaatattgtt

SEQ ID NO: 7686225 - DNA, 22 bp, Homo sapiens
tacaggtggtaaaaatattgtt

SEQ ID NO: 7686226 - DNA, 22 bp, Homo sapiens
tacaggtggtaaaaatattgtt

SEQ ID NO: 7686227 - DNA, 22 bp, Homo sapiens
tacaggttacacttttaaaagt

SEQ ID NO: 7686228 - DNA, 22 bp, Homo sapiens
tacaggtggtaaaaatattgtt

SEQ ID NO: 7686229 - DNA, 22 bp, Homo sapiens
tacaggtggtaaaaatattgtt

SEQ ID NO: 7686230 - DNA, 22 bp, Homo sapiens
tacaggtggatcactagtatag

SEQ ID NO: 7686231 - DNA, 22 bp, Homo sapiens
tacaggtggatcactagtatag

SEQ ID NO: 7686232 - DNA, 22 bp, Homo sapiens
tacaggtggatcactagtatag

SEQ ID NO: 7686233 - DNA, 22 bp, Homo sapiens
caggccctttcctgggcatagg

SEQ ID NO: 7686234 - DNA, 22 bp, Homo sapiens
caggccctttcctgggcatagg

SEQ ID NO: 7686235 - DNA, 22 bp, Homo sapiens
caggccctgtgctgggtgatgt

SEQ ID NO: 7686236 - DNA, 22 bp, Homo sapiens
caggccctttcctgggcatagg

SEQ ID NO: 7686237 - DNA, 22 bp, Homo sapiens
caggccctttcctgggcatagg

SEQ ID NO: 7686238 - DNA, 22 bp, Homo sapiens
tacagtttgttacattgttagt

SEQ ID NO: 7686239 - DNA, 22 bp, Homo sapiens
caggccggccggccccagctct

SEQ ID NO: 7686240 - DNA, 22 bp, Homo sapiens
caggccggccggccccagctct

SEQ ID NO: 7686241 - DNA, 22 bp, Homo sapiens
tacagtttgtgtggagctggag

SEQ ID NO: 7686242 - DNA, 18 bp, Homo sapiens
caggccctgtctggcctc

SEQ ID NO: 7686243 - DNA, 18 bp, Homo sapiens
caggccctgtctggcctc

SEQ ID NO: 7686244 - DNA, 18 bp, Homo sapiens
caggccctgtctggcctc

SEQ ID NO: 7686245 - DNA, 22 bp, Homo sapiens
caggccctgggcaggcacagag

SEQ ID NO: 7686246 - DNA, 22 bp, Homo sapiens
caggccctgtgctgggtgatgt

SEQ ID NO: 7686247 - DNA, 18 bp, Homo sapiens
caggccctgtctggcctc

SEQ ID NO: 7686248 - DNA, 18 bp, Homo sapiens
caggccctgtctggcctc

SEQ ID NO: 7686249 - DNA, 18 bp, Homo sapiens
caggccctgtctggcctc

SEQ ID NO: 7686250 - DNA, 18 bp, Homo sapiens
caggccctgtctggcctc

SEQ ID NO: 7686251 - DNA, 22 bp, Homo sapiens
caggccctggcagggctgagtc

SEQ ID NO: 7686252 - DNA, 22 bp, Homo sapiens
caggccctggcagggctgagtc

SEQ ID NO: 7686253 - DNA, 22 bp, Homo sapiens
caggccctggcagggctgagtc

SEQ ID NO: 7686254 - DNA, 19 bp, Homo sapiens
caggccctggacccatctg

SEQ ID NO: 7686255 - DNA, 22 bp, Homo sapiens
caggccctggcagggctgagtc

SEQ ID NO: 7686256 - DNA, 22 bp, Homo sapiens
caggccctggcagggctgagtc

SEQ ID NO: 7686257 - DNA, 22 bp, Homo sapiens
caggccctggcagggctgagtc

SEQ ID NO: 7686258 - DNA, 22 bp, Homo sapiens
caggccctgggcaggatcagcc

SEQ ID NO: 7686259 - DNA, 22 bp, Homo sapiens
caggccctgggcaggatcagcc

SEQ ID NO: 7686260 - DNA, 22 bp, Homo sapiens
caggccctgggcaggatcagcc

SEQ ID NO: 7686261 - DNA, 22 bp, Homo sapiens
caggccctgggcaggcacagag

SEQ ID NO: 7686262 - DNA, 22 bp, Homo sapiens
caggccctgggcaggcacagag

SEQ ID NO: 7686263 - DNA, 22 bp, Homo sapiens
caggccctgggcaggcacagag

SEQ ID NO: 7686264 - DNA, 22 bp, Homo sapiens
caggccctgggcaggcacagag

SEQ ID NO: 7686265 - DNA, 22 bp, Homo sapiens
caggccctgggcaggcacagag

SEQ ID NO: 7686266 - DNA, 22 bp, Homo sapiens
tacaagtgtggctcctctgtct

SEQ ID NO: 7686267 - DNA, 22 bp, Homo sapiens
tacaagtgtggctcctctgtct

SEQ ID NO: 7686268 - DNA, 22 bp, Homo sapiens
tacaagtgtgcaccaccatgtc

SEQ ID NO: 7686269 - DNA, 22 bp, Homo sapiens
tacaagtgtgcaccaccatgtc

SEQ ID NO: 7686270 - DNA, 22 bp, Homo sapiens
tacaagtgtgcaccaccatgtc

SEQ ID NO: 7686271 - DNA, 22 bp, Homo sapiens
tacaagtgtaagcttgtgagac

SEQ ID NO: 7686272 - DNA, 22 bp, Homo sapiens
tacaagtgtaagcttgtgagac

SEQ ID NO: 7686273 - DNA, 16 bp, Homo sapiens
tacaagtgttagggaa

SEQ ID NO: 7686274 - DNA, 22 bp, Homo sapiens
tacaagtgtttgagaggtggac

SEQ ID NO: 7686275 - DNA, 22 bp, Homo sapiens
tacaagttccattttgaaagtg

SEQ ID NO: 7686276 - DNA, 22 bp, Homo sapiens
tacaagtccgtaaagggcagat

SEQ ID NO: 7686277 - DNA, 22 bp, Homo sapiens
tacaagtcattggatgaggaat

SEQ ID NO: 7686278 - DNA, 22 bp, Homo sapiens
tacaagtcacttcctttctaaa

SEQ ID NO: 7686279 - DNA, 22 bp, Homo sapiens
tacaagtcacttcctttctaaa

SEQ ID NO: 7686280 - DNA, 22 bp, Homo sapiens
tacaagtcacttcctttctaaa

SEQ ID NO: 7686281 - DNA, 22 bp, Homo sapiens
tacaagtccgtaaagggcagat

SEQ ID NO: 7686282 - DNA, 22 bp, Homo sapiens
tacaagtctcagttttggattc

SEQ ID NO: 7686283 - DNA, 22 bp, Homo sapiens
tacaagtgctagcagatattgt

SEQ ID NO: 7686284 - DNA, 22 bp, Homo sapiens
tacaagtgctagcagatattgt

SEQ ID NO: 7686285 - DNA, 22 bp, Homo sapiens
tacaagtgctagcagatattgt

SEQ ID NO: 7686286 - DNA, 22 bp, Homo sapiens
tacaagtgctagcagatattgt

SEQ ID NO: 7686287 - DNA, 22 bp, Homo sapiens
tacaagtggagttaggaagttt

SEQ ID NO: 7686288 - DNA, 22 bp, Homo sapiens
tacaagtactgtggctttgaat

SEQ ID NO: 7686289 - DNA, 22 bp, Homo sapiens
tacaagtatattctagtgatat

SEQ ID NO: 7686290 - DNA, 22 bp, Homo sapiens
tacaagtactgtggctttgaat

SEQ ID NO: 7686291 - DNA, 22 bp, Homo sapiens
tacaagtatattctagtgatat

SEQ ID NO: 7686292 - DNA, 22 bp, Homo sapiens
tacaagtatggaatgattctca

SEQ ID NO: 7686293 - DNA, 22 bp, Homo sapiens
tacaagtatgttttaaaatgtt

SEQ ID NO: 7686294 - DNA, 22 bp, Homo sapiens
tacaagtatgttttaaaatgtt

SEQ ID NO: 7686295 - DNA, 22 bp, Homo sapiens
tacaagtatgttttaaaatgtt

SEQ ID NO: 7686296 - DNA, 22 bp, Homo sapiens
tacaagtatgttttaaaatgtt

SEQ ID NO: 7686297 - DNA, 20 bp, Homo sapiens
tacaagtacattatagttat

SEQ ID NO: 7686298 - DNA, 22 bp, Homo sapiens
tacaagtaaattgtagatacca

SEQ ID NO: 7686299 - DNA, 22 bp, Homo sapiens
tacaagtaaattgtagatacca

SEQ ID NO: 7686300 - DNA, 22 bp, Homo sapiens
tacaagtaaattgtagatacca

SEQ ID NO: 7686301 - DNA, 22 bp, Homo sapiens
tacaaggttgtactttctctct

SEQ ID NO: 7686302 - DNA, 22 bp, Homo sapiens
tacaagggagattattcatatt

SEQ ID NO: 7686303 - DNA, 22 bp, Homo sapiens
tacaaggcttcagctcagctat

SEQ ID NO: 7686304 - DNA, 22 bp, Homo sapiens
tacaaggcaaatccatgatgtc

SEQ ID NO: 7686305 - DNA, 20 bp, Homo sapiens
tacaatacacatgcatatga

SEQ ID NO: 7686306 - DNA, 22 bp, Homo sapiens
tacaatacttaacctattttgc

SEQ ID NO: 7686307 - DNA, 22 bp, Homo sapiens
tacaatacttaacctattttgc

SEQ ID NO: 7686308 - DNA, 22 bp, Homo sapiens
tacaatacttaacctattttgc

SEQ ID NO: 7686309 - DNA, 21 bp, Homo sapiens
tacaagttgcttttgaagtcc

SEQ ID NO: 7686310 - DNA, 21 bp, Homo sapiens
tacaagttgcttttgaagtcc

SEQ ID NO: 7686311 - DNA, 22 bp, Homo sapiens
tacaatagggcttttgtttatg

SEQ ID NO: 7686312 - DNA, 22 bp, Homo sapiens
tacaatagggcttttgtttatg

SEQ ID NO: 7686313 - DNA, 22 bp, Homo sapiens
tacaatagggcttttgtttatg

SEQ ID NO: 7686314 - DNA, 22 bp, Homo sapiens
tacagctgttggtgtttcctct

SEQ ID NO: 7686315 - DNA, 22 bp, Homo sapiens
tacagctgttggtgtttcctct

SEQ ID NO: 7686316 - DNA, 22 bp, Homo sapiens
tacagggattcctgccgctcgc

SEQ ID NO: 7686317 - DNA, 22 bp, Homo sapiens
tacagggattgttttaatcacc

SEQ ID NO: 7686318 - DNA, 22 bp, Homo sapiens
tacagcttaaaaaagccaactt

SEQ ID NO: 7686319 - DNA, 22 bp, Homo sapiens
tacagcttaaaaaagccaactt

SEQ ID NO: 7686320 - DNA, 22 bp, Homo sapiens
tacagggattcctgccgctcgc

SEQ ID NO: 7686321 - DNA, 22 bp, Homo sapiens
tacaggggtaacagtggggaat

SEQ ID NO: 7686322 - DNA, 22 bp, Homo sapiens
tacaggggtaacagtggggaat

SEQ ID NO: 7686323 - DNA, 22 bp, Homo sapiens
tacagggcatgtgcagacacat

SEQ ID NO: 7686324 - DNA, 22 bp, Homo sapiens
tacagggtattcaagggtagtt

SEQ ID NO: 7686325 - DNA, 22 bp, Homo sapiens
tacagggtataggtacagatga

SEQ ID NO: 7686326 - DNA, 22 bp, Homo sapiens
tacagggtattcaagggtagtt

SEQ ID NO: 7686327 - DNA, 22 bp, Homo sapiens
tacagggtataggtacagatga

SEQ ID NO: 7686328 - DNA, 22 bp, Homo sapiens
tacaggtaaaattatcagaaac

SEQ ID NO: 7686329 - DNA, 22 bp, Homo sapiens
tacaggtaaaattatcagaaac

SEQ ID NO: 7686330 - DNA, 22 bp, Homo sapiens
tacaggtagaatgggtgtacag

SEQ ID NO: 7686331 - DNA, 20 bp, Homo sapiens
tacaggtagaactccctggc

SEQ ID NO: 7686332 - DNA, 22 bp, Homo sapiens
tacaggtagaaatgaagccaga

SEQ ID NO: 7686333 - DNA, 22 bp, Homo sapiens
tacaggtagagtctctagttta

SEQ ID NO: 7686334 - DNA, 22 bp, Homo sapiens
tacaggtagcaaaacctttcct

SEQ ID NO: 7686335 - DNA, 22 bp, Homo sapiens
tacaggtctaactaaatgaatt

SEQ ID NO: 7686336 - DNA, 22 bp, Homo sapiens
tacaggtcttgccatggcaatg

SEQ ID NO: 7686337 - DNA, 22 bp, Homo sapiens
tacaggtagagtctctagttta

SEQ ID NO: 7686338 - DNA, 22 bp, Homo sapiens
caggcagggagctggaaaggat

SEQ ID NO: 7686339 - DNA, 22 bp, Homo sapiens
caggcagggagctggaaaggat

SEQ ID NO: 7686340 - DNA, 22 bp, Homo sapiens
caggcagggagccactgtataa

SEQ ID NO: 7686341 - DNA, 22 bp, Homo sapiens
caggcagggagctggaaaggat

SEQ ID NO: 7686342 - DNA, 22 bp, Homo sapiens
tacaaactaacatgtctcatcc

SEQ ID NO: 7686343 - DNA, 22 bp, Homo sapiens
caggcagggagctggaaaggat

SEQ ID NO: 7686344 - DNA, 22 bp, Homo sapiens
caggcagggagctggaaaggat

SEQ ID NO: 7686345 - DNA, 22 bp, Homo sapiens
tacaaactaacatgtctcatcc

SEQ ID NO: 7686346 - DNA, 22 bp, Homo sapiens
tacaaactaacatgtctcatcc

SEQ ID NO: 7686347 - DNA, 22 bp, Homo sapiens
tacaaatgaaccaactttgatg

SEQ ID NO: 7686348 - DNA, 22 bp, Homo sapiens
tacaaatgaaccaactttgatg

SEQ ID NO: 7686349 - DNA, 22 bp, Homo sapiens
tacaaactaacatgtctcatcc

SEQ ID NO: 7686350 - DNA, 22 bp, Homo sapiens
tacaaactccgaagtttgtacc

SEQ ID NO: 7686351 - DNA, 22 bp, Homo sapiens
tacaaactccgaagtttgtacc

SEQ ID NO: 7686352 - DNA, 22 bp, Homo sapiens
tacaaactccgaagtttgtacc

SEQ ID NO: 7686353 - DNA, 22 bp, Homo sapiens
tacaaatgaaccaactttgatg

SEQ ID NO: 7686354 - DNA, 22 bp, Homo sapiens
tacaaatgaaccaactttgatg

SEQ ID NO: 7686355 - DNA, 22 bp, Homo sapiens
tacaaatgaaccaactttgatg

SEQ ID NO: 7686356 - DNA, 22 bp, Homo sapiens
tacaaatgaaccaactttgatg

SEQ ID NO: 7686357 - DNA, 22 bp, Homo sapiens
tacaaatgaaccaactttgatg

SEQ ID NO: 7686358 - DNA, 22 bp, Homo sapiens
tacaaatgcctgacacacagat

SEQ ID NO: 7686359 - DNA, 22 bp, Homo sapiens
tacaaatgcctgacacacagat

SEQ ID NO: 7686360 - DNA, 22 bp, Homo sapiens
tacaaatgcctgacacacagat

SEQ ID NO: 7686361 - DNA, 22 bp, Homo sapiens
tacaaatgcctgacacacagat

SEQ ID NO: 7686362 - DNA, 22 bp, Homo sapiens
tacaaatgcctgacacacagat

SEQ ID NO: 7686363 - DNA, 22 bp, Homo sapiens
tacaaatgcctgacacacagat

SEQ ID NO: 7686364 - DNA, 22 bp, Homo sapiens
tacaaatgcctgacacacagat

SEQ ID NO: 7686365 - DNA, 22 bp, Homo sapiens
tacaaatgagttgtatgaacca

SEQ ID NO: 7686366 - DNA, 22 bp, Homo sapiens
tacaaatgagttgtatgaacca

SEQ ID NO: 7686367 - DNA, 22 bp, Homo sapiens
tacaaatgagttgtatgaacca

SEQ ID NO: 7686368 - DNA, 22 bp, Homo sapiens
tacaaatgagttgtatgaacca

SEQ ID NO: 7686369 - DNA, 22 bp, Homo sapiens
tacaaatgagttgtatgaacca

SEQ ID NO: 7686370 - DNA, 22 bp, Homo sapiens
tacaaatgaccatagccactta

SEQ ID NO: 7686371 - DNA, 22 bp, Homo sapiens
tacaaatgaccatagccactta

SEQ ID NO: 7686372 - DNA, 22 bp, Homo sapiens
tacaaatgaccatagccactta

SEQ ID NO: 7686373 - DNA, 22 bp, Homo sapiens
tacaaatgaccatagccactta

SEQ ID NO: 7686374 - DNA, 22 bp, Homo sapiens
tacaaatgaccatagccactta

SEQ ID NO: 7686375 - DNA, 22 bp, Homo sapiens
tacaaatgagttgtatgaacca

SEQ ID NO: 7686376 - DNA, 22 bp, Homo sapiens
tacaaatgagttgtatgaacca

SEQ ID NO: 7686377 - DNA, 22 bp, Homo sapiens
tacaaatgagttgtatgaacca

SEQ ID NO: 7686378 - DNA, 22 bp, Homo sapiens
tacaaatgagttgtatgaacca

SEQ ID NO: 7686379 - DNA, 22 bp, Homo sapiens
tacaaatgagttgtatgaacca

SEQ ID NO: 7686380 - DNA, 22 bp, Homo sapiens
tacaaatgagttgtatgaacca

SEQ ID NO: 7686381 - DNA, 22 bp, Homo sapiens
tacaaatgagttgtatgaacca

SEQ ID NO: 7686382 - DNA, 20 bp, Homo sapiens
tacaaattttccatgtttcc

SEQ ID NO: 7686383 - DNA, 20 bp, Homo sapiens
tacaaattttccatgtttcc

SEQ ID NO: 7686384 - DNA, 20 bp, Homo sapiens
tacaaattttccatgtttcc

SEQ ID NO: 7686385 - DNA, 20 bp, Homo sapiens
tacaaattttccatgtttcc

SEQ ID NO: 7686386 - DNA, 20 bp, Homo sapiens
tacaaattttccatgtttcc

SEQ ID NO: 7686387 - DNA, 22 bp, Homo sapiens
tacaaattaatgggcatgttta

SEQ ID NO: 7686388 - DNA, 22 bp, Homo sapiens
tacaaattaatgggcatgttta

SEQ ID NO: 7686389 - DNA, 22 bp, Homo sapiens
tacaaattaatgggcatgttta

SEQ ID NO: 7686390 - DNA, 22 bp, Homo sapiens
tacaaattaatgggcatgttta

SEQ ID NO: 7686391 - DNA, 22 bp, Homo sapiens
tacaaggaaaatcttgaagtac

SEQ ID NO: 7686392 - DNA, 22 bp, Homo sapiens
tacaaggaggctaatgatgaca

SEQ ID NO: 7686393 - DNA, 22 bp, Homo sapiens
tacaaggaggctaatgatgaca

SEQ ID NO: 7686394 - DNA, 22 bp, Homo sapiens
tacaaggcaaatccatgatgtc

SEQ ID NO: 7686395 - DNA, 22 bp, Homo sapiens
tacaaggcaaatccatgatgtc

SEQ ID NO: 7686396 - DNA, 19 bp, Homo sapiens
tacaagcttttttggcagg

SEQ ID NO: 7686397 - DNA, 19 bp, Homo sapiens
tacaagcttttttggcagg

SEQ ID NO: 7686398 - DNA, 20 bp, Homo sapiens
tacaaattttccatgtttcc

SEQ ID NO: 7686399 - DNA, 20 bp, Homo sapiens
tacaaattttccatgtttcc

SEQ ID NO: 7686400 - DNA, 22 bp, Homo sapiens
tacaaatgtattttattttggt

SEQ ID NO: 7686401 - DNA, 22 bp, Homo sapiens
tacaaatgtattttattttggt

SEQ ID NO: 7686402 - DNA, 22 bp, Homo sapiens
tacaaatgtattttattttggt

SEQ ID NO: 7686403 - DNA, 22 bp, Homo sapiens
tacaaatggttgaatggatgaa

SEQ ID NO: 7686404 - DNA, 22 bp, Homo sapiens
tacaaatggttgaatggatgaa

SEQ ID NO: 7686405 - DNA, 22 bp, Homo sapiens
tacaaatggttgaatggatgaa

SEQ ID NO: 7686406 - DNA, 22 bp, Homo sapiens
tacaaatggttgaatggatgaa

SEQ ID NO: 7686407 - DNA, 22 bp, Homo sapiens
tacaaatggttgaatggatgaa

SEQ ID NO: 7686408 - DNA, 22 bp, Homo sapiens
tacaaatggttgaatggatgaa

SEQ ID NO: 7686409 - DNA, 22 bp, Homo sapiens
tacaaatgtattttattttggt

SEQ ID NO: 7686410 - DNA, 22 bp, Homo sapiens
tacaaatgggttaaaatatagt

SEQ ID NO: 7686411 - DNA, 22 bp, Homo sapiens
tacaaatgggttaaaatatagt

SEQ ID NO: 7686412 - DNA, 22 bp, Homo sapiens
tacaaatgggttaaaatatagt

SEQ ID NO: 7686413 - DNA, 22 bp, Homo sapiens
tacaaatgggttaaaatatagt

SEQ ID NO: 7686414 - DNA, 22 bp, Homo sapiens
tacaaatgggttaaaatatagt

SEQ ID NO: 7686415 - DNA, 22 bp, Homo sapiens
tacaaatgggttaaaatatagt

SEQ ID NO: 7686416 - DNA, 22 bp, Homo sapiens
tacaaatgcctgacacacagat

SEQ ID NO: 7686417 - DNA, 22 bp, Homo sapiens
tacaaatgggttaaaatatagt

SEQ ID NO: 7686418 - DNA, 22 bp, Homo sapiens
tacaaatgggttaaaatatagt

SEQ ID NO: 7686419 - DNA, 22 bp, Homo sapiens
tacaaatgggttaaaatatagt

SEQ ID NO: 7686420 - DNA, 22 bp, Homo sapiens
tacaaatgggttaaaatatagt

SEQ ID NO: 7686421 - DNA, 22 bp, Homo sapiens
tacaaatgggttaaaatatagt

SEQ ID NO: 7686422 - DNA, 22 bp, Homo sapiens
caggcagcaggagccctgctcg

SEQ ID NO: 7686423 - DNA, 22 bp, Homo sapiens
caggcagcaggagccctgctcg

SEQ ID NO: 7686424 - DNA, 22 bp, Homo sapiens
caggcagcaggagccctgctcg

SEQ ID NO: 7686425 - DNA, 22 bp, Homo sapiens
caggcagcaggagccctgctcg

SEQ ID NO: 7686426 - DNA, 22 bp, Homo sapiens
caggcagcaggagccctgctcg

SEQ ID NO: 7686427 - DNA, 22 bp, Homo sapiens
caggcagcaggagccctgctcg

SEQ ID NO: 7686428 - DNA, 22 bp, Homo sapiens
taatttacttgcaaataacaat

SEQ ID NO: 7686429 - DNA, 22 bp, Homo sapiens
taatttacttgcaaataacaat

SEQ ID NO: 7686430 - DNA, 22 bp, Homo sapiens
caggcagcagccactctggtat

SEQ ID NO: 7686431 - DNA, 22 bp, Homo sapiens
caggcagcagccactctggtat

SEQ ID NO: 7686432 - DNA, 22 bp, Homo sapiens
caggcagcagccactctggtat

SEQ ID NO: 7686433 - DNA, 22 bp, Homo sapiens
caggcagcagccactctggtat

SEQ ID NO: 7686434 - DNA, 22 bp, Homo sapiens
caggcagcagccactctggtat

SEQ ID NO: 7686435 - DNA, 22 bp, Homo sapiens
caggcagcatttactctgatga

SEQ ID NO: 7686436 - DNA, 22 bp, Homo sapiens
caggcagcatttactctgatga

SEQ ID NO: 7686437 - DNA, 22 bp, Homo sapiens
caggcagccaggggacctgtcc

SEQ ID NO: 7686438 - DNA, 22 bp, Homo sapiens
caggcagccaggggacctgtcc

SEQ ID NO: 7686439 - DNA, 22 bp, Homo sapiens
caggcagccaggggacctgtcc

SEQ ID NO: 7686440 - DNA, 22 bp, Homo sapiens
caggcagcatcagtctgctgta

SEQ ID NO: 7686441 - DNA, 22 bp, Homo sapiens
caggcagcatcagtctgctgta

SEQ ID NO: 7686442 - DNA, 22 bp, Homo sapiens
caggcagcatttactctgatga

SEQ ID NO: 7686443 - DNA, 22 bp, Homo sapiens
caggcagcatcagtctgctgta

SEQ ID NO: 7686444 - DNA, 22 bp, Homo sapiens
caggcagcatcagtctgctgta

SEQ ID NO: 7686445 - DNA, 22 bp, Homo sapiens
caggcagcatcagtctgctgta

SEQ ID NO: 7686446 - DNA, 22 bp, Homo sapiens
caggcagcatcagtctgctgta

SEQ ID NO: 7686447 - DNA, 22 bp, Homo sapiens
caggcagctctgcttttcctaa

SEQ ID NO: 7686448 - DNA, 22 bp, Homo sapiens
caggcagctgactgtcagatat

SEQ ID NO: 7686449 - DNA, 22 bp, Homo sapiens
caggcagctgactgtcagatat

SEQ ID NO: 7686450 - DNA, 22 bp, Homo sapiens
caggcagctgactgtcagatat

SEQ ID NO: 7686451 - DNA, 22 bp, Homo sapiens
caggcagctgactgtcagatat

SEQ ID NO: 7686452 - DNA, 22 bp, Homo sapiens
caggcagctgactgtcagatat

SEQ ID NO: 7686453 - DNA, 22 bp, Homo sapiens
caggcagctgactgtcagatat

SEQ ID NO: 7686454 - DNA, 22 bp, Homo sapiens
caggcagctctaatggaaagtg

SEQ ID NO: 7686455 - DNA, 22 bp, Homo sapiens
caggcagctctaatggaaagtg

SEQ ID NO: 7686456 - DNA, 22 bp, Homo sapiens
caggcagctctaatggaaagtg

SEQ ID NO: 7686457 - DNA, 22 bp, Homo sapiens
caggcagctctaatggaaagtg

SEQ ID NO: 7686458 - DNA, 22 bp, Homo sapiens
caggcagctctaatggaaagtg

SEQ ID NO: 7686459 - DNA, 22 bp, Homo sapiens
caggcagctctgcttttcctaa

SEQ ID NO: 7686460 - DNA, 22 bp, Homo sapiens
caggcagctctaatggaaagtg

SEQ ID NO: 7686461 - DNA, 22 bp, Homo sapiens
caggcagctctaatggaaagtg

SEQ ID NO: 7686462 - DNA, 22 bp, Homo sapiens
caggcagctcgatgccttgttg

SEQ ID NO: 7686463 - DNA, 22 bp, Homo sapiens
caggcagcctgcggtctgcaca

SEQ ID NO: 7686464 - DNA, 22 bp, Homo sapiens
caggcagctctaatggaaagtg

SEQ ID NO: 7686465 - DNA, 22 bp, Homo sapiens
caggcagctctaatggaaagtg

SEQ ID NO: 7686466 - DNA, 22 bp, Homo sapiens
caggcagcctgagggatctggg

SEQ ID NO: 7686467 - DNA, 22 bp, Homo sapiens
caggcagcctgagggatctggg

SEQ ID NO: 7686468 - DNA, 22 bp, Homo sapiens
caggcagcctgagggatctggg

SEQ ID NO: 7686469 - DNA, 22 bp, Homo sapiens
caggcagccaggggacctgtcc

SEQ ID NO: 7686470 - DNA, 22 bp, Homo sapiens
caggcagccaggggacctgtcc

SEQ ID NO: 7686471 - DNA, 22 bp, Homo sapiens
caggcagccctgcaccaagtgt

SEQ ID NO: 7686472 - DNA, 22 bp, Homo sapiens
caggcagccctgcaccaagtgt

SEQ ID NO: 7686473 - DNA, 22 bp, Homo sapiens
caggcagccctgcaccaagtgt

SEQ ID NO: 7686474 - DNA, 22 bp, Homo sapiens
caggcagcctgagggatctggg

SEQ ID NO: 7686475 - DNA, 22 bp, Homo sapiens
caggcagcctgagggatctggg

SEQ ID NO: 7686476 - DNA, 22 bp, Homo sapiens
caggcagcctgagggatctggg

SEQ ID NO: 7686477 - DNA, 22 bp, Homo sapiens
caggcaggctgctttttgttca

SEQ ID NO: 7686478 - DNA, 23 bp, Homo sapiens
caggcaggatgaggactacactc

SEQ ID NO: 7686479 - DNA, 22 bp, Homo sapiens
caggcaggctgctttttgttca

SEQ ID NO: 7686480 - DNA, 22 bp, Homo sapiens
caggcaggctgctttttgttca

SEQ ID NO: 7686481 - DNA, 22 bp, Homo sapiens
caggcaggctgctttttgttca

SEQ ID NO: 7686482 - DNA, 22 bp, Homo sapiens
caggcagggagccactgtataa

SEQ ID NO: 7686483 - DNA, 22 bp, Homo sapiens
caggcagggagccactgtataa

SEQ ID NO: 7686484 - DNA, 22 bp, Homo sapiens
caggcagggagccactgtataa

SEQ ID NO: 7686485 - DNA, 22 bp, Homo sapiens
caggcagggagccactgtataa

SEQ ID NO: 7686486 - DNA, 22 bp, Homo sapiens
caggcaggagccagggattcca

SEQ ID NO: 7686487 - DNA, 23 bp, Homo sapiens
caggcaggatgaggactacactc

SEQ ID NO: 7686488 - DNA, 23 bp, Homo sapiens
caggcaggatgaggactacactc

SEQ ID NO: 7686489 - DNA, 23 bp, Homo sapiens
caggcaggatgaggactacactc

SEQ ID NO: 7686490 - DNA, 23 bp, Homo sapiens
caggcaggatgaggactacactc

SEQ ID NO: 7686491 - DNA, 23 bp, Homo sapiens
caggcaggatgaggactacactc

SEQ ID NO: 7686492 - DNA, 23 bp, Homo sapiens
caggcaggatgaggactacactc

SEQ ID NO: 7686493 - DNA, 23 bp, Homo sapiens
caggcaggatgaggactacactc

SEQ ID NO: 7686494 - DNA, 23 bp, Homo sapiens
caggcaggatgaggactacactc

SEQ ID NO: 7686495 - DNA, 22 bp, Homo sapiens
caggcaggagaggaggatttct

SEQ ID NO: 7686496 - DNA, 22 bp, Homo sapiens
caggcaggagaggaggatttct

SEQ ID NO: 7686497 - DNA, 22 bp, Homo sapiens
caggcaggagacatttggttgg

SEQ ID NO: 7686498 - DNA, 22 bp, Homo sapiens
caggcaggagacatttggttgg

SEQ ID NO: 7686499 - DNA, 22 bp, Homo sapiens
caggcaggagaggaggatttct

SEQ ID NO: 7686500 - DNA, 22 bp, Homo sapiens
caggcaggagaggaggatttct

SEQ ID NO: 7686501 - DNA, 22 bp, Homo sapiens
caggcaggagaggaggatttct

SEQ ID NO: 7686502 - DNA, 22 bp, Homo sapiens
caggcaggagaggaggatttct

SEQ ID NO: 7686503 - DNA, 22 bp, Homo sapiens
caggcaggagccagggattcca

SEQ ID NO: 7686504 - DNA, 22 bp, Homo sapiens
caggcaggagccagggattcca

SEQ ID NO: 7686505 - DNA, 22 bp, Homo sapiens
caggcaggagccagggattcca

SEQ ID NO: 7686506 - DNA, 22 bp, Homo sapiens
caggcaggagccagggattcca

SEQ ID NO: 7686507 - DNA, 22 bp, Homo sapiens
caggcaggagccagggattcca

SEQ ID NO: 7686508 - DNA, 22 bp, Homo sapiens
caggcaggagccagggattcca

SEQ ID NO: 7686509 - DNA, 22 bp, Homo sapiens
caggcaggagccagggattcca

SEQ ID NO: 7686510 - DNA, 23 bp, Homo sapiens
caggcaggatgaggactacactc

SEQ ID NO: 7686511 - DNA, 22 bp, Homo sapiens
caggcaggagacatttggttgg

SEQ ID NO: 7686512 - DNA, 22 bp, Homo sapiens
caggcaggagccagggattcca

SEQ ID NO: 7686513 - DNA, 22 bp, Homo sapiens
caggcaggagacatttggttgg

SEQ ID NO: 7686514 - DNA, 22 bp, Homo sapiens
caggcaggagacatttggttgg

SEQ ID NO: 7686515 - DNA, 22 bp, Homo sapiens
caggcagctgggtcaccgtccc

SEQ ID NO: 7686516 - DNA, 22 bp, Homo sapiens
caggcagctgggtcaccgtccc

SEQ ID NO: 7686517 - DNA, 22 bp, Homo sapiens
caggcagctgggtcaccgtccc

SEQ ID NO: 7686518 - DNA, 22 bp, Homo sapiens
caggcagctgggtcaccgtccc

SEQ ID NO: 7686519 - DNA, 22 bp, Homo sapiens
caggcagctgctgggttcagcc

SEQ ID NO: 7686520 - DNA, 22 bp, Homo sapiens
caggcagctgctgggttcagcc

SEQ ID NO: 7686521 - DNA, 22 bp, Homo sapiens
caggcagctgctgggttcagcc

SEQ ID NO: 7686522 - DNA, 22 bp, Homo sapiens
caggcagctgctgggttcagcc

SEQ ID NO: 7686523 - DNA, 22 bp, Homo sapiens
caggcagctgctgggttcagcc

SEQ ID NO: 7686524 - DNA, 22 bp, Homo sapiens
caggcagctgctgggttcagcc

SEQ ID NO: 7686525 - DNA, 22 bp, Homo sapiens
caggcagctgctgggttcagcc

SEQ ID NO: 7686526 - DNA, 22 bp, Homo sapiens
caggcagctgaggactttgcta

SEQ ID NO: 7686527 - DNA, 22 bp, Homo sapiens
caggcagctgcgacaagagagc

SEQ ID NO: 7686528 - DNA, 22 bp, Homo sapiens
caggcagctgaggactttgcta

SEQ ID NO: 7686529 - DNA, 22 bp, Homo sapiens
caggcagctgaggactttgcta

SEQ ID NO: 7686530 - DNA, 22 bp, Homo sapiens
caggcagctgactgtcagatat

SEQ ID NO: 7686531 - DNA, 22 bp, Homo sapiens
caggcagctgaggactttgcta

SEQ ID NO: 7686532 - DNA, 22 bp, Homo sapiens
caggcagctgactgtcagatat

SEQ ID NO: 7686533 - DNA, 22 bp, Homo sapiens
caggcagctgaggactttgcta

SEQ ID NO: 7686534 - DNA, 22 bp, Homo sapiens
caggcagctgcgacaagagagc

SEQ ID NO: 7686535 - DNA, 22 bp, Homo sapiens
caggcagctgcgacaagagagc

SEQ ID NO: 7686536 - DNA, 22 bp, Homo sapiens
caggcagctgcgacaagagagc

SEQ ID NO: 7686537 - DNA, 22 bp, Homo sapiens
caggcagctgctgggttcagcc

SEQ ID NO: 7686538 - DNA, 22 bp, Homo sapiens
caggcagctgcgacaagagagc

SEQ ID NO: 7686539 - DNA, 22 bp, Homo sapiens
caggcagctgcgacaagagagc

SEQ ID NO: 7686540 - DNA, 22 bp, Homo sapiens
caggcagctgaggactttgcta

SEQ ID NO: 7686541 - DNA, 22 bp, Homo sapiens
caggcagctgcgacaagagagc

SEQ ID NO: 7686542 - DNA, 22 bp, Homo sapiens
caggcagctgcgacaagagagc

SEQ ID NO: 7686543 - DNA, 22 bp, Homo sapiens
caggcagctgcgacaagagagc

SEQ ID NO: 7686544 - DNA, 22 bp, Homo sapiens
caggcagctgcgacaagagagc

SEQ ID NO: 7686545 - DNA, 22 bp, Homo sapiens
caggcagagaggagcatttaat

SEQ ID NO: 7686546 - DNA, 22 bp, Homo sapiens
caggcagagacgtcagtgtagg

SEQ ID NO: 7686547 - DNA, 22 bp, Homo sapiens
caggcagagaggagcatttaat

SEQ ID NO: 7686548 - DNA, 22 bp, Homo sapiens
caggcagagaggagcatttaat

SEQ ID NO: 7686549 - DNA, 22 bp, Homo sapiens
caggcagagcaactggtccaga

SEQ ID NO: 7686550 - DNA, 22 bp, Homo sapiens
caggcagagaggagcatttaat

SEQ ID NO: 7686551 - DNA, 22 bp, Homo sapiens
caggcagagacgtcagtgtagg

SEQ ID NO: 7686552 - DNA, 22 bp, Homo sapiens
caggcagagacgtcagtgtagg

SEQ ID NO: 7686553 - DNA, 22 bp, Homo sapiens
caggcagagaccctctcctaaa

SEQ ID NO: 7686554 - DNA, 22 bp, Homo sapiens
caggcagagaccctctcctaaa

SEQ ID NO: 7686555 - DNA, 22 bp, Homo sapiens
caggcagagaccctctcctaaa

SEQ ID NO: 7686556 - DNA, 22 bp, Homo sapiens
caggcagagacgtcagtgtagg

SEQ ID NO: 7686557 - DNA, 22 bp, Homo sapiens
caggcagagacgtcagtgtagg

SEQ ID NO: 7686558 - DNA, 22 bp, Homo sapiens
caggcagagacgtcagtgtagg

SEQ ID NO: 7686559 - DNA, 22 bp, Homo sapiens
caggcagagaccctctcctaaa

SEQ ID NO: 7686560 - DNA, 22 bp, Homo sapiens
caggcagagacgtcagtgtagg

SEQ ID NO: 7686561 - DNA, 22 bp, Homo sapiens
caggcagagacgtcagtgtagg

SEQ ID NO: 7686562 - DNA, 22 bp, Homo sapiens
caggcagactttgagaatgatg

SEQ ID NO: 7686563 - DNA, 22 bp, Homo sapiens
caggcagactttgagaatgatg

SEQ ID NO: 7686564 - DNA, 22 bp, Homo sapiens
caggcagactttgagaatgatg

SEQ ID NO: 7686565 - DNA, 22 bp, Homo sapiens
caggcagactttgagaatgatg

SEQ ID NO: 7686566 - DNA, 22 bp, Homo sapiens
caggcagacatttttgacatag

SEQ ID NO: 7686567 - DNA, 17 bp, Homo sapiens
caggcagacatgtaagc

SEQ ID NO: 7686568 - DNA, 17 bp, Homo sapiens
caggcagacatgtaagc

SEQ ID NO: 7686569 - DNA, 17 bp, Homo sapiens
caggcagacatgtaagc

SEQ ID NO: 7686570 - DNA, 17 bp, Homo sapiens
caggcagacatgtaagc

SEQ ID NO: 7686571 - DNA, 22 bp, Homo sapiens
caggcagacatttttgacatag

SEQ ID NO: 7686572 - DNA, 22 bp, Homo sapiens
caggcagagaccctctcctaaa

SEQ ID NO: 7686573 - DNA, 22 bp, Homo sapiens
caggcagagaccctctcctaaa

SEQ ID NO: 7686574 - DNA, 22 bp, Homo sapiens
caggcagagaccctctcctaaa

SEQ ID NO: 7686575 - DNA, 22 bp, Homo sapiens
caggcagagaccctctcctaaa

SEQ ID NO: 7686576 - DNA, 22 bp, Homo sapiens
caggcagagaactcatccgtga

SEQ ID NO: 7686577 - DNA, 22 bp, Homo sapiens
caggcagagaactcatccgtga

SEQ ID NO: 7686578 - DNA, 22 bp, Homo sapiens
caggcagagaactcatccgtga

SEQ ID NO: 7686579 - DNA, 22 bp, Homo sapiens
caggcagagaactcatccgtga

SEQ ID NO: 7686580 - DNA, 22 bp, Homo sapiens
caggcagactttgagaatgatg

SEQ ID NO: 7686581 - DNA, 22 bp, Homo sapiens
caggcagactttgagaatgatg

SEQ ID NO: 7686582 - DNA, 22 bp, Homo sapiens
caggcagaagaagtggaaggac

SEQ ID NO: 7686583 - DNA, 22 bp, Homo sapiens
caggcagaagaagtggaaggac

SEQ ID NO: 7686584 - DNA, 22 bp, Homo sapiens
caggcagaagaagtggaaggac

SEQ ID NO: 7686585 - DNA, 22 bp, Homo sapiens
caggcagaagaagtggaaggac

SEQ ID NO: 7686586 - DNA, 22 bp, Homo sapiens
caggcagaaattttgtttcatt

SEQ ID NO: 7686587 - DNA, 22 bp, Homo sapiens
caggcagaaattttgtttcatt

SEQ ID NO: 7686588 - DNA, 22 bp, Homo sapiens
caggcagaaattttgtttcatt

SEQ ID NO: 7686589 - DNA, 22 bp, Homo sapiens
caggcagaaggaagtaccaggc

SEQ ID NO: 7686590 - DNA, 22 bp, Homo sapiens
caggcagaagaagtggaaggac

SEQ ID NO: 7686591 - DNA, 22 bp, Homo sapiens
caggcagaaggaagtaccaggc

SEQ ID NO: 7686592 - DNA, 22 bp, Homo sapiens
caggcagaaggaagtaccaggc

SEQ ID NO: 7686593 - DNA, 22 bp, Homo sapiens
caggcagaaggaagtaccaggc

SEQ ID NO: 7686594 - DNA, 22 bp, Homo sapiens
caggcagaaggaagtaccaggc

SEQ ID NO: 7686595 - DNA, 22 bp, Homo sapiens
caggcagaaggaagtaccaggc

SEQ ID NO: 7686596 - DNA, 22 bp, Homo sapiens
caggcagaaggaagtaccaggc

SEQ ID NO: 7686597 - DNA, 22 bp, Homo sapiens
caggcagaaggaagtaccaggc

SEQ ID NO: 7686598 - DNA, 22 bp, Homo sapiens
caggcagaaggaagtaccaggc

SEQ ID NO: 7686599 - DNA, 22 bp, Homo sapiens
caggcagaaggaagtaccaggc

SEQ ID NO: 7686600 - DNA, 22 bp, Homo sapiens
caggcagaatgaccgacctcgc

SEQ ID NO: 7686601 - DNA, 22 bp, Homo sapiens
caggcagaaggaagtaccaggc

SEQ ID NO: 7686602 - DNA, 22 bp, Homo sapiens
caggcagaaggaagtaccaggc

SEQ ID NO: 7686603 - DNA, 22 bp, Homo sapiens
caggcagaaggaagtaccaggc

SEQ ID NO: 7686604 - DNA, 22 bp, Homo sapiens
caggcagaaggaagtaccaggc

SEQ ID NO: 7686605 - DNA, 22 bp, Homo sapiens
caggcagaaggaagtaccaggc

SEQ ID NO: 7686606 - DNA, 22 bp, Homo sapiens
caggcagaatgagattacttca

SEQ ID NO: 7686607 - DNA, 17 bp, Homo sapiens
caggcagacatgtaagc

SEQ ID NO: 7686608 - DNA, 17 bp, Homo sapiens
caggcagacatgtaagc

SEQ ID NO: 7686609 - DNA, 17 bp, Homo sapiens
caggcagacatgtaagc

SEQ ID NO: 7686610 - DNA, 17 bp, Homo sapiens
caggcagacatgtaagc

SEQ ID NO: 7686611 - DNA, 22 bp, Homo sapiens
caggcagaatgagattacttca

SEQ ID NO: 7686612 - DNA, 22 bp, Homo sapiens
caggcagaatgagattacttca

SEQ ID NO: 7686613 - DNA, 22 bp, Homo sapiens
caggcagaatgagattacttca

SEQ ID NO: 7686614 - DNA, 22 bp, Homo sapiens
caggcagaatgaccgacctcgc

SEQ ID NO: 7686615 - DNA, 22 bp, Homo sapiens
caggcagaatgagattacttca

SEQ ID NO: 7686616 - DNA, 22 bp, Homo sapiens
caggcagaatgagattacttca

SEQ ID NO: 7686617 - DNA, 22 bp, Homo sapiens
caggcagagcaactggtccaga

SEQ ID NO: 7686618 - DNA, 22 bp, Homo sapiens
caggcagagcaactggtccaga

SEQ ID NO: 7686619 - DNA, 22 bp, Homo sapiens
caggcagagcaactggtccaga

SEQ ID NO: 7686620 - DNA, 22 bp, Homo sapiens
caggcagagcaactggtccaga

SEQ ID NO: 7686621 - DNA, 22 bp, Homo sapiens
caggcagagcaactggtccaga

SEQ ID NO: 7686622 - DNA, 22 bp, Homo sapiens
caggcagagcaactggtccaga

SEQ ID NO: 7686623 - DNA, 22 bp, Homo sapiens
caggcagagcaactggtccaga

SEQ ID NO: 7686624 - DNA, 22 bp, Homo sapiens
caggcagagcaactggtccaga

SEQ ID NO: 7686625 - DNA, 22 bp, Homo sapiens
caggcagagcaactggtccaga

SEQ ID NO: 7686626 - DNA, 22 bp, Homo sapiens
caggcagagcaactggtccaga

SEQ ID NO: 7686627 - DNA, 22 bp, Homo sapiens
caggcagagcaactggtccaga

SEQ ID NO: 7686628 - DNA, 22 bp, Homo sapiens
caggcagagcaactggtccaga

SEQ ID NO: 7686629 - DNA, 22 bp, Homo sapiens
taatgtttagaagcagacagct

SEQ ID NO: 7686630 - DNA, 22 bp, Homo sapiens
taatgtttagaagcagacagct

SEQ ID NO: 7686631 - DNA, 22 bp, Homo sapiens
taatgttataaattcttggttt

SEQ ID NO: 7686632 - DNA, 22 bp, Homo sapiens
taatgttgctgtagaaagtcaa

SEQ ID NO: 7686633 - DNA, 22 bp, Homo sapiens
taatgttataaattcttggttt

SEQ ID NO: 7686634 - DNA, 22 bp, Homo sapiens
caggcagagccaatcgtggggt

SEQ ID NO: 7686635 - DNA, 22 bp, Homo sapiens
caggcagagccaatcgtggggt

SEQ ID NO: 7686636 - DNA, 22 bp, Homo sapiens
taatgttagtatgtaatcttat

SEQ ID NO: 7686637 - DNA, 22 bp, Homo sapiens
taatgttagtatgtaatcttat

SEQ ID NO: 7686638 - DNA, 22 bp, Homo sapiens
taatgttagtatgtaatcttat

SEQ ID NO: 7686639 - DNA, 22 bp, Homo sapiens
caggcagagccaatcgtggggt

SEQ ID NO: 7686640 - DNA, 22 bp, Homo sapiens
taattggtgagagagctgagtc

SEQ ID NO: 7686641 - DNA, 22 bp, Homo sapiens
taattgtaaagtagtagtacag

SEQ ID NO: 7686642 - DNA, 22 bp, Homo sapiens
taattgggcaatttaggactag

SEQ ID NO: 7686643 - DNA, 22 bp, Homo sapiens
taatgtttagaagcagacagct

SEQ ID NO: 7686644 - DNA, 22 bp, Homo sapiens
taattgtaaagtagtagtacag

SEQ ID NO: 7686645 - DNA, 22 bp, Homo sapiens
taattgtaaagtagtagtacag

SEQ ID NO: 7686646 - DNA, 22 bp, Homo sapiens
taattgtaaagtagtagtacag

SEQ ID NO: 7686647 - DNA, 22 bp, Homo sapiens
taattgtacgatgttaaatcag

SEQ ID NO: 7686648 - DNA, 22 bp, Homo sapiens
taattgtacgatgttaaatcag

SEQ ID NO: 7686649 - DNA, 22 bp, Homo sapiens
taattgtacgatgttaaatcag

SEQ ID NO: 7686650 - DNA, 22 bp, Homo sapiens
taattgtatggagaaggctgca

SEQ ID NO: 7686651 - DNA, 22 bp, Homo sapiens
taattgtatggagaaggctgca

SEQ ID NO: 7686652 - DNA, 22 bp, Homo sapiens
taattgtagctttgtaatcagc

SEQ ID NO: 7686653 - DNA, 22 bp, Homo sapiens
taattgtagctttgtaatcagc

SEQ ID NO: 7686654 - DNA, 22 bp, Homo sapiens
taattgtagctttgtaatcagc

SEQ ID NO: 7686655 - DNA, 22 bp, Homo sapiens
taattgtagctttgtaatcagc

SEQ ID NO: 7686656 - DNA, 22 bp, Homo sapiens
taattgtactccctgtgggaaa

SEQ ID NO: 7686657 - DNA, 22 bp, Homo sapiens
taattgtactccctgtgggaaa

SEQ ID NO: 7686658 - DNA, 22 bp, Homo sapiens
taatttaattccatggattcta

SEQ ID NO: 7686659 - DNA, 22 bp, Homo sapiens
taatttaattccatggattcta

SEQ ID NO: 7686660 - DNA, 22 bp, Homo sapiens
taatttaatccaagtgttacat

SEQ ID NO: 7686661 - DNA, 22 bp, Homo sapiens
taatttaatccaagtgttacat

SEQ ID NO: 7686662 - DNA, 22 bp, Homo sapiens
taatttaatccaagtgttacat

SEQ ID NO: 7686663 - DNA, 22 bp, Homo sapiens
taatttaatccaagtgttacat

SEQ ID NO: 7686664 - DNA, 22 bp, Homo sapiens
taatttaatccaagtgttacat

SEQ ID NO: 7686665 - DNA, 22 bp, Homo sapiens
taattgttttcaatgttaatga

SEQ ID NO: 7686666 - DNA, 22 bp, Homo sapiens
taatttaatccaagtgttacat

SEQ ID NO: 7686667 - DNA, 22 bp, Homo sapiens
taattgtatggagaaggctgca

SEQ ID NO: 7686668 - DNA, 22 bp, Homo sapiens
taattgtcctcggtccaaatga

SEQ ID NO: 7686669 - DNA, 22 bp, Homo sapiens
taatttacttgcaaataacaat

SEQ ID NO: 7686670 - DNA, 22 bp, Homo sapiens
taatttactcagatgttcaatc

SEQ ID NO: 7686671 - DNA, 22 bp, Homo sapiens
taatttacttgcaaataacaat

SEQ ID NO: 7686672 - DNA, 22 bp, Homo sapiens
taatttacttgcaaataacaat

SEQ ID NO: 7686673 - DNA, 22 bp, Homo sapiens
taatttacttgcaaataacaat

SEQ ID NO: 7686674 - DNA, 22 bp, Homo sapiens
taatttacttgcaaataacaat

SEQ ID NO: 7686675 - DNA, 22 bp, Homo sapiens
taatttacagttcgccatgtct

SEQ ID NO: 7686676 - DNA, 22 bp, Homo sapiens
taatttacagttcgccatgtct

SEQ ID NO: 7686677 - DNA, 22 bp, Homo sapiens
taatttacagttcgccatgtct

SEQ ID NO: 7686678 - DNA, 22 bp, Homo sapiens
taatttacagttcgccatgtct

SEQ ID NO: 7686679 - DNA, 22 bp, Homo sapiens
taatttactcagatgttcaatc

SEQ ID NO: 7686680 - DNA, 22 bp, Homo sapiens
taatttactcagatgttcaatc

SEQ ID NO: 7686681 - DNA, 22 bp, Homo sapiens
taatttactcagatgttcaatc

SEQ ID NO: 7686682 - DNA, 22 bp, Homo sapiens
taatttactcagatgttcaatc

SEQ ID NO: 7686683 - DNA, 22 bp, Homo sapiens
taatttacagagatacagtcag

SEQ ID NO: 7686684 - DNA, 22 bp, Homo sapiens
taatttaatttcatgccagcct

SEQ ID NO: 7686685 - DNA, 22 bp, Homo sapiens
taatttacagagatacagtcag

SEQ ID NO: 7686686 - DNA, 22 bp, Homo sapiens
taatttaatttcatgccagcct

SEQ ID NO: 7686687 - DNA, 22 bp, Homo sapiens
taatttaatttcatgccagcct

SEQ ID NO: 7686688 - DNA, 22 bp, Homo sapiens
taatttaatttcatgccagcct

SEQ ID NO: 7686689 - DNA, 22 bp, Homo sapiens
taatttaattccatggattcta

SEQ ID NO: 7686690 - DNA, 22 bp, Homo sapiens
taatttaattccatggattcta

SEQ ID NO: 7686691 - DNA, 22 bp, Homo sapiens
taaggcagccgctcagagaggt

SEQ ID NO: 7686692 - DNA, 22 bp, Homo sapiens
taaggcagccgctcagagaggt

SEQ ID NO: 7686693 - DNA, 22 bp, Homo sapiens
taaggcagcataattaggccac

SEQ ID NO: 7686694 - DNA, 22 bp, Homo sapiens
taaggcagcataattaggccac

SEQ ID NO: 7686695 - DNA, 19 bp, Homo sapiens
taaggcagcagtgacaggc

SEQ ID NO: 7686696 - DNA, 19 bp, Homo sapiens
taaggcagcagtgacaggc

SEQ ID NO: 7686697 - DNA, 19 bp, Homo sapiens
taaggcagcagtgacaggc

SEQ ID NO: 7686698 - DNA, 22 bp, Homo sapiens
taaggcagatgtggaatcaatt

SEQ ID NO: 7686699 - DNA, 19 bp, Homo sapiens
taaggcagcagtgacaggc

SEQ ID NO: 7686700 - DNA, 22 bp, Homo sapiens
taaggcagatgtggaatcaatt

SEQ ID NO: 7686701 - DNA, 22 bp, Homo sapiens
taaggcagatgtggaatcaatt

SEQ ID NO: 7686702 - DNA, 22 bp, Homo sapiens
taaggcagaggtaccactaggc

SEQ ID NO: 7686703 - DNA, 22 bp, Homo sapiens
taaggcagatgtggaatcaatt

SEQ ID NO: 7686704 - DNA, 22 bp, Homo sapiens
taaggcagaggtaccactaggc

SEQ ID NO: 7686705 - DNA, 22 bp, Homo sapiens
taaggcagaggtaccactaggc

SEQ ID NO: 7686706 - DNA, 22 bp, Homo sapiens
taaggcagaaatatgagcaggg

SEQ ID NO: 7686707 - DNA, 22 bp, Homo sapiens
taaggcagaaatatgagcaggg

SEQ ID NO: 7686708 - DNA, 22 bp, Homo sapiens
caggcactcagtctggatccct

SEQ ID NO: 7686709 - DNA, 22 bp, Homo sapiens
caggcactcagtctggatccct

SEQ ID NO: 7686710 - DNA, 22 bp, Homo sapiens
caggcactttgctgggggcgca

SEQ ID NO: 7686711 - DNA, 22 bp, Homo sapiens
caggcactagcagaatgaggct

SEQ ID NO: 7686712 - DNA, 22 bp, Homo sapiens
caggcactcagtctggatccct

SEQ ID NO: 7686713 - DNA, 22 bp, Homo sapiens
caggcagaaagtattctgtgta

SEQ ID NO: 7686714 - DNA, 22 bp, Homo sapiens
caggcactttgctgggggcgca

SEQ ID NO: 7686715 - DNA, 22 bp, Homo sapiens
caggcactttgctgggggcgca

SEQ ID NO: 7686716 - DNA, 22 bp, Homo sapiens
caggcagaaagtattctgtgta

SEQ ID NO: 7686717 - DNA, 22 bp, Homo sapiens
caggcagaaagtattctgtgta

SEQ ID NO: 7686718 - DNA, 22 bp, Homo sapiens
caggcagaaagtattctgtgta

SEQ ID NO: 7686719 - DNA, 22 bp, Homo sapiens
caggcagaaagtattctgtgta

SEQ ID NO: 7686720 - DNA, 22 bp, Homo sapiens
caggcagaaagtattctgtgta

SEQ ID NO: 7686721 - DNA, 22 bp, Homo sapiens
caggcagaaattttgtttcatt

SEQ ID NO: 7686722 - DNA, 22 bp, Homo sapiens
caggcagaaattttgtttcatt

SEQ ID NO: 7686723 - DNA, 22 bp, Homo sapiens
caggcagaaattttgtttcatt

SEQ ID NO: 7686724 - DNA, 22 bp, Homo sapiens
caggcagaaattttgtttcatt

SEQ ID NO: 7686725 - DNA, 22 bp, Homo sapiens
taaggcagcctcagggtagggt

SEQ ID NO: 7686726 - DNA, 22 bp, Homo sapiens
taaggcagccgctcagagaggt

SEQ ID NO: 7686727 - DNA, 22 bp, Homo sapiens
taaggcagccgctcagagaggt

SEQ ID NO: 7686728 - DNA, 22 bp, Homo sapiens
caggcactagcagaatgaggct

SEQ ID NO: 7686729 - DNA, 22 bp, Homo sapiens
caggcactagcagaatgaggct

SEQ ID NO: 7686730 - DNA, 22 bp, Homo sapiens
taaggcagccgctcagagaggt

SEQ ID NO: 7686731 - DNA, 22 bp, Homo sapiens
taaggcagcctcagggtagggt

SEQ ID NO: 7686732 - DNA, 22 bp, Homo sapiens
caggcactagcagaatgaggct

SEQ ID NO: 7686733 - DNA, 22 bp, Homo sapiens
caggcactcagtctggatccct

SEQ ID NO: 7686734 - DNA, 22 bp, Homo sapiens
caggcactagcagaatgaggct

SEQ ID NO: 7686735 - DNA, 22 bp, Homo sapiens
taaggcagaaatatgagcaggg

SEQ ID NO: 7686736 - DNA, 22 bp, Homo sapiens
taaggcagaaatatgagcaggg

SEQ ID NO: 7686737 - DNA, 22 bp, Homo sapiens
taaggcagaaatatgagcaggg

SEQ ID NO: 7686738 - DNA, 22 bp, Homo sapiens
taaggcacgcataagagggggc

SEQ ID NO: 7686739 - DNA, 22 bp, Homo sapiens
taaggcacccgtgagctgccag

SEQ ID NO: 7686740 - DNA, 22 bp, Homo sapiens
taagcaaatagctagatcagag

SEQ ID NO: 7686741 - DNA, 22 bp, Homo sapiens
taagcaaatagctagatcagag

SEQ ID NO: 7686742 - DNA, 22 bp, Homo sapiens
taagcaaatagctagatcagag

SEQ ID NO: 7686743 - DNA, 22 bp, Homo sapiens
taagcaaatagctagatcagag

SEQ ID NO: 7686744 - DNA, 22 bp, Homo sapiens
taagcaaatagctagatcagag

SEQ ID NO: 7686745 - DNA, 22 bp, Homo sapiens
taagcaaatagctagatcagag

SEQ ID NO: 7686746 - DNA, 22 bp, Homo sapiens
taagcaaataatgcatcaaggg

SEQ ID NO: 7686747 - DNA, 22 bp, Homo sapiens
taagcaaataatgcatcaaggg

SEQ ID NO: 7686748 - DNA, 22 bp, Homo sapiens
taagcaaatagctagatcagag

SEQ ID NO: 7686749 - DNA, 22 bp, Homo sapiens
taagcaaataatgcatcaaggg

SEQ ID NO: 7686750 - DNA, 22 bp, Homo sapiens
taagcaaataatgcatcaaggg

SEQ ID NO: 7686751 - DNA, 22 bp, Homo sapiens
taaggcacacagttgctgcatg

SEQ ID NO: 7686752 - DNA, 22 bp, Homo sapiens
taaggcacacagttgctgcatg

SEQ ID NO: 7686753 - DNA, 22 bp, Homo sapiens
taagcaacaaggtgtttaaatt

SEQ ID NO: 7686754 - DNA, 22 bp, Homo sapiens
taagattatacttaaagagaaa

SEQ ID NO: 7686755 - DNA, 22 bp, Homo sapiens
taagattatacttaaagagaaa

SEQ ID NO: 7686756 - DNA, 22 bp, Homo sapiens
taagatttttaaaatgtcctca

SEQ ID NO: 7686757 - DNA, 22 bp, Homo sapiens
taagatttttaaaatgtcctca

SEQ ID NO: 7686758 - DNA, 22 bp, Homo sapiens
taagatttttaaaatgtcctca

SEQ ID NO: 7686759 - DNA, 22 bp, Homo sapiens
taagattacagtgagaaataaa

SEQ ID NO: 7686760 - DNA, 22 bp, Homo sapiens
taagattacagtgagaaataaa

SEQ ID NO: 7686761 - DNA, 22 bp, Homo sapiens
taagattacagtgagaaataaa

SEQ ID NO: 7686762 - DNA, 22 bp, Homo sapiens
taagattacagtgagaaataaa

SEQ ID NO: 7686763 - DNA, 22 bp, Homo sapiens
taagattatacttaaagagaaa

SEQ ID NO: 7686764 - DNA, 22 bp, Homo sapiens
taagatgttttggtttgataag

SEQ ID NO: 7686765 - DNA, 22 bp, Homo sapiens
taagattacagtgagaaataaa

SEQ ID NO: 7686766 - DNA, 22 bp, Homo sapiens
taagattacagtgagaaataaa

SEQ ID NO: 7686767 - DNA, 22 bp, Homo sapiens
taagatgtggaatcacagcttc

SEQ ID NO: 7686768 - DNA, 22 bp, Homo sapiens
taagatgtttacagtatggaga

SEQ ID NO: 7686769 - DNA, 22 bp, Homo sapiens
taagatgttttggtttgataag

SEQ ID NO: 7686770 - DNA, 22 bp, Homo sapiens
taagatgtcatccacatagagt

SEQ ID NO: 7686771 - DNA, 22 bp, Homo sapiens
taagatgtctaagaggagatgc

SEQ ID NO: 7686772 - DNA, 22 bp, Homo sapiens
taagatgtcatccacatagagt

SEQ ID NO: 7686773 - DNA, 22 bp, Homo sapiens
taagatgtggaatcacagcttc

SEQ ID NO: 7686774 - DNA, 22 bp, Homo sapiens
taagcaaataatgcatcaaggg

SEQ ID NO: 7686775 - DNA, 22 bp, Homo sapiens
taagcaaataatgcatcaaggg

SEQ ID NO: 7686776 - DNA, 22 bp, Homo sapiens
taagcaaataatgcatcaaggg

SEQ ID NO: 7686777 - DNA, 22 bp, Homo sapiens
taagcaaataatgcatcaaggg

SEQ ID NO: 7686778 - DNA, 22 bp, Homo sapiens
taagcaaataatgcatcaaggg

SEQ ID NO: 7686779 - DNA, 22 bp, Homo sapiens
taagcaaagtttataaggctct

SEQ ID NO: 7686780 - DNA, 22 bp, Homo sapiens
taagcaaagtttataaggctct

SEQ ID NO: 7686781 - DNA, 22 bp, Homo sapiens
taagcaaaggattttgatcttt

SEQ ID NO: 7686782 - DNA, 22 bp, Homo sapiens
taagcaaaggattttgatcttt

SEQ ID NO: 7686783 - DNA, 22 bp, Homo sapiens
taagcaaaggattttgatcttt

SEQ ID NO: 7686784 - DNA, 22 bp, Homo sapiens
taagcaaaggattttgatcttt

SEQ ID NO: 7686785 - DNA, 22 bp, Homo sapiens
taagcaaaggattttgatcttt

SEQ ID NO: 7686786 - DNA, 22 bp, Homo sapiens
taagcaaagtttataaggctct

SEQ ID NO: 7686787 - DNA, 22 bp, Homo sapiens
taagcaaaagtcgagtgtgagc

SEQ ID NO: 7686788 - DNA, 22 bp, Homo sapiens
taagcaaaagtcgagtgtgagc

SEQ ID NO: 7686789 - DNA, 22 bp, Homo sapiens
taagcaaaagtcgagtgtgagc

SEQ ID NO: 7686790 - DNA, 22 bp, Homo sapiens
taagatttttaaaatgtcctca

SEQ ID NO: 7686791 - DNA, 22 bp, Homo sapiens
taagcaaaggattttgatcttt

SEQ ID NO: 7686792 - DNA, 22 bp, Homo sapiens
taagcaaaggattttgatcttt

SEQ ID NO: 7686793 - DNA, 22 bp, Homo sapiens
taagcaaaggattttgatcttt

SEQ ID NO: 7686794 - DNA, 22 bp, Homo sapiens
taagcaaaggattttgatcttt

SEQ ID NO: 7686795 - DNA, 22 bp, Homo sapiens
taagcaaaggattttgatcttt

SEQ ID NO: 7686796 - DNA, 22 bp, Homo sapiens
taagcaaaagtcgagtgtgagc

SEQ ID NO: 7686797 - DNA, 22 bp, Homo sapiens
taagatgtacaaccacttctct

SEQ ID NO: 7686798 - DNA, 22 bp, Homo sapiens
taagatgtacaaccacttctct

SEQ ID NO: 7686799 - DNA, 22 bp, Homo sapiens
taagatgtcaaagggtcacagt

SEQ ID NO: 7686800 - DNA, 22 bp, Homo sapiens
taagatgtaagatcagagcttg

SEQ ID NO: 7686801 - DNA, 19 bp, Homo sapiens
taagacagattcctagagt

SEQ ID NO: 7686802 - DNA, 22 bp, Homo sapiens
taagatgtaagatcagagcttg

SEQ ID NO: 7686803 - DNA, 22 bp, Homo sapiens
taagacacgggctgatctaaag

SEQ ID NO: 7686804 - DNA, 19 bp, Homo sapiens
taagacagattcctagagt

SEQ ID NO: 7686805 - DNA, 23 bp, Homo sapiens
taagacacccgactccagagatg

SEQ ID NO: 7686806 - DNA, 22 bp, Homo sapiens
taagacacattggagtagatga

SEQ ID NO: 7686807 - DNA, 23 bp, Homo sapiens
taagacacccgactccagagatg

SEQ ID NO: 7686808 - DNA, 23 bp, Homo sapiens
taagacacccgactccagagatg

SEQ ID NO: 7686809 - DNA, 22 bp, Homo sapiens
taagacacgggctgatctaaag

SEQ ID NO: 7686810 - DNA, 22 bp, Homo sapiens
taagacacctctctgcccttca

SEQ ID NO: 7686811 - DNA, 22 bp, Homo sapiens
taagacacgggctgatctaaag

SEQ ID NO: 7686812 - DNA, 22 bp, Homo sapiens
taagacacctctctgcccttca

SEQ ID NO: 7686813 - DNA, 22 bp, Homo sapiens
taagacacatgcgtacaagata

SEQ ID NO: 7686814 - DNA, 22 bp, Homo sapiens
taagacacatgcgtacaagata

SEQ ID NO: 7686815 - DNA, 22 bp, Homo sapiens
taagacacatgcgtacaagata

SEQ ID NO: 7686816 - DNA, 22 bp, Homo sapiens
taagacacatgcgtacaagata

SEQ ID NO: 7686817 - DNA, 22 bp, Homo sapiens
taagacacatgcgtacaagata

SEQ ID NO: 7686818 - DNA, 22 bp, Homo sapiens
taagacacatgcgtacaagata

SEQ ID NO: 7686819 - DNA, 22 bp, Homo sapiens
taagacacattcatatctgtct

SEQ ID NO: 7686820 - DNA, 22 bp, Homo sapiens
taagacacattggagtagatga

SEQ ID NO: 7686821 - DNA, 22 bp, Homo sapiens
taagacacattcatatctgtct

SEQ ID NO: 7686822 - DNA, 22 bp, Homo sapiens
taagacacattgagaaacacaa

SEQ ID NO: 7686823 - DNA, 22 bp, Homo sapiens
taagacacattgagaaacacaa

SEQ ID NO: 7686824 - DNA, 22 bp, Homo sapiens
taagacacattggagtagatga

SEQ ID NO: 7686825 - DNA, 22 bp, Homo sapiens
taagacacattggagtagatga

SEQ ID NO: 7686826 - DNA, 22 bp, Homo sapiens
taagacacattggagtagatga

SEQ ID NO: 7686827 - DNA, 22 bp, Homo sapiens
caggatggtgtgagtgtgagga

SEQ ID NO: 7686828 - DNA, 22 bp, Homo sapiens
caggatggtgtgagtgtgagga

SEQ ID NO: 7686829 - DNA, 22 bp, Homo sapiens
caggatggtgtgagtgtgagga

SEQ ID NO: 7686830 - DNA, 22 bp, Homo sapiens
caggatggtgtgagtgtgagga

SEQ ID NO: 7686831 - DNA, 22 bp, Homo sapiens
caggatggtgtgagtgtgagga

SEQ ID NO: 7686832 - DNA, 22 bp, Homo sapiens
caggatggtgtgagtgtgagga

SEQ ID NO: 7686833 - DNA, 22 bp, Homo sapiens
caggatggtggcatgatcagaa

SEQ ID NO: 7686834 - DNA, 22 bp, Homo sapiens
caggatggtggcatgatcagaa

SEQ ID NO: 7686835 - DNA, 22 bp, Homo sapiens
caggatggtggcatgatcagaa

SEQ ID NO: 7686836 - DNA, 22 bp, Homo sapiens
caggatggtggcatgatcagaa

SEQ ID NO: 7686837 - DNA, 22 bp, Homo sapiens
caggatgttgctcccatgtccc

SEQ ID NO: 7686838 - DNA, 22 bp, Homo sapiens
caggatgttcaagggacctatg

SEQ ID NO: 7686839 - DNA, 22 bp, Homo sapiens
caggatgttcaagggacctatg

SEQ ID NO: 7686840 - DNA, 22 bp, Homo sapiens
caggatgttgctcccatgtccc

SEQ ID NO: 7686841 - DNA, 22 bp, Homo sapiens
caggattgaatgcttctccctg

SEQ ID NO: 7686842 - DNA, 22 bp, Homo sapiens
caggattataaactgtgcactg

SEQ ID NO: 7686843 - DNA, 22 bp, Homo sapiens
caggatggtgtgagtgtgagga

SEQ ID NO: 7686844 - DNA, 22 bp, Homo sapiens
caggatgtatgtcttattcttc

SEQ ID NO: 7686845 - DNA, 22 bp, Homo sapiens
caggatgttcaagggacctatg

SEQ ID NO: 7686846 - DNA, 22 bp, Homo sapiens
caggcaagattagagatgagca

SEQ ID NO: 7686847 - DNA, 22 bp, Homo sapiens
caggcaagattagagatgagca

SEQ ID NO: 7686848 - DNA, 22 bp, Homo sapiens
caggcaagatccagaggctgct

SEQ ID NO: 7686849 - DNA, 22 bp, Homo sapiens
caggcaagattagagatgagca

SEQ ID NO: 7686850 - DNA, 22 bp, Homo sapiens
caggcaagattagagatgagca

SEQ ID NO: 7686851 - DNA, 22 bp, Homo sapiens
caggcaagatccagaggctgct

SEQ ID NO: 7686852 - DNA, 22 bp, Homo sapiens
caggcaagatccagaggctgct

SEQ ID NO: 7686853 - DNA, 22 bp, Homo sapiens
caggcaagatccagaggctgct

SEQ ID NO: 7686854 - DNA, 22 bp, Homo sapiens
caggcaagatccagaggctgct

SEQ ID NO: 7686855 - DNA, 22 bp, Homo sapiens
caggcaagatccagaggctgct

SEQ ID NO: 7686856 - DNA, 22 bp, Homo sapiens
caggcaagatccagaggctgct

SEQ ID NO: 7686857 - DNA, 22 bp, Homo sapiens
caggcaagatccagaggctgct

SEQ ID NO: 7686858 - DNA, 22 bp, Homo sapiens
caggcaagatccagaggctgct

SEQ ID NO: 7686859 - DNA, 22 bp, Homo sapiens
caggcaagatccagaggctgct

SEQ ID NO: 7686860 - DNA, 22 bp, Homo sapiens
caggcaagatccagaggctgct

SEQ ID NO: 7686861 - DNA, 22 bp, Homo sapiens
caggcaagatccagaggctgct

SEQ ID NO: 7686862 - DNA, 22 bp, Homo sapiens
caggcaacgtccttagagatgc

SEQ ID NO: 7686863 - DNA, 22 bp, Homo sapiens
caggatttcatacatctttact

SEQ ID NO: 7686864 - DNA, 19 bp, Homo sapiens
caggattgtttaaagcttt

SEQ ID NO: 7686865 - DNA, 22 bp, Homo sapiens
caggattcaggttttccctcct

SEQ ID NO: 7686866 - DNA, 22 bp, Homo sapiens
caggattgaatgcttctccctg

SEQ ID NO: 7686867 - DNA, 22 bp, Homo sapiens
caggcaagttcatttccaggca

SEQ ID NO: 7686868 - DNA, 22 bp, Homo sapiens
caggcaagttcatttccaggca

SEQ ID NO: 7686869 - DNA, 22 bp, Homo sapiens
caggcacaaaaggaccccagca

SEQ ID NO: 7686870 - DNA, 22 bp, Homo sapiens
caggcacaaaaggaccccagca

SEQ ID NO: 7686871 - DNA, 22 bp, Homo sapiens
caggcacaaaaggaccccagca

SEQ ID NO: 7686872 - DNA, 22 bp, Homo sapiens
caggcacaaaaggaccccagca

SEQ ID NO: 7686873 - DNA, 22 bp, Homo sapiens
caggcacaaatttctagataag

SEQ ID NO: 7686874 - DNA, 22 bp, Homo sapiens
caggcacaaaaggaccccagca

SEQ ID NO: 7686875 - DNA, 22 bp, Homo sapiens
caggcacaaatttctagataag

SEQ ID NO: 7686876 - DNA, 22 bp, Homo sapiens
caggcacaaatttctagataag

SEQ ID NO: 7686877 - DNA, 22 bp, Homo sapiens
caggcaaggaggcactgaggga

SEQ ID NO: 7686878 - DNA, 22 bp, Homo sapiens
caggcaaggaggcactgaggga

SEQ ID NO: 7686879 - DNA, 22 bp, Homo sapiens
caggcaaggaggcactgaggga

SEQ ID NO: 7686880 - DNA, 22 bp, Homo sapiens
caggcaaggaggcactgaggga

SEQ ID NO: 7686881 - DNA, 22 bp, Homo sapiens
caggcaaggaggcactgaggga

SEQ ID NO: 7686882 - DNA, 22 bp, Homo sapiens
caggcaaggaggcactgaggga

SEQ ID NO: 7686883 - DNA, 22 bp, Homo sapiens
caggcaaggaggcactgaggga

SEQ ID NO: 7686884 - DNA, 22 bp, Homo sapiens
caggcaaggaggcactgaggga

SEQ ID NO: 7686885 - DNA, 22 bp, Homo sapiens
caggcaaggaggcactgaggga

SEQ ID NO: 7686886 - DNA, 22 bp, Homo sapiens
caggcaaggactctggtaattt

SEQ ID NO: 7686887 - DNA, 22 bp, Homo sapiens
caggcaagcacggtgaacctgg

SEQ ID NO: 7686888 - DNA, 22 bp, Homo sapiens
caggcaagcaaggggtcttgaa

SEQ ID NO: 7686889 - DNA, 22 bp, Homo sapiens
caggcaagcacggtgaacctgg

SEQ ID NO: 7686890 - DNA, 22 bp, Homo sapiens
caggcaaggaggcactgaggga

SEQ ID NO: 7686891 - DNA, 22 bp, Homo sapiens
caggcaaggaggcactgaggga

SEQ ID NO: 7686892 - DNA, 22 bp, Homo sapiens
caggcaaggaggcactgaggga

SEQ ID NO: 7686893 - DNA, 22 bp, Homo sapiens
caggcaaggaggcactgaggga

SEQ ID NO: 7686894 - DNA, 22 bp, Homo sapiens
caggcaaggagctggctcaagt

SEQ ID NO: 7686895 - DNA, 22 bp, Homo sapiens
caggcaaggagctggctcaagt

SEQ ID NO: 7686896 - DNA, 22 bp, Homo sapiens
caggcaagattagagatgagca

SEQ ID NO: 7686897 - DNA, 22 bp, Homo sapiens
caggcaagattagagatgagca

SEQ ID NO: 7686898 - DNA, 22 bp, Homo sapiens
caggcaagattagagatgagca

SEQ ID NO: 7686899 - DNA, 22 bp, Homo sapiens
caggcaagcaaggggtcttgaa

SEQ ID NO: 7686900 - DNA, 22 bp, Homo sapiens
caggcaagcaaggggtcttgaa

SEQ ID NO: 7686901 - DNA, 22 bp, Homo sapiens
caggcaagattagagatgagca

SEQ ID NO: 7686902 - DNA, 22 bp, Homo sapiens
caggcaagattagagatgagca

SEQ ID NO: 7686903 - DNA, 22 bp, Homo sapiens
caggcaagcaaggggtcttgaa

SEQ ID NO: 7686904 - DNA, 22 bp, Homo sapiens
taagacaattcttcagtcacaa

SEQ ID NO: 7686905 - DNA, 22 bp, Homo sapiens
taagacaattcttcagtcacaa

SEQ ID NO: 7686906 - DNA, 22 bp, Homo sapiens
taagacacaaatatcttttaca

SEQ ID NO: 7686907 - DNA, 22 bp, Homo sapiens
taagacacagtccgcactctct

SEQ ID NO: 7686908 - DNA, 22 bp, Homo sapiens
taagacacagtccgcactctct

SEQ ID NO: 7686909 - DNA, 19 bp, Homo sapiens
taagacacaaatgcaagcc

SEQ ID NO: 7686910 - DNA, 22 bp, Homo sapiens
taagacacaaatatcttttaca

SEQ ID NO: 7686911 - DNA, 22 bp, Homo sapiens
caggcacatgggagctcatcat

SEQ ID NO: 7686912 - DNA, 22 bp, Homo sapiens
caggcacatgggagctcatcat

SEQ ID NO: 7686913 - DNA, 22 bp, Homo sapiens
caggcacatgggagctcatcat

SEQ ID NO: 7686914 - DNA, 22 bp, Homo sapiens
caggcacatgggagctcatcat

SEQ ID NO: 7686915 - DNA, 22 bp, Homo sapiens
caggcaccaacttcctggggag

SEQ ID NO: 7686916 - DNA, 22 bp, Homo sapiens
caggcaccaacttcctggggag

SEQ ID NO: 7686917 - DNA, 22 bp, Homo sapiens
caggcaccaacttcctggggag

SEQ ID NO: 7686918 - DNA, 22 bp, Homo sapiens
caggcaccaacttcctggggag

SEQ ID NO: 7686919 - DNA, 22 bp, Homo sapiens
caggcacatgggagctcatcat

SEQ ID NO: 7686920 - DNA, 22 bp, Homo sapiens
caggcacagttccaagcatttt

SEQ ID NO: 7686921 - DNA, 22 bp, Homo sapiens
caggcacagttccaagcatttt

SEQ ID NO: 7686922 - DNA, 22 bp, Homo sapiens
caggcacagtgttgctgttcaa

SEQ ID NO: 7686923 - DNA, 22 bp, Homo sapiens
caggcacagtgttgctgttcaa

SEQ ID NO: 7686924 - DNA, 22 bp, Homo sapiens
caggcacagtgttgctgttcaa

SEQ ID NO: 7686925 - DNA, 22 bp, Homo sapiens
caggcacagtgttgctgttcaa

SEQ ID NO: 7686926 - DNA, 22 bp, Homo sapiens
caggcacagtggggtcctctct

SEQ ID NO: 7686927 - DNA, 22 bp, Homo sapiens
caggcacagtggggtcctctct

SEQ ID NO: 7686928 - DNA, 22 bp, Homo sapiens
caggcacagtggggtcctctct

SEQ ID NO: 7686929 - DNA, 22 bp, Homo sapiens
caggcacagtggggtcctctct

SEQ ID NO: 7686930 - DNA, 17 bp, Homo sapiens
caggcacatgaagccag

SEQ ID NO: 7686931 - DNA, 22 bp, Homo sapiens
caggcacagttccaagcatttt

SEQ ID NO: 7686932 - DNA, 17 bp, Homo sapiens
caggcacatgaagccag

SEQ ID NO: 7686933 - DNA, 17 bp, Homo sapiens
caggcacatgaagccag

SEQ ID NO: 7686934 - DNA, 17 bp, Homo sapiens
caggcacatgaagccag

SEQ ID NO: 7686935 - DNA, 22 bp, Homo sapiens
caggcacatgggagctcatcat

SEQ ID NO: 7686936 - DNA, 22 bp, Homo sapiens
caggcacatgggagctcatcat

SEQ ID NO: 7686937 - DNA, 22 bp, Homo sapiens
caggcacatgggagctcatcat

SEQ ID NO: 7686938 - DNA, 22 bp, Homo sapiens
caggcacatgggagctcatcat

SEQ ID NO: 7686939 - DNA, 22 bp, Homo sapiens
caggcacatgggagctcatcat

SEQ ID NO: 7686940 - DNA, 22 bp, Homo sapiens
caggcacatgggagctcatcat

SEQ ID NO: 7686941 - DNA, 22 bp, Homo sapiens
caggcacatgggagctcatcat

SEQ ID NO: 7686942 - DNA, 17 bp, Homo sapiens
caggcacatgaagccag

SEQ ID NO: 7686943 - DNA, 17 bp, Homo sapiens
caggcacatgaagccag

SEQ ID NO: 7686944 - DNA, 22 bp, Homo sapiens
caggcacaggggaatgtctttt

SEQ ID NO: 7686945 - DNA, 22 bp, Homo sapiens
caggcacagtggggtcctctct

SEQ ID NO: 7686946 - DNA, 22 bp, Homo sapiens
caggcacagtggggtcctctct

SEQ ID NO: 7686947 - DNA, 22 bp, Homo sapiens
caggcacagtggggtcctctct

SEQ ID NO: 7686948 - DNA, 22 bp, Homo sapiens
caggcacagtggggtcctctct

SEQ ID NO: 7686949 - DNA, 22 bp, Homo sapiens
caggcacaggggaatgtctttt

SEQ ID NO: 7686950 - DNA, 22 bp, Homo sapiens
caggcacaggggaatgtctttt

SEQ ID NO: 7686951 - DNA, 22 bp, Homo sapiens
caggcacagctgggcaattgcg

SEQ ID NO: 7686952 - DNA, 22 bp, Homo sapiens
caggcacagctgggcaattgcg

SEQ ID NO: 7686953 - DNA, 22 bp, Homo sapiens
caggcacagctaagactggcca

SEQ ID NO: 7686954 - DNA, 22 bp, Homo sapiens
caggcacagagagaataccttt

SEQ ID NO: 7686955 - DNA, 22 bp, Homo sapiens
caggcacagacgcaaacttctt

SEQ ID NO: 7686956 - DNA, 22 bp, Homo sapiens
caggcacagacgcaaacttctt

SEQ ID NO: 7686957 - DNA, 22 bp, Homo sapiens
caggcacagctaagactggcca

SEQ ID NO: 7686958 - DNA, 22 bp, Homo sapiens
caggcacagctaagactggcca

SEQ ID NO: 7686959 - DNA, 22 bp, Homo sapiens
caggcacagctaagactggcca

SEQ ID NO: 7686960 - DNA, 22 bp, Homo sapiens
caggcacagctaagactggcca

SEQ ID NO: 7686961 - DNA, 22 bp, Homo sapiens
caggcacagctaagactggcca

SEQ ID NO: 7686962 - DNA, 22 bp, Homo sapiens
caggcacaagatcggctagata

SEQ ID NO: 7686963 - DNA, 22 bp, Homo sapiens
caggcacaagatcggctagata

SEQ ID NO: 7686964 - DNA, 22 bp, Homo sapiens
caggcacaagatcggctagata

SEQ ID NO: 7686965 - DNA, 22 bp, Homo sapiens
caggcacaagatcggctagata

SEQ ID NO: 7686966 - DNA, 22 bp, Homo sapiens
caggcacaagatcggctagata

SEQ ID NO: 7686967 - DNA, 22 bp, Homo sapiens
caggcacaagatcggctagata

SEQ ID NO: 7686968 - DNA, 22 bp, Homo sapiens
caggcacaagaagcaaatgtta

SEQ ID NO: 7686969 - DNA, 22 bp, Homo sapiens
caggcacaaatttctagataag

SEQ ID NO: 7686970 - DNA, 22 bp, Homo sapiens
caggcacaagaagcaaatgtta

SEQ ID NO: 7686971 - DNA, 22 bp, Homo sapiens
caggcacaagaagcaaatgtta

SEQ ID NO: 7686972 - DNA, 22 bp, Homo sapiens
caggcacagacgcaaacttctt

SEQ ID NO: 7686973 - DNA, 22 bp, Homo sapiens
caggcacaatgagcgccatctt

SEQ ID NO: 7686974 - DNA, 22 bp, Homo sapiens
caggcacaatgagcgccatctt

SEQ ID NO: 7686975 - DNA, 22 bp, Homo sapiens
caggcacaatgagcgccatctt

SEQ ID NO: 7686976 - DNA, 22 bp, Homo sapiens
caggcacaatgagcgccatctt

SEQ ID NO: 7686977 - DNA, 22 bp, Homo sapiens
caggcacaagatcggctagata

SEQ ID NO: 7686978 - DNA, 22 bp, Homo sapiens
caggcacaagatcggctagata

SEQ ID NO: 7686979 - DNA, 22 bp, Homo sapiens
caggcacaagatcggctagata

SEQ ID NO: 7686980 - DNA, 22 bp, Homo sapiens
caggcacaagatcggctagata

SEQ ID NO: 7686981 - DNA, 22 bp, Homo sapiens
taacaacttgcttttatcttag

SEQ ID NO: 7686982 - DNA, 22 bp, Homo sapiens
taacaagaaatacattggttct

SEQ ID NO: 7686983 - DNA, 22 bp, Homo sapiens
taacaacttgcttttatcttag

SEQ ID NO: 7686984 - DNA, 22 bp, Homo sapiens
taacaagaaatacattggttct

SEQ ID NO: 7686985 - DNA, 22 bp, Homo sapiens
taacaactggacaatgttgctc

SEQ ID NO: 7686986 - DNA, 22 bp, Homo sapiens
taacaacttgcttttatcttag

SEQ ID NO: 7686987 - DNA, 22 bp, Homo sapiens
taacaacttgcttttatcttag

SEQ ID NO: 7686988 - DNA, 22 bp, Homo sapiens
taacaagatatatgacttggat

SEQ ID NO: 7686989 - DNA, 22 bp, Homo sapiens
taacaagagcacctgggaatgg

SEQ ID NO: 7686990 - DNA, 23 bp, Homo sapiens
taacaagaacctcatgtgacttt

SEQ ID NO: 7686991 - DNA, 23 bp, Homo sapiens
taacaagaacctcatgtgacttt

SEQ ID NO: 7686992 - DNA, 22 bp, Homo sapiens
taacaactcagtttgttccttg

SEQ ID NO: 7686993 - DNA, 19 bp, Homo sapiens
taacaaagtctgaagtcag

SEQ ID NO: 7686994 - DNA, 22 bp, Homo sapiens
taacaactcagtttgttccttg

SEQ ID NO: 7686995 - DNA, 22 bp, Homo sapiens
taacaactcagtttgttccttg

SEQ ID NO: 7686996 - DNA, 22 bp, Homo sapiens
taacaactggacaatgttgctc

SEQ ID NO: 7686997 - DNA, 22 bp, Homo sapiens
taacaactggacaatgttgctc

SEQ ID NO: 7686998 - DNA, 22 bp, Homo sapiens
taacaactgctgaggtatttga

SEQ ID NO: 7686999 - DNA, 22 bp, Homo sapiens
taacaactgctgaggtatttga

SEQ ID NO: 7687000 - DNA, 22 bp, Homo sapiens
taacaacatgcaatttaacctt

SEQ ID NO: 7687001 - DNA, 22 bp, Homo sapiens
taacaacatgcaatttaacctt

SEQ ID NO: 7687002 - DNA, 19 bp, Homo sapiens
taacaaagtctgaagtcag

SEQ ID NO: 7687003 - DNA, 22 bp, Homo sapiens
taacaaagtattgtttgtgtat

SEQ ID NO: 7687004 - DNA, 22 bp, Homo sapiens
taacaagatttgtaaaattgta

SEQ ID NO: 7687005 - DNA, 22 bp, Homo sapiens
taacaagatttgtaaaattgta

SEQ ID NO: 7687006 - DNA, 19 bp, Homo sapiens
taacaagcactctgcattc

SEQ ID NO: 7687007 - DNA, 22 bp, Homo sapiens
taacaagatgtcactcctgtcc

SEQ ID NO: 7687008 - DNA, 22 bp, Homo sapiens
taacaagatttgtaaaattgta

SEQ ID NO: 7687009 - DNA, 22 bp, Homo sapiens
taacaaggtggtcttggtattt

SEQ ID NO: 7687010 - DNA, 22 bp, Homo sapiens
taacaaggtaagcctggccatg

SEQ ID NO: 7687011 - DNA, 22 bp, Homo sapiens
taacaagatttgtaaaattgta

SEQ ID NO: 7687012 - DNA, 19 bp, Homo sapiens
taacaagcactctgcattc

SEQ ID NO: 7687013 - DNA, 22 bp, Homo sapiens
taacaagtttcatttatagaat

SEQ ID NO: 7687014 - DNA, 22 bp, Homo sapiens
taacaagtttcatttatagaat

SEQ ID NO: 7687015 - DNA, 22 bp, Homo sapiens
taacaagttctgacagcattgt

SEQ ID NO: 7687016 - DNA, 21 bp, Homo sapiens
taacaagtctgcatacattca

SEQ ID NO: 7687017 - DNA, 22 bp, Homo sapiens
taacaagtcattttatcagcag

SEQ ID NO: 7687018 - DNA, 22 bp, Homo sapiens
taacaagtcattttaaattatg

SEQ ID NO: 7687019 - DNA, 22 bp, Homo sapiens
taacaatacccattctaattac

SEQ ID NO: 7687020 - DNA, 22 bp, Homo sapiens
taacaatacccattctaattac

SEQ ID NO: 7687021 - DNA, 22 bp, Homo sapiens
taacaatacccattctaattac

SEQ ID NO: 7687022 - DNA, 22 bp, Homo sapiens
taacaatacccattctaattac

SEQ ID NO: 7687023 - DNA, 22 bp, Homo sapiens
taacaatacccattctaattac

SEQ ID NO: 7687024 - DNA, 22 bp, Homo sapiens
taacaatacccattctaattac

SEQ ID NO: 7687025 - DNA, 22 bp, Homo sapiens
taacaatacccattctaattac

SEQ ID NO: 7687026 - DNA, 22 bp, Homo sapiens
taacaatacccattctaattac

SEQ ID NO: 7687027 - DNA, 22 bp, Homo sapiens
taacaatacccattctaattac

SEQ ID NO: 7687028 - DNA, 22 bp, Homo sapiens
taacaatacccattctaattac

SEQ ID NO: 7687029 - DNA, 22 bp, Homo sapiens
taacaatacccattctaattac

SEQ ID NO: 7687030 - DNA, 22 bp, Homo sapiens
taacaatacccattctaattac

SEQ ID NO: 7687031 - DNA, 22 bp, Homo sapiens
taacacttcagatgattttgtt

SEQ ID NO: 7687032 - DNA, 22 bp, Homo sapiens
taacaatacccattctaattac

SEQ ID NO: 7687033 - DNA, 22 bp, Homo sapiens
taacactgtgtctgccatatcc

SEQ ID NO: 7687034 - DNA, 22 bp, Homo sapiens
taacactgtgtctgccatatcc

SEQ ID NO: 7687035 - DNA, 22 bp, Homo sapiens
taacaatacccattctaattac

SEQ ID NO: 7687036 - DNA, 22 bp, Homo sapiens
taacactgtgtctgccatatcc

SEQ ID NO: 7687037 - DNA, 22 bp, Homo sapiens
taacacttgaagccatttttgc

SEQ ID NO: 7687038 - DNA, 20 bp, Homo sapiens
taacacttgctttttgactt

SEQ ID NO: 7687039 - DNA, 22 bp, Homo sapiens
taacacttgaagccatttttgc

SEQ ID NO: 7687040 - DNA, 22 bp, Homo sapiens
taacactttggattaaaattct

SEQ ID NO: 7687041 - DNA, 22 bp, Homo sapiens
taacactttggattaaaattct

SEQ ID NO: 7687042 - DNA, 22 bp, Homo sapiens
taacactttggattaaaattct

SEQ ID NO: 7687043 - DNA, 22 bp, Homo sapiens
taacacttgggggcatccttag

SEQ ID NO: 7687044 - DNA, 20 bp, Homo sapiens
taacacttgctttttgactt

SEQ ID NO: 7687045 - DNA, 22 bp, Homo sapiens
taacacttgggggcatccttag

SEQ ID NO: 7687046 - DNA, 22 bp, Homo sapiens
taacagaaaagaactgagtttg

SEQ ID NO: 7687047 - DNA, 22 bp, Homo sapiens
taacagaaaagaactgagtttg

SEQ ID NO: 7687048 - DNA, 22 bp, Homo sapiens
taacagaaaagaactgagtttg

SEQ ID NO: 7687049 - DNA, 22 bp, Homo sapiens
taacagaaaagaactgagtttg

SEQ ID NO: 7687050 - DNA, 22 bp, Homo sapiens
taacagaaaggggacagaaata

SEQ ID NO: 7687051 - DNA, 22 bp, Homo sapiens
taacagaaaggggacagaaata

SEQ ID NO: 7687052 - DNA, 22 bp, Homo sapiens
taacagaaaggggacagaaata

SEQ ID NO: 7687053 - DNA, 22 bp, Homo sapiens
taacagaaaggctcaggtgctc

SEQ ID NO: 7687054 - DNA, 22 bp, Homo sapiens
taacagaaaggctcaggtgctc

SEQ ID NO: 7687055 - DNA, 22 bp, Homo sapiens
taacagaaaggctcaggtgctc

SEQ ID NO: 7687056 - DNA, 22 bp, Homo sapiens
taacagaaaggctcaggtgctc

SEQ ID NO: 7687057 - DNA, 22 bp, Homo sapiens
taacagaaaggctcaggtgctc

SEQ ID NO: 7687058 - DNA, 22 bp, Homo sapiens
taacagaaacagataagtgtaa

SEQ ID NO: 7687059 - DNA, 22 bp, Homo sapiens
taacagaaacagataagtgtaa

SEQ ID NO: 7687060 - DNA, 22 bp, Homo sapiens
taacagaaacagataagtgtaa

SEQ ID NO: 7687061 - DNA, 22 bp, Homo sapiens
taacagaaacagataagtgtaa

SEQ ID NO: 7687062 - DNA, 22 bp, Homo sapiens
taacagaaacagataagtgtaa

SEQ ID NO: 7687063 - DNA, 22 bp, Homo sapiens
taacagaaacagataagtgtaa

SEQ ID NO: 7687064 - DNA, 22 bp, Homo sapiens
taacattaggtagacataagcc

SEQ ID NO: 7687065 - DNA, 22 bp, Homo sapiens
taacattaggtagacataagcc

SEQ ID NO: 7687066 - DNA, 22 bp, Homo sapiens
taacattatacagagaggacag

SEQ ID NO: 7687067 - DNA, 22 bp, Homo sapiens
taacattatacagagaggacag

SEQ ID NO: 7687068 - DNA, 22 bp, Homo sapiens
taacattatacagagaggacag

SEQ ID NO: 7687069 - DNA, 22 bp, Homo sapiens
taacattaggtagacataagcc

SEQ ID NO: 7687070 - DNA, 22 bp, Homo sapiens
taacattaggtagacataagcc

SEQ ID NO: 7687071 - DNA, 22 bp, Homo sapiens
taacattaggtagacataagcc

SEQ ID NO: 7687072 - DNA, 22 bp, Homo sapiens
taacattaggtagacataagcc

SEQ ID NO: 7687073 - DNA, 22 bp, Homo sapiens
taacagaagttgttcattgtgg

SEQ ID NO: 7687074 - DNA, 22 bp, Homo sapiens
taacagaagttgttcattgtgg

SEQ ID NO: 7687075 - DNA, 22 bp, Homo sapiens
taacagaagttgttcattgtgg

SEQ ID NO: 7687076 - DNA, 22 bp, Homo sapiens
taacattaggtagacataagcc

SEQ ID NO: 7687077 - DNA, 22 bp, Homo sapiens
taacagaagttgttcattgtgg

SEQ ID NO: 7687078 - DNA, 22 bp, Homo sapiens
taacattaggtagacataagcc

SEQ ID NO: 7687079 - DNA, 20 bp, Homo sapiens
taacagaagtagaagtgggt

SEQ ID NO: 7687080 - DNA, 22 bp, Homo sapiens
taacagaagttgttcattgtgg

SEQ ID NO: 7687081 - DNA, 22 bp, Homo sapiens
taacagaagttgttcattgtgg

SEQ ID NO: 7687082 - DNA, 22 bp, Homo sapiens
taacagaagttgttcattgtgg

SEQ ID NO: 7687083 - DNA, 20 bp, Homo sapiens
taacagaagtagaagtgggt

SEQ ID NO: 7687084 - DNA, 20 bp, Homo sapiens
taacagaagtagaagtgggt

SEQ ID NO: 7687085 - DNA, 20 bp, Homo sapiens
taacagaagtagaagtgggt

SEQ ID NO: 7687086 - DNA, 20 bp, Homo sapiens
taacagaagtagaagtgggt

SEQ ID NO: 7687087 - DNA, 22 bp, Homo sapiens
taacatttaaatttttcacata

SEQ ID NO: 7687088 - DNA, 22 bp, Homo sapiens
taacatttaaatttttcacata

SEQ ID NO: 7687089 - DNA, 22 bp, Homo sapiens
taacatttaaatttttcacata

SEQ ID NO: 7687090 - DNA, 22 bp, Homo sapiens
taacatttaaatttttcacata

SEQ ID NO: 7687091 - DNA, 22 bp, Homo sapiens
taacattgttatgaatcaggtc

SEQ ID NO: 7687092 - DNA, 22 bp, Homo sapiens
taacattgtcagttcaactgct

SEQ ID NO: 7687093 - DNA, 22 bp, Homo sapiens
taacattgagtccactaaacag

SEQ ID NO: 7687094 - DNA, 22 bp, Homo sapiens
taacattgagtccactaaacag

SEQ ID NO: 7687095 - DNA, 22 bp, Homo sapiens
taacattgagtccactaaacag

SEQ ID NO: 7687096 - DNA, 22 bp, Homo sapiens
taacattcttaacttagaaaca

SEQ ID NO: 7687097 - DNA, 22 bp, Homo sapiens
taacattcttaacttagaaaca

SEQ ID NO: 7687098 - DNA, 22 bp, Homo sapiens
taacattcttaacttagaaaca

SEQ ID NO: 7687099 - DNA, 22 bp, Homo sapiens
taacattcttaacttagaaaca

SEQ ID NO: 7687100 - DNA, 22 bp, Homo sapiens
taacattccatggatctgcaga

SEQ ID NO: 7687101 - DNA, 22 bp, Homo sapiens
taacattccatggatctgcaga

SEQ ID NO: 7687102 - DNA, 22 bp, Homo sapiens
taacattccatggatctgcaga

SEQ ID NO: 7687103 - DNA, 22 bp, Homo sapiens
taacattccatggatctgcaga

SEQ ID NO: 7687104 - DNA, 22 bp, Homo sapiens
taacattccctttgtgccaagg

SEQ ID NO: 7687105 - DNA, 22 bp, Homo sapiens
taacagaaatagaaatgagagt

SEQ ID NO: 7687106 - DNA, 22 bp, Homo sapiens
taacagaaatagaaatgagagt

SEQ ID NO: 7687107 - DNA, 22 bp, Homo sapiens
taacagaaatagaaatgagagt

SEQ ID NO: 7687108 - DNA, 22 bp, Homo sapiens
taacagaaatagaaatgagagt

SEQ ID NO: 7687109 - DNA, 22 bp, Homo sapiens
taacagaaatagaaatgagagt

SEQ ID NO: 7687110 - DNA, 22 bp, Homo sapiens
taacagaaatagaaatgagagt

SEQ ID NO: 7687111 - DNA, 22 bp, Homo sapiens
taacagaaatagaaatgagagt

SEQ ID NO: 7687112 - DNA, 22 bp, Homo sapiens
taacagaaatagtaggtgaggg

SEQ ID NO: 7687113 - DNA, 22 bp, Homo sapiens
taacagaaatagtaggtgaggg

SEQ ID NO: 7687114 - DNA, 22 bp, Homo sapiens
taacagaaaggggacagaaata

SEQ ID NO: 7687115 - DNA, 22 bp, Homo sapiens
taacagaaaggggacagaaata

SEQ ID NO: 7687116 - DNA, 22 bp, Homo sapiens
taacagaaaggggacagaaata

SEQ ID NO: 7687117 - DNA, 22 bp, Homo sapiens
taacagaaaggggacagaaata

SEQ ID NO: 7687118 - DNA, 22 bp, Homo sapiens
taacagaaaggggacagaaata

SEQ ID NO: 7687119 - DNA, 22 bp, Homo sapiens
taacagaaaggggacagaaata

SEQ ID NO: 7687120 - DNA, 22 bp, Homo sapiens
taacagaaaggggacagaaata

SEQ ID NO: 7687121 - DNA, 22 bp, Homo sapiens
taacagaaaggggacagaaata

SEQ ID NO: 7687122 - DNA, 22 bp, Homo sapiens
taacagaaaggggacagaaata

SEQ ID NO: 7687123 - DNA, 22 bp, Homo sapiens
taacagaagaaaacatattgga

SEQ ID NO: 7687124 - DNA, 22 bp, Homo sapiens
taacagaagaaaacatattgga

SEQ ID NO: 7687125 - DNA, 22 bp, Homo sapiens
taacagaagaaaacatattgga

SEQ ID NO: 7687126 - DNA, 22 bp, Homo sapiens
taacagaagaaaacatattgga

SEQ ID NO: 7687127 - DNA, 22 bp, Homo sapiens
taacagaaattttagttagggg

SEQ ID NO: 7687128 - DNA, 22 bp, Homo sapiens
taacagaaattttagttagggg

SEQ ID NO: 7687129 - DNA, 22 bp, Homo sapiens
taacagaaattttagttagggg

SEQ ID NO: 7687130 - DNA, 22 bp, Homo sapiens
taacagaaatagtaggtgaggg

SEQ ID NO: 7687131 - DNA, 22 bp, Homo sapiens
taacagaaatagtaggtgaggg

SEQ ID NO: 7687132 - DNA, 22 bp, Homo sapiens
taacagaaattttagttagggg

SEQ ID NO: 7687133 - DNA, 22 bp, Homo sapiens
taacagaaatatttccaggtga

SEQ ID NO: 7687134 - DNA, 22 bp, Homo sapiens
taacagaaatatttccaggtga

SEQ ID NO: 7687135 - DNA, 22 bp, Homo sapiens
taacagaaatatttccaggtga

SEQ ID NO: 7687136 - DNA, 22 bp, Homo sapiens
taacagaagatgaaacttcttt

SEQ ID NO: 7687137 - DNA, 22 bp, Homo sapiens
taacagaagatgaaacttcttt

SEQ ID NO: 7687138 - DNA, 22 bp, Homo sapiens
taacagaagatgaaacttcttt

SEQ ID NO: 7687139 - DNA, 22 bp, Homo sapiens
taacagaagatgaaacttcttt

SEQ ID NO: 7687140 - DNA, 22 bp, Homo sapiens
taacagaagatgaaacttcttt

SEQ ID NO: 7687141 - DNA, 22 bp, Homo sapiens
taacagaagagcaggcagccct

SEQ ID NO: 7687142 - DNA, 22 bp, Homo sapiens
taacagaagagcaggcagccct

SEQ ID NO: 7687143 - DNA, 22 bp, Homo sapiens
taacagaagaaaacatattgga

SEQ ID NO: 7687144 - DNA, 22 bp, Homo sapiens
taacagaagaaaacatattgga

SEQ ID NO: 7687145 - DNA, 22 bp, Homo sapiens
taacagaagaaaacatattgga

SEQ ID NO: 7687146 - DNA, 22 bp, Homo sapiens
taacagaagagcaggcagccct

SEQ ID NO: 7687147 - DNA, 22 bp, Homo sapiens
caggatggtggcatgatcagaa

SEQ ID NO: 7687148 - DNA, 22 bp, Homo sapiens
caggatggtcttcatttggctc

SEQ ID NO: 7687149 - DNA, 22 bp, Homo sapiens
caggatggtggcatgatcagaa

SEQ ID NO: 7687150 - DNA, 22 bp, Homo sapiens
caggatggtcttcatttggctc

SEQ ID NO: 7687151 - DNA, 22 bp, Homo sapiens
caggatggtctcgatctcctga

SEQ ID NO: 7687152 - DNA, 22 bp, Homo sapiens
caggatggtctcgatctcctga

SEQ ID NO: 7687153 - DNA, 22 bp, Homo sapiens
caggatgcttctggggccaggc

SEQ ID NO: 7687154 - DNA, 22 bp, Homo sapiens
caggatgcttctggggccaggc

SEQ ID NO: 7687155 - DNA, 22 bp, Homo sapiens
caggatgctgaaaacacgagga

SEQ ID NO: 7687156 - DNA, 22 bp, Homo sapiens
caggatgctgaaaacacgagga

SEQ ID NO: 7687157 - DNA, 22 bp, Homo sapiens
caggatgctgaaaacacgagga

SEQ ID NO: 7687158 - DNA, 22 bp, Homo sapiens
caggatggagagtgaggggtca

SEQ ID NO: 7687159 - DNA, 22 bp, Homo sapiens
caggatggagagtgaggggtca

SEQ ID NO: 7687160 - DNA, 22 bp, Homo sapiens
caggatggagagtgaggggtca

SEQ ID NO: 7687161 - DNA, 22 bp, Homo sapiens
caggatggagagtgaggggtca

SEQ ID NO: 7687162 - DNA, 20 bp, Homo sapiens
caggatgattggacacgatg

SEQ ID NO: 7687163 - DNA, 22 bp, Homo sapiens
caggatgatgttaattgaagtt

SEQ ID NO: 7687164 - DNA, 21 bp, Homo sapiens
caggatgatgggaaggtggtg

SEQ ID NO: 7687165 - DNA, 21 bp, Homo sapiens
caggatgatgggaaggtggtg

SEQ ID NO: 7687166 - DNA, 18 bp, Homo sapiens
caggatgagtgatgggga

SEQ ID NO: 7687167 - DNA, 22 bp, Homo sapiens
caggatgatgagtagagtgtga

SEQ ID NO: 7687168 - DNA, 22 bp, Homo sapiens
caggatgatgagtagagtgtga

SEQ ID NO: 7687169 - DNA, 21 bp, Homo sapiens
caggatgatgataattcatgg

SEQ ID NO: 7687170 - DNA, 21 bp, Homo sapiens
caggatgatgataattcatgg

SEQ ID NO: 7687171 - DNA, 20 bp, Homo sapiens
caggatgattggacacgatg

SEQ ID NO: 7687172 - DNA, 20 bp, Homo sapiens
caggatgattggacacgatg

SEQ ID NO: 7687173 - DNA, 22 bp, Homo sapiens
caggatgcagtgggacccaggg

SEQ ID NO: 7687174 - DNA, 22 bp, Homo sapiens
caggatgcactaggaaccaggg

SEQ ID NO: 7687175 - DNA, 22 bp, Homo sapiens
caggatgcactaggaaccaggg

SEQ ID NO: 7687176 - DNA, 22 bp, Homo sapiens
caggatgcactaggaaccaggg

SEQ ID NO: 7687177 - DNA, 22 bp, Homo sapiens
caggatgccttggacacccggt

SEQ ID NO: 7687178 - DNA, 22 bp, Homo sapiens
caggatgcggcctgactctaag

SEQ ID NO: 7687179 - DNA, 22 bp, Homo sapiens
caggatgcggcctgactctaag

SEQ ID NO: 7687180 - DNA, 22 bp, Homo sapiens
caggatgcagtgggacccaggg

SEQ ID NO: 7687181 - DNA, 22 bp, Homo sapiens
caggatgcagtgggacccaggg

SEQ ID NO: 7687182 - DNA, 22 bp, Homo sapiens
caggatgccatctgctgctgct

SEQ ID NO: 7687183 - DNA, 22 bp, Homo sapiens
caggatgccatctgctgctgct

SEQ ID NO: 7687184 - DNA, 22 bp, Homo sapiens
taagaaacatttttatgacagt

SEQ ID NO: 7687185 - DNA, 22 bp, Homo sapiens
taagaaacatttttatgacagt

SEQ ID NO: 7687186 - DNA, 22 bp, Homo sapiens
taagaaacatttttatgacagt

SEQ ID NO: 7687187 - DNA, 22 bp, Homo sapiens
taagaaacatttttatgacagt

SEQ ID NO: 7687188 - DNA, 22 bp, Homo sapiens
taagaaacccaggaatttctta

SEQ ID NO: 7687189 - DNA, 22 bp, Homo sapiens
taagaaacccaggaatttctta

SEQ ID NO: 7687190 - DNA, 22 bp, Homo sapiens
taagaaacatttttatgacagt

SEQ ID NO: 7687191 - DNA, 22 bp, Homo sapiens
taagaaacccaggaatttctta

SEQ ID NO: 7687192 - DNA, 22 bp, Homo sapiens
caggatcatgctgaatctggca

SEQ ID NO: 7687193 - DNA, 22 bp, Homo sapiens
caggatattacctaatatttga

SEQ ID NO: 7687194 - DNA, 22 bp, Homo sapiens
taagaaacccaggaatttctta

SEQ ID NO: 7687195 - DNA, 22 bp, Homo sapiens
caggatccctggcctccgccca

SEQ ID NO: 7687196 - DNA, 22 bp, Homo sapiens
caggatcctggctgcatggacg

SEQ ID NO: 7687197 - DNA, 22 bp, Homo sapiens
caggatccctggcctccgccca

SEQ ID NO: 7687198 - DNA, 22 bp, Homo sapiens
caggatctgccaatattcaacc

SEQ ID NO: 7687199 - DNA, 22 bp, Homo sapiens
caggatctgcccaggcctttgg

SEQ ID NO: 7687200 - DNA, 22 bp, Homo sapiens
caggatctgcccaggcctttgg

SEQ ID NO: 7687201 - DNA, 22 bp, Homo sapiens
caggatctgcccaggcctttgg

SEQ ID NO: 7687202 - DNA, 22 bp, Homo sapiens
caggatcttttaatgtctccag

SEQ ID NO: 7687203 - DNA, 22 bp, Homo sapiens
caggatctgttaagttgttcca

SEQ ID NO: 7687204 - DNA, 22 bp, Homo sapiens
caggatctgttaagttgttcca

SEQ ID NO: 7687205 - DNA, 22 bp, Homo sapiens
caggatcttttaatgtctccag

SEQ ID NO: 7687206 - DNA, 22 bp, Homo sapiens
caggatgaagggcaaaggcaag

SEQ ID NO: 7687207 - DNA, 18 bp, Homo sapiens
caggatgagtgatgggga

SEQ ID NO: 7687208 - DNA, 18 bp, Homo sapiens
caggatgagtgatgggga

SEQ ID NO: 7687209 - DNA, 22 bp, Homo sapiens
caggatgaggtagaggcagata

SEQ ID NO: 7687210 - DNA, 22 bp, Homo sapiens
caggatgaggtagaggcagata

SEQ ID NO: 7687211 - DNA, 19 bp, Homo sapiens
caggatgatcccatgacac

SEQ ID NO: 7687212 - DNA, 19 bp, Homo sapiens
caggatgatcccatgacac

SEQ ID NO: 7687213 - DNA, 18 bp, Homo sapiens
caggatgagtgatgggga

SEQ ID NO: 7687214 - DNA, 18 bp, Homo sapiens
caggatgagtgatgggga

SEQ ID NO: 7687215 - DNA, 22 bp, Homo sapiens
caggatgaccatatgttccagt

SEQ ID NO: 7687216 - DNA, 22 bp, Homo sapiens
caggatgagaggcccagggaag

SEQ ID NO: 7687217 - DNA, 22 bp, Homo sapiens
caggatgaggtagaggcagata

SEQ ID NO: 7687218 - DNA, 22 bp, Homo sapiens
taactttgagaactttctggtg

SEQ ID NO: 7687219 - DNA, 22 bp, Homo sapiens
taactttgaagggaattttact

SEQ ID NO: 7687220 - DNA, 22 bp, Homo sapiens
taactttcttcatatgtgaacc

SEQ ID NO: 7687221 - DNA, 22 bp, Homo sapiens
taactttgaagggaattttact

SEQ ID NO: 7687222 - DNA, 22 bp, Homo sapiens
taactttgaagggaattttact

SEQ ID NO: 7687223 - DNA, 20 bp, Homo sapiens
taactttctatgctttcagc

SEQ ID NO: 7687224 - DNA, 20 bp, Homo sapiens
taactttctatgctttcagc

SEQ ID NO: 7687225 - DNA, 22 bp, Homo sapiens
taactttcttcatatgtgaacc

SEQ ID NO: 7687226 - DNA, 22 bp, Homo sapiens
taactttgatcacttgataagg

SEQ ID NO: 7687227 - DNA, 22 bp, Homo sapiens
taactttggggacacttctctt

SEQ ID NO: 7687228 - DNA, 22 bp, Homo sapiens
taactttgatcacttgataagg

SEQ ID NO: 7687229 - DNA, 22 bp, Homo sapiens
taactttgataagaatcaggga

SEQ ID NO: 7687230 - DNA, 22 bp, Homo sapiens
taactttgataagaatcaggga

SEQ ID NO: 7687231 - DNA, 22 bp, Homo sapiens
taactttggggacacttctctt

SEQ ID NO: 7687232 - DNA, 22 bp, Homo sapiens
taacttttacatttggctcact

SEQ ID NO: 7687233 - DNA, 22 bp, Homo sapiens
taactttagtgtatgaggtaag

SEQ ID NO: 7687234 - DNA, 22 bp, Homo sapiens
taactttcacatcacactgact

SEQ ID NO: 7687235 - DNA, 22 bp, Homo sapiens
taactttaggaataggtaatct

SEQ ID NO: 7687236 - DNA, 22 bp, Homo sapiens
taactttagtgtatgaggtaag

SEQ ID NO: 7687237 - DNA, 22 bp, Homo sapiens
taacttttctaggtgtgataat

SEQ ID NO: 7687238 - DNA, 22 bp, Homo sapiens
taacttttctaggtgtgataat

SEQ ID NO: 7687239 - DNA, 22 bp, Homo sapiens
taacttttgtgatctgtcgatt

SEQ ID NO: 7687240 - DNA, 22 bp, Homo sapiens
taacttttacttaccatctgag

SEQ ID NO: 7687241 - DNA, 22 bp, Homo sapiens
taacttttctaggtgtgataat

SEQ ID NO: 7687242 - DNA, 22 bp, Homo sapiens
taacttttctaggtgtgataat

SEQ ID NO: 7687243 - DNA, 21 bp, Homo sapiens
taacttttgtgcctatcttgt

SEQ ID NO: 7687244 - DNA, 21 bp, Homo sapiens
taacttttgtgcctatcttgt

SEQ ID NO: 7687245 - DNA, 15 bp, Homo sapiens
taacttttttgggct

SEQ ID NO: 7687246 - DNA, 22 bp, Homo sapiens
taagaaacatgatacttttcct

SEQ ID NO: 7687247 - DNA, 22 bp, Homo sapiens
taagaaacatgatacttttcct

SEQ ID NO: 7687248 - DNA, 21 bp, Homo sapiens
taacttttgtgcctatcttgt

SEQ ID NO: 7687249 - DNA, 22 bp, Homo sapiens
taagaaacatgatacttttcct

SEQ ID NO: 7687250 - DNA, 22 bp, Homo sapiens
taagaaacatgatacttttcct

SEQ ID NO: 7687251 - DNA, 22 bp, Homo sapiens
taagaaacatttttatgacagt

SEQ ID NO: 7687252 - DNA, 22 bp, Homo sapiens
taagaaacatttttatgacagt

SEQ ID NO: 7687253 - DNA, 22 bp, Homo sapiens
taagaaacatttttatgacagt

SEQ ID NO: 7687254 - DNA, 22 bp, Homo sapiens
taagaaacatgatacttttcct

SEQ ID NO: 7687255 - DNA, 22 bp, Homo sapiens
taagaaacatgattaatggcag

SEQ ID NO: 7687256 - DNA, 22 bp, Homo sapiens
taacttggttggtgggcaggag

SEQ ID NO: 7687257 - DNA, 22 bp, Homo sapiens
taacttgtgttacattactctt

SEQ ID NO: 7687258 - DNA, 22 bp, Homo sapiens
taacttgtgttacattactctt

SEQ ID NO: 7687259 - DNA, 22 bp, Homo sapiens
taactttaggaataggtaatct

SEQ ID NO: 7687260 - DNA, 22 bp, Homo sapiens
taacttgagctctcagtgctat

SEQ ID NO: 7687261 - DNA, 22 bp, Homo sapiens
taacttgataagtattctctgc

SEQ ID NO: 7687262 - DNA, 22 bp, Homo sapiens
taacttgataagtattctctgc

SEQ ID NO: 7687263 - DNA, 19 bp, Homo sapiens
taacttgtagatatgaagt

SEQ ID NO: 7687264 - DNA, 16 bp, Homo sapiens
taacatttttaaaagg

SEQ ID NO: 7687265 - DNA, 16 bp, Homo sapiens
taacatttttaaaagg

SEQ ID NO: 7687266 - DNA, 16 bp, Homo sapiens
taacatttttaaaagg

SEQ ID NO: 7687267 - DNA, 16 bp, Homo sapiens
taacatttttaaaagg

SEQ ID NO: 7687268 - DNA, 22 bp, Homo sapiens
taacttctttggtttaaagaga

SEQ ID NO: 7687269 - DNA, 22 bp, Homo sapiens
taacttctttggtttaaagaga

SEQ ID NO: 7687270 - DNA, 22 bp, Homo sapiens
taacatttcggtgacagtggga

SEQ ID NO: 7687271 - DNA, 22 bp, Homo sapiens
taacatttcggtgacagtggga

SEQ ID NO: 7687272 - DNA, 22 bp, Homo sapiens
taacatttcggtgacagtggga

SEQ ID NO: 7687273 - DNA, 22 bp, Homo sapiens
taacatttcggtgacagtggga

SEQ ID NO: 7687274 - DNA, 22 bp, Homo sapiens
taacatttgctgtctcctatgt

SEQ ID NO: 7687275 - DNA, 22 bp, Homo sapiens
taacatttgctgtctcctatgt

SEQ ID NO: 7687276 - DNA, 22 bp, Homo sapiens
taacatttgctgtctcctatgt

SEQ ID NO: 7687277 - DNA, 22 bp, Homo sapiens
taacatttgctgtctcctatgt

SEQ ID NO: 7687278 - DNA, 22 bp, Homo sapiens
taacatttagaaagtgtccatt

SEQ ID NO: 7687279 - DNA, 22 bp, Homo sapiens
taacatttaaatttttcacata

SEQ ID NO: 7687280 - DNA, 22 bp, Homo sapiens
taacatttaaatttttcacata

SEQ ID NO: 7687281 - DNA, 22 bp, Homo sapiens
taacatttaaatttttcacata

SEQ ID NO: 7687282 - DNA, 22 bp, Homo sapiens
caggaattcatagcattgttct

SEQ ID NO: 7687283 - DNA, 22 bp, Homo sapiens
caggacaaagccctttgagaaa

SEQ ID NO: 7687284 - DNA, 22 bp, Homo sapiens
caggacaaagccctttgagaaa

SEQ ID NO: 7687285 - DNA, 22 bp, Homo sapiens
caggacaatctcgtcgggtcct

SEQ ID NO: 7687286 - DNA, 22 bp, Homo sapiens
caggacaagagggaatcgataa

SEQ ID NO: 7687287 - DNA, 22 bp, Homo sapiens
caggacaatggtcatactggat

SEQ ID NO: 7687288 - DNA, 22 bp, Homo sapiens
caggacaacctcaggttgctgc

SEQ ID NO: 7687289 - DNA, 22 bp, Homo sapiens
caggacaagagggaatcgataa

SEQ ID NO: 7687290 - DNA, 22 bp, Homo sapiens
caggacaagagggaatcgataa

SEQ ID NO: 7687291 - DNA, 22 bp, Homo sapiens
caggacaagagggaatcgataa

SEQ ID NO: 7687292 - DNA, 22 bp, Homo sapiens
caggaatgtttgtgctccttta

SEQ ID NO: 7687293 - DNA, 22 bp, Homo sapiens
caggaatgttgcatgtgatctt

SEQ ID NO: 7687294 - DNA, 22 bp, Homo sapiens
caggaatgtgagggttccctgc

SEQ ID NO: 7687295 - DNA, 22 bp, Homo sapiens
caggaatgtttgtgctccttta

SEQ ID NO: 7687296 - DNA, 22 bp, Homo sapiens
caggaatgttgcatgtgatctt

SEQ ID NO: 7687297 - DNA, 22 bp, Homo sapiens
caggaatgtttgtgctccttta

SEQ ID NO: 7687298 - DNA, 22 bp, Homo sapiens
caggaatgtttgtgctccttta

SEQ ID NO: 7687299 - DNA, 22 bp, Homo sapiens
caggaatgtttgtgctccttta

SEQ ID NO: 7687300 - DNA, 22 bp, Homo sapiens
caggaatgtcccatccccttca

SEQ ID NO: 7687301 - DNA, 22 bp, Homo sapiens
caggaatgtccttgtcatttca

SEQ ID NO: 7687302 - DNA, 22 bp, Homo sapiens
caggaatgtccttgtcatttca

SEQ ID NO: 7687303 - DNA, 22 bp, Homo sapiens
caggaatgtgagggttccctgc

SEQ ID NO: 7687304 - DNA, 22 bp, Homo sapiens
caggacactaaaaagccaagct

SEQ ID NO: 7687305 - DNA, 22 bp, Homo sapiens
caggacactaaaaagccaagct

SEQ ID NO: 7687306 - DNA, 22 bp, Homo sapiens
caggacactaaaaagccaagct

SEQ ID NO: 7687307 - DNA, 22 bp, Homo sapiens
caggacactaaaaagccaagct

SEQ ID NO: 7687308 - DNA, 22 bp, Homo sapiens
caggacacagggtgtggctgat

SEQ ID NO: 7687309 - DNA, 22 bp, Homo sapiens
caggacacagggtgtggctgat

SEQ ID NO: 7687310 - DNA, 22 bp, Homo sapiens
caggacaatttccacttggtaa

SEQ ID NO: 7687311 - DNA, 22 bp, Homo sapiens
caggacaattttgagccacctg

SEQ ID NO: 7687312 - DNA, 22 bp, Homo sapiens
caggacaatttccacttggtaa

SEQ ID NO: 7687313 - DNA, 22 bp, Homo sapiens
caggacacagaataaggcagtt

SEQ ID NO: 7687314 - DNA, 22 bp, Homo sapiens
caggacacagaataaggcagtt

SEQ ID NO: 7687315 - DNA, 22 bp, Homo sapiens
caggacaattttgagccacctg

SEQ ID NO: 7687316 - DNA, 22 bp, Homo sapiens
caggacacagaataaggcagtt

SEQ ID NO: 7687317 - DNA, 22 bp, Homo sapiens
caggacacagggtgtggctgat

SEQ ID NO: 7687318 - DNA, 22 bp, Homo sapiens
caggacacagaataaggcagtt

SEQ ID NO: 7687319 - DNA, 22 bp, Homo sapiens
caggaatgatctgctgagtgat

SEQ ID NO: 7687320 - DNA, 22 bp, Homo sapiens
caggaatgcattctagaatggc

SEQ ID NO: 7687321 - DNA, 22 bp, Homo sapiens
caggaatgccaaccagtgcatg

SEQ ID NO: 7687322 - DNA, 22 bp, Homo sapiens
caggaatgccaaccagtgcatg

SEQ ID NO: 7687323 - DNA, 22 bp, Homo sapiens
caggaatgatattcgaggagat

SEQ ID NO: 7687324 - DNA, 22 bp, Homo sapiens
caggaatgagttctggtgctct

SEQ ID NO: 7687325 - DNA, 22 bp, Homo sapiens
caggaatgatctgctgagtgat

SEQ ID NO: 7687326 - DNA, 22 bp, Homo sapiens
caggaatgatattcgaggagat

SEQ ID NO: 7687327 - DNA, 22 bp, Homo sapiens
caggaatgatctgctgagtgat

SEQ ID NO: 7687328 - DNA, 22 bp, Homo sapiens
caggaatgatattcgaggagat

SEQ ID NO: 7687329 - DNA, 22 bp, Homo sapiens
caggaatgagttctggtgctct

SEQ ID NO: 7687330 - DNA, 22 bp, Homo sapiens
caggaatgagttctggtgctct

SEQ ID NO: 7687331 - DNA, 22 bp, Homo sapiens
caggaatgagttctggtgctct

SEQ ID NO: 7687332 - DNA, 22 bp, Homo sapiens
caggaatgaggtcgtaagtgtc

SEQ ID NO: 7687333 - DNA, 22 bp, Homo sapiens
caggaatgaggtcgtaagtgtc

SEQ ID NO: 7687334 - DNA, 22 bp, Homo sapiens
caggaatgaggtcgtaagtgtc

SEQ ID NO: 7687335 - DNA, 19 bp, Homo sapiens
caggaatgaggtaatggct

SEQ ID NO: 7687336 - DNA, 19 bp, Homo sapiens
caggaatgaggtaatggct

SEQ ID NO: 7687337 - DNA, 19 bp, Homo sapiens
caggaatgaggtaatggct

SEQ ID NO: 7687338 - DNA, 22 bp, Homo sapiens
caggaatgactgcagatggggc

SEQ ID NO: 7687339 - DNA, 22 bp, Homo sapiens
caggaatgtatgatacagtggt

SEQ ID NO: 7687340 - DNA, 22 bp, Homo sapiens
caggaatgtatgatacagtggt

SEQ ID NO: 7687341 - DNA, 22 bp, Homo sapiens
caggaatgtatgatacagtggt

SEQ ID NO: 7687342 - DNA, 22 bp, Homo sapiens
caggaatgtatgatacagtggt

SEQ ID NO: 7687343 - DNA, 22 bp, Homo sapiens
caggaatgtagcagcgatggaa

SEQ ID NO: 7687344 - DNA, 22 bp, Homo sapiens
caggaatgtagcagcgatggaa

SEQ ID NO: 7687345 - DNA, 22 bp, Homo sapiens
caggaatggttaatctaaagtg

SEQ ID NO: 7687346 - DNA, 22 bp, Homo sapiens
caggaatggttgggactatgtt

SEQ ID NO: 7687347 - DNA, 22 bp, Homo sapiens
caggaatggttgggactatgtt

SEQ ID NO: 7687348 - DNA, 22 bp, Homo sapiens
caggaatggttgggactatgtt

SEQ ID NO: 7687349 - DNA, 22 bp, Homo sapiens
caggaatgtagcagcgatggaa

SEQ ID NO: 7687350 - DNA, 22 bp, Homo sapiens
caggaatgtagcagcgatggaa

SEQ ID NO: 7687351 - DNA, 22 bp, Homo sapiens
caggaatgtagcagcgatggaa

SEQ ID NO: 7687352 - DNA, 22 bp, Homo sapiens
caggaatgggtgacagtcagct

SEQ ID NO: 7687353 - DNA, 22 bp, Homo sapiens
caggaatgggtgacagtcagct

SEQ ID NO: 7687354 - DNA, 22 bp, Homo sapiens
caggaatgggtgacagtcagct

SEQ ID NO: 7687355 - DNA, 22 bp, Homo sapiens
caggaatgggtgacagtcagct

SEQ ID NO: 7687356 - DNA, 18 bp, Homo sapiens
caggaatggatgggattt

SEQ ID NO: 7687357 - DNA, 18 bp, Homo sapiens
caggaatggatgggattt

SEQ ID NO: 7687358 - DNA, 18 bp, Homo sapiens
caggaatggatgggattt

SEQ ID NO: 7687359 - DNA, 22 bp, Homo sapiens
caggaatggaggcatttatgaa

SEQ ID NO: 7687360 - DNA, 22 bp, Homo sapiens
caggaatgccttcttcagccat

SEQ ID NO: 7687361 - DNA, 22 bp, Homo sapiens
caggaatgccttcttcagccat

SEQ ID NO: 7687362 - DNA, 22 bp, Homo sapiens
caggaatggaggcatttatgaa

SEQ ID NO: 7687363 - DNA, 18 bp, Homo sapiens
caggaatggatgggattt

SEQ ID NO: 7687364 - DNA, 22 bp, Homo sapiens
caggacagtataggctttagga

SEQ ID NO: 7687365 - DNA, 22 bp, Homo sapiens
caggacaggtgttctagatcag

SEQ ID NO: 7687366 - DNA, 22 bp, Homo sapiens
caggacagtataggctttagga

SEQ ID NO: 7687367 - DNA, 22 bp, Homo sapiens
caggacagtataggctttagga

SEQ ID NO: 7687368 - DNA, 22 bp, Homo sapiens
caggacagtataggctttagga

SEQ ID NO: 7687369 - DNA, 22 bp, Homo sapiens
caggacagtataggctttagga

SEQ ID NO: 7687370 - DNA, 22 bp, Homo sapiens
caggacagtataggctttagga

SEQ ID NO: 7687371 - DNA, 22 bp, Homo sapiens
caggacagtataggctttagga

SEQ ID NO: 7687372 - DNA, 22 bp, Homo sapiens
caggacaggtgttctagatcag

SEQ ID NO: 7687373 - DNA, 22 bp, Homo sapiens
caggacaggccctgtggggtct

SEQ ID NO: 7687374 - DNA, 22 bp, Homo sapiens
caggacaggtgttctagatcag

SEQ ID NO: 7687375 - DNA, 22 bp, Homo sapiens
caggacaggtgttctagatcag

SEQ ID NO: 7687376 - DNA, 22 bp, Homo sapiens
caggacaggtgttctagatcag

SEQ ID NO: 7687377 - DNA, 22 bp, Homo sapiens
caggacaggccctgtggggtct

SEQ ID NO: 7687378 - DNA, 22 bp, Homo sapiens
caggacaggtgttctagatcag

SEQ ID NO: 7687379 - DNA, 22 bp, Homo sapiens
caggacaggtgttctagatcag

SEQ ID NO: 7687380 - DNA, 22 bp, Homo sapiens
caggacaggccctgtggggtct

SEQ ID NO: 7687381 - DNA, 22 bp, Homo sapiens
caggacaggtgttctagatcag

SEQ ID NO: 7687382 - DNA, 22 bp, Homo sapiens
caggacaggtgttctagatcag

SEQ ID NO: 7687383 - DNA, 22 bp, Homo sapiens
caggacagtgcaggtccatcct

SEQ ID NO: 7687384 - DNA, 22 bp, Homo sapiens
caggacagtataggctttagga

SEQ ID NO: 7687385 - DNA, 22 bp, Homo sapiens
caggacagtgcaggtccatcct

SEQ ID NO: 7687386 - DNA, 22 bp, Homo sapiens
gttttccaggtaccttggtatt

SEQ ID NO: 7687387 - DNA, 22 bp, Homo sapiens
gttttccaggtaccttggtatt

SEQ ID NO: 7687388 - DNA, 18 bp, Homo sapiens
gttttccatttgttcctc

SEQ ID NO: 7687389 - DNA, 18 bp, Homo sapiens
gttttccatttgttcctc

SEQ ID NO: 7687390 - DNA, 22 bp, Homo sapiens
gttttccatggaggtctgacct

SEQ ID NO: 7687391 - DNA, 22 bp, Homo sapiens
gttttcctactgtatcatcaaa

SEQ ID NO: 7687392 - DNA, 22 bp, Homo sapiens
gttttcctactgtatcatcaaa

SEQ ID NO: 7687393 - DNA, 18 bp, Homo sapiens
gttttccatttgttcctc

SEQ ID NO: 7687394 - DNA, 22 bp, Homo sapiens
gttttcctgaaactgatggtgt

SEQ ID NO: 7687395 - DNA, 22 bp, Homo sapiens
gttttcctgaaactgatggtgt

SEQ ID NO: 7687396 - DNA, 22 bp, Homo sapiens
gttttcctactgtatcatcaaa

SEQ ID NO: 7687397 - DNA, 22 bp, Homo sapiens
gttttcctactgtatcatcaaa

SEQ ID NO: 7687398 - DNA, 22 bp, Homo sapiens
gttttcctactgtatcatcaaa

SEQ ID NO: 7687399 - DNA, 22 bp, Homo sapiens
caggacagctgggccaccacca

SEQ ID NO: 7687400 - DNA, 22 bp, Homo sapiens
caggacaggagtggggtcaaag

SEQ ID NO: 7687401 - DNA, 22 bp, Homo sapiens
caggacaggagtggggtcaaag

SEQ ID NO: 7687402 - DNA, 22 bp, Homo sapiens
caggacaggagtggggtcaaag

SEQ ID NO: 7687403 - DNA, 22 bp, Homo sapiens
caggacaggagtggggtcaaag

SEQ ID NO: 7687404 - DNA, 22 bp, Homo sapiens
caggacagctgggccaccacca

SEQ ID NO: 7687405 - DNA, 22 bp, Homo sapiens
caggacaggagtggggtcaaag

SEQ ID NO: 7687406 - DNA, 22 bp, Homo sapiens
caggacaggagtggggtcaaag

SEQ ID NO: 7687407 - DNA, 22 bp, Homo sapiens
caggacaggagtggggtcaaag

SEQ ID NO: 7687408 - DNA, 22 bp, Homo sapiens
caggacaggagtggggtcaaag

SEQ ID NO: 7687409 - DNA, 22 bp, Homo sapiens
caggacaggagtggggtcaaag

SEQ ID NO: 7687410 - DNA, 22 bp, Homo sapiens
caggacaggccctgtggggtct

SEQ ID NO: 7687411 - DNA, 22 bp, Homo sapiens
caggacaggagtggggtcaaag

SEQ ID NO: 7687412 - DNA, 22 bp, Homo sapiens
caggacaggagtggggtcaaag

SEQ ID NO: 7687413 - DNA, 22 bp, Homo sapiens
caggacaggagtggggtcaaag

SEQ ID NO: 7687414 - DNA, 22 bp, Homo sapiens
caggacaggccctgtggggtct

SEQ ID NO: 7687415 - DNA, 22 bp, Homo sapiens
caggacaggccctgtggggtct

SEQ ID NO: 7687416 - DNA, 22 bp, Homo sapiens
caggacaggccctgtggggtct

SEQ ID NO: 7687417 - DNA, 22 bp, Homo sapiens
caggacaggccctgtggggtct

SEQ ID NO: 7687418 - DNA, 22 bp, Homo sapiens
caggacaggccctgtggggtct

SEQ ID NO: 7687419 - DNA, 22 bp, Homo sapiens
caggacagctcaacacctcctc

SEQ ID NO: 7687420 - DNA, 22 bp, Homo sapiens
caggacagctcaacacctcctc

SEQ ID NO: 7687421 - DNA, 22 bp, Homo sapiens
caggacagctcaacacctcctc

SEQ ID NO: 7687422 - DNA, 22 bp, Homo sapiens
caggacagctgggccaccacca

SEQ ID NO: 7687423 - DNA, 22 bp, Homo sapiens
caggacagctcaacacctcctc

SEQ ID NO: 7687424 - DNA, 22 bp, Homo sapiens
caggacagctcaacacctcctc

SEQ ID NO: 7687425 - DNA, 22 bp, Homo sapiens
caggacagctgggccaccacca

SEQ ID NO: 7687426 - DNA, 22 bp, Homo sapiens
caggacagctgggccaccacca

SEQ ID NO: 7687427 - DNA, 22 bp, Homo sapiens
caggacagctgggccaccacca

SEQ ID NO: 7687428 - DNA, 22 bp, Homo sapiens
caggacagctgggccaccacca

SEQ ID NO: 7687429 - DNA, 22 bp, Homo sapiens
caggacacttgttcttctctgc

SEQ ID NO: 7687430 - DNA, 22 bp, Homo sapiens
caggacacttgttcttctctgc

SEQ ID NO: 7687431 - DNA, 22 bp, Homo sapiens
caggacagctcaacacctcctc

SEQ ID NO: 7687432 - DNA, 22 bp, Homo sapiens
caggacagctcaacacctcctc

SEQ ID NO: 7687433 - DNA, 22 bp, Homo sapiens
caggacagctcaacacctcctc

SEQ ID NO: 7687434 - DNA, 22 bp, Homo sapiens
caggacagctcaacacctcctc

SEQ ID NO: 7687435 - DNA, 22 bp, Homo sapiens
caggaagtgcctggtgagagga

SEQ ID NO: 7687436 - DNA, 22 bp, Homo sapiens
caggaagtctttgcccaggcca

SEQ ID NO: 7687437 - DNA, 22 bp, Homo sapiens
caggaagtctttgcccaggcca

SEQ ID NO: 7687438 - DNA, 22 bp, Homo sapiens
caggaagtctttgcccaggcca

SEQ ID NO: 7687439 - DNA, 22 bp, Homo sapiens
caggaagtcgcagagctggggg

SEQ ID NO: 7687440 - DNA, 22 bp, Homo sapiens
caggaagtcgcagagctggggg

SEQ ID NO: 7687441 - DNA, 22 bp, Homo sapiens
caggaagggggatccttggaag

SEQ ID NO: 7687442 - DNA, 22 bp, Homo sapiens
caggaagtagagttggccagcc

SEQ ID NO: 7687443 - DNA, 22 bp, Homo sapiens
caggaagggggatccttggaag

SEQ ID NO: 7687444 - DNA, 22 bp, Homo sapiens
caggaagggggatccttggaag

SEQ ID NO: 7687445 - DNA, 22 bp, Homo sapiens
caggaagggggatccttggaag

SEQ ID NO: 7687446 - DNA, 22 bp, Homo sapiens
caggaagggggatccttggaag

SEQ ID NO: 7687447 - DNA, 22 bp, Homo sapiens
caggaagggggatccttggaag

SEQ ID NO: 7687448 - DNA, 22 bp, Homo sapiens
caggaagtgcctggtgagagga

SEQ ID NO: 7687449 - DNA, 22 bp, Homo sapiens
caggaagtgcctggtgagagga

SEQ ID NO: 7687450 - DNA, 22 bp, Homo sapiens
caggaagtgcctggtgagagga

SEQ ID NO: 7687451 - DNA, 22 bp, Homo sapiens
caggaagtgctcgctgtgggga

SEQ ID NO: 7687452 - DNA, 22 bp, Homo sapiens
caggaagtggggtcatggagta

SEQ ID NO: 7687453 - DNA, 22 bp, Homo sapiens
caggaagtggctgggctgggtt

SEQ ID NO: 7687454 - DNA, 22 bp, Homo sapiens
caggaagtggctgggctgggtt

SEQ ID NO: 7687455 - DNA, 22 bp, Homo sapiens
caggaagtggctgggctgggtt

SEQ ID NO: 7687456 - DNA, 22 bp, Homo sapiens
caggaagtggggtcatggagta

SEQ ID NO: 7687457 - DNA, 22 bp, Homo sapiens
caggaagtggggtcatggagta

SEQ ID NO: 7687458 - DNA, 22 bp, Homo sapiens
caggaagtgggtagaaggaata

SEQ ID NO: 7687459 - DNA, 22 bp, Homo sapiens
caggaagtgggtagaaggaata

SEQ ID NO: 7687460 - DNA, 22 bp, Homo sapiens
caggaagtgggtagaaggaata

SEQ ID NO: 7687461 - DNA, 22 bp, Homo sapiens
caggaagtgtgagggtggtgta

SEQ ID NO: 7687462 - DNA, 22 bp, Homo sapiens
caggaagtgtgagggtggtgta

SEQ ID NO: 7687463 - DNA, 22 bp, Homo sapiens
caggaagtgtgagggtggtgta

SEQ ID NO: 7687464 - DNA, 22 bp, Homo sapiens
caggaatgactgcagatggggc

SEQ ID NO: 7687465 - DNA, 22 bp, Homo sapiens
caggaatgactgcagatggggc

SEQ ID NO: 7687466 - DNA, 22 bp, Homo sapiens
caggaatgactgcagatggggc

SEQ ID NO: 7687467 - DNA, 22 bp, Homo sapiens
caggaatgacccaacagtttca

SEQ ID NO: 7687468 - DNA, 22 bp, Homo sapiens
caggaatgacccaacagtttca

SEQ ID NO: 7687469 - DNA, 22 bp, Homo sapiens
caggaatgacccaacagtttca

SEQ ID NO: 7687470 - DNA, 22 bp, Homo sapiens
caggaatgaaaggtcagggttg

SEQ ID NO: 7687471 - DNA, 22 bp, Homo sapiens
caggaatgaaaggtcagggttg

SEQ ID NO: 7687472 - DNA, 22 bp, Homo sapiens
caggaatgaaaggtcagggttg

SEQ ID NO: 7687473 - DNA, 22 bp, Homo sapiens
caggaatgaaaggtcagggttg

SEQ ID NO: 7687474 - DNA, 22 bp, Homo sapiens
caggaagtgtgagggtggtgta

SEQ ID NO: 7687475 - DNA, 22 bp, Homo sapiens
caggaagttgtgtgttcgaggc

SEQ ID NO: 7687476 - DNA, 22 bp, Homo sapiens
caggaagtgtgcctgagcacct

SEQ ID NO: 7687477 - DNA, 22 bp, Homo sapiens
caggaagtgtgcctgagcacct

SEQ ID NO: 7687478 - DNA, 22 bp, Homo sapiens
caggaatagggcgtgagcatat

SEQ ID NO: 7687479 - DNA, 22 bp, Homo sapiens
caggaagttgtgtgttcgaggc

SEQ ID NO: 7687480 - DNA, 22 bp, Homo sapiens
caggaagttgtgtgttcgaggc

SEQ ID NO: 7687481 - DNA, 22 bp, Homo sapiens
caggaatccagagtgagcctcc

SEQ ID NO: 7687482 - DNA, 22 bp, Homo sapiens
caggaatcctatggcttttgct

SEQ ID NO: 7687483 - DNA, 22 bp, Homo sapiens
caggaatccagagtgagcctcc

SEQ ID NO: 7687484 - DNA, 22 bp, Homo sapiens
caggaatagtggagcaacaaga

SEQ ID NO: 7687485 - DNA, 22 bp, Homo sapiens
caggaatagtggagcaacaaga

SEQ ID NO: 7687486 - DNA, 22 bp, Homo sapiens
caggaatagtggagcaacaaga

SEQ ID NO: 7687487 - DNA, 22 bp, Homo sapiens
caggaaggaaagggtgtggaga

SEQ ID NO: 7687488 - DNA, 22 bp, Homo sapiens
caggaaggaaagggtgtggaga

SEQ ID NO: 7687489 - DNA, 22 bp, Homo sapiens
caggaaggaaagggtgtggaga

SEQ ID NO: 7687490 - DNA, 22 bp, Homo sapiens
caggaaggaaagggtgtggaga

SEQ ID NO: 7687491 - DNA, 22 bp, Homo sapiens
caggaaggaaagggtgtggaga

SEQ ID NO: 7687492 - DNA, 22 bp, Homo sapiens
caggaaggaccgtccagatcag

SEQ ID NO: 7687493 - DNA, 22 bp, Homo sapiens
caggaaggaaagggtgtggaga

SEQ ID NO: 7687494 - DNA, 22 bp, Homo sapiens
caggaagggggatccttggaag

SEQ ID NO: 7687495 - DNA, 22 bp, Homo sapiens
caggaagggggatccttggaag

SEQ ID NO: 7687496 - DNA, 22 bp, Homo sapiens
caggaagggggatccttggaag

SEQ ID NO: 7687497 - DNA, 22 bp, Homo sapiens
caggaaggaaagggtgtggaga

SEQ ID NO: 7687498 - DNA, 22 bp, Homo sapiens
caggaaggaaagggtgtggaga

SEQ ID NO: 7687499 - DNA, 22 bp, Homo sapiens
caggaaggaaagggtgtggaga

SEQ ID NO: 7687500 - DNA, 22 bp, Homo sapiens
caggaaggaaagggtgtggaga

SEQ ID NO: 7687501 - DNA, 22 bp, Homo sapiens
caggaaggaaagggtgtggaga

SEQ ID NO: 7687502 - DNA, 22 bp, Homo sapiens
caggaaggaaagggtgtggaga

SEQ ID NO: 7687503 - DNA, 22 bp, Homo sapiens
caggaaggaaagggtgtggaga

SEQ ID NO: 7687504 - DNA, 22 bp, Homo sapiens
caggaagctgtgaaggagacgg

SEQ ID NO: 7687505 - DNA, 22 bp, Homo sapiens
caggaagctgtgaaggagacgg

SEQ ID NO: 7687506 - DNA, 22 bp, Homo sapiens
caggaagctgtgaaggagacgg

SEQ ID NO: 7687507 - DNA, 22 bp, Homo sapiens
caggaagctggtcagatcctgt

SEQ ID NO: 7687508 - DNA, 22 bp, Homo sapiens
caggaagctgtgaaggagacgg

SEQ ID NO: 7687509 - DNA, 22 bp, Homo sapiens
caggaagctgtgaaggagacgg

SEQ ID NO: 7687510 - DNA, 22 bp, Homo sapiens
caggaagctggtcagatcctgt

SEQ ID NO: 7687511 - DNA, 22 bp, Homo sapiens
caggaagctgccggtgagcgag

SEQ ID NO: 7687512 - DNA, 22 bp, Homo sapiens
caggaagctgccggtgagcgag

SEQ ID NO: 7687513 - DNA, 22 bp, Homo sapiens
caggaagctgccggtgagcgag

SEQ ID NO: 7687514 - DNA, 22 bp, Homo sapiens
caggaagctgagctgcactgca

SEQ ID NO: 7687515 - DNA, 22 bp, Homo sapiens
caggaagctgagctgcactgca

SEQ ID NO: 7687516 - DNA, 22 bp, Homo sapiens
caggaagctgagctgcactgca

SEQ ID NO: 7687517 - DNA, 22 bp, Homo sapiens
caggaagctgagctgcactgca

SEQ ID NO: 7687518 - DNA, 22 bp, Homo sapiens
caggaagctgagctgcactgca

SEQ ID NO: 7687519 - DNA, 22 bp, Homo sapiens
caggaagctgatgtctagtcat

SEQ ID NO: 7687520 - DNA, 22 bp, Homo sapiens
caggaagctgatgtctagtcat

SEQ ID NO: 7687521 - DNA, 22 bp, Homo sapiens
gtttggaatagcagtaaacatt

SEQ ID NO: 7687522 - DNA, 22 bp, Homo sapiens
gtttggaatagcagtaaacatt

SEQ ID NO: 7687523 - DNA, 22 bp, Homo sapiens
gtttggaatagcagtaaacatt

SEQ ID NO: 7687524 - DNA, 22 bp, Homo sapiens
gtttggaatagcagtaaacatt

SEQ ID NO: 7687525 - DNA, 22 bp, Homo sapiens
gtttggaatagcagtaaacatt

SEQ ID NO: 7687526 - DNA, 22 bp, Homo sapiens
gtttggaagttaagtgcagcag

SEQ ID NO: 7687527 - DNA, 22 bp, Homo sapiens
gtttggaagttaagtgcagcag

SEQ ID NO: 7687528 - DNA, 21 bp, Homo sapiens
gtttggaacagaccctgggga

SEQ ID NO: 7687529 - DNA, 21 bp, Homo sapiens
gtttggaacagaccctgggga

SEQ ID NO: 7687530 - DNA, 18 bp, Homo sapiens
gtttggacttttctccct

SEQ ID NO: 7687531 - DNA, 22 bp, Homo sapiens
gtttggagccccgtgggaagga

SEQ ID NO: 7687532 - DNA, 22 bp, Homo sapiens
gtttggagccccgtgggaagga

SEQ ID NO: 7687533 - DNA, 22 bp, Homo sapiens
gtttggaatgagtcctgccatt

SEQ ID NO: 7687534 - DNA, 22 bp, Homo sapiens
gtttggaatgagtcctgccatt

SEQ ID NO: 7687535 - DNA, 19 bp, Homo sapiens
gtttggatcccctgttaga

SEQ ID NO: 7687536 - DNA, 22 bp, Homo sapiens
gtttggatgtgtagtgagggga

SEQ ID NO: 7687537 - DNA, 22 bp, Homo sapiens
gtttggatagtgagagatactt

SEQ ID NO: 7687538 - DNA, 22 bp, Homo sapiens
gtttggcaagaagaggagtaag

SEQ ID NO: 7687539 - DNA, 22 bp, Homo sapiens
gtttggcaagaagaggagtaag

SEQ ID NO: 7687540 - DNA, 22 bp, Homo sapiens
gtttggcactatgatgaggcta

SEQ ID NO: 7687541 - DNA, 22 bp, Homo sapiens
gtttggcactatgatgaggcta

SEQ ID NO: 7687542 - DNA, 22 bp, Homo sapiens
gtttggggtctgcagagcggcg

SEQ ID NO: 7687543 - DNA, 22 bp, Homo sapiens
gtttgggtaatatcagtagagt

SEQ ID NO: 7687544 - DNA, 22 bp, Homo sapiens
gtttgggtccctctgtcccact

SEQ ID NO: 7687545 - DNA, 22 bp, Homo sapiens
gtttggggtctgcagagcggcg

SEQ ID NO: 7687546 - DNA, 22 bp, Homo sapiens
gtttgggtaatatcagtagagt

SEQ ID NO: 7687547 - DNA, 22 bp, Homo sapiens
gtttgggtacaggcttcaggtg

SEQ ID NO: 7687548 - DNA, 18 bp, Homo sapiens
gtttggcataactgatgc

SEQ ID NO: 7687549 - DNA, 18 bp, Homo sapiens
gtttggcataactgatgc

SEQ ID NO: 7687550 - DNA, 22 bp, Homo sapiens
gtttggcagtgttatgtaggtt

SEQ ID NO: 7687551 - DNA, 19 bp, Homo sapiens
gtttggcagcaaatcagac

SEQ ID NO: 7687552 - DNA, 19 bp, Homo sapiens
gtttggcagcaaatcagac

SEQ ID NO: 7687553 - DNA, 22 bp, Homo sapiens
gtttggcagttttagagtgcaa

SEQ ID NO: 7687554 - DNA, 23 bp, Homo sapiens
caggaagcagatggggtagaaga

SEQ ID NO: 7687555 - DNA, 23 bp, Homo sapiens
caggaagcagatggggtagaaga

SEQ ID NO: 7687556 - DNA, 23 bp, Homo sapiens
caggaagcagatggggtagaaga

SEQ ID NO: 7687557 - DNA, 22 bp, Homo sapiens
gtttgtatgaatgttttatgct

SEQ ID NO: 7687558 - DNA, 22 bp, Homo sapiens
gtttgtatgaatgttttatgct

SEQ ID NO: 7687559 - DNA, 22 bp, Homo sapiens
gtttgtatgaatgttttatgct

SEQ ID NO: 7687560 - DNA, 22 bp, Homo sapiens
gtttgtatgaatgttttatgct

SEQ ID NO: 7687561 - DNA, 22 bp, Homo sapiens
gtttgtaattacctcttttgac

SEQ ID NO: 7687562 - DNA, 22 bp, Homo sapiens
gtttgtaattactgcagcatgg

SEQ ID NO: 7687563 - DNA, 22 bp, Homo sapiens
gtttgtaattacctcttttgac

SEQ ID NO: 7687564 - DNA, 22 bp, Homo sapiens
gtttggttggctgtctttaaca

SEQ ID NO: 7687565 - DNA, 22 bp, Homo sapiens
gtttggttggctgtctttaaca

SEQ ID NO: 7687566 - DNA, 22 bp, Homo sapiens
gtttgtaaccagaacagagagt

SEQ ID NO: 7687567 - DNA, 22 bp, Homo sapiens
gtttgtaaccagaacagagagt

SEQ ID NO: 7687568 - DNA, 22 bp, Homo sapiens
gtttgtaaccagaacagagagt

SEQ ID NO: 7687569 - DNA, 22 bp, Homo sapiens
gtttgtaagcagtctgcttgtg

SEQ ID NO: 7687570 - DNA, 21 bp, Homo sapiens
gtttgtaaggcactgtgttct

SEQ ID NO: 7687571 - DNA, 22 bp, Homo sapiens
gtttggttggctgtctttaaca

SEQ ID NO: 7687572 - DNA, 22 bp, Homo sapiens
gtttggttccaaagcccattct

SEQ ID NO: 7687573 - DNA, 22 bp, Homo sapiens
gtttggtggtagcattggctat

SEQ ID NO: 7687574 - DNA, 22 bp, Homo sapiens
gtttggtgtgagttcataccac

SEQ ID NO: 7687575 - DNA, 22 bp, Homo sapiens
gtttggttccaaagcccattct

SEQ ID NO: 7687576 - DNA, 22 bp, Homo sapiens
gtttggttccaaagcccattct

SEQ ID NO: 7687577 - DNA, 22 bp, Homo sapiens
gtttggtgagcagcttgggtat

SEQ ID NO: 7687578 - DNA, 22 bp, Homo sapiens
gtttggtgacacatagtttgat

SEQ ID NO: 7687579 - DNA, 22 bp, Homo sapiens
gtttggtgagctaagattattt

SEQ ID NO: 7687580 - DNA, 22 bp, Homo sapiens
caggaagccttccttgtctgct

SEQ ID NO: 7687581 - DNA, 22 bp, Homo sapiens
caggaagccttccttgtctgct

SEQ ID NO: 7687582 - DNA, 22 bp, Homo sapiens
caggaagctgagctgcactgca

SEQ ID NO: 7687583 - DNA, 22 bp, Homo sapiens
caggaagctgagctgcactgca

SEQ ID NO: 7687584 - DNA, 22 bp, Homo sapiens
caggaagctgagctgcactgca

SEQ ID NO: 7687585 - DNA, 22 bp, Homo sapiens
caggaagctgagctgcactgca

SEQ ID NO: 7687586 - DNA, 22 bp, Homo sapiens
caggaagctcttagcagtcacc

SEQ ID NO: 7687587 - DNA, 22 bp, Homo sapiens
caggaagctcttagcagtcacc

SEQ ID NO: 7687588 - DNA, 22 bp, Homo sapiens
caggaagctcttagcagtcacc

SEQ ID NO: 7687589 - DNA, 22 bp, Homo sapiens
caggaagccacaggacaggtag

SEQ ID NO: 7687590 - DNA, 22 bp, Homo sapiens
caggaagccacaggacaggtag

SEQ ID NO: 7687591 - DNA, 22 bp, Homo sapiens
caggaagcatctggctagctaa

SEQ ID NO: 7687592 - DNA, 22 bp, Homo sapiens
caggaagcatctggctagctaa

SEQ ID NO: 7687593 - DNA, 22 bp, Homo sapiens
caggaagcatctggctagctaa

SEQ ID NO: 7687594 - DNA, 22 bp, Homo sapiens
caggaagccacaggacaggtag

SEQ ID NO: 7687595 - DNA, 22 bp, Homo sapiens
taaaaatcttatgaatggcaag

SEQ ID NO: 7687596 - DNA, 22 bp, Homo sapiens
taaaaatcttatgaatggcaag

SEQ ID NO: 7687597 - DNA, 22 bp, Homo sapiens
taaaaatcttatgaatggcaag

SEQ ID NO: 7687598 - DNA, 22 bp, Homo sapiens
taaaaatcttatgaatggcaag

SEQ ID NO: 7687599 - DNA, 22 bp, Homo sapiens
taaaaatcttatgaatggcaag

SEQ ID NO: 7687600 - DNA, 22 bp, Homo sapiens
taaaaatcttatgaatggcaag

SEQ ID NO: 7687601 - DNA, 22 bp, Homo sapiens
taaaaatcttatgaatggcaag

SEQ ID NO: 7687602 - DNA, 22 bp, Homo sapiens
taaaaatcttatgaatggcaag

SEQ ID NO: 7687603 - DNA, 22 bp, Homo sapiens
taaaaatcttatgaatggcaag

SEQ ID NO: 7687604 - DNA, 22 bp, Homo sapiens
taaaaatcttatgaatggcaag

SEQ ID NO: 7687605 - DNA, 22 bp, Homo sapiens
taaaaatcttatgaatggcaag

SEQ ID NO: 7687606 - DNA, 22 bp, Homo sapiens
taaaaagtagtgagaatggcgc

SEQ ID NO: 7687607 - DNA, 22 bp, Homo sapiens
taaaaagtagtgagaatggcgc

SEQ ID NO: 7687608 - DNA, 22 bp, Homo sapiens
taaaaagttgaaaggacttatc

SEQ ID NO: 7687609 - DNA, 22 bp, Homo sapiens
taaaaagttgaaaggacttatc

SEQ ID NO: 7687610 - DNA, 22 bp, Homo sapiens
taaaaagttgaaaggacttatc

SEQ ID NO: 7687611 - DNA, 22 bp, Homo sapiens
taaaaagttgaaaggacttatc

SEQ ID NO: 7687612 - DNA, 22 bp, Homo sapiens
taaaaagttgaaaggacttatc

SEQ ID NO: 7687613 - DNA, 22 bp, Homo sapiens
taaaaagttgaaaggacttatc

SEQ ID NO: 7687614 - DNA, 22 bp, Homo sapiens
taaaaagttgaaaggacttatc

SEQ ID NO: 7687615 - DNA, 22 bp, Homo sapiens
taaaatagcatgtgcagtgaaa

SEQ ID NO: 7687616 - DNA, 22 bp, Homo sapiens
taaaatagcatgtgcagtgaaa

SEQ ID NO: 7687617 - DNA, 22 bp, Homo sapiens
taaaatagcatgtgcagtgaaa

SEQ ID NO: 7687618 - DNA, 22 bp, Homo sapiens
taaaatagcatgtgcagtgaaa

SEQ ID NO: 7687619 - DNA, 22 bp, Homo sapiens
taaaaatcttatgaatggcaag

SEQ ID NO: 7687620 - DNA, 22 bp, Homo sapiens
taaaatagcatgtgcagtgaaa

SEQ ID NO: 7687621 - DNA, 22 bp, Homo sapiens
taaaatagcatgtgcagtgaaa

SEQ ID NO: 7687622 - DNA, 22 bp, Homo sapiens
taaaatagcatgtgcagtgaaa

SEQ ID NO: 7687623 - DNA, 22 bp, Homo sapiens
taaaatagccagtgcccctctg

SEQ ID NO: 7687624 - DNA, 22 bp, Homo sapiens
taaaatagccagtgcccctctg

SEQ ID NO: 7687625 - DNA, 22 bp, Homo sapiens
taaaatagccagtgcccctctg

SEQ ID NO: 7687626 - DNA, 22 bp, Homo sapiens
taaaatagcttatgtcttttga

SEQ ID NO: 7687627 - DNA, 22 bp, Homo sapiens
taaaatagcttatgtcttttga

SEQ ID NO: 7687628 - DNA, 22 bp, Homo sapiens
taaaatagcttatgtcttttga

SEQ ID NO: 7687629 - DNA, 22 bp, Homo sapiens
taaaatagcttatgtcttttga

SEQ ID NO: 7687630 - DNA, 22 bp, Homo sapiens
taaaatagcttatgtcttttga

SEQ ID NO: 7687631 - DNA, 22 bp, Homo sapiens
taaaatcaccaaaagcaggtgg

SEQ ID NO: 7687632 - DNA, 22 bp, Homo sapiens
taaaatcaccaaaagcaggtgg

SEQ ID NO: 7687633 - DNA, 22 bp, Homo sapiens
taaaatcaccaaaagcaggtgg

SEQ ID NO: 7687634 - DNA, 22 bp, Homo sapiens
taaaatcaccaaaagcaggtgg

SEQ ID NO: 7687635 - DNA, 22 bp, Homo sapiens
taaaatcaccaaaagcaggtgg

SEQ ID NO: 7687636 - DNA, 22 bp, Homo sapiens
taaaatcagccgaccatggtgg

SEQ ID NO: 7687637 - DNA, 22 bp, Homo sapiens
taaaatcatgacagattgacat

SEQ ID NO: 7687638 - DNA, 22 bp, Homo sapiens
taaaatcatgacagattgacat

SEQ ID NO: 7687639 - DNA, 22 bp, Homo sapiens
taaaatcatgacagattgacat

SEQ ID NO: 7687640 - DNA, 22 bp, Homo sapiens
taaaatcagccgaccatggtgg

SEQ ID NO: 7687641 - DNA, 22 bp, Homo sapiens
taaaatcagccgaccatggtgg

SEQ ID NO: 7687642 - DNA, 22 bp, Homo sapiens
taaaatcagccgaccatggtgg

SEQ ID NO: 7687643 - DNA, 22 bp, Homo sapiens
taaaatcagccgaccatggtgg

SEQ ID NO: 7687644 - DNA, 22 bp, Homo sapiens
taaaatcagccgaccatggtgg

SEQ ID NO: 7687645 - DNA, 22 bp, Homo sapiens
taaaatcattctggtgtcagta

SEQ ID NO: 7687646 - DNA, 22 bp, Homo sapiens
taaaatcattctggtgtcagta

SEQ ID NO: 7687647 - DNA, 22 bp, Homo sapiens
taaaatcattctggtgtcagta

SEQ ID NO: 7687648 - DNA, 22 bp, Homo sapiens
taaaatcattctggtgtcagta

SEQ ID NO: 7687649 - DNA, 22 bp, Homo sapiens
taaaatcattctggtgtcagta

SEQ ID NO: 7687650 - DNA, 22 bp, Homo sapiens
taaaatcattctggtgtcagta

SEQ ID NO: 7687651 - DNA, 22 bp, Homo sapiens
taaaatgacttcctccaacatc

SEQ ID NO: 7687652 - DNA, 22 bp, Homo sapiens
taaaatgacttcctccaacatc

SEQ ID NO: 7687653 - DNA, 22 bp, Homo sapiens
taaaatgacttcctccaacatc

SEQ ID NO: 7687654 - DNA, 22 bp, Homo sapiens
taaaatgacttcctccaacatc

SEQ ID NO: 7687655 - DNA, 22 bp, Homo sapiens
taaaatcattctggtgtcagta

SEQ ID NO: 7687656 - DNA, 22 bp, Homo sapiens
taaaatcattctggtgtcagta

SEQ ID NO: 7687657 - DNA, 22 bp, Homo sapiens
taaaatgacttcctccaacatc

SEQ ID NO: 7687658 - DNA, 22 bp, Homo sapiens
taaaatgacttcctccaacatc

SEQ ID NO: 7687659 - DNA, 22 bp, Homo sapiens
taaaatgacttcctccaacatc

SEQ ID NO: 7687660 - DNA, 22 bp, Homo sapiens
taaaatgacttcctccaacatc

SEQ ID NO: 7687661 - DNA, 22 bp, Homo sapiens
taaaatgacttcctccaacatc

SEQ ID NO: 7687662 - DNA, 22 bp, Homo sapiens
taaaatgacttcctccaacatc

SEQ ID NO: 7687663 - DNA, 22 bp, Homo sapiens
gttttctaccagggaagagagt

SEQ ID NO: 7687664 - DNA, 22 bp, Homo sapiens
gttttctaggatcccctccaag

SEQ ID NO: 7687665 - DNA, 22 bp, Homo sapiens
gttttctaccagggaagagagt

SEQ ID NO: 7687666 - DNA, 22 bp, Homo sapiens
gttttctaccagggaagagagt

SEQ ID NO: 7687667 - DNA, 22 bp, Homo sapiens
gttttctaccagggaagagagt

SEQ ID NO: 7687668 - DNA, 22 bp, Homo sapiens
gttttctaccagggaagagagt

SEQ ID NO: 7687669 - DNA, 22 bp, Homo sapiens
gttttctcaggatggtgtgtac

SEQ ID NO: 7687670 - DNA, 22 bp, Homo sapiens
gttttctaggatcccctccaag

SEQ ID NO: 7687671 - DNA, 22 bp, Homo sapiens
gttttctcaggatggtgtgtac

SEQ ID NO: 7687672 - DNA, 22 bp, Homo sapiens
gttttctcatctcctcaatggt

SEQ ID NO: 7687673 - DNA, 22 bp, Homo sapiens
gttttctgattagcaaatctga

SEQ ID NO: 7687674 - DNA, 22 bp, Homo sapiens
gttttctgattagcaaatctga

SEQ ID NO: 7687675 - DNA, 19 bp, Homo sapiens
gttttctgatcttgccccc

SEQ ID NO: 7687676 - DNA, 19 bp, Homo sapiens
gttttctgatcttgccccc

SEQ ID NO: 7687677 - DNA, 22 bp, Homo sapiens
gttttctctgtgtttggatgat

SEQ ID NO: 7687678 - DNA, 22 bp, Homo sapiens
gttttctctgagatgcctttct

SEQ ID NO: 7687679 - DNA, 22 bp, Homo sapiens
gttttctctgagatgcctttct

SEQ ID NO: 7687680 - DNA, 22 bp, Homo sapiens
gttttctgcctgaaggtgacca

SEQ ID NO: 7687681 - DNA, 22 bp, Homo sapiens
gttttctgcctgaaggtgacca

SEQ ID NO: 7687682 - DNA, 22 bp, Homo sapiens
gttttctgccggtggtgggctc

SEQ ID NO: 7687683 - DNA, 22 bp, Homo sapiens
gttttctgccggtggtgggctc

SEQ ID NO: 7687684 - DNA, 22 bp, Homo sapiens
gttttcctgttgagtagtattc

SEQ ID NO: 7687685 - DNA, 22 bp, Homo sapiens
gttttccttctcagccattgcc

SEQ ID NO: 7687686 - DNA, 22 bp, Homo sapiens
gttttccttctcagccattgcc

SEQ ID NO: 7687687 - DNA, 22 bp, Homo sapiens
gttttccttctcagccattgcc

SEQ ID NO: 7687688 - DNA, 22 bp, Homo sapiens
gttttctaagtaggtagcacca

SEQ ID NO: 7687689 - DNA, 22 bp, Homo sapiens
gttttccttctcagccattgcc

SEQ ID NO: 7687690 - DNA, 22 bp, Homo sapiens
gttttccttctcagccattgcc

SEQ ID NO: 7687691 - DNA, 22 bp, Homo sapiens
gttttccttctcagccattgcc

SEQ ID NO: 7687692 - DNA, 22 bp, Homo sapiens
gttttctaccagggaagagagt

SEQ ID NO: 7687693 - DNA, 22 bp, Homo sapiens
gttttctaccagggaagagagt

SEQ ID NO: 7687694 - DNA, 22 bp, Homo sapiens
gttttctaagtaggtagcacca

SEQ ID NO: 7687695 - DNA, 22 bp, Homo sapiens
gttttcctgagcccagagatgc

SEQ ID NO: 7687696 - DNA, 22 bp, Homo sapiens
gttttcctgagcccagagatgc

SEQ ID NO: 7687697 - DNA, 22 bp, Homo sapiens
gttttcctgagcccagagatgc

SEQ ID NO: 7687698 - DNA, 22 bp, Homo sapiens
gttttcctgaaactgatggtgt

SEQ ID NO: 7687699 - DNA, 22 bp, Homo sapiens
gttttcctgaaactgatggtgt

SEQ ID NO: 7687700 - DNA, 22 bp, Homo sapiens
gttttcctgttgagtagtattc

SEQ ID NO: 7687701 - DNA, 22 bp, Homo sapiens
gttttcctgttgagtagtattc

SEQ ID NO: 7687702 - DNA, 22 bp, Homo sapiens
gttttcctgttgagtagtattc

SEQ ID NO: 7687703 - DNA, 22 bp, Homo sapiens
gttttcctgttgagtagtattc

SEQ ID NO: 7687704 - DNA, 22 bp, Homo sapiens
gttttcctgagcccagagatgc

SEQ ID NO: 7687705 - DNA, 22 bp, Homo sapiens
gttttcctgagcccagagatgc

SEQ ID NO: 7687706 - DNA, 22 bp, Homo sapiens
gttttcctgagcccagagatgc

SEQ ID NO: 7687707 - DNA, 22 bp, Homo sapiens
taaaaaacattactctgtcctg

SEQ ID NO: 7687708 - DNA, 22 bp, Homo sapiens
taaaaaacattactctgtcctg

SEQ ID NO: 7687709 - DNA, 22 bp, Homo sapiens
taaaaaacattactctgtcctg

SEQ ID NO: 7687710 - DNA, 19 bp, Homo sapiens
taaaaactgaaggaagcag

SEQ ID NO: 7687711 - DNA, 19 bp, Homo sapiens
taaaaactgaaggaagcag

SEQ ID NO: 7687712 - DNA, 22 bp, Homo sapiens
taaaaaacattactctgtcctg

SEQ ID NO: 7687713 - DNA, 22 bp, Homo sapiens
taaaaaacattactctgtcctg

SEQ ID NO: 7687714 - DNA, 22 bp, Homo sapiens
taaaaaacattactctgtcctg

SEQ ID NO: 7687715 - DNA, 22 bp, Homo sapiens
taaaaaacattactctgtcctg

SEQ ID NO: 7687716 - DNA, 22 bp, Homo sapiens
taaaaaacattactctgtcctg

SEQ ID NO: 7687717 - DNA, 22 bp, Homo sapiens
taaaaaacattactctgtcctg

SEQ ID NO: 7687718 - DNA, 22 bp, Homo sapiens
taaaaaacattactctgtcctg

SEQ ID NO: 7687719 - DNA, 22 bp, Homo sapiens
taaaaaacattactctgtcctg

SEQ ID NO: 7687720 - DNA, 22 bp, Homo sapiens
taaaaaacattactctgtcctg

SEQ ID NO: 7687721 - DNA, 22 bp, Homo sapiens
gttttcttcctgcaattggcat

SEQ ID NO: 7687722 - DNA, 22 bp, Homo sapiens
gttttcttcctgcaattggcat

SEQ ID NO: 7687723 - DNA, 22 bp, Homo sapiens
gttttcttcctgcaattggcat

SEQ ID NO: 7687724 - DNA, 22 bp, Homo sapiens
gttttctggcagttattcctta

SEQ ID NO: 7687725 - DNA, 22 bp, Homo sapiens
gttttctggcagttattcctta

SEQ ID NO: 7687726 - DNA, 19 bp, Homo sapiens
taaaaactgaaggaagcag

SEQ ID NO: 7687727 - DNA, 22 bp, Homo sapiens
taaaaagcagctgagattttct

SEQ ID NO: 7687728 - DNA, 22 bp, Homo sapiens
taaaaagcagctgagattttct

SEQ ID NO: 7687729 - DNA, 22 bp, Homo sapiens
taaaaagcagctgagattttct

SEQ ID NO: 7687730 - DNA, 19 bp, Homo sapiens
taaaaactgaaggaagcag

SEQ ID NO: 7687731 - DNA, 19 bp, Homo sapiens
taaaaactgaaggaagcag

SEQ ID NO: 7687732 - DNA, 19 bp, Homo sapiens
taaaaactgaaggaagcag

SEQ ID NO: 7687733 - DNA, 19 bp, Homo sapiens
taaaaactgaaggaagcag

SEQ ID NO: 7687734 - DNA, 19 bp, Homo sapiens
taaaaactgaaggaagcag

SEQ ID NO: 7687735 - DNA, 22 bp, Homo sapiens
taaaaagtagtgagaatggcgc

SEQ ID NO: 7687736 - DNA, 22 bp, Homo sapiens
taaaaagtagtgagaatggcgc

SEQ ID NO: 7687737 - DNA, 22 bp, Homo sapiens
taaaaagtagtgagaatggcgc

SEQ ID NO: 7687738 - DNA, 22 bp, Homo sapiens
taaaaagtagtgagaatggcgc

SEQ ID NO: 7687739 - DNA, 22 bp, Homo sapiens
taaaaagtagtgagaatggcgc

SEQ ID NO: 7687740 - DNA, 22 bp, Homo sapiens
taaactcttctgtagaatcaga

SEQ ID NO: 7687741 - DNA, 22 bp, Homo sapiens
taaactatctgtgtttgaagtt

SEQ ID NO: 7687742 - DNA, 22 bp, Homo sapiens
taaactatctgtgtttgaagtt

SEQ ID NO: 7687743 - DNA, 22 bp, Homo sapiens
taaactatctgtgtttgaagtt

SEQ ID NO: 7687744 - DNA, 22 bp, Homo sapiens
taaactatctgtgtttgaagtt

SEQ ID NO: 7687745 - DNA, 22 bp, Homo sapiens
taaactactgggcaaggacagg

SEQ ID NO: 7687746 - DNA, 22 bp, Homo sapiens
taaaccttggtagcatcttgct

SEQ ID NO: 7687747 - DNA, 22 bp, Homo sapiens
taaaccttcatgatggtcatta

SEQ ID NO: 7687748 - DNA, 22 bp, Homo sapiens
taaactacccatgacagtttca

SEQ ID NO: 7687749 - DNA, 22 bp, Homo sapiens
taaactacagtggtaatgtctc

SEQ ID NO: 7687750 - DNA, 22 bp, Homo sapiens
taaactactaggatgaattttt

SEQ ID NO: 7687751 - DNA, 22 bp, Homo sapiens
taaactactaggatgaattttt

SEQ ID NO: 7687752 - DNA, 22 bp, Homo sapiens
taaactacttccatctagagat

SEQ ID NO: 7687753 - DNA, 22 bp, Homo sapiens
caggacagttggcatctgctgc

SEQ ID NO: 7687754 - DNA, 22 bp, Homo sapiens
caggacagtgcaggtccatcct

SEQ ID NO: 7687755 - DNA, 22 bp, Homo sapiens
caggacagttggcatctgctgc

SEQ ID NO: 7687756 - DNA, 22 bp, Homo sapiens
caggacagttggcatctgctgc

SEQ ID NO: 7687757 - DNA, 22 bp, Homo sapiens
caggacagttggcatctgctgc

SEQ ID NO: 7687758 - DNA, 22 bp, Homo sapiens
caggacagttggcatctgctgc

SEQ ID NO: 7687759 - DNA, 22 bp, Homo sapiens
caggacagtgcaggtccatcct

SEQ ID NO: 7687760 - DNA, 22 bp, Homo sapiens
caggacagtgcaggtccatcct

SEQ ID NO: 7687761 - DNA, 22 bp, Homo sapiens
caggacagtgcaggtccatcct

SEQ ID NO: 7687762 - DNA, 22 bp, Homo sapiens
caggacagtgcaggtccatcct

SEQ ID NO: 7687763 - DNA, 22 bp, Homo sapiens
taaactgcttctctcagtctgt

SEQ ID NO: 7687764 - DNA, 22 bp, Homo sapiens
taaactgaagctcaactcaaat

SEQ ID NO: 7687765 - DNA, 22 bp, Homo sapiens
taaactgaagctcaactcaaat

SEQ ID NO: 7687766 - DNA, 22 bp, Homo sapiens
taaactcttctgtagaatcaga

SEQ ID NO: 7687767 - DNA, 22 bp, Homo sapiens
taaactcttctgtagaatcaga

SEQ ID NO: 7687768 - DNA, 22 bp, Homo sapiens
caggacagtgcaggtccatcct

SEQ ID NO: 7687769 - DNA, 22 bp, Homo sapiens
caggacagtgcaggtccatcct

SEQ ID NO: 7687770 - DNA, 22 bp, Homo sapiens
caggacagtgcaggtccatcct

SEQ ID NO: 7687771 - DNA, 22 bp, Homo sapiens
caggacagtgcaggtccatcct

SEQ ID NO: 7687772 - DNA, 22 bp, Homo sapiens
caggacagtgcaggtccatcct

SEQ ID NO: 7687773 - DNA, 22 bp, Homo sapiens
caggacagtgcaggtccatcct

SEQ ID NO: 7687774 - DNA, 21 bp, Homo sapiens
taaacctggcgctgttcaaag

SEQ ID NO: 7687775 - DNA, 22 bp, Homo sapiens
taaacctgtagttgatgtaatt

SEQ ID NO: 7687776 - DNA, 22 bp, Homo sapiens
taaacctgcaactatagccacc

SEQ ID NO: 7687777 - DNA, 19 bp, Homo sapiens
taaaccctggctttttctg

SEQ ID NO: 7687778 - DNA, 18 bp, Homo sapiens
taaacctgagaagcgtgt

SEQ ID NO: 7687779 - DNA, 22 bp, Homo sapiens
taaaccattcacatcccagaaa

SEQ ID NO: 7687780 - DNA, 22 bp, Homo sapiens
taaaccatgcagacagctccat

SEQ ID NO: 7687781 - DNA, 22 bp, Homo sapiens
taaaccattcagactgaaccac

SEQ ID NO: 7687782 - DNA, 22 bp, Homo sapiens
taaaccattcagactgaaccac

SEQ ID NO: 7687783 - DNA, 22 bp, Homo sapiens
taaaccattcacatcccagaaa

SEQ ID NO: 7687784 - DNA, 22 bp, Homo sapiens
taaaccatccatcccacctgtg

SEQ ID NO: 7687785 - DNA, 22 bp, Homo sapiens
taaaccatccatcccacctgtg

SEQ ID NO: 7687786 - DNA, 22 bp, Homo sapiens
taaaccaagtgtccatattagt

SEQ ID NO: 7687787 - DNA, 22 bp, Homo sapiens
taaaccaagtgtccatattagt

SEQ ID NO: 7687788 - DNA, 22 bp, Homo sapiens
taaaccaagtgtccatattagt

SEQ ID NO: 7687789 - DNA, 22 bp, Homo sapiens
taaaccaagtgtccatattagt

SEQ ID NO: 7687790 - DNA, 22 bp, Homo sapiens
taaaccaagtgtccatattagt

SEQ ID NO: 7687791 - DNA, 18 bp, Homo sapiens
taaaccagatgacagttg

SEQ ID NO: 7687792 - DNA, 22 bp, Homo sapiens
taaacatttgttattcttgttt

SEQ ID NO: 7687793 - DNA, 22 bp, Homo sapiens
taaacatttgttattcttgttt

SEQ ID NO: 7687794 - DNA, 22 bp, Homo sapiens
taaacatttgttattcttgttt

SEQ ID NO: 7687795 - DNA, 22 bp, Homo sapiens
taaacatttgttattcttgttt

SEQ ID NO: 7687796 - DNA, 22 bp, Homo sapiens
taaacatttgttattcttgttt

SEQ ID NO: 7687797 - DNA, 22 bp, Homo sapiens
taaacatttgttattcttgttt

SEQ ID NO: 7687798 - DNA, 22 bp, Homo sapiens
taaacatttgttattcttgttt

SEQ ID NO: 7687799 - DNA, 22 bp, Homo sapiens
taaacatttgttattcttgttt

SEQ ID NO: 7687800 - DNA, 22 bp, Homo sapiens
taaacatttgttattcttgttt

SEQ ID NO: 7687801 - DNA, 22 bp, Homo sapiens
taaacatttgttattcttgttt

SEQ ID NO: 7687802 - DNA, 22 bp, Homo sapiens
taaacatttgttattcttgttt

SEQ ID NO: 7687803 - DNA, 22 bp, Homo sapiens
taaacatttgttattcttgttt

SEQ ID NO: 7687804 - DNA, 22 bp, Homo sapiens
taaacatttgttattcttgttt

SEQ ID NO: 7687805 - DNA, 22 bp, Homo sapiens
taaaatgatctctcatgttctt

SEQ ID NO: 7687806 - DNA, 22 bp, Homo sapiens
taaaatgatctctcatgttctt

SEQ ID NO: 7687807 - DNA, 22 bp, Homo sapiens
taaaatgacttcctccaacatc

SEQ ID NO: 7687808 - DNA, 22 bp, Homo sapiens
taaaatgacttcctccaacatc

SEQ ID NO: 7687809 - DNA, 22 bp, Homo sapiens
taaaatgatctctcatgttctt

SEQ ID NO: 7687810 - DNA, 22 bp, Homo sapiens
taaaatgatctctcatgttctt

SEQ ID NO: 7687811 - DNA, 22 bp, Homo sapiens
taaacatgttgacatcttacct

SEQ ID NO: 7687812 - DNA, 22 bp, Homo sapiens
caggaccccatattcactgaac

SEQ ID NO: 7687813 - DNA, 22 bp, Homo sapiens
caggaccccatattcactgaac

SEQ ID NO: 7687814 - DNA, 22 bp, Homo sapiens
caggacccatcagccaggcact

SEQ ID NO: 7687815 - DNA, 22 bp, Homo sapiens
caggaccccatattcactgaac

SEQ ID NO: 7687816 - DNA, 22 bp, Homo sapiens
caggagaaggtttggagtgcag

SEQ ID NO: 7687817 - DNA, 22 bp, Homo sapiens
caggagaaggtttggagtgcag

SEQ ID NO: 7687818 - DNA, 22 bp, Homo sapiens
caggagaagtctctagggggtg

SEQ ID NO: 7687819 - DNA, 22 bp, Homo sapiens
caggagaagtctctagggggtg

SEQ ID NO: 7687820 - DNA, 22 bp, Homo sapiens
caggagaagtctctagggggtg

SEQ ID NO: 7687821 - DNA, 22 bp, Homo sapiens
caggagaagtctctagggggtg

SEQ ID NO: 7687822 - DNA, 22 bp, Homo sapiens
caggagaaggtttggagtgcag

SEQ ID NO: 7687823 - DNA, 22 bp, Homo sapiens
caggagaagtctctagggggtg

SEQ ID NO: 7687824 - DNA, 22 bp, Homo sapiens
caggagacaagttagcagctga

SEQ ID NO: 7687825 - DNA, 22 bp, Homo sapiens
caggagacaagttagcagctga

SEQ ID NO: 7687826 - DNA, 22 bp, Homo sapiens
caggagacaagttagcagctga

SEQ ID NO: 7687827 - DNA, 22 bp, Homo sapiens
caggagacaagttagcagctga

SEQ ID NO: 7687828 - DNA, 22 bp, Homo sapiens
caggagacaagttagcagctga

SEQ ID NO: 7687829 - DNA, 22 bp, Homo sapiens
caggagacaatggctgtggggc

SEQ ID NO: 7687830 - DNA, 22 bp, Homo sapiens
caggagacaatggctgtggggc

SEQ ID NO: 7687831 - DNA, 22 bp, Homo sapiens
caggagacaatggctgtggggc

SEQ ID NO: 7687832 - DNA, 22 bp, Homo sapiens
caggagactatggcccaaggcc

SEQ ID NO: 7687833 - DNA, 22 bp, Homo sapiens
caggagactatggcccaaggcc

SEQ ID NO: 7687834 - DNA, 22 bp, Homo sapiens
caggagactatggcccaaggcc

SEQ ID NO: 7687835 - DNA, 22 bp, Homo sapiens
caggagacctggtaagccaagt

SEQ ID NO: 7687836 - DNA, 22 bp, Homo sapiens
caggacccaacctccctgctct

SEQ ID NO: 7687837 - DNA, 22 bp, Homo sapiens
caggacccaacctccctgctct

SEQ ID NO: 7687838 - DNA, 22 bp, Homo sapiens
caggacccatcagccaggcact

SEQ ID NO: 7687839 - DNA, 22 bp, Homo sapiens
caggacccatcagccaggcact

SEQ ID NO: 7687840 - DNA, 22 bp, Homo sapiens
caggacccatcagccaggcact

SEQ ID NO: 7687841 - DNA, 22 bp, Homo sapiens
caggacccatcagccaggcact

SEQ ID NO: 7687842 - DNA, 22 bp, Homo sapiens
caggaccaggcgttctgggctg

SEQ ID NO: 7687843 - DNA, 22 bp, Homo sapiens
caggaccaggcgttctgggctg

SEQ ID NO: 7687844 - DNA, 22 bp, Homo sapiens
caggacccaacctccctgctct

SEQ ID NO: 7687845 - DNA, 22 bp, Homo sapiens
caggacccaacctccctgctct

SEQ ID NO: 7687846 - DNA, 22 bp, Homo sapiens
caggaccattgcaactgcccct

SEQ ID NO: 7687847 - DNA, 22 bp, Homo sapiens
caggaccattgcaactgcccct

SEQ ID NO: 7687848 - DNA, 22 bp, Homo sapiens
caggaccaggcgttctgggctg

SEQ ID NO: 7687849 - DNA, 22 bp, Homo sapiens
caggacagtttgctttgccctg

SEQ ID NO: 7687850 - DNA, 22 bp, Homo sapiens
caggacagtttgctttgccctg

SEQ ID NO: 7687851 - DNA, 22 bp, Homo sapiens
caggacagtttgctttgccctg

SEQ ID NO: 7687852 - DNA, 22 bp, Homo sapiens
caggaccaagcaaagtttcttt

SEQ ID NO: 7687853 - DNA, 22 bp, Homo sapiens
caggaccaggcgttctgggctg

SEQ ID NO: 7687854 - DNA, 22 bp, Homo sapiens
caggacagttggcatctgctgc

SEQ ID NO: 7687855 - DNA, 19 bp, Homo sapiens
caggacagtttgccaagaa

SEQ ID NO: 7687856 - DNA, 22 bp, Homo sapiens
caggacagttggcatctgctgc

SEQ ID NO: 7687857 - DNA, 22 bp, Homo sapiens
caggacagttggcatctgctgc

SEQ ID NO: 7687858 - DNA, 19 bp, Homo sapiens
caggacagtttgccaagaa

SEQ ID NO: 7687859 - DNA, 19 bp, Homo sapiens
caggacagtttgccaagaa

SEQ ID NO: 7687860 - DNA, 19 bp, Homo sapiens
caggacagtttgccaagaa

SEQ ID NO: 7687861 - DNA, 19 bp, Homo sapiens
caggacagtttgccaagaa

SEQ ID NO: 7687862 - DNA, 19 bp, Homo sapiens
caggacagtttgccaagaa

SEQ ID NO: 7687863 - DNA, 19 bp, Homo sapiens
caggacagtttgccaagaa

SEQ ID NO: 7687864 - DNA, 19 bp, Homo sapiens
caggacagtttgccaagaa

SEQ ID NO: 7687865 - DNA, 19 bp, Homo sapiens
caggacagtttgccaagaa

SEQ ID NO: 7687866 - DNA, 19 bp, Homo sapiens
caggacagtttgccaagaa

SEQ ID NO: 7687867 - DNA, 19 bp, Homo sapiens
caggacagtttgccaagaa

SEQ ID NO: 7687868 - DNA, 19 bp, Homo sapiens
caggacagtttgccaagaa

SEQ ID NO: 7687869 - DNA, 19 bp, Homo sapiens
caggacagtttgccaagaa

SEQ ID NO: 7687870 - DNA, 22 bp, Homo sapiens
caggacagtttgctttgccctg

SEQ ID NO: 7687871 - DNA, 22 bp, Homo sapiens
caggacagtttgctttgccctg

SEQ ID NO: 7687872 - DNA, 22 bp, Homo sapiens
caggaggaacaagaggttctgg

SEQ ID NO: 7687873 - DNA, 22 bp, Homo sapiens
caggaggaacaagaggttctgg

SEQ ID NO: 7687874 - DNA, 22 bp, Homo sapiens
caggaggaacaagaggttctgg

SEQ ID NO: 7687875 - DNA, 22 bp, Homo sapiens
caggaggaacaagaggttctgg

SEQ ID NO: 7687876 - DNA, 22 bp, Homo sapiens
caggaggaacaagaggttctgg

SEQ ID NO: 7687877 - DNA, 22 bp, Homo sapiens
caggaggaaatgtgaccctgct

SEQ ID NO: 7687878 - DNA, 22 bp, Homo sapiens
caggaggaaatgtgaccctgct

SEQ ID NO: 7687879 - DNA, 22 bp, Homo sapiens
caggaggaaatgtgaccctgct

SEQ ID NO: 7687880 - DNA, 22 bp, Homo sapiens
caggaggaaatgtgaccctgct

SEQ ID NO: 7687881 - DNA, 22 bp, Homo sapiens
caggaggaaagttccactcaac

SEQ ID NO: 7687882 - DNA, 22 bp, Homo sapiens
caggaggaaagttccactcaac

SEQ ID NO: 7687883 - DNA, 22 bp, Homo sapiens
caggaggaaagttccactcaac

SEQ ID NO: 7687884 - DNA, 22 bp, Homo sapiens
caggaggaaagttccactcaac

SEQ ID NO: 7687885 - DNA, 22 bp, Homo sapiens
caggaggaaagttccactcaac

SEQ ID NO: 7687886 - DNA, 22 bp, Homo sapiens
caggaggaaatgtgaccctgct

SEQ ID NO: 7687887 - DNA, 22 bp, Homo sapiens
caggaggaaatgtgaccctgct

SEQ ID NO: 7687888 - DNA, 22 bp, Homo sapiens
caggaggaaatgtgaccctgct

SEQ ID NO: 7687889 - DNA, 22 bp, Homo sapiens
caggaggaaactggattcactt

SEQ ID NO: 7687890 - DNA, 22 bp, Homo sapiens
caggaggaaatgtgaccctgct

SEQ ID NO: 7687891 - DNA, 22 bp, Homo sapiens
caggaggaaatgtgaccctgct

SEQ ID NO: 7687892 - DNA, 20 bp, Homo sapiens
caggaggcaaggtcaaggtc

SEQ ID NO: 7687893 - DNA, 22 bp, Homo sapiens
caggaggattgcttgaggccag

SEQ ID NO: 7687894 - DNA, 20 bp, Homo sapiens
caggaggcaaggtcaaggtc

SEQ ID NO: 7687895 - DNA, 20 bp, Homo sapiens
caggaggcaaggtcaaggtc

SEQ ID NO: 7687896 - DNA, 20 bp, Homo sapiens
caggaggcaaggtcaaggtc

SEQ ID NO: 7687897 - DNA, 20 bp, Homo sapiens
caggaggcaaggtcaaggtc

SEQ ID NO: 7687898 - DNA, 20 bp, Homo sapiens
caggaggcaaggtcaaggtc

SEQ ID NO: 7687899 - DNA, 20 bp, Homo sapiens
caggaggcaaggtcaaggtc

SEQ ID NO: 7687900 - DNA, 22 bp, Homo sapiens
caggaggcagaggatgcccagt

SEQ ID NO: 7687901 - DNA, 22 bp, Homo sapiens
caggaggcagaggatgcccagt

SEQ ID NO: 7687902 - DNA, 22 bp, Homo sapiens
caggaggcagaggatgcccagt

SEQ ID NO: 7687903 - DNA, 22 bp, Homo sapiens
caggaggaagaactctgcaaca

SEQ ID NO: 7687904 - DNA, 22 bp, Homo sapiens
caggaggaacaagaggttctgg

SEQ ID NO: 7687905 - DNA, 22 bp, Homo sapiens
caggaggaagaactctgcaaca

SEQ ID NO: 7687906 - DNA, 22 bp, Homo sapiens
caggaggaagaactctgcaaca

SEQ ID NO: 7687907 - DNA, 22 bp, Homo sapiens
caggaggaacaagaggttctgg

SEQ ID NO: 7687908 - DNA, 22 bp, Homo sapiens
caggaggaagaactctgcaaca

SEQ ID NO: 7687909 - DNA, 22 bp, Homo sapiens
caggaggattgcttgaggccag

SEQ ID NO: 7687910 - DNA, 22 bp, Homo sapiens
caggaggattgcttgaggccag

SEQ ID NO: 7687911 - DNA, 22 bp, Homo sapiens
caggaggacatactggctcaca

SEQ ID NO: 7687912 - DNA, 22 bp, Homo sapiens
caggaggaagaactctgcaaca

SEQ ID NO: 7687913 - DNA, 22 bp, Homo sapiens
caggaggaagaactctgcaaca

SEQ ID NO: 7687914 - DNA, 22 bp, Homo sapiens
caggaggcagcgctctcaggac

SEQ ID NO: 7687915 - DNA, 22 bp, Homo sapiens
caggaggcagcgctctcaggac

SEQ ID NO: 7687916 - DNA, 22 bp, Homo sapiens
caggaggcagaggttgcagtga

SEQ ID NO: 7687917 - DNA, 22 bp, Homo sapiens
caggaggcagaggttgcagtga

SEQ ID NO: 7687918 - DNA, 22 bp, Homo sapiens
caggaggcagaggttgcagtga

SEQ ID NO: 7687919 - DNA, 22 bp, Homo sapiens
caggaggcagaggttgcagtga

SEQ ID NO: 7687920 - DNA, 22 bp, Homo sapiens
caggaggcagaggttgcagtga

SEQ ID NO: 7687921 - DNA, 22 bp, Homo sapiens
caggaggcagaggttgcagtga

SEQ ID NO: 7687922 - DNA, 22 bp, Homo sapiens
caggaggcagaggttgcagtga

SEQ ID NO: 7687923 - DNA, 22 bp, Homo sapiens
caggaggcagaggttgcagtga

SEQ ID NO: 7687924 - DNA, 22 bp, Homo sapiens
caggaggcagaggttgcagcga

SEQ ID NO: 7687925 - DNA, 22 bp, Homo sapiens
caggaggcagaggttgcagcga

SEQ ID NO: 7687926 - DNA, 22 bp, Homo sapiens
caggaggcagaggttgcagcga

SEQ ID NO: 7687927 - DNA, 22 bp, Homo sapiens
caggaggcagaggttgcagcga

SEQ ID NO: 7687928 - DNA, 22 bp, Homo sapiens
caggaggcagaggttgcagcga

SEQ ID NO: 7687929 - DNA, 22 bp, Homo sapiens
caggaggcagaggatgcccagt

SEQ ID NO: 7687930 - DNA, 22 bp, Homo sapiens
caggaggcagaggttgcagcga

SEQ ID NO: 7687931 - DNA, 22 bp, Homo sapiens
caggaggcagaggttgcagcga

SEQ ID NO: 7687932 - DNA, 22 bp, Homo sapiens
caggaggcagaggttgcagcga

SEQ ID NO: 7687933 - DNA, 22 bp, Homo sapiens
caggaggcagaggatgcccagt

SEQ ID NO: 7687934 - DNA, 22 bp, Homo sapiens
caggaggcagaggatgcccagt

SEQ ID NO: 7687935 - DNA, 22 bp, Homo sapiens
caggaggcagaggatgcccagt

SEQ ID NO: 7687936 - DNA, 22 bp, Homo sapiens
caggaggcagaggatgcccagt

SEQ ID NO: 7687937 - DNA, 22 bp, Homo sapiens
caggaggcagaggatgcccagt

SEQ ID NO: 7687938 - DNA, 22 bp, Homo sapiens
caggaggcagtttcagaagtca

SEQ ID NO: 7687939 - DNA, 22 bp, Homo sapiens
caggaggcagtttcagaagtca

SEQ ID NO: 7687940 - DNA, 22 bp, Homo sapiens
caggaggcagtttcagaagtca

SEQ ID NO: 7687941 - DNA, 22 bp, Homo sapiens
caggaggcagtttcagaagtca

SEQ ID NO: 7687942 - DNA, 22 bp, Homo sapiens
caggaggcagtttcagaagtca

SEQ ID NO: 7687943 - DNA, 22 bp, Homo sapiens
caggaggcagtgggtgttgtct

SEQ ID NO: 7687944 - DNA, 22 bp, Homo sapiens
caggaggcagtgggtgttgtct

SEQ ID NO: 7687945 - DNA, 22 bp, Homo sapiens
caggaggcagtgggtgttgtct

SEQ ID NO: 7687946 - DNA, 22 bp, Homo sapiens
caggaggcaggtgcattttgag

SEQ ID NO: 7687947 - DNA, 22 bp, Homo sapiens
caggaggcaggtgcattttgag

SEQ ID NO: 7687948 - DNA, 22 bp, Homo sapiens
caggaggcaggtgcattttgag

SEQ ID NO: 7687949 - DNA, 22 bp, Homo sapiens
caggaggcaggtgcattttgag

SEQ ID NO: 7687950 - DNA, 22 bp, Homo sapiens
caggaggcagcgctctcaggac

SEQ ID NO: 7687951 - DNA, 22 bp, Homo sapiens
caggaggcagcgctctcaggac

SEQ ID NO: 7687952 - DNA, 22 bp, Homo sapiens
caggaggcagcgctctcaggac

SEQ ID NO: 7687953 - DNA, 22 bp, Homo sapiens
caggaggcagcgctctcaggac

SEQ ID NO: 7687954 - DNA, 22 bp, Homo sapiens
caggaggcagcgctctcaggac

SEQ ID NO: 7687955 - DNA, 22 bp, Homo sapiens
caggaggcagcgctctcaggac

SEQ ID NO: 7687956 - DNA, 22 bp, Homo sapiens
taaatgtctttgtcacgttggg

SEQ ID NO: 7687957 - DNA, 22 bp, Homo sapiens
taaatgtctttgtcacgttggg

SEQ ID NO: 7687958 - DNA, 22 bp, Homo sapiens
taaatgtctgttaacatgaatg

SEQ ID NO: 7687959 - DNA, 22 bp, Homo sapiens
taaatgtctgttaacatgaatg

SEQ ID NO: 7687960 - DNA, 22 bp, Homo sapiens
taaatgtgaccttcattttata

SEQ ID NO: 7687961 - DNA, 22 bp, Homo sapiens
taaatgtgaccttcattttata

SEQ ID NO: 7687962 - DNA, 22 bp, Homo sapiens
taaatgtgagtgatgcggtgaa

SEQ ID NO: 7687963 - DNA, 21 bp, Homo sapiens
taaatgtgagcagggctgggc

SEQ ID NO: 7687964 - DNA, 22 bp, Homo sapiens
taaatgtgaccttcattttata

SEQ ID NO: 7687965 - DNA, 21 bp, Homo sapiens
taaatgtgagcagggctgggc

SEQ ID NO: 7687966 - DNA, 22 bp, Homo sapiens
caggagctgggtctggaagcag

SEQ ID NO: 7687967 - DNA, 22 bp, Homo sapiens
caggagctgggtctggaagcag

SEQ ID NO: 7687968 - DNA, 22 bp, Homo sapiens
caggagctgggtctggaagcag

SEQ ID NO: 7687969 - DNA, 22 bp, Homo sapiens
caggagctggatctccttgcgg

SEQ ID NO: 7687970 - DNA, 22 bp, Homo sapiens
caggagctggatctccttgcgg

SEQ ID NO: 7687971 - DNA, 22 bp, Homo sapiens
caggagctgggtctggaagcag

SEQ ID NO: 7687972 - DNA, 22 bp, Homo sapiens
caggagctgggtctggaagcag

SEQ ID NO: 7687973 - DNA, 22 bp, Homo sapiens
caggagctgggtctggaagcag

SEQ ID NO: 7687974 - DNA, 22 bp, Homo sapiens
caggagcttctgcccatggcca

SEQ ID NO: 7687975 - DNA, 22 bp, Homo sapiens
caggagcttctgcccatggcca

SEQ ID NO: 7687976 - DNA, 22 bp, Homo sapiens
caggagcttctgcccatggcca

SEQ ID NO: 7687977 - DNA, 22 bp, Homo sapiens
caggagcttctgcccatggcca

SEQ ID NO: 7687978 - DNA, 22 bp, Homo sapiens
caggagcttctgcccatggcca

SEQ ID NO: 7687979 - DNA, 22 bp, Homo sapiens
caggagctgggtctggaagcag

SEQ ID NO: 7687980 - DNA, 22 bp, Homo sapiens
caggagctgggtctggaagcag

SEQ ID NO: 7687981 - DNA, 22 bp, Homo sapiens
caggagctgggtctggaagcag

SEQ ID NO: 7687982 - DNA, 22 bp, Homo sapiens
caggagctgggtctggaagcag

SEQ ID NO: 7687983 - DNA, 22 bp, Homo sapiens
caggagctgggtctggaagcag

SEQ ID NO: 7687984 - DNA, 22 bp, Homo sapiens
caggagctgggtctggaagcag

SEQ ID NO: 7687985 - DNA, 22 bp, Homo sapiens
caggagcttctgcccatggcca

SEQ ID NO: 7687986 - DNA, 22 bp, Homo sapiens
caggagcttctgcccatggcca

SEQ ID NO: 7687987 - DNA, 22 bp, Homo sapiens
caggagcttctgcccatggcca

SEQ ID NO: 7687988 - DNA, 22 bp, Homo sapiens
caggaggaaactggattcactt

SEQ ID NO: 7687989 - DNA, 22 bp, Homo sapiens
caggaggaaactggattcactt

SEQ ID NO: 7687990 - DNA, 22 bp, Homo sapiens
caggaggaaactggattcactt

SEQ ID NO: 7687991 - DNA, 22 bp, Homo sapiens
caggagctttcttcccaaactt

SEQ ID NO: 7687992 - DNA, 22 bp, Homo sapiens
taaatgtctcccgtgagcctca

SEQ ID NO: 7687993 - DNA, 22 bp, Homo sapiens
taaatgtctgttaacatgaatg

SEQ ID NO: 7687994 - DNA, 22 bp, Homo sapiens
taaatgtctgttaacatgaatg

SEQ ID NO: 7687995 - DNA, 22 bp, Homo sapiens
taaatgtctgttaacatgaatg

SEQ ID NO: 7687996 - DNA, 22 bp, Homo sapiens
taaatgtctgttaacatgaatg

SEQ ID NO: 7687997 - DNA, 22 bp, Homo sapiens
taaatgtcaatgtgatttataa

SEQ ID NO: 7687998 - DNA, 22 bp, Homo sapiens
taaatgtcaatgtgatttataa

SEQ ID NO: 7687999 - DNA, 22 bp, Homo sapiens
taaatgtataggcactaaacct

SEQ ID NO: 7688000 - DNA, 22 bp, Homo sapiens
taaatgtataggcactaaacct

SEQ ID NO: 7688001 - DNA, 22 bp, Homo sapiens
taaatgtcaatgtgatttataa

SEQ ID NO: 7688002 - DNA, 22 bp, Homo sapiens
taaatgtataggcactaaacct

SEQ ID NO: 7688003 - DNA, 22 bp, Homo sapiens
taaatgtataggcactaaacct

SEQ ID NO: 7688004 - DNA, 22 bp, Homo sapiens
taaatgtataggcactaaacct

SEQ ID NO: 7688005 - DNA, 22 bp, Homo sapiens
taaatgtataggcactaaacct

SEQ ID NO: 7688006 - DNA, 22 bp, Homo sapiens
taaatgtataggcactaaacct

SEQ ID NO: 7688007 - DNA, 22 bp, Homo sapiens
taaatgtataggcactaaacct

SEQ ID NO: 7688008 - DNA, 22 bp, Homo sapiens
taaatgtataggcactaaacct

SEQ ID NO: 7688009 - DNA, 22 bp, Homo sapiens
taaatgtagtcaaaggagcctc

SEQ ID NO: 7688010 - DNA, 22 bp, Homo sapiens
taaatgtataggcactaaacct

SEQ ID NO: 7688011 - DNA, 22 bp, Homo sapiens
taaatgtataggcactaaacct

SEQ ID NO: 7688012 - DNA, 22 bp, Homo sapiens
taaatgtataggcactaaacct

SEQ ID NO: 7688013 - DNA, 22 bp, Homo sapiens
taaatgtataggcactaaacct

SEQ ID NO: 7688014 - DNA, 22 bp, Homo sapiens
taaatgtaccttctgccttact

SEQ ID NO: 7688015 - DNA, 22 bp, Homo sapiens
taaatgtaccttctgccttact

SEQ ID NO: 7688016 - DNA, 22 bp, Homo sapiens
taaatgtaaatggcgtcttgcg

SEQ ID NO: 7688017 - DNA, 22 bp, Homo sapiens
taaatgtaaatggcgtcttgcg

SEQ ID NO: 7688018 - DNA, 22 bp, Homo sapiens
taaatgtaaatggcgtcttgcg

SEQ ID NO: 7688019 - DNA, 22 bp, Homo sapiens
taaatgtaaatggcgtcttgcg

SEQ ID NO: 7688020 - DNA, 22 bp, Homo sapiens
taaatggttccgtgattcatga

SEQ ID NO: 7688021 - DNA, 20 bp, Homo sapiens
taaatggtgcatttcttata

SEQ ID NO: 7688022 - DNA, 22 bp, Homo sapiens
taaatggtatccttgctgtgct

SEQ ID NO: 7688023 - DNA, 22 bp, Homo sapiens
taaatggtatccttgctgtgct

SEQ ID NO: 7688024 - DNA, 22 bp, Homo sapiens
taaatgtactgaggcaacagga

SEQ ID NO: 7688025 - DNA, 22 bp, Homo sapiens
taaatgtagtcaaaggagcctc

SEQ ID NO: 7688026 - DNA, 22 bp, Homo sapiens
taaatgtactgaggcaacagga

SEQ ID NO: 7688027 - DNA, 22 bp, Homo sapiens
taaatgtactgaggcaacagga

SEQ ID NO: 7688028 - DNA, 22 bp, Homo sapiens
taaatgtactgaggcaacagga

SEQ ID NO: 7688029 - DNA, 22 bp, Homo sapiens
taaatgtaccttctgccttact

SEQ ID NO: 7688030 - DNA, 22 bp, Homo sapiens
taaatgtaccttctgccttact

SEQ ID NO: 7688031 - DNA, 22 bp, Homo sapiens
taaatgtaccttctgccttact

SEQ ID NO: 7688032 - DNA, 22 bp, Homo sapiens
caggaggccaactgtgggactt

SEQ ID NO: 7688033 - DNA, 22 bp, Homo sapiens
caggaggccaactgtgggactt

SEQ ID NO: 7688034 - DNA, 22 bp, Homo sapiens
caggaggccaactgtgggactt

SEQ ID NO: 7688035 - DNA, 22 bp, Homo sapiens
caggaggccaactgtgggactt

SEQ ID NO: 7688036 - DNA, 22 bp, Homo sapiens
caggaggccaactgtgggactt

SEQ ID NO: 7688037 - DNA, 22 bp, Homo sapiens
caggaggccaactgtgggactt

SEQ ID NO: 7688038 - DNA, 22 bp, Homo sapiens
caggaggccaactgtgggactt

SEQ ID NO: 7688039 - DNA, 22 bp, Homo sapiens
caggaggcatcatggagcggac

SEQ ID NO: 7688040 - DNA, 22 bp, Homo sapiens
caggaggcatcatggagcggac

SEQ ID NO: 7688041 - DNA, 22 bp, Homo sapiens
caggaggcatcatggagcggac

SEQ ID NO: 7688042 - DNA, 22 bp, Homo sapiens
caggaggcatatttaaatccaa

SEQ ID NO: 7688043 - DNA, 22 bp, Homo sapiens
caggaggcatatttaaatccaa

SEQ ID NO: 7688044 - DNA, 22 bp, Homo sapiens
caggaggcagtttcagaagtca

SEQ ID NO: 7688045 - DNA, 22 bp, Homo sapiens
caggaggcatatttaaatccaa

SEQ ID NO: 7688046 - DNA, 22 bp, Homo sapiens
caggaggcatcatggagcggac

SEQ ID NO: 7688047 - DNA, 22 bp, Homo sapiens
caggaggcatcatggagcggac

SEQ ID NO: 7688048 - DNA, 22 bp, Homo sapiens
caggaggcatcatggagcggac

SEQ ID NO: 7688049 - DNA, 22 bp, Homo sapiens
caggaggcatcatggagcggac

SEQ ID NO: 7688050 - DNA, 22 bp, Homo sapiens
caggaggcccggccacagccca

SEQ ID NO: 7688051 - DNA, 22 bp, Homo sapiens
caggaggcccggccacagccca

SEQ ID NO: 7688052 - DNA, 22 bp, Homo sapiens
caggaggcccggccacagccca

SEQ ID NO: 7688053 - DNA, 22 bp, Homo sapiens
caggaggcccggccacagccca

SEQ ID NO: 7688054 - DNA, 22 bp, Homo sapiens
caggaggcccggccacagccca

SEQ ID NO: 7688055 - DNA, 22 bp, Homo sapiens
caggaggcccggccacagccca

SEQ ID NO: 7688056 - DNA, 22 bp, Homo sapiens
caggaggcccacaggcccctgc

SEQ ID NO: 7688057 - DNA, 22 bp, Homo sapiens
caggaggcccacaggcccctgc

SEQ ID NO: 7688058 - DNA, 22 bp, Homo sapiens
caggaggcccacaggcccctgc

SEQ ID NO: 7688059 - DNA, 22 bp, Homo sapiens
caggaggcccacaggcccctgc

SEQ ID NO: 7688060 - DNA, 22 bp, Homo sapiens
caggaggcccacaggcccctgc

SEQ ID NO: 7688061 - DNA, 22 bp, Homo sapiens
caggaggcccacaggcccctgc

SEQ ID NO: 7688062 - DNA, 22 bp, Homo sapiens
caggaggcccaaagggcgcaga

SEQ ID NO: 7688063 - DNA, 22 bp, Homo sapiens
caggaggcccaaagggcgcaga

SEQ ID NO: 7688064 - DNA, 22 bp, Homo sapiens
caggaggcccaaagggcgcaga

SEQ ID NO: 7688065 - DNA, 22 bp, Homo sapiens
caggaggcccaaagggcgcaga

SEQ ID NO: 7688066 - DNA, 22 bp, Homo sapiens
caggaggcccacaggcccctgc

SEQ ID NO: 7688067 - DNA, 22 bp, Homo sapiens
caggaggcccaaagggcgcaga

SEQ ID NO: 7688068 - DNA, 22 bp, Homo sapiens
caggaggcccaaagggcgcaga

SEQ ID NO: 7688069 - DNA, 22 bp, Homo sapiens
caggaggctttgggatccaagt

SEQ ID NO: 7688070 - DNA, 23 bp, Homo sapiens
caggagggaatgaagttagacaa

SEQ ID NO: 7688071 - DNA, 23 bp, Homo sapiens
caggagggaatgaagttagacaa

SEQ ID NO: 7688072 - DNA, 22 bp, Homo sapiens
caggaggctttgggatccaagt

SEQ ID NO: 7688073 - DNA, 22 bp, Homo sapiens
caggaggctttgggatccaagt

SEQ ID NO: 7688074 - DNA, 22 bp, Homo sapiens
caggaggctttgggatccaagt

SEQ ID NO: 7688075 - DNA, 22 bp, Homo sapiens
caggaggctcctagggctctgt

SEQ ID NO: 7688076 - DNA, 22 bp, Homo sapiens
caggaggcccggccacagccca

SEQ ID NO: 7688077 - DNA, 22 bp, Homo sapiens
caggaggcgtcttcagtttgtt

SEQ ID NO: 7688078 - DNA, 22 bp, Homo sapiens
caggaggcgtcttcagtttgtt

SEQ ID NO: 7688079 - DNA, 22 bp, Homo sapiens
caggaggcgtcttcagtttgtt

SEQ ID NO: 7688080 - DNA, 22 bp, Homo sapiens
caggaggcgtcttcagtttgtt

SEQ ID NO: 7688081 - DNA, 22 bp, Homo sapiens
caggaggctcctagggctctgt

SEQ ID NO: 7688082 - DNA, 22 bp, Homo sapiens
caggaggctcctagggctctgt

SEQ ID NO: 7688083 - DNA, 22 bp, Homo sapiens
caggaggctcctagggctctgt

SEQ ID NO: 7688084 - DNA, 22 bp, Homo sapiens
caggaggctcctagggctctgt

SEQ ID NO: 7688085 - DNA, 22 bp, Homo sapiens
caggaggcgtcttcagtttgtt

SEQ ID NO: 7688086 - DNA, 22 bp, Homo sapiens
caggaggcgtcttcagtttgtt

SEQ ID NO: 7688087 - DNA, 22 bp, Homo sapiens
caggagggcccgagactcttcc

SEQ ID NO: 7688088 - DNA, 22 bp, Homo sapiens
caggagggcccgagactcttcc

SEQ ID NO: 7688089 - DNA, 20 bp, Homo sapiens
caggagggacatttcagcat

SEQ ID NO: 7688090 - DNA, 20 bp, Homo sapiens
caggagggacatttcagcat

SEQ ID NO: 7688091 - DNA, 20 bp, Homo sapiens
caggagggacatttcagcat

SEQ ID NO: 7688092 - DNA, 20 bp, Homo sapiens
caggagggacatttcagcat

SEQ ID NO: 7688093 - DNA, 20 bp, Homo sapiens
caggagggacatttcagcat

SEQ ID NO: 7688094 - DNA, 20 bp, Homo sapiens
caggagggacatttcagcat

SEQ ID NO: 7688095 - DNA, 23 bp, Homo sapiens
caggagggaatgaagttagacaa

SEQ ID NO: 7688096 - DNA, 23 bp, Homo sapiens
caggagggaatgaagttagacaa

SEQ ID NO: 7688097 - DNA, 23 bp, Homo sapiens
caggagggaatgaagttagacaa

SEQ ID NO: 7688098 - DNA, 22 bp, Homo sapiens
caggagggggtggagtttcgcc

SEQ ID NO: 7688099 - DNA, 22 bp, Homo sapiens
caggagggcccgagactcttcc

SEQ ID NO: 7688100 - DNA, 22 bp, Homo sapiens
caggagggcccgagactcttcc

SEQ ID NO: 7688101 - DNA, 22 bp, Homo sapiens
caggagggcccgagactcttcc

SEQ ID NO: 7688102 - DNA, 22 bp, Homo sapiens
caggagggggtggagtttcgcc

SEQ ID NO: 7688103 - DNA, 22 bp, Homo sapiens
caggagggtgtggaaaactggg

SEQ ID NO: 7688104 - DNA, 22 bp, Homo sapiens
caggagggtgtggaaaactggg

SEQ ID NO: 7688105 - DNA, 22 bp, Homo sapiens
caggagggggtggagtttcgcc

SEQ ID NO: 7688106 - DNA, 22 bp, Homo sapiens
caggagggggtggagtttcgcc

SEQ ID NO: 7688107 - DNA, 22 bp, Homo sapiens
caggagggggtggagtttcgcc

SEQ ID NO: 7688108 - DNA, 22 bp, Homo sapiens
taacaaagtaccatagattggg

SEQ ID NO: 7688109 - DNA, 22 bp, Homo sapiens
taacaaagtaccatagattggg

SEQ ID NO: 7688110 - DNA, 19 bp, Homo sapiens
taacaaagtctgaagtcag

SEQ ID NO: 7688111 - DNA, 19 bp, Homo sapiens
taacaaagtctgaagtcag

SEQ ID NO: 7688112 - DNA, 22 bp, Homo sapiens
taacaaaggttgccaaactaag

SEQ ID NO: 7688113 - DNA, 22 bp, Homo sapiens
taacaaagtaccatagactgga

SEQ ID NO: 7688114 - DNA, 22 bp, Homo sapiens
caggatactacaacaggactgt

SEQ ID NO: 7688115 - DNA, 22 bp, Homo sapiens
caggatagaaaggccatggagt

SEQ ID NO: 7688116 - DNA, 22 bp, Homo sapiens
caggatagaaaggccatggagt

SEQ ID NO: 7688117 - DNA, 22 bp, Homo sapiens
taacaaaggttgccaaactaag

SEQ ID NO: 7688118 - DNA, 22 bp, Homo sapiens
taacaaaggttgccaaactaag

SEQ ID NO: 7688119 - DNA, 22 bp, Homo sapiens
taacaaaggttgccaaactaag

SEQ ID NO: 7688120 - DNA, 22 bp, Homo sapiens
caggataaatagtaaatgtaag

SEQ ID NO: 7688121 - DNA, 22 bp, Homo sapiens
caggataaatagtaaatgtaag

SEQ ID NO: 7688122 - DNA, 22 bp, Homo sapiens
caggatagaaaggccatggagt

SEQ ID NO: 7688123 - DNA, 22 bp, Homo sapiens
caggataacagaaaatagctga

SEQ ID NO: 7688124 - DNA, 22 bp, Homo sapiens
caggataacagaaaatagctga

SEQ ID NO: 7688125 - DNA, 22 bp, Homo sapiens
caggataacagaaaatagctga

SEQ ID NO: 7688126 - DNA, 22 bp, Homo sapiens
caggagttggtaatattgtgga

SEQ ID NO: 7688127 - DNA, 22 bp, Homo sapiens
caggagtttctattgttccaaa

SEQ ID NO: 7688128 - DNA, 22 bp, Homo sapiens
caggagtttggtgatttcttgc

SEQ ID NO: 7688129 - DNA, 22 bp, Homo sapiens
caggagtgttgattgctcagga

SEQ ID NO: 7688130 - DNA, 22 bp, Homo sapiens
caggagtgttgattgctcagga

SEQ ID NO: 7688131 - DNA, 22 bp, Homo sapiens
caggagtgttgattgctcagga

SEQ ID NO: 7688132 - DNA, 22 bp, Homo sapiens
caggagtgtctccacacagcaa

SEQ ID NO: 7688133 - DNA, 22 bp, Homo sapiens
caggagtgttgattgctcagga

SEQ ID NO: 7688134 - DNA, 22 bp, Homo sapiens
caggagtgtttgctacagtttc

SEQ ID NO: 7688135 - DNA, 22 bp, Homo sapiens
caggagtgtttgctacagtttc

SEQ ID NO: 7688136 - DNA, 22 bp, Homo sapiens
caggagtgttgattgctcagga

SEQ ID NO: 7688137 - DNA, 22 bp, Homo sapiens
caggagtgtttgctacagtttc

SEQ ID NO: 7688138 - DNA, 22 bp, Homo sapiens
caggagttcaaggttgcagtga

SEQ ID NO: 7688139 - DNA, 22 bp, Homo sapiens
caggagtgagttggggtctaca

SEQ ID NO: 7688140 - DNA, 22 bp, Homo sapiens
caggagtgagttggggtctaca

SEQ ID NO: 7688141 - DNA, 22 bp, Homo sapiens
caggagtgagttggggtctaca

SEQ ID NO: 7688142 - DNA, 22 bp, Homo sapiens
caggagtgagttggggtctaca

SEQ ID NO: 7688143 - DNA, 22 bp, Homo sapiens
caggagtgagttggggtctaca

SEQ ID NO: 7688144 - DNA, 22 bp, Homo sapiens
caggagggtgtggaaaactggg

SEQ ID NO: 7688145 - DNA, 22 bp, Homo sapiens
caggagggtgtggaaaactggg

SEQ ID NO: 7688146 - DNA, 22 bp, Homo sapiens
caggagtgaaatgaggcccagg

SEQ ID NO: 7688147 - DNA, 22 bp, Homo sapiens
caggagtgaaatgaggcccagg

SEQ ID NO: 7688148 - DNA, 22 bp, Homo sapiens
caggagtgcaggtggtgaggca

SEQ ID NO: 7688149 - DNA, 22 bp, Homo sapiens
caggagtgcaggtggtgaggca

SEQ ID NO: 7688150 - DNA, 22 bp, Homo sapiens
caggagtgcaggtggtgaggca

SEQ ID NO: 7688151 - DNA, 22 bp, Homo sapiens
caggagtgcaggtggtgaggca

SEQ ID NO: 7688152 - DNA, 22 bp, Homo sapiens
caggagtgcaggtggtgaggca

SEQ ID NO: 7688153 - DNA, 22 bp, Homo sapiens
caggagtgcaggtggtgaggca

SEQ ID NO: 7688154 - DNA, 22 bp, Homo sapiens
caggagtgcaggtggtgaggca

SEQ ID NO: 7688155 - DNA, 22 bp, Homo sapiens
caggagtgcaggtggtgaggca

SEQ ID NO: 7688156 - DNA, 22 bp, Homo sapiens
caggagtggcacccttttccct

SEQ ID NO: 7688157 - DNA, 22 bp, Homo sapiens
caggagtggcacccttttccct

SEQ ID NO: 7688158 - DNA, 22 bp, Homo sapiens
caggagtggtgtgagggactcc

SEQ ID NO: 7688159 - DNA, 22 bp, Homo sapiens
caggagtgcaggtggtgaggca

SEQ ID NO: 7688160 - DNA, 22 bp, Homo sapiens
caggagtgcaggtggtgaggca

SEQ ID NO: 7688161 - DNA, 22 bp, Homo sapiens
caggagtgtcgggtcactaggt

SEQ ID NO: 7688162 - DNA, 22 bp, Homo sapiens
caggagtgtcgggtcactaggt

SEQ ID NO: 7688163 - DNA, 22 bp, Homo sapiens
caggagtgtcgggtcactaggt

SEQ ID NO: 7688164 - DNA, 22 bp, Homo sapiens
caggagtgtcgggtcactaggt

SEQ ID NO: 7688165 - DNA, 22 bp, Homo sapiens
caggagtgtctccacacagcaa

SEQ ID NO: 7688166 - DNA, 22 bp, Homo sapiens
caggagtgtctccacacagcaa

SEQ ID NO: 7688167 - DNA, 22 bp, Homo sapiens
caggagtgtctccacacagcaa

SEQ ID NO: 7688168 - DNA, 22 bp, Homo sapiens
caggagtgtctccacacagcaa

SEQ ID NO: 7688169 - DNA, 22 bp, Homo sapiens
caggagtgtctccacacagcaa

SEQ ID NO: 7688170 - DNA, 22 bp, Homo sapiens
caggagtggtgtgagggactcc

SEQ ID NO: 7688171 - DNA, 22 bp, Homo sapiens
caggagtggtgtgagggactcc

SEQ ID NO: 7688172 - DNA, 22 bp, Homo sapiens
caggagtggtgtgagggactcc

SEQ ID NO: 7688173 - DNA, 22 bp, Homo sapiens
caggagtggtgtgagggactcc

SEQ ID NO: 7688174 - DNA, 22 bp, Homo sapiens
caggagtggtgtgagggactcc

SEQ ID NO: 7688175 - DNA, 22 bp, Homo sapiens
caggagtggtgtgagggactcc

SEQ ID NO: 7688176 - DNA, 22 bp, Homo sapiens
caggagtggtgtgagggactcc

SEQ ID NO: 7688177 - DNA, 22 bp, Homo sapiens
caggagtggtgtgagggactcc

SEQ ID NO: 7688178 - DNA, 22 bp, Homo sapiens
caggagtggtgtgagggactcc

SEQ ID NO: 7688179 - DNA, 22 bp, Homo sapiens
caggagtgtcgggtcactaggt

SEQ ID NO: 7688180 - DNA, 22 bp, Homo sapiens
caggagtgtcgggtcactaggt

SEQ ID NO: 7688181 - DNA, 22 bp, Homo sapiens
taaagtgagtacaaaatgaggg

SEQ ID NO: 7688182 - DNA, 22 bp, Homo sapiens
taaagtgagtacaaaatgaggg

SEQ ID NO: 7688183 - DNA, 22 bp, Homo sapiens
taaagtgcagactcccggaaac

SEQ ID NO: 7688184 - DNA, 22 bp, Homo sapiens
taaagtgcagactcccggaaac

SEQ ID NO: 7688185 - DNA, 22 bp, Homo sapiens
taaagtgaagttcagaatggct

SEQ ID NO: 7688186 - DNA, 22 bp, Homo sapiens
taaagtgagtacaaaatgaggg

SEQ ID NO: 7688187 - DNA, 22 bp, Homo sapiens
taaagtgagtacaaaatgaggg

SEQ ID NO: 7688188 - DNA, 22 bp, Homo sapiens
taaagtgcagattgtgattcag

SEQ ID NO: 7688189 - DNA, 22 bp, Homo sapiens
taaagtgcaggctactcagaag

SEQ ID NO: 7688190 - DNA, 22 bp, Homo sapiens
taaagtgcagattgtgattcag

SEQ ID NO: 7688191 - DNA, 22 bp, Homo sapiens
taaagtgcagattgtgattcag

SEQ ID NO: 7688192 - DNA, 22 bp, Homo sapiens
taaagtgcagactcccggaaac

SEQ ID NO: 7688193 - DNA, 22 bp, Homo sapiens
taaagtgcccagggaaagcggg

SEQ ID NO: 7688194 - DNA, 22 bp, Homo sapiens
taaagtgcatgcggggccagat

SEQ ID NO: 7688195 - DNA, 22 bp, Homo sapiens
taaagtgcccagggaaagcggg

SEQ ID NO: 7688196 - DNA, 22 bp, Homo sapiens
taaagtgcccagggaaagcggg

SEQ ID NO: 7688197 - DNA, 22 bp, Homo sapiens
taaagtgcatgcggggccagat

SEQ ID NO: 7688198 - DNA, 22 bp, Homo sapiens
taaagtgcatgcggggccagat

SEQ ID NO: 7688199 - DNA, 22 bp, Homo sapiens
taaagtgcatgcggggccagat

SEQ ID NO: 7688200 - DNA, 22 bp, Homo sapiens
taaagtgcaggctactcagaag

SEQ ID NO: 7688201 - DNA, 22 bp, Homo sapiens
taaagtgcaggctactcagaag

SEQ ID NO: 7688202 - DNA, 22 bp, Homo sapiens
taaagtgcaggctactcagaag

SEQ ID NO: 7688203 - DNA, 22 bp, Homo sapiens
taaagtgcaggctactcagaag

SEQ ID NO: 7688204 - DNA, 22 bp, Homo sapiens
taaagtgcaggctactcagaag

SEQ ID NO: 7688205 - DNA, 22 bp, Homo sapiens
taaatagagaatcagcttggag

SEQ ID NO: 7688206 - DNA, 22 bp, Homo sapiens
taaatagagaatcagcttggag

SEQ ID NO: 7688207 - DNA, 22 bp, Homo sapiens
taaatagagaatcagcttggag

SEQ ID NO: 7688208 - DNA, 22 bp, Homo sapiens
taaatagggaatagaagaggaa

SEQ ID NO: 7688209 - DNA, 22 bp, Homo sapiens
taaatagagaatcagcttggag

SEQ ID NO: 7688210 - DNA, 22 bp, Homo sapiens
taaatagagaatcagcttggag

SEQ ID NO: 7688211 - DNA, 18 bp, Homo sapiens
taaatatatttccccctt

SEQ ID NO: 7688212 - DNA, 18 bp, Homo sapiens
taaatatatttccccctt

SEQ ID NO: 7688213 - DNA, 18 bp, Homo sapiens
taaatatatttccccctt

SEQ ID NO: 7688214 - DNA, 18 bp, Homo sapiens
taaatatatttccccctt

SEQ ID NO: 7688215 - DNA, 18 bp, Homo sapiens
taaatatatttccccctt

SEQ ID NO: 7688216 - DNA, 18 bp, Homo sapiens
taaatatatttccccctt

SEQ ID NO: 7688217 - DNA, 18 bp, Homo sapiens
taaatatatttccccctt

SEQ ID NO: 7688218 - DNA, 18 bp, Homo sapiens
taaatatatttccccctt

SEQ ID NO: 7688219 - DNA, 18 bp, Homo sapiens
taaatatatttccccctt

SEQ ID NO: 7688220 - DNA, 18 bp, Homo sapiens
taaatatatttccccctt

SEQ ID NO: 7688221 - DNA, 22 bp, Homo sapiens
taaatatgcatgtatccttatc

SEQ ID NO: 7688222 - DNA, 22 bp, Homo sapiens
taaatatgcatgtatccttatc

SEQ ID NO: 7688223 - DNA, 22 bp, Homo sapiens
taaatatgcatgtatccttatc

SEQ ID NO: 7688224 - DNA, 22 bp, Homo sapiens
taaatatgcatgtatccttatc

SEQ ID NO: 7688225 - DNA, 22 bp, Homo sapiens
taaatatgcatgtatccttatc

SEQ ID NO: 7688226 - DNA, 22 bp, Homo sapiens
taaatatcagtccagctcttcc

SEQ ID NO: 7688227 - DNA, 22 bp, Homo sapiens
taaatatcagtccagctcttcc

SEQ ID NO: 7688228 - DNA, 22 bp, Homo sapiens
taaatatcagtccagctcttcc

SEQ ID NO: 7688229 - DNA, 22 bp, Homo sapiens
taaatatcagtccagctcttcc

SEQ ID NO: 7688230 - DNA, 22 bp, Homo sapiens
taaatatcacctggaattgtta

SEQ ID NO: 7688231 - DNA, 22 bp, Homo sapiens
taaatatcacctggaattgtta

SEQ ID NO: 7688232 - DNA, 22 bp, Homo sapiens
taaatatcacctggaattgtta

SEQ ID NO: 7688233 - DNA, 22 bp, Homo sapiens
taaatcacatcgaaatctgggt

SEQ ID NO: 7688234 - DNA, 22 bp, Homo sapiens
taaatcaagaatatcagcttgt

SEQ ID NO: 7688235 - DNA, 22 bp, Homo sapiens
taaatcaagaatatcagcttgt

SEQ ID NO: 7688236 - DNA, 22 bp, Homo sapiens
taaatcaagaatatcagcttgt

SEQ ID NO: 7688237 - DNA, 22 bp, Homo sapiens
taaatcaagaatatcagcttgt

SEQ ID NO: 7688238 - DNA, 22 bp, Homo sapiens
taaatgctttctatgaaagagg

SEQ ID NO: 7688239 - DNA, 22 bp, Homo sapiens
taaatgctttctatgaaagagg

SEQ ID NO: 7688240 - DNA, 22 bp, Homo sapiens
taaatgcttagattcatagaaa

SEQ ID NO: 7688241 - DNA, 22 bp, Homo sapiens
taaatgcttagattcatagaaa

SEQ ID NO: 7688242 - DNA, 22 bp, Homo sapiens
taaatgcttagattcatagaaa

SEQ ID NO: 7688243 - DNA, 22 bp, Homo sapiens
taaagtcagatatctgggttga

SEQ ID NO: 7688244 - DNA, 22 bp, Homo sapiens
taaagtcagatatctgggttga

SEQ ID NO: 7688245 - DNA, 22 bp, Homo sapiens
taaagtcagatatctgggttga

SEQ ID NO: 7688246 - DNA, 22 bp, Homo sapiens
taaagtcagggagattgaggct

SEQ ID NO: 7688247 - DNA, 22 bp, Homo sapiens
taaagtcagatatctgggttga

SEQ ID NO: 7688248 - DNA, 22 bp, Homo sapiens
taaagtcagatatctgggttga

SEQ ID NO: 7688249 - DNA, 22 bp, Homo sapiens
taaagtcagatatctgggttga

SEQ ID NO: 7688250 - DNA, 22 bp, Homo sapiens
taaagtcagggagattgaggct

SEQ ID NO: 7688251 - DNA, 22 bp, Homo sapiens
taaagtcagggagattgaggct

SEQ ID NO: 7688252 - DNA, 22 bp, Homo sapiens
taaagtcataagagtggatccg

SEQ ID NO: 7688253 - DNA, 22 bp, Homo sapiens
taaagtcataagagtggatccg

SEQ ID NO: 7688254 - DNA, 22 bp, Homo sapiens
taaagtcatctttaaacatgcc

SEQ ID NO: 7688255 - DNA, 22 bp, Homo sapiens
taaagtcataagagtggatccg

SEQ ID NO: 7688256 - DNA, 22 bp, Homo sapiens
taaagtcagggagattgaggct

SEQ ID NO: 7688257 - DNA, 22 bp, Homo sapiens
taaagtcataagagtggatccg

SEQ ID NO: 7688258 - DNA, 22 bp, Homo sapiens
taaagtcagagatccttggctt

SEQ ID NO: 7688259 - DNA, 23 bp, Homo sapiens
taaagtcacatattagagtgagc

SEQ ID NO: 7688260 - DNA, 22 bp, Homo sapiens
taaagtcagagatccttggctt

SEQ ID NO: 7688261 - DNA, 22 bp, Homo sapiens
taaagtcagagatccttggctt

SEQ ID NO: 7688262 - DNA, 23 bp, Homo sapiens
taaagtcacatattagagtgagc

SEQ ID NO: 7688263 - DNA, 23 bp, Homo sapiens
taaagtcacatattagagtgagc

SEQ ID NO: 7688264 - DNA, 23 bp, Homo sapiens
taaagtcacatattagagtgagc

SEQ ID NO: 7688265 - DNA, 22 bp, Homo sapiens
taaagtcacagagcaggtgcaa

SEQ ID NO: 7688266 - DNA, 22 bp, Homo sapiens
taaagtcacagagcaggtgcaa

SEQ ID NO: 7688267 - DNA, 22 bp, Homo sapiens
taaagtcaaggtactgtttcac

SEQ ID NO: 7688268 - DNA, 22 bp, Homo sapiens
taaagtcaaggtactgtttcac

SEQ ID NO: 7688269 - DNA, 23 bp, Homo sapiens
taaagtcacatattagagtgagc

SEQ ID NO: 7688270 - DNA, 22 bp, Homo sapiens
taaagtcacagagcaggtgcaa

SEQ ID NO: 7688271 - DNA, 22 bp, Homo sapiens
taaagtcacagagcaggtgcaa

SEQ ID NO: 7688272 - DNA, 22 bp, Homo sapiens
taaagtcacagagcaggtgcaa

SEQ ID NO: 7688273 - DNA, 22 bp, Homo sapiens
taaagtcatctttacatctttg

SEQ ID NO: 7688274 - DNA, 22 bp, Homo sapiens
taaagtcatctttacatctttg

SEQ ID NO: 7688275 - DNA, 22 bp, Homo sapiens
taaagtcatctttacatctttg

SEQ ID NO: 7688276 - DNA, 22 bp, Homo sapiens
taaagtcatctttacatctttg

SEQ ID NO: 7688277 - DNA, 22 bp, Homo sapiens
taaagtgaaggtcataatgatt

SEQ ID NO: 7688278 - DNA, 22 bp, Homo sapiens
taaagtgaaggtcataatgatt

SEQ ID NO: 7688279 - DNA, 22 bp, Homo sapiens
taaagtgaaggtcataatgatt

SEQ ID NO: 7688280 - DNA, 22 bp, Homo sapiens
taaagtgaaggtcataatgatt

SEQ ID NO: 7688281 - DNA, 22 bp, Homo sapiens
taaagtgaaggtcataatgatt

SEQ ID NO: 7688282 - DNA, 22 bp, Homo sapiens
taaagtcatctttacatctttg

SEQ ID NO: 7688283 - DNA, 22 bp, Homo sapiens
taaagtcatctttaaacatgcc

SEQ ID NO: 7688284 - DNA, 22 bp, Homo sapiens
taaagtcatctttacatctttg

SEQ ID NO: 7688285 - DNA, 22 bp, Homo sapiens
taaagtcatctttacatctttg

SEQ ID NO: 7688286 - DNA, 22 bp, Homo sapiens
taaagtcatctttacatctttg

SEQ ID NO: 7688287 - DNA, 22 bp, Homo sapiens
taaagtcatctttaaacatgcc

SEQ ID NO: 7688288 - DNA, 22 bp, Homo sapiens
taaagtcatctttaaacatgcc

SEQ ID NO: 7688289 - DNA, 22 bp, Homo sapiens
taaagtcatctttaaacatgcc

SEQ ID NO: 7688290 - DNA, 22 bp, Homo sapiens
taaagtcatctttaaacatgcc

SEQ ID NO: 7688291 - DNA, 22 bp, Homo sapiens
taaagtcatctttaaacatgcc

SEQ ID NO: 7688292 - DNA, 22 bp, Homo sapiens
taaagtcatctttaaacatgcc

SEQ ID NO: 7688293 - DNA, 22 bp, Homo sapiens
taaagtcatctttaaacatgcc

SEQ ID NO: 7688294 - DNA, 22 bp, Homo sapiens
taaagccacttcattctagtct

SEQ ID NO: 7688295 - DNA, 22 bp, Homo sapiens
taaagccacttcattctagtct

SEQ ID NO: 7688296 - DNA, 17 bp, Homo sapiens
taaagccagtcaagtca

SEQ ID NO: 7688297 - DNA, 22 bp, Homo sapiens
taaagccacttcattctagtct

SEQ ID NO: 7688298 - DNA, 22 bp, Homo sapiens
taaagccacgctggaaatcagg

SEQ ID NO: 7688299 - DNA, 22 bp, Homo sapiens
taaagccacgctggaaatcagg

SEQ ID NO: 7688300 - DNA, 22 bp, Homo sapiens
taaagccacgctggaaatcagg

SEQ ID NO: 7688301 - DNA, 22 bp, Homo sapiens
taaagctacacattattaatcc

SEQ ID NO: 7688302 - DNA, 22 bp, Homo sapiens
taaagctacacattattaatcc

SEQ ID NO: 7688303 - DNA, 22 bp, Homo sapiens
taaagtcaaggtactgtttcac

SEQ ID NO: 7688304 - DNA, 22 bp, Homo sapiens
taaagctaaccttagtgaacac

SEQ ID NO: 7688305 - DNA, 22 bp, Homo sapiens
taaagccatactgaaagccact

SEQ ID NO: 7688306 - DNA, 22 bp, Homo sapiens
taaagccctctgatcacactgg

SEQ ID NO: 7688307 - DNA, 22 bp, Homo sapiens
taaagcatgtttcagtaaggtt

SEQ ID NO: 7688308 - DNA, 22 bp, Homo sapiens
taaagcatgtttcagtaaggtt

SEQ ID NO: 7688309 - DNA, 22 bp, Homo sapiens
taaagcatgtgttagaagtgca

SEQ ID NO: 7688310 - DNA, 22 bp, Homo sapiens
taaagcatgtttcagtaaggtt

SEQ ID NO: 7688311 - DNA, 22 bp, Homo sapiens
taaagcatgtgttagaagtgca

SEQ ID NO: 7688312 - DNA, 22 bp, Homo sapiens
taaagcatgtactgtgtgctag

SEQ ID NO: 7688313 - DNA, 22 bp, Homo sapiens
taaagcatgtactgtgtgctag

SEQ ID NO: 7688314 - DNA, 22 bp, Homo sapiens
taaagccaacactttactgctc

SEQ ID NO: 7688315 - DNA, 22 bp, Homo sapiens
taaagccacgctggaaatcagg

SEQ ID NO: 7688316 - DNA, 22 bp, Homo sapiens
taaagccaacactttactgctc

SEQ ID NO: 7688317 - DNA, 22 bp, Homo sapiens
taaagccaatatacctagcata

SEQ ID NO: 7688318 - DNA, 22 bp, Homo sapiens
taaagcatttttgaaattatga

SEQ ID NO: 7688319 - DNA, 22 bp, Homo sapiens
taaagcatttttgaaattatga

SEQ ID NO: 7688320 - DNA, 22 bp, Homo sapiens
taaagcatttttgaaattatga

SEQ ID NO: 7688321 - DNA, 22 bp, Homo sapiens
taaagcatttttgaaattatga

SEQ ID NO: 7688322 - DNA, 22 bp, Homo sapiens
taaagcatttttgaaattatga

SEQ ID NO: 7688323 - DNA, 22 bp, Homo sapiens
caggagagatatgagtccccac

SEQ ID NO: 7688324 - DNA, 22 bp, Homo sapiens
caggagagatatgagtccccac

SEQ ID NO: 7688325 - DNA, 22 bp, Homo sapiens
caggagagatatgagtccccac

SEQ ID NO: 7688326 - DNA, 22 bp, Homo sapiens
caggagagatatgagtccccac

SEQ ID NO: 7688327 - DNA, 22 bp, Homo sapiens
caggagagatatgagtccccac

SEQ ID NO: 7688328 - DNA, 22 bp, Homo sapiens
caggagactcagcatccaggat

SEQ ID NO: 7688329 - DNA, 22 bp, Homo sapiens
caggagagatatgagtccccac

SEQ ID NO: 7688330 - DNA, 19 bp, Homo sapiens
caggagagcatgcactttg

SEQ ID NO: 7688331 - DNA, 19 bp, Homo sapiens
caggagagcatgcactttg

SEQ ID NO: 7688332 - DNA, 22 bp, Homo sapiens
caggagagatatgagtccccac

SEQ ID NO: 7688333 - DNA, 19 bp, Homo sapiens
caggagagcatgcactttg

SEQ ID NO: 7688334 - DNA, 19 bp, Homo sapiens
caggagagcatgcactttg

SEQ ID NO: 7688335 - DNA, 19 bp, Homo sapiens
caggagagcatgcactttg

SEQ ID NO: 7688336 - DNA, 22 bp, Homo sapiens
caggagagatatgagtccccac

SEQ ID NO: 7688337 - DNA, 22 bp, Homo sapiens
caggagagatatgagtccccac

SEQ ID NO: 7688338 - DNA, 22 bp, Homo sapiens
caggagagatatgagtccccac

SEQ ID NO: 7688339 - DNA, 22 bp, Homo sapiens
caggagagatatgagtccccac

SEQ ID NO: 7688340 - DNA, 19 bp, Homo sapiens
caggagagcatgcactttg

SEQ ID NO: 7688341 - DNA, 22 bp, Homo sapiens
caggagagcccgggtccgggct

SEQ ID NO: 7688342 - DNA, 22 bp, Homo sapiens
caggagagcccgggtccgggct

SEQ ID NO: 7688343 - DNA, 22 bp, Homo sapiens
caggagagcccgggtccgggct

SEQ ID NO: 7688344 - DNA, 22 bp, Homo sapiens
caggagagcccgggtccgggct

SEQ ID NO: 7688345 - DNA, 22 bp, Homo sapiens
caggagagcccgggtccgggct

SEQ ID NO: 7688346 - DNA, 22 bp, Homo sapiens
caggagagcccgggtccgggct

SEQ ID NO: 7688347 - DNA, 22 bp, Homo sapiens
caggagagcccgggtccgggct

SEQ ID NO: 7688348 - DNA, 22 bp, Homo sapiens
caggagagcccgggtccgggct

SEQ ID NO: 7688349 - DNA, 22 bp, Homo sapiens
caggagagcccgggtccgggct

SEQ ID NO: 7688350 - DNA, 22 bp, Homo sapiens
caggagaggaggctacttctta

SEQ ID NO: 7688351 - DNA, 22 bp, Homo sapiens
caggagaggaggctacttctta

SEQ ID NO: 7688352 - DNA, 22 bp, Homo sapiens
caggagaggaggctacttctta

SEQ ID NO: 7688353 - DNA, 22 bp, Homo sapiens
caggagaggaggctacttctta

SEQ ID NO: 7688354 - DNA, 22 bp, Homo sapiens
caggagagcccgggtccgggct

SEQ ID NO: 7688355 - DNA, 22 bp, Homo sapiens
caggagagcccgggtccgggct

SEQ ID NO: 7688356 - DNA, 22 bp, Homo sapiens
caggagagcccgggtccgggct

SEQ ID NO: 7688357 - DNA, 22 bp, Homo sapiens
caggagatgacagggaagaacc

SEQ ID NO: 7688358 - DNA, 22 bp, Homo sapiens
caggagatgacagggaagaacc

SEQ ID NO: 7688359 - DNA, 22 bp, Homo sapiens
caggagatgacagggaagaacc

SEQ ID NO: 7688360 - DNA, 22 bp, Homo sapiens
caggagatgcggtgtttgctct

SEQ ID NO: 7688361 - DNA, 23 bp, Homo sapiens
caggagatggctgctgtgtcagc

SEQ ID NO: 7688362 - DNA, 23 bp, Homo sapiens
caggagatggctgctgtgtcagc

SEQ ID NO: 7688363 - DNA, 22 bp, Homo sapiens
caggagcaaggagcagtgggat

SEQ ID NO: 7688364 - DNA, 22 bp, Homo sapiens
caggagcaaggagcagtgggat

SEQ ID NO: 7688365 - DNA, 22 bp, Homo sapiens
caggagcaaatccaaaagaatt

SEQ ID NO: 7688366 - DNA, 22 bp, Homo sapiens
caggagatgtacctgtttttga

SEQ ID NO: 7688367 - DNA, 22 bp, Homo sapiens
caggagatgtacctgtttttga

SEQ ID NO: 7688368 - DNA, 22 bp, Homo sapiens
caggagcaaatccaaaagaatt

SEQ ID NO: 7688369 - DNA, 22 bp, Homo sapiens
caggagatgtaagacttctgtt

SEQ ID NO: 7688370 - DNA, 22 bp, Homo sapiens
caggagatgtaagacttctgtt

SEQ ID NO: 7688371 - DNA, 22 bp, Homo sapiens
caggagaggctgtacgtttctc

SEQ ID NO: 7688372 - DNA, 22 bp, Homo sapiens
caggagaggctgtacgtttctc

SEQ ID NO: 7688373 - DNA, 22 bp, Homo sapiens
caggagataaaagagatgcttt

SEQ ID NO: 7688374 - DNA, 22 bp, Homo sapiens
caggagataaaagagatgcttt

SEQ ID NO: 7688375 - DNA, 22 bp, Homo sapiens
caggagatgacagggaagaacc

SEQ ID NO: 7688376 - DNA, 22 bp, Homo sapiens
caggagatgacagggaagaacc

SEQ ID NO: 7688377 - DNA, 22 bp, Homo sapiens
caggagatgacagggaagaacc

SEQ ID NO: 7688378 - DNA, 22 bp, Homo sapiens
caggagatgacagggaagaacc

SEQ ID NO: 7688379 - DNA, 22 bp, Homo sapiens
caggagatgacagggaagaacc

SEQ ID NO: 7688380 - DNA, 22 bp, Homo sapiens
caggagatgacagggaagaacc

SEQ ID NO: 7688381 - DNA, 22 bp, Homo sapiens
caggagatgacagggaagaacc

SEQ ID NO: 7688382 - DNA, 22 bp, Homo sapiens
caggagatcttaggaattctta

SEQ ID NO: 7688383 - DNA, 22 bp, Homo sapiens
caggagccctggtgggtggaca

SEQ ID NO: 7688384 - DNA, 22 bp, Homo sapiens
caggagcccgttgctccggcgg

SEQ ID NO: 7688385 - DNA, 22 bp, Homo sapiens
caggagcccgttgctccggcgg

SEQ ID NO: 7688386 - DNA, 22 bp, Homo sapiens
caggagcaaggagcagtgggat

SEQ ID NO: 7688387 - DNA, 22 bp, Homo sapiens
caggagcccgttgctccggcgg

SEQ ID NO: 7688388 - DNA, 22 bp, Homo sapiens
caggagcccgttgctccggcgg

SEQ ID NO: 7688389 - DNA, 22 bp, Homo sapiens
caggagcctcctgattccaatt

SEQ ID NO: 7688390 - DNA, 22 bp, Homo sapiens
caggagccgccaggcacgttgg

SEQ ID NO: 7688391 - DNA, 22 bp, Homo sapiens
caggagccgccaggcacgttgg

SEQ ID NO: 7688392 - DNA, 22 bp, Homo sapiens
caggagccgccaggcacgttgg

SEQ ID NO: 7688393 - DNA, 22 bp, Homo sapiens
caggagccctggtgggtggaca

SEQ ID NO: 7688394 - DNA, 22 bp, Homo sapiens
caggagccctggtgggtggaca

SEQ ID NO: 7688395 - DNA, 22 bp, Homo sapiens
caggagcccgttgctccggcgg

SEQ ID NO: 7688396 - DNA, 22 bp, Homo sapiens
caggagccctggtgggtggaca

SEQ ID NO: 7688397 - DNA, 22 bp, Homo sapiens
caggagccctggtgggtggaca

SEQ ID NO: 7688398 - DNA, 22 bp, Homo sapiens
caggagcctcctgattccaatt

SEQ ID NO: 7688399 - DNA, 22 bp, Homo sapiens
caggagctactcaggttgggtt

SEQ ID NO: 7688400 - DNA, 22 bp, Homo sapiens
caggagctactcaggttgggtt

SEQ ID NO: 7688401 - DNA, 22 bp, Homo sapiens
caggagctactcaggttgggtt

SEQ ID NO: 7688402 - DNA, 22 bp, Homo sapiens
caggagctactcaggttgggtt

SEQ ID NO: 7688403 - DNA, 22 bp, Homo sapiens
caggagctactcaggttgggtt

SEQ ID NO: 7688404 - DNA, 22 bp, Homo sapiens
caggagctcaagaccaccctgg

SEQ ID NO: 7688405 - DNA, 22 bp, Homo sapiens
caggagctcaagaccaccctgg

SEQ ID NO: 7688406 - DNA, 22 bp, Homo sapiens
caggagctcaagaccaccctgg

SEQ ID NO: 7688407 - DNA, 22 bp, Homo sapiens
caggagctcaagaccaccctgg

SEQ ID NO: 7688408 - DNA, 22 bp, Homo sapiens
caggagctactcaggttgggtt

SEQ ID NO: 7688409 - DNA, 22 bp, Homo sapiens
caggagctactcaggttgggtt

SEQ ID NO: 7688410 - DNA, 22 bp, Homo sapiens
caggagctcacagtctttgggt

SEQ ID NO: 7688411 - DNA, 22 bp, Homo sapiens
caggagctcactgtctaatggg

SEQ ID NO: 7688412 - DNA, 22 bp, Homo sapiens
caggagctcactgtctaatggg

SEQ ID NO: 7688413 - DNA, 22 bp, Homo sapiens
caggagctcacagtctttgggt

SEQ ID NO: 7688414 - DNA, 22 bp, Homo sapiens
caggagctcacagtctttgggt

SEQ ID NO: 7688415 - DNA, 22 bp, Homo sapiens
caggagctcagatgacatctca

SEQ ID NO: 7688416 - DNA, 22 bp, Homo sapiens
caggagctcagatgacatctca

SEQ ID NO: 7688417 - DNA, 22 bp, Homo sapiens
caggagctcactgtctaatggg

SEQ ID NO: 7688418 - DNA, 22 bp, Homo sapiens
caggagctcagatgacatctca

SEQ ID NO: 7688419 - DNA, 22 bp, Homo sapiens
taaagcagtgcaaaagcgtttt

SEQ ID NO: 7688420 - DNA, 22 bp, Homo sapiens
taaagcagtgcaaaagcgtttt

SEQ ID NO: 7688421 - DNA, 22 bp, Homo sapiens
taaagcagtgcaaaagcgtttt

SEQ ID NO: 7688422 - DNA, 22 bp, Homo sapiens
taaagcagtgcaaaagcgtttt

SEQ ID NO: 7688423 - DNA, 22 bp, Homo sapiens
taaagcagtgcaaaagcgtttt

SEQ ID NO: 7688424 - DNA, 22 bp, Homo sapiens
taaagcagtgtggttgtgtccc

SEQ ID NO: 7688425 - DNA, 22 bp, Homo sapiens
taaagcagtgtggttgtgtccc

SEQ ID NO: 7688426 - DNA, 22 bp, Homo sapiens
taaagcagtggttctcaaactt

SEQ ID NO: 7688427 - DNA, 22 bp, Homo sapiens
taaagcagtgtggttgtgtccc

SEQ ID NO: 7688428 - DNA, 22 bp, Homo sapiens
taaagcatgtactgtgtgctag

SEQ ID NO: 7688429 - DNA, 22 bp, Homo sapiens
taaagcataatgaatatctaga

SEQ ID NO: 7688430 - DNA, 22 bp, Homo sapiens
taaagcataatgaatatctaga

SEQ ID NO: 7688431 - DNA, 22 bp, Homo sapiens
taaagcataatgaatatctaga

SEQ ID NO: 7688432 - DNA, 22 bp, Homo sapiens
taaagcataatgaatatctaga

SEQ ID NO: 7688433 - DNA, 22 bp, Homo sapiens
taaagcataatgaatatctaga

SEQ ID NO: 7688434 - DNA, 22 bp, Homo sapiens
taaagcataatgaatatctaga

SEQ ID NO: 7688435 - DNA, 22 bp, Homo sapiens
taaagcagtgttgggtcggacg

SEQ ID NO: 7688436 - DNA, 22 bp, Homo sapiens
caggagctcttaaggatgtgat

SEQ ID NO: 7688437 - DNA, 22 bp, Homo sapiens
caggagctcttaaggatgtgat

SEQ ID NO: 7688438 - DNA, 22 bp, Homo sapiens
caggagctcttaaggatgtgat

SEQ ID NO: 7688439 - DNA, 22 bp, Homo sapiens
caggagctcttaaggatgtgat

SEQ ID NO: 7688440 - DNA, 22 bp, Homo sapiens
caggagctcttaaggatgtgat

SEQ ID NO: 7688441 - DNA, 22 bp, Homo sapiens
caggagctcttaaggatgtgat

SEQ ID NO: 7688442 - DNA, 22 bp, Homo sapiens
caggagctcttaaggatgtgat

SEQ ID NO: 7688443 - DNA, 22 bp, Homo sapiens
caggagctctcatcgtcagggc

SEQ ID NO: 7688444 - DNA, 22 bp, Homo sapiens
caggagctctcatcgtcagggc

SEQ ID NO: 7688445 - DNA, 22 bp, Homo sapiens
caggagctctcatcgtcagggc

SEQ ID NO: 7688446 - DNA, 22 bp, Homo sapiens
caggagctctcatcgtcagggc

SEQ ID NO: 7688447 - DNA, 22 bp, Homo sapiens
caggagctggataggaccacaa

SEQ ID NO: 7688448 - DNA, 22 bp, Homo sapiens
caggagctggataggaccacaa

SEQ ID NO: 7688449 - DNA, 22 bp, Homo sapiens
caggagctggatctccttgcgg

SEQ ID NO: 7688450 - DNA, 22 bp, Homo sapiens
caggagctggatctccttgcgg

SEQ ID NO: 7688451 - DNA, 22 bp, Homo sapiens
caggagctggatctccttgcgg

SEQ ID NO: 7688452 - DNA, 22 bp, Homo sapiens
caggagctggataggaccacaa

SEQ ID NO: 7688453 - DNA, 22 bp, Homo sapiens
caggagctggataggaccacaa

SEQ ID NO: 7688454 - DNA, 22 bp, Homo sapiens
caggagctggataggaccacaa

SEQ ID NO: 7688455 - DNA, 22 bp, Homo sapiens
caggagctcttaaggatgtgat

SEQ ID NO: 7688456 - DNA, 22 bp, Homo sapiens
caggagctcttaaggatgtgat

SEQ ID NO: 7688457 - DNA, 22 bp, Homo sapiens
caggagctcttaaggatgtgat

SEQ ID NO: 7688458 - DNA, 22 bp, Homo sapiens
caggagctcttaaggatgtgat

SEQ ID NO: 7688459 - DNA, 22 bp, Homo sapiens
gttattctacagtcattgaagt

SEQ ID NO: 7688460 - DNA, 22 bp, Homo sapiens
gttattctacagtcattgaagt

SEQ ID NO: 7688461 - DNA, 22 bp, Homo sapiens
gttattcccttgccagaggctt

SEQ ID NO: 7688462 - DNA, 22 bp, Homo sapiens
gttattcaatggcttataagga

SEQ ID NO: 7688463 - DNA, 22 bp, Homo sapiens
gttattcaatggcttataagga

SEQ ID NO: 7688464 - DNA, 22 bp, Homo sapiens
gttattcaacttgtgtctctta

SEQ ID NO: 7688465 - DNA, 22 bp, Homo sapiens
gttattatttctctccttgcta

SEQ ID NO: 7688466 - DNA, 22 bp, Homo sapiens
gttattatttctctccttgcta

SEQ ID NO: 7688467 - DNA, 22 bp, Homo sapiens
gttattatcttgaggaatctgt

SEQ ID NO: 7688468 - DNA, 22 bp, Homo sapiens
gttattatttctctccttgcta

SEQ ID NO: 7688469 - DNA, 22 bp, Homo sapiens
gttattagtaagactcgcacat

SEQ ID NO: 7688470 - DNA, 22 bp, Homo sapiens
gttattagaagtgaaggattgt

SEQ ID NO: 7688471 - DNA, 22 bp, Homo sapiens
gttattaaagtatttgatgtta

SEQ ID NO: 7688472 - DNA, 22 bp, Homo sapiens
gttattaaagtatttgatgtta

SEQ ID NO: 7688473 - DNA, 22 bp, Homo sapiens
gttattaaagtatttgatgtta

SEQ ID NO: 7688474 - DNA, 22 bp, Homo sapiens
gttattaaagtatttgatgtta

SEQ ID NO: 7688475 - DNA, 22 bp, Homo sapiens
gttatgtattgggaaatccaag

SEQ ID NO: 7688476 - DNA, 22 bp, Homo sapiens
gttatgtattgggaaatccaag

SEQ ID NO: 7688477 - DNA, 22 bp, Homo sapiens
gttacataggtgtgttcagttt

SEQ ID NO: 7688478 - DNA, 22 bp, Homo sapiens
gttacatggagcaatgatgcat

SEQ ID NO: 7688479 - DNA, 22 bp, Homo sapiens
gttacataggtgtgttcagttt

SEQ ID NO: 7688480 - DNA, 22 bp, Homo sapiens
gttacataggtgtgttcagttt

SEQ ID NO: 7688481 - DNA, 22 bp, Homo sapiens
gttacattacttgtgcagttgt

SEQ ID NO: 7688482 - DNA, 22 bp, Homo sapiens
gttacattacttgtgcagttgt

SEQ ID NO: 7688483 - DNA, 22 bp, Homo sapiens
gttacattaaaaacattcactg

SEQ ID NO: 7688484 - DNA, 22 bp, Homo sapiens
gttacattacttgtgcagttgt

SEQ ID NO: 7688485 - DNA, 22 bp, Homo sapiens
gttacatttggtgatttggtgc

SEQ ID NO: 7688486 - DNA, 23 bp, Homo sapiens
gttaccatctacatttgtgttgc

SEQ ID NO: 7688487 - DNA, 22 bp, Homo sapiens
gttaccatgagtgggtgggtga

SEQ ID NO: 7688488 - DNA, 22 bp, Homo sapiens
gttacatttattagaggtctct

SEQ ID NO: 7688489 - DNA, 22 bp, Homo sapiens
gttacattaggataatttgctg

SEQ ID NO: 7688490 - DNA, 22 bp, Homo sapiens
gttacctttgatgtgttaccct

SEQ ID NO: 7688491 - DNA, 22 bp, Homo sapiens
gttatgtatgggggccttatga

SEQ ID NO: 7688492 - DNA, 22 bp, Homo sapiens
gttatgtatgggggccttatga

SEQ ID NO: 7688493 - DNA, 22 bp, Homo sapiens
gttacccagtgctgtggaggga

SEQ ID NO: 7688494 - DNA, 22 bp, Homo sapiens
gttacctgaacaagatgttaat

SEQ ID NO: 7688495 - DNA, 22 bp, Homo sapiens
gttacctgaacaagatgttaat

SEQ ID NO: 7688496 - DNA, 22 bp, Homo sapiens
gttaccttgaagtaagtattgt

SEQ ID NO: 7688497 - DNA, 22 bp, Homo sapiens
gttattgaggtggagtctcact

SEQ ID NO: 7688498 - DNA, 22 bp, Homo sapiens
gttattgcacagtgggtgaggt

SEQ ID NO: 7688499 - DNA, 22 bp, Homo sapiens
cagcttctaccatcaggaaatt

SEQ ID NO: 7688500 - DNA, 22 bp, Homo sapiens
gttattgagacatagagttatg

SEQ ID NO: 7688501 - DNA, 22 bp, Homo sapiens
gttattcttttatagcaataca

SEQ ID NO: 7688502 - DNA, 22 bp, Homo sapiens
gttattcttttatagcaataca

SEQ ID NO: 7688503 - DNA, 22 bp, Homo sapiens
gttattctttgtatggtacatc

SEQ ID NO: 7688504 - DNA, 22 bp, Homo sapiens
gttattctttgtatggtacatc

SEQ ID NO: 7688505 - DNA, 22 bp, Homo sapiens
gttattctttgtatggtacatc

SEQ ID NO: 7688506 - DNA, 22 bp, Homo sapiens
gttattcttggtggccctgctg

SEQ ID NO: 7688507 - DNA, 22 bp, Homo sapiens
gttattctgccaaacttccaca

SEQ ID NO: 7688508 - DNA, 22 bp, Homo sapiens
gttattctaccactatgtacag

SEQ ID NO: 7688509 - DNA, 22 bp, Homo sapiens
gttattctaccactatgtacag

SEQ ID NO: 7688510 - DNA, 22 bp, Homo sapiens
gttattctacagtcattgaagt

SEQ ID NO: 7688511 - DNA, 22 bp, Homo sapiens
gttattctaccactatgtacag

SEQ ID NO: 7688512 - DNA, 22 bp, Homo sapiens
gttattctagtgctcagccatt

SEQ ID NO: 7688513 - DNA, 22 bp, Homo sapiens
cagcttctccagatgaccctca

SEQ ID NO: 7688514 - DNA, 22 bp, Homo sapiens
cagcttctccagatgaccctca

SEQ ID NO: 7688515 - DNA, 22 bp, Homo sapiens
cagcttctccagatgaccctca

SEQ ID NO: 7688516 - DNA, 22 bp, Homo sapiens
cagcttctccagatgaccctca

SEQ ID NO: 7688517 - DNA, 22 bp, Homo sapiens
cagcttctccagatgaccctca

SEQ ID NO: 7688518 - DNA, 22 bp, Homo sapiens
cagcttctcagaaagctgaggt

SEQ ID NO: 7688519 - DNA, 22 bp, Homo sapiens
cagcttctatttatctttgtgt

SEQ ID NO: 7688520 - DNA, 22 bp, Homo sapiens
cagcttctcagaaagctgaggt

SEQ ID NO: 7688521 - DNA, 22 bp, Homo sapiens
cagcttctcagaaagctgaggt

SEQ ID NO: 7688522 - DNA, 22 bp, Homo sapiens
cagcttctagcatcggctttga

SEQ ID NO: 7688523 - DNA, 22 bp, Homo sapiens
cagcttctaccatcaggaaatt

SEQ ID NO: 7688524 - DNA, 22 bp, Homo sapiens
cagcttctaccatcaggaaatt

SEQ ID NO: 7688525 - DNA, 22 bp, Homo sapiens
cagcttctatttatctttgtgt

SEQ ID NO: 7688526 - DNA, 22 bp, Homo sapiens
cagcttctatttatctttgtgt

SEQ ID NO: 7688527 - DNA, 22 bp, Homo sapiens
cagcttctatttatctttgtgt

SEQ ID NO: 7688528 - DNA, 22 bp, Homo sapiens
cagcttctcagaaagctgaggt

SEQ ID NO: 7688529 - DNA, 22 bp, Homo sapiens
cagcttctcagaaagctgaggt

SEQ ID NO: 7688530 - DNA, 22 bp, Homo sapiens
cagcttctcgggagcgcatgtg

SEQ ID NO: 7688531 - DNA, 22 bp, Homo sapiens
cagcttctcgggagcgcatgtg

SEQ ID NO: 7688532 - DNA, 22 bp, Homo sapiens
cagcttctccggcctggtgcgg

SEQ ID NO: 7688533 - DNA, 22 bp, Homo sapiens
cagcttctcgggagcgcatgtg

SEQ ID NO: 7688534 - DNA, 22 bp, Homo sapiens
cagcttctccggcctggtgcgg

SEQ ID NO: 7688535 - DNA, 22 bp, Homo sapiens
cagcttctccggcctggtgcgg

SEQ ID NO: 7688536 - DNA, 22 bp, Homo sapiens
cagcttctccattcttctggct

SEQ ID NO: 7688537 - DNA, 22 bp, Homo sapiens
cagcttctccattcttctggct

SEQ ID NO: 7688538 - DNA, 22 bp, Homo sapiens
cagcttctgagcaagccagggg

SEQ ID NO: 7688539 - DNA, 22 bp, Homo sapiens
cagcttctgctatcgaacatct

SEQ ID NO: 7688540 - DNA, 22 bp, Homo sapiens
cagcttctgagcaagccagggg

SEQ ID NO: 7688541 - DNA, 22 bp, Homo sapiens
cagcttctgagcaagccagggg

SEQ ID NO: 7688542 - DNA, 21 bp, Homo sapiens
cagcttctgaaggtgtaggaa

SEQ ID NO: 7688543 - DNA, 22 bp, Homo sapiens
cagcttctgagcaagccagggg

SEQ ID NO: 7688544 - DNA, 22 bp, Homo sapiens
cagcttctgagcaagccagggg

SEQ ID NO: 7688545 - DNA, 22 bp, Homo sapiens
cagcttgggggcgctggcctca

SEQ ID NO: 7688546 - DNA, 22 bp, Homo sapiens
cagcttgggagtttggttttat

SEQ ID NO: 7688547 - DNA, 22 bp, Homo sapiens
cagcttgggggcgctggcctca

SEQ ID NO: 7688548 - DNA, 22 bp, Homo sapiens
cagcttgggggcgctggcctca

SEQ ID NO: 7688549 - DNA, 22 bp, Homo sapiens
cagcttgggggcgctggcctca

SEQ ID NO: 7688550 - DNA, 22 bp, Homo sapiens
cagcttgggggcgctggcctca

SEQ ID NO: 7688551 - DNA, 22 bp, Homo sapiens
cagcttgggggcgctggcctca

SEQ ID NO: 7688552 - DNA, 22 bp, Homo sapiens
cagcttgggtcaggtgcctgct

SEQ ID NO: 7688553 - DNA, 22 bp, Homo sapiens
cagcttggcgaatgtaggtatg

SEQ ID NO: 7688554 - DNA, 22 bp, Homo sapiens
cagcttgggtcaggtgcctgct

SEQ ID NO: 7688555 - DNA, 22 bp, Homo sapiens
cagcttgggtcaggtgcctgct

SEQ ID NO: 7688556 - DNA, 22 bp, Homo sapiens
cagcttggcttcacattctgta

SEQ ID NO: 7688557 - DNA, 22 bp, Homo sapiens
cagcttggcgaatgtaggtatg

SEQ ID NO: 7688558 - DNA, 22 bp, Homo sapiens
cagcttggcttcacattctgta

SEQ ID NO: 7688559 - DNA, 22 bp, Homo sapiens
cagcttggcttcacattctgta

SEQ ID NO: 7688560 - DNA, 22 bp, Homo sapiens
cagcttggcgaatgtaggtatg

SEQ ID NO: 7688561 - DNA, 22 bp, Homo sapiens
cagcttggattttggcacgtgt

SEQ ID NO: 7688562 - DNA, 22 bp, Homo sapiens
cagcttgggagtttggttttat

SEQ ID NO: 7688563 - DNA, 22 bp, Homo sapiens
cagcttggcttccgctttactg

SEQ ID NO: 7688564 - DNA, 22 bp, Homo sapiens
cagcttgggagtttggttttat

SEQ ID NO: 7688565 - DNA, 22 bp, Homo sapiens
cagcttggcttccgctttactg

SEQ ID NO: 7688566 - DNA, 20 bp, Homo sapiens
cagcttgctttgggacattt

SEQ ID NO: 7688567 - DNA, 20 bp, Homo sapiens
cagcttgctttgggacattt

SEQ ID NO: 7688568 - DNA, 22 bp, Homo sapiens
cagcttgctcaaggttatagat

SEQ ID NO: 7688569 - DNA, 22 bp, Homo sapiens
cagcttgctaattttgacttca

SEQ ID NO: 7688570 - DNA, 22 bp, Homo sapiens
cagcttggaggaggatctaaga

SEQ ID NO: 7688571 - DNA, 22 bp, Homo sapiens
cagcttggaggaggatctaaga

SEQ ID NO: 7688572 - DNA, 22 bp, Homo sapiens
cagcttggaggaggatctaaga

SEQ ID NO: 7688573 - DNA, 22 bp, Homo sapiens
cagcttgcagtacttgtttttg

SEQ ID NO: 7688574 - DNA, 22 bp, Homo sapiens
cagcttctgctcatggaggggt

SEQ ID NO: 7688575 - DNA, 22 bp, Homo sapiens
cagcttctgctcatggaggggt

SEQ ID NO: 7688576 - DNA, 22 bp, Homo sapiens
cagcttctgctatcgaacatct

SEQ ID NO: 7688577 - DNA, 22 bp, Homo sapiens
cagcttgctaactggtaggggt

SEQ ID NO: 7688578 - DNA, 22 bp, Homo sapiens
cagcttgctaactggtaggggt

SEQ ID NO: 7688579 - DNA, 22 bp, Homo sapiens
cagcttgctaattttgacttca

SEQ ID NO: 7688580 - DNA, 20 bp, Homo sapiens
cagcttggatgagaggctga

SEQ ID NO: 7688581 - DNA, 20 bp, Homo sapiens
cagcttggatgagaggctga

SEQ ID NO: 7688582 - DNA, 22 bp, Homo sapiens
cagcttggattttggcacgtgt

SEQ ID NO: 7688583 - DNA, 22 bp, Homo sapiens
cagcttggattttggcacgtgt

SEQ ID NO: 7688584 - DNA, 20 bp, Homo sapiens
cagcttggatgagaggctga

SEQ ID NO: 7688585 - DNA, 20 bp, Homo sapiens
cagcttggatgagaggctga

SEQ ID NO: 7688586 - DNA, 20 bp, Homo sapiens
cagcttggatgagaggctga

SEQ ID NO: 7688587 - DNA, 20 bp, Homo sapiens
cagcttggatgagaggctga

SEQ ID NO: 7688588 - DNA, 20 bp, Homo sapiens
cagcttggatgagaggctga

SEQ ID NO: 7688589 - DNA, 20 bp, Homo sapiens
cagctttagatctttgatta

SEQ ID NO: 7688590 - DNA, 20 bp, Homo sapiens
cagctttagatctttgatta

SEQ ID NO: 7688591 - DNA, 22 bp, Homo sapiens
cagctttagagaaaacatattt

SEQ ID NO: 7688592 - DNA, 22 bp, Homo sapiens
cagctttagagaaaacatattt

SEQ ID NO: 7688593 - DNA, 22 bp, Homo sapiens
cagctttaggactcataataaa

SEQ ID NO: 7688594 - DNA, 22 bp, Homo sapiens
cagctttaggactcataataaa

SEQ ID NO: 7688595 - DNA, 22 bp, Homo sapiens
cagctttaggactcataataaa

SEQ ID NO: 7688596 - DNA, 22 bp, Homo sapiens
cagctttaggactcataataaa

SEQ ID NO: 7688597 - DNA, 22 bp, Homo sapiens
cagctttagtaacccactgctc

SEQ ID NO: 7688598 - DNA, 17 bp, Homo sapiens
cagctttatgctactgt

SEQ ID NO: 7688599 - DNA, 17 bp, Homo sapiens
cagctttatgctactgt

SEQ ID NO: 7688600 - DNA, 17 bp, Homo sapiens
cagctttatgctactgt

SEQ ID NO: 7688601 - DNA, 22 bp, Homo sapiens
cagctttattaatgattgtctt

SEQ ID NO: 7688602 - DNA, 22 bp, Homo sapiens
cagctttattaatgattgtctt

SEQ ID NO: 7688603 - DNA, 16 bp, Homo sapiens
cagctttatgtcagtg

SEQ ID NO: 7688604 - DNA, 22 bp, Homo sapiens
cagcttgttaccgagggagggt

SEQ ID NO: 7688605 - DNA, 22 bp, Homo sapiens
cagcttgttaccaagggtggct

SEQ ID NO: 7688606 - DNA, 22 bp, Homo sapiens
cagcttgtgcaaaggtcctggg

SEQ ID NO: 7688607 - DNA, 22 bp, Homo sapiens
cagcttgtgtcattcatcttgt

SEQ ID NO: 7688608 - DNA, 22 bp, Homo sapiens
cagcttgtgaaatgtcaccact

SEQ ID NO: 7688609 - DNA, 22 bp, Homo sapiens
cagcttgtattgaagctatacc

SEQ ID NO: 7688610 - DNA, 22 bp, Homo sapiens
cagcttgtgaaatgtcaccact

SEQ ID NO: 7688611 - DNA, 22 bp, Homo sapiens
cagcttgtattgaagctatacc

SEQ ID NO: 7688612 - DNA, 22 bp, Homo sapiens
cagcttgggtcaggtgcctgct

SEQ ID NO: 7688613 - DNA, 22 bp, Homo sapiens
cagctttagagaaaacatattt

SEQ ID NO: 7688614 - DNA, 22 bp, Homo sapiens
cagctttagagaaaacatattt

SEQ ID NO: 7688615 - DNA, 22 bp, Homo sapiens
cagctttagagaaaacatattt

SEQ ID NO: 7688616 - DNA, 22 bp, Homo sapiens
cagctttacctttaggagtaac

SEQ ID NO: 7688617 - DNA, 22 bp, Homo sapiens
cagctttacctttaggagtaac

SEQ ID NO: 7688618 - DNA, 22 bp, Homo sapiens
cagctttaccaatatttggaaa

SEQ ID NO: 7688619 - DNA, 22 bp, Homo sapiens
cagcttgtttacatgcttattc

SEQ ID NO: 7688620 - DNA, 22 bp, Homo sapiens
cagcttgttttatttggggacc

SEQ ID NO: 7688621 - DNA, 22 bp, Homo sapiens
caggaaaatggaatcacctgta

SEQ ID NO: 7688622 - DNA, 22 bp, Homo sapiens
caggaaaatgtcaatggaaagc

SEQ ID NO: 7688623 - DNA, 22 bp, Homo sapiens
caggaaaatgtcaatggaaagc

SEQ ID NO: 7688624 - DNA, 22 bp, Homo sapiens
caggaaaatggaatcacctgta

SEQ ID NO: 7688625 - DNA, 22 bp, Homo sapiens
caggaaaatggaatcacctgta

SEQ ID NO: 7688626 - DNA, 22 bp, Homo sapiens
caggaaaatggaatcacctgta

SEQ ID NO: 7688627 - DNA, 22 bp, Homo sapiens
caggaaaatggaatcacctgta

SEQ ID NO: 7688628 - DNA, 22 bp, Homo sapiens
cagctttgagagttgcatttta

SEQ ID NO: 7688629 - DNA, 22 bp, Homo sapiens
cagctttgattcactgcctagt

SEQ ID NO: 7688630 - DNA, 22 bp, Homo sapiens
caggaaaatctgcccacacaag

SEQ ID NO: 7688631 - DNA, 22 bp, Homo sapiens
caggaaaatctgcccacacaag

SEQ ID NO: 7688632 - DNA, 22 bp, Homo sapiens
caggaaaatctgcccacacaag

SEQ ID NO: 7688633 - DNA, 22 bp, Homo sapiens
cagctttccccgtgcctcagcc

SEQ ID NO: 7688634 - DNA, 23 bp, Homo sapiens
cagctttcagggctttagggaag

SEQ ID NO: 7688635 - DNA, 22 bp, Homo sapiens
cagctttatttcacgtgtttgt

SEQ ID NO: 7688636 - DNA, 22 bp, Homo sapiens
cagctttctttccataaggttt

SEQ ID NO: 7688637 - DNA, 22 bp, Homo sapiens
cagctttcttccttctgtctgt

SEQ ID NO: 7688638 - DNA, 22 bp, Homo sapiens
cagctttctctggtttcaagat

SEQ ID NO: 7688639 - DNA, 22 bp, Homo sapiens
cagctttctgtctcatgactga

SEQ ID NO: 7688640 - DNA, 22 bp, Homo sapiens
cagctttcttccttctgtctgt

SEQ ID NO: 7688641 - DNA, 22 bp, Homo sapiens
gttcacaatttttactgattgg

SEQ ID NO: 7688642 - DNA, 22 bp, Homo sapiens
gttcacaatggctttacctaag

SEQ ID NO: 7688643 - DNA, 22 bp, Homo sapiens
gttcacagaaattgtgtacctc

SEQ ID NO: 7688644 - DNA, 22 bp, Homo sapiens
gttcacagaaattgtgtacctc

SEQ ID NO: 7688645 - DNA, 22 bp, Homo sapiens
gttcacagaaggccagatggta

SEQ ID NO: 7688646 - DNA, 22 bp, Homo sapiens
gttcacacttttgatatgtgaa

SEQ ID NO: 7688647 - DNA, 22 bp, Homo sapiens
gttcacagaaattgtgtacctc

SEQ ID NO: 7688648 - DNA, 22 bp, Homo sapiens
gttcacagaaattgtgtacctc

SEQ ID NO: 7688649 - DNA, 22 bp, Homo sapiens
gttcacagaaattgtgtacctc

SEQ ID NO: 7688650 - DNA, 22 bp, Homo sapiens
gttcacagcttcttaggtcata

SEQ ID NO: 7688651 - DNA, 22 bp, Homo sapiens
gttcacagctgggacaagactg

SEQ ID NO: 7688652 - DNA, 22 bp, Homo sapiens
gttcacagcttcttaggtcata

SEQ ID NO: 7688653 - DNA, 22 bp, Homo sapiens
gttcacagctgggacaagactg

SEQ ID NO: 7688654 - DNA, 22 bp, Homo sapiens
gttcacagctgggacaagactg

SEQ ID NO: 7688655 - DNA, 22 bp, Homo sapiens
gttcacagctgggacaagactg

SEQ ID NO: 7688656 - DNA, 22 bp, Homo sapiens
gttcacagaaggccagatggta

SEQ ID NO: 7688657 - DNA, 22 bp, Homo sapiens
gttcacagaaggccagatggta

SEQ ID NO: 7688658 - DNA, 22 bp, Homo sapiens
gttcacagatccttgaagccag

SEQ ID NO: 7688659 - DNA, 22 bp, Homo sapiens
gttcacagatccttgaagccag

SEQ ID NO: 7688660 - DNA, 22 bp, Homo sapiens
gttcacagcaaacctatgaact

SEQ ID NO: 7688661 - DNA, 22 bp, Homo sapiens
gttcacagcaaacctatgaact

SEQ ID NO: 7688662 - DNA, 22 bp, Homo sapiens
gttcacagcaaacctatgaact

SEQ ID NO: 7688663 - DNA, 22 bp, Homo sapiens
gttcacaagctgattgtctttc

SEQ ID NO: 7688664 - DNA, 22 bp, Homo sapiens
gttcacaagatgtggtggggag

SEQ ID NO: 7688665 - DNA, 22 bp, Homo sapiens
gttcacaagctgggtttctgca

SEQ ID NO: 7688666 - DNA, 22 bp, Homo sapiens
gttcacaaatatgcacttacga

SEQ ID NO: 7688667 - DNA, 22 bp, Homo sapiens
gttcacaaatatgcacttacga

SEQ ID NO: 7688668 - DNA, 22 bp, Homo sapiens
gttcacaagagttacagacaga

SEQ ID NO: 7688669 - DNA, 22 bp, Homo sapiens
gttcacaagagttacagacaga

SEQ ID NO: 7688670 - DNA, 22 bp, Homo sapiens
caggaaagccgagtgccatagg

SEQ ID NO: 7688671 - DNA, 22 bp, Homo sapiens
caggaaagagctgccaggcagg

SEQ ID NO: 7688672 - DNA, 22 bp, Homo sapiens
caggaaagccgagtgccatagg

SEQ ID NO: 7688673 - DNA, 22 bp, Homo sapiens
caggaaagccgagtgccatagg

SEQ ID NO: 7688674 - DNA, 22 bp, Homo sapiens
caggaaagccgagtgccatagg

SEQ ID NO: 7688675 - DNA, 22 bp, Homo sapiens
caggaaagagctgccaggcagg

SEQ ID NO: 7688676 - DNA, 22 bp, Homo sapiens
caggaaagagctgccaggcagg

SEQ ID NO: 7688677 - DNA, 22 bp, Homo sapiens
caggaaagagctgccaggcagg

SEQ ID NO: 7688678 - DNA, 22 bp, Homo sapiens
caggaaagagctgccaggcagg

SEQ ID NO: 7688679 - DNA, 22 bp, Homo sapiens
caggaaagagctgccaggcagg

SEQ ID NO: 7688680 - DNA, 22 bp, Homo sapiens
caggaaagagctgccaggcagg

SEQ ID NO: 7688681 - DNA, 22 bp, Homo sapiens
caggaaagagctgccaggcagg

SEQ ID NO: 7688682 - DNA, 22 bp, Homo sapiens
caggaaagagctgccaggcagg

SEQ ID NO: 7688683 - DNA, 22 bp, Homo sapiens
caggaaagagctgccaggcagg

SEQ ID NO: 7688684 - DNA, 22 bp, Homo sapiens
caggaaagagctgccaggcagg

SEQ ID NO: 7688685 - DNA, 22 bp, Homo sapiens
caggaaaatgtcaatggaaagc

SEQ ID NO: 7688686 - DNA, 22 bp, Homo sapiens
caggaaaatgtcaatggaaagc

SEQ ID NO: 7688687 - DNA, 22 bp, Homo sapiens
caggaaaatgtcaatggaaagc

SEQ ID NO: 7688688 - DNA, 22 bp, Homo sapiens
caggaaacaaagccttgctcat

SEQ ID NO: 7688689 - DNA, 22 bp, Homo sapiens
caggaaacaaagccttgctcat

SEQ ID NO: 7688690 - DNA, 19 bp, Homo sapiens
caggaaacacctactgcta

SEQ ID NO: 7688691 - DNA, 22 bp, Homo sapiens
caggaaacatatgtgcttgagg

SEQ ID NO: 7688692 - DNA, 22 bp, Homo sapiens
caggaaacatatgtgcttgagg

SEQ ID NO: 7688693 - DNA, 19 bp, Homo sapiens
caggaaacacctactgcta

SEQ ID NO: 7688694 - DNA, 19 bp, Homo sapiens
caggaaacacctactgcta

SEQ ID NO: 7688695 - DNA, 22 bp, Homo sapiens
caggaaacggctattcttttgt

SEQ ID NO: 7688696 - DNA, 22 bp, Homo sapiens
caggaaaccgcatcccagtggg

SEQ ID NO: 7688697 - DNA, 22 bp, Homo sapiens
caggaaaccgcatcccagtggg

SEQ ID NO: 7688698 - DNA, 22 bp, Homo sapiens
caggaaaccgcatcccagtggg

SEQ ID NO: 7688699 - DNA, 22 bp, Homo sapiens
caggaaacggctattcttttgt

SEQ ID NO: 7688700 - DNA, 21 bp, Homo sapiens
caggaaactgaggccatgggg

SEQ ID NO: 7688701 - DNA, 22 bp, Homo sapiens
caggaaacattcccataacaca

SEQ ID NO: 7688702 - DNA, 22 bp, Homo sapiens
caggaaacattcccataacaca

SEQ ID NO: 7688703 - DNA, 22 bp, Homo sapiens
caggaaacattcttggtaagga

SEQ ID NO: 7688704 - DNA, 21 bp, Homo sapiens
caggaaagaaaacgtacatat

SEQ ID NO: 7688705 - DNA, 21 bp, Homo sapiens
caggaaagaaaacgtacatat

SEQ ID NO: 7688706 - DNA, 22 bp, Homo sapiens
caggaaagaaatgagaacacca

SEQ ID NO: 7688707 - DNA, 22 bp, Homo sapiens
caggaaagaaatgagaacacca

SEQ ID NO: 7688708 - DNA, 22 bp, Homo sapiens
caggaaagaaatgagaacacca

SEQ ID NO: 7688709 - DNA, 22 bp, Homo sapiens
caggaaagaaatgagaacacca

SEQ ID NO: 7688710 - DNA, 22 bp, Homo sapiens
caggaaagaaatgagaacacca

SEQ ID NO: 7688711 - DNA, 21 bp, Homo sapiens
caggaaagaaaacgtacatat

SEQ ID NO: 7688712 - DNA, 16 bp, Homo sapiens
caggaaacttaaagac

SEQ ID NO: 7688713 - DNA, 21 bp, Homo sapiens
caggaaactgaggccatgggg

SEQ ID NO: 7688714 - DNA, 22 bp, Homo sapiens
caggaaactgtgggcttaaatc

SEQ ID NO: 7688715 - DNA, 22 bp, Homo sapiens
caggaaagagagctattcactt

SEQ ID NO: 7688716 - DNA, 22 bp, Homo sapiens
caggaaagagagctattcactt

SEQ ID NO: 7688717 - DNA, 22 bp, Homo sapiens
caggaaagagctgccaggcagg

SEQ ID NO: 7688718 - DNA, 22 bp, Homo sapiens
caggaaagagagctattcactt

SEQ ID NO: 7688719 - DNA, 22 bp, Homo sapiens
caggaaagagctgccaggcagg

SEQ ID NO: 7688720 - DNA, 22 bp, Homo sapiens
caggaaagagctgccaggcagg

SEQ ID NO: 7688721 - DNA, 22 bp, Homo sapiens
caggaaagaaatgagaacacca

SEQ ID NO: 7688722 - DNA, 22 bp, Homo sapiens
caggaaagaaatgagaacacca

SEQ ID NO: 7688723 - DNA, 22 bp, Homo sapiens
caggaaagaaatgagaacacca

SEQ ID NO: 7688724 - DNA, 22 bp, Homo sapiens
caggaaagaaatgagaacacca

SEQ ID NO: 7688725 - DNA, 22 bp, Homo sapiens
gttacaaatgccaaagctgaga

SEQ ID NO: 7688726 - DNA, 22 bp, Homo sapiens
gttacaaatgccaaagctgaga

SEQ ID NO: 7688727 - DNA, 22 bp, Homo sapiens
gttacaaatgccaaagctgaga

SEQ ID NO: 7688728 - DNA, 22 bp, Homo sapiens
gttacaaatgccaaagctgaga

SEQ ID NO: 7688729 - DNA, 22 bp, Homo sapiens
gttacaaatgtaaattctgggg

SEQ ID NO: 7688730 - DNA, 22 bp, Homo sapiens
gttacaaatgtaaattctgggg

SEQ ID NO: 7688731 - DNA, 22 bp, Homo sapiens
gttacaaatgtaaattctgggg

SEQ ID NO: 7688732 - DNA, 22 bp, Homo sapiens
gttacaaatgtaaattctgggg

SEQ ID NO: 7688733 - DNA, 22 bp, Homo sapiens
gttacaaatgtaaattctgggg

SEQ ID NO: 7688734 - DNA, 22 bp, Homo sapiens
gttacaaatgtaaattctgggg

SEQ ID NO: 7688735 - DNA, 22 bp, Homo sapiens
gttacaaatgtaaattctgggg

SEQ ID NO: 7688736 - DNA, 22 bp, Homo sapiens
gttacaaatgtaaattctgggg

SEQ ID NO: 7688737 - DNA, 22 bp, Homo sapiens
gttacaaatgtaaattctgggg

SEQ ID NO: 7688738 - DNA, 22 bp, Homo sapiens
gttacaaatgtaaattctgggg

SEQ ID NO: 7688739 - DNA, 22 bp, Homo sapiens
gttacaaatgtaaattctgggg

SEQ ID NO: 7688740 - DNA, 22 bp, Homo sapiens
gttacaaatgtaaattctgggg

SEQ ID NO: 7688741 - DNA, 22 bp, Homo sapiens
gttacaatgtccttacatgaaa

SEQ ID NO: 7688742 - DNA, 22 bp, Homo sapiens
gttacaagtgttcgagagtgac

SEQ ID NO: 7688743 - DNA, 22 bp, Homo sapiens
gttacaactccctgaacctcgg

SEQ ID NO: 7688744 - DNA, 22 bp, Homo sapiens
gttacaagtgagatttaggaga

SEQ ID NO: 7688745 - DNA, 22 bp, Homo sapiens
gttacacagctaagcttctcct

SEQ ID NO: 7688746 - DNA, 22 bp, Homo sapiens
gttacagtcaggagatattttg

SEQ ID NO: 7688747 - DNA, 22 bp, Homo sapiens
gttacacaggaaaacattagca

SEQ ID NO: 7688748 - DNA, 22 bp, Homo sapiens
gttacagtgcttggcaataagt

SEQ ID NO: 7688749 - DNA, 22 bp, Homo sapiens
gttacaatgttcttcagttctg

SEQ ID NO: 7688750 - DNA, 22 bp, Homo sapiens
gttacaatgttcttcagttctg

SEQ ID NO: 7688751 - DNA, 22 bp, Homo sapiens
gttacaatgttcttcagttctg

SEQ ID NO: 7688752 - DNA, 22 bp, Homo sapiens
gttacacacaatatatcctaaa

SEQ ID NO: 7688753 - DNA, 22 bp, Homo sapiens
gttacaatgtccttacatgaaa

SEQ ID NO: 7688754 - DNA, 22 bp, Homo sapiens
gttacaatgttcttcagttctg

SEQ ID NO: 7688755 - DNA, 22 bp, Homo sapiens
gttacaatgtccttacatgaaa

SEQ ID NO: 7688756 - DNA, 22 bp, Homo sapiens
gttacaatgtccttacatgaaa

SEQ ID NO: 7688757 - DNA, 22 bp, Homo sapiens
gttacaatgtccttacatgaaa

SEQ ID NO: 7688758 - DNA, 22 bp, Homo sapiens
gttacaatgttcttcagttctg

SEQ ID NO: 7688759 - DNA, 22 bp, Homo sapiens
gttacaatgtccttacatgaaa

SEQ ID NO: 7688760 - DNA, 22 bp, Homo sapiens
gttacaatgtccttacatgaaa

SEQ ID NO: 7688761 - DNA, 22 bp, Homo sapiens
gtgttttggccattagtgtgat

SEQ ID NO: 7688762 - DNA, 22 bp, Homo sapiens
gtgttttggccattagtgtgat

SEQ ID NO: 7688763 - DNA, 22 bp, Homo sapiens
gtgttttggccattagtgtgat

SEQ ID NO: 7688764 - DNA, 22 bp, Homo sapiens
gtgttttggccattagtgtgat

SEQ ID NO: 7688765 - DNA, 22 bp, Homo sapiens
gtgttttggccattagtgtgat

SEQ ID NO: 7688766 - DNA, 22 bp, Homo sapiens
gtgttttggccattagtgtgat

SEQ ID NO: 7688767 - DNA, 22 bp, Homo sapiens
gtgttttgtgaggccttctttc

SEQ ID NO: 7688768 - DNA, 22 bp, Homo sapiens
gtgttttattggtgcagtcaga

SEQ ID NO: 7688769 - DNA, 22 bp, Homo sapiens
gtgttttattggtgcagtcaga

SEQ ID NO: 7688770 - DNA, 22 bp, Homo sapiens
gttaaacaataactggcacaca

SEQ ID NO: 7688771 - DNA, 22 bp, Homo sapiens
gttaaacaagctggacactgaa

SEQ ID NO: 7688772 - DNA, 22 bp, Homo sapiens
gttaaacaataactggcacaca

SEQ ID NO: 7688773 - DNA, 22 bp, Homo sapiens
gttaaacagttacatgtgctgg

SEQ ID NO: 7688774 - DNA, 22 bp, Homo sapiens
gttaaacaataactggcacaca

SEQ ID NO: 7688775 - DNA, 22 bp, Homo sapiens
gttaaacaataactggcacaca

SEQ ID NO: 7688776 - DNA, 22 bp, Homo sapiens
gttaaacaagctggacactgaa

SEQ ID NO: 7688777 - DNA, 22 bp, Homo sapiens
gttaaacaagctggacactgaa

SEQ ID NO: 7688778 - DNA, 22 bp, Homo sapiens
gttaaacaagctggacactgaa

SEQ ID NO: 7688779 - DNA, 20 bp, Homo sapiens
gttaaaagagtaatttgagg

SEQ ID NO: 7688780 - DNA, 22 bp, Homo sapiens
gttaaaagaacaactcggaggt

SEQ ID NO: 7688781 - DNA, 20 bp, Homo sapiens
gttaaaagagtaatttgagg

SEQ ID NO: 7688782 - DNA, 22 bp, Homo sapiens
gttaaacattgctccacgggtt

SEQ ID NO: 7688783 - DNA, 22 bp, Homo sapiens
gttaaacagttacatgtgctgg

SEQ ID NO: 7688784 - DNA, 22 bp, Homo sapiens
gttaaacagttacatgtgctgg

SEQ ID NO: 7688785 - DNA, 22 bp, Homo sapiens
gttaaacagttacatgtgctgg

SEQ ID NO: 7688786 - DNA, 22 bp, Homo sapiens
gttaaacagttacatgtgctgg

SEQ ID NO: 7688787 - DNA, 22 bp, Homo sapiens
gttaaagagtttggctttcttc

SEQ ID NO: 7688788 - DNA, 22 bp, Homo sapiens
gttaaagaagaatagttccttt

SEQ ID NO: 7688789 - DNA, 22 bp, Homo sapiens
gttaaagtgatcttgtcaggtt

SEQ ID NO: 7688790 - DNA, 22 bp, Homo sapiens
gttaaagtgatcttgtcaggtt

SEQ ID NO: 7688791 - DNA, 22 bp, Homo sapiens
gttaaagtgagctactttaggt

SEQ ID NO: 7688792 - DNA, 22 bp, Homo sapiens
gttaaagtgagctactttaggt

SEQ ID NO: 7688793 - DNA, 22 bp, Homo sapiens
gttaaagtgagctactttaggt

SEQ ID NO: 7688794 - DNA, 22 bp, Homo sapiens
gttaaataacctcatgtccgtt

SEQ ID NO: 7688795 - DNA, 22 bp, Homo sapiens
gttaaagtgatcttgtcaggtt

SEQ ID NO: 7688796 - DNA, 22 bp, Homo sapiens
gttacaaatgccaaagctgaga

SEQ ID NO: 7688797 - DNA, 22 bp, Homo sapiens
gttacaaatgccaaagctgaga

SEQ ID NO: 7688798 - DNA, 22 bp, Homo sapiens
gttacaaatgccaaagctgaga

SEQ ID NO: 7688799 - DNA, 22 bp, Homo sapiens
gtgtgtgccaactttatgtgca

SEQ ID NO: 7688800 - DNA, 22 bp, Homo sapiens
gtgtgtgccaactttatgtgca

SEQ ID NO: 7688801 - DNA, 22 bp, Homo sapiens
gtgtgtgcaagaggtttattga

SEQ ID NO: 7688802 - DNA, 22 bp, Homo sapiens
gtgtgtgcaagaggtttattga

SEQ ID NO: 7688803 - DNA, 22 bp, Homo sapiens
gtgtgtctttcatttcatgagg

SEQ ID NO: 7688804 - DNA, 22 bp, Homo sapiens
gtgtgtgcaagaggtttattga

SEQ ID NO: 7688805 - DNA, 22 bp, Homo sapiens
gtgtgtctttcatttcatgagg

SEQ ID NO: 7688806 - DNA, 20 bp, Homo sapiens
gtgtgtgctccatgcatgct

SEQ ID NO: 7688807 - DNA, 20 bp, Homo sapiens
gtgtgtgctccatgcatgct

SEQ ID NO: 7688808 - DNA, 22 bp, Homo sapiens
gtgtgtgctccccaggagagct

SEQ ID NO: 7688809 - DNA, 20 bp, Homo sapiens
gtgtgtgctccatgcatgct

SEQ ID NO: 7688810 - DNA, 22 bp, Homo sapiens
gtgtgtgccaactttatgtgca

SEQ ID NO: 7688811 - DNA, 22 bp, Homo sapiens
gtgtgtgccatcaagagctttc

SEQ ID NO: 7688812 - DNA, 20 bp, Homo sapiens
gtgtgtgctccatgcatgct

SEQ ID NO: 7688813 - DNA, 22 bp, Homo sapiens
gtgtgtgccatcaagagctttc

SEQ ID NO: 7688814 - DNA, 22 bp, Homo sapiens
gtgtgtgctccccaggagagct

SEQ ID NO: 7688815 - DNA, 22 bp, Homo sapiens
gtgtgtgctccccaggagagct

SEQ ID NO: 7688816 - DNA, 23 bp, Homo sapiens
gtgtgtggaaagtgcatgggcct

SEQ ID NO: 7688817 - DNA, 23 bp, Homo sapiens
gtgtgtggaaagtgcatgggcct

SEQ ID NO: 7688818 - DNA, 22 bp, Homo sapiens
gtgtgtgctccccaggagagct

SEQ ID NO: 7688819 - DNA, 23 bp, Homo sapiens
gtgtgtggaaagtgcatgggcct

SEQ ID NO: 7688820 - DNA, 22 bp, Homo sapiens
gtgtgtggcaaactgggcctgc

SEQ ID NO: 7688821 - DNA, 22 bp, Homo sapiens
gtgtgtggcaaactgggcctgc

SEQ ID NO: 7688822 - DNA, 22 bp, Homo sapiens
gtgtgtgtactctgtatataaa

SEQ ID NO: 7688823 - DNA, 22 bp, Homo sapiens
gtgtgtgtactctgtatataaa

SEQ ID NO: 7688824 - DNA, 22 bp, Homo sapiens
gtgtgtgtactctgtatataaa

SEQ ID NO: 7688825 - DNA, 22 bp, Homo sapiens
gtgtgtgtactctgtatataaa

SEQ ID NO: 7688826 - DNA, 22 bp, Homo sapiens
gtgtgtggggccttcgggtcct

SEQ ID NO: 7688827 - DNA, 22 bp, Homo sapiens
gtgtgtgtactctgtatataaa

SEQ ID NO: 7688828 - DNA, 22 bp, Homo sapiens
gtgtgtggggccttcgggtcct

SEQ ID NO: 7688829 - DNA, 22 bp, Homo sapiens
gtgtgtgtatatatacacacac

SEQ ID NO: 7688830 - DNA, 22 bp, Homo sapiens
gtgtgtgtatatatacacacac

SEQ ID NO: 7688831 - DNA, 22 bp, Homo sapiens
gtgtgtgtatatatacacacac

SEQ ID NO: 7688832 - DNA, 22 bp, Homo sapiens
gtgtgtgtatatatacacacac

SEQ ID NO: 7688833 - DNA, 22 bp, Homo sapiens
gtgtgtgtactctgtatataaa

SEQ ID NO: 7688834 - DNA, 22 bp, Homo sapiens
gtgtttgtgagctaggtgacat

SEQ ID NO: 7688835 - DNA, 22 bp, Homo sapiens
gtgtttggtcagacgtccgggg

SEQ ID NO: 7688836 - DNA, 22 bp, Homo sapiens
gtgtgtgtatctgcctatcaca

SEQ ID NO: 7688837 - DNA, 22 bp, Homo sapiens
gtgtttggtcagacgtccgggg

SEQ ID NO: 7688838 - DNA, 22 bp, Homo sapiens
gtgttttaagaaagaagctcag

SEQ ID NO: 7688839 - DNA, 22 bp, Homo sapiens
gtgttttaagaaagaagctcag

SEQ ID NO: 7688840 - DNA, 22 bp, Homo sapiens
gtgtttgtttagtgcagagaga

SEQ ID NO: 7688841 - DNA, 22 bp, Homo sapiens
gtgttttagtgctgctgagctg

SEQ ID NO: 7688842 - DNA, 22 bp, Homo sapiens
gtgttttagtgctgctgagctg

SEQ ID NO: 7688843 - DNA, 22 bp, Homo sapiens
gtgttttatcagacaaagtata

SEQ ID NO: 7688844 - DNA, 22 bp, Homo sapiens
gtgttttatggagtcataacgt

SEQ ID NO: 7688845 - DNA, 22 bp, Homo sapiens
gtgttttatggagtcataacgt

SEQ ID NO: 7688846 - DNA, 22 bp, Homo sapiens
gtgttttatcagacaaagtata

SEQ ID NO: 7688847 - DNA, 22 bp, Homo sapiens
gtgttttatggagtcataacgt

SEQ ID NO: 7688848 - DNA, 22 bp, Homo sapiens
cagcttccgaccgggggctgca

SEQ ID NO: 7688849 - DNA, 22 bp, Homo sapiens
cagcttctaaagtgtgaagcca

SEQ ID NO: 7688850 - DNA, 22 bp, Homo sapiens
cagcttctaaagtgtgaagcca

SEQ ID NO: 7688851 - DNA, 22 bp, Homo sapiens
cagcttcccttggctgagcaga

SEQ ID NO: 7688852 - DNA, 22 bp, Homo sapiens
cagcttccgaccgggggctgca

SEQ ID NO: 7688853 - DNA, 22 bp, Homo sapiens
cagcttccgaccgggggctgca

SEQ ID NO: 7688854 - DNA, 22 bp, Homo sapiens
gtgtgtctcccaagaaggccca

SEQ ID NO: 7688855 - DNA, 21 bp, Homo sapiens
gtgtgtctaatgtagtggaaa

SEQ ID NO: 7688856 - DNA, 22 bp, Homo sapiens
cagcttctaaagtgtgaagcca

SEQ ID NO: 7688857 - DNA, 22 bp, Homo sapiens
cagcttctaaagtgtgaagcca

SEQ ID NO: 7688858 - DNA, 22 bp, Homo sapiens
cagcttctaccatcaggaaatt

SEQ ID NO: 7688859 - DNA, 22 bp, Homo sapiens
cagcttctaccatcaggaaatt

SEQ ID NO: 7688860 - DNA, 22 bp, Homo sapiens
gtgtgtcttgaccaggatcgga

SEQ ID NO: 7688861 - DNA, 22 bp, Homo sapiens
gtgtgtctgaagttgagtagac

SEQ ID NO: 7688862 - DNA, 22 bp, Homo sapiens
gtgtgtctttataagaagaggg

SEQ ID NO: 7688863 - DNA, 22 bp, Homo sapiens
gtgtgtctttataagaagaggg

SEQ ID NO: 7688864 - DNA, 22 bp, Homo sapiens
gtgtgtcttgaccaggatcgga

SEQ ID NO: 7688865 - DNA, 22 bp, Homo sapiens
gtgtgtctgaagttgagtagac

SEQ ID NO: 7688866 - DNA, 22 bp, Homo sapiens
gtgtgtctcccaagaaggccca

SEQ ID NO: 7688867 - DNA, 22 bp, Homo sapiens
gtgtgtctgaagttgagtagac

SEQ ID NO: 7688868 - DNA, 22 bp, Homo sapiens
gtgtgtctgaagttgagtagac

SEQ ID NO: 7688869 - DNA, 22 bp, Homo sapiens
gtgtgtctgaagttgagtagac

SEQ ID NO: 7688870 - DNA, 22 bp, Homo sapiens
gtgtgtctgaagttgagtagac

SEQ ID NO: 7688871 - DNA, 22 bp, Homo sapiens
cagcttccatctccactgccct

SEQ ID NO: 7688872 - DNA, 22 bp, Homo sapiens
cagcttccatctccactgccct

SEQ ID NO: 7688873 - DNA, 22 bp, Homo sapiens
cagcttcccttggctgagcaga

SEQ ID NO: 7688874 - DNA, 22 bp, Homo sapiens
cagcttccccccgggcttgaga

SEQ ID NO: 7688875 - DNA, 22 bp, Homo sapiens
cagcttccccccgggcttgaga

SEQ ID NO: 7688876 - DNA, 22 bp, Homo sapiens
cagcttcccttggctgagcaga

SEQ ID NO: 7688877 - DNA, 22 bp, Homo sapiens
cagcttccataagagatggaga

SEQ ID NO: 7688878 - DNA, 22 bp, Homo sapiens
cagcttccacagacttggctcg

SEQ ID NO: 7688879 - DNA, 22 bp, Homo sapiens
cagcttcatgtccaggtactgt

SEQ ID NO: 7688880 - DNA, 22 bp, Homo sapiens
cagcttcatgtccaggtactgt

SEQ ID NO: 7688881 - DNA, 22 bp, Homo sapiens
cagcttcattgcctgatgtctt

SEQ ID NO: 7688882 - DNA, 22 bp, Homo sapiens
cagcttcattgcctgatgtctt

SEQ ID NO: 7688883 - DNA, 22 bp, Homo sapiens
cagcttcattgcctgatgtctt

SEQ ID NO: 7688884 - DNA, 22 bp, Homo sapiens
cagcttcaccagggccatggtt

SEQ ID NO: 7688885 - DNA, 20 bp, Homo sapiens
cagcttcaatgtcagcttga

SEQ ID NO: 7688886 - DNA, 22 bp, Homo sapiens
cagcttcagaagaagccgtgag

SEQ ID NO: 7688887 - DNA, 22 bp, Homo sapiens
cagcttcagaagaagccgtgag

SEQ ID NO: 7688888 - DNA, 22 bp, Homo sapiens
cagcttcaccagggccatggtt

SEQ ID NO: 7688889 - DNA, 22 bp, Homo sapiens
cagcttcaccagggccatggtt

SEQ ID NO: 7688890 - DNA, 20 bp, Homo sapiens
cagcttcaatgtcagcttga

SEQ ID NO: 7688891 - DNA, 22 bp, Homo sapiens
cagcttcaataatggctgatgg

SEQ ID NO: 7688892 - DNA, 22 bp, Homo sapiens
cagcttcaactgcacagtcaac

SEQ ID NO: 7688893 - DNA, 20 bp, Homo sapiens
cagcttcaatgtcagcttga

SEQ ID NO: 7688894 - DNA, 22 bp, Homo sapiens
cagcttcagggacagcttcttt

SEQ ID NO: 7688895 - DNA, 22 bp, Homo sapiens
cagcttcatgacaaacagtttt

SEQ ID NO: 7688896 - DNA, 22 bp, Homo sapiens
cagcttcatgacaaacagtttt

SEQ ID NO: 7688897 - DNA, 22 bp, Homo sapiens
cagcttcatgacaaacagtttt

SEQ ID NO: 7688898 - DNA, 22 bp, Homo sapiens
cagcttcatgacaaacagtttt

SEQ ID NO: 7688899 - DNA, 22 bp, Homo sapiens
cagcttcagggacagcttcttt

SEQ ID NO: 7688900 - DNA, 22 bp, Homo sapiens
cagcttcagcgtgacaccagtg

SEQ ID NO: 7688901 - DNA, 22 bp, Homo sapiens
cagcttcagaccctgggctgca

SEQ ID NO: 7688902 - DNA, 22 bp, Homo sapiens
cagcttcagcgtgacaccagtg

SEQ ID NO: 7688903 - DNA, 22 bp, Homo sapiens
cagctgtgtatgagagcatgct

SEQ ID NO: 7688904 - DNA, 22 bp, Homo sapiens
cagctgttgttatgtctgcagg

SEQ ID NO: 7688905 - DNA, 22 bp, Homo sapiens
cagctgttgtgtatcaggcaga

SEQ ID NO: 7688906 - DNA, 22 bp, Homo sapiens
cagctgttgtgtatcaggcaga

SEQ ID NO: 7688907 - DNA, 22 bp, Homo sapiens
cagctgtttgggcatggccaga

SEQ ID NO: 7688908 - DNA, 22 bp, Homo sapiens
cagctgtttcagtagcgttact

SEQ ID NO: 7688909 - DNA, 22 bp, Homo sapiens
cagcttcaactgcacagtcaac

SEQ ID NO: 7688910 - DNA, 22 bp, Homo sapiens
cagcttcaactgcacagtcaac

SEQ ID NO: 7688911 - DNA, 22 bp, Homo sapiens
cagcttcaactgcacagtcaac

SEQ ID NO: 7688912 - DNA, 22 bp, Homo sapiens
cagcttcaactgcacagtcaac

SEQ ID NO: 7688913 - DNA, 22 bp, Homo sapiens
cagcttcaactgcacagtcaac

SEQ ID NO: 7688914 - DNA, 22 bp, Homo sapiens
cagctgtgggcctgacgtggca

SEQ ID NO: 7688915 - DNA, 22 bp, Homo sapiens
cagctgtgggcctgacgtggca

SEQ ID NO: 7688916 - DNA, 22 bp, Homo sapiens
cagctgtggctgccactgctcc

SEQ ID NO: 7688917 - DNA, 22 bp, Homo sapiens
cagctgtggctgccactgctcc

SEQ ID NO: 7688918 - DNA, 22 bp, Homo sapiens
cagctgtggctgccactgctcc

SEQ ID NO: 7688919 - DNA, 22 bp, Homo sapiens
cagctgtggagggaggaaatgc

SEQ ID NO: 7688920 - DNA, 22 bp, Homo sapiens
cagctgtggctgccactgctcc

SEQ ID NO: 7688921 - DNA, 22 bp, Homo sapiens
cagctgtggctgccactgctcc

SEQ ID NO: 7688922 - DNA, 22 bp, Homo sapiens
cagctgtggctgccactgctcc

SEQ ID NO: 7688923 - DNA, 22 bp, Homo sapiens
cagctgtggggagcttgggcca

SEQ ID NO: 7688924 - DNA, 22 bp, Homo sapiens
cagctgtgggcctgacgtggca

SEQ ID NO: 7688925 - DNA, 22 bp, Homo sapiens
cagctgtggggagcttgggcca

SEQ ID NO: 7688926 - DNA, 22 bp, Homo sapiens
cagctgtggggagcttgggcca

SEQ ID NO: 7688927 - DNA, 22 bp, Homo sapiens
cagctgtggggagcttgggcca

SEQ ID NO: 7688928 - DNA, 22 bp, Homo sapiens
cagctgtgggcctgacgtggca

SEQ ID NO: 7688929 - DNA, 22 bp, Homo sapiens
cagctgtgggcctgacgtggca

SEQ ID NO: 7688930 - DNA, 22 bp, Homo sapiens
cagctgtgggcctgacgtggca

SEQ ID NO: 7688931 - DNA, 22 bp, Homo sapiens
cagctgtgggcctgacgtggca

SEQ ID NO: 7688932 - DNA, 22 bp, Homo sapiens
cagctgtgtagatgcagggtca

SEQ ID NO: 7688933 - DNA, 22 bp, Homo sapiens
cagctgtgtagatgcagggtca

SEQ ID NO: 7688934 - DNA, 22 bp, Homo sapiens
cagctgtgtatgagagcatgct

SEQ ID NO: 7688935 - DNA, 22 bp, Homo sapiens
cagctgtgtatgagagcatgct

SEQ ID NO: 7688936 - DNA, 22 bp, Homo sapiens
cagctgtgtatgagagcatgct

SEQ ID NO: 7688937 - DNA, 22 bp, Homo sapiens
cagctgtgtatgagagcatgct

SEQ ID NO: 7688938 - DNA, 22 bp, Homo sapiens
cagctgtgtatgagagcatgct

SEQ ID NO: 7688939 - DNA, 22 bp, Homo sapiens
cagctgtgtatgagagcatgct

SEQ ID NO: 7688940 - DNA, 22 bp, Homo sapiens
cagctgtgtatgagagcatgct

SEQ ID NO: 7688941 - DNA, 22 bp, Homo sapiens
cagctgtgtagatgcagggtca

SEQ ID NO: 7688942 - DNA, 22 bp, Homo sapiens
cagctgtgtagatgcagggtca

SEQ ID NO: 7688943 - DNA, 22 bp, Homo sapiens
cagctgtgtagatgcagggtca

SEQ ID NO: 7688944 - DNA, 22 bp, Homo sapiens
cagctgtgtaaacacatgtgta

SEQ ID NO: 7688945 - DNA, 22 bp, Homo sapiens
cagctgtgtaaacacatgtgta

SEQ ID NO: 7688946 - DNA, 22 bp, Homo sapiens
cagctgtgtaaacacatgtgta

SEQ ID NO: 7688947 - DNA, 22 bp, Homo sapiens
cagctgtgtaaacacatgtgta

SEQ ID NO: 7688948 - DNA, 22 bp, Homo sapiens
cagctgtgtaaacacatgtgta

SEQ ID NO: 7688949 - DNA, 22 bp, Homo sapiens
cagctgtgtaaacacatgtgta

SEQ ID NO: 7688950 - DNA, 22 bp, Homo sapiens
cagctgtgtaaacacatgtgta

SEQ ID NO: 7688951 - DNA, 22 bp, Homo sapiens
cagctgtggggagcttgggcca

SEQ ID NO: 7688952 - DNA, 22 bp, Homo sapiens
cagctgtgtaaacacatgtgta

SEQ ID NO: 7688953 - DNA, 22 bp, Homo sapiens
cagctgtgctgattgctcagta

SEQ ID NO: 7688954 - DNA, 22 bp, Homo sapiens
cagctgtgctgtattaagctct

SEQ ID NO: 7688955 - DNA, 22 bp, Homo sapiens
cagctgtgctgattgctcagta

SEQ ID NO: 7688956 - DNA, 22 bp, Homo sapiens
cagctgtgctgattgctcagta

SEQ ID NO: 7688957 - DNA, 22 bp, Homo sapiens
cagctgtgctgattgctcagta

SEQ ID NO: 7688958 - DNA, 22 bp, Homo sapiens
cagctgtgctgattgctcagta

SEQ ID NO: 7688959 - DNA, 22 bp, Homo sapiens
cagctgtgctgattgctcagta

SEQ ID NO: 7688960 - DNA, 22 bp, Homo sapiens
cagctgtgctgattgctcagta

SEQ ID NO: 7688961 - DNA, 22 bp, Homo sapiens
cagctgtgctgattgctcagta

SEQ ID NO: 7688962 - DNA, 22 bp, Homo sapiens
cagctgtggagatggggtgcat

SEQ ID NO: 7688963 - DNA, 22 bp, Homo sapiens
cagctgtggagatggggtgcat

SEQ ID NO: 7688964 - DNA, 22 bp, Homo sapiens
cagctgtggagatggggtgcat

SEQ ID NO: 7688965 - DNA, 22 bp, Homo sapiens
cagctgtggagggaggaaatgc

SEQ ID NO: 7688966 - DNA, 22 bp, Homo sapiens
cagctgtggagggaggaaatgc

SEQ ID NO: 7688967 - DNA, 22 bp, Homo sapiens
cagctgtggagatggggtgcat

SEQ ID NO: 7688968 - DNA, 22 bp, Homo sapiens
cagctgtgctagaagccacgaa

SEQ ID NO: 7688969 - DNA, 22 bp, Homo sapiens
cagctgtgctgattgctcagta

SEQ ID NO: 7688970 - DNA, 22 bp, Homo sapiens
cagctgtgctgattgctcagta

SEQ ID NO: 7688971 - DNA, 22 bp, Homo sapiens
cagctgtgctgattgctcagta

SEQ ID NO: 7688972 - DNA, 22 bp, Homo sapiens
cagctgtgctagaagccacgaa

SEQ ID NO: 7688973 - DNA, 18 bp, Homo sapiens
cagctgtgccctgtttgg

SEQ ID NO: 7688974 - DNA, 22 bp, Homo sapiens
cagctgtgctagaagccacgaa

SEQ ID NO: 7688975 - DNA, 22 bp, Homo sapiens
cagctgtgctagaagccacgaa

SEQ ID NO: 7688976 - DNA, 22 bp, Homo sapiens
cagctgtgctagaagccacgaa

SEQ ID NO: 7688977 - DNA, 22 bp, Homo sapiens
cagctgtgattcctgctgtcca

SEQ ID NO: 7688978 - DNA, 22 bp, Homo sapiens
cagctgtgatatgcctgcctga

SEQ ID NO: 7688979 - DNA, 22 bp, Homo sapiens
cagctgtgatatgcctgcctga

SEQ ID NO: 7688980 - DNA, 22 bp, Homo sapiens
cagctgtgagcagccagttgcc

SEQ ID NO: 7688981 - DNA, 22 bp, Homo sapiens
cagctgtgattcctgctgtcca

SEQ ID NO: 7688982 - DNA, 22 bp, Homo sapiens
cagctgtgattcctgctgtcca

SEQ ID NO: 7688983 - DNA, 22 bp, Homo sapiens
cagctgtgattcctgctgtcca

SEQ ID NO: 7688984 - DNA, 22 bp, Homo sapiens
cagctgtgattcctgctgtcca

SEQ ID NO: 7688985 - DNA, 22 bp, Homo sapiens
gtttacattaagtattagcatc

SEQ ID NO: 7688986 - DNA, 22 bp, Homo sapiens
gtttacatgtactcattatact

SEQ ID NO: 7688987 - DNA, 22 bp, Homo sapiens
gtttacatgtactcattatact

SEQ ID NO: 7688988 - DNA, 22 bp, Homo sapiens
gtttacatgtttttctcttaca

SEQ ID NO: 7688989 - DNA, 22 bp, Homo sapiens
gtttacatgtttttctcttaca

SEQ ID NO: 7688990 - DNA, 22 bp, Homo sapiens
gtttacatgtaatgtgttattg

SEQ ID NO: 7688991 - DNA, 22 bp, Homo sapiens
gtttacatgtaatgtgttattg

SEQ ID NO: 7688992 - DNA, 22 bp, Homo sapiens
gtttacatgtaatgtgttattg

SEQ ID NO: 7688993 - DNA, 22 bp, Homo sapiens
gtttacatgtactcattatact

SEQ ID NO: 7688994 - DNA, 22 bp, Homo sapiens
gtttacatgtactcattatact

SEQ ID NO: 7688995 - DNA, 22 bp, Homo sapiens
gtttacatgtaatgtgttattg

SEQ ID NO: 7688996 - DNA, 22 bp, Homo sapiens
gtttacatgtactcattatact

SEQ ID NO: 7688997 - DNA, 22 bp, Homo sapiens
gtttacatgtactcattatact

SEQ ID NO: 7688998 - DNA, 22 bp, Homo sapiens
gtttattattcaacttcatgtt

SEQ ID NO: 7688999 - DNA, 22 bp, Homo sapiens
gtttattattcaacttcatgtt

SEQ ID NO: 7689000 - DNA, 22 bp, Homo sapiens
gtttattattcaacttcatgtt

SEQ ID NO: 7689001 - DNA, 22 bp, Homo sapiens
gtttattccagcaatctgctta

SEQ ID NO: 7689002 - DNA, 22 bp, Homo sapiens
gtttattattcaacttcatgtt

SEQ ID NO: 7689003 - DNA, 22 bp, Homo sapiens
gtttattattcaacttcatgtt

SEQ ID NO: 7689004 - DNA, 22 bp, Homo sapiens
gtttattattcaacttcatgtt

SEQ ID NO: 7689005 - DNA, 22 bp, Homo sapiens
gtttattattcaacttcatgtt

SEQ ID NO: 7689006 - DNA, 22 bp, Homo sapiens
gtttattattcaacttcatgtt

SEQ ID NO: 7689007 - DNA, 22 bp, Homo sapiens
gtttacattgctgtttgtgtct

SEQ ID NO: 7689008 - DNA, 22 bp, Homo sapiens
gtttacattgctgtttgtgtct

SEQ ID NO: 7689009 - DNA, 22 bp, Homo sapiens
gtttattatacaacaaaagcta

SEQ ID NO: 7689010 - DNA, 18 bp, Homo sapiens
gtttacattactgaatag

SEQ ID NO: 7689011 - DNA, 22 bp, Homo sapiens
gtttattatacaacaaaagcta

SEQ ID NO: 7689012 - DNA, 18 bp, Homo sapiens
gtttacattactgaatag

SEQ ID NO: 7689013 - DNA, 22 bp, Homo sapiens
gtttattgataaaagctggaca

SEQ ID NO: 7689014 - DNA, 22 bp, Homo sapiens
gtttattgataaaagctggaca

SEQ ID NO: 7689015 - DNA, 22 bp, Homo sapiens
gtttattgataaaagctggaca

SEQ ID NO: 7689016 - DNA, 22 bp, Homo sapiens
gtttattgataaaagctggaca

SEQ ID NO: 7689017 - DNA, 22 bp, Homo sapiens
gtttattgataaaagctggaca

SEQ ID NO: 7689018 - DNA, 22 bp, Homo sapiens
gtttattgataaaagctggaca

SEQ ID NO: 7689019 - DNA, 22 bp, Homo sapiens
gtttattgataaaagctggaca

SEQ ID NO: 7689020 - DNA, 22 bp, Homo sapiens
gtttattgataaaagctggaca

SEQ ID NO: 7689021 - DNA, 22 bp, Homo sapiens
gtttattgataaaagctggaca

SEQ ID NO: 7689022 - DNA, 22 bp, Homo sapiens
gtttattcttcagcaacatctg

SEQ ID NO: 7689023 - DNA, 22 bp, Homo sapiens
gtttattgggtattgtggagcc

SEQ ID NO: 7689024 - DNA, 22 bp, Homo sapiens
gtttattgggtattgtggagcc

SEQ ID NO: 7689025 - DNA, 22 bp, Homo sapiens
gtttattgggtattgtggagcc

SEQ ID NO: 7689026 - DNA, 22 bp, Homo sapiens
gtttattgggtattgtggagcc

SEQ ID NO: 7689027 - DNA, 22 bp, Homo sapiens
gtttattgggtattgtggagcc

SEQ ID NO: 7689028 - DNA, 22 bp, Homo sapiens
gtttattgggtattgtggagcc

SEQ ID NO: 7689029 - DNA, 22 bp, Homo sapiens
gtttattgggtattgtggagcc

SEQ ID NO: 7689030 - DNA, 22 bp, Homo sapiens
gtttattgggtattgtggagcc

SEQ ID NO: 7689031 - DNA, 22 bp, Homo sapiens
gtttcaaaagtcaggctattct

SEQ ID NO: 7689032 - DNA, 22 bp, Homo sapiens
gtttcaaaagtcaggctattct

SEQ ID NO: 7689033 - DNA, 22 bp, Homo sapiens
gtttcaaaagtcaggctattct

SEQ ID NO: 7689034 - DNA, 22 bp, Homo sapiens
gtttcaaaagtcaggctattct

SEQ ID NO: 7689035 - DNA, 22 bp, Homo sapiens
gtttcaaaatgatgctgtaact

SEQ ID NO: 7689036 - DNA, 22 bp, Homo sapiens
gtttcaaaatgatgctgtaact

SEQ ID NO: 7689037 - DNA, 22 bp, Homo sapiens
gtttcaaagcacagctcacatt

SEQ ID NO: 7689038 - DNA, 22 bp, Homo sapiens
gtttcaaagcacagctcacatt

SEQ ID NO: 7689039 - DNA, 22 bp, Homo sapiens
gtttcaaaatgatgctgtaact

SEQ ID NO: 7689040 - DNA, 22 bp, Homo sapiens
gtttcaaagcacagctcacatt

SEQ ID NO: 7689041 - DNA, 22 bp, Homo sapiens
gtttcaaagcacagctcacatt

SEQ ID NO: 7689042 - DNA, 22 bp, Homo sapiens
gtttcctttaatagtgatattg

SEQ ID NO: 7689043 - DNA, 19 bp, Homo sapiens
gtttccttgggtgtaggga

SEQ ID NO: 7689044 - DNA, 22 bp, Homo sapiens
gtttcctttaatagtgatattg

SEQ ID NO: 7689045 - DNA, 22 bp, Homo sapiens
gtttcctttaatagtgatattg

SEQ ID NO: 7689046 - DNA, 22 bp, Homo sapiens
gtttcctttaatagtgatattg

SEQ ID NO: 7689047 - DNA, 22 bp, Homo sapiens
gtttcctttctattgccttgat

SEQ ID NO: 7689048 - DNA, 19 bp, Homo sapiens
gtttccttgggtgtaggga

SEQ ID NO: 7689049 - DNA, 22 bp, Homo sapiens
gtttcctttctattgccttgat

SEQ ID NO: 7689050 - DNA, 22 bp, Homo sapiens
gtttgcatttattagtcttctg

SEQ ID NO: 7689051 - DNA, 22 bp, Homo sapiens
gtttcctttaatagtgatattg

SEQ ID NO: 7689052 - DNA, 22 bp, Homo sapiens
gtttgcctgccgacgctctcat

SEQ ID NO: 7689053 - DNA, 22 bp, Homo sapiens
gtttgcctgtgatgtacatttc

SEQ ID NO: 7689054 - DNA, 22 bp, Homo sapiens
gtttgcctgtgatgtacatttc

SEQ ID NO: 7689055 - DNA, 22 bp, Homo sapiens
gtttgcttttttgaatcaggag

SEQ ID NO: 7689056 - DNA, 22 bp, Homo sapiens
gtttgcctgtgatgtacatttc

SEQ ID NO: 7689057 - DNA, 22 bp, Homo sapiens
gtttgctaatttaaagctattt

SEQ ID NO: 7689058 - DNA, 22 bp, Homo sapiens
gtttgcatttcttgaactatat

SEQ ID NO: 7689059 - DNA, 22 bp, Homo sapiens
gtttgccttttagataggaatg

SEQ ID NO: 7689060 - DNA, 19 bp, Homo sapiens
gtttccttgggtgtaggga

SEQ ID NO: 7689061 - DNA, 19 bp, Homo sapiens
gtttccttgggtgtaggga

SEQ ID NO: 7689062 - DNA, 22 bp, Homo sapiens
gtttcctgtttctcagcagccc

SEQ ID NO: 7689063 - DNA, 22 bp, Homo sapiens
gtttcctgtttctcagcagccc

SEQ ID NO: 7689064 - DNA, 22 bp, Homo sapiens
gtttcctgtttctcagcagccc

SEQ ID NO: 7689065 - DNA, 22 bp, Homo sapiens
gtttcctgtttctcagcagccc

SEQ ID NO: 7689066 - DNA, 22 bp, Homo sapiens
gtttcctgtgggaactcggctg

SEQ ID NO: 7689067 - DNA, 22 bp, Homo sapiens
gtttcctgtgggaactcggctg

SEQ ID NO: 7689068 - DNA, 22 bp, Homo sapiens
gtttcctgtggccacagaataa

SEQ ID NO: 7689069 - DNA, 22 bp, Homo sapiens
gtttcctgtggccacagaataa

SEQ ID NO: 7689070 - DNA, 22 bp, Homo sapiens
gtttcctgtggccacagaataa

SEQ ID NO: 7689071 - DNA, 22 bp, Homo sapiens
gtttcctgtggccacagaataa

SEQ ID NO: 7689072 - DNA, 22 bp, Homo sapiens
gtttcctgggccccaacccaga

SEQ ID NO: 7689073 - DNA, 22 bp, Homo sapiens
gtttcctgtctgctttactata

SEQ ID NO: 7689074 - DNA, 22 bp, Homo sapiens
gtttcctgtctgctttactata

SEQ ID NO: 7689075 - DNA, 22 bp, Homo sapiens
gtttcctgtctgctttactata

SEQ ID NO: 7689076 - DNA, 18 bp, Homo sapiens
gtttcctgtcttacgggg

SEQ ID NO: 7689077 - DNA, 18 bp, Homo sapiens
gtttcctgtcttacgggg

SEQ ID NO: 7689078 - DNA, 22 bp, Homo sapiens
gtttcctggaaactgctccact

SEQ ID NO: 7689079 - DNA, 22 bp, Homo sapiens
gtttcctggaaactgctccact

SEQ ID NO: 7689080 - DNA, 22 bp, Homo sapiens
gtttcctggaaacattaggaga

SEQ ID NO: 7689081 - DNA, 22 bp, Homo sapiens
gtttcctggaaactgctccact

SEQ ID NO: 7689082 - DNA, 22 bp, Homo sapiens
gtttcctggaaactgctccact

SEQ ID NO: 7689083 - DNA, 22 bp, Homo sapiens
gtttcctggaggttatttttga

SEQ ID NO: 7689084 - DNA, 22 bp, Homo sapiens
gtttcctggaggttatttttga

SEQ ID NO: 7689085 - DNA, 22 bp, Homo sapiens
gtttcctggaggttatttttga

SEQ ID NO: 7689086 - DNA, 22 bp, Homo sapiens
gtttcaaagcacagctcacatt

SEQ ID NO: 7689087 - DNA, 22 bp, Homo sapiens
gtttcctataactcaggcacca

SEQ ID NO: 7689088 - DNA, 22 bp, Homo sapiens
gtttcctatggctgctgcagga

SEQ ID NO: 7689089 - DNA, 22 bp, Homo sapiens
gtttcctatgtccattgaggga

SEQ ID NO: 7689090 - DNA, 22 bp, Homo sapiens
gtttcctctgctggttttcatt

SEQ ID NO: 7689091 - DNA, 20 bp, Homo sapiens
gtttcctatttacctcctca

SEQ ID NO: 7689092 - DNA, 22 bp, Homo sapiens
gtttcctgaagttatttcatcc

SEQ ID NO: 7689093 - DNA, 22 bp, Homo sapiens
gtttcctgaagttatttcatcc

SEQ ID NO: 7689094 - DNA, 22 bp, Homo sapiens
gtttcctgaagttatttcatcc

SEQ ID NO: 7689095 - DNA, 22 bp, Homo sapiens
gtttcctgaccctggcccagca

SEQ ID NO: 7689096 - DNA, 22 bp, Homo sapiens
gtttcctgaccctggcccagca

SEQ ID NO: 7689097 - DNA, 22 bp, Homo sapiens
gtttcctgaccctggcccagca

SEQ ID NO: 7689098 - DNA, 22 bp, Homo sapiens
gtttcctgaaaagtaagggaca

SEQ ID NO: 7689099 - DNA, 22 bp, Homo sapiens
gtttcctgaaatagagtactgg

SEQ ID NO: 7689100 - DNA, 22 bp, Homo sapiens
gtttcctgaaatagagtactgg

SEQ ID NO: 7689101 - DNA, 22 bp, Homo sapiens
gtttcctgaaaagtaagggaca

SEQ ID NO: 7689102 - DNA, 22 bp, Homo sapiens
gtttcctctgctggttttcatt

SEQ ID NO: 7689103 - DNA, 22 bp, Homo sapiens
gtttcctctgctggttttcatt

SEQ ID NO: 7689104 - DNA, 22 bp, Homo sapiens
gtttcctgatgtgggagatctt

SEQ ID NO: 7689105 - DNA, 22 bp, Homo sapiens
gtttcctgatgtgggagatctt

SEQ ID NO: 7689106 - DNA, 22 bp, Homo sapiens
gtttcctgatgtgggagatctt

SEQ ID NO: 7689107 - DNA, 22 bp, Homo sapiens
gtttcctgatgtgggagatctt

SEQ ID NO: 7689108 - DNA, 18 bp, Homo sapiens
gtttcctgaggtgaaggg

SEQ ID NO: 7689109 - DNA, 18 bp, Homo sapiens
gtttcctgaggtgaaggg

SEQ ID NO: 7689110 - DNA, 18 bp, Homo sapiens
gtttcctgaggtgaaggg

SEQ ID NO: 7689111 - DNA, 22 bp, Homo sapiens
gtttcctgactgtggaattata

SEQ ID NO: 7689112 - DNA, 22 bp, Homo sapiens
gtttcctgactgtggaattata

SEQ ID NO: 7689113 - DNA, 22 bp, Homo sapiens
gtttcctgactgtggaattata

SEQ ID NO: 7689114 - DNA, 22 bp, Homo sapiens
gtttcctgactgtggaattata

SEQ ID NO: 7689115 - DNA, 22 bp, Homo sapiens
gtttcctgaccctggcccagca

SEQ ID NO: 7689116 - DNA, 22 bp, Homo sapiens
gtttcctggaaacattaggaga

SEQ ID NO: 7689117 - DNA, 22 bp, Homo sapiens
gtttcctggaaacattaggaga

SEQ ID NO: 7689118 - DNA, 22 bp, Homo sapiens
gtttcctgcgtgtgccactcat

SEQ ID NO: 7689119 - DNA, 22 bp, Homo sapiens
gtttcctgcgtgtgccactcat

SEQ ID NO: 7689120 - DNA, 22 bp, Homo sapiens
gtttcctgcgtgtgccactcat

SEQ ID NO: 7689121 - DNA, 22 bp, Homo sapiens
gtttcctgccctgtcttatcca

SEQ ID NO: 7689122 - DNA, 22 bp, Homo sapiens
gtttcctgatgtgggagatctt

SEQ ID NO: 7689123 - DNA, 22 bp, Homo sapiens
gtttcctgcacacgtgttatat

SEQ ID NO: 7689124 - DNA, 22 bp, Homo sapiens
gtttcctgcacacgtgttatat

SEQ ID NO: 7689125 - DNA, 22 bp, Homo sapiens
gtttcctgcacacgtgttatat

SEQ ID NO: 7689126 - DNA, 22 bp, Homo sapiens
gtttcctgcacacgtgttatat

SEQ ID NO: 7689127 - DNA, 22 bp, Homo sapiens
gtttcctgccctgtcttatcca

SEQ ID NO: 7689128 - DNA, 22 bp, Homo sapiens
gtttcctgccctgtcttatcca

SEQ ID NO: 7689129 - DNA, 22 bp, Homo sapiens
caggaacatgttggaaagaaat

SEQ ID NO: 7689130 - DNA, 21 bp, Homo sapiens
caggaacattctttacattta

SEQ ID NO: 7689131 - DNA, 21 bp, Homo sapiens
caggaacattctttacattta

SEQ ID NO: 7689132 - DNA, 22 bp, Homo sapiens
caggaacattgtagaattgaaa

SEQ ID NO: 7689133 - DNA, 22 bp, Homo sapiens
caggaacattgtagaattgaaa

SEQ ID NO: 7689134 - DNA, 21 bp, Homo sapiens
caggaacattctttacattta

SEQ ID NO: 7689135 - DNA, 22 bp, Homo sapiens
caggaacatttaaccacagggt

SEQ ID NO: 7689136 - DNA, 22 bp, Homo sapiens
caggaacatttaaccacagggt

SEQ ID NO: 7689137 - DNA, 22 bp, Homo sapiens
caggaacattgtagaattgaaa

SEQ ID NO: 7689138 - DNA, 22 bp, Homo sapiens
caggaacattgtagaattgaaa

SEQ ID NO: 7689139 - DNA, 22 bp, Homo sapiens
caggaagagaacatggaggctg

SEQ ID NO: 7689140 - DNA, 22 bp, Homo sapiens
caggaacatttaaccacagggt

SEQ ID NO: 7689141 - DNA, 22 bp, Homo sapiens
caggaacatgttggaaagaaat

SEQ ID NO: 7689142 - DNA, 22 bp, Homo sapiens
caggaacatgttggaaagaaat

SEQ ID NO: 7689143 - DNA, 22 bp, Homo sapiens
caggaacatgttggaaagaaat

SEQ ID NO: 7689144 - DNA, 22 bp, Homo sapiens
caggaacatgttggaaagaaat

SEQ ID NO: 7689145 - DNA, 22 bp, Homo sapiens
caggaacatgttggaaagaaat

SEQ ID NO: 7689146 - DNA, 22 bp, Homo sapiens
caggaacatgttggaaagaaat

SEQ ID NO: 7689147 - DNA, 22 bp, Homo sapiens
caggaacatgtctccaattaga

SEQ ID NO: 7689148 - DNA, 22 bp, Homo sapiens
caggaacatgtctccaattaga

SEQ ID NO: 7689149 - DNA, 19 bp, Homo sapiens
caggaacatggagggaggg

SEQ ID NO: 7689150 - DNA, 22 bp, Homo sapiens
caggaacatgtctccaattaga

SEQ ID NO: 7689151 - DNA, 22 bp, Homo sapiens
caggaacatgtctccaattaga

SEQ ID NO: 7689152 - DNA, 19 bp, Homo sapiens
caggaacatggagggaggg

SEQ ID NO: 7689153 - DNA, 19 bp, Homo sapiens
caggaacatggagggaggg

SEQ ID NO: 7689154 - DNA, 22 bp, Homo sapiens
caggaagaggtatcaccgagca

SEQ ID NO: 7689155 - DNA, 22 bp, Homo sapiens
caggaagaggacaggcttcccc

SEQ ID NO: 7689156 - DNA, 22 bp, Homo sapiens
caggaagaggtatcaccgagca

SEQ ID NO: 7689157 - DNA, 22 bp, Homo sapiens
caggaagaggtatcaccgagca

SEQ ID NO: 7689158 - DNA, 22 bp, Homo sapiens
caggaagaggtatcaccgagca

SEQ ID NO: 7689159 - DNA, 22 bp, Homo sapiens
caggaagaggtatcaccgagca

SEQ ID NO: 7689160 - DNA, 22 bp, Homo sapiens
caggaagaggtatcaccgagca

SEQ ID NO: 7689161 - DNA, 22 bp, Homo sapiens
caggaagaggtatcaccgagca

SEQ ID NO: 7689162 - DNA, 22 bp, Homo sapiens
caggaagaggtatcaccgagca

SEQ ID NO: 7689163 - DNA, 22 bp, Homo sapiens
caggaagagaacatggaggctg

SEQ ID NO: 7689164 - DNA, 22 bp, Homo sapiens
caggaagagaacatggaggctg

SEQ ID NO: 7689165 - DNA, 22 bp, Homo sapiens
caggaagaggacaggcttcccc

SEQ ID NO: 7689166 - DNA, 22 bp, Homo sapiens
caggaagaggacaggcttcccc

SEQ ID NO: 7689167 - DNA, 22 bp, Homo sapiens
caggaagaggacaggcttcccc

SEQ ID NO: 7689168 - DNA, 22 bp, Homo sapiens
caggaagaggacaggcttcccc

SEQ ID NO: 7689169 - DNA, 22 bp, Homo sapiens
caggaagaggacaggcttcccc

SEQ ID NO: 7689170 - DNA, 22 bp, Homo sapiens
caggaagaggacaggcttcccc

SEQ ID NO: 7689171 - DNA, 22 bp, Homo sapiens
caggaacacaatgagtctcaaa

SEQ ID NO: 7689172 - DNA, 22 bp, Homo sapiens
caggaacacaagttcagggatg

SEQ ID NO: 7689173 - DNA, 22 bp, Homo sapiens
caggaacacaagttcagggatg

SEQ ID NO: 7689174 - DNA, 22 bp, Homo sapiens
caggaacacaagttcagggatg

SEQ ID NO: 7689175 - DNA, 22 bp, Homo sapiens
caggaacacaagttcagggatg

SEQ ID NO: 7689176 - DNA, 22 bp, Homo sapiens
caggaacacaagttcagggatg

SEQ ID NO: 7689177 - DNA, 22 bp, Homo sapiens
caggaacaatgtaagtctcatt

SEQ ID NO: 7689178 - DNA, 22 bp, Homo sapiens
caggaacaatgtaagtctcatt

SEQ ID NO: 7689179 - DNA, 22 bp, Homo sapiens
caggaacaatgtaagtctcatt

SEQ ID NO: 7689180 - DNA, 22 bp, Homo sapiens
caggaacaatgtaagtctcatt

SEQ ID NO: 7689181 - DNA, 22 bp, Homo sapiens
caggaacaatgtaagtctcatt

SEQ ID NO: 7689182 - DNA, 22 bp, Homo sapiens
caggaacacaatgagtctcaaa

SEQ ID NO: 7689183 - DNA, 22 bp, Homo sapiens
caggaacacaatgagtctcaaa

SEQ ID NO: 7689184 - DNA, 22 bp, Homo sapiens
caggaacacaatgagtctcaaa

SEQ ID NO: 7689185 - DNA, 22 bp, Homo sapiens
caggaacacctgcagctagtgg

SEQ ID NO: 7689186 - DNA, 22 bp, Homo sapiens
caggaacacaatgagtctcaaa

SEQ ID NO: 7689187 - DNA, 22 bp, Homo sapiens
caggaacacaatgagtctcaaa

SEQ ID NO: 7689188 - DNA, 22 bp, Homo sapiens
caggaacagagtggcattgtct

SEQ ID NO: 7689189 - DNA, 22 bp, Homo sapiens
caggaacagagtggcattgtct

SEQ ID NO: 7689190 - DNA, 22 bp, Homo sapiens
caggaacagagtggcattgtct

SEQ ID NO: 7689191 - DNA, 22 bp, Homo sapiens
caggaacagagtggcattgtct

SEQ ID NO: 7689192 - DNA, 22 bp, Homo sapiens
caggaacagagtggcattgtct

SEQ ID NO: 7689193 - DNA, 22 bp, Homo sapiens
caggaacacctgcagctagtgg

SEQ ID NO: 7689194 - DNA, 22 bp, Homo sapiens
caggaacacctgcagctagtgg

SEQ ID NO: 7689195 - DNA, 22 bp, Homo sapiens
caggaacacctgcagctagtgg

SEQ ID NO: 7689196 - DNA, 22 bp, Homo sapiens
caggaacacctgcagctagtgg

SEQ ID NO: 7689197 - DNA, 22 bp, Homo sapiens
caggaacagctgacctgacaat

SEQ ID NO: 7689198 - DNA, 22 bp, Homo sapiens
caggaacagctgacctgacaat

SEQ ID NO: 7689199 - DNA, 22 bp, Homo sapiens
caggaacagctgacctgacaat

SEQ ID NO: 7689200 - DNA, 22 bp, Homo sapiens
caggaacagagtggcattgtct

SEQ ID NO: 7689201 - DNA, 22 bp, Homo sapiens
caggaacagcaccaggagctag

SEQ ID NO: 7689202 - DNA, 22 bp, Homo sapiens
caggaacagcaccaggagctag

SEQ ID NO: 7689203 - DNA, 22 bp, Homo sapiens
caggaacagcaccaggagctag

SEQ ID NO: 7689204 - DNA, 19 bp, Homo sapiens
caggaacatggagggaggg

SEQ ID NO: 7689205 - DNA, 22 bp, Homo sapiens
caggaacagggtgtcctggcag

SEQ ID NO: 7689206 - DNA, 22 bp, Homo sapiens
caggaacagggtgtcctggcag

SEQ ID NO: 7689207 - DNA, 22 bp, Homo sapiens
caggaacaggggagtgaacctg

SEQ ID NO: 7689208 - DNA, 22 bp, Homo sapiens
caggaacagggtgtcctggcag

SEQ ID NO: 7689209 - DNA, 22 bp, Homo sapiens
caggaacaggggagtgaacctg

SEQ ID NO: 7689210 - DNA, 22 bp, Homo sapiens
caggaacaggggagtgaacctg

SEQ ID NO: 7689211 - DNA, 22 bp, Homo sapiens
caggaacaggctgatgggcagg

SEQ ID NO: 7689212 - DNA, 22 bp, Homo sapiens
caggaacaggctgatgggcagg

SEQ ID NO: 7689213 - DNA, 22 bp, Homo sapiens
caggaacaggctgatgggcagg

SEQ ID NO: 7689214 - DNA, 22 bp, Homo sapiens
caggaacaggctgatgggcagg

SEQ ID NO: 7689215 - DNA, 22 bp, Homo sapiens
caggaacagctgacctgacaat

SEQ ID NO: 7689216 - DNA, 22 bp, Homo sapiens
gtttacatgcagaaaatcaatg

SEQ ID NO: 7689217 - DNA, 22 bp, Homo sapiens
gtttacatgcagaaaatcaatg

SEQ ID NO: 7689218 - DNA, 22 bp, Homo sapiens
gtttacatgcatgcaagaatga

SEQ ID NO: 7689219 - DNA, 22 bp, Homo sapiens
gtttacatgcagaaaatcaatg

SEQ ID NO: 7689220 - DNA, 22 bp, Homo sapiens
gtttacatgcagaaaatcaatg

SEQ ID NO: 7689221 - DNA, 22 bp, Homo sapiens
gtttacatattttaattggtga

SEQ ID NO: 7689222 - DNA, 22 bp, Homo sapiens
gtttacatattttaattggtga

SEQ ID NO: 7689223 - DNA, 22 bp, Homo sapiens
gtttacatatgtctgtctgcac

SEQ ID NO: 7689224 - DNA, 22 bp, Homo sapiens
gtttacagtggcttcattggat

SEQ ID NO: 7689225 - DNA, 22 bp, Homo sapiens
gtttacagtactcacttgcatt

SEQ ID NO: 7689226 - DNA, 22 bp, Homo sapiens
gtttacagtactcacttgcatt

SEQ ID NO: 7689227 - DNA, 22 bp, Homo sapiens
gtttacagtactcacttgcatt

SEQ ID NO: 7689228 - DNA, 22 bp, Homo sapiens
gtttacagagacagaaagtagt

SEQ ID NO: 7689229 - DNA, 18 bp, Homo sapiens
gtttacacattctagaaa

SEQ ID NO: 7689230 - DNA, 22 bp, Homo sapiens
gtttacaacatcttgtccttca

SEQ ID NO: 7689231 - DNA, 22 bp, Homo sapiens
gtttacaacatcttgtccttca

SEQ ID NO: 7689232 - DNA, 22 bp, Homo sapiens
gtttacaacatcttgtccttca

SEQ ID NO: 7689233 - DNA, 22 bp, Homo sapiens
gtttacaacatcttgtccttca

SEQ ID NO: 7689234 - DNA, 22 bp, Homo sapiens
gtttacaacatgccaactgggc

SEQ ID NO: 7689235 - DNA, 22 bp, Homo sapiens
gtttacaacatgccaactgggc

SEQ ID NO: 7689236 - DNA, 22 bp, Homo sapiens
gtttacaacatgccaactgggc

SEQ ID NO: 7689237 - DNA, 22 bp, Homo sapiens
gtttacaacatgccaactgggc

SEQ ID NO: 7689238 - DNA, 23 bp, Homo sapiens
caggaagcagatggggtagaaga

SEQ ID NO: 7689239 - DNA, 22 bp, Homo sapiens
gtttacaacatcttgtccttca

SEQ ID NO: 7689240 - DNA, 22 bp, Homo sapiens
gtttacaacatcttgtccttca

SEQ ID NO: 7689241 - DNA, 22 bp, Homo sapiens
gtttacaacatcttgtccttca

SEQ ID NO: 7689242 - DNA, 22 bp, Homo sapiens
gtttacaacatcttgtccttca

SEQ ID NO: 7689243 - DNA, 22 bp, Homo sapiens
gtttacaacatgccaactgggc

SEQ ID NO: 7689244 - DNA, 22 bp, Homo sapiens
gtttacaacatgccaactgggc

SEQ ID NO: 7689245 - DNA, 22 bp, Homo sapiens
gtttacaacatgccaactgggc

SEQ ID NO: 7689246 - DNA, 21 bp, Homo sapiens
gtttacaaggctttgctcctg

SEQ ID NO: 7689247 - DNA, 21 bp, Homo sapiens
gtttacaaggctttgctcctg

SEQ ID NO: 7689248 - DNA, 21 bp, Homo sapiens
gtttacaaggctttgctcctg

SEQ ID NO: 7689249 - DNA, 21 bp, Homo sapiens
gtttacaaggctttgctcctg

SEQ ID NO: 7689250 - DNA, 21 bp, Homo sapiens
gtttacaaggctttgctcctg

SEQ ID NO: 7689251 - DNA, 21 bp, Homo sapiens
gtttacaaggctttgctcctg

SEQ ID NO: 7689252 - DNA, 22 bp, Homo sapiens
gtttacacataactcctatcaa

SEQ ID NO: 7689253 - DNA, 22 bp, Homo sapiens
caggaagattgtggaggtggtt

SEQ ID NO: 7689254 - DNA, 22 bp, Homo sapiens
caggaagattgtggaggtggtt

SEQ ID NO: 7689255 - DNA, 22 bp, Homo sapiens
caggaagattgtggaggtggtt

SEQ ID NO: 7689256 - DNA, 22 bp, Homo sapiens
caggaagattgtggaggtggtt

SEQ ID NO: 7689257 - DNA, 22 bp, Homo sapiens
caggaagattgtggaggtggtt

SEQ ID NO: 7689258 - DNA, 22 bp, Homo sapiens
caggaagattgtggaggtggtt

SEQ ID NO: 7689259 - DNA, 22 bp, Homo sapiens
caggaagattgtggaggtggtt

SEQ ID NO: 7689260 - DNA, 22 bp, Homo sapiens
caggaagcaccagcccggcccc

SEQ ID NO: 7689261 - DNA, 22 bp, Homo sapiens
caggaagcacagtgaggagacc

SEQ ID NO: 7689262 - DNA, 22 bp, Homo sapiens
caggaagcacagtgaggagacc

SEQ ID NO: 7689263 - DNA, 22 bp, Homo sapiens
caggaagattgtggaggtggtt

SEQ ID NO: 7689264 - DNA, 22 bp, Homo sapiens
caggaagcaagtgattttcttg

SEQ ID NO: 7689265 - DNA, 22 bp, Homo sapiens
caggaagcacagtgaggagacc

SEQ ID NO: 7689266 - DNA, 22 bp, Homo sapiens
caggaagaggtggggctaaagt

SEQ ID NO: 7689267 - DNA, 22 bp, Homo sapiens
caggaagaggtggggctaaagt

SEQ ID NO: 7689268 - DNA, 22 bp, Homo sapiens
caggaagaggtggggctaaagt

SEQ ID NO: 7689269 - DNA, 22 bp, Homo sapiens
caggaagaggtggggctaaagt

SEQ ID NO: 7689270 - DNA, 22 bp, Homo sapiens
caggaagaggtggggctaaagt

SEQ ID NO: 7689271 - DNA, 22 bp, Homo sapiens
caggaagaggtatcaccgagca

SEQ ID NO: 7689272 - DNA, 22 bp, Homo sapiens
caggaagattagaccaagagct

SEQ ID NO: 7689273 - DNA, 22 bp, Homo sapiens
caggaagattagaccaagagct

SEQ ID NO: 7689274 - DNA, 22 bp, Homo sapiens
caggaagattagaccaagagct

SEQ ID NO: 7689275 - DNA, 22 bp, Homo sapiens
caggaagattagaccaagagct

SEQ ID NO: 7689276 - DNA, 22 bp, Homo sapiens
caggaagattagaccaagagct

SEQ ID NO: 7689277 - DNA, 22 bp, Homo sapiens
caggaagattagaccaagagct

SEQ ID NO: 7689278 - DNA, 22 bp, Homo sapiens
caggaagattagaccaagagct

SEQ ID NO: 7689279 - DNA, 22 bp, Homo sapiens
caggaagattagaccaagagct

SEQ ID NO: 7689280 - DNA, 22 bp, Homo sapiens
caggaagattagaccaagagct

SEQ ID NO: 7689281 - DNA, 22 bp, Homo sapiens
caggaagattagaccaagagct

SEQ ID NO: 7689282 - DNA, 22 bp, Homo sapiens
caggaagattagaccaagagct

SEQ ID NO: 7689283 - DNA, 22 bp, Homo sapiens
caggaagattgtggaggtggtt

SEQ ID NO: 7689284 - DNA, 22 bp, Homo sapiens
caggaagattgtggaggtggtt

SEQ ID NO: 7689285 - DNA, 22 bp, Homo sapiens
caggaagattgtggaggtggtt

SEQ ID NO: 7689286 - DNA, 22 bp, Homo sapiens
caggaagattagaccaagagct

SEQ ID NO: 7689287 - DNA, 22 bp, Homo sapiens
caggaagattagaccaagagct

SEQ ID NO: 7689288 - DNA, 22 bp, Homo sapiens
caggaagattagaccaagagct

SEQ ID NO: 7689289 - DNA, 22 bp, Homo sapiens
caggaagattagaccaagagct

SEQ ID NO: 7689290 - DNA, 22 bp, Homo sapiens
caggaagattagaccaagagct

SEQ ID NO: 7689291 - DNA, 22 bp, Homo sapiens
caggaagattagaccaagagct

SEQ ID NO: 7689292 - DNA, 22 bp, Homo sapiens
caggaagattagaccaagagct

SEQ ID NO: 7689293 - DNA, 22 bp, Homo sapiens
gttcttaaccttctttggttgt

SEQ ID NO: 7689294 - DNA, 22 bp, Homo sapiens
gttcttaagaccacaataaaaa

SEQ ID NO: 7689295 - DNA, 22 bp, Homo sapiens
gttcttaagaccacaataaaaa

SEQ ID NO: 7689296 - DNA, 21 bp, Homo sapiens
gttctgttgactgtgggcatc

SEQ ID NO: 7689297 - DNA, 19 bp, Homo sapiens
gttctgtgtcctggaggaa

SEQ ID NO: 7689298 - DNA, 22 bp, Homo sapiens
gttcttaaagattcatcaagca

SEQ ID NO: 7689299 - DNA, 22 bp, Homo sapiens
gttcttaaagattcatcaagca

SEQ ID NO: 7689300 - DNA, 22 bp, Homo sapiens
gttctgtcctcctaccaggcat

SEQ ID NO: 7689301 - DNA, 22 bp, Homo sapiens
gttcttcaaagtgacaactaaa

SEQ ID NO: 7689302 - DNA, 22 bp, Homo sapiens
gttcttcacatttcattgagga

SEQ ID NO: 7689303 - DNA, 22 bp, Homo sapiens
gttcttcacatttcattgagga

SEQ ID NO: 7689304 - DNA, 22 bp, Homo sapiens
gttcttcaccaaggtcagaggc

SEQ ID NO: 7689305 - DNA, 22 bp, Homo sapiens
gttcttcaccaaggtcagaggc

SEQ ID NO: 7689306 - DNA, 22 bp, Homo sapiens
gttcttcacattttggggtcac

SEQ ID NO: 7689307 - DNA, 22 bp, Homo sapiens
gttctgtcctcactgcaggcct

SEQ ID NO: 7689308 - DNA, 22 bp, Homo sapiens
gttctgtcctcactgcaggcct

SEQ ID NO: 7689309 - DNA, 22 bp, Homo sapiens
gttctgtagtcatagagcaatt

SEQ ID NO: 7689310 - DNA, 22 bp, Homo sapiens
gttctgtagtcatagagcaatt

SEQ ID NO: 7689311 - DNA, 22 bp, Homo sapiens
gttctgggttctgggttattgg

SEQ ID NO: 7689312 - DNA, 22 bp, Homo sapiens
gttctgggtgatgaggttggct

SEQ ID NO: 7689313 - DNA, 22 bp, Homo sapiens
gttctgggttcaaaccccggcc

SEQ ID NO: 7689314 - DNA, 22 bp, Homo sapiens
gttctgggttctgggttattgg

SEQ ID NO: 7689315 - DNA, 22 bp, Homo sapiens
gttctgggtagatgtatctttt

SEQ ID NO: 7689316 - DNA, 22 bp, Homo sapiens
gttctgggagatcttgagcttc

SEQ ID NO: 7689317 - DNA, 22 bp, Homo sapiens
gttctgggagatcttgagcttc

SEQ ID NO: 7689318 - DNA, 22 bp, Homo sapiens
gttctgggagatcttgagcttc

SEQ ID NO: 7689319 - DNA, 22 bp, Homo sapiens
gttctgggaaggtggacctgtt

SEQ ID NO: 7689320 - DNA, 22 bp, Homo sapiens
gttctgggtagatgtatctttt

SEQ ID NO: 7689321 - DNA, 22 bp, Homo sapiens
gttctgggtctggacacacaga

SEQ ID NO: 7689322 - DNA, 22 bp, Homo sapiens
gttctgggtctggacacacaga

SEQ ID NO: 7689323 - DNA, 22 bp, Homo sapiens
gttctgggtgatgaggttggct

SEQ ID NO: 7689324 - DNA, 22 bp, Homo sapiens
gttctgggtgatgaggttggct

SEQ ID NO: 7689325 - DNA, 22 bp, Homo sapiens
gttctgggtgatgaggttggct

SEQ ID NO: 7689326 - DNA, 22 bp, Homo sapiens
gttgcttgttagtggtgaggtt

SEQ ID NO: 7689327 - DNA, 22 bp, Homo sapiens
gttgctttacagctggtgacag

SEQ ID NO: 7689328 - DNA, 20 bp, Homo sapiens
gttgctttagtctggtttgg

SEQ ID NO: 7689329 - DNA, 20 bp, Homo sapiens
gttgctttagtctggtttgg

SEQ ID NO: 7689330 - DNA, 20 bp, Homo sapiens
gttgctttagtctggtttgg

SEQ ID NO: 7689331 - DNA, 22 bp, Homo sapiens
gttggaaatgcagagtctcaga

SEQ ID NO: 7689332 - DNA, 22 bp, Homo sapiens
gttggaaatgcagagtctcaga

SEQ ID NO: 7689333 - DNA, 20 bp, Homo sapiens
gttggaaagttcactctgct

SEQ ID NO: 7689334 - DNA, 20 bp, Homo sapiens
gttggaaagttcactctgct

SEQ ID NO: 7689335 - DNA, 22 bp, Homo sapiens
gttgcttttttgataggtggaa

SEQ ID NO: 7689336 - DNA, 22 bp, Homo sapiens
gttgcttttctccatcacatgg

SEQ ID NO: 7689337 - DNA, 22 bp, Homo sapiens
gttgctgattaacactttgagt

SEQ ID NO: 7689338 - DNA, 22 bp, Homo sapiens
gttgctgcaaaggagtgtaggt

SEQ ID NO: 7689339 - DNA, 22 bp, Homo sapiens
gttgctgggagcagggatcctg

SEQ ID NO: 7689340 - DNA, 22 bp, Homo sapiens
gttgctggaagctatggtccag

SEQ ID NO: 7689341 - DNA, 22 bp, Homo sapiens
gttgctggaagctatggtccag

SEQ ID NO: 7689342 - DNA, 22 bp, Homo sapiens
gttgctgcaaaggagtgtaggt

SEQ ID NO: 7689343 - DNA, 22 bp, Homo sapiens
gttgcttctcttaagtccagct

SEQ ID NO: 7689344 - DNA, 22 bp, Homo sapiens
gttgctgggagcagggatcctg

SEQ ID NO: 7689345 - DNA, 22 bp, Homo sapiens
gttcttcagccctcaggtccta

SEQ ID NO: 7689346 - DNA, 22 bp, Homo sapiens
gttcttcaggccatcctcccag

SEQ ID NO: 7689347 - DNA, 22 bp, Homo sapiens
gttcttcaggctgagcagagag

SEQ ID NO: 7689348 - DNA, 22 bp, Homo sapiens
gttcttcaggctgagcagagag

SEQ ID NO: 7689349 - DNA, 22 bp, Homo sapiens
gttcttcaggctgtgctctaga

SEQ ID NO: 7689350 - DNA, 21 bp, Homo sapiens
gttgctcttcaagaaaatccc

SEQ ID NO: 7689351 - DNA, 22 bp, Homo sapiens
gttgctgaaggcatgccagaga

SEQ ID NO: 7689352 - DNA, 22 bp, Homo sapiens
gttcttcagaggtcggaggcta

SEQ ID NO: 7689353 - DNA, 22 bp, Homo sapiens
gttcttcagattccatttcagt

SEQ ID NO: 7689354 - DNA, 22 bp, Homo sapiens
gttcttcagcattagaagtcat

SEQ ID NO: 7689355 - DNA, 22 bp, Homo sapiens
gttcttcagcattagaagtcat

SEQ ID NO: 7689356 - DNA, 22 bp, Homo sapiens
gttcttcagaggggaaagaacc

SEQ ID NO: 7689357 - DNA, 22 bp, Homo sapiens
gttcttcagaggggaaagaacc

SEQ ID NO: 7689358 - DNA, 22 bp, Homo sapiens
gttcttcagaggtcggaggcta

SEQ ID NO: 7689359 - DNA, 22 bp, Homo sapiens
gttcacagttaggacaactgct

SEQ ID NO: 7689360 - DNA, 22 bp, Homo sapiens
gttcacagtgttttctttgcat

SEQ ID NO: 7689361 - DNA, 22 bp, Homo sapiens
gttcacagtgttttctttgcat

SEQ ID NO: 7689362 - DNA, 22 bp, Homo sapiens
gttcacagtgttttctttgcat

SEQ ID NO: 7689363 - DNA, 22 bp, Homo sapiens
gttcacagttaggacaactgct

SEQ ID NO: 7689364 - DNA, 22 bp, Homo sapiens
gttcacagttaggacaactgct

SEQ ID NO: 7689365 - DNA, 22 bp, Homo sapiens
gttcacagttaggacaactgct

SEQ ID NO: 7689366 - DNA, 22 bp, Homo sapiens
gttcacagttcagcctgtaaca

SEQ ID NO: 7689367 - DNA, 22 bp, Homo sapiens
gttcacagttcagcctgtaaca

SEQ ID NO: 7689368 - DNA, 22 bp, Homo sapiens
gttcacagttcagcctgtaaca

SEQ ID NO: 7689369 - DNA, 22 bp, Homo sapiens
gttcacagttcagcctgtaaca

SEQ ID NO: 7689370 - DNA, 22 bp, Homo sapiens
gttcacagttcagcctgtaaca

SEQ ID NO: 7689371 - DNA, 22 bp, Homo sapiens
gttcacagtttctaatcccagc

SEQ ID NO: 7689372 - DNA, 22 bp, Homo sapiens
gttcacagtttctaatcccagc

SEQ ID NO: 7689373 - DNA, 22 bp, Homo sapiens
gttcacagttttatacctgaga

SEQ ID NO: 7689374 - DNA, 22 bp, Homo sapiens
gttcacagttttatacctgaga

SEQ ID NO: 7689375 - DNA, 22 bp, Homo sapiens
gttcacagttttatacctgaga

SEQ ID NO: 7689376 - DNA, 22 bp, Homo sapiens
gttcccaggccctgggctctcc

SEQ ID NO: 7689377 - DNA, 22 bp, Homo sapiens
gttcccaggccctgggctctcc

SEQ ID NO: 7689378 - DNA, 22 bp, Homo sapiens
gttcacagttttatacctgaga

SEQ ID NO: 7689379 - DNA, 22 bp, Homo sapiens
gttcccaggccctgggctctcc

SEQ ID NO: 7689380 - DNA, 22 bp, Homo sapiens
gttcccaggccctgggctctcc

SEQ ID NO: 7689381 - DNA, 22 bp, Homo sapiens
gttcccaggccctgggctctcc

SEQ ID NO: 7689382 - DNA, 22 bp, Homo sapiens
gttcccatgcctccaagcttca

SEQ ID NO: 7689383 - DNA, 22 bp, Homo sapiens
gttcccatgcctccaagcttca

SEQ ID NO: 7689384 - DNA, 22 bp, Homo sapiens
gttcccattgccctagcttgta

SEQ ID NO: 7689385 - DNA, 22 bp, Homo sapiens
gttcccattgccctagcttgta

SEQ ID NO: 7689386 - DNA, 22 bp, Homo sapiens
gttccccttgtgttgttgccca

SEQ ID NO: 7689387 - DNA, 22 bp, Homo sapiens
gttccccttgtgttgttgccca

SEQ ID NO: 7689388 - DNA, 22 bp, Homo sapiens
gttcacagtctacatagtaaag

SEQ ID NO: 7689389 - DNA, 22 bp, Homo sapiens
gttcacaggttctctttctaag

SEQ ID NO: 7689390 - DNA, 22 bp, Homo sapiens
gttcacaggttctctttctaag

SEQ ID NO: 7689391 - DNA, 22 bp, Homo sapiens
gttcacagtgttttctttgcat

SEQ ID NO: 7689392 - DNA, 22 bp, Homo sapiens
gttcacagtctacatagtaaag

SEQ ID NO: 7689393 - DNA, 22 bp, Homo sapiens
gttcacagtctacatagtaaag

SEQ ID NO: 7689394 - DNA, 22 bp, Homo sapiens
gttcacaggttctctttctaag

SEQ ID NO: 7689395 - DNA, 22 bp, Homo sapiens
gttcacagtctacatagtaaag

SEQ ID NO: 7689396 - DNA, 22 bp, Homo sapiens
gttcacagtctacatagtaaag

SEQ ID NO: 7689397 - DNA, 20 bp, Homo sapiens
gttcacaggcttcctttcag

SEQ ID NO: 7689398 - DNA, 22 bp, Homo sapiens
gttcacagcttgtgttttctct

SEQ ID NO: 7689399 - DNA, 20 bp, Homo sapiens
gttcacaggcttcctttcag

SEQ ID NO: 7689400 - DNA, 20 bp, Homo sapiens
gttcacaggcttcctttcag

SEQ ID NO: 7689401 - DNA, 22 bp, Homo sapiens
gttcacagcttcttaggtcata

SEQ ID NO: 7689402 - DNA, 22 bp, Homo sapiens
gttcacagcttcttaggtcata

SEQ ID NO: 7689403 - DNA, 22 bp, Homo sapiens
gttcacagcttgtgttttctct

SEQ ID NO: 7689404 - DNA, 22 bp, Homo sapiens
gttcacagcttgtgttttctct

SEQ ID NO: 7689405 - DNA, 20 bp, Homo sapiens
gttcacaggcttcctttcag

SEQ ID NO: 7689406 - DNA, 22 bp, Homo sapiens
gttcacagcttcttaggtcata

SEQ ID NO: 7689407 - DNA, 22 bp, Homo sapiens
gttcacagggatccttgttgaa

SEQ ID NO: 7689408 - DNA, 22 bp, Homo sapiens
gttcacagggatccttgttgaa

SEQ ID NO: 7689409 - DNA, 22 bp, Homo sapiens
gttcacagggatccttgttgaa

SEQ ID NO: 7689410 - DNA, 22 bp, Homo sapiens
gttcacagggttaggaatcact

SEQ ID NO: 7689411 - DNA, 22 bp, Homo sapiens
gttcacagggttaggaatcact

SEQ ID NO: 7689412 - DNA, 22 bp, Homo sapiens
gttcacaggttctctttctaag

SEQ ID NO: 7689413 - DNA, 22 bp, Homo sapiens
gttccctttcgtatggactggg

SEQ ID NO: 7689414 - DNA, 21 bp, Homo sapiens
gttcccttattggggcaggca

SEQ ID NO: 7689415 - DNA, 22 bp, Homo sapiens
gttcccttctcatggggtccag

SEQ ID NO: 7689416 - DNA, 22 bp, Homo sapiens
gttcctaaatctggaggacctc

SEQ ID NO: 7689417 - DNA, 22 bp, Homo sapiens
gttcctaaatctggaggacctc

SEQ ID NO: 7689418 - DNA, 22 bp, Homo sapiens
gttcctaaatttgaaggacttt

SEQ ID NO: 7689419 - DNA, 22 bp, Homo sapiens
gttcctaaccagcagagaaaca

SEQ ID NO: 7689420 - DNA, 22 bp, Homo sapiens
gttcctaaccagcagagaaaca

SEQ ID NO: 7689421 - DNA, 22 bp, Homo sapiens
gttcctaagcactgtgcattct

SEQ ID NO: 7689422 - DNA, 22 bp, Homo sapiens
gttcctaagctgtggccctgga

SEQ ID NO: 7689423 - DNA, 22 bp, Homo sapiens
gttcctcacgtggacagatgat

SEQ ID NO: 7689424 - DNA, 22 bp, Homo sapiens
gttcctcacgtggacagatgat

SEQ ID NO: 7689425 - DNA, 22 bp, Homo sapiens
gttcctcaaaaaggagagcccc

SEQ ID NO: 7689426 - DNA, 22 bp, Homo sapiens
gttcctcaaaaaggagagcccc

SEQ ID NO: 7689427 - DNA, 22 bp, Homo sapiens
gttcctgggaggcatgggctgg

SEQ ID NO: 7689428 - DNA, 22 bp, Homo sapiens
gttcctgcaagtaagtggctga

SEQ ID NO: 7689429 - DNA, 22 bp, Homo sapiens
gttcctggcattgtcagcggcc

SEQ ID NO: 7689430 - DNA, 22 bp, Homo sapiens
gttctggagtggtgccaggcct

SEQ ID NO: 7689431 - DNA, 22 bp, Homo sapiens
gttctggagtggtgccaggcct

SEQ ID NO: 7689432 - DNA, 22 bp, Homo sapiens
gttcctgggaggcatgggctgg

SEQ ID NO: 7689433 - DNA, 22 bp, Homo sapiens
gttctgggaaggtggacctgtt

SEQ ID NO: 7689434 - DNA, 22 bp, Homo sapiens
gttctgggaaggtggacctgtt

SEQ ID NO: 7689435 - DNA, 22 bp, Homo sapiens
gttcctgaagggactggtgcag

SEQ ID NO: 7689436 - DNA, 22 bp, Homo sapiens
gttcctgagaaataaagagaga

SEQ ID NO: 7689437 - DNA, 22 bp, Homo sapiens
gttcctcatgagtaccccttaa

SEQ ID NO: 7689438 - DNA, 22 bp, Homo sapiens
gttcctcatccagtcatgacta

SEQ ID NO: 7689439 - DNA, 22 bp, Homo sapiens
gttcctcagttgtaaaaaatgt

SEQ ID NO: 7689440 - DNA, 22 bp, Homo sapiens
gttcctcagcccttacttagcc

SEQ ID NO: 7689441 - DNA, 22 bp, Homo sapiens
caggaaatggctgaataaattc

SEQ ID NO: 7689442 - DNA, 22 bp, Homo sapiens
caggaaatggggtttagttatt

SEQ ID NO: 7689443 - DNA, 22 bp, Homo sapiens
caggaaatggggtttagttatt

SEQ ID NO: 7689444 - DNA, 22 bp, Homo sapiens
caggaaatggggtttagttatt

SEQ ID NO: 7689445 - DNA, 22 bp, Homo sapiens
caggaaatggctgaataaattc

SEQ ID NO: 7689446 - DNA, 22 bp, Homo sapiens
caggaaatggctgaataaattc

SEQ ID NO: 7689447 - DNA, 22 bp, Homo sapiens
caggaaatggctgaataaattc

SEQ ID NO: 7689448 - DNA, 22 bp, Homo sapiens
caggaaatagttcagtcaaact

SEQ ID NO: 7689449 - DNA, 22 bp, Homo sapiens
caggaaatagttcagtcaaact

SEQ ID NO: 7689450 - DNA, 22 bp, Homo sapiens
caggaaataggcgtttgtcctc

SEQ ID NO: 7689451 - DNA, 22 bp, Homo sapiens
caggaaatagttcagtcaaact

SEQ ID NO: 7689452 - DNA, 22 bp, Homo sapiens
caggaaataggcgtttgtcctc

SEQ ID NO: 7689453 - DNA, 22 bp, Homo sapiens
caggaaataggcgtttgtcctc

SEQ ID NO: 7689454 - DNA, 22 bp, Homo sapiens
caggaaataggcgtttgtcctc

SEQ ID NO: 7689455 - DNA, 22 bp, Homo sapiens
caggaaataaatggtaatgcat

SEQ ID NO: 7689456 - DNA, 22 bp, Homo sapiens
caggaaataaatggtaatgcat

SEQ ID NO: 7689457 - DNA, 22 bp, Homo sapiens
caggaaataaaaagtatcttct

SEQ ID NO: 7689458 - DNA, 22 bp, Homo sapiens
caggaaataaatggtaatgcat

SEQ ID NO: 7689459 - DNA, 22 bp, Homo sapiens
caggaaataaatggtaatgcat

SEQ ID NO: 7689460 - DNA, 22 bp, Homo sapiens
caggaaatagacactgtatgat

SEQ ID NO: 7689461 - DNA, 22 bp, Homo sapiens
caggaaatagacactgtatgat

SEQ ID NO: 7689462 - DNA, 22 bp, Homo sapiens
caggaaatagacactgtatgat

SEQ ID NO: 7689463 - DNA, 22 bp, Homo sapiens
caggaaagtctgtaaaggaacc

SEQ ID NO: 7689464 - DNA, 22 bp, Homo sapiens
caggaaataaaaagtatcttct

SEQ ID NO: 7689465 - DNA, 22 bp, Homo sapiens
caggaaataaaaagtatcttct

SEQ ID NO: 7689466 - DNA, 22 bp, Homo sapiens
caggaaataaaaagtatcttct

SEQ ID NO: 7689467 - DNA, 22 bp, Homo sapiens
caggaaataaaaagtatcttct

SEQ ID NO: 7689468 - DNA, 22 bp, Homo sapiens
caggaaataaaaagtatcttct

SEQ ID NO: 7689469 - DNA, 22 bp, Homo sapiens
caggaaataaaaagtatcttct

SEQ ID NO: 7689470 - DNA, 22 bp, Homo sapiens
caggaaataaaaagtatcttct

SEQ ID NO: 7689471 - DNA, 22 bp, Homo sapiens
caggaaattagtctctctgttg

SEQ ID NO: 7689472 - DNA, 22 bp, Homo sapiens
caggaaattagtctctctgttg

SEQ ID NO: 7689473 - DNA, 22 bp, Homo sapiens
caggaaattagtctctctgttg

SEQ ID NO: 7689474 - DNA, 22 bp, Homo sapiens
caggaaattcaagagaggctgc

SEQ ID NO: 7689475 - DNA, 22 bp, Homo sapiens
caggaaattcaagagaggctgc

SEQ ID NO: 7689476 - DNA, 22 bp, Homo sapiens
caggaaattcaagagaggctgc

SEQ ID NO: 7689477 - DNA, 23 bp, Homo sapiens
caggaaatgttcttgaagcctga

SEQ ID NO: 7689478 - DNA, 23 bp, Homo sapiens
caggaaatgttcttgaagcctga

SEQ ID NO: 7689479 - DNA, 23 bp, Homo sapiens
caggaaatgttcttgaagcctga

SEQ ID NO: 7689480 - DNA, 22 bp, Homo sapiens
caggaaattcaagagaggctgc

SEQ ID NO: 7689481 - DNA, 22 bp, Homo sapiens
caggaaattcaagagaggctgc

SEQ ID NO: 7689482 - DNA, 22 bp, Homo sapiens
caggaaattcccagaaggactg

SEQ ID NO: 7689483 - DNA, 22 bp, Homo sapiens
caggaaattcccagaaggactg

SEQ ID NO: 7689484 - DNA, 22 bp, Homo sapiens
caggaaattcccagaaggactg

SEQ ID NO: 7689485 - DNA, 22 bp, Homo sapiens
caggaaattcccagaaggactg

SEQ ID NO: 7689486 - DNA, 22 bp, Homo sapiens
caggaaattcttttgtttgtgc

SEQ ID NO: 7689487 - DNA, 22 bp, Homo sapiens
caggaaattcttttgtttgtgc

SEQ ID NO: 7689488 - DNA, 22 bp, Homo sapiens
caggaaattcttttgtttgtgc

SEQ ID NO: 7689489 - DNA, 22 bp, Homo sapiens
caggaaatgggtcgttttataa

SEQ ID NO: 7689490 - DNA, 22 bp, Homo sapiens
caggaaatgggtcgttttataa

SEQ ID NO: 7689491 - DNA, 22 bp, Homo sapiens
caggaaatgggtcgttttataa

SEQ ID NO: 7689492 - DNA, 22 bp, Homo sapiens
caggaaatggggtttagttatt

SEQ ID NO: 7689493 - DNA, 22 bp, Homo sapiens
caggaaatggggtttagttatt

SEQ ID NO: 7689494 - DNA, 22 bp, Homo sapiens
caggaaatgtataattttataa

SEQ ID NO: 7689495 - DNA, 22 bp, Homo sapiens
caggaaatgtataattttataa

SEQ ID NO: 7689496 - DNA, 22 bp, Homo sapiens
caggaaatgggtcgttttataa

SEQ ID NO: 7689497 - DNA, 22 bp, Homo sapiens
caggaaatgggtcgttttataa

SEQ ID NO: 7689498 - DNA, 22 bp, Homo sapiens
caggaaatgtataattttataa

SEQ ID NO: 7689499 - DNA, 22 bp, Homo sapiens
caggaaatgtataattttataa

SEQ ID NO: 7689500 - DNA, 22 bp, Homo sapiens
caggaaatgtataattttataa

SEQ ID NO: 7689501 - DNA, 22 bp, Homo sapiens
caggaacaatgtaagtctcatt

SEQ ID NO: 7689502 - DNA, 22 bp, Homo sapiens
caggaacaatcttactactatt

SEQ ID NO: 7689503 - DNA, 22 bp, Homo sapiens
caggaacaatcttactactatt

SEQ ID NO: 7689504 - DNA, 22 bp, Homo sapiens
caggaacaatcttactactatt

SEQ ID NO: 7689505 - DNA, 22 bp, Homo sapiens
caggaacaatcttactactatt

SEQ ID NO: 7689506 - DNA, 22 bp, Homo sapiens
caggaacaatacctcttgccag

SEQ ID NO: 7689507 - DNA, 22 bp, Homo sapiens
caggaacaatacctcttgccag

SEQ ID NO: 7689508 - DNA, 22 bp, Homo sapiens
caggaacaatacctcttgccag

SEQ ID NO: 7689509 - DNA, 22 bp, Homo sapiens
caggaacaaggcctatgggact

SEQ ID NO: 7689510 - DNA, 22 bp, Homo sapiens
caggaacaaggcctatgggact

SEQ ID NO: 7689511 - DNA, 22 bp, Homo sapiens
caggaacaatatctgtcctggt

SEQ ID NO: 7689512 - DNA, 22 bp, Homo sapiens
caggaacaatatctgtcctggt

SEQ ID NO: 7689513 - DNA, 22 bp, Homo sapiens
caggaacaatatctgtcctggt

SEQ ID NO: 7689514 - DNA, 22 bp, Homo sapiens
caggaacaactcccagcatctc

SEQ ID NO: 7689515 - DNA, 22 bp, Homo sapiens
caggaacaactcccagcatctc

SEQ ID NO: 7689516 - DNA, 22 bp, Homo sapiens
caggaacaactcccagcatctc

SEQ ID NO: 7689517 - DNA, 22 bp, Homo sapiens
caggaacaactcccagcatctc

SEQ ID NO: 7689518 - DNA, 22 bp, Homo sapiens
caggaaattttgtgatctgttc

SEQ ID NO: 7689519 - DNA, 22 bp, Homo sapiens
caggaacaaggcctatgggact

SEQ ID NO: 7689520 - DNA, 22 bp, Homo sapiens
caggaacaactcccagcatctc

SEQ ID NO: 7689521 - DNA, 22 bp, Homo sapiens
caggaacaactcccagcatctc

SEQ ID NO: 7689522 - DNA, 22 bp, Homo sapiens
caggaaattttgtgatctgttc

SEQ ID NO: 7689523 - DNA, 22 bp, Homo sapiens
caggaaattttgtgatctgttc

SEQ ID NO: 7689524 - DNA, 22 bp, Homo sapiens
caggaaatttatgttctactta

SEQ ID NO: 7689525 - DNA, 22 bp, Homo sapiens
caggaacaactcccagcatctc

SEQ ID NO: 7689526 - DNA, 22 bp, Homo sapiens
caggaaattctttttaacagaa

SEQ ID NO: 7689527 - DNA, 23 bp, Homo sapiens
caggaaatgttcttgaagcctga

SEQ ID NO: 7689528 - DNA, 22 bp, Homo sapiens
caggaaattctttttaacagaa

SEQ ID NO: 7689529 - DNA, 22 bp, Homo sapiens
caggaaattctttttaacagaa

SEQ ID NO: 7689530 - DNA, 22 bp, Homo sapiens
caggaaattcttttgtttgtgc

SEQ ID NO: 7689531 - DNA, 22 bp, Homo sapiens
caggaaattcttttgtttgtgc

SEQ ID NO: 7689532 - DNA, 22 bp, Homo sapiens
caggaaattggctatttgggat

SEQ ID NO: 7689533 - DNA, 22 bp, Homo sapiens
caggaaattgcaacagtctgag

SEQ ID NO: 7689534 - DNA, 22 bp, Homo sapiens
caggaaattgcaacagtctgag

SEQ ID NO: 7689535 - DNA, 22 bp, Homo sapiens
caggaaattgcaacagtctgag

SEQ ID NO: 7689536 - DNA, 22 bp, Homo sapiens
caggaaattctttttaacagaa

SEQ ID NO: 7689537 - DNA, 22 bp, Homo sapiens
caggaaattgcaacagtctgag

SEQ ID NO: 7689538 - DNA, 22 bp, Homo sapiens
caggaaattggctatttgggat

SEQ ID NO: 7689539 - DNA, 22 bp, Homo sapiens
caggaaatttatgttctactta

SEQ ID NO: 7689540 - DNA, 22 bp, Homo sapiens
caggaaatttatgttctactta

SEQ ID NO: 7689541 - DNA, 22 bp, Homo sapiens
caggaaatttatgttctactta

SEQ ID NO: 7689542 - DNA, 22 bp, Homo sapiens
caggaaatttatgttctactta

SEQ ID NO: 7689543 - DNA, 22 bp, Homo sapiens
caggaaatttatgttctactta

SEQ ID NO: 7689544 - DNA, 22 bp, Homo sapiens
caggaaatttatgttctactta

SEQ ID NO: 7689545 - DNA, 22 bp, Homo sapiens
caggaaatttaagagtgtacaa

SEQ ID NO: 7689546 - DNA, 22 bp, Homo sapiens
caggaaattggctatttgggat

SEQ ID NO: 7689547 - DNA, 22 bp, Homo sapiens
caggaaattggctatttgggat

SEQ ID NO: 7689548 - DNA, 22 bp, Homo sapiens
caggaaattggctatttgggat

SEQ ID NO: 7689549 - DNA, 22 bp, Homo sapiens
caggaaatttaagagtgtacaa

SEQ ID NO: 7689550 - DNA, 22 bp, Homo sapiens
caggaaatttaagagtgtacaa

SEQ ID NO: 7689551 - DNA, 22 bp, Homo sapiens
caggaaatttaagagtgtacaa

SEQ ID NO: 7689552 - DNA, 22 bp, Homo sapiens
caggaaattggctatttgggat

SEQ ID NO: 7689553 - DNA, 22 bp, Homo sapiens
caggaaatttaagagtgtacaa

SEQ ID NO: 7689554 - DNA, 22 bp, Homo sapiens
caggaaatttaagagtgtacaa

SEQ ID NO: 7689555 - DNA, 22 bp, Homo sapiens
gttggctcattttatagacagc

SEQ ID NO: 7689556 - DNA, 22 bp, Homo sapiens
gttggctgtcgctcacctccct

SEQ ID NO: 7689557 - DNA, 22 bp, Homo sapiens
gttggctatgagagctttagtg

SEQ ID NO: 7689558 - DNA, 22 bp, Homo sapiens
gttggctatgagagctttagtg

SEQ ID NO: 7689559 - DNA, 22 bp, Homo sapiens
gttgggaaggcaagaagtagaa

SEQ ID NO: 7689560 - DNA, 22 bp, Homo sapiens
gttgggaagcagatggatgagc

SEQ ID NO: 7689561 - DNA, 22 bp, Homo sapiens
gttgggaagcagatggatgagc

SEQ ID NO: 7689562 - DNA, 22 bp, Homo sapiens
gttgggaacatgacctaatggt

SEQ ID NO: 7689563 - DNA, 22 bp, Homo sapiens
gttggctttgctctctgtccta

SEQ ID NO: 7689564 - DNA, 22 bp, Homo sapiens
gttggctttgctctctgtccta

SEQ ID NO: 7689565 - DNA, 22 bp, Homo sapiens
gttggccatcgctatgacaaga

SEQ ID NO: 7689566 - DNA, 22 bp, Homo sapiens
gttggccatcgctatgacaaga

SEQ ID NO: 7689567 - DNA, 22 bp, Homo sapiens
gttggccaggctggtctcaatc

SEQ ID NO: 7689568 - DNA, 22 bp, Homo sapiens
gttggccaggctggtctcaaac

SEQ ID NO: 7689569 - DNA, 22 bp, Homo sapiens
gttggccattaattggaggaca

SEQ ID NO: 7689570 - DNA, 22 bp, Homo sapiens
gttggccattaattggaggaca

SEQ ID NO: 7689571 - DNA, 22 bp, Homo sapiens
gttggctatagggagatggggc

SEQ ID NO: 7689572 - DNA, 22 bp, Homo sapiens
gttggctatagggagatggggc

SEQ ID NO: 7689573 - DNA, 22 bp, Homo sapiens
gttggctatgagagctttagtg

SEQ ID NO: 7689574 - DNA, 22 bp, Homo sapiens
gttggcagaaagctttcgatcg

SEQ ID NO: 7689575 - DNA, 22 bp, Homo sapiens
gttggcagagagaagcctagca

SEQ ID NO: 7689576 - DNA, 22 bp, Homo sapiens
gttggcagaaagctttcgatcg

SEQ ID NO: 7689577 - DNA, 22 bp, Homo sapiens
gttggcagaaagctttcgatcg

SEQ ID NO: 7689578 - DNA, 22 bp, Homo sapiens
gttggcacttagccccagtcta

SEQ ID NO: 7689579 - DNA, 22 bp, Homo sapiens
gttggcacttcataatatgaaa

SEQ ID NO: 7689580 - DNA, 22 bp, Homo sapiens
gttggcaagtgttccttcctct

SEQ ID NO: 7689581 - DNA, 22 bp, Homo sapiens
gttggcagagagaagcctagca

SEQ ID NO: 7689582 - DNA, 22 bp, Homo sapiens
gttggccagcacagcttgcaag

SEQ ID NO: 7689583 - DNA, 22 bp, Homo sapiens
gttggccagcacagcttgcaag

SEQ ID NO: 7689584 - DNA, 22 bp, Homo sapiens
gttggccagagatgctgatata

SEQ ID NO: 7689585 - DNA, 22 bp, Homo sapiens
gttggccagagatgctgatata

SEQ ID NO: 7689586 - DNA, 22 bp, Homo sapiens
gttggaaatgcagagtctcaga

SEQ ID NO: 7689587 - DNA, 22 bp, Homo sapiens
gttggaaatggtttctatccct

SEQ ID NO: 7689588 - DNA, 22 bp, Homo sapiens
gttggagattaaagagtggggt

SEQ ID NO: 7689589 - DNA, 22 bp, Homo sapiens
gttggagcagagtagctgctca

SEQ ID NO: 7689590 - DNA, 22 bp, Homo sapiens
gttggcactactccttgcttaa

SEQ ID NO: 7689591 - DNA, 22 bp, Homo sapiens
gttggagtgcagcttgtgcgat

SEQ ID NO: 7689592 - DNA, 22 bp, Homo sapiens
gttggagtgcagcttgtgcgat

SEQ ID NO: 7689593 - DNA, 22 bp, Homo sapiens
gttggagtgcagcttgtgcgat

SEQ ID NO: 7689594 - DNA, 22 bp, Homo sapiens
gttggagtgcagcttgtgcgat

SEQ ID NO: 7689595 - DNA, 22 bp, Homo sapiens
caggaaagccgagtgccatagg

SEQ ID NO: 7689596 - DNA, 22 bp, Homo sapiens
caggaaagggatgggctgccac

SEQ ID NO: 7689597 - DNA, 22 bp, Homo sapiens
caggaaagggatgggctgccac

SEQ ID NO: 7689598 - DNA, 22 bp, Homo sapiens
caggaaagggatgggctgccac

SEQ ID NO: 7689599 - DNA, 22 bp, Homo sapiens
caggaaagggatgggctgccac

SEQ ID NO: 7689600 - DNA, 22 bp, Homo sapiens
caggaaagccgagtgccatagg

SEQ ID NO: 7689601 - DNA, 22 bp, Homo sapiens
caggaaagccgagtgccatagg

SEQ ID NO: 7689602 - DNA, 22 bp, Homo sapiens
gttgggaagcagatggatgagc

SEQ ID NO: 7689603 - DNA, 22 bp, Homo sapiens
caggaaagccgagtgccatagg

SEQ ID NO: 7689604 - DNA, 22 bp, Homo sapiens
caggaaagggatgggctgccac

SEQ ID NO: 7689605 - DNA, 22 bp, Homo sapiens
caggaaagggatgggctgccac

SEQ ID NO: 7689606 - DNA, 22 bp, Homo sapiens
caggaaagggatgggctgccac

SEQ ID NO: 7689607 - DNA, 22 bp, Homo sapiens
caggaaagggatgggctgccac

SEQ ID NO: 7689608 - DNA, 22 bp, Homo sapiens
caggaaagggatgggctgccac

SEQ ID NO: 7689609 - DNA, 22 bp, Homo sapiens
caggaaagggatgggctgccac

SEQ ID NO: 7689610 - DNA, 22 bp, Homo sapiens
caggaaaggtagtcacaatgta

SEQ ID NO: 7689611 - DNA, 22 bp, Homo sapiens
caggaaaggtagtcacaatgta

SEQ ID NO: 7689612 - DNA, 22 bp, Homo sapiens
caggaaaggtagtcacaatgta

SEQ ID NO: 7689613 - DNA, 22 bp, Homo sapiens
caggaaaggtagtcacaatgta

SEQ ID NO: 7689614 - DNA, 22 bp, Homo sapiens
caggaaaggtagtcacaatgta

SEQ ID NO: 7689615 - DNA, 22 bp, Homo sapiens
caggaaagtctgtaaaggaacc

SEQ ID NO: 7689616 - DNA, 22 bp, Homo sapiens
caggaaagtctgtaaaggaacc

SEQ ID NO: 7689617 - DNA, 22 bp, Homo sapiens
caggaaaggtgtgtcatgatgg

SEQ ID NO: 7689618 - DNA, 22 bp, Homo sapiens
caggaaagtctgtaaaggaacc

SEQ ID NO: 7689619 - DNA, 22 bp, Homo sapiens
caggaaagtctgtaaaggaacc

SEQ ID NO: 7689620 - DNA, 22 bp, Homo sapiens
caggaaaggtgtgtcatgatgg

SEQ ID NO: 7689621 - DNA, 22 bp, Homo sapiens
caggaaaggtgtgtcatgatgg

SEQ ID NO: 7689622 - DNA, 22 bp, Homo sapiens
caggaaaggtgtgtcatgatgg

SEQ ID NO: 7689623 - DNA, 22 bp, Homo sapiens
caggaaaggtagtcacaatgta

SEQ ID NO: 7689624 - DNA, 22 bp, Homo sapiens
caggaaaggtagtcacaatgta

SEQ ID NO: 7689625 - DNA, 22 bp, Homo sapiens
caggaaaggtagtcacaatgta

SEQ ID NO: 7689626 - DNA, 22 bp, Homo sapiens
caggaaaggtagtcacaatgta

SEQ ID NO: 7689627 - DNA, 22 bp, Homo sapiens
caggaaaggtgtgtcatgatgg

SEQ ID NO: 7689628 - DNA, 22 bp, Homo sapiens
caggaaaggtagtcacaatgta

SEQ ID NO: 7689629 - DNA, 22 bp, Homo sapiens
caggaaaggtgtgtcatgatgg

SEQ ID NO: 7689630 - DNA, 22 bp, Homo sapiens
caggaaaggtgtgtcatgatgg

SEQ ID NO: 7689631 - DNA, 22 bp, Homo sapiens
caggaaaggtgtgtcatgatgg

SEQ ID NO: 7689632 - DNA, 22 bp, Homo sapiens
caggaaaggtgtgtcatgatgg

SEQ ID NO: 7689633 - DNA, 22 bp, Homo sapiens
gtgtagcatatagcaagagcat

SEQ ID NO: 7689634 - DNA, 22 bp, Homo sapiens
gtgtagatagtttagatttcaa

SEQ ID NO: 7689635 - DNA, 22 bp, Homo sapiens
gtgtagagtgacaaggtgggaa

SEQ ID NO: 7689636 - DNA, 22 bp, Homo sapiens
gtgtagagtagctgaatgctaa

SEQ ID NO: 7689637 - DNA, 22 bp, Homo sapiens
gtgtataacccaaatatgctgc

SEQ ID NO: 7689638 - DNA, 22 bp, Homo sapiens
gtgtataacccaaatatgctgc

SEQ ID NO: 7689639 - DNA, 22 bp, Homo sapiens
gtgtataacccaaatatgctgc

SEQ ID NO: 7689640 - DNA, 19 bp, Homo sapiens
gtgtagctattggtcaaaa

SEQ ID NO: 7689641 - DNA, 22 bp, Homo sapiens
gtgtacttctgctgagccatgg

SEQ ID NO: 7689642 - DNA, 22 bp, Homo sapiens
gtgtagagtgacaaggtgggaa

SEQ ID NO: 7689643 - DNA, 22 bp, Homo sapiens
gtgtagagtgacaaggtgggaa

SEQ ID NO: 7689644 - DNA, 22 bp, Homo sapiens
gtgtacatgagaaatcaacttt

SEQ ID NO: 7689645 - DNA, 22 bp, Homo sapiens
gtgtacatgagaaatcaacttt

SEQ ID NO: 7689646 - DNA, 22 bp, Homo sapiens
gtgtacatattgagtctgctga

SEQ ID NO: 7689647 - DNA, 22 bp, Homo sapiens
gtgtacatattgagtctgctga

SEQ ID NO: 7689648 - DNA, 22 bp, Homo sapiens
gtgtacatagaattgtgctttg

SEQ ID NO: 7689649 - DNA, 22 bp, Homo sapiens
gtgtacatagaattgtgctttg

SEQ ID NO: 7689650 - DNA, 22 bp, Homo sapiens
gtgtacatagaattgtgctttg

SEQ ID NO: 7689651 - DNA, 22 bp, Homo sapiens
gtgtacatattgagtctgctga

SEQ ID NO: 7689652 - DNA, 22 bp, Homo sapiens
gtgtacatagaattgtgctttg

SEQ ID NO: 7689653 - DNA, 22 bp, Homo sapiens
gtgtacatattgagtctgctga

SEQ ID NO: 7689654 - DNA, 22 bp, Homo sapiens
gtgtataatgctgtttgtacat

SEQ ID NO: 7689655 - DNA, 22 bp, Homo sapiens
gtgtataatgctttgaagatta

SEQ ID NO: 7689656 - DNA, 22 bp, Homo sapiens
gtgtataatgctttgaagatta

SEQ ID NO: 7689657 - DNA, 22 bp, Homo sapiens
gtgtatactaggttctattcca

SEQ ID NO: 7689658 - DNA, 22 bp, Homo sapiens
gtgtatactaggttctattcca

SEQ ID NO: 7689659 - DNA, 22 bp, Homo sapiens
gtgtatactgagaaatgtcagc

SEQ ID NO: 7689660 - DNA, 22 bp, Homo sapiens
gtgtataactatctatctagta

SEQ ID NO: 7689661 - DNA, 22 bp, Homo sapiens
gtgtataactatctatctagta

SEQ ID NO: 7689662 - DNA, 22 bp, Homo sapiens
gtgtataactatctatctagta

SEQ ID NO: 7689663 - DNA, 22 bp, Homo sapiens
gtgtataataatgtgagctaaa

SEQ ID NO: 7689664 - DNA, 22 bp, Homo sapiens
gtgtataatcctgcaaagggag

SEQ ID NO: 7689665 - DNA, 22 bp, Homo sapiens
gtgtatctggcatgtcgagtgt

SEQ ID NO: 7689666 - DNA, 22 bp, Homo sapiens
gtgtatctcatgttcttctctg

SEQ ID NO: 7689667 - DNA, 22 bp, Homo sapiens
gtgtatccttattcacacacat

SEQ ID NO: 7689668 - DNA, 17 bp, Homo sapiens
gtgtatcaccatggcaa

SEQ ID NO: 7689669 - DNA, 22 bp, Homo sapiens
gtgtatcaaagcacagacttca

SEQ ID NO: 7689670 - DNA, 19 bp, Homo sapiens
gtgtatgtaagttgtgagg

SEQ ID NO: 7689671 - DNA, 22 bp, Homo sapiens
gtgtatggacacatgtcatgtt

SEQ ID NO: 7689672 - DNA, 22 bp, Homo sapiens
gtgtatgcaattgagtcataga

SEQ ID NO: 7689673 - DNA, 22 bp, Homo sapiens
gtgggtggattccagcaacgct

SEQ ID NO: 7689674 - DNA, 22 bp, Homo sapiens
gtgggtggattccagcaacgct

SEQ ID NO: 7689675 - DNA, 22 bp, Homo sapiens
gtgggtggattccagcaacgct

SEQ ID NO: 7689676 - DNA, 22 bp, Homo sapiens
gtgggtggattccagcaacgct

SEQ ID NO: 7689677 - DNA, 22 bp, Homo sapiens
gtgggtggggagctctctggag

SEQ ID NO: 7689678 - DNA, 22 bp, Homo sapiens
gtgggtggggagctctctggag

SEQ ID NO: 7689679 - DNA, 22 bp, Homo sapiens
gtgggtggggagctctctggag

SEQ ID NO: 7689680 - DNA, 22 bp, Homo sapiens
gtgggtggggagctctctggag

SEQ ID NO: 7689681 - DNA, 22 bp, Homo sapiens
gtgggtggggagctctctggag

SEQ ID NO: 7689682 - DNA, 22 bp, Homo sapiens
gtgggtggggagctctctggag

SEQ ID NO: 7689683 - DNA, 22 bp, Homo sapiens
gtgggtggggagctctctggag

SEQ ID NO: 7689684 - DNA, 22 bp, Homo sapiens
gtgggtgtgagtgacggcgtcc

SEQ ID NO: 7689685 - DNA, 22 bp, Homo sapiens
gtgggtgtcctgtgaaggctca

SEQ ID NO: 7689686 - DNA, 22 bp, Homo sapiens
gtgggtgtcagtatctttaacg

SEQ ID NO: 7689687 - DNA, 22 bp, Homo sapiens
gtgggtgtcctgtgaaggctca

SEQ ID NO: 7689688 - DNA, 22 bp, Homo sapiens
gtgggtgtgagtgacggcgtcc

SEQ ID NO: 7689689 - DNA, 22 bp, Homo sapiens
gtgggtgtctcaagaatggggg

SEQ ID NO: 7689690 - DNA, 22 bp, Homo sapiens
gtgggtgtgagtgacggcgtcc

SEQ ID NO: 7689691 - DNA, 22 bp, Homo sapiens
gtgggtgtgataagaccaaggg

SEQ ID NO: 7689692 - DNA, 22 bp, Homo sapiens
gtgggtgtgataagaccaaggg

SEQ ID NO: 7689693 - DNA, 22 bp, Homo sapiens
gtgggtgtgataagaccaaggg

SEQ ID NO: 7689694 - DNA, 22 bp, Homo sapiens
gtgggtggattccagcaacgct

SEQ ID NO: 7689695 - DNA, 22 bp, Homo sapiens
gtgggtggggagctctctggag

SEQ ID NO: 7689696 - DNA, 22 bp, Homo sapiens
gtgggtggggagctctctggag

SEQ ID NO: 7689697 - DNA, 22 bp, Homo sapiens
gtggtaaaatgtgaaatggatt

SEQ ID NO: 7689698 - DNA, 22 bp, Homo sapiens
gtggtaaaatgtgaaatggatt

SEQ ID NO: 7689699 - DNA, 22 bp, Homo sapiens
gtggtaaagctgattgaattga

SEQ ID NO: 7689700 - DNA, 22 bp, Homo sapiens
gtggtacagctgaaaggcttgc

SEQ ID NO: 7689701 - DNA, 22 bp, Homo sapiens
gtgggtgtggaactgtgagacc

SEQ ID NO: 7689702 - DNA, 22 bp, Homo sapiens
gtgggtgtggaactgtgagacc

SEQ ID NO: 7689703 - DNA, 22 bp, Homo sapiens
gtgtacatagaattgtgctttg

SEQ ID NO: 7689704 - DNA, 22 bp, Homo sapiens
gtgtacagtgatttgagttcac

SEQ ID NO: 7689705 - DNA, 22 bp, Homo sapiens
gtgtacagtgatttgagttcac

SEQ ID NO: 7689706 - DNA, 22 bp, Homo sapiens
gtgtacagtgatttgagttcac

SEQ ID NO: 7689707 - DNA, 22 bp, Homo sapiens
gtgtacagtgatttgagttcac

SEQ ID NO: 7689708 - DNA, 22 bp, Homo sapiens
gtgtacagtaagtgaatctagg

SEQ ID NO: 7689709 - DNA, 22 bp, Homo sapiens
gtgtacagtaagtgaatctagg

SEQ ID NO: 7689710 - DNA, 22 bp, Homo sapiens
gtgtacagtaagtgaatctagg

SEQ ID NO: 7689711 - DNA, 22 bp, Homo sapiens
gtggtaagactaacatttctca

SEQ ID NO: 7689712 - DNA, 22 bp, Homo sapiens
gtgtacaggatgactgtactta

SEQ ID NO: 7689713 - DNA, 22 bp, Homo sapiens
gtggtaggcacagagaacaaga

SEQ ID NO: 7689714 - DNA, 22 bp, Homo sapiens
gtggtaggcacagagaacaaga

SEQ ID NO: 7689715 - DNA, 22 bp, Homo sapiens
gtgtctgcatattcaaacttgt

SEQ ID NO: 7689716 - DNA, 20 bp, Homo sapiens
gtgtctgcatatagcaggtg

SEQ ID NO: 7689717 - DNA, 20 bp, Homo sapiens
gtgtctgcatatagcaggtg

SEQ ID NO: 7689718 - DNA, 22 bp, Homo sapiens
gtgtctgcacataggatctcaa

SEQ ID NO: 7689719 - DNA, 19 bp, Homo sapiens
gtgtctgcctttgtgccac

SEQ ID NO: 7689720 - DNA, 22 bp, Homo sapiens
gtgtctgcctttggactaactg

SEQ ID NO: 7689721 - DNA, 22 bp, Homo sapiens
gtgtctgcatattcaaacttgt

SEQ ID NO: 7689722 - DNA, 22 bp, Homo sapiens
gtgtctgcatattcaaacttgt

SEQ ID NO: 7689723 - DNA, 22 bp, Homo sapiens
gtgtctgcacataggatctcaa

SEQ ID NO: 7689724 - DNA, 22 bp, Homo sapiens
gtgtctgcaagatagccaagtc

SEQ ID NO: 7689725 - DNA, 22 bp, Homo sapiens
gtgtcaaatccactcctctttt

SEQ ID NO: 7689726 - DNA, 22 bp, Homo sapiens
gtgtctgcaagatagccaagtc

SEQ ID NO: 7689727 - DNA, 22 bp, Homo sapiens
gtgtattgcacatcctgtagcc

SEQ ID NO: 7689728 - DNA, 22 bp, Homo sapiens
gtgtcaaatccactcctctttt

SEQ ID NO: 7689729 - DNA, 19 bp, Homo sapiens
gtgtatgtaagttgtgagg

SEQ ID NO: 7689730 - DNA, 22 bp, Homo sapiens
gtgtatgcttagccagagattt

SEQ ID NO: 7689731 - DNA, 22 bp, Homo sapiens
gtgtatgggaaagcccttgagt

SEQ ID NO: 7689732 - DNA, 22 bp, Homo sapiens
gtgtatgtgccttacattttat

SEQ ID NO: 7689733 - DNA, 19 bp, Homo sapiens
gtgtatgtaagttgtgagg

SEQ ID NO: 7689734 - DNA, 22 bp, Homo sapiens
gtgtatgttctacttaatatta

SEQ ID NO: 7689735 - DNA, 22 bp, Homo sapiens
gtgtatgttctacttaatatta

SEQ ID NO: 7689736 - DNA, 22 bp, Homo sapiens
gtgtatgtgtttatagggaggt

SEQ ID NO: 7689737 - DNA, 22 bp, Homo sapiens
gtgtatgtgccttacattttat

SEQ ID NO: 7689738 - DNA, 22 bp, Homo sapiens
gtgtatgttctacttaatatta

SEQ ID NO: 7689739 - DNA, 22 bp, Homo sapiens
gtgtatgttctacttaatatta

SEQ ID NO: 7689740 - DNA, 20 bp, Homo sapiens
gtgtctggagtactagagag

SEQ ID NO: 7689741 - DNA, 20 bp, Homo sapiens
gtgtctggagtactagagag

SEQ ID NO: 7689742 - DNA, 22 bp, Homo sapiens
gtgtctgtgtcattactaatag

SEQ ID NO: 7689743 - DNA, 22 bp, Homo sapiens
gtgtctgttatacagaggagac

SEQ ID NO: 7689744 - DNA, 22 bp, Homo sapiens
gtgtcttaattcttgttgttca

SEQ ID NO: 7689745 - DNA, 22 bp, Homo sapiens
gtgtctgtgtcattactaatag

SEQ ID NO: 7689746 - DNA, 22 bp, Homo sapiens
gtgtctgttatacagaggagac

SEQ ID NO: 7689747 - DNA, 22 bp, Homo sapiens
gtgtctgctgcaccctcacacc

SEQ ID NO: 7689748 - DNA, 22 bp, Homo sapiens
gtgtctgctcagcttgctagaa

SEQ ID NO: 7689749 - DNA, 19 bp, Homo sapiens
gtgtctgcctttgtgccac

SEQ ID NO: 7689750 - DNA, 19 bp, Homo sapiens
gtgtctgcctttgtgccac

SEQ ID NO: 7689751 - DNA, 22 bp, Homo sapiens
gtgtctgctgcaccctcacacc

SEQ ID NO: 7689752 - DNA, 22 bp, Homo sapiens
gtgtctgctgcaccctcacacc

SEQ ID NO: 7689753 - DNA, 22 bp, Homo sapiens
gtgtctgcttgctgagcattta

SEQ ID NO: 7689754 - DNA, 22 bp, Homo sapiens
gtgtctggaacgggtggtactc

SEQ ID NO: 7689755 - DNA, 22 bp, Homo sapiens
gtgtctgctttcagctagtagg

SEQ ID NO: 7689756 - DNA, 22 bp, Homo sapiens
gtgtctgcttggtcatctttca

SEQ ID NO: 7689757 - DNA, 22 bp, Homo sapiens
gtgtctgcttggtcatctttca

SEQ ID NO: 7689758 - DNA, 22 bp, Homo sapiens
gtgtctgcttgctgagcattta

SEQ ID NO: 7689759 - DNA, 22 bp, Homo sapiens
gtgtctgcttgctgagcattta

SEQ ID NO: 7689760 - DNA, 22 bp, Homo sapiens
gtgtctgctttcagctagtagg

SEQ ID NO: 7689761 - DNA, 22 bp, Homo sapiens
gtgtgagcagaaaccatgagta

SEQ ID NO: 7689762 - DNA, 22 bp, Homo sapiens
gtgtgagcagaaaccatgagta

SEQ ID NO: 7689763 - DNA, 22 bp, Homo sapiens
gtgtgagagactgaagaaagcc

SEQ ID NO: 7689764 - DNA, 22 bp, Homo sapiens
gtgtgagagcaaaactgcagga

SEQ ID NO: 7689765 - DNA, 22 bp, Homo sapiens
gtgtgagcagaaaccatgagta

SEQ ID NO: 7689766 - DNA, 22 bp, Homo sapiens
gtgtgagcatcaaagcctgtca

SEQ ID NO: 7689767 - DNA, 22 bp, Homo sapiens
gtgtgagcatcaaagcctgtca

SEQ ID NO: 7689768 - DNA, 22 bp, Homo sapiens
gtgtgacctcatcttaactgga

SEQ ID NO: 7689769 - DNA, 22 bp, Homo sapiens
gtgtgacctcatcttaactgga

SEQ ID NO: 7689770 - DNA, 22 bp, Homo sapiens
gtgtgactttatttggaaatag

SEQ ID NO: 7689771 - DNA, 20 bp, Homo sapiens
gtgtgaagccctcaggagga

SEQ ID NO: 7689772 - DNA, 22 bp, Homo sapiens
gtgtgacccaaggacactctct

SEQ ID NO: 7689773 - DNA, 22 bp, Homo sapiens
gtgtgacccaaggacactctct

SEQ ID NO: 7689774 - DNA, 22 bp, Homo sapiens
gtgtgagagaagctgccatgga

SEQ ID NO: 7689775 - DNA, 22 bp, Homo sapiens
gtgtgactttatttggaaatag

SEQ ID NO: 7689776 - DNA, 22 bp, Homo sapiens
gtgtgagaagggaatgtaaagc

SEQ ID NO: 7689777 - DNA, 22 bp, Homo sapiens
gtgtgaaagttcctaagactat

SEQ ID NO: 7689778 - DNA, 22 bp, Homo sapiens
gtgtgaaagttcctaagactat

SEQ ID NO: 7689779 - DNA, 22 bp, Homo sapiens
gtgtcttagtcatttcaggctg

SEQ ID NO: 7689780 - DNA, 18 bp, Homo sapiens
gtgtcttattacagtggg

SEQ ID NO: 7689781 - DNA, 22 bp, Homo sapiens
gtgtctttattcctctatgttt

SEQ ID NO: 7689782 - DNA, 17 bp, Homo sapiens
gtgtctttgctgttgtg

SEQ ID NO: 7689783 - DNA, 22 bp, Homo sapiens
gtgtcttttctgtctagcacaa

SEQ ID NO: 7689784 - DNA, 22 bp, Homo sapiens
gtgtggaaccaaataacctaaa

SEQ ID NO: 7689785 - DNA, 22 bp, Homo sapiens
gtgtggaaccaaataacctaaa

SEQ ID NO: 7689786 - DNA, 22 bp, Homo sapiens
gtgtggaaagagtggcctctca

SEQ ID NO: 7689787 - DNA, 22 bp, Homo sapiens
gtgtggaatggagtttttgccc

SEQ ID NO: 7689788 - DNA, 22 bp, Homo sapiens
gtgtggaagcagatgggtgagc

SEQ ID NO: 7689789 - DNA, 22 bp, Homo sapiens
gtgtggaagcagatgggtgagc

SEQ ID NO: 7689790 - DNA, 22 bp, Homo sapiens
gtgtgctgttgttcaggtagaa

SEQ ID NO: 7689791 - DNA, 22 bp, Homo sapiens
gtgtggaaagagtggcctctca

SEQ ID NO: 7689792 - DNA, 22 bp, Homo sapiens
gtgtggaaacagagagggcaac

SEQ ID NO: 7689793 - DNA, 22 bp, Homo sapiens
gtgtgctgttgttcaggtagaa

SEQ ID NO: 7689794 - DNA, 22 bp, Homo sapiens
gtgtgctgcccaactcgcagat

SEQ ID NO: 7689795 - DNA, 22 bp, Homo sapiens
gtgtgctgcccaactcgcagat

SEQ ID NO: 7689796 - DNA, 22 bp, Homo sapiens
gtgtgctgcccaactcgcagat

SEQ ID NO: 7689797 - DNA, 22 bp, Homo sapiens
gtgtgctgcccaactcgcagat

SEQ ID NO: 7689798 - DNA, 22 bp, Homo sapiens
gtgtgctgggaccacgctgggt

SEQ ID NO: 7689799 - DNA, 22 bp, Homo sapiens
gtgtgctgggaccacgctgggt

SEQ ID NO: 7689800 - DNA, 22 bp, Homo sapiens
gtgtgctgcccaactcgcagat

SEQ ID NO: 7689801 - DNA, 22 bp, Homo sapiens
gtgtgctgttgttcaggtagaa

SEQ ID NO: 7689802 - DNA, 22 bp, Homo sapiens
gtgtgctgttgttcaggtagaa

SEQ ID NO: 7689803 - DNA, 21 bp, Homo sapiens
gtgtgctgatacattggagaa

SEQ ID NO: 7689804 - DNA, 22 bp, Homo sapiens
gtgtgctgagtgactgtcatca

SEQ ID NO: 7689805 - DNA, 22 bp, Homo sapiens
gtgtgctgagtgactgtcatca

SEQ ID NO: 7689806 - DNA, 22 bp, Homo sapiens
gtgtgctcaagggcaggaacct

SEQ ID NO: 7689807 - DNA, 22 bp, Homo sapiens
gtgtgctcaagggcaggaacct

SEQ ID NO: 7689808 - DNA, 18 bp, Homo sapiens
gtgtgctcagagagtgag

SEQ ID NO: 7689809 - DNA, 22 bp, Homo sapiens
gtgtgctgagtgactgtcatca

SEQ ID NO: 7689810 - DNA, 22 bp, Homo sapiens
gtgtgcgctggtgcttggtcaa

SEQ ID NO: 7689811 - DNA, 22 bp, Homo sapiens
gtgtgcgcgctcataggtgtgt

SEQ ID NO: 7689812 - DNA, 22 bp, Homo sapiens
gtgtgagcatcaaagcctgtca

SEQ ID NO: 7689813 - DNA, 22 bp, Homo sapiens
gtgtgcctttcacacactggga

SEQ ID NO: 7689814 - DNA, 22 bp, Homo sapiens
gtgtgcctttcacacactggga

SEQ ID NO: 7689815 - DNA, 22 bp, Homo sapiens
gtgtgctagctgcttcacacag

SEQ ID NO: 7689816 - DNA, 22 bp, Homo sapiens
gtgtgctcaagggcaggaacct

SEQ ID NO: 7689817 - DNA, 22 bp, Homo sapiens
gtgtgcgcgcgcgtcccgggtg

SEQ ID NO: 7689818 - DNA, 17 bp, Homo sapiens
gtgtgctactatcattt

SEQ ID NO: 7689819 - DNA, 22 bp, Homo sapiens
gtgtgcgttcctagtaaacgtg

SEQ ID NO: 7689820 - DNA, 22 bp, Homo sapiens
cagctggcttgtttgttcttga

SEQ ID NO: 7689821 - DNA, 22 bp, Homo sapiens
cagctgggagctccattagata

SEQ ID NO: 7689822 - DNA, 22 bp, Homo sapiens
cagctgggagctccattagata

SEQ ID NO: 7689823 - DNA, 22 bp, Homo sapiens
cagctgggagctccattagata

SEQ ID NO: 7689824 - DNA, 22 bp, Homo sapiens
cagctggcttgtttgttcttga

SEQ ID NO: 7689825 - DNA, 22 bp, Homo sapiens
cagctggctggtcagtgcacaa

SEQ ID NO: 7689826 - DNA, 22 bp, Homo sapiens
cagctggctggtcagtgcacaa

SEQ ID NO: 7689827 - DNA, 22 bp, Homo sapiens
cagctggctggtcagtgcacaa

SEQ ID NO: 7689828 - DNA, 22 bp, Homo sapiens
cagctggctgcggtgaggggac

SEQ ID NO: 7689829 - DNA, 22 bp, Homo sapiens
cagctggctgcggtgaggggac

SEQ ID NO: 7689830 - DNA, 22 bp, Homo sapiens
gtgtggccgtgtatccatggct

SEQ ID NO: 7689831 - DNA, 22 bp, Homo sapiens
cagctggctgcggtgaggggac

SEQ ID NO: 7689832 - DNA, 22 bp, Homo sapiens
cagctggctgcggtgaggggac

SEQ ID NO: 7689833 - DNA, 22 bp, Homo sapiens
gtgtggcctcaacgggatgcaa

SEQ ID NO: 7689834 - DNA, 22 bp, Homo sapiens
gtgtggccgtgtatccatggct

SEQ ID NO: 7689835 - DNA, 22 bp, Homo sapiens
gtgtggaatggagtttttgccc

SEQ ID NO: 7689836 - DNA, 21 bp, Homo sapiens
gtgtggatatgtgacaggtgg

SEQ ID NO: 7689837 - DNA, 22 bp, Homo sapiens
gtgtggcaaggtgagaagtggg

SEQ ID NO: 7689838 - DNA, 19 bp, Homo sapiens
gtgtggcagagagtgacca

SEQ ID NO: 7689839 - DNA, 19 bp, Homo sapiens
gtgtggcagagagtgacca

SEQ ID NO: 7689840 - DNA, 19 bp, Homo sapiens
gtgtggcagagagtgacca

SEQ ID NO: 7689841 - DNA, 19 bp, Homo sapiens
gtgtggcagagagtgacca

SEQ ID NO: 7689842 - DNA, 22 bp, Homo sapiens
gtgtggcacctcctttccagct

SEQ ID NO: 7689843 - DNA, 23 bp, Homo sapiens
gtgtggcagcgctgtggttagct

SEQ ID NO: 7689844 - DNA, 22 bp, Homo sapiens
gtgtggcagggcgtttgcagac

SEQ ID NO: 7689845 - DNA, 22 bp, Homo sapiens
gtgtggccaattatgggcattc

SEQ ID NO: 7689846 - DNA, 22 bp, Homo sapiens
gtgtggccaattatgggcattc

SEQ ID NO: 7689847 - DNA, 22 bp, Homo sapiens
gtgtggccctgcgtcctgagtc

SEQ ID NO: 7689848 - DNA, 22 bp, Homo sapiens
gtgtggccctgcgtcctgagtc

SEQ ID NO: 7689849 - DNA, 22 bp, Homo sapiens
gtgtggccctgcgtcctgagtc

SEQ ID NO: 7689850 - DNA, 22 bp, Homo sapiens
cagctgggcctcctgagccctg

SEQ ID NO: 7689851 - DNA, 22 bp, Homo sapiens
cagctgggagctccattagata

SEQ ID NO: 7689852 - DNA, 22 bp, Homo sapiens
cagctgggcctcctgagccctg

SEQ ID NO: 7689853 - DNA, 22 bp, Homo sapiens
cagctgggcctcctgagccctg

SEQ ID NO: 7689854 - DNA, 22 bp, Homo sapiens
cagctgggcctcctgagccctg

SEQ ID NO: 7689855 - DNA, 22 bp, Homo sapiens
cagctgggcctcctgagccctg

SEQ ID NO: 7689856 - DNA, 22 bp, Homo sapiens
cagctgggcctcctgagccctg

SEQ ID NO: 7689857 - DNA, 22 bp, Homo sapiens
cagctgggcctcctgagccctg

SEQ ID NO: 7689858 - DNA, 22 bp, Homo sapiens
cagctgggcctcctgagccctg

SEQ ID NO: 7689859 - DNA, 22 bp, Homo sapiens
cagctgggcctcctgagccctg

SEQ ID NO: 7689860 - DNA, 22 bp, Homo sapiens
cagctggggagagacatggcag

SEQ ID NO: 7689861 - DNA, 22 bp, Homo sapiens
cagctgggctaagagtagaggc

SEQ ID NO: 7689862 - DNA, 22 bp, Homo sapiens
cagctggggagagacatggcag

SEQ ID NO: 7689863 - DNA, 22 bp, Homo sapiens
cagctgggctaagagtagaggc

SEQ ID NO: 7689864 - DNA, 22 bp, Homo sapiens
cagctgggctaagagtagaggc

SEQ ID NO: 7689865 - DNA, 22 bp, Homo sapiens
cagctgggctaagagtagaggc

SEQ ID NO: 7689866 - DNA, 22 bp, Homo sapiens
cagctgggctaagagtagaggc

SEQ ID NO: 7689867 - DNA, 22 bp, Homo sapiens
cagctgggtgatcttgggcagg

SEQ ID NO: 7689868 - DNA, 22 bp, Homo sapiens
cagctggggcagccacgtgcgg

SEQ ID NO: 7689869 - DNA, 22 bp, Homo sapiens
cagctgggtgatcttgggcagg

SEQ ID NO: 7689870 - DNA, 22 bp, Homo sapiens
cagctgggtgatcttgggcagg

SEQ ID NO: 7689871 - DNA, 22 bp, Homo sapiens
cagctgggtgatcttgggcagg

SEQ ID NO: 7689872 - DNA, 22 bp, Homo sapiens
cagctggggcagccacgtgcgg

SEQ ID NO: 7689873 - DNA, 22 bp, Homo sapiens
cagctggggcagccacgtgcgg

SEQ ID NO: 7689874 - DNA, 22 bp, Homo sapiens
cagctggggcagccacgtgcgg

SEQ ID NO: 7689875 - DNA, 22 bp, Homo sapiens
cagctggggagagacatggcag

SEQ ID NO: 7689876 - DNA, 22 bp, Homo sapiens
cagctggggagagacatggcag

SEQ ID NO: 7689877 - DNA, 22 bp, Homo sapiens
cagctggggcagccacgtgcgg

SEQ ID NO: 7689878 - DNA, 22 bp, Homo sapiens
cagctggggcagccacgtgcgg

SEQ ID NO: 7689879 - DNA, 22 bp, Homo sapiens
cagctggggcagccacgtgcgg

SEQ ID NO: 7689880 - DNA, 22 bp, Homo sapiens
cagctggggcagccacgtgcgg

SEQ ID NO: 7689881 - DNA, 22 bp, Homo sapiens
cagctggggcagccacgtgcgg

SEQ ID NO: 7689882 - DNA, 22 bp, Homo sapiens
cagctgtctggggagtgctcgc

SEQ ID NO: 7689883 - DNA, 22 bp, Homo sapiens
cagctgtctggggagtgctcgc

SEQ ID NO: 7689884 - DNA, 22 bp, Homo sapiens
cagctgtctggggagtgctcgc

SEQ ID NO: 7689885 - DNA, 22 bp, Homo sapiens
cagctgtctttgcacagtttag

SEQ ID NO: 7689886 - DNA, 22 bp, Homo sapiens
cagctgtctttgcacagtttag

SEQ ID NO: 7689887 - DNA, 22 bp, Homo sapiens
cagctgtcttttctaaatatta

SEQ ID NO: 7689888 - DNA, 22 bp, Homo sapiens
cagctgtctgctgaaggaagct

SEQ ID NO: 7689889 - DNA, 22 bp, Homo sapiens
cagctgtctgctgaaggaagct

SEQ ID NO: 7689890 - DNA, 22 bp, Homo sapiens
cagctgtctgctgaaggaagct

SEQ ID NO: 7689891 - DNA, 22 bp, Homo sapiens
cagctgtctgaagcaggagtcc

SEQ ID NO: 7689892 - DNA, 22 bp, Homo sapiens
cagctgtctgaagcaggagtcc

SEQ ID NO: 7689893 - DNA, 22 bp, Homo sapiens
cagctgtctgaagcaggagtcc

SEQ ID NO: 7689894 - DNA, 22 bp, Homo sapiens
cagctgtctaagttgagcagga

SEQ ID NO: 7689895 - DNA, 22 bp, Homo sapiens
cagctgtctaagttgagcagga

SEQ ID NO: 7689896 - DNA, 22 bp, Homo sapiens
cagctgtctcagggaggtgatc

SEQ ID NO: 7689897 - DNA, 22 bp, Homo sapiens
cagctgtctcagggaggtgatc

SEQ ID NO: 7689898 - DNA, 22 bp, Homo sapiens
cagctgtctcagggaggtgatc

SEQ ID NO: 7689899 - DNA, 22 bp, Homo sapiens
cagctgtctcagggaggtgatc

SEQ ID NO: 7689900 - DNA, 22 bp, Homo sapiens
cagctgtctgaagcaggagtcc

SEQ ID NO: 7689901 - DNA, 22 bp, Homo sapiens
cagctgtctgaagcaggagtcc

SEQ ID NO: 7689902 - DNA, 22 bp, Homo sapiens
cagctgggtgatcttgggcagg

SEQ ID NO: 7689903 - DNA, 17 bp, Homo sapiens
cagctgtgagagcctta

SEQ ID NO: 7689904 - DNA, 22 bp, Homo sapiens
cagctgtgacagccagttgatg

SEQ ID NO: 7689905 - DNA, 17 bp, Homo sapiens
cagctgtgagagcctta

SEQ ID NO: 7689906 - DNA, 22 bp, Homo sapiens
cagctgtgacagccagttgatg

SEQ ID NO: 7689907 - DNA, 22 bp, Homo sapiens
cagctgtgaattgtcttatcta

SEQ ID NO: 7689908 - DNA, 22 bp, Homo sapiens
cagctgtgagcagccagttgcc

SEQ ID NO: 7689909 - DNA, 22 bp, Homo sapiens
cagctgtgagcagccagttgcc

SEQ ID NO: 7689910 - DNA, 22 bp, Homo sapiens
cagctgtgagcagccagttgcc

SEQ ID NO: 7689911 - DNA, 22 bp, Homo sapiens
cagctgtgagagtgcattgaag

SEQ ID NO: 7689912 - DNA, 22 bp, Homo sapiens
cagctgtgagagtgcattgaag

SEQ ID NO: 7689913 - DNA, 17 bp, Homo sapiens
cagctgtgagagcctta

SEQ ID NO: 7689914 - DNA, 17 bp, Homo sapiens
cagctgtgagagcctta

SEQ ID NO: 7689915 - DNA, 22 bp, Homo sapiens
cagctgcctgcaacacaagctt

SEQ ID NO: 7689916 - DNA, 20 bp, Homo sapiens
cagctgcctggctctgggat

SEQ ID NO: 7689917 - DNA, 22 bp, Homo sapiens
cagctgcctgcaacacaagctt

SEQ ID NO: 7689918 - DNA, 22 bp, Homo sapiens
cagctgcctgcaacacaagctt

SEQ ID NO: 7689919 - DNA, 22 bp, Homo sapiens
cagctgcctgcaacacaagctt

SEQ ID NO: 7689920 - DNA, 22 bp, Homo sapiens
cagctgcctgcaacacaagctt

SEQ ID NO: 7689921 - DNA, 22 bp, Homo sapiens
cagctgcctgcaacacaagctt

SEQ ID NO: 7689922 - DNA, 22 bp, Homo sapiens
cagctgcctatgacctagcctc

SEQ ID NO: 7689923 - DNA, 20 bp, Homo sapiens
cagctgcctggctctgggat

SEQ ID NO: 7689924 - DNA, 20 bp, Homo sapiens
cagctgcctggctctgggat

SEQ ID NO: 7689925 - DNA, 20 bp, Homo sapiens
cagctgcctggctctgggat

SEQ ID NO: 7689926 - DNA, 22 bp, Homo sapiens
cagctgcctgtattgtcctcat

SEQ ID NO: 7689927 - DNA, 22 bp, Homo sapiens
cagctgcctgtattgtcctcat

SEQ ID NO: 7689928 - DNA, 22 bp, Homo sapiens
cagctgcctgtattgtcctcat

SEQ ID NO: 7689929 - DNA, 22 bp, Homo sapiens
cagctgcctgtattgtcctcat

SEQ ID NO: 7689930 - DNA, 22 bp, Homo sapiens
cagctgcctgtattgtcctcat

SEQ ID NO: 7689931 - DNA, 22 bp, Homo sapiens
cagctgcctgtattgtcctcat

SEQ ID NO: 7689932 - DNA, 22 bp, Homo sapiens
cagctgcctatgacctagcctc

SEQ ID NO: 7689933 - DNA, 22 bp, Homo sapiens
cagctgcctatgacctagcctc

SEQ ID NO: 7689934 - DNA, 22 bp, Homo sapiens
cagctgcctatgacctagcctc

SEQ ID NO: 7689935 - DNA, 22 bp, Homo sapiens
cagctgcctatgacctagcctc

SEQ ID NO: 7689936 - DNA, 22 bp, Homo sapiens
cagctgcctatgacctagcctc

SEQ ID NO: 7689937 - DNA, 22 bp, Homo sapiens
cagctgcctatgacctagcctc

SEQ ID NO: 7689938 - DNA, 22 bp, Homo sapiens
cagctgcctatgacctagcctc

SEQ ID NO: 7689939 - DNA, 22 bp, Homo sapiens
cagctgcccctccagggctggg

SEQ ID NO: 7689940 - DNA, 22 bp, Homo sapiens
cagctgcctatgacctagcctc

SEQ ID NO: 7689941 - DNA, 22 bp, Homo sapiens
cagctgcccctccagggctggg

SEQ ID NO: 7689942 - DNA, 22 bp, Homo sapiens
cagctgcccctccagggctggg

SEQ ID NO: 7689943 - DNA, 22 bp, Homo sapiens
cagctgccacttgctctcggct

SEQ ID NO: 7689944 - DNA, 22 bp, Homo sapiens
cagctgccctgccttgccctta

SEQ ID NO: 7689945 - DNA, 22 bp, Homo sapiens
cagctgccctgccttgccctta

SEQ ID NO: 7689946 - DNA, 22 bp, Homo sapiens
cagctgccctgccttgccctta

SEQ ID NO: 7689947 - DNA, 22 bp, Homo sapiens
cagctgcccctccagggctggg

SEQ ID NO: 7689948 - DNA, 22 bp, Homo sapiens
cagctgcaggagctgagcactt

SEQ ID NO: 7689949 - DNA, 18 bp, Homo sapiens
cagctgcaggctcaggac

SEQ ID NO: 7689950 - DNA, 18 bp, Homo sapiens
cagctgcaggctcaggac

SEQ ID NO: 7689951 - DNA, 18 bp, Homo sapiens
cagctgcaggctcaggac

SEQ ID NO: 7689952 - DNA, 18 bp, Homo sapiens
cagctgcaggctcaggac

SEQ ID NO: 7689953 - DNA, 18 bp, Homo sapiens
cagctgcaggctcaggac

SEQ ID NO: 7689954 - DNA, 18 bp, Homo sapiens
cagctgcaggctcaggac

SEQ ID NO: 7689955 - DNA, 18 bp, Homo sapiens
cagctgcaggctcaggac

SEQ ID NO: 7689956 - DNA, 22 bp, Homo sapiens
cagctgcaggctgtgcaggaag

SEQ ID NO: 7689957 - DNA, 22 bp, Homo sapiens
cagctgcaggctgtgcaggaag

SEQ ID NO: 7689958 - DNA, 22 bp, Homo sapiens
cagctgcaggctgtgcaggaag

SEQ ID NO: 7689959 - DNA, 22 bp, Homo sapiens
cagctgcagtgggggaccacaa

SEQ ID NO: 7689960 - DNA, 22 bp, Homo sapiens
cagctgcagtcatcttctagaa

SEQ ID NO: 7689961 - DNA, 22 bp, Homo sapiens
cagctgcagtgggggaccacaa

SEQ ID NO: 7689962 - DNA, 22 bp, Homo sapiens
cagctgcagtgggggaccacaa

SEQ ID NO: 7689963 - DNA, 22 bp, Homo sapiens
cagctgcagtcatcttctagaa

SEQ ID NO: 7689964 - DNA, 22 bp, Homo sapiens
cagctgcagtcatcttctagaa

SEQ ID NO: 7689965 - DNA, 22 bp, Homo sapiens
cagctgcaggctgtgcaggaag

SEQ ID NO: 7689966 - DNA, 22 bp, Homo sapiens
cagctgcagtgggggaccacaa

SEQ ID NO: 7689967 - DNA, 22 bp, Homo sapiens
cagctgcagttcaatgcttgct

SEQ ID NO: 7689968 - DNA, 22 bp, Homo sapiens
cagctgcagttcaatgcttgct

SEQ ID NO: 7689969 - DNA, 22 bp, Homo sapiens
cagctgcagttcaatgcttgct

SEQ ID NO: 7689970 - DNA, 22 bp, Homo sapiens
cagctgcatgtctgtggtggtc

SEQ ID NO: 7689971 - DNA, 22 bp, Homo sapiens
cagctgcagttcaatgcttgct

SEQ ID NO: 7689972 - DNA, 22 bp, Homo sapiens
cagctgcatgtctgtggtggtc

SEQ ID NO: 7689973 - DNA, 22 bp, Homo sapiens
cagctgcattaattttagtgaa

SEQ ID NO: 7689974 - DNA, 22 bp, Homo sapiens
cagctgcattaattttagtgaa

SEQ ID NO: 7689975 - DNA, 22 bp, Homo sapiens
cagctgcatgtctgtggtggtc

SEQ ID NO: 7689976 - DNA, 22 bp, Homo sapiens
cagctgcattaattttagtgaa

SEQ ID NO: 7689977 - DNA, 22 bp, Homo sapiens
cagctgcattaattttagtgaa

SEQ ID NO: 7689978 - DNA, 22 bp, Homo sapiens
cagctgccaagaatcttttcta

SEQ ID NO: 7689979 - DNA, 22 bp, Homo sapiens
cagctgccaagaatcttttcta

SEQ ID NO: 7689980 - DNA, 22 bp, Homo sapiens
cagctgccacacctctttctct

SEQ ID NO: 7689981 - DNA, 22 bp, Homo sapiens
cagctgccacacctctttctct

SEQ ID NO: 7689982 - DNA, 22 bp, Homo sapiens
cagctgccacacctctttctct

SEQ ID NO: 7689983 - DNA, 22 bp, Homo sapiens
cagctgccacaggactttctga

SEQ ID NO: 7689984 - DNA, 22 bp, Homo sapiens
cagctgccacttgctctcggct

SEQ ID NO: 7689985 - DNA, 22 bp, Homo sapiens
cagctgccacttgctctcggct

SEQ ID NO: 7689986 - DNA, 22 bp, Homo sapiens
cagctgccacttgctctcggct

SEQ ID NO: 7689987 - DNA, 22 bp, Homo sapiens
cagctgcactgaagcaggtttg

SEQ ID NO: 7689988 - DNA, 22 bp, Homo sapiens
cagctgcactgaagcaggtttg

SEQ ID NO: 7689989 - DNA, 22 bp, Homo sapiens
cagctgcactgaagcaggtttg

SEQ ID NO: 7689990 - DNA, 22 bp, Homo sapiens
cagctgcactgaagcaggtttg

SEQ ID NO: 7689991 - DNA, 22 bp, Homo sapiens
cagctgcagaaagcaagcaggt

SEQ ID NO: 7689992 - DNA, 22 bp, Homo sapiens
cagctgcagaaagcaagcaggt

SEQ ID NO: 7689993 - DNA, 22 bp, Homo sapiens
cagctgcagaaagcaagcaggt

SEQ ID NO: 7689994 - DNA, 22 bp, Homo sapiens
cagctgcagaaagcaagcaggt

SEQ ID NO: 7689995 - DNA, 22 bp, Homo sapiens
cagctgcagaaagcaagcaggt

SEQ ID NO: 7689996 - DNA, 22 bp, Homo sapiens
cagctgcagatcatgtttacag

SEQ ID NO: 7689997 - DNA, 22 bp, Homo sapiens
cagctgcagatcatgtttacag

SEQ ID NO: 7689998 - DNA, 22 bp, Homo sapiens
cagctgcagaaagcaagcaggt

SEQ ID NO: 7689999 - DNA, 22 bp, Homo sapiens
cagctgcagaaagcaagcaggt

SEQ ID NO: 7690000 - DNA, 22 bp, Homo sapiens
cagctgcaggagaaacagaggc

SEQ ID NO: 7690001 - DNA, 22 bp, Homo sapiens
cagctgcaggagaaacagaggc

SEQ ID NO: 7690002 - DNA, 22 bp, Homo sapiens
cagctgcaggagaaacagaggc

SEQ ID NO: 7690003 - DNA, 22 bp, Homo sapiens
cagctgcaggaacaaaaatgtg

SEQ ID NO: 7690004 - DNA, 22 bp, Homo sapiens
cagctgcaggaacaaaaatgtg

SEQ ID NO: 7690005 - DNA, 22 bp, Homo sapiens
cagctgcaggagctgagcactt

SEQ ID NO: 7690006 - DNA, 22 bp, Homo sapiens
cagctgcaggagctgagcactt

SEQ ID NO: 7690007 - DNA, 22 bp, Homo sapiens
cagctgcaggagctgagcactt

SEQ ID NO: 7690008 - DNA, 22 bp, Homo sapiens
cagctgcaggagctgagcactt

SEQ ID NO: 7690009 - DNA, 22 bp, Homo sapiens
cagctgcaggagaaacagaggc

SEQ ID NO: 7690010 - DNA, 22 bp, Homo sapiens
cagctgcaggagaaacagaggc

SEQ ID NO: 7690011 - DNA, 22 bp, Homo sapiens
gtggggctgagtggagccagaa

SEQ ID NO: 7690012 - DNA, 22 bp, Homo sapiens
gtggggctgagtggagccagaa

SEQ ID NO: 7690013 - DNA, 22 bp, Homo sapiens
gtggggctgagtggagccagaa

SEQ ID NO: 7690014 - DNA, 22 bp, Homo sapiens
gtggggctgagtggagccagaa

SEQ ID NO: 7690015 - DNA, 22 bp, Homo sapiens
gtggggctgagtggagccagaa

SEQ ID NO: 7690016 - DNA, 22 bp, Homo sapiens
gtggggctgagtggagccagaa

SEQ ID NO: 7690017 - DNA, 22 bp, Homo sapiens
gtggggctgcttaggctgcgca

SEQ ID NO: 7690018 - DNA, 22 bp, Homo sapiens
gtggggctgagtggagccagaa

SEQ ID NO: 7690019 - DNA, 22 bp, Homo sapiens
gtggggctgcttaggctgcgca

SEQ ID NO: 7690020 - DNA, 22 bp, Homo sapiens
gtggggctgcttaggctgcgca

SEQ ID NO: 7690021 - DNA, 22 bp, Homo sapiens
gtggggctgcttaggctgcgca

SEQ ID NO: 7690022 - DNA, 22 bp, Homo sapiens
gtggggctgcttaggctgcgca

SEQ ID NO: 7690023 - DNA, 22 bp, Homo sapiens
gtggggctgcttaggctgcgca

SEQ ID NO: 7690024 - DNA, 22 bp, Homo sapiens
gtggggctgcttaggctgcgca

SEQ ID NO: 7690025 - DNA, 22 bp, Homo sapiens
gtggggctggaagatgggtact

SEQ ID NO: 7690026 - DNA, 22 bp, Homo sapiens
gtggggctggaagatgggtact

SEQ ID NO: 7690027 - DNA, 22 bp, Homo sapiens
gtggggctggaagatgggtact

SEQ ID NO: 7690028 - DNA, 22 bp, Homo sapiens
cagctgatggttttgctgagac

SEQ ID NO: 7690029 - DNA, 22 bp, Homo sapiens
cagctgatggttttgctgagac

SEQ ID NO: 7690030 - DNA, 22 bp, Homo sapiens
cagctgatggttttgctgagac

SEQ ID NO: 7690031 - DNA, 22 bp, Homo sapiens
cagctgatttgagaaagaatga

SEQ ID NO: 7690032 - DNA, 22 bp, Homo sapiens
cagctgcaatcagaagctaagg

SEQ ID NO: 7690033 - DNA, 19 bp, Homo sapiens
cagctgcaccgtgaccatc

SEQ ID NO: 7690034 - DNA, 22 bp, Homo sapiens
cagctgcactgaagcaggtttg

SEQ ID NO: 7690035 - DNA, 19 bp, Homo sapiens
cagctgcaccgtgaccatc

SEQ ID NO: 7690036 - DNA, 19 bp, Homo sapiens
cagctgcaccgtgaccatc

SEQ ID NO: 7690037 - DNA, 19 bp, Homo sapiens
cagctgcaccgtgaccatc

SEQ ID NO: 7690038 - DNA, 22 bp, Homo sapiens
gtggggagggagatgctgaagt

SEQ ID NO: 7690039 - DNA, 22 bp, Homo sapiens
gtggggagtgttctgtgattgg

SEQ ID NO: 7690040 - DNA, 22 bp, Homo sapiens
gtggggagggagatgctgaagt

SEQ ID NO: 7690041 - DNA, 22 bp, Homo sapiens
gtggggagggagatgctgaagt

SEQ ID NO: 7690042 - DNA, 22 bp, Homo sapiens
gtggggagggagatgctgaagt

SEQ ID NO: 7690043 - DNA, 22 bp, Homo sapiens
gtggggagtgttctgtgattgg

SEQ ID NO: 7690044 - DNA, 22 bp, Homo sapiens
gtggggagtgttctgtgattgg

SEQ ID NO: 7690045 - DNA, 22 bp, Homo sapiens
gtggggagtgttctgtgattgg

SEQ ID NO: 7690046 - DNA, 22 bp, Homo sapiens
gtggggagtgttctgtgattgg

SEQ ID NO: 7690047 - DNA, 22 bp, Homo sapiens
gtggggcagtggcctgggagca

SEQ ID NO: 7690048 - DNA, 22 bp, Homo sapiens
gtggggcagtggcctgggagca

SEQ ID NO: 7690049 - DNA, 22 bp, Homo sapiens
gtggggcagtggcctgggagca

SEQ ID NO: 7690050 - DNA, 22 bp, Homo sapiens
gtggggatcactggggacaatc

SEQ ID NO: 7690051 - DNA, 22 bp, Homo sapiens
gtggggagtgttctgtgattgg

SEQ ID NO: 7690052 - DNA, 22 bp, Homo sapiens
gtggggcagtggcctgggagca

SEQ ID NO: 7690053 - DNA, 22 bp, Homo sapiens
gtggggcagtggcctgggagca

SEQ ID NO: 7690054 - DNA, 22 bp, Homo sapiens
gtggggcagtggcctgggagca

SEQ ID NO: 7690055 - DNA, 22 bp, Homo sapiens
gtggggcagtggcctgggagca

SEQ ID NO: 7690056 - DNA, 22 bp, Homo sapiens
gtggggctcccatctcctggct

SEQ ID NO: 7690057 - DNA, 22 bp, Homo sapiens
gtggggctcccatctcctggct

SEQ ID NO: 7690058 - DNA, 22 bp, Homo sapiens
gtggggctcccatctcctggct

SEQ ID NO: 7690059 - DNA, 22 bp, Homo sapiens
gtggggctaaaaactgtgcagt

SEQ ID NO: 7690060 - DNA, 22 bp, Homo sapiens
gtggggcggcagatgctccctg

SEQ ID NO: 7690061 - DNA, 22 bp, Homo sapiens
gtggggctaaaaactgtgcagt

SEQ ID NO: 7690062 - DNA, 22 bp, Homo sapiens
gtggggctaaaaactgtgcagt

SEQ ID NO: 7690063 - DNA, 22 bp, Homo sapiens
gtggggctaaaaactgtgcagt

SEQ ID NO: 7690064 - DNA, 22 bp, Homo sapiens
gtggggctaaaaactgtgcagt

SEQ ID NO: 7690065 - DNA, 22 bp, Homo sapiens
gtggggcatgcacgctgctcct

SEQ ID NO: 7690066 - DNA, 22 bp, Homo sapiens
gtggggcctgtggcttccgtgg

SEQ ID NO: 7690067 - DNA, 22 bp, Homo sapiens
gtggggcatgcacgctgctcct

SEQ ID NO: 7690068 - DNA, 22 bp, Homo sapiens
gtggggcatgcacgctgctcct

SEQ ID NO: 7690069 - DNA, 22 bp, Homo sapiens
gtggggcatgcacgctgctcct

SEQ ID NO: 7690070 - DNA, 22 bp, Homo sapiens
gtggggcagtggcctgggagca

SEQ ID NO: 7690071 - DNA, 22 bp, Homo sapiens
cagctgcttctcctccagagct

SEQ ID NO: 7690072 - DNA, 22 bp, Homo sapiens
cagctgcttctcctccagagct

SEQ ID NO: 7690073 - DNA, 22 bp, Homo sapiens
cagctgcttctcctccagagct

SEQ ID NO: 7690074 - DNA, 22 bp, Homo sapiens
cagctgcttctcctccagagct

SEQ ID NO: 7690075 - DNA, 22 bp, Homo sapiens
cagctgcttctcctccagagct

SEQ ID NO: 7690076 - DNA, 22 bp, Homo sapiens
cagctgcttctcctccagagct

SEQ ID NO: 7690077 - DNA, 22 bp, Homo sapiens
cagctgcttactagctgtgtga

SEQ ID NO: 7690078 - DNA, 22 bp, Homo sapiens
cagctgctttagttttccatcc

SEQ ID NO: 7690079 - DNA, 22 bp, Homo sapiens
cagctgctttagttttccatcc

SEQ ID NO: 7690080 - DNA, 22 bp, Homo sapiens
cagctggccaatcagggcgccc

SEQ ID NO: 7690081 - DNA, 22 bp, Homo sapiens
cagctggccaatcagggcgccc

SEQ ID NO: 7690082 - DNA, 22 bp, Homo sapiens
cagctggccaatcagggcgccc

SEQ ID NO: 7690083 - DNA, 22 bp, Homo sapiens
cagctgcttactagctgtgtga

SEQ ID NO: 7690084 - DNA, 22 bp, Homo sapiens
cagctgcttactagctgtgtga

SEQ ID NO: 7690085 - DNA, 22 bp, Homo sapiens
cagctgctgttcagttttgttt

SEQ ID NO: 7690086 - DNA, 22 bp, Homo sapiens
cagctgcttactagctgtgtga

SEQ ID NO: 7690087 - DNA, 22 bp, Homo sapiens
cagctgcttactagctgtgtga

SEQ ID NO: 7690088 - DNA, 22 bp, Homo sapiens
cagctgctgttcagttttgttt

SEQ ID NO: 7690089 - DNA, 22 bp, Homo sapiens
cagctgctgttcagttttgttt

SEQ ID NO: 7690090 - DNA, 22 bp, Homo sapiens
cagctgctgttactgcttatta

SEQ ID NO: 7690091 - DNA, 22 bp, Homo sapiens
cagctgctgttactgcttatta

SEQ ID NO: 7690092 - DNA, 22 bp, Homo sapiens
cagctgctgttactgcttatta

SEQ ID NO: 7690093 - DNA, 22 bp, Homo sapiens
cagctgctgttcagttttgttt

SEQ ID NO: 7690094 - DNA, 22 bp, Homo sapiens
cagctgctgttactgcttatta

SEQ ID NO: 7690095 - DNA, 22 bp, Homo sapiens
cagctgctgttcagttttgttt

SEQ ID NO: 7690096 - DNA, 22 bp, Homo sapiens
cagctgctgttcagttttgttt

SEQ ID NO: 7690097 - DNA, 22 bp, Homo sapiens
cagctgctgttcagttttgttt

SEQ ID NO: 7690098 - DNA, 22 bp, Homo sapiens
cagctgctgttcagttttgttt

SEQ ID NO: 7690099 - DNA, 22 bp, Homo sapiens
cagctgctgttcagttttgttt

SEQ ID NO: 7690100 - DNA, 22 bp, Homo sapiens
cagctgctgttcagttttgttt

SEQ ID NO: 7690101 - DNA, 22 bp, Homo sapiens
cagctgctgcccttggctgcag

SEQ ID NO: 7690102 - DNA, 22 bp, Homo sapiens
cagctgctgcccttggctgcag

SEQ ID NO: 7690103 - DNA, 22 bp, Homo sapiens
cagctgctgcctcatccacttt

SEQ ID NO: 7690104 - DNA, 22 bp, Homo sapiens
cagctgctgcctcatccacttt

SEQ ID NO: 7690105 - DNA, 22 bp, Homo sapiens
cagctgctgcctcatccacttt

SEQ ID NO: 7690106 - DNA, 22 bp, Homo sapiens
cagctgctggctccgggctaag

SEQ ID NO: 7690107 - DNA, 22 bp, Homo sapiens
cagctgctggctccgggctaag

SEQ ID NO: 7690108 - DNA, 22 bp, Homo sapiens
cagctgctgcctcatccacttt

SEQ ID NO: 7690109 - DNA, 22 bp, Homo sapiens
cagctgctgtaacagaatactt

SEQ ID NO: 7690110 - DNA, 22 bp, Homo sapiens
cagctgctgtaacagaatactt

SEQ ID NO: 7690111 - DNA, 22 bp, Homo sapiens
cagctgctgtaacagaatactt

SEQ ID NO: 7690112 - DNA, 22 bp, Homo sapiens
cagctgctgatggcctgacaga

SEQ ID NO: 7690113 - DNA, 22 bp, Homo sapiens
cagctgctgcccttggctgcag

SEQ ID NO: 7690114 - DNA, 22 bp, Homo sapiens
cagctgctgcccttggctgcag

SEQ ID NO: 7690115 - DNA, 22 bp, Homo sapiens
cagctgctgcccttggctgcag

SEQ ID NO: 7690116 - DNA, 22 bp, Homo sapiens
cagctgctgcccttggctgcag

SEQ ID NO: 7690117 - DNA, 22 bp, Homo sapiens
cagctgctgatggcctgacaga

SEQ ID NO: 7690118 - DNA, 22 bp, Homo sapiens
cagctgctgatggcctgacaga

SEQ ID NO: 7690119 - DNA, 22 bp, Homo sapiens
cagctgctgatggcctgacaga

SEQ ID NO: 7690120 - DNA, 22 bp, Homo sapiens
cagctgctgatggcctgacaga

SEQ ID NO: 7690121 - DNA, 22 bp, Homo sapiens
cagctgctgaggaaggggttgg

SEQ ID NO: 7690122 - DNA, 22 bp, Homo sapiens
cagctgctgagaagcctccctt

SEQ ID NO: 7690123 - DNA, 22 bp, Homo sapiens
cagctgctgagaagcctccctt

SEQ ID NO: 7690124 - DNA, 22 bp, Homo sapiens
cagctgctgaggaaggggttgg

SEQ ID NO: 7690125 - DNA, 22 bp, Homo sapiens
cagctgctgaggaaggggttgg

SEQ ID NO: 7690126 - DNA, 22 bp, Homo sapiens
cagctgctgagaagcctccctt

SEQ ID NO: 7690127 - DNA, 22 bp, Homo sapiens
cagctgctcttctggcctgtca

SEQ ID NO: 7690128 - DNA, 22 bp, Homo sapiens
cagctgctcttctggcctgtca

SEQ ID NO: 7690129 - DNA, 22 bp, Homo sapiens
cagctgctcttctggcctgtca

SEQ ID NO: 7690130 - DNA, 22 bp, Homo sapiens
cagctgctctggtggtctctcc

SEQ ID NO: 7690131 - DNA, 22 bp, Homo sapiens
cagctgctcttctggcctgtca

SEQ ID NO: 7690132 - DNA, 22 bp, Homo sapiens
cagctgctcttctggcctgtca

SEQ ID NO: 7690133 - DNA, 22 bp, Homo sapiens
cagctgctctggtggtctctcc

SEQ ID NO: 7690134 - DNA, 22 bp, Homo sapiens
cagctgcctgtattgtcctcat

SEQ ID NO: 7690135 - DNA, 22 bp, Homo sapiens
cagctgcctgtattgtcctcat

SEQ ID NO: 7690136 - DNA, 22 bp, Homo sapiens
cagctgcctgtattgtcctcat

SEQ ID NO: 7690137 - DNA, 22 bp, Homo sapiens
cagctgcctgtctggaggcaat

SEQ ID NO: 7690138 - DNA, 22 bp, Homo sapiens
cagctgcctgtattgtcctcat

SEQ ID NO: 7690139 - DNA, 22 bp, Homo sapiens
cagctgcctgtattgtcctcat

SEQ ID NO: 7690140 - DNA, 22 bp, Homo sapiens
cagctgcctgtctggaggcaat

SEQ ID NO: 7690141 - DNA, 22 bp, Homo sapiens
cagctgcctgtctggaggcaat

SEQ ID NO: 7690142 - DNA, 22 bp, Homo sapiens
cagctgcctgtctggaggcaat

SEQ ID NO: 7690143 - DNA, 22 bp, Homo sapiens
cagctgccttctgcgggaagtc

SEQ ID NO: 7690144 - DNA, 19 bp, Homo sapiens
cagctgccttttctttgca

SEQ ID NO: 7690145 - DNA, 22 bp, Homo sapiens
cagctgccttctgcgggaagtc

SEQ ID NO: 7690146 - DNA, 19 bp, Homo sapiens
cagctgccttttctttgca

SEQ ID NO: 7690147 - DNA, 21 bp, Homo sapiens
cagctgcgtgtcctcccaccc

SEQ ID NO: 7690148 - DNA, 21 bp, Homo sapiens
cagctgcgtgtcctcccaccc

SEQ ID NO: 7690149 - DNA, 22 bp, Homo sapiens
cagctgctctggtggtctctcc

SEQ ID NO: 7690150 - DNA, 22 bp, Homo sapiens
cagctgctctggtggtctctcc

SEQ ID NO: 7690151 - DNA, 22 bp, Homo sapiens
cagctgctctggtggtctctcc

SEQ ID NO: 7690152 - DNA, 22 bp, Homo sapiens
cagctgctctggtggtctctcc

SEQ ID NO: 7690153 - DNA, 22 bp, Homo sapiens
cagctgctctggtggtctctcc

SEQ ID NO: 7690154 - DNA, 22 bp, Homo sapiens
cagctggcctgagcggtggcgg

SEQ ID NO: 7690155 - DNA, 22 bp, Homo sapiens
cagctggcctgagcggtggcgg

SEQ ID NO: 7690156 - DNA, 22 bp, Homo sapiens
cagctggcctgagcggtggcgg

SEQ ID NO: 7690157 - DNA, 22 bp, Homo sapiens
cagctggcctgagcggtggcgg

SEQ ID NO: 7690158 - DNA, 22 bp, Homo sapiens
cagctggcctgagcggtggcgg

SEQ ID NO: 7690159 - DNA, 22 bp, Homo sapiens
cagctggcctgagcggtggcgg

SEQ ID NO: 7690160 - DNA, 22 bp, Homo sapiens
cagctggcctgatccctgtggc

SEQ ID NO: 7690161 - DNA, 22 bp, Homo sapiens
cagctggcctgatccctgtggc

SEQ ID NO: 7690162 - DNA, 22 bp, Homo sapiens
cagctggcctgatccctgtggc

SEQ ID NO: 7690163 - DNA, 22 bp, Homo sapiens
cagctggcctgatccctgtggc

SEQ ID NO: 7690164 - DNA, 22 bp, Homo sapiens
cagctggccaatcagggcgccc

SEQ ID NO: 7690165 - DNA, 22 bp, Homo sapiens
cagctggccaatcagggcgccc

SEQ ID NO: 7690166 - DNA, 22 bp, Homo sapiens
cagctggccaatcagggcgccc

SEQ ID NO: 7690167 - DNA, 22 bp, Homo sapiens
cagctggccccacagtagaggc

SEQ ID NO: 7690168 - DNA, 22 bp, Homo sapiens
cagctggccccacagtagaggc

SEQ ID NO: 7690169 - DNA, 22 bp, Homo sapiens
cagctggccccacagtagaggc

SEQ ID NO: 7690170 - DNA, 22 bp, Homo sapiens
cagctggccctttggtagcctt

SEQ ID NO: 7690171 - DNA, 22 bp, Homo sapiens
cagctggccctttggtagcctt

SEQ ID NO: 7690172 - DNA, 22 bp, Homo sapiens
cagctggccctttggtagcctt

SEQ ID NO: 7690173 - DNA, 22 bp, Homo sapiens
cagctggccctttggtagcctt

SEQ ID NO: 7690174 - DNA, 22 bp, Homo sapiens
cagctggccccacagtagaggc

SEQ ID NO: 7690175 - DNA, 22 bp, Homo sapiens
cagctggcgtggagtgattgca

SEQ ID NO: 7690176 - DNA, 22 bp, Homo sapiens
cagctggcgtggagtgattgca

SEQ ID NO: 7690177 - DNA, 22 bp, Homo sapiens
cagctggctccacctctgggct

SEQ ID NO: 7690178 - DNA, 22 bp, Homo sapiens
cagctggctccacctctgggct

SEQ ID NO: 7690179 - DNA, 22 bp, Homo sapiens
cagctggctccacctctgggct

SEQ ID NO: 7690180 - DNA, 22 bp, Homo sapiens
cagctggctccacctctgggct

SEQ ID NO: 7690181 - DNA, 22 bp, Homo sapiens
cagctggctccacctctgggct

SEQ ID NO: 7690182 - DNA, 22 bp, Homo sapiens
cagctggcgtggagtgattgca

SEQ ID NO: 7690183 - DNA, 22 bp, Homo sapiens
cagctggcgtggagtgattgca

SEQ ID NO: 7690184 - DNA, 22 bp, Homo sapiens
cagctggcgcctggggaccaga

SEQ ID NO: 7690185 - DNA, 22 bp, Homo sapiens
cagctggcgcctggggaccaga

SEQ ID NO: 7690186 - DNA, 22 bp, Homo sapiens
cagctggcgggcagagccgcca

SEQ ID NO: 7690187 - DNA, 22 bp, Homo sapiens
cagctggcgggcagagccgcca

SEQ ID NO: 7690188 - DNA, 22 bp, Homo sapiens
cagctggcgggcagagccgcca

SEQ ID NO: 7690189 - DNA, 22 bp, Homo sapiens
cagctggcgggcagagccgcca

SEQ ID NO: 7690190 - DNA, 22 bp, Homo sapiens
cagctggcgcctggggaccaga

SEQ ID NO: 7690191 - DNA, 22 bp, Homo sapiens
cagctggcgcctggggaccaga

SEQ ID NO: 7690192 - DNA, 22 bp, Homo sapiens
cagctggcgcctggggaccaga

SEQ ID NO: 7690193 - DNA, 22 bp, Homo sapiens
cagctggcgactctcctcgatg

SEQ ID NO: 7690194 - DNA, 22 bp, Homo sapiens
cagctggcgactctcctcgatg

SEQ ID NO: 7690195 - DNA, 22 bp, Homo sapiens
cagctggcgactctcctcgatg

SEQ ID NO: 7690196 - DNA, 22 bp, Homo sapiens
cagctggctccacctctgggct

SEQ ID NO: 7690197 - DNA, 22 bp, Homo sapiens
cagctggctgcatgatgccaaa

SEQ ID NO: 7690198 - DNA, 22 bp, Homo sapiens
cagctggctccacctctgggct

SEQ ID NO: 7690199 - DNA, 22 bp, Homo sapiens
cagctggctccacctctgggct

SEQ ID NO: 7690200 - DNA, 22 bp, Homo sapiens
cagctggctgcatgatgccaaa

SEQ ID NO: 7690201 - DNA, 22 bp, Homo sapiens
cagctggctgcatgatgccaaa

SEQ ID NO: 7690202 - DNA, 22 bp, Homo sapiens
gtgggtggatcacctgaggtca

SEQ ID NO: 7690203 - DNA, 22 bp, Homo sapiens
gtgggtggatcacctgaggtca

SEQ ID NO: 7690204 - DNA, 22 bp, Homo sapiens
gtgggtggatcacctgaggtca

SEQ ID NO: 7690205 - DNA, 22 bp, Homo sapiens
gtgggtggatcacctgaggtca

SEQ ID NO: 7690206 - DNA, 22 bp, Homo sapiens
gtgggtggatcacctgaggtca

SEQ ID NO: 7690207 - DNA, 22 bp, Homo sapiens
gtgggtggaggcgtcgagggca

SEQ ID NO: 7690208 - DNA, 22 bp, Homo sapiens
cagctggctgcggtgaggggac

SEQ ID NO: 7690209 - DNA, 22 bp, Homo sapiens
cagctggctgcggtgaggggac

SEQ ID NO: 7690210 - DNA, 22 bp, Homo sapiens
cagctggctgcggtgaggggac

SEQ ID NO: 7690211 - DNA, 22 bp, Homo sapiens
cagctggctgcggtgaggggac

SEQ ID NO: 7690212 - DNA, 22 bp, Homo sapiens
gtgggtggatcatgaggtcagg

SEQ ID NO: 7690213 - DNA, 22 bp, Homo sapiens
gtgggtggatcatgaggtcagg

SEQ ID NO: 7690214 - DNA, 22 bp, Homo sapiens
gtgggtggatcatgaggtcagg

SEQ ID NO: 7690215 - DNA, 22 bp, Homo sapiens
gtgggtggatcatgaggtcagg

SEQ ID NO: 7690216 - DNA, 22 bp, Homo sapiens
gtgggtggatcatgaggtcagg

SEQ ID NO: 7690217 - DNA, 22 bp, Homo sapiens
gtgggtggatcatgaggtcagg

SEQ ID NO: 7690218 - DNA, 22 bp, Homo sapiens
gtgggtggatcatgaggtcagg

SEQ ID NO: 7690219 - DNA, 22 bp, Homo sapiens
gtgggtggatggctcacctcca

SEQ ID NO: 7690220 - DNA, 22 bp, Homo sapiens
gtgggtggatggctcacctcca

SEQ ID NO: 7690221 - DNA, 22 bp, Homo sapiens
gtgggtggatcatgaggtcagg

SEQ ID NO: 7690222 - DNA, 22 bp, Homo sapiens
gtgggtggatggctcacctcca

SEQ ID NO: 7690223 - DNA, 22 bp, Homo sapiens
gtgggtggatggctcacctcca

SEQ ID NO: 7690224 - DNA, 22 bp, Homo sapiens
gtgggtggatcacctgaggtca

SEQ ID NO: 7690225 - DNA, 22 bp, Homo sapiens
gtgggtggatcacctgaggtca

SEQ ID NO: 7690226 - DNA, 22 bp, Homo sapiens
gtgggtggatcacctgaggtca

SEQ ID NO: 7690227 - DNA, 22 bp, Homo sapiens
gtgggtggatcacctgaggtca

SEQ ID NO: 7690228 - DNA, 22 bp, Homo sapiens
gtgggtggatcacctgaggtca

SEQ ID NO: 7690229 - DNA, 22 bp, Homo sapiens
gtgggtggatcatgaggtcagg

SEQ ID NO: 7690230 - DNA, 22 bp, Homo sapiens
gtgggtggatcatgaggtcagg

SEQ ID NO: 7690231 - DNA, 22 bp, Homo sapiens
gtgggtggatcatgaggtcagg

SEQ ID NO: 7690232 - DNA, 22 bp, Homo sapiens
gtgggtggatcatgaggtcagg

SEQ ID NO: 7690233 - DNA, 22 bp, Homo sapiens
gtgggtggatcatgaggtcagg

SEQ ID NO: 7690234 - DNA, 22 bp, Homo sapiens
gtgggtggatcacctgaggtca

SEQ ID NO: 7690235 - DNA, 22 bp, Homo sapiens
cagctctgcttccttgtacagg

SEQ ID NO: 7690236 - DNA, 22 bp, Homo sapiens
cagctctgcttccttgtacagg

SEQ ID NO: 7690237 - DNA, 22 bp, Homo sapiens
cagctctgcttccttgtacagg

SEQ ID NO: 7690238 - DNA, 22 bp, Homo sapiens
cagctctgcttccttgtacagg

SEQ ID NO: 7690239 - DNA, 22 bp, Homo sapiens
cagctctgcttccttgtacagg

SEQ ID NO: 7690240 - DNA, 22 bp, Homo sapiens
cagctctgctggtggtgccagg

SEQ ID NO: 7690241 - DNA, 22 bp, Homo sapiens
cagctctgctggtggtgccagg

SEQ ID NO: 7690242 - DNA, 22 bp, Homo sapiens
cagctctgctggtggtgccagg

SEQ ID NO: 7690243 - DNA, 22 bp, Homo sapiens
cagctctgctggtggtgccagg

SEQ ID NO: 7690244 - DNA, 22 bp, Homo sapiens
cagctctgctggtggtgccagg

SEQ ID NO: 7690245 - DNA, 22 bp, Homo sapiens
cagctctgctggtggtgccagg

SEQ ID NO: 7690246 - DNA, 22 bp, Homo sapiens
cagctctgctggtggtgccagg

SEQ ID NO: 7690247 - DNA, 22 bp, Homo sapiens
cagctctgctggtggtgccagg

SEQ ID NO: 7690248 - DNA, 22 bp, Homo sapiens
cagctctgctggtggtgccagg

SEQ ID NO: 7690249 - DNA, 22 bp, Homo sapiens
cagctctgctggtggtgccagg

SEQ ID NO: 7690250 - DNA, 22 bp, Homo sapiens
gtggcccacacagacagcatct

SEQ ID NO: 7690251 - DNA, 22 bp, Homo sapiens
gtggccattttttcctagcaca

SEQ ID NO: 7690252 - DNA, 22 bp, Homo sapiens
cagctctgctgggaggatgcag

SEQ ID NO: 7690253 - DNA, 22 bp, Homo sapiens
cagctctggcgtcagggagcga

SEQ ID NO: 7690254 - DNA, 22 bp, Homo sapiens
cagctctggcgtcagggagcga

SEQ ID NO: 7690255 - DNA, 22 bp, Homo sapiens
cagctctggcgtcagggagcga

SEQ ID NO: 7690256 - DNA, 22 bp, Homo sapiens
cagctctggcgtcagggagcga

SEQ ID NO: 7690257 - DNA, 22 bp, Homo sapiens
cagctctggcgtcagggagcga

SEQ ID NO: 7690258 - DNA, 22 bp, Homo sapiens
cagctctggccagatctatcct

SEQ ID NO: 7690259 - DNA, 22 bp, Homo sapiens
cagctctggccagatctatcct

SEQ ID NO: 7690260 - DNA, 22 bp, Homo sapiens
cagctctggcgtcagggagcga

SEQ ID NO: 7690261 - DNA, 22 bp, Homo sapiens
cagctctggcgtcagggagcga

SEQ ID NO: 7690262 - DNA, 22 bp, Homo sapiens
cagctctggcgtcagggagcga

SEQ ID NO: 7690263 - DNA, 22 bp, Homo sapiens
cagctctgcttccttgtacagg

SEQ ID NO: 7690264 - DNA, 22 bp, Homo sapiens
cagctctgcttccttgtacagg

SEQ ID NO: 7690265 - DNA, 22 bp, Homo sapiens
cagctctggcagagcccaaccc

SEQ ID NO: 7690266 - DNA, 22 bp, Homo sapiens
cagctctggcagagcccaaccc

SEQ ID NO: 7690267 - DNA, 22 bp, Homo sapiens
cagctctggcagagcccaaccc

SEQ ID NO: 7690268 - DNA, 22 bp, Homo sapiens
cagctctggccagatctatcct

SEQ ID NO: 7690269 - DNA, 22 bp, Homo sapiens
cagctctggccagatctatcct

SEQ ID NO: 7690270 - DNA, 22 bp, Homo sapiens
cagctctggcagagcccaaccc

SEQ ID NO: 7690271 - DNA, 22 bp, Homo sapiens
cagctctggcagagcccaaccc

SEQ ID NO: 7690272 - DNA, 20 bp, Homo sapiens
cagctctgggaaagaggcca

SEQ ID NO: 7690273 - DNA, 20 bp, Homo sapiens
cagctctgggaaagaggcca

SEQ ID NO: 7690274 - DNA, 20 bp, Homo sapiens
cagctctgggaaagaggcca

SEQ ID NO: 7690275 - DNA, 20 bp, Homo sapiens
cagctctgggaaagaggcca

SEQ ID NO: 7690276 - DNA, 20 bp, Homo sapiens
cagctctgggaaagaggcca

SEQ ID NO: 7690277 - DNA, 20 bp, Homo sapiens
cagctctgggaaagaggcca

SEQ ID NO: 7690278 - DNA, 22 bp, Homo sapiens
cagctctgggagtcccacccct

SEQ ID NO: 7690279 - DNA, 22 bp, Homo sapiens
cagctctgggagtcccacccct

SEQ ID NO: 7690280 - DNA, 22 bp, Homo sapiens
cagctctgggagtcccacccct

SEQ ID NO: 7690281 - DNA, 22 bp, Homo sapiens
cagctctgggagtcccacccct

SEQ ID NO: 7690282 - DNA, 22 bp, Homo sapiens
cagctctggctttggggagctt

SEQ ID NO: 7690283 - DNA, 22 bp, Homo sapiens
cagctctggctttggggagctt

SEQ ID NO: 7690284 - DNA, 22 bp, Homo sapiens
cagctctggctttggggagctt

SEQ ID NO: 7690285 - DNA, 22 bp, Homo sapiens
cagctctggctttggggagctt

SEQ ID NO: 7690286 - DNA, 22 bp, Homo sapiens
cagctctggctttggggagctt

SEQ ID NO: 7690287 - DNA, 22 bp, Homo sapiens
cagctctggctattgaggacca

SEQ ID NO: 7690288 - DNA, 22 bp, Homo sapiens
cagctctggctattgaggacca

SEQ ID NO: 7690289 - DNA, 22 bp, Homo sapiens
cagctctggctattgaggacca

SEQ ID NO: 7690290 - DNA, 22 bp, Homo sapiens
cagctctggctattgaggacca

SEQ ID NO: 7690291 - DNA, 22 bp, Homo sapiens
cagctctggctattgaggacca

SEQ ID NO: 7690292 - DNA, 22 bp, Homo sapiens
cagctctggctattgaggacca

SEQ ID NO: 7690293 - DNA, 22 bp, Homo sapiens
cagctctgtgcaggcctgggga

SEQ ID NO: 7690294 - DNA, 22 bp, Homo sapiens
cagctctgtgcaggcctgggga

SEQ ID NO: 7690295 - DNA, 22 bp, Homo sapiens
cagctctgtgcaggcctgggga

SEQ ID NO: 7690296 - DNA, 22 bp, Homo sapiens
cagctctgtgcaggcctgggga

SEQ ID NO: 7690297 - DNA, 22 bp, Homo sapiens
cagctctgtgcaggcctgggga

SEQ ID NO: 7690298 - DNA, 22 bp, Homo sapiens
cagctctgtgggagcgtatgtg

SEQ ID NO: 7690299 - DNA, 22 bp, Homo sapiens
cagctctgtgggagcgtatgtg

SEQ ID NO: 7690300 - DNA, 22 bp, Homo sapiens
cagctctgtgtattttccccac

SEQ ID NO: 7690301 - DNA, 22 bp, Homo sapiens
cagctctgtgtattttccccac

SEQ ID NO: 7690302 - DNA, 22 bp, Homo sapiens
cagctctgtgcaggcctgggga

SEQ ID NO: 7690303 - DNA, 22 bp, Homo sapiens
cagctctgtgcaggcctgggga

SEQ ID NO: 7690304 - DNA, 22 bp, Homo sapiens
cagctctgtgcaggcctgggga

SEQ ID NO: 7690305 - DNA, 22 bp, Homo sapiens
cagctctgtgcaggcctgggga

SEQ ID NO: 7690306 - DNA, 22 bp, Homo sapiens
cagctctgtgcaggcctgggga

SEQ ID NO: 7690307 - DNA, 22 bp, Homo sapiens
cagctctgtgcaggcctgggga

SEQ ID NO: 7690308 - DNA, 22 bp, Homo sapiens
cagctctgggagtcccacccct

SEQ ID NO: 7690309 - DNA, 20 bp, Homo sapiens
cagctctgggcaggtcgagg

SEQ ID NO: 7690310 - DNA, 22 bp, Homo sapiens
cagctctgggagtcccacccct

SEQ ID NO: 7690311 - DNA, 22 bp, Homo sapiens
cagctctgggagtcccacccct

SEQ ID NO: 7690312 - DNA, 22 bp, Homo sapiens
gtggccagtcccgatgcttgtt

SEQ ID NO: 7690313 - DNA, 22 bp, Homo sapiens
gtggccagtcccgatgcttgtt

SEQ ID NO: 7690314 - DNA, 22 bp, Homo sapiens
gtggccagtcccgatgcttgtt

SEQ ID NO: 7690315 - DNA, 22 bp, Homo sapiens
gtggccaggtcagggacttgtg

SEQ ID NO: 7690316 - DNA, 22 bp, Homo sapiens
gtggccaggtcagggacttgtg

SEQ ID NO: 7690317 - DNA, 22 bp, Homo sapiens
gtggccagtcccgatgcttgtt

SEQ ID NO: 7690318 - DNA, 22 bp, Homo sapiens
gtggccagggcccacaggatga

SEQ ID NO: 7690319 - DNA, 22 bp, Homo sapiens
gtggccagggcccacaggatga

SEQ ID NO: 7690320 - DNA, 22 bp, Homo sapiens
gtggccaggtcagggacttgtg

SEQ ID NO: 7690321 - DNA, 22 bp, Homo sapiens
gtggccaggtcagggacttgtg

SEQ ID NO: 7690322 - DNA, 19 bp, Homo sapiens
gtggccagggcaggggctg

SEQ ID NO: 7690323 - DNA, 19 bp, Homo sapiens
gtggccagggcaggggctg

SEQ ID NO: 7690324 - DNA, 22 bp, Homo sapiens
gtggccagggcccacaggatga

SEQ ID NO: 7690325 - DNA, 22 bp, Homo sapiens
gtggccagggcccacaggatga

SEQ ID NO: 7690326 - DNA, 22 bp, Homo sapiens
gtggccagggcccacaggatga

SEQ ID NO: 7690327 - DNA, 22 bp, Homo sapiens
gtggccagggcccacaggatga

SEQ ID NO: 7690328 - DNA, 22 bp, Homo sapiens
gtggccatacatgtccatatta

SEQ ID NO: 7690329 - DNA, 22 bp, Homo sapiens
gtggccatataattttcttgaa

SEQ ID NO: 7690330 - DNA, 22 bp, Homo sapiens
gtggccatataattttcttgaa

SEQ ID NO: 7690331 - DNA, 22 bp, Homo sapiens
gtggccagtggtgggcgccctg

SEQ ID NO: 7690332 - DNA, 22 bp, Homo sapiens
gtggccagtggtgggcgccctg

SEQ ID NO: 7690333 - DNA, 22 bp, Homo sapiens
gtggccatgtgcttgcagggta

SEQ ID NO: 7690334 - DNA, 22 bp, Homo sapiens
gtggccatctttggccctgact

SEQ ID NO: 7690335 - DNA, 22 bp, Homo sapiens
gtggccatctttggccctgact

SEQ ID NO: 7690336 - DNA, 22 bp, Homo sapiens
gtggccatgtgcttgcagggta

SEQ ID NO: 7690337 - DNA, 22 bp, Homo sapiens
gtggccatgttgctttcctttg

SEQ ID NO: 7690338 - DNA, 22 bp, Homo sapiens
gtggccatgtgcttgcagggta

SEQ ID NO: 7690339 - DNA, 22 bp, Homo sapiens
gtggccatttggaaggcaagta

SEQ ID NO: 7690340 - DNA, 22 bp, Homo sapiens
gtggccagtgggaatgggctca

SEQ ID NO: 7690341 - DNA, 21 bp, Homo sapiens
gtggccagtgactacttattg

SEQ ID NO: 7690342 - DNA, 22 bp, Homo sapiens
gtggccagtgggaatgggctca

SEQ ID NO: 7690343 - DNA, 22 bp, Homo sapiens
gtggccagtgggaatgggctca

SEQ ID NO: 7690344 - DNA, 22 bp, Homo sapiens
gtggccagtgggaatgggctca

SEQ ID NO: 7690345 - DNA, 22 bp, Homo sapiens
gtggccagtggtgggcgccctg

SEQ ID NO: 7690346 - DNA, 22 bp, Homo sapiens
gtggccagtgggaatgggctca

SEQ ID NO: 7690347 - DNA, 22 bp, Homo sapiens
gtggcagtagacagtgcatcta

SEQ ID NO: 7690348 - DNA, 22 bp, Homo sapiens
gtggcagtagacagtgcatcta

SEQ ID NO: 7690349 - DNA, 22 bp, Homo sapiens
gtggcagtagacagtgcatcta

SEQ ID NO: 7690350 - DNA, 22 bp, Homo sapiens
gtggcaggttccgtagacagca

SEQ ID NO: 7690351 - DNA, 22 bp, Homo sapiens
gtggcagtagacagtgcatcta

SEQ ID NO: 7690352 - DNA, 22 bp, Homo sapiens
gtggcagtagacagtgcatcta

SEQ ID NO: 7690353 - DNA, 22 bp, Homo sapiens
gtggcagtagacagtgcatcta

SEQ ID NO: 7690354 - DNA, 22 bp, Homo sapiens
gtggcaggttccgtagacagca

SEQ ID NO: 7690355 - DNA, 22 bp, Homo sapiens
gtggcaggttccgtagacagca

SEQ ID NO: 7690356 - DNA, 22 bp, Homo sapiens
gtggcaggttccgtagacagca

SEQ ID NO: 7690357 - DNA, 22 bp, Homo sapiens
gtggcagtctcatctgtggctc

SEQ ID NO: 7690358 - DNA, 22 bp, Homo sapiens
gtggcagtcggaagtcaggaga

SEQ ID NO: 7690359 - DNA, 22 bp, Homo sapiens
gtggcagtctcatctgtggctc

SEQ ID NO: 7690360 - DNA, 22 bp, Homo sapiens
gtggcagtctcatctgtggctc

SEQ ID NO: 7690361 - DNA, 22 bp, Homo sapiens
gtggcagtcatcaaggacagat

SEQ ID NO: 7690362 - DNA, 22 bp, Homo sapiens
gtggcagtcggaagtcaggaga

SEQ ID NO: 7690363 - DNA, 19 bp, Homo sapiens
gtggccagggcaggggctg

SEQ ID NO: 7690364 - DNA, 19 bp, Homo sapiens
gtggccagggcaggggctg

SEQ ID NO: 7690365 - DNA, 22 bp, Homo sapiens
gtggccaggcgtccgcgcggct

SEQ ID NO: 7690366 - DNA, 19 bp, Homo sapiens
gtggccagggcaggggctg

SEQ ID NO: 7690367 - DNA, 19 bp, Homo sapiens
gtggccagggcaggggctg

SEQ ID NO: 7690368 - DNA, 19 bp, Homo sapiens
gtggccagggcaggggctg

SEQ ID NO: 7690369 - DNA, 19 bp, Homo sapiens
gtggccagggcaggggctg

SEQ ID NO: 7690370 - DNA, 22 bp, Homo sapiens
gtggcagtgaggcaggagcagt

SEQ ID NO: 7690371 - DNA, 22 bp, Homo sapiens
gtggcagtcatcaaggacagat

SEQ ID NO: 7690372 - DNA, 22 bp, Homo sapiens
gtggcagtgaggcaggagcagt

SEQ ID NO: 7690373 - DNA, 22 bp, Homo sapiens
gtggccaggccgactgccaggc

SEQ ID NO: 7690374 - DNA, 22 bp, Homo sapiens
gtggccaggccgactgccaggc

SEQ ID NO: 7690375 - DNA, 22 bp, Homo sapiens
gtggccaggcgtccgcgcggct

SEQ ID NO: 7690376 - DNA, 22 bp, Homo sapiens
gtggcagagatagaactggaat

SEQ ID NO: 7690377 - DNA, 22 bp, Homo sapiens
gtggcagagcaggagacaggac

SEQ ID NO: 7690378 - DNA, 22 bp, Homo sapiens
gtggcagagcaggagacaggac

SEQ ID NO: 7690379 - DNA, 22 bp, Homo sapiens
gtggcagagagcaagtgtctga

SEQ ID NO: 7690380 - DNA, 22 bp, Homo sapiens
gtggcagagagcaagtgtctga

SEQ ID NO: 7690381 - DNA, 22 bp, Homo sapiens
gtggcagagcaggagacaggac

SEQ ID NO: 7690382 - DNA, 22 bp, Homo sapiens
gtggcagagcaggagacaggac

SEQ ID NO: 7690383 - DNA, 22 bp, Homo sapiens
gtggcagagcaggagacaggac

SEQ ID NO: 7690384 - DNA, 22 bp, Homo sapiens
gtggcagagcaggagacaggac

SEQ ID NO: 7690385 - DNA, 22 bp, Homo sapiens
gtggcagagaacaaggagaggt

SEQ ID NO: 7690386 - DNA, 22 bp, Homo sapiens
gtggcagagaacaaggagaggt

SEQ ID NO: 7690387 - DNA, 22 bp, Homo sapiens
gtggcagagaacaaggagaggt

SEQ ID NO: 7690388 - DNA, 22 bp, Homo sapiens
gtggcagagaacaaggagaggt

SEQ ID NO: 7690389 - DNA, 22 bp, Homo sapiens
gtggcagagaacaaggagaggt

SEQ ID NO: 7690390 - DNA, 22 bp, Homo sapiens
gtggcagagaacaaggagaggt

SEQ ID NO: 7690391 - DNA, 22 bp, Homo sapiens
gtggcagagaacaaggagaggt

SEQ ID NO: 7690392 - DNA, 22 bp, Homo sapiens
gtggcagaagagtaggatgggc

SEQ ID NO: 7690393 - DNA, 22 bp, Homo sapiens
gtggcagaagagtaggatgggc

SEQ ID NO: 7690394 - DNA, 22 bp, Homo sapiens
gtggcagaagagtaggatgggc

SEQ ID NO: 7690395 - DNA, 22 bp, Homo sapiens
gtggcagaagagtaggatgggc

SEQ ID NO: 7690396 - DNA, 22 bp, Homo sapiens
gtggcagaactatgtgattgct

SEQ ID NO: 7690397 - DNA, 22 bp, Homo sapiens
gtggcagaactatgtgattgct

SEQ ID NO: 7690398 - DNA, 22 bp, Homo sapiens
gtggcagaagagtaggatgggc

SEQ ID NO: 7690399 - DNA, 22 bp, Homo sapiens
gtggcagaagagtaggatgggc

SEQ ID NO: 7690400 - DNA, 22 bp, Homo sapiens
gtggcagaagagtaggatgggc

SEQ ID NO: 7690401 - DNA, 22 bp, Homo sapiens
gtggcagaagagtaggatgggc

SEQ ID NO: 7690402 - DNA, 22 bp, Homo sapiens
gtggcagaccttcccttctcct

SEQ ID NO: 7690403 - DNA, 22 bp, Homo sapiens
gtggcagaaactggcagaggag

SEQ ID NO: 7690404 - DNA, 22 bp, Homo sapiens
gtggcagaaactggcagaggag

SEQ ID NO: 7690405 - DNA, 22 bp, Homo sapiens
gtggcagaaactggcagaggag

SEQ ID NO: 7690406 - DNA, 22 bp, Homo sapiens
gtggcagaaatattcttgctct

SEQ ID NO: 7690407 - DNA, 22 bp, Homo sapiens
gtggcagaaatattcttgctct

SEQ ID NO: 7690408 - DNA, 22 bp, Homo sapiens
gtggcagaaatgggactttgag

SEQ ID NO: 7690409 - DNA, 22 bp, Homo sapiens
gtggcagaaatgggactttgag

SEQ ID NO: 7690410 - DNA, 22 bp, Homo sapiens
gtggcaggttccgtagacagca

SEQ ID NO: 7690411 - DNA, 22 bp, Homo sapiens
gtggcaggttccgtagacagca

SEQ ID NO: 7690412 - DNA, 22 bp, Homo sapiens
gtggcaggttccgtagacagca

SEQ ID NO: 7690413 - DNA, 22 bp, Homo sapiens
gtggcaggttataagcatctca

SEQ ID NO: 7690414 - DNA, 22 bp, Homo sapiens
gtggcaggttataagcatctca

SEQ ID NO: 7690415 - DNA, 22 bp, Homo sapiens
gtggcaggttataagcatctca

SEQ ID NO: 7690416 - DNA, 22 bp, Homo sapiens
gtggcaggttataagcatctca

SEQ ID NO: 7690417 - DNA, 22 bp, Homo sapiens
gtggcaggtggagcctcctgca

SEQ ID NO: 7690418 - DNA, 22 bp, Homo sapiens
gtggcaggttataagcatctca

SEQ ID NO: 7690419 - DNA, 22 bp, Homo sapiens
gtggcaggttataagcatctca

SEQ ID NO: 7690420 - DNA, 22 bp, Homo sapiens
gtggcaggtggagcctcctgca

SEQ ID NO: 7690421 - DNA, 22 bp, Homo sapiens
gtggcaggtggagcctcctgca

SEQ ID NO: 7690422 - DNA, 22 bp, Homo sapiens
gtggcaggtggagcctcctgca

SEQ ID NO: 7690423 - DNA, 22 bp, Homo sapiens
gtggcaggtcccattggagcag

SEQ ID NO: 7690424 - DNA, 22 bp, Homo sapiens
gtggcaggtggagcctcctgca

SEQ ID NO: 7690425 - DNA, 22 bp, Homo sapiens
gtggcaggttataagcatctca

SEQ ID NO: 7690426 - DNA, 22 bp, Homo sapiens
gtggcaggttataagcatctca

SEQ ID NO: 7690427 - DNA, 22 bp, Homo sapiens
gtggcaggtggagcctcctgca

SEQ ID NO: 7690428 - DNA, 22 bp, Homo sapiens
gtggcaggtcccattggagcag

SEQ ID NO: 7690429 - DNA, 22 bp, Homo sapiens
gtggcaggtcccattggagcag

SEQ ID NO: 7690430 - DNA, 22 bp, Homo sapiens
gtggcaggtcccattggagcag

SEQ ID NO: 7690431 - DNA, 22 bp, Homo sapiens
gtggcaggtcccattggagcag

SEQ ID NO: 7690432 - DNA, 22 bp, Homo sapiens
gtggcaggtcccattggagcag

SEQ ID NO: 7690433 - DNA, 22 bp, Homo sapiens
gtggcaggtcccattggagcag

SEQ ID NO: 7690434 - DNA, 22 bp, Homo sapiens
gtggcaggtcccattggagcag

SEQ ID NO: 7690435 - DNA, 22 bp, Homo sapiens
gtggcagggtgctcatcatgca

SEQ ID NO: 7690436 - DNA, 22 bp, Homo sapiens
gtggcagagccaaggctggagc

SEQ ID NO: 7690437 - DNA, 22 bp, Homo sapiens
gtggcagggtgctcatcatgca

SEQ ID NO: 7690438 - DNA, 22 bp, Homo sapiens
gtggcagggtgctcatcatgca

SEQ ID NO: 7690439 - DNA, 22 bp, Homo sapiens
gtggcagagcaggagacaggac

SEQ ID NO: 7690440 - DNA, 22 bp, Homo sapiens
gtggcagagccaaggctggagc

SEQ ID NO: 7690441 - DNA, 22 bp, Homo sapiens
gtggcagagccaaggctggagc

SEQ ID NO: 7690442 - DNA, 22 bp, Homo sapiens
gtggcagagccaaggctggagc

SEQ ID NO: 7690443 - DNA, 22 bp, Homo sapiens
gtggcagagccaaggctggagc

SEQ ID NO: 7690444 - DNA, 22 bp, Homo sapiens
cagcccagcgcaaacaactggc

SEQ ID NO: 7690445 - DNA, 22 bp, Homo sapiens
cagcccagcgcaaacaactggc

SEQ ID NO: 7690446 - DNA, 22 bp, Homo sapiens
cagcccagcgcaaacaactggc

SEQ ID NO: 7690447 - DNA, 22 bp, Homo sapiens
cagcccagcgcaaacaactggc

SEQ ID NO: 7690448 - DNA, 22 bp, Homo sapiens
cagcccagctctgactaaccct

SEQ ID NO: 7690449 - DNA, 22 bp, Homo sapiens
cagcccagctgggatcacactc

SEQ ID NO: 7690450 - DNA, 22 bp, Homo sapiens
cagcccagctgggatcacactc

SEQ ID NO: 7690451 - DNA, 22 bp, Homo sapiens
cagcccagctctgactaaccct

SEQ ID NO: 7690452 - DNA, 22 bp, Homo sapiens
cagcccagctgggatcacactc

SEQ ID NO: 7690453 - DNA, 22 bp, Homo sapiens
cagcccaggactgcaggtgttt

SEQ ID NO: 7690454 - DNA, 22 bp, Homo sapiens
cagcccaggactgcaggtgttt

SEQ ID NO: 7690455 - DNA, 22 bp, Homo sapiens
cagcccaggactgcaggtgttt

SEQ ID NO: 7690456 - DNA, 22 bp, Homo sapiens
cagcccaggactgcaggtgttt

SEQ ID NO: 7690457 - DNA, 21 bp, Homo sapiens
cagcccagcttcttccccagt

SEQ ID NO: 7690458 - DNA, 21 bp, Homo sapiens
cagcccagcttcttccccagt

SEQ ID NO: 7690459 - DNA, 21 bp, Homo sapiens
cagcccagcttcttccccagt

SEQ ID NO: 7690460 - DNA, 21 bp, Homo sapiens
cagcccagcttcttccccagt

SEQ ID NO: 7690461 - DNA, 21 bp, Homo sapiens
cagcccagcttcttccccagt

SEQ ID NO: 7690462 - DNA, 22 bp, Homo sapiens
cagcccagctgggatcacactc

SEQ ID NO: 7690463 - DNA, 21 bp, Homo sapiens
cagcccagcttcttccccagt

SEQ ID NO: 7690464 - DNA, 21 bp, Homo sapiens
cagcccagcttcttccccagt

SEQ ID NO: 7690465 - DNA, 22 bp, Homo sapiens
cagcccagcgcaaacaactggc

SEQ ID NO: 7690466 - DNA, 22 bp, Homo sapiens
cagcccagcgcaaacaactggc

SEQ ID NO: 7690467 - DNA, 22 bp, Homo sapiens
cagcccagccttgtctctttat

SEQ ID NO: 7690468 - DNA, 22 bp, Homo sapiens
cagcccagcgcaaacaactggc

SEQ ID NO: 7690469 - DNA, 22 bp, Homo sapiens
cagcccagccttgtctctttat

SEQ ID NO: 7690470 - DNA, 22 bp, Homo sapiens
cagcccagccgagggcctggct

SEQ ID NO: 7690471 - DNA, 22 bp, Homo sapiens
cagcccagccgagggcctggct

SEQ ID NO: 7690472 - DNA, 22 bp, Homo sapiens
cagcccagccgagggcctggct

SEQ ID NO: 7690473 - DNA, 22 bp, Homo sapiens
cagcccagccgagggcctggct

SEQ ID NO: 7690474 - DNA, 22 bp, Homo sapiens
cagcccagccgagggcctggct

SEQ ID NO: 7690475 - DNA, 22 bp, Homo sapiens
cagcccagccgagggcctggct

SEQ ID NO: 7690476 - DNA, 21 bp, Homo sapiens
cagcccagcccattgacagtg

SEQ ID NO: 7690477 - DNA, 22 bp, Homo sapiens
cagcccagccgagggcctggct

SEQ ID NO: 7690478 - DNA, 22 bp, Homo sapiens
cagcccagccgagggcctggct

SEQ ID NO: 7690479 - DNA, 22 bp, Homo sapiens
cagcccagccgagggcctggct

SEQ ID NO: 7690480 - DNA, 22 bp, Homo sapiens
cagcccagccgagggcctggct

SEQ ID NO: 7690481 - DNA, 22 bp, Homo sapiens
cagcccagccgagggcctggct

SEQ ID NO: 7690482 - DNA, 22 bp, Homo sapiens
cagcccagccgagggcctggct

SEQ ID NO: 7690483 - DNA, 22 bp, Homo sapiens
cagcccagccgagggcctggct

SEQ ID NO: 7690484 - DNA, 22 bp, Homo sapiens
cagcccagccgagggcctggct

SEQ ID NO: 7690485 - DNA, 22 bp, Homo sapiens
cagcccagccgagggcctggct

SEQ ID NO: 7690486 - DNA, 22 bp, Homo sapiens
cagcccagccgagggcctggct

SEQ ID NO: 7690487 - DNA, 22 bp, Homo sapiens
cagcccaggccgacagttcctc

SEQ ID NO: 7690488 - DNA, 22 bp, Homo sapiens
cagcccaggccgacagttcctc

SEQ ID NO: 7690489 - DNA, 22 bp, Homo sapiens
cagcccaggactgcaggtgttt

SEQ ID NO: 7690490 - DNA, 22 bp, Homo sapiens
cagcccaggactgcaggtgttt

SEQ ID NO: 7690491 - DNA, 22 bp, Homo sapiens
cagcccaggactgcaggtgttt

SEQ ID NO: 7690492 - DNA, 22 bp, Homo sapiens
cagcccaggactgcaggtgttt

SEQ ID NO: 7690493 - DNA, 22 bp, Homo sapiens
cagcccaggactgcaggtgttt

SEQ ID NO: 7690494 - DNA, 22 bp, Homo sapiens
cagcccaggactgcaggtgttt

SEQ ID NO: 7690495 - DNA, 22 bp, Homo sapiens
cagcccaggactgcaggtgttt

SEQ ID NO: 7690496 - DNA, 22 bp, Homo sapiens
cagcccaggccgacagttcctc

SEQ ID NO: 7690497 - DNA, 22 bp, Homo sapiens
cagcccaggccgacagttcctc

SEQ ID NO: 7690498 - DNA, 22 bp, Homo sapiens
cagcccaggccgacagttcctc

SEQ ID NO: 7690499 - DNA, 22 bp, Homo sapiens
cagcccaggccgacagttcctc

SEQ ID NO: 7690500 - DNA, 22 bp, Homo sapiens
cagcccaggccgacagttcctc

SEQ ID NO: 7690501 - DNA, 22 bp, Homo sapiens
cagcccaggccgacagttcctc

SEQ ID NO: 7690502 - DNA, 22 bp, Homo sapiens
cagcccaggccgacagttcctc

SEQ ID NO: 7690503 - DNA, 22 bp, Homo sapiens
cagcccaggccgacagttcctc

SEQ ID NO: 7690504 - DNA, 22 bp, Homo sapiens
cagcccaggccgacagttcctc

SEQ ID NO: 7690505 - DNA, 22 bp, Homo sapiens
cagcccaggccgacagttcctc

SEQ ID NO: 7690506 - DNA, 22 bp, Homo sapiens
cagcccaggccgacagttcctc

SEQ ID NO: 7690507 - DNA, 22 bp, Homo sapiens
cagcccaggccgacagttcctc

SEQ ID NO: 7690508 - DNA, 22 bp, Homo sapiens
gtggcagaaactggcagaggag

SEQ ID NO: 7690509 - DNA, 22 bp, Homo sapiens
gtggcagaaactggcagaggag

SEQ ID NO: 7690510 - DNA, 22 bp, Homo sapiens
gtggcagaaactggcagaggag

SEQ ID NO: 7690511 - DNA, 22 bp, Homo sapiens
gtggcagaaactggcagaggag

SEQ ID NO: 7690512 - DNA, 22 bp, Homo sapiens
gtggcagaaactggcagaggag

SEQ ID NO: 7690513 - DNA, 22 bp, Homo sapiens
gtggcactgggtgagtgagtga

SEQ ID NO: 7690514 - DNA, 22 bp, Homo sapiens
gtggcactgggtgagtgagtga

SEQ ID NO: 7690515 - DNA, 22 bp, Homo sapiens
gtggcactgtttcccacggaag

SEQ ID NO: 7690516 - DNA, 22 bp, Homo sapiens
gtggcactgggtgagtgagtga

SEQ ID NO: 7690517 - DNA, 22 bp, Homo sapiens
gtggcactgatagtttcactct

SEQ ID NO: 7690518 - DNA, 22 bp, Homo sapiens
gtggagccctgccttgctcatg

SEQ ID NO: 7690519 - DNA, 22 bp, Homo sapiens
gtggagccctgccttgctcatg

SEQ ID NO: 7690520 - DNA, 22 bp, Homo sapiens
gtggcactcacctgtagtttca

SEQ ID NO: 7690521 - DNA, 22 bp, Homo sapiens
gtggagccaggggctgtaggta

SEQ ID NO: 7690522 - DNA, 22 bp, Homo sapiens
cagcccaggccgacagttcctc

SEQ ID NO: 7690523 - DNA, 22 bp, Homo sapiens
cagctctgttcatagatggtgc

SEQ ID NO: 7690524 - DNA, 22 bp, Homo sapiens
cagctctgttcatagatggtgc

SEQ ID NO: 7690525 - DNA, 22 bp, Homo sapiens
cagctctgttcatagatggtgc

SEQ ID NO: 7690526 - DNA, 22 bp, Homo sapiens
cagctctgtgtattttccccac

SEQ ID NO: 7690527 - DNA, 22 bp, Homo sapiens
cagctctgttcaaactatccag

SEQ ID NO: 7690528 - DNA, 22 bp, Homo sapiens
cagctctgttcaaactatccag

SEQ ID NO: 7690529 - DNA, 22 bp, Homo sapiens
cagctctgttcatagatggtgc

SEQ ID NO: 7690530 - DNA, 22 bp, Homo sapiens
cagctctgttcaaactatccag

SEQ ID NO: 7690531 - DNA, 22 bp, Homo sapiens
cagctctgttcaaactatccag

SEQ ID NO: 7690532 - DNA, 22 bp, Homo sapiens
cagctctgttcaaactatccag

SEQ ID NO: 7690533 - DNA, 22 bp, Homo sapiens
cagctctgttgccaaagtgggc

SEQ ID NO: 7690534 - DNA, 22 bp, Homo sapiens
cagctctgttgccaaagtgggc

SEQ ID NO: 7690535 - DNA, 22 bp, Homo sapiens
cagctctgttgccaaagtgggc

SEQ ID NO: 7690536 - DNA, 22 bp, Homo sapiens
cagctctgttgccaaagtgggc

SEQ ID NO: 7690537 - DNA, 22 bp, Homo sapiens
cagctctgttgccaaagtgggc

SEQ ID NO: 7690538 - DNA, 22 bp, Homo sapiens
cagctctgttgccctggaaacg

SEQ ID NO: 7690539 - DNA, 22 bp, Homo sapiens
cagctctgttgccctggaaacg

SEQ ID NO: 7690540 - DNA, 22 bp, Homo sapiens
cagctcttaacacagcttgtat

SEQ ID NO: 7690541 - DNA, 22 bp, Homo sapiens
cagctcttattttctctcctaa

SEQ ID NO: 7690542 - DNA, 22 bp, Homo sapiens
cagctcttagagggagacagac

SEQ ID NO: 7690543 - DNA, 22 bp, Homo sapiens
cagctcttagagggagacagac

SEQ ID NO: 7690544 - DNA, 22 bp, Homo sapiens
cagctcttagagggagacagac

SEQ ID NO: 7690545 - DNA, 22 bp, Homo sapiens
cagctcttaacacagcttgtat

SEQ ID NO: 7690546 - DNA, 22 bp, Homo sapiens
cagctcttcagagtgagcaatg

SEQ ID NO: 7690547 - DNA, 22 bp, Homo sapiens
cagctcttcagagtgagcaatg

SEQ ID NO: 7690548 - DNA, 22 bp, Homo sapiens
cagctcttcagagtgagcaatg

SEQ ID NO: 7690549 - DNA, 22 bp, Homo sapiens
cagctcttattttctctcctaa

SEQ ID NO: 7690550 - DNA, 22 bp, Homo sapiens
cagctcttattttctctcctaa

SEQ ID NO: 7690551 - DNA, 22 bp, Homo sapiens
cagctcttcagtgcctgagata

SEQ ID NO: 7690552 - DNA, 22 bp, Homo sapiens
cagctcttccatttccttcagc

SEQ ID NO: 7690553 - DNA, 22 bp, Homo sapiens
cagctcttcagtgcctgagata

SEQ ID NO: 7690554 - DNA, 22 bp, Homo sapiens
cagctcttcagtgcctgagata

SEQ ID NO: 7690555 - DNA, 22 bp, Homo sapiens
cagctcttccctcttcttgtag

SEQ ID NO: 7690556 - DNA, 22 bp, Homo sapiens
cagctcttccatttccttcagc

SEQ ID NO: 7690557 - DNA, 22 bp, Homo sapiens
cagctcttccctcttcttgtag

SEQ ID NO: 7690558 - DNA, 22 bp, Homo sapiens
cagctcttcctaccctagttgg

SEQ ID NO: 7690559 - DNA, 22 bp, Homo sapiens
cagctcttcctaccctagttgg

SEQ ID NO: 7690560 - DNA, 22 bp, Homo sapiens
cagctcttcctaccctagttgg

SEQ ID NO: 7690561 - DNA, 22 bp, Homo sapiens
cagctctttgagtattccattt

SEQ ID NO: 7690562 - DNA, 22 bp, Homo sapiens
cagctctttgagtattccattt

SEQ ID NO: 7690563 - DNA, 22 bp, Homo sapiens
cagctctttttcacacaacatg

SEQ ID NO: 7690564 - DNA, 22 bp, Homo sapiens
cagctctttgagtattccattt

SEQ ID NO: 7690565 - DNA, 22 bp, Homo sapiens
cagctcttttttgcagcagctg

SEQ ID NO: 7690566 - DNA, 22 bp, Homo sapiens
cagctctttttcacacaacatg

SEQ ID NO: 7690567 - DNA, 22 bp, Homo sapiens
cagctcttttttgcagcagctg

SEQ ID NO: 7690568 - DNA, 22 bp, Homo sapiens
cagctgaagaaagagtggttag

SEQ ID NO: 7690569 - DNA, 22 bp, Homo sapiens
cagctgaacatgtagagcatct

SEQ ID NO: 7690570 - DNA, 22 bp, Homo sapiens
cagctgaaagaaggaagtgtca

SEQ ID NO: 7690571 - DNA, 22 bp, Homo sapiens
cagctgaacatgtagagcatct

SEQ ID NO: 7690572 - DNA, 22 bp, Homo sapiens
cagctgaaagaaggaagtgtca

SEQ ID NO: 7690573 - DNA, 22 bp, Homo sapiens
cagctgaaagaaggaagtgtca

SEQ ID NO: 7690574 - DNA, 22 bp, Homo sapiens
cagctcttcctagccatgccac

SEQ ID NO: 7690575 - DNA, 22 bp, Homo sapiens
cagctcttcctagccatgccac

SEQ ID NO: 7690576 - DNA, 22 bp, Homo sapiens
cagctcttcctaccctagttgg

SEQ ID NO: 7690577 - DNA, 22 bp, Homo sapiens
cagctcttcctagccatgccac

SEQ ID NO: 7690578 - DNA, 22 bp, Homo sapiens
cagctcttcctagccatgccac

SEQ ID NO: 7690579 - DNA, 22 bp, Homo sapiens
cagctcttcctagccatgccac

SEQ ID NO: 7690580 - DNA, 22 bp, Homo sapiens
cagctcttcctcccaccggaca

SEQ ID NO: 7690581 - DNA, 17 bp, Homo sapiens
cagctcttcctccctct

SEQ ID NO: 7690582 - DNA, 22 bp, Homo sapiens
cagctcttcctcccaccggaca

SEQ ID NO: 7690583 - DNA, 17 bp, Homo sapiens
cagctcttcctccctct

SEQ ID NO: 7690584 - DNA, 18 bp, Homo sapiens
cagctcttctccagtaac

SEQ ID NO: 7690585 - DNA, 22 bp, Homo sapiens
cagctcttggagaaaccagagc

SEQ ID NO: 7690586 - DNA, 18 bp, Homo sapiens
cagctcttctccagtaac

SEQ ID NO: 7690587 - DNA, 22 bp, Homo sapiens
cagctcttggagcctccagtaa

SEQ ID NO: 7690588 - DNA, 22 bp, Homo sapiens
cagctcttggagaaaccagagc

SEQ ID NO: 7690589 - DNA, 18 bp, Homo sapiens
cagctcttctccagtaac

SEQ ID NO: 7690590 - DNA, 22 bp, Homo sapiens
cagctctttactctgcaatgat

SEQ ID NO: 7690591 - DNA, 22 bp, Homo sapiens
cagctcttggagcctccagtaa

SEQ ID NO: 7690592 - DNA, 22 bp, Homo sapiens
cagctctttattgccaatattc

SEQ ID NO: 7690593 - DNA, 22 bp, Homo sapiens
cagctctttattgaaacaaaaa

SEQ ID NO: 7690594 - DNA, 22 bp, Homo sapiens
cagctctttattgccaatattc

SEQ ID NO: 7690595 - DNA, 22 bp, Homo sapiens
cagctgagtggaccctagaggc

SEQ ID NO: 7690596 - DNA, 22 bp, Homo sapiens
cagctgagtggaccctagaggc

SEQ ID NO: 7690597 - DNA, 22 bp, Homo sapiens
cagctgagtggaccctagaggc

SEQ ID NO: 7690598 - DNA, 22 bp, Homo sapiens
cagctgagtggaccctagaggc

SEQ ID NO: 7690599 - DNA, 22 bp, Homo sapiens
cagctgagtctgaggttctttg

SEQ ID NO: 7690600 - DNA, 22 bp, Homo sapiens
cagctgagtgttggcatgttca

SEQ ID NO: 7690601 - DNA, 22 bp, Homo sapiens
cagctgagtgttggcatgttca

SEQ ID NO: 7690602 - DNA, 22 bp, Homo sapiens
cagctgagtgttggcatgttca

SEQ ID NO: 7690603 - DNA, 22 bp, Homo sapiens
cagctgagtgttggcatgttca

SEQ ID NO: 7690604 - DNA, 22 bp, Homo sapiens
cagctgagtggaccctagaggc

SEQ ID NO: 7690605 - DNA, 22 bp, Homo sapiens
cagctgagtggaccctagaggc

SEQ ID NO: 7690606 - DNA, 22 bp, Homo sapiens
cagctgagtggaccctagaggc

SEQ ID NO: 7690607 - DNA, 22 bp, Homo sapiens
cagctgagttactctgaggtct

SEQ ID NO: 7690608 - DNA, 22 bp, Homo sapiens
cagctgagttactctgaggtct

SEQ ID NO: 7690609 - DNA, 22 bp, Homo sapiens
cagctgagttactctgaggtct

SEQ ID NO: 7690610 - DNA, 22 bp, Homo sapiens
cagctgagttactctgaggtct

SEQ ID NO: 7690611 - DNA, 22 bp, Homo sapiens
cagctgagttactctgaggtct

SEQ ID NO: 7690612 - DNA, 22 bp, Homo sapiens
cagctgagtttccaagtctgcc

SEQ ID NO: 7690613 - DNA, 22 bp, Homo sapiens
cagctgagtttccaagtctgcc

SEQ ID NO: 7690614 - DNA, 22 bp, Homo sapiens
cagctgagtttccaagtctgcc

SEQ ID NO: 7690615 - DNA, 22 bp, Homo sapiens
cagctgagttactctgaggtct

SEQ ID NO: 7690616 - DNA, 22 bp, Homo sapiens
gtggcctgtcagaagccgtggg

SEQ ID NO: 7690617 - DNA, 22 bp, Homo sapiens
gtggcctgtcagaagccgtggg

SEQ ID NO: 7690618 - DNA, 22 bp, Homo sapiens
gtggcctgtcagaagccgtggg

SEQ ID NO: 7690619 - DNA, 22 bp, Homo sapiens
gtggcctgtcagaagccgtggg

SEQ ID NO: 7690620 - DNA, 22 bp, Homo sapiens
cagctgagtttccaagtctgcc

SEQ ID NO: 7690621 - DNA, 22 bp, Homo sapiens
cagctgagtttccaagtctgcc

SEQ ID NO: 7690622 - DNA, 22 bp, Homo sapiens
cagctgagtttccaagtctgcc

SEQ ID NO: 7690623 - DNA, 22 bp, Homo sapiens
cagctgagtttccaagtctgcc

SEQ ID NO: 7690624 - DNA, 22 bp, Homo sapiens
gtggccttaagaaacaaacaac

SEQ ID NO: 7690625 - DNA, 22 bp, Homo sapiens
gtggccttaagaaacaaacaac

SEQ ID NO: 7690626 - DNA, 22 bp, Homo sapiens
gtggccttaggacacgtttatt

SEQ ID NO: 7690627 - DNA, 22 bp, Homo sapiens
gtggccttattatgtacaaaat

SEQ ID NO: 7690628 - DNA, 22 bp, Homo sapiens
gtggcctgtgctgtctccccaa

SEQ ID NO: 7690629 - DNA, 22 bp, Homo sapiens
gtggcctgtcagaagccgtggg

SEQ ID NO: 7690630 - DNA, 20 bp, Homo sapiens
gtggcctgtcctgttgtggg

SEQ ID NO: 7690631 - DNA, 20 bp, Homo sapiens
gtggcctgtcctgttgtggg

SEQ ID NO: 7690632 - DNA, 20 bp, Homo sapiens
gtggcctgtcctgttgtggg

SEQ ID NO: 7690633 - DNA, 23 bp, Homo sapiens
cagctgaagcagcctgggctgga

SEQ ID NO: 7690634 - DNA, 22 bp, Homo sapiens
cagctgagcatcactagtctgg

SEQ ID NO: 7690635 - DNA, 22 bp, Homo sapiens
cagctgagcatcactagtctgg

SEQ ID NO: 7690636 - DNA, 22 bp, Homo sapiens
cagctgagcatcactagtctgg

SEQ ID NO: 7690637 - DNA, 23 bp, Homo sapiens
cagctgaagcagcctgggctgga

SEQ ID NO: 7690638 - DNA, 22 bp, Homo sapiens
cagctgaagagaggtgctgagt

SEQ ID NO: 7690639 - DNA, 22 bp, Homo sapiens
cagctgaacctttccctggagc

SEQ ID NO: 7690640 - DNA, 22 bp, Homo sapiens
cagctgagcatcactagtctgg

SEQ ID NO: 7690641 - DNA, 22 bp, Homo sapiens
cagctgagcatcactagtctgg

SEQ ID NO: 7690642 - DNA, 22 bp, Homo sapiens
cagctgagctcccaggccatca

SEQ ID NO: 7690643 - DNA, 22 bp, Homo sapiens
cagctgagctcccaggccatca

SEQ ID NO: 7690644 - DNA, 22 bp, Homo sapiens
cagctgagctcccaggccatca

SEQ ID NO: 7690645 - DNA, 22 bp, Homo sapiens
cagctgagctgccagactactg

SEQ ID NO: 7690646 - DNA, 22 bp, Homo sapiens
cagctgagctcccaggccatca

SEQ ID NO: 7690647 - DNA, 22 bp, Homo sapiens
cagctgagctgccagactactg

SEQ ID NO: 7690648 - DNA, 22 bp, Homo sapiens
cagctgagctgccagactactg

SEQ ID NO: 7690649 - DNA, 22 bp, Homo sapiens
cagctgaggaatactagatgta

SEQ ID NO: 7690650 - DNA, 22 bp, Homo sapiens
cagctgaggaatactagatgta

SEQ ID NO: 7690651 - DNA, 22 bp, Homo sapiens
cagctgaggaatactagatgta

SEQ ID NO: 7690652 - DNA, 18 bp, Homo sapiens
cagctgaggaccaaactg

SEQ ID NO: 7690653 - DNA, 22 bp, Homo sapiens
cagctgaggaatactagatgta

SEQ ID NO: 7690654 - DNA, 22 bp, Homo sapiens
cagctgaggaatactagatgta

SEQ ID NO: 7690655 - DNA, 18 bp, Homo sapiens
cagctgaggaccaaactg

SEQ ID NO: 7690656 - DNA, 22 bp, Homo sapiens
cagctgaggtcaaagaagcagg

SEQ ID NO: 7690657 - DNA, 22 bp, Homo sapiens
cagctgaggtcaaagaagcagg

SEQ ID NO: 7690658 - DNA, 22 bp, Homo sapiens
cagctgaggtcaaagaagcagg

SEQ ID NO: 7690659 - DNA, 22 bp, Homo sapiens
cagctgagtctgaggttctttg

SEQ ID NO: 7690660 - DNA, 22 bp, Homo sapiens
cagctgagtatgcattcaagca

SEQ ID NO: 7690661 - DNA, 22 bp, Homo sapiens
cagctgaggtcttttttatgtg

SEQ ID NO: 7690662 - DNA, 22 bp, Homo sapiens
cagctgagtatgcattcaagca

SEQ ID NO: 7690663 - DNA, 22 bp, Homo sapiens
gtgggacagctggagggtccct

SEQ ID NO: 7690664 - DNA, 22 bp, Homo sapiens
gtgggacagcggggtgggacag

SEQ ID NO: 7690665 - DNA, 22 bp, Homo sapiens
gtgggacagctggagggtccct

SEQ ID NO: 7690666 - DNA, 22 bp, Homo sapiens
gtgggacagctggagggtccct

SEQ ID NO: 7690667 - DNA, 22 bp, Homo sapiens
gtgggacagcggggtgggacag

SEQ ID NO: 7690668 - DNA, 22 bp, Homo sapiens
gtgggacagcggggtgggacag

SEQ ID NO: 7690669 - DNA, 22 bp, Homo sapiens
gtgggacagcggggtgggacag

SEQ ID NO: 7690670 - DNA, 22 bp, Homo sapiens
gtgggacagtcagaagtgagca

SEQ ID NO: 7690671 - DNA, 22 bp, Homo sapiens
gtgggactcttctttggcagtg

SEQ ID NO: 7690672 - DNA, 22 bp, Homo sapiens
gtgggcaggaggccctgccctg

SEQ ID NO: 7690673 - DNA, 22 bp, Homo sapiens
gtgggcaggaggccctgccctg

SEQ ID NO: 7690674 - DNA, 22 bp, Homo sapiens
gtgggcaggagtgagcaacagg

SEQ ID NO: 7690675 - DNA, 22 bp, Homo sapiens
gtgggcaggagtgagcaacagg

SEQ ID NO: 7690676 - DNA, 22 bp, Homo sapiens
gtgggcaggagtgagcaacagg

SEQ ID NO: 7690677 - DNA, 22 bp, Homo sapiens
gtgggcaggagtgagcaacagg

SEQ ID NO: 7690678 - DNA, 22 bp, Homo sapiens
gtgggcaggagtgagcaacagg

SEQ ID NO: 7690679 - DNA, 22 bp, Homo sapiens
gtgggcaggccccaaagcaggg

SEQ ID NO: 7690680 - DNA, 22 bp, Homo sapiens
gtgggcaggccccaaagcaggg

SEQ ID NO: 7690681 - DNA, 22 bp, Homo sapiens
gtgggcaggccccaaagcaggg

SEQ ID NO: 7690682 - DNA, 22 bp, Homo sapiens
gtgggcaggccccaaagcaggg

SEQ ID NO: 7690683 - DNA, 22 bp, Homo sapiens
gtgggcaggagtgagcaacagg

SEQ ID NO: 7690684 - DNA, 22 bp, Homo sapiens
gtgggcaggccccaaagcaggg

SEQ ID NO: 7690685 - DNA, 22 bp, Homo sapiens
gtgggcaggccccaaagcaggg

SEQ ID NO: 7690686 - DNA, 22 bp, Homo sapiens
gtgggcaggccccaaagcaggg

SEQ ID NO: 7690687 - DNA, 22 bp, Homo sapiens
gtgggcaggccccaaagcaggg

SEQ ID NO: 7690688 - DNA, 22 bp, Homo sapiens
gtgggcaggccctaggcgattt

SEQ ID NO: 7690689 - DNA, 22 bp, Homo sapiens
gtgggcaggccctaggcgattt

SEQ ID NO: 7690690 - DNA, 22 bp, Homo sapiens
gtgggcaggccctaggcgattt

SEQ ID NO: 7690691 - DNA, 22 bp, Homo sapiens
gtgggcaggccctaggcgattt

SEQ ID NO: 7690692 - DNA, 22 bp, Homo sapiens
gtgggcaggccctaggcgattt

SEQ ID NO: 7690693 - DNA, 22 bp, Homo sapiens
gtgggcaggccctaggcgattt

SEQ ID NO: 7690694 - DNA, 22 bp, Homo sapiens
gtgggcaggccctaggcgattt

SEQ ID NO: 7690695 - DNA, 22 bp, Homo sapiens
gtgggcaggccctaggcgattt

SEQ ID NO: 7690696 - DNA, 22 bp, Homo sapiens
gtgggcaggccctaggcgattt

SEQ ID NO: 7690697 - DNA, 22 bp, Homo sapiens
gtgggcagtggggtcttctgcc

SEQ ID NO: 7690698 - DNA, 22 bp, Homo sapiens
gtgggcagtggtttgcgcggtc

SEQ ID NO: 7690699 - DNA, 22 bp, Homo sapiens
gtgggcagtggggtcttctgcc

SEQ ID NO: 7690700 - DNA, 22 bp, Homo sapiens
gtgggcagtggggtcttctgcc

SEQ ID NO: 7690701 - DNA, 22 bp, Homo sapiens
gtgggcagtggggtcttctgcc

SEQ ID NO: 7690702 - DNA, 22 bp, Homo sapiens
gtgggcagtggggtcttctgcc

SEQ ID NO: 7690703 - DNA, 22 bp, Homo sapiens
gtgggcagtgcctgacggatga

SEQ ID NO: 7690704 - DNA, 22 bp, Homo sapiens
gtgggcagtgcctgacggatga

SEQ ID NO: 7690705 - DNA, 22 bp, Homo sapiens
gtgggcagtggggtcttctgcc

SEQ ID NO: 7690706 - DNA, 22 bp, Homo sapiens
gtgggcagtggggtcttctgcc

SEQ ID NO: 7690707 - DNA, 22 bp, Homo sapiens
gtgggcagtggggtcttctgcc

SEQ ID NO: 7690708 - DNA, 22 bp, Homo sapiens
gtgggcagtggggtcttctgcc

SEQ ID NO: 7690709 - DNA, 22 bp, Homo sapiens
gtggggaggcctaagcaagttg

SEQ ID NO: 7690710 - DNA, 22 bp, Homo sapiens
gtggggaggcctaagcaagttg

SEQ ID NO: 7690711 - DNA, 22 bp, Homo sapiens
gtggggaggcctaagcaagttg

SEQ ID NO: 7690712 - DNA, 22 bp, Homo sapiens
gtggggaggcctaagcaagttg

SEQ ID NO: 7690713 - DNA, 22 bp, Homo sapiens
gtggggagggagatgctgaagt

SEQ ID NO: 7690714 - DNA, 22 bp, Homo sapiens
gtggggagggagatgctgaagt

SEQ ID NO: 7690715 - DNA, 22 bp, Homo sapiens
gtggggagggagatgctgaagt

SEQ ID NO: 7690716 - DNA, 22 bp, Homo sapiens
gtggggagggagatgctgaagt

SEQ ID NO: 7690717 - DNA, 22 bp, Homo sapiens
gtggggagggagatgctgaagt

SEQ ID NO: 7690718 - DNA, 22 bp, Homo sapiens
gtggggagggagatgctgaagt

SEQ ID NO: 7690719 - DNA, 22 bp, Homo sapiens
gtggggagggagatgctgaagt

SEQ ID NO: 7690720 - DNA, 22 bp, Homo sapiens
gtgggcaggtaggcaccagcta

SEQ ID NO: 7690721 - DNA, 22 bp, Homo sapiens
gtgggcaggtaggcaccagcta

SEQ ID NO: 7690722 - DNA, 22 bp, Homo sapiens
gtgggcaggtaggcaccagcta

SEQ ID NO: 7690723 - DNA, 22 bp, Homo sapiens
gtgggcaggtaggcaccagcta

SEQ ID NO: 7690724 - DNA, 22 bp, Homo sapiens
gtgggcaggtaggcaccagcta

SEQ ID NO: 7690725 - DNA, 22 bp, Homo sapiens
gtgggcaggtaggcaccagcta

SEQ ID NO: 7690726 - DNA, 22 bp, Homo sapiens
gtgggcaggtaggcaccagcta

SEQ ID NO: 7690727 - DNA, 22 bp, Homo sapiens
gtgggcagggttgctttctccg

SEQ ID NO: 7690728 - DNA, 22 bp, Homo sapiens
gtgggcagggttgctttctccg

SEQ ID NO: 7690729 - DNA, 22 bp, Homo sapiens
gtgggcagtcatgaaatctaga

SEQ ID NO: 7690730 - DNA, 22 bp, Homo sapiens
gtgggcagtcatgaaatctaga

SEQ ID NO: 7690731 - DNA, 22 bp, Homo sapiens
gtgggcagtgcctgacggatga

SEQ ID NO: 7690732 - DNA, 22 bp, Homo sapiens
gtgggcagtcatgaaatctaga

SEQ ID NO: 7690733 - DNA, 22 bp, Homo sapiens
gtgggcaggtaggcaccagcta

SEQ ID NO: 7690734 - DNA, 22 bp, Homo sapiens
gtgggcagtgcctgacggatga

SEQ ID NO: 7690735 - DNA, 22 bp, Homo sapiens
gtgggcagtgcctgacggatga

SEQ ID NO: 7690736 - DNA, 22 bp, Homo sapiens
gtgggcagtgcctgacggatga

SEQ ID NO: 7690737 - DNA, 22 bp, Homo sapiens
gtgggcagtgcctgacggatga

SEQ ID NO: 7690738 - DNA, 22 bp, Homo sapiens
gtgggcagtgcctgacggatga

SEQ ID NO: 7690739 - DNA, 22 bp, Homo sapiens
gtgggcagtgcctgacggatga

SEQ ID NO: 7690740 - DNA, 22 bp, Homo sapiens
gtggctcacgtctgtcatctca

SEQ ID NO: 7690741 - DNA, 22 bp, Homo sapiens
gtggctcacgcctgtaatccca

SEQ ID NO: 7690742 - DNA, 22 bp, Homo sapiens
gtggctcacagcaatgtttcct

SEQ ID NO: 7690743 - DNA, 22 bp, Homo sapiens
gtggctcagcggagctctgcac

SEQ ID NO: 7690744 - DNA, 22 bp, Homo sapiens
gtggctcacgtctgtcatctca

SEQ ID NO: 7690745 - DNA, 22 bp, Homo sapiens
gtggctcacgcctgtaatccca

SEQ ID NO: 7690746 - DNA, 22 bp, Homo sapiens
gtggctcacgcctgtaatccca

SEQ ID NO: 7690747 - DNA, 22 bp, Homo sapiens
gtggcttctgcggtgtgcgcag

SEQ ID NO: 7690748 - DNA, 22 bp, Homo sapiens
gtggctcacgtctgtcatctca

SEQ ID NO: 7690749 - DNA, 22 bp, Homo sapiens
gtggcttctgcggtgtgcgcag

SEQ ID NO: 7690750 - DNA, 22 bp, Homo sapiens
gtggcttctgcggtgtgcgcag

SEQ ID NO: 7690751 - DNA, 22 bp, Homo sapiens
gtggcttctgcggtgtgcgcag

SEQ ID NO: 7690752 - DNA, 22 bp, Homo sapiens
gtggcttctgcggtgtgcgcag

SEQ ID NO: 7690753 - DNA, 22 bp, Homo sapiens
gtggctcacgcctgtaatccca

SEQ ID NO: 7690754 - DNA, 22 bp, Homo sapiens
gtggctcacagcaatgtttcct

SEQ ID NO: 7690755 - DNA, 22 bp, Homo sapiens
gtggctcacacctgtaatccca

SEQ ID NO: 7690756 - DNA, 22 bp, Homo sapiens
gtggctcacagcaatgtttcct

SEQ ID NO: 7690757 - DNA, 22 bp, Homo sapiens
gtggctcacagcaatgtttcct

SEQ ID NO: 7690758 - DNA, 22 bp, Homo sapiens
gtggctcacacctgtaatccca

SEQ ID NO: 7690759 - DNA, 22 bp, Homo sapiens
gtggctcacacctgtaatccca

SEQ ID NO: 7690760 - DNA, 22 bp, Homo sapiens
gtggctcacacctgtaatccca

SEQ ID NO: 7690761 - DNA, 22 bp, Homo sapiens
gtggctatatttgaggatacgt

SEQ ID NO: 7690762 - DNA, 22 bp, Homo sapiens
gtggctaggcccaacggcagga

SEQ ID NO: 7690763 - DNA, 22 bp, Homo sapiens
gtggctagggacacagattgct

SEQ ID NO: 7690764 - DNA, 22 bp, Homo sapiens
gtggctagttggcagagaacag

SEQ ID NO: 7690765 - DNA, 22 bp, Homo sapiens
gtggccttgggcactgaccttg

SEQ ID NO: 7690766 - DNA, 22 bp, Homo sapiens
gtggccttggcttctaccctga

SEQ ID NO: 7690767 - DNA, 22 bp, Homo sapiens
gtggccttgctcacatgtccag

SEQ ID NO: 7690768 - DNA, 22 bp, Homo sapiens
gtggccttgctcacatgtccag

SEQ ID NO: 7690769 - DNA, 22 bp, Homo sapiens
gtggccttataagaagagacat

SEQ ID NO: 7690770 - DNA, 22 bp, Homo sapiens
gtggccttattatgtacaaaat

SEQ ID NO: 7690771 - DNA, 22 bp, Homo sapiens
gtggccttggcttctaccctga

SEQ ID NO: 7690772 - DNA, 22 bp, Homo sapiens
gtggccttgggcactgaccttg

SEQ ID NO: 7690773 - DNA, 22 bp, Homo sapiens
gtggcctttatcttaggtatcc

SEQ ID NO: 7690774 - DNA, 22 bp, Homo sapiens
gtggcctttcctgaagaaatga

SEQ ID NO: 7690775 - DNA, 22 bp, Homo sapiens
gtggcctttcctgaagaaatga

SEQ ID NO: 7690776 - DNA, 22 bp, Homo sapiens
gtggcctttcttgggctacaga

SEQ ID NO: 7690777 - DNA, 22 bp, Homo sapiens
gtggcctttcttgggctacaga

SEQ ID NO: 7690778 - DNA, 22 bp, Homo sapiens
gtggcctttgtccaggcgaaac

SEQ ID NO: 7690779 - DNA, 22 bp, Homo sapiens
gtggcgcagagggtggcagaga

SEQ ID NO: 7690780 - DNA, 22 bp, Homo sapiens
gtggcgaggggaggtcctggcg

SEQ ID NO: 7690781 - DNA, 22 bp, Homo sapiens
gtggccttttcaagtagggtat

SEQ ID NO: 7690782 - DNA, 22 bp, Homo sapiens
gtggcgagtgcagcagatgcag

SEQ ID NO: 7690783 - DNA, 22 bp, Homo sapiens
gtggccttttagaataaactct

SEQ ID NO: 7690784 - DNA, 22 bp, Homo sapiens
gtggccttttcaagtagggtat

SEQ ID NO: 7690785 - DNA, 22 bp, Homo sapiens
gtggccttttagaataaactct

SEQ ID NO: 7690786 - DNA, 22 bp, Homo sapiens
gtggcgaggggaggtcctggcg

SEQ ID NO: 7690787 - DNA, 22 bp, Homo sapiens
gtggcgaggggaggtcctggcg

SEQ ID NO: 7690788 - DNA, 22 bp, Homo sapiens
gtggcgcagagggtggcagaga

SEQ ID NO: 7690789 - DNA, 22 bp, Homo sapiens
gtggcggactcgacctggcctg

SEQ ID NO: 7690790 - DNA, 22 bp, Homo sapiens
gtgggacaaggatgaagatatt

SEQ ID NO: 7690791 - DNA, 22 bp, Homo sapiens
gtgggaagtctctcggaggaag

SEQ ID NO: 7690792 - DNA, 22 bp, Homo sapiens
gtgggaagtctctcggaggaag

SEQ ID NO: 7690793 - DNA, 22 bp, Homo sapiens
gtgggaagtctctcggaggaag

SEQ ID NO: 7690794 - DNA, 22 bp, Homo sapiens
gtgggaagtctctcggaggaag

SEQ ID NO: 7690795 - DNA, 22 bp, Homo sapiens
gtgggaagagccaattggggta

SEQ ID NO: 7690796 - DNA, 22 bp, Homo sapiens
gtgggaagagccaattggggta

SEQ ID NO: 7690797 - DNA, 22 bp, Homo sapiens
gtgggaagaacttcaagtggct

SEQ ID NO: 7690798 - DNA, 22 bp, Homo sapiens
gtgggaagaacttcaagtggct

SEQ ID NO: 7690799 - DNA, 22 bp, Homo sapiens
gtgggaagaacttcaagtggct

SEQ ID NO: 7690800 - DNA, 22 bp, Homo sapiens
gtgggaagaacttcaagtggct

SEQ ID NO: 7690801 - DNA, 22 bp, Homo sapiens
gtgggaagaacttcaagtggct

SEQ ID NO: 7690802 - DNA, 22 bp, Homo sapiens
gtgggaagaacttcaagtggct

SEQ ID NO: 7690803 - DNA, 22 bp, Homo sapiens
gtggcttgaccatccctgctac

SEQ ID NO: 7690804 - DNA, 22 bp, Homo sapiens
gtggcttcttcttgggagctgc

SEQ ID NO: 7690805 - DNA, 22 bp, Homo sapiens
gtggcttggaccagtcacagtg

SEQ ID NO: 7690806 - DNA, 22 bp, Homo sapiens
gtggcttgagcaggggcagagg

SEQ ID NO: 7690807 - DNA, 22 bp, Homo sapiens
gtggcttctggctgggcctcag

SEQ ID NO: 7690808 - DNA, 22 bp, Homo sapiens
gtggcttctggctgggcctcag

SEQ ID NO: 7690809 - DNA, 22 bp, Homo sapiens
gtggcttctggctgggcctcag

SEQ ID NO: 7690810 - DNA, 22 bp, Homo sapiens
gtggcttcttctgccagaagga

SEQ ID NO: 7690811 - DNA, 22 bp, Homo sapiens
gtggcttcttcttgggagctgc

SEQ ID NO: 7690812 - DNA, 22 bp, Homo sapiens
gtggcttcttcttgggagctgc

SEQ ID NO: 7690813 - DNA, 22 bp, Homo sapiens
gtggcttcttcttgggagctgc

SEQ ID NO: 7690814 - DNA, 22 bp, Homo sapiens
gtggctttgtttccaaatgaaa

SEQ ID NO: 7690815 - DNA, 22 bp, Homo sapiens
gtggctttgtttccaaatgaaa

SEQ ID NO: 7690816 - DNA, 22 bp, Homo sapiens
gtggctttgtttccaaatgaaa

SEQ ID NO: 7690817 - DNA, 22 bp, Homo sapiens
gtgggaagaacttcaagtggct

SEQ ID NO: 7690818 - DNA, 22 bp, Homo sapiens
gtggctttggaattgtagactc

SEQ ID NO: 7690819 - DNA, 22 bp, Homo sapiens
gtggctttcatttcaggatgtg

SEQ ID NO: 7690820 - DNA, 22 bp, Homo sapiens
gtggcttggaccagtcacagtg

SEQ ID NO: 7690821 - DNA, 22 bp, Homo sapiens
gtggcttggaccagtcacagtg

SEQ ID NO: 7690822 - DNA, 22 bp, Homo sapiens
gtggcttgtgtgggaagtgcag

SEQ ID NO: 7690823 - DNA, 22 bp, Homo sapiens
gtggctttataggaagaggaac

SEQ ID NO: 7690824 - DNA, 22 bp, Homo sapiens
gtggctttataggaagaggaac

SEQ ID NO: 7690825 - DNA, 22 bp, Homo sapiens
gtggctttataggaagaggaac

SEQ ID NO: 7690826 - DNA, 22 bp, Homo sapiens
ccagaggacttgggggctgaat

SEQ ID NO: 7690827 - DNA, 22 bp, Homo sapiens
ccagaggacttgggggctgaat

SEQ ID NO: 7690828 - DNA, 22 bp, Homo sapiens
ccagaggacttgggggctgaat

SEQ ID NO: 7690829 - DNA, 22 bp, Homo sapiens
ccagaggacttgggggctgaat

SEQ ID NO: 7690830 - DNA, 22 bp, Homo sapiens
ccagaggacttgggggctgaat

SEQ ID NO: 7690831 - DNA, 22 bp, Homo sapiens
ccagaggacttgggggctgaat

SEQ ID NO: 7690832 - DNA, 22 bp, Homo sapiens
ccagaggacttgggggctgaat

SEQ ID NO: 7690833 - DNA, 22 bp, Homo sapiens
ccagaggacttgggggctgaat

SEQ ID NO: 7690834 - DNA, 22 bp, Homo sapiens
ccagaggacttgggggctgaat

SEQ ID NO: 7690835 - DNA, 22 bp, Homo sapiens
ccagaggacttgggggctgaat

SEQ ID NO: 7690836 - DNA, 22 bp, Homo sapiens
ccagaggagatgcctcctctgt

SEQ ID NO: 7690837 - DNA, 22 bp, Homo sapiens
ccagaggagatgcctcctctgt

SEQ ID NO: 7690838 - DNA, 22 bp, Homo sapiens
ccagaggagatgcctcctctgt

SEQ ID NO: 7690839 - DNA, 22 bp, Homo sapiens
ccagaggagatgcctcctctgt

SEQ ID NO: 7690840 - DNA, 22 bp, Homo sapiens
ccagaggagatgcctcctctgt

SEQ ID NO: 7690841 - DNA, 22 bp, Homo sapiens
ccagaggagatgcctcctctgt

SEQ ID NO: 7690842 - DNA, 22 bp, Homo sapiens
ccagaggagcaggctggctcca

SEQ ID NO: 7690843 - DNA, 22 bp, Homo sapiens
ccagaggagcaggctggctcca

SEQ ID NO: 7690844 - DNA, 22 bp, Homo sapiens
ccagaggagcaggctggctcca

SEQ ID NO: 7690845 - DNA, 22 bp, Homo sapiens
ccagaggagcaggctggctcca

SEQ ID NO: 7690846 - DNA, 22 bp, Homo sapiens
ccagaggagcaggctggctcca

SEQ ID NO: 7690847 - DNA, 22 bp, Homo sapiens
ccagaggagcaggctggctcca

SEQ ID NO: 7690848 - DNA, 22 bp, Homo sapiens
ccagaggagcaggctggctcca

SEQ ID NO: 7690849 - DNA, 22 bp, Homo sapiens
ccagaggagatgcctcctctgt

SEQ ID NO: 7690850 - DNA, 22 bp, Homo sapiens
ccagaggaggggggtctttctg

SEQ ID NO: 7690851 - DNA, 22 bp, Homo sapiens
ccagaggaggggggtctttctg

SEQ ID NO: 7690852 - DNA, 22 bp, Homo sapiens
ccagaggagggctctgatgagg

SEQ ID NO: 7690853 - DNA, 22 bp, Homo sapiens
ccagaggagggctctgatgagg

SEQ ID NO: 7690854 - DNA, 22 bp, Homo sapiens
ccagaggagttgaggctttggg

SEQ ID NO: 7690855 - DNA, 22 bp, Homo sapiens
ccagaggagttgaggctttggg

SEQ ID NO: 7690856 - DNA, 22 bp, Homo sapiens
ccagaggagttgaggctttggg

SEQ ID NO: 7690857 - DNA, 22 bp, Homo sapiens
ccagaggtgccacagaaagagc

SEQ ID NO: 7690858 - DNA, 22 bp, Homo sapiens
ccagaggtgccacagaaagagc

SEQ ID NO: 7690859 - DNA, 22 bp, Homo sapiens
ccagaggtgccacagaaagagc

SEQ ID NO: 7690860 - DNA, 22 bp, Homo sapiens
ccagaggagcaggctggctcca

SEQ ID NO: 7690861 - DNA, 22 bp, Homo sapiens
ccagaggagcaggctggctcca

SEQ ID NO: 7690862 - DNA, 22 bp, Homo sapiens
ccagaggagcaggctggctcca

SEQ ID NO: 7690863 - DNA, 22 bp, Homo sapiens
ccagaggagggctctgatgagg

SEQ ID NO: 7690864 - DNA, 22 bp, Homo sapiens
ccagaggagggctctgatgagg

SEQ ID NO: 7690865 - DNA, 22 bp, Homo sapiens
ccagaggagggctctgatgagg

SEQ ID NO: 7690866 - DNA, 22 bp, Homo sapiens
ccagaggagggctctgatgagg

SEQ ID NO: 7690867 - DNA, 22 bp, Homo sapiens
ccagaggagggctctgatgagg

SEQ ID NO: 7690868 - DNA, 22 bp, Homo sapiens
ccagaggagggctctgatgagg

SEQ ID NO: 7690869 - DNA, 22 bp, Homo sapiens
tctctagtataatatagcaaaa

SEQ ID NO: 7690870 - DNA, 22 bp, Homo sapiens
tctctagtattaaatatagtgt

SEQ ID NO: 7690871 - DNA, 22 bp, Homo sapiens
tctctaggttgatataaattat

SEQ ID NO: 7690872 - DNA, 22 bp, Homo sapiens
tctctagtataatatagcaaaa

SEQ ID NO: 7690873 - DNA, 22 bp, Homo sapiens
tctctagtataatatagcaaaa

SEQ ID NO: 7690874 - DNA, 19 bp, Homo sapiens
ccagaggactgttaatgaa

SEQ ID NO: 7690875 - DNA, 19 bp, Homo sapiens
ccagaggactgttaatgaa

SEQ ID NO: 7690876 - DNA, 22 bp, Homo sapiens
ccagaggacttgggggctgaat

SEQ ID NO: 7690877 - DNA, 19 bp, Homo sapiens
ccagaggactgttaatgaa

SEQ ID NO: 7690878 - DNA, 22 bp, Homo sapiens
tctctacagattccatggggaa

SEQ ID NO: 7690879 - DNA, 22 bp, Homo sapiens
tctctagacatggggaatgtca

SEQ ID NO: 7690880 - DNA, 22 bp, Homo sapiens
tctctaggcagtgtcagaatca

SEQ ID NO: 7690881 - DNA, 19 bp, Homo sapiens
tctctacactacatttcta

SEQ ID NO: 7690882 - DNA, 19 bp, Homo sapiens
tctctacactacatttcta

SEQ ID NO: 7690883 - DNA, 22 bp, Homo sapiens
tctctacacaggattcacatga

SEQ ID NO: 7690884 - DNA, 21 bp, Homo sapiens
tctctacaaattatgttaggt

SEQ ID NO: 7690885 - DNA, 22 bp, Homo sapiens
tctctaagataggaatacagtt

SEQ ID NO: 7690886 - DNA, 22 bp, Homo sapiens
tctctaacctaatgtggaggga

SEQ ID NO: 7690887 - DNA, 22 bp, Homo sapiens
tctctaataatggagagaagca

SEQ ID NO: 7690888 - DNA, 22 bp, Homo sapiens
tctctaattgacattacttgac

SEQ ID NO: 7690889 - DNA, 22 bp, Homo sapiens
tctctaattcaaccagacactt

SEQ ID NO: 7690890 - DNA, 22 bp, Homo sapiens
tctctacataacctcaatactc

SEQ ID NO: 7690891 - DNA, 22 bp, Homo sapiens
tctctacagatcctatatagaa

SEQ ID NO: 7690892 - DNA, 21 bp, Homo sapiens
tctctacactttcactaggct

SEQ ID NO: 7690893 - DNA, 22 bp, Homo sapiens
ccagatattcacttttacatgc

SEQ ID NO: 7690894 - DNA, 22 bp, Homo sapiens
ccagatatcactgccgtgttgt

SEQ ID NO: 7690895 - DNA, 22 bp, Homo sapiens
ccagatattcacttttacatgc

SEQ ID NO: 7690896 - DNA, 22 bp, Homo sapiens
ccagatcactcaaccagagctc

SEQ ID NO: 7690897 - DNA, 17 bp, Homo sapiens
ccagatcccagtcctta

SEQ ID NO: 7690898 - DNA, 17 bp, Homo sapiens
ccagatcccagtcctta

SEQ ID NO: 7690899 - DNA, 17 bp, Homo sapiens
ccagatcccagtcctta

SEQ ID NO: 7690900 - DNA, 17 bp, Homo sapiens
ccagatcccagtcctta

SEQ ID NO: 7690901 - DNA, 22 bp, Homo sapiens
ccagatccctgtttgcctctgg

SEQ ID NO: 7690902 - DNA, 22 bp, Homo sapiens
ccagatccctgtttgcctctgg

SEQ ID NO: 7690903 - DNA, 19 bp, Homo sapiens
ccagatgagcagctgagat

SEQ ID NO: 7690904 - DNA, 19 bp, Homo sapiens
ccagatgagcagctgagat

SEQ ID NO: 7690905 - DNA, 16 bp, Homo sapiens
ccagatgaatgggagt

SEQ ID NO: 7690906 - DNA, 22 bp, Homo sapiens
ccagatgagaccacactgctgg

SEQ ID NO: 7690907 - DNA, 21 bp, Homo sapiens
ccagatcctgcttcctcaccc

SEQ ID NO: 7690908 - DNA, 22 bp, Homo sapiens
ccagatcttcttttcagtgtct

SEQ ID NO: 7690909 - DNA, 22 bp, Homo sapiens
ccagaggtgctgggagaggtct

SEQ ID NO: 7690910 - DNA, 22 bp, Homo sapiens
ccagaggtgctgggagaggtct

SEQ ID NO: 7690911 - DNA, 22 bp, Homo sapiens
ccagaggtgctgggagaggtct

SEQ ID NO: 7690912 - DNA, 22 bp, Homo sapiens
ccagaggtgctgggagaggtct

SEQ ID NO: 7690913 - DNA, 22 bp, Homo sapiens
ccagaggtgctgggagaggtct

SEQ ID NO: 7690914 - DNA, 22 bp, Homo sapiens
ccagaggtgctgggagaggtct

SEQ ID NO: 7690915 - DNA, 19 bp, Homo sapiens
ccagagttggcagagcagg

SEQ ID NO: 7690916 - DNA, 22 bp, Homo sapiens
ccagaggtgctgggagaggtct

SEQ ID NO: 7690917 - DNA, 22 bp, Homo sapiens
ccagaggtgctctttggaagtg

SEQ ID NO: 7690918 - DNA, 22 bp, Homo sapiens
ccagaggtgccacagaaagagc

SEQ ID NO: 7690919 - DNA, 22 bp, Homo sapiens
ccagatagggatgagagtgcta

SEQ ID NO: 7690920 - DNA, 22 bp, Homo sapiens
ccagatagggatgagagtgcta

SEQ ID NO: 7690921 - DNA, 22 bp, Homo sapiens
ccagatagcaggtcagaagtgc

SEQ ID NO: 7690922 - DNA, 22 bp, Homo sapiens
ccagatatcactgccgtgttgt

SEQ ID NO: 7690923 - DNA, 22 bp, Homo sapiens
ccagatatcactgccgtgttgt

SEQ ID NO: 7690924 - DNA, 22 bp, Homo sapiens
ccagatagggatgagagtgcta

SEQ ID NO: 7690925 - DNA, 22 bp, Homo sapiens
ccagatagaaaagaaggcagga

SEQ ID NO: 7690926 - DNA, 22 bp, Homo sapiens
ccagatagaaaagaaggcagga

SEQ ID NO: 7690927 - DNA, 22 bp, Homo sapiens
ccagatagcaggtcagaagtgc

SEQ ID NO: 7690928 - DNA, 22 bp, Homo sapiens
ccagatagaaaagaaggcagga

SEQ ID NO: 7690929 - DNA, 22 bp, Homo sapiens
ccagataaggctttttaaaagc

SEQ ID NO: 7690930 - DNA, 22 bp, Homo sapiens
ccagagttttatacaacttttt

SEQ ID NO: 7690931 - DNA, 22 bp, Homo sapiens
ccagagttttatacaacttttt

SEQ ID NO: 7690932 - DNA, 22 bp, Homo sapiens
ccagaggtgctctttggaagtg

SEQ ID NO: 7690933 - DNA, 19 bp, Homo sapiens
tctctctgtacattagata

SEQ ID NO: 7690934 - DNA, 19 bp, Homo sapiens
tctctctgtacattagata

SEQ ID NO: 7690935 - DNA, 19 bp, Homo sapiens
tctctctgtacattagata

SEQ ID NO: 7690936 - DNA, 20 bp, Homo sapiens
tctctctggttggaggagct

SEQ ID NO: 7690937 - DNA, 20 bp, Homo sapiens
tctctctggttggaggagct

SEQ ID NO: 7690938 - DNA, 22 bp, Homo sapiens
ccagatggtttgcatgggaggg

SEQ ID NO: 7690939 - DNA, 22 bp, Homo sapiens
ccagatggtttgcatgggaggg

SEQ ID NO: 7690940 - DNA, 22 bp, Homo sapiens
ccagatggtttgcatgggaggg

SEQ ID NO: 7690941 - DNA, 22 bp, Homo sapiens
ccagatgtatgtatgagtgcat

SEQ ID NO: 7690942 - DNA, 22 bp, Homo sapiens
ccagatgtatgtatgagtgcat

SEQ ID NO: 7690943 - DNA, 20 bp, Homo sapiens
ccagatggtccctgtgaaaa

SEQ ID NO: 7690944 - DNA, 22 bp, Homo sapiens
ccagatggtccagagtctagcc

SEQ ID NO: 7690945 - DNA, 22 bp, Homo sapiens
ccagatggtccagagtctagcc

SEQ ID NO: 7690946 - DNA, 22 bp, Homo sapiens
ccagatggtccagagtctagcc

SEQ ID NO: 7690947 - DNA, 22 bp, Homo sapiens
ccagatggtatagtagggagag

SEQ ID NO: 7690948 - DNA, 22 bp, Homo sapiens
ccagatggtatagtagggagag

SEQ ID NO: 7690949 - DNA, 22 bp, Homo sapiens
ccagatggtatagtagggagag

SEQ ID NO: 7690950 - DNA, 21 bp, Homo sapiens
ccagatgcaaatgcagacatt

SEQ ID NO: 7690951 - DNA, 22 bp, Homo sapiens
ccagatgaggtcatgctgggtt

SEQ ID NO: 7690952 - DNA, 22 bp, Homo sapiens
ccagatgaggtcatgctgggtt

SEQ ID NO: 7690953 - DNA, 22 bp, Homo sapiens
ccagatggaaatgatgttctca

SEQ ID NO: 7690954 - DNA, 22 bp, Homo sapiens
ccagatggaaatgatgttctca

SEQ ID NO: 7690955 - DNA, 22 bp, Homo sapiens
ccagatggaaatgatgttctca

SEQ ID NO: 7690956 - DNA, 18 bp, Homo sapiens
ccagatggccagtctgct

SEQ ID NO: 7690957 - DNA, 18 bp, Homo sapiens
ccagatggccagtctgct

SEQ ID NO: 7690958 - DNA, 18 bp, Homo sapiens
ccagatggccagtctgct

SEQ ID NO: 7690959 - DNA, 22 bp, Homo sapiens
ccagatgggctttagcaaatga

SEQ ID NO: 7690960 - DNA, 22 bp, Homo sapiens
ccagatgggctttagcaaatga

SEQ ID NO: 7690961 - DNA, 22 bp, Homo sapiens
ccagatgggctttagcaaatga

SEQ ID NO: 7690962 - DNA, 22 bp, Homo sapiens
ccagatgggaagaagcatgact

SEQ ID NO: 7690963 - DNA, 22 bp, Homo sapiens
ccagatgggccaggggtttgtt

SEQ ID NO: 7690964 - DNA, 18 bp, Homo sapiens
ccagatggccagtctgct

SEQ ID NO: 7690965 - DNA, 18 bp, Homo sapiens
ccagatggccagtctgct

SEQ ID NO: 7690966 - DNA, 22 bp, Homo sapiens
tctcccaagggcacattcaagg

SEQ ID NO: 7690967 - DNA, 22 bp, Homo sapiens
tctcccaagggcacattcaagg

SEQ ID NO: 7690968 - DNA, 22 bp, Homo sapiens
tctcccaagggcacattcaagg

SEQ ID NO: 7690969 - DNA, 22 bp, Homo sapiens
tctcccaaggcacagaaagagt

SEQ ID NO: 7690970 - DNA, 22 bp, Homo sapiens
tctcccaagtgaccaggaaaga

SEQ ID NO: 7690971 - DNA, 22 bp, Homo sapiens
tctcccaagtgaccaggaaaga

SEQ ID NO: 7690972 - DNA, 22 bp, Homo sapiens
tctcccaagggcacattcaagg

SEQ ID NO: 7690973 - DNA, 22 bp, Homo sapiens
tctcccaagtgaccaggaaaga

SEQ ID NO: 7690974 - DNA, 22 bp, Homo sapiens
tctcccacagccgtgcttcaag

SEQ ID NO: 7690975 - DNA, 22 bp, Homo sapiens
tctcccacagtctcccatggct

SEQ ID NO: 7690976 - DNA, 22 bp, Homo sapiens
tctcctgggaggacaaggaagg

SEQ ID NO: 7690977 - DNA, 22 bp, Homo sapiens
tctcctgggaggacaaggaagg

SEQ ID NO: 7690978 - DNA, 22 bp, Homo sapiens
tctcccacagtctcccatggct

SEQ ID NO: 7690979 - DNA, 22 bp, Homo sapiens
tctcccacagccgtgcttcaag

SEQ ID NO: 7690980 - DNA, 22 bp, Homo sapiens
tctcccacagccgtgcttcaag

SEQ ID NO: 7690981 - DNA, 22 bp, Homo sapiens
tctcccacagccgtgcttcaag

SEQ ID NO: 7690982 - DNA, 22 bp, Homo sapiens
tctcccacagccgtgcttcaag

SEQ ID NO: 7690983 - DNA, 22 bp, Homo sapiens
tctctaaatacagatgtcatgg

SEQ ID NO: 7690984 - DNA, 22 bp, Homo sapiens
tctctaaagtagaaaagacccc

SEQ ID NO: 7690985 - DNA, 22 bp, Homo sapiens
tctctaaagcctggaagaggag

SEQ ID NO: 7690986 - DNA, 22 bp, Homo sapiens
tctctaaatgctctcccatccc

SEQ ID NO: 7690987 - DNA, 22 bp, Homo sapiens
tctctaacaaaggagctgctgc

SEQ ID NO: 7690988 - DNA, 22 bp, Homo sapiens
tctctaaatgattgtgtactcc

SEQ ID NO: 7690989 - DNA, 22 bp, Homo sapiens
tctctaaatgattgtgtactcc

SEQ ID NO: 7690990 - DNA, 22 bp, Homo sapiens
tctctaaatctggttcacttgc

SEQ ID NO: 7690991 - DNA, 22 bp, Homo sapiens
tctctaaatacagatgtcatgg

SEQ ID NO: 7690992 - DNA, 22 bp, Homo sapiens
tctctaaatctggttcacttgc

SEQ ID NO: 7690993 - DNA, 19 bp, Homo sapiens
tctccagtttattcttcca

SEQ ID NO: 7690994 - DNA, 19 bp, Homo sapiens
tctccagtttattcttcca

SEQ ID NO: 7690995 - DNA, 21 bp, Homo sapiens
tctccagttgacagtgtctcc

SEQ ID NO: 7690996 - DNA, 22 bp, Homo sapiens
tctccatctgtcattcttgtcc

SEQ ID NO: 7690997 - DNA, 22 bp, Homo sapiens
tctccatacttgcctttggcct

SEQ ID NO: 7690998 - DNA, 22 bp, Homo sapiens
tctccataggcagttcataaca

SEQ ID NO: 7690999 - DNA, 23 bp, Homo sapiens
tctcccaagcctggcaggggcac

SEQ ID NO: 7691000 - DNA, 21 bp, Homo sapiens
tctcccaaggaggtcctgagg

SEQ ID NO: 7691001 - DNA, 22 bp, Homo sapiens
tctcccaaggcacagaaagagt

SEQ ID NO: 7691002 - DNA, 21 bp, Homo sapiens
tctcccaaggaggtcctgagg

SEQ ID NO: 7691003 - DNA, 22 bp, Homo sapiens
tctcccaagcctggcaggggca

SEQ ID NO: 7691004 - DNA, 22 bp, Homo sapiens
tctcccaagcctggcaggggca

SEQ ID NO: 7691005 - DNA, 22 bp, Homo sapiens
tctcccaacctctggtgggtgc

SEQ ID NO: 7691006 - DNA, 22 bp, Homo sapiens
tctcccaacatgtggaggtcag

SEQ ID NO: 7691007 - DNA, 22 bp, Homo sapiens
tctcccaacatgtggaggtcag

SEQ ID NO: 7691008 - DNA, 22 bp, Homo sapiens
tctccattttatagataatgaa

SEQ ID NO: 7691009 - DNA, 22 bp, Homo sapiens
tctccattttatagataatgaa

SEQ ID NO: 7691010 - DNA, 22 bp, Homo sapiens
tctccattttatagataatgaa

SEQ ID NO: 7691011 - DNA, 22 bp, Homo sapiens
tctccattagtgggtggcagtg

SEQ ID NO: 7691012 - DNA, 22 bp, Homo sapiens
tctccattagtgggtggcagtg

SEQ ID NO: 7691013 - DNA, 23 bp, Homo sapiens
tctccagtgtctcttcattgagt

SEQ ID NO: 7691014 - DNA, 21 bp, Homo sapiens
tctccagtgcttctgcctctt

SEQ ID NO: 7691015 - DNA, 21 bp, Homo sapiens
tctccagtgcttctgcctctt

SEQ ID NO: 7691016 - DNA, 22 bp, Homo sapiens
tctccagtctcaagacattgag

SEQ ID NO: 7691017 - DNA, 22 bp, Homo sapiens
tctccagtgaatctcctcctgg

SEQ ID NO: 7691018 - DNA, 22 bp, Homo sapiens
tctccagtcccttctctgttag

SEQ ID NO: 7691019 - DNA, 22 bp, Homo sapiens
ccagaggaaaaatatctcccta

SEQ ID NO: 7691020 - DNA, 22 bp, Homo sapiens
ccagaggaattgggaaacatgt

SEQ ID NO: 7691021 - DNA, 19 bp, Homo sapiens
ccagaggactgttaatgaa

SEQ ID NO: 7691022 - DNA, 19 bp, Homo sapiens
ccagaggactgttaatgaa

SEQ ID NO: 7691023 - DNA, 19 bp, Homo sapiens
ccagaggactgttaatgaa

SEQ ID NO: 7691024 - DNA, 22 bp, Homo sapiens
ccagaggaaaaatatctcccta

SEQ ID NO: 7691025 - DNA, 22 bp, Homo sapiens
ccagaggaaaaatatctcccta

SEQ ID NO: 7691026 - DNA, 22 bp, Homo sapiens
ccagaggaaaaatatctcccta

SEQ ID NO: 7691027 - DNA, 22 bp, Homo sapiens
ccagaggaattgggaaacatgt

SEQ ID NO: 7691028 - DNA, 22 bp, Homo sapiens
ccagaggaaaaatatctcccta

SEQ ID NO: 7691029 - DNA, 22 bp, Homo sapiens
ccagaggaaaaatatctcccta

SEQ ID NO: 7691030 - DNA, 22 bp, Homo sapiens
ccagaggaaaaatatctcccta

SEQ ID NO: 7691031 - DNA, 22 bp, Homo sapiens
ccagagcttgacgtgcaacgga

SEQ ID NO: 7691032 - DNA, 22 bp, Homo sapiens
ccagagcttgacgtgcaacgga

SEQ ID NO: 7691033 - DNA, 22 bp, Homo sapiens
ccagagcttcggggcggctgta

SEQ ID NO: 7691034 - DNA, 22 bp, Homo sapiens
ccagagcttgacgtgcaacgga

SEQ ID NO: 7691035 - DNA, 22 bp, Homo sapiens
ccagagcttcggggcggctgta

SEQ ID NO: 7691036 - DNA, 22 bp, Homo sapiens
ccagagcttcggggcggctgta

SEQ ID NO: 7691037 - DNA, 22 bp, Homo sapiens
ccagagcttcggggcggctgta

SEQ ID NO: 7691038 - DNA, 18 bp, Homo sapiens
ccagagctggctcctcgc

SEQ ID NO: 7691039 - DNA, 18 bp, Homo sapiens
ccagagctggctcctcgc

SEQ ID NO: 7691040 - DNA, 18 bp, Homo sapiens
ccagagctggctcctcgc

SEQ ID NO: 7691041 - DNA, 22 bp, Homo sapiens
ccagagcttcggggcggctgta

SEQ ID NO: 7691042 - DNA, 22 bp, Homo sapiens
ccagagcttcggggcggctgta

SEQ ID NO: 7691043 - DNA, 22 bp, Homo sapiens
ccagagcttcggggcggctgta

SEQ ID NO: 7691044 - DNA, 22 bp, Homo sapiens
ccagagcttcggggcggctgta

SEQ ID NO: 7691045 - DNA, 18 bp, Homo sapiens
ccagagctggctcctcgc

SEQ ID NO: 7691046 - DNA, 18 bp, Homo sapiens
ccagagctggctcctcgc

SEQ ID NO: 7691047 - DNA, 18 bp, Homo sapiens
ccagagctggctcctcgc

SEQ ID NO: 7691048 - DNA, 22 bp, Homo sapiens
ccagagctgcatccagcaggtt

SEQ ID NO: 7691049 - DNA, 22 bp, Homo sapiens
ccagagctgcatccagcaggtt

SEQ ID NO: 7691050 - DNA, 22 bp, Homo sapiens
ccagagctgcatccagcaggtt

SEQ ID NO: 7691051 - DNA, 22 bp, Homo sapiens
ccagagctgcatccagcaggtt

SEQ ID NO: 7691052 - DNA, 22 bp, Homo sapiens
ccagagctgcaggtaaaatgct

SEQ ID NO: 7691053 - DNA, 22 bp, Homo sapiens
ccagagctgcatccagcaggtt

SEQ ID NO: 7691054 - DNA, 18 bp, Homo sapiens
ccagagctggctcctcgc

SEQ ID NO: 7691055 - DNA, 22 bp, Homo sapiens
ccagagctgcatccagcaggtt

SEQ ID NO: 7691056 - DNA, 22 bp, Homo sapiens
ccagagctgcatccagcaggtt

SEQ ID NO: 7691057 - DNA, 22 bp, Homo sapiens
ccagagctgcatccagcaggtt

SEQ ID NO: 7691058 - DNA, 22 bp, Homo sapiens
ccagagctgattcctgggactt

SEQ ID NO: 7691059 - DNA, 22 bp, Homo sapiens
ccagagctgatgggcccagggt

SEQ ID NO: 7691060 - DNA, 22 bp, Homo sapiens
ccagagctgattcctgggactt

SEQ ID NO: 7691061 - DNA, 22 bp, Homo sapiens
ccagagctgattcctgggactt

SEQ ID NO: 7691062 - DNA, 22 bp, Homo sapiens
ccagagctgattcctgggactt

SEQ ID NO: 7691063 - DNA, 22 bp, Homo sapiens
ccagagctgattcctgggactt

SEQ ID NO: 7691064 - DNA, 22 bp, Homo sapiens
ccagagctgattcctgggactt

SEQ ID NO: 7691065 - DNA, 22 bp, Homo sapiens
ccagagctgatgggcccagggt

SEQ ID NO: 7691066 - DNA, 22 bp, Homo sapiens
ccagagctgattcctgggactt

SEQ ID NO: 7691067 - DNA, 22 bp, Homo sapiens
ccagagctgattcctgggactt

SEQ ID NO: 7691068 - DNA, 22 bp, Homo sapiens
ccagaatgtgtgaaatttgatg

SEQ ID NO: 7691069 - DNA, 22 bp, Homo sapiens
ccagaatgttctagagccaccc

SEQ ID NO: 7691070 - DNA, 22 bp, Homo sapiens
ccagaattcagaaagggcataa

SEQ ID NO: 7691071 - DNA, 20 bp, Homo sapiens
ccagacagcacctgcctggt

SEQ ID NO: 7691072 - DNA, 20 bp, Homo sapiens
ccagacagcacctgcctggt

SEQ ID NO: 7691073 - DNA, 20 bp, Homo sapiens
ccagacagcacctgcctggt

SEQ ID NO: 7691074 - DNA, 20 bp, Homo sapiens
ccagacagcacctgcctggt

SEQ ID NO: 7691075 - DNA, 22 bp, Homo sapiens
ccagacagcagttaaaggacat

SEQ ID NO: 7691076 - DNA, 22 bp, Homo sapiens
ccagacagcagttaaaggacat

SEQ ID NO: 7691077 - DNA, 22 bp, Homo sapiens
ccagacagcagttaaaggacat

SEQ ID NO: 7691078 - DNA, 20 bp, Homo sapiens
ccagacagcacctgcctggt

SEQ ID NO: 7691079 - DNA, 20 bp, Homo sapiens
ccagacagcacctgcctggt

SEQ ID NO: 7691080 - DNA, 20 bp, Homo sapiens
ccagacagcacctgcctggt

SEQ ID NO: 7691081 - DNA, 22 bp, Homo sapiens
ccagagctgatgggcccagggt

SEQ ID NO: 7691082 - DNA, 22 bp, Homo sapiens
ccagagctgatgggcccagggt

SEQ ID NO: 7691083 - DNA, 20 bp, Homo sapiens
ccagagctgatggctgcccg

SEQ ID NO: 7691084 - DNA, 21 bp, Homo sapiens
ccagagcctgctgagccccct

SEQ ID NO: 7691085 - DNA, 22 bp, Homo sapiens
ccagagcctgctgagccccatt

SEQ ID NO: 7691086 - DNA, 22 bp, Homo sapiens
ccagagcctgctgagccccatt

SEQ ID NO: 7691087 - DNA, 22 bp, Homo sapiens
ccagacaggaacacacatctcc

SEQ ID NO: 7691088 - DNA, 22 bp, Homo sapiens
ccagacaggaacacacatctcc

SEQ ID NO: 7691089 - DNA, 22 bp, Homo sapiens
ccagacaggaacacacatctcc

SEQ ID NO: 7691090 - DNA, 22 bp, Homo sapiens
ccagacaggaacacacatctcc

SEQ ID NO: 7691091 - DNA, 22 bp, Homo sapiens
ccagacaggaacacacatctcc

SEQ ID NO: 7691092 - DNA, 22 bp, Homo sapiens
ccagacaggaacacacatctcc

SEQ ID NO: 7691093 - DNA, 22 bp, Homo sapiens
ccagaagagatcacagttcttg

SEQ ID NO: 7691094 - DNA, 22 bp, Homo sapiens
ccagaaaaggagctgcaggatg

SEQ ID NO: 7691095 - DNA, 22 bp, Homo sapiens
ccagaagagatcacagttcttg

SEQ ID NO: 7691096 - DNA, 22 bp, Homo sapiens
ccagaagagatcacagttcttg

SEQ ID NO: 7691097 - DNA, 22 bp, Homo sapiens
ccagaagagatcacagttcttg

SEQ ID NO: 7691098 - DNA, 22 bp, Homo sapiens
ccagaagaggacacagtgtgga

SEQ ID NO: 7691099 - DNA, 20 bp, Homo sapiens
ccagaagagatgatcatcca

SEQ ID NO: 7691100 - DNA, 20 bp, Homo sapiens
ccagaagagatgatcatcca

SEQ ID NO: 7691101 - DNA, 20 bp, Homo sapiens
ccagaagagatgatcatcca

SEQ ID NO: 7691102 - DNA, 22 bp, Homo sapiens
ccagaagaggacacagtgtgga

SEQ ID NO: 7691103 - DNA, 22 bp, Homo sapiens
ccagaagatggctcaaaccatg

SEQ ID NO: 7691104 - DNA, 22 bp, Homo sapiens
ccagaagcaaaacagacagttt

SEQ ID NO: 7691105 - DNA, 22 bp, Homo sapiens
ccagaagcaaaacagacagttt

SEQ ID NO: 7691106 - DNA, 22 bp, Homo sapiens
ccagaagaggacacagtgtgga

SEQ ID NO: 7691107 - DNA, 22 bp, Homo sapiens
ccagaagatggctcaaaccatg

SEQ ID NO: 7691108 - DNA, 22 bp, Homo sapiens
ccagaagatggctcaaaccatg

SEQ ID NO: 7691109 - DNA, 22 bp, Homo sapiens
ccagaagcaaaacagacagttt

SEQ ID NO: 7691110 - DNA, 22 bp, Homo sapiens
ccagaagcaaaacagacagttt

SEQ ID NO: 7691111 - DNA, 20 bp, Homo sapiens
ccagaagcactcttcatgtt

SEQ ID NO: 7691112 - DNA, 20 bp, Homo sapiens
ccagaagcactcttcatgtt

SEQ ID NO: 7691113 - DNA, 22 bp, Homo sapiens
ccagaagcacctccttttgtgc

SEQ ID NO: 7691114 - DNA, 22 bp, Homo sapiens
ccagaagcaaaacagacagttt

SEQ ID NO: 7691115 - DNA, 22 bp, Homo sapiens
ccagaagcttctacacaggaga

SEQ ID NO: 7691116 - DNA, 22 bp, Homo sapiens
ccagaagcttctacacaggaga

SEQ ID NO: 7691117 - DNA, 22 bp, Homo sapiens
ccagaagcttctacacaggaga

SEQ ID NO: 7691118 - DNA, 22 bp, Homo sapiens
ccagaagcttcaaggagattct

SEQ ID NO: 7691119 - DNA, 22 bp, Homo sapiens
ccagaaggcggagattgcagtg

SEQ ID NO: 7691120 - DNA, 22 bp, Homo sapiens
ccagaaggcggagattgcagtg

SEQ ID NO: 7691121 - DNA, 23 bp, Homo sapiens
ccagaaggagccacactccttgc

SEQ ID NO: 7691122 - DNA, 22 bp, Homo sapiens
ccagaaggcggagattgcagtg

SEQ ID NO: 7691123 - DNA, 22 bp, Homo sapiens
ccagaaggcggagattgcagtg

SEQ ID NO: 7691124 - DNA, 22 bp, Homo sapiens
ccagaaggcggagattgcagtg

SEQ ID NO: 7691125 - DNA, 22 bp, Homo sapiens
ccagaagcagagcctgaggcag

SEQ ID NO: 7691126 - DNA, 21 bp, Homo sapiens
ccagaagctgcttgcaggcta

SEQ ID NO: 7691127 - DNA, 21 bp, Homo sapiens
ccagaagctgcttgcaggcta

SEQ ID NO: 7691128 - DNA, 21 bp, Homo sapiens
ccagaagctgcttgcaggcta

SEQ ID NO: 7691129 - DNA, 21 bp, Homo sapiens
ccagaagctgcttgcaggcta

SEQ ID NO: 7691130 - DNA, 22 bp, Homo sapiens
ccagaatagaatgaaagaaggg

SEQ ID NO: 7691131 - DNA, 22 bp, Homo sapiens
ccagaataggagtaataaaacc

SEQ ID NO: 7691132 - DNA, 22 bp, Homo sapiens
ccagaataggagtaataaaacc

SEQ ID NO: 7691133 - DNA, 22 bp, Homo sapiens
ccagaatcatcatctgaagcct

SEQ ID NO: 7691134 - DNA, 22 bp, Homo sapiens
ccagaatccaaaacgttttgag

SEQ ID NO: 7691135 - DNA, 22 bp, Homo sapiens
ccagaatcccattgtcacttca

SEQ ID NO: 7691136 - DNA, 22 bp, Homo sapiens
ccagaagtgtctatcaagatgt

SEQ ID NO: 7691137 - DNA, 22 bp, Homo sapiens
ccagaagtgtctatcaagatgt

SEQ ID NO: 7691138 - DNA, 22 bp, Homo sapiens
ccagaagtgtctatcaagatgt

SEQ ID NO: 7691139 - DNA, 22 bp, Homo sapiens
ccagaagtcaggaatgagtctt

SEQ ID NO: 7691140 - DNA, 22 bp, Homo sapiens
ccagaagtcaatgcagatgtga

SEQ ID NO: 7691141 - DNA, 22 bp, Homo sapiens
ccagaagtggctttctcaggga

SEQ ID NO: 7691142 - DNA, 22 bp, Homo sapiens
ccagaagtggctttctcaggga

SEQ ID NO: 7691143 - DNA, 22 bp, Homo sapiens
ccagaagtggctttctcaggga

SEQ ID NO: 7691144 - DNA, 22 bp, Homo sapiens
ccagaagtgtctatcaagatgt

SEQ ID NO: 7691145 - DNA, 22 bp, Homo sapiens
ccagaagttcctaagcatcatt

SEQ ID NO: 7691146 - DNA, 22 bp, Homo sapiens
ccagaagttcctaagcatcatt

SEQ ID NO: 7691147 - DNA, 22 bp, Homo sapiens
ccagaagttcctaagcatcatt

SEQ ID NO: 7691148 - DNA, 22 bp, Homo sapiens
ccagaatagaatgaaagaaggg

SEQ ID NO: 7691149 - DNA, 22 bp, Homo sapiens
ccagaatagaaggcagctgtca

SEQ ID NO: 7691150 - DNA, 20 bp, Homo sapiens
ccagaaggtaggatggaaca

SEQ ID NO: 7691151 - DNA, 22 bp, Homo sapiens
ccagaagtcaagtaagatgaag

SEQ ID NO: 7691152 - DNA, 22 bp, Homo sapiens
ccagaagtcaagtaagatgaag

SEQ ID NO: 7691153 - DNA, 22 bp, Homo sapiens
ccagaagtcaatgcagatgtga

SEQ ID NO: 7691154 - DNA, 22 bp, Homo sapiens
ccagaagtcaggaatgagtctt

SEQ ID NO: 7691155 - DNA, 20 bp, Homo sapiens
ccagaaggtaggatggaaca

SEQ ID NO: 7691156 - DNA, 20 bp, Homo sapiens
ccagaaggtaggatggaaca

SEQ ID NO: 7691157 - DNA, 20 bp, Homo sapiens
ccagaaggtttgccactttc

SEQ ID NO: 7691158 - DNA, 22 bp, Homo sapiens
ccagaagtcaagtaagatgaag

SEQ ID NO: 7691159 - DNA, 20 bp, Homo sapiens
ccagaaggtaggatggaaca

SEQ ID NO: 7691160 - DNA, 22 bp, Homo sapiens
ccagaagggctattgcagtgac

SEQ ID NO: 7691161 - DNA, 22 bp, Homo sapiens
ccagaagggctattgcagtgac

SEQ ID NO: 7691162 - DNA, 22 bp, Homo sapiens
ccagaagggctattgcagtgac

SEQ ID NO: 7691163 - DNA, 19 bp, Homo sapiens
ccagaagggcagctatgga

SEQ ID NO: 7691164 - DNA, 22 bp, Homo sapiens
ccagaagggctattgcagtgac

SEQ ID NO: 7691165 - DNA, 19 bp, Homo sapiens
ccagaagggcagctatgga

SEQ ID NO: 7691166 - DNA, 22 bp, Homo sapiens
ccagaagggctattgcagtgac

SEQ ID NO: 7691167 - DNA, 22 bp, Homo sapiens
ccagaagggctattgcagtgac

SEQ ID NO: 7691168 - DNA, 22 bp, Homo sapiens
ccagaagggctattgcagtgac

SEQ ID NO: 7691169 - DNA, 22 bp, Homo sapiens
ccagaaaagcatctggttcttt

SEQ ID NO: 7691170 - DNA, 22 bp, Homo sapiens
ccagaaaaggagctgcaggatg

SEQ ID NO: 7691171 - DNA, 22 bp, Homo sapiens
ccagaaaaggagctgcaggatg

SEQ ID NO: 7691172 - DNA, 22 bp, Homo sapiens
ccagaaaaggagctgcaggatg

SEQ ID NO: 7691173 - DNA, 22 bp, Homo sapiens
ccactgcctgacttagatgaca

SEQ ID NO: 7691174 - DNA, 22 bp, Homo sapiens
ccagaaaactctacatgcttgt

SEQ ID NO: 7691175 - DNA, 22 bp, Homo sapiens
ccagaaaactctacatgcttgt

SEQ ID NO: 7691176 - DNA, 22 bp, Homo sapiens
ccagaaaactctacatgcttgt

SEQ ID NO: 7691177 - DNA, 22 bp, Homo sapiens
ccagaaaagcatctggttcttt

SEQ ID NO: 7691178 - DNA, 22 bp, Homo sapiens
ccagaaaagcatctggttcttt

SEQ ID NO: 7691179 - DNA, 22 bp, Homo sapiens
ccagaaaagcatctggttcttt

SEQ ID NO: 7691180 - DNA, 22 bp, Homo sapiens
ccactgcctctccagggccatc

SEQ ID NO: 7691181 - DNA, 22 bp, Homo sapiens
ccactgcctctccagggccatc

SEQ ID NO: 7691182 - DNA, 22 bp, Homo sapiens
ccactgcctctccagggccatc

SEQ ID NO: 7691183 - DNA, 22 bp, Homo sapiens
ccactgccgtgggccttgggga

SEQ ID NO: 7691184 - DNA, 22 bp, Homo sapiens
ccactgccgtgggccttgggga

SEQ ID NO: 7691185 - DNA, 22 bp, Homo sapiens
ccactgccgtgggccttgggga

SEQ ID NO: 7691186 - DNA, 22 bp, Homo sapiens
ccactgccgtgggccttgggga

SEQ ID NO: 7691187 - DNA, 22 bp, Homo sapiens
ccactgcctatttgcagggccc

SEQ ID NO: 7691188 - DNA, 22 bp, Homo sapiens
ccactgcctatttgcagggccc

SEQ ID NO: 7691189 - DNA, 22 bp, Homo sapiens
ccactgccctgcaaaagctgga

SEQ ID NO: 7691190 - DNA, 22 bp, Homo sapiens
ccactgccccctgaagaccagg

SEQ ID NO: 7691191 - DNA, 22 bp, Homo sapiens
ccactgccgtgggccttgggga

SEQ ID NO: 7691192 - DNA, 22 bp, Homo sapiens
ccactgccccctgaagaccagg

SEQ ID NO: 7691193 - DNA, 22 bp, Homo sapiens
ccactgcccaccccgacgtcta

SEQ ID NO: 7691194 - DNA, 22 bp, Homo sapiens
ccactgcccaccccgacgtcta

SEQ ID NO: 7691195 - DNA, 22 bp, Homo sapiens
ccactgccatgggctaggcatg

SEQ ID NO: 7691196 - DNA, 22 bp, Homo sapiens
ccactgccatgggctaggcatg

SEQ ID NO: 7691197 - DNA, 22 bp, Homo sapiens
ccactgccatgggctaggcatg

SEQ ID NO: 7691198 - DNA, 22 bp, Homo sapiens
ccactgccagctttgtcctccc

SEQ ID NO: 7691199 - DNA, 22 bp, Homo sapiens
ccactgccagctttgtcctccc

SEQ ID NO: 7691200 - DNA, 22 bp, Homo sapiens
ccactgccagctttgtcctccc

SEQ ID NO: 7691201 - DNA, 22 bp, Homo sapiens
ccactgccagccgcccggaggc

SEQ ID NO: 7691202 - DNA, 22 bp, Homo sapiens
ccactgccagccgcccggaggc

SEQ ID NO: 7691203 - DNA, 22 bp, Homo sapiens
ccactgcacttcagcctgggtg

SEQ ID NO: 7691204 - DNA, 22 bp, Homo sapiens
ccactgcacttcagcctgggtg

SEQ ID NO: 7691205 - DNA, 22 bp, Homo sapiens
ccactgcacttcagcctgggtg

SEQ ID NO: 7691206 - DNA, 22 bp, Homo sapiens
ccactgcacttcagcctgggtg

SEQ ID NO: 7691207 - DNA, 22 bp, Homo sapiens
ccactgcactccagcctgccaa

SEQ ID NO: 7691208 - DNA, 22 bp, Homo sapiens
ccactgcactccagccttggca

SEQ ID NO: 7691209 - DNA, 22 bp, Homo sapiens
ccactgcactccagccttggca

SEQ ID NO: 7691210 - DNA, 22 bp, Homo sapiens
ccactgcactccagccttggca

SEQ ID NO: 7691211 - DNA, 23 bp, Homo sapiens
ccactgatgcattttctctctgt

SEQ ID NO: 7691212 - DNA, 22 bp, Homo sapiens
ccactgatcctgactttggagc

SEQ ID NO: 7691213 - DNA, 22 bp, Homo sapiens
ccactgagtgagcagagcaggg

SEQ ID NO: 7691214 - DNA, 22 bp, Homo sapiens
ccactgagtgagcagagcaggg

SEQ ID NO: 7691215 - DNA, 22 bp, Homo sapiens
ccactgagtacccgatggctgc

SEQ ID NO: 7691216 - DNA, 22 bp, Homo sapiens
ccactgagtacccgatggctgc

SEQ ID NO: 7691217 - DNA, 22 bp, Homo sapiens
ccactgagtacccgatggctgc

SEQ ID NO: 7691218 - DNA, 22 bp, Homo sapiens
ccactgagtacccgatggctgc

SEQ ID NO: 7691219 - DNA, 22 bp, Homo sapiens
ccactgaggaggtgaggacaga

SEQ ID NO: 7691220 - DNA, 22 bp, Homo sapiens
ccactgaggaacatgggctcca

SEQ ID NO: 7691221 - DNA, 22 bp, Homo sapiens
ccactgagcagtagctgcgtcg

SEQ ID NO: 7691222 - DNA, 22 bp, Homo sapiens
ccactgagcagtagctgcgtcg

SEQ ID NO: 7691223 - DNA, 21 bp, Homo sapiens
ccactgagcattgttatgaag

SEQ ID NO: 7691224 - DNA, 21 bp, Homo sapiens
ccactgagcattgttatgaag

SEQ ID NO: 7691225 - DNA, 22 bp, Homo sapiens
ccactgagaccttttggaggag

SEQ ID NO: 7691226 - DNA, 22 bp, Homo sapiens
ccactgagcagtagctgcgtcg

SEQ ID NO: 7691227 - DNA, 22 bp, Homo sapiens
ccactgaggcctgggcccaggg

SEQ ID NO: 7691228 - DNA, 22 bp, Homo sapiens
ccactgaggcctgggcccaggg

SEQ ID NO: 7691229 - DNA, 19 bp, Homo sapiens
ccactgaggcttggttctt

SEQ ID NO: 7691230 - DNA, 22 bp, Homo sapiens
ccactgaggcctgggcccaggg

SEQ ID NO: 7691231 - DNA, 22 bp, Homo sapiens
ccactgaggggtcatggtggga

SEQ ID NO: 7691232 - DNA, 22 bp, Homo sapiens
ccactgaggggtcatggtggga

SEQ ID NO: 7691233 - DNA, 22 bp, Homo sapiens
ccactgaggggtcatggtggga

SEQ ID NO: 7691234 - DNA, 22 bp, Homo sapiens
ccactgaggggtcatggtggga

SEQ ID NO: 7691235 - DNA, 22 bp, Homo sapiens
ccactgaggttttgtggttatg

SEQ ID NO: 7691236 - DNA, 22 bp, Homo sapiens
ccactgaggttttgtggttatg

SEQ ID NO: 7691237 - DNA, 22 bp, Homo sapiens
tcctggtgcctggagctctcca

SEQ ID NO: 7691238 - DNA, 22 bp, Homo sapiens
tcctggtgcctggagctctcca

SEQ ID NO: 7691239 - DNA, 19 bp, Homo sapiens
tcctggtgcttgacactga

SEQ ID NO: 7691240 - DNA, 19 bp, Homo sapiens
tcctggtgcttgacactga

SEQ ID NO: 7691241 - DNA, 22 bp, Homo sapiens
tcctggtgaggctagaagtgtc

SEQ ID NO: 7691242 - DNA, 22 bp, Homo sapiens
tcctggtgaggctagaagtgtc

SEQ ID NO: 7691243 - DNA, 19 bp, Homo sapiens
tcctggtgaccctgaaatt

SEQ ID NO: 7691244 - DNA, 23 bp, Homo sapiens
tcctggtgacatgcctgagcatc

SEQ ID NO: 7691245 - DNA, 23 bp, Homo sapiens
tcctggtgacatgcctgagcatc

SEQ ID NO: 7691246 - DNA, 23 bp, Homo sapiens
tcctggtgacatgcctgagcatc

SEQ ID NO: 7691247 - DNA, 23 bp, Homo sapiens
tcctggtgacatgcctgagcatc

SEQ ID NO: 7691248 - DNA, 23 bp, Homo sapiens
tcctggtgacatgcctgagcatc

SEQ ID NO: 7691249 - DNA, 22 bp, Homo sapiens
tcctggtcttcaggttgcaaaa

SEQ ID NO: 7691250 - DNA, 22 bp, Homo sapiens
tcctggtctacactgcattggg

SEQ ID NO: 7691251 - DNA, 22 bp, Homo sapiens
tcctggtctacactgcattggg

SEQ ID NO: 7691252 - DNA, 22 bp, Homo sapiens
tcctggtcagtgccaaactggt

SEQ ID NO: 7691253 - DNA, 20 bp, Homo sapiens
tcctggtcatgtggctgggc

SEQ ID NO: 7691254 - DNA, 20 bp, Homo sapiens
tcctggtcatgtggctgggc

SEQ ID NO: 7691255 - DNA, 20 bp, Homo sapiens
tcctggtcatgtggctgggc

SEQ ID NO: 7691256 - DNA, 20 bp, Homo sapiens
tcctggtcatgtggctgggc

SEQ ID NO: 7691257 - DNA, 22 bp, Homo sapiens
tcctggtctacactgcattggg

SEQ ID NO: 7691258 - DNA, 22 bp, Homo sapiens
tcctggggagggttctggctcc

SEQ ID NO: 7691259 - DNA, 22 bp, Homo sapiens
tcctggggagggttctggctcc

SEQ ID NO: 7691260 - DNA, 22 bp, Homo sapiens
tcctggggagggttctggctcc

SEQ ID NO: 7691261 - DNA, 22 bp, Homo sapiens
tcctggggagggttctggctcc

SEQ ID NO: 7691262 - DNA, 22 bp, Homo sapiens
tcctggggagggttctggctcc

SEQ ID NO: 7691263 - DNA, 22 bp, Homo sapiens
tcctggtgctgacacccatagc

SEQ ID NO: 7691264 - DNA, 20 bp, Homo sapiens
tcctggtggatactgcttaa

SEQ ID NO: 7691265 - DNA, 18 bp, Homo sapiens
tcctggtggagaagtggt

SEQ ID NO: 7691266 - DNA, 22 bp, Homo sapiens
tcctggtgcttgtatttgaagt

SEQ ID NO: 7691267 - DNA, 18 bp, Homo sapiens
tcctggtggagaagtggt

SEQ ID NO: 7691268 - DNA, 18 bp, Homo sapiens
tcctggtggagaagtggt

SEQ ID NO: 7691269 - DNA, 22 bp, Homo sapiens
tcctggtggatagaagccaagg

SEQ ID NO: 7691270 - DNA, 22 bp, Homo sapiens
ccacaggggtctctgtagctga

SEQ ID NO: 7691271 - DNA, 22 bp, Homo sapiens
ccacagggtcagccactctgca

SEQ ID NO: 7691272 - DNA, 22 bp, Homo sapiens
ccacagggtcagccactctgca

SEQ ID NO: 7691273 - DNA, 22 bp, Homo sapiens
ccacagggtgtcatcagcttga

SEQ ID NO: 7691274 - DNA, 22 bp, Homo sapiens
ccacagggtcagccactctgca

SEQ ID NO: 7691275 - DNA, 22 bp, Homo sapiens
ccacagggtcagccactctgca

SEQ ID NO: 7691276 - DNA, 22 bp, Homo sapiens
ccacagggtcagccactctgca

SEQ ID NO: 7691277 - DNA, 22 bp, Homo sapiens
ccacaggtacggattgaggacc

SEQ ID NO: 7691278 - DNA, 22 bp, Homo sapiens
ccacaggtacggattgaggacc

SEQ ID NO: 7691279 - DNA, 22 bp, Homo sapiens
ccacagggtgtcatcagcttga

SEQ ID NO: 7691280 - DNA, 22 bp, Homo sapiens
ccacagggtgtcatcagcttga

SEQ ID NO: 7691281 - DNA, 22 bp, Homo sapiens
ccacagtacaggaaatcttgtt

SEQ ID NO: 7691282 - DNA, 22 bp, Homo sapiens
ccacagtaagagatagtttatg

SEQ ID NO: 7691283 - DNA, 22 bp, Homo sapiens
ccacagtacaggaaatcttgtt

SEQ ID NO: 7691284 - DNA, 22 bp, Homo sapiens
ccacagtaagagatagtttatg

SEQ ID NO: 7691285 - DNA, 16 bp, Homo sapiens
ccacagtaagaaatac

SEQ ID NO: 7691286 - DNA, 22 bp, Homo sapiens
ccacagtaaatggattcagacc

SEQ ID NO: 7691287 - DNA, 22 bp, Homo sapiens
ccacagtaactgttttgtaccg

SEQ ID NO: 7691288 - DNA, 22 bp, Homo sapiens
ccacagtaaatggattcagacc

SEQ ID NO: 7691289 - DNA, 22 bp, Homo sapiens
ccacagtaaagaaacaacttcg

SEQ ID NO: 7691290 - DNA, 16 bp, Homo sapiens
ccacaggtgtcctgca

SEQ ID NO: 7691291 - DNA, 22 bp, Homo sapiens
ccacaggtacggattgaggacc

SEQ ID NO: 7691292 - DNA, 22 bp, Homo sapiens
ccactctgatttcaagggagat

SEQ ID NO: 7691293 - DNA, 22 bp, Homo sapiens
ccactctgatttcaagggagat

SEQ ID NO: 7691294 - DNA, 21 bp, Homo sapiens
ccactctgagtgttgaacaga

SEQ ID NO: 7691295 - DNA, 22 bp, Homo sapiens
ccactctgattggtcacctctg

SEQ ID NO: 7691296 - DNA, 22 bp, Homo sapiens
ccactctgattggtcacctctg

SEQ ID NO: 7691297 - DNA, 22 bp, Homo sapiens
ccactctgattggtcacctctg

SEQ ID NO: 7691298 - DNA, 23 bp, Homo sapiens
ccactctcccaccatatctgtat

SEQ ID NO: 7691299 - DNA, 16 bp, Homo sapiens
ccacctgcagctctca

SEQ ID NO: 7691300 - DNA, 23 bp, Homo sapiens
ccacctggactctgggcaggtgc

SEQ ID NO: 7691301 - DNA, 23 bp, Homo sapiens
ccactctcccaccatatctgtat

SEQ ID NO: 7691302 - DNA, 21 bp, Homo sapiens
ccactctgagtgttgaacaga

SEQ ID NO: 7691303 - DNA, 21 bp, Homo sapiens
ccactctgagtgttgaacaga

SEQ ID NO: 7691304 - DNA, 22 bp, Homo sapiens
ccactctgattttggctccact

SEQ ID NO: 7691305 - DNA, 22 bp, Homo sapiens
ccactctgattttggctccact

SEQ ID NO: 7691306 - DNA, 22 bp, Homo sapiens
ccactctgattttggctccact

SEQ ID NO: 7691307 - DNA, 22 bp, Homo sapiens
ccactctgattttggctccact

SEQ ID NO: 7691308 - DNA, 22 bp, Homo sapiens
ccactctgattttggctccact

SEQ ID NO: 7691309 - DNA, 22 bp, Homo sapiens
ccactctgctgtgctccatgat

SEQ ID NO: 7691310 - DNA, 22 bp, Homo sapiens
ccactctgctgtgctccatgat

SEQ ID NO: 7691311 - DNA, 22 bp, Homo sapiens
ccactctgctgtgctccatgat

SEQ ID NO: 7691312 - DNA, 22 bp, Homo sapiens
ccactctgctgtgctccatgat

SEQ ID NO: 7691313 - DNA, 22 bp, Homo sapiens
ccactctgctgtgctccatgat

SEQ ID NO: 7691314 - DNA, 17 bp, Homo sapiens
ccactgactctgacttc

SEQ ID NO: 7691315 - DNA, 22 bp, Homo sapiens
ccactgagaagcacagcttgtc

SEQ ID NO: 7691316 - DNA, 22 bp, Homo sapiens
ccactgagaagcacagcttgtc

SEQ ID NO: 7691317 - DNA, 22 bp, Homo sapiens
ccactgagaaggggttggggtc

SEQ ID NO: 7691318 - DNA, 22 bp, Homo sapiens
ccactgagaaggggttggggtc

SEQ ID NO: 7691319 - DNA, 22 bp, Homo sapiens
ccactgactccaggagctgagg

SEQ ID NO: 7691320 - DNA, 22 bp, Homo sapiens
ccactgacacagacaaggcctg

SEQ ID NO: 7691321 - DNA, 22 bp, Homo sapiens
ccactgacacagacaaggcctg

SEQ ID NO: 7691322 - DNA, 22 bp, Homo sapiens
ccactctgctgtgctccatgat

SEQ ID NO: 7691323 - DNA, 22 bp, Homo sapiens
ccactgaaaaatttgagatgga

SEQ ID NO: 7691324 - DNA, 22 bp, Homo sapiens
ccactgaaaaatttgagatgga

SEQ ID NO: 7691325 - DNA, 22 bp, Homo sapiens
ccactcttgaatcaagagctca

SEQ ID NO: 7691326 - DNA, 22 bp, Homo sapiens
ccactgaaggtcaacatagagc

SEQ ID NO: 7691327 - DNA, 22 bp, Homo sapiens
ccactgaaggtcaacatagagc

SEQ ID NO: 7691328 - DNA, 23 bp, Homo sapiens
ccactgaagaatccagggagttt

SEQ ID NO: 7691329 - DNA, 23 bp, Homo sapiens
ccactgaagaatccagggagttt

SEQ ID NO: 7691330 - DNA, 23 bp, Homo sapiens
ccactgaagaatccagggagttt

SEQ ID NO: 7691331 - DNA, 22 bp, Homo sapiens
ccacagtgagttctgtactctg

SEQ ID NO: 7691332 - DNA, 22 bp, Homo sapiens
ccacagtgagttctgtactctg

SEQ ID NO: 7691333 - DNA, 22 bp, Homo sapiens
ccacagtgagttctgtactctg

SEQ ID NO: 7691334 - DNA, 22 bp, Homo sapiens
ccacagtgagttctgtactctg

SEQ ID NO: 7691335 - DNA, 22 bp, Homo sapiens
ccacagtgagttctgtactctg

SEQ ID NO: 7691336 - DNA, 16 bp, Homo sapiens
ccacctgcagctctca

SEQ ID NO: 7691337 - DNA, 16 bp, Homo sapiens
ccacctgcagctctca

SEQ ID NO: 7691338 - DNA, 22 bp, Homo sapiens
ccacctgctggttttgctctcc

SEQ ID NO: 7691339 - DNA, 16 bp, Homo sapiens
ccacctgcagctctca

SEQ ID NO: 7691340 - DNA, 16 bp, Homo sapiens
ccacctgcagctctca

SEQ ID NO: 7691341 - DNA, 16 bp, Homo sapiens
ccacctgcagctctca

SEQ ID NO: 7691342 - DNA, 22 bp, Homo sapiens
ccacagtgagttagattgacca

SEQ ID NO: 7691343 - DNA, 22 bp, Homo sapiens
ccacagtgagtgtcatacttgg

SEQ ID NO: 7691344 - DNA, 22 bp, Homo sapiens
ccacagtgagttagattgacca

SEQ ID NO: 7691345 - DNA, 22 bp, Homo sapiens
ccacagtgagttagattgacca

SEQ ID NO: 7691346 - DNA, 22 bp, Homo sapiens
ccacagtgagtgtcatacttgg

SEQ ID NO: 7691347 - DNA, 22 bp, Homo sapiens
ccacagtgacacgggctggccc

SEQ ID NO: 7691348 - DNA, 22 bp, Homo sapiens
ccacagtgagtgtcatacttgg

SEQ ID NO: 7691349 - DNA, 22 bp, Homo sapiens
ccacagtgagtgtcatacttgg

SEQ ID NO: 7691350 - DNA, 22 bp, Homo sapiens
ccacagtgacacgggctggccc

SEQ ID NO: 7691351 - DNA, 22 bp, Homo sapiens
ccacagtgacacgggctggccc

SEQ ID NO: 7691352 - DNA, 22 bp, Homo sapiens
ccacagtgacacgggctggccc

SEQ ID NO: 7691353 - DNA, 22 bp, Homo sapiens
ccacagtgacacgggctggccc

SEQ ID NO: 7691354 - DNA, 22 bp, Homo sapiens
ccacagtgacacgggctggccc

SEQ ID NO: 7691355 - DNA, 22 bp, Homo sapiens
ccacagtgacacgggctggccc

SEQ ID NO: 7691356 - DNA, 22 bp, Homo sapiens
ccacagtccgggctggcaggac

SEQ ID NO: 7691357 - DNA, 22 bp, Homo sapiens
ccacagtccgggctggcaggac

SEQ ID NO: 7691358 - DNA, 22 bp, Homo sapiens
ccacagtaggaacaagttgtcg

SEQ ID NO: 7691359 - DNA, 22 bp, Homo sapiens
ccacagtaggaacaagttgtcg

SEQ ID NO: 7691360 - DNA, 22 bp, Homo sapiens
ccacagtagcatccaaacagta

SEQ ID NO: 7691361 - DNA, 22 bp, Homo sapiens
ccacagtagcatccaaacagta

SEQ ID NO: 7691362 - DNA, 22 bp, Homo sapiens
ccacagtagcatccaaacagta

SEQ ID NO: 7691363 - DNA, 22 bp, Homo sapiens
ccacagtagaattcatctccct

SEQ ID NO: 7691364 - DNA, 22 bp, Homo sapiens
ccacagtagaattcatctccct

SEQ ID NO: 7691365 - DNA, 22 bp, Homo sapiens
ccacagtagaattcatctccct

SEQ ID NO: 7691366 - DNA, 22 bp, Homo sapiens
ccacagtccgggctggcaggac

SEQ ID NO: 7691367 - DNA, 22 bp, Homo sapiens
ccacagtctagctagaaggcat

SEQ ID NO: 7691368 - DNA, 22 bp, Homo sapiens
ccacagtctatgcaacaaggtc

SEQ ID NO: 7691369 - DNA, 22 bp, Homo sapiens
ccacagtctatgcaacaaggtc

SEQ ID NO: 7691370 - DNA, 22 bp, Homo sapiens
ccacagtgaaatcttgatggag

SEQ ID NO: 7691371 - DNA, 22 bp, Homo sapiens
ccacagtgaaatcttgatggag

SEQ ID NO: 7691372 - DNA, 22 bp, Homo sapiens
ccacagtgaaatcttgatggag

SEQ ID NO: 7691373 - DNA, 22 bp, Homo sapiens
ccacagtgaaatcttgatggag

SEQ ID NO: 7691374 - DNA, 23 bp, Homo sapiens
ccacagctatagggtagtgcagt

SEQ ID NO: 7691375 - DNA, 22 bp, Homo sapiens
ccacagctagggcaatctgatt

SEQ ID NO: 7691376 - DNA, 23 bp, Homo sapiens
ccacagctatagggtagtgcagt

SEQ ID NO: 7691377 - DNA, 22 bp, Homo sapiens
ccacagcggcgggagcgcgggt

SEQ ID NO: 7691378 - DNA, 23 bp, Homo sapiens
ccacagctatagggtagtgcagt

SEQ ID NO: 7691379 - DNA, 22 bp, Homo sapiens
ccacagctcctcagcctctttc

SEQ ID NO: 7691380 - DNA, 22 bp, Homo sapiens
ccacagctctagctccctccca

SEQ ID NO: 7691381 - DNA, 22 bp, Homo sapiens
ccacagctcctcagcctctttc

SEQ ID NO: 7691382 - DNA, 22 bp, Homo sapiens
ccacagctcctcagcctctttc

SEQ ID NO: 7691383 - DNA, 22 bp, Homo sapiens
ccacagctcctcagcctctttc

SEQ ID NO: 7691384 - DNA, 22 bp, Homo sapiens
ccacagctgacaatggatagac

SEQ ID NO: 7691385 - DNA, 22 bp, Homo sapiens
ccacagctgaaagcagaggctc

SEQ ID NO: 7691386 - DNA, 22 bp, Homo sapiens
tcctggggagggttctggctcc

SEQ ID NO: 7691387 - DNA, 22 bp, Homo sapiens
tcctggggagggttctggctcc

SEQ ID NO: 7691388 - DNA, 22 bp, Homo sapiens
tcctggggagggttctggctcc

SEQ ID NO: 7691389 - DNA, 22 bp, Homo sapiens
tcctggggagggttctggctcc

SEQ ID NO: 7691390 - DNA, 22 bp, Homo sapiens
ccacagctgaaagcagaggctc

SEQ ID NO: 7691391 - DNA, 22 bp, Homo sapiens
ccacagctgaaagcagaggctc

SEQ ID NO: 7691392 - DNA, 22 bp, Homo sapiens
ccacagctgaaagcagaggctc

SEQ ID NO: 7691393 - DNA, 22 bp, Homo sapiens
ccacagctctagctccctccca

SEQ ID NO: 7691394 - DNA, 22 bp, Homo sapiens
ccacagctgaaagcagaggctc

SEQ ID NO: 7691395 - DNA, 22 bp, Homo sapiens
ccacagccattccagggaggct

SEQ ID NO: 7691396 - DNA, 22 bp, Homo sapiens
ccacagccattccagggaggct

SEQ ID NO: 7691397 - DNA, 17 bp, Homo sapiens
ccacagcctggcacttg

SEQ ID NO: 7691398 - DNA, 17 bp, Homo sapiens
ccacagcctggcacttg

SEQ ID NO: 7691399 - DNA, 19 bp, Homo sapiens
ccacagcctgctgtcttcc

SEQ ID NO: 7691400 - DNA, 19 bp, Homo sapiens
ccacagcctgctgtcttcc

SEQ ID NO: 7691401 - DNA, 19 bp, Homo sapiens
ccacagcctgctgtcttcc

SEQ ID NO: 7691402 - DNA, 22 bp, Homo sapiens
ccacagccattccagggaggct

SEQ ID NO: 7691403 - DNA, 22 bp, Homo sapiens
ccacagccattccagggaggct

SEQ ID NO: 7691404 - DNA, 23 bp, Homo sapiens
ccacagcgaggtaggtgtgggag

SEQ ID NO: 7691405 - DNA, 23 bp, Homo sapiens
ccacagcgaggtaggtgtgggag

SEQ ID NO: 7691406 - DNA, 17 bp, Homo sapiens
ccacagcctggcacttg

SEQ ID NO: 7691407 - DNA, 18 bp, Homo sapiens
ccacagcggaatggacat

SEQ ID NO: 7691408 - DNA, 22 bp, Homo sapiens
ccacagctagggcaatctgatt

SEQ ID NO: 7691409 - DNA, 17 bp, Homo sapiens
ccacagcctggcacttg

SEQ ID NO: 7691410 - DNA, 17 bp, Homo sapiens
ccacagcctggcacttg

SEQ ID NO: 7691411 - DNA, 17 bp, Homo sapiens
ccacagcctggcacttg

SEQ ID NO: 7691412 - DNA, 17 bp, Homo sapiens
ccacagcctggcacttg

SEQ ID NO: 7691413 - DNA, 22 bp, Homo sapiens
ccacagcatgcaggcctgacac

SEQ ID NO: 7691414 - DNA, 22 bp, Homo sapiens
ccacagcatgcaggcctgacac

SEQ ID NO: 7691415 - DNA, 22 bp, Homo sapiens
ccacagcaggactggagccgcc

SEQ ID NO: 7691416 - DNA, 22 bp, Homo sapiens
ccacagcatgcaggcctgacac

SEQ ID NO: 7691417 - DNA, 22 bp, Homo sapiens
ccacagcatgcaggcctgacac

SEQ ID NO: 7691418 - DNA, 22 bp, Homo sapiens
ccacagcatgcaggcctgacac

SEQ ID NO: 7691419 - DNA, 18 bp, Homo sapiens
ccacagcagagttcttac

SEQ ID NO: 7691420 - DNA, 22 bp, Homo sapiens
ccacagcacctgcagccagttg

SEQ ID NO: 7691421 - DNA, 18 bp, Homo sapiens
ccacagcagagttcttac

SEQ ID NO: 7691422 - DNA, 18 bp, Homo sapiens
ccacagcagagttcttac

SEQ ID NO: 7691423 - DNA, 18 bp, Homo sapiens
ccacagcagagttcttac

SEQ ID NO: 7691424 - DNA, 18 bp, Homo sapiens
ccacagcagagttcttac

SEQ ID NO: 7691425 - DNA, 18 bp, Homo sapiens
ccacagcagagttcttac

SEQ ID NO: 7691426 - DNA, 22 bp, Homo sapiens
ccacagcaggactggagccgcc

SEQ ID NO: 7691427 - DNA, 22 bp, Homo sapiens
ccacagcaggactggagccgcc

SEQ ID NO: 7691428 - DNA, 22 bp, Homo sapiens
ccacagcacctgcagccagttg

SEQ ID NO: 7691429 - DNA, 22 bp, Homo sapiens
ccacagcacctgcagccagttg

SEQ ID NO: 7691430 - DNA, 22 bp, Homo sapiens
ccacagcacctgcagccagttg

SEQ ID NO: 7691431 - DNA, 22 bp, Homo sapiens
ccacagcacctgcagccagttg

SEQ ID NO: 7691432 - DNA, 22 bp, Homo sapiens
ccacagcacctgcagccagttg

SEQ ID NO: 7691433 - DNA, 22 bp, Homo sapiens
ccacagcaccgctgccagtccc

SEQ ID NO: 7691434 - DNA, 22 bp, Homo sapiens
ccacagcaccgctgccagtccc

SEQ ID NO: 7691435 - DNA, 22 bp, Homo sapiens
ccacagcaccgctgccagtccc

SEQ ID NO: 7691436 - DNA, 22 bp, Homo sapiens
ccacagcaccgctgccagtccc

SEQ ID NO: 7691437 - DNA, 22 bp, Homo sapiens
ccacagcaccgctgccagtccc

SEQ ID NO: 7691438 - DNA, 22 bp, Homo sapiens
ccacagcaccgctgccagtccc

SEQ ID NO: 7691439 - DNA, 22 bp, Homo sapiens
ccacagagttacaaaacagtca

SEQ ID NO: 7691440 - DNA, 22 bp, Homo sapiens
ccacagagttacaaaacagtca

SEQ ID NO: 7691441 - DNA, 22 bp, Homo sapiens
ccacagagttacaaaacagtca

SEQ ID NO: 7691442 - DNA, 22 bp, Homo sapiens
ccacagagttacaaaacagtca

SEQ ID NO: 7691443 - DNA, 22 bp, Homo sapiens
ccacagagttgatgcaataaga

SEQ ID NO: 7691444 - DNA, 22 bp, Homo sapiens
ccacagattatttctaaacagg

SEQ ID NO: 7691445 - DNA, 22 bp, Homo sapiens
ccacagattatttctaaacagg

SEQ ID NO: 7691446 - DNA, 22 bp, Homo sapiens
ccacagagttgatgcaataaga

SEQ ID NO: 7691447 - DNA, 22 bp, Homo sapiens
ccacagaggacaactgcctggc

SEQ ID NO: 7691448 - DNA, 22 bp, Homo sapiens
ccacagaggacaactgcctggc

SEQ ID NO: 7691449 - DNA, 22 bp, Homo sapiens
ccacagaggacaactgcctggc

SEQ ID NO: 7691450 - DNA, 22 bp, Homo sapiens
ccacagaggacaactgcctggc

SEQ ID NO: 7691451 - DNA, 22 bp, Homo sapiens
ccacagaggacaactgcctggc

SEQ ID NO: 7691452 - DNA, 22 bp, Homo sapiens
ccacagaggacaactgcctggc

SEQ ID NO: 7691453 - DNA, 22 bp, Homo sapiens
ccacagaggacaactgcctggc

SEQ ID NO: 7691454 - DNA, 22 bp, Homo sapiens
ccacagaggacaactgcctggc

SEQ ID NO: 7691455 - DNA, 19 bp, Homo sapiens
tcctgcccaccagccaggg

SEQ ID NO: 7691456 - DNA, 23 bp, Homo sapiens
ccacagagctgccaattcctgtg

SEQ ID NO: 7691457 - DNA, 23 bp, Homo sapiens
ccacagagctgccaattcctgtg

SEQ ID NO: 7691458 - DNA, 22 bp, Homo sapiens
ccacagaatgatgacacttcag

SEQ ID NO: 7691459 - DNA, 22 bp, Homo sapiens
ccacagaatgatgacacttcag

SEQ ID NO: 7691460 - DNA, 22 bp, Homo sapiens
ccacagaatgatgacacttcag

SEQ ID NO: 7691461 - DNA, 22 bp, Homo sapiens
ccacagaatgatgacacttcag

SEQ ID NO: 7691462 - DNA, 22 bp, Homo sapiens
ccacagaatcgctagtggagca

SEQ ID NO: 7691463 - DNA, 22 bp, Homo sapiens
ccacagaatcgctagtggagca

SEQ ID NO: 7691464 - DNA, 22 bp, Homo sapiens
ccacagaatcgctagtggagca

SEQ ID NO: 7691465 - DNA, 22 bp, Homo sapiens
tcctgcccacagctgctggaca

SEQ ID NO: 7691466 - DNA, 19 bp, Homo sapiens
tcctgcccaccagccaggg

SEQ ID NO: 7691467 - DNA, 19 bp, Homo sapiens
tcctgcccaccagccaggg

SEQ ID NO: 7691468 - DNA, 19 bp, Homo sapiens
tcctgcccaccagccaggg

SEQ ID NO: 7691469 - DNA, 22 bp, Homo sapiens
ccacagaatcgctagtggagca

SEQ ID NO: 7691470 - DNA, 22 bp, Homo sapiens
ccacagaatcgctagtggagca

SEQ ID NO: 7691471 - DNA, 22 bp, Homo sapiens
ccacagaatcgctagtggagca

SEQ ID NO: 7691472 - DNA, 22 bp, Homo sapiens
ccacagaatcgctagtggagca

SEQ ID NO: 7691473 - DNA, 20 bp, Homo sapiens
ccacagaggacagggctgtg

SEQ ID NO: 7691474 - DNA, 20 bp, Homo sapiens
ccacagaggacagggctgtg

SEQ ID NO: 7691475 - DNA, 20 bp, Homo sapiens
ccacagaggacagggctgtg

SEQ ID NO: 7691476 - DNA, 20 bp, Homo sapiens
ccacagaggacagggctgtg

SEQ ID NO: 7691477 - DNA, 22 bp, Homo sapiens
ccacagaggacaactgcctggc

SEQ ID NO: 7691478 - DNA, 20 bp, Homo sapiens
ccacagaggacagggctgtg

SEQ ID NO: 7691479 - DNA, 20 bp, Homo sapiens
ccacagaggacagggctgtg

SEQ ID NO: 7691480 - DNA, 20 bp, Homo sapiens
ccacagaggacagggctgtg

SEQ ID NO: 7691481 - DNA, 20 bp, Homo sapiens
ccacagaggacagggctgtg

SEQ ID NO: 7691482 - DNA, 20 bp, Homo sapiens
ccacagaggacagggctgtg

SEQ ID NO: 7691483 - DNA, 22 bp, Homo sapiens
ccacagagtccgcatttgaggc

SEQ ID NO: 7691484 - DNA, 20 bp, Homo sapiens
ccacagaggacagggctgtg

SEQ ID NO: 7691485 - DNA, 22 bp, Homo sapiens
ccacagagtccgcatttgaggc

SEQ ID NO: 7691486 - DNA, 22 bp, Homo sapiens
ccacagagtccgcatttgaggc

SEQ ID NO: 7691487 - DNA, 22 bp, Homo sapiens
ccacagagtccgcatttgaggc

SEQ ID NO: 7691488 - DNA, 22 bp, Homo sapiens
ccacagagtcttccttctcttc

SEQ ID NO: 7691489 - DNA, 22 bp, Homo sapiens
ccacagagtcttccttctcttc

SEQ ID NO: 7691490 - DNA, 22 bp, Homo sapiens
ccacagagtcttccttctcttc

SEQ ID NO: 7691491 - DNA, 22 bp, Homo sapiens
tcctgccaggagatggtagcca

SEQ ID NO: 7691492 - DNA, 22 bp, Homo sapiens
tcctgccaggagtgctggccct

SEQ ID NO: 7691493 - DNA, 22 bp, Homo sapiens
tcctgccaggagtgctggccct

SEQ ID NO: 7691494 - DNA, 22 bp, Homo sapiens
tcctgccagctggggctgcttc

SEQ ID NO: 7691495 - DNA, 22 bp, Homo sapiens
tcctgccagcccacagactcat

SEQ ID NO: 7691496 - DNA, 22 bp, Homo sapiens
tcctgccagcaggaggtggcag

SEQ ID NO: 7691497 - DNA, 22 bp, Homo sapiens
tcctgccactgcacatatactt

SEQ ID NO: 7691498 - DNA, 23 bp, Homo sapiens
tcctgccagatgactcctttctt

SEQ ID NO: 7691499 - DNA, 22 bp, Homo sapiens
tcctgccactgcacatatactt

SEQ ID NO: 7691500 - DNA, 22 bp, Homo sapiens
tcctgccatttgctttttctcc

SEQ ID NO: 7691501 - DNA, 22 bp, Homo sapiens
tcctgcccacagctgctggaca

SEQ ID NO: 7691502 - DNA, 22 bp, Homo sapiens
tcctgcccacagctgctggaca

SEQ ID NO: 7691503 - DNA, 22 bp, Homo sapiens
tcctgcccacagctgctggaca

SEQ ID NO: 7691504 - DNA, 22 bp, Homo sapiens
tcctgcccacagctgctggaca

SEQ ID NO: 7691505 - DNA, 22 bp, Homo sapiens
tcctgccaggagtgctggccct

SEQ ID NO: 7691506 - DNA, 22 bp, Homo sapiens
tcctgccaggagtgctggccct

SEQ ID NO: 7691507 - DNA, 22 bp, Homo sapiens
tcctgccatcccacccggctca

SEQ ID NO: 7691508 - DNA, 22 bp, Homo sapiens
tcctgccatcccacccggctca

SEQ ID NO: 7691509 - DNA, 22 bp, Homo sapiens
tcctgccatctgctgttgatct

SEQ ID NO: 7691510 - DNA, 22 bp, Homo sapiens
tcctgccatctgctgttgatct

SEQ ID NO: 7691511 - DNA, 22 bp, Homo sapiens
tcctgccatttgctttttctcc

SEQ ID NO: 7691512 - DNA, 22 bp, Homo sapiens
tcctgccaaaatatccctacct

SEQ ID NO: 7691513 - DNA, 20 bp, Homo sapiens
tcctgcagttcctaggaggg

SEQ ID NO: 7691514 - DNA, 20 bp, Homo sapiens
tcctgcagttcctaggaggg

SEQ ID NO: 7691515 - DNA, 20 bp, Homo sapiens
tcctgcagttcctaggaggg

SEQ ID NO: 7691516 - DNA, 20 bp, Homo sapiens
tcctgcagttcctaggaggg

SEQ ID NO: 7691517 - DNA, 20 bp, Homo sapiens
tcctgcagttcctaggaggg

SEQ ID NO: 7691518 - DNA, 20 bp, Homo sapiens
tcctgcagttcctaggaggg

SEQ ID NO: 7691519 - DNA, 22 bp, Homo sapiens
tcctgccacctgcacagctccc

SEQ ID NO: 7691520 - DNA, 22 bp, Homo sapiens
tcctgccacctgcacagctccc

SEQ ID NO: 7691521 - DNA, 22 bp, Homo sapiens
tcctgccaccgggggtggcgat

SEQ ID NO: 7691522 - DNA, 17 bp, Homo sapiens
tcctgccacctgtcagg

SEQ ID NO: 7691523 - DNA, 17 bp, Homo sapiens
tcctgccacctgtcagg

SEQ ID NO: 7691524 - DNA, 17 bp, Homo sapiens
tcctgccacctgtcagg

SEQ ID NO: 7691525 - DNA, 22 bp, Homo sapiens
tcctgccacctgcacagctccc

SEQ ID NO: 7691526 - DNA, 20 bp, Homo sapiens
tcctgccacacctcagttgc

SEQ ID NO: 7691527 - DNA, 22 bp, Homo sapiens
tcctgccacaggtgataactgg

SEQ ID NO: 7691528 - DNA, 22 bp, Homo sapiens
tcctgccaaagcatgtactggg

SEQ ID NO: 7691529 - DNA, 22 bp, Homo sapiens
tcctgccaaagcatgtactggg

SEQ ID NO: 7691530 - DNA, 20 bp, Homo sapiens
tcctgccacacctcagttgc

SEQ ID NO: 7691531 - DNA, 22 bp, Homo sapiens
tcctgcagttacatcccagcca

SEQ ID NO: 7691532 - DNA, 22 bp, Homo sapiens
tcctgcagttacatcccagcca

SEQ ID NO: 7691533 - DNA, 22 bp, Homo sapiens
tcctgcagttacatcccagcca

SEQ ID NO: 7691534 - DNA, 22 bp, Homo sapiens
tcctgcagttacatcccagcca

SEQ ID NO: 7691535 - DNA, 22 bp, Homo sapiens
tcctgcagttacatcccagcca

SEQ ID NO: 7691536 - DNA, 22 bp, Homo sapiens
ccacacagggggatgagttatt

SEQ ID NO: 7691537 - DNA, 22 bp, Homo sapiens
tcctgcagtgtgtctcctgcac

SEQ ID NO: 7691538 - DNA, 22 bp, Homo sapiens
tcctgcagtgtgtctcctgcac

SEQ ID NO: 7691539 - DNA, 22 bp, Homo sapiens
tcctgcagtgtgtctcctgcac

SEQ ID NO: 7691540 - DNA, 22 bp, Homo sapiens
tcctgcagtgtgtctcctgcac

SEQ ID NO: 7691541 - DNA, 22 bp, Homo sapiens
tcctgcagtgtgtctcctgcac

SEQ ID NO: 7691542 - DNA, 22 bp, Homo sapiens
tcctgcagtgtgtctcctgcac

SEQ ID NO: 7691543 - DNA, 22 bp, Homo sapiens
tcctgcagtgtgtctcctgcac

SEQ ID NO: 7691544 - DNA, 22 bp, Homo sapiens
tcctgcagtgtgtctcctgcac

SEQ ID NO: 7691545 - DNA, 22 bp, Homo sapiens
ccacacagataagtgttttcta

SEQ ID NO: 7691546 - DNA, 22 bp, Homo sapiens
ccacacagggggatgagttatt

SEQ ID NO: 7691547 - DNA, 22 bp, Homo sapiens
ccacacagataagtgttttcta

SEQ ID NO: 7691548 - DNA, 22 bp, Homo sapiens
ccacacagggggatgagttatt

SEQ ID NO: 7691549 - DNA, 22 bp, Homo sapiens
ccacaaggcctgtggggctgct

SEQ ID NO: 7691550 - DNA, 22 bp, Homo sapiens
ccacaaggaggacagcagttgg

SEQ ID NO: 7691551 - DNA, 22 bp, Homo sapiens
ccacaaggcctgtggggctgct

SEQ ID NO: 7691552 - DNA, 22 bp, Homo sapiens
ccacaagtgaagtacacctgcc

SEQ ID NO: 7691553 - DNA, 22 bp, Homo sapiens
ccacaagtgaagtacacctgcc

SEQ ID NO: 7691554 - DNA, 22 bp, Homo sapiens
ccacaagtttcagcacccagag

SEQ ID NO: 7691555 - DNA, 22 bp, Homo sapiens
ccacaattttatgatttaggag

SEQ ID NO: 7691556 - DNA, 23 bp, Homo sapiens
ccacaattgagagattctgcaat

SEQ ID NO: 7691557 - DNA, 22 bp, Homo sapiens
ccacaattttatgatttaggag

SEQ ID NO: 7691558 - DNA, 22 bp, Homo sapiens
ccacacagataagtgttttcta

SEQ ID NO: 7691559 - DNA, 22 bp, Homo sapiens
ccacacagataagtgttttcta

SEQ ID NO: 7691560 - DNA, 22 bp, Homo sapiens
ccacaatttatgtattctccta

SEQ ID NO: 7691561 - DNA, 22 bp, Homo sapiens
ccacaatttatgtattctccta

SEQ ID NO: 7691562 - DNA, 21 bp, Homo sapiens
ccacaattctagttacatatg

SEQ ID NO: 7691563 - DNA, 22 bp, Homo sapiens
ccacaattctgctttaatttct

SEQ ID NO: 7691564 - DNA, 22 bp, Homo sapiens
ccacaagtttgttgattgaaac

SEQ ID NO: 7691565 - DNA, 21 bp, Homo sapiens
ccacaattctagttacatatg

SEQ ID NO: 7691566 - DNA, 21 bp, Homo sapiens
ccacaattctagttacatatg

SEQ ID NO: 7691567 - DNA, 21 bp, Homo sapiens
ccacaattctagttacatatg

SEQ ID NO: 7691568 - DNA, 22 bp, Homo sapiens
ccacaaaactgtgtgtcaaaga

SEQ ID NO: 7691569 - DNA, 22 bp, Homo sapiens
ccacaaaactgtgtgtcaaaga

SEQ ID NO: 7691570 - DNA, 22 bp, Homo sapiens
ccacaaaactgtgtgtcaaaga

SEQ ID NO: 7691571 - DNA, 22 bp, Homo sapiens
ccacaaaactgtgtgtcaaaga

SEQ ID NO: 7691572 - DNA, 22 bp, Homo sapiens
ccacaaaactgtgtgtcaaaga

SEQ ID NO: 7691573 - DNA, 22 bp, Homo sapiens
ccacaaaactgtgtgtcaaaga

SEQ ID NO: 7691574 - DNA, 19 bp, Homo sapiens
ccacaaaattattttagtt

SEQ ID NO: 7691575 - DNA, 19 bp, Homo sapiens
ccacaaaattattttagtt

SEQ ID NO: 7691576 - DNA, 19 bp, Homo sapiens
ccacaaaattattttagtt

SEQ ID NO: 7691577 - DNA, 22 bp, Homo sapiens
ccacaaagaatgggggaagcat

SEQ ID NO: 7691578 - DNA, 19 bp, Homo sapiens
ccacaaaattattttagtt

SEQ ID NO: 7691579 - DNA, 22 bp, Homo sapiens
ccacaagatgcaaactctaaca

SEQ ID NO: 7691580 - DNA, 22 bp, Homo sapiens
ccacaagactctgtcagcataa

SEQ ID NO: 7691581 - DNA, 22 bp, Homo sapiens
ccacaagactctgtcagcataa

SEQ ID NO: 7691582 - DNA, 22 bp, Homo sapiens
ccacaagactctgtcagcataa

SEQ ID NO: 7691583 - DNA, 23 bp, Homo sapiens
ccacaaaccatttgtgaaggagc

SEQ ID NO: 7691584 - DNA, 22 bp, Homo sapiens
ccacaaagaatgggggaagcat

SEQ ID NO: 7691585 - DNA, 22 bp, Homo sapiens
ccacaaagttgctgagtttctg

SEQ ID NO: 7691586 - DNA, 22 bp, Homo sapiens
ccacaaattaggttttgcttgt

SEQ ID NO: 7691587 - DNA, 22 bp, Homo sapiens
ccaatgttttatacagaagtac

SEQ ID NO: 7691588 - DNA, 22 bp, Homo sapiens
ccaatgttttatacagaagtac

SEQ ID NO: 7691589 - DNA, 22 bp, Homo sapiens
ccaatgtttattttcctgctgc

SEQ ID NO: 7691590 - DNA, 23 bp, Homo sapiens
ccaattcagatattggcttgtgc

SEQ ID NO: 7691591 - DNA, 22 bp, Homo sapiens
ccaattcacttccaaccccttc

SEQ ID NO: 7691592 - DNA, 22 bp, Homo sapiens
ccaattcacctcctatgcacat

SEQ ID NO: 7691593 - DNA, 23 bp, Homo sapiens
ccaattcatggcagatttgaaga

SEQ ID NO: 7691594 - DNA, 23 bp, Homo sapiens
ccaattcatggcagatttgaaga

SEQ ID NO: 7691595 - DNA, 22 bp, Homo sapiens
ccaattctgtagagttgattaa

SEQ ID NO: 7691596 - DNA, 22 bp, Homo sapiens
ccaatttcctgccagtaccttc

SEQ ID NO: 7691597 - DNA, 22 bp, Homo sapiens
ccaatttctgcctgagggcttt

SEQ ID NO: 7691598 - DNA, 22 bp, Homo sapiens
ccaattttattcttctgcaagt

SEQ ID NO: 7691599 - DNA, 22 bp, Homo sapiens
ccaattttattcttctgcaagt

SEQ ID NO: 7691600 - DNA, 22 bp, Homo sapiens
ccaagggccatcctatcacttg

SEQ ID NO: 7691601 - DNA, 22 bp, Homo sapiens
ccaagggccatcctatcacttg

SEQ ID NO: 7691602 - DNA, 22 bp, Homo sapiens
ccaagggagactgtgagacctc

SEQ ID NO: 7691603 - DNA, 22 bp, Homo sapiens
ccaagggcatcttgcatgctgg

SEQ ID NO: 7691604 - DNA, 22 bp, Homo sapiens
ccaagggcgcctccgttccccc

SEQ ID NO: 7691605 - DNA, 22 bp, Homo sapiens
ccaagggcccttctaaaattct

SEQ ID NO: 7691606 - DNA, 22 bp, Homo sapiens
ccaagggcgcctccgttccccc

SEQ ID NO: 7691607 - DNA, 22 bp, Homo sapiens
ccaagggcgcctccgttccccc

SEQ ID NO: 7691608 - DNA, 22 bp, Homo sapiens
ccaatgttaggctctggtttta

SEQ ID NO: 7691609 - DNA, 20 bp, Homo sapiens
ccaatgtttacagattactt

SEQ ID NO: 7691610 - DNA, 22 bp, Homo sapiens
ccaagggctatttacagaacag

SEQ ID NO: 7691611 - DNA, 22 bp, Homo sapiens
ccaagggctatttacagaacag

SEQ ID NO: 7691612 - DNA, 22 bp, Homo sapiens
ccaagggctatttacagaacag

SEQ ID NO: 7691613 - DNA, 22 bp, Homo sapiens
tcctcccacataggacaatggg

SEQ ID NO: 7691614 - DNA, 22 bp, Homo sapiens
tcctcccacataggacaatggg

SEQ ID NO: 7691615 - DNA, 22 bp, Homo sapiens
tcctcccacataggacaatggg

SEQ ID NO: 7691616 - DNA, 22 bp, Homo sapiens
tcctcccacataggacaatggg

SEQ ID NO: 7691617 - DNA, 22 bp, Homo sapiens
tcctcccaacttttccatctca

SEQ ID NO: 7691618 - DNA, 22 bp, Homo sapiens
tcctcccaacttttccatctca

SEQ ID NO: 7691619 - DNA, 22 bp, Homo sapiens
tcctcccaacttttccatctca

SEQ ID NO: 7691620 - DNA, 22 bp, Homo sapiens
tcctcccaacttttccatctca

SEQ ID NO: 7691621 - DNA, 22 bp, Homo sapiens
tcctcccaacttttccatctca

SEQ ID NO: 7691622 - DNA, 22 bp, Homo sapiens
tcctcccacataggacaatggg

SEQ ID NO: 7691623 - DNA, 22 bp, Homo sapiens
tcctcccacataggacaatggg

SEQ ID NO: 7691624 - DNA, 22 bp, Homo sapiens
tcctcccacataggacaatggg

SEQ ID NO: 7691625 - DNA, 22 bp, Homo sapiens
tcctcccacataggacaatggg

SEQ ID NO: 7691626 - DNA, 22 bp, Homo sapiens
tcctccccaaagcccagcctgg

SEQ ID NO: 7691627 - DNA, 22 bp, Homo sapiens
tcctccccaaagcccagcctgg

SEQ ID NO: 7691628 - DNA, 22 bp, Homo sapiens
tcctccccaaagcccagcctgg

SEQ ID NO: 7691629 - DNA, 22 bp, Homo sapiens
tcctccccaaagcccagcctgg

SEQ ID NO: 7691630 - DNA, 22 bp, Homo sapiens
tcctcccacataggacaatggg

SEQ ID NO: 7691631 - DNA, 22 bp, Homo sapiens
tcctcccacataggacaatggg

SEQ ID NO: 7691632 - DNA, 20 bp, Homo sapiens
tcctcccccacctttgcagc

SEQ ID NO: 7691633 - DNA, 20 bp, Homo sapiens
tcctcccccacctttgcagc

SEQ ID NO: 7691634 - DNA, 20 bp, Homo sapiens
tcctcccccacctttgcagc

SEQ ID NO: 7691635 - DNA, 20 bp, Homo sapiens
tcctcccccacctttgcagc

SEQ ID NO: 7691636 - DNA, 17 bp, Homo sapiens
tcctccccgcagttgca

SEQ ID NO: 7691637 - DNA, 20 bp, Homo sapiens
tcctcccccacctttgcagc

SEQ ID NO: 7691638 - DNA, 20 bp, Homo sapiens
tcctcccccacctttgcagc

SEQ ID NO: 7691639 - DNA, 17 bp, Homo sapiens
tcctccccgcagttgca

SEQ ID NO: 7691640 - DNA, 22 bp, Homo sapiens
ccaagggcatcttgcatgctgg

SEQ ID NO: 7691641 - DNA, 22 bp, Homo sapiens
ccaagggcatcttgcatgctgg

SEQ ID NO: 7691642 - DNA, 22 bp, Homo sapiens
ccaagggaaggatgtatatgat

SEQ ID NO: 7691643 - DNA, 22 bp, Homo sapiens
tcctccccaaagcccagcctgg

SEQ ID NO: 7691644 - DNA, 22 bp, Homo sapiens
tcctccccaaagcccagcctgg

SEQ ID NO: 7691645 - DNA, 22 bp, Homo sapiens
tcctccccaaagcccagcctgg

SEQ ID NO: 7691646 - DNA, 22 bp, Homo sapiens
tcctccccaaagcccagcctgg

SEQ ID NO: 7691647 - DNA, 22 bp, Homo sapiens
tcctccccaaagcccagcctgg

SEQ ID NO: 7691648 - DNA, 22 bp, Homo sapiens
tcctccccaaagcccagcctgg

SEQ ID NO: 7691649 - DNA, 22 bp, Homo sapiens
tcctccccaaagcccagcctgg

SEQ ID NO: 7691650 - DNA, 22 bp, Homo sapiens
tcctccccaaagcccagcctgg

SEQ ID NO: 7691651 - DNA, 22 bp, Homo sapiens
tcctccccaaagcccagcctgg

SEQ ID NO: 7691652 - DNA, 22 bp, Homo sapiens
tcctccccaaagcccagcctgg

SEQ ID NO: 7691653 - DNA, 22 bp, Homo sapiens
tcctccccaaagcccagcctgg

SEQ ID NO: 7691654 - DNA, 20 bp, Homo sapiens
ccaaatgtggagaaaaagta

SEQ ID NO: 7691655 - DNA, 20 bp, Homo sapiens
ccaaatgtggagaaaaagta

SEQ ID NO: 7691656 - DNA, 22 bp, Homo sapiens
ccaaattaaatcatacagacag

SEQ ID NO: 7691657 - DNA, 22 bp, Homo sapiens
ccaaatgtctattaggtcaatt

SEQ ID NO: 7691658 - DNA, 22 bp, Homo sapiens
ccaaatgctccactgactttgg

SEQ ID NO: 7691659 - DNA, 22 bp, Homo sapiens
ccaaatcaccagcacgatcatt

SEQ ID NO: 7691660 - DNA, 22 bp, Homo sapiens
ccaaatcaggggccacaagcat

SEQ ID NO: 7691661 - DNA, 23 bp, Homo sapiens
tcctcccaaatttcagcctcatt

SEQ ID NO: 7691662 - DNA, 23 bp, Homo sapiens
tcctcccaaatttcagcctcatt

SEQ ID NO: 7691663 - DNA, 23 bp, Homo sapiens
tcctcccaaatttcagcctcatt

SEQ ID NO: 7691664 - DNA, 23 bp, Homo sapiens
tcctcccaaatttcagcctcatt

SEQ ID NO: 7691665 - DNA, 23 bp, Homo sapiens
tcctcccaaatttcagcctcatt

SEQ ID NO: 7691666 - DNA, 22 bp, Homo sapiens
tcctcccaacttttccatctca

SEQ ID NO: 7691667 - DNA, 23 bp, Homo sapiens
tcctcccaaatttcagcctcatt

SEQ ID NO: 7691668 - DNA, 22 bp, Homo sapiens
ccaaagtgctggggttacaggc

SEQ ID NO: 7691669 - DNA, 22 bp, Homo sapiens
ccaaagtgtgggagaagaggta

SEQ ID NO: 7691670 - DNA, 22 bp, Homo sapiens
ccaaagtgctggggttacaggc

SEQ ID NO: 7691671 - DNA, 22 bp, Homo sapiens
ccaaataatatttcagaaccat

SEQ ID NO: 7691672 - DNA, 21 bp, Homo sapiens
ccaaatagcctccattaacag

SEQ ID NO: 7691673 - DNA, 22 bp, Homo sapiens
ccaaatagtctttcattgaatt

SEQ ID NO: 7691674 - DNA, 22 bp, Homo sapiens
ccaaatattaacaaagtaattt

SEQ ID NO: 7691675 - DNA, 22 bp, Homo sapiens
ccaaatattaacaaagtaattt

SEQ ID NO: 7691676 - DNA, 22 bp, Homo sapiens
ccaaatattaacaaagtaattt

SEQ ID NO: 7691677 - DNA, 22 bp, Homo sapiens
ccaaatagtctttcattgaatt

SEQ ID NO: 7691678 - DNA, 22 bp, Homo sapiens
ccaaatattaacaaagtaattt

SEQ ID NO: 7691679 - DNA, 22 bp, Homo sapiens
ccaaatattaacaaagtaattt

SEQ ID NO: 7691680 - DNA, 22 bp, Homo sapiens
ccaaatattaacaaagtaattt

SEQ ID NO: 7691681 - DNA, 22 bp, Homo sapiens
ccaaatcaccagcacgatcatt

SEQ ID NO: 7691682 - DNA, 22 bp, Homo sapiens
ccaaatcaccagcacgatcatt

SEQ ID NO: 7691683 - DNA, 22 bp, Homo sapiens
catttagttatactaaaacatt

SEQ ID NO: 7691684 - DNA, 22 bp, Homo sapiens
catttagttatactaaaacatt

SEQ ID NO: 7691685 - DNA, 22 bp, Homo sapiens
catttagttatactaaaacatt

SEQ ID NO: 7691686 - DNA, 22 bp, Homo sapiens
catttagttttgcagtagcagg

SEQ ID NO: 7691687 - DNA, 22 bp, Homo sapiens
catttagttttgcagtagcagg

SEQ ID NO: 7691688 - DNA, 22 bp, Homo sapiens
catttatataaaatgtccagaa

SEQ ID NO: 7691689 - DNA, 22 bp, Homo sapiens
catttagttttgcagtagcagg

SEQ ID NO: 7691690 - DNA, 22 bp, Homo sapiens
catttagagtcttgcaatttta

SEQ ID NO: 7691691 - DNA, 22 bp, Homo sapiens
catttagagtcttgcaatttta

SEQ ID NO: 7691692 - DNA, 22 bp, Homo sapiens
catttagagtcttgcaatttta

SEQ ID NO: 7691693 - DNA, 22 bp, Homo sapiens
catttagagagtaaaaattagc

SEQ ID NO: 7691694 - DNA, 22 bp, Homo sapiens
catttagagagtaaaaattagc

SEQ ID NO: 7691695 - DNA, 22 bp, Homo sapiens
catttagagagtaaaaattagc

SEQ ID NO: 7691696 - DNA, 22 bp, Homo sapiens
catttagagagtaaaaattagc

SEQ ID NO: 7691697 - DNA, 22 bp, Homo sapiens
catttagtctgatatggatgaa

SEQ ID NO: 7691698 - DNA, 22 bp, Homo sapiens
catttagtacaacttttacagt

SEQ ID NO: 7691699 - DNA, 22 bp, Homo sapiens
catttagtacaacttttacagt

SEQ ID NO: 7691700 - DNA, 22 bp, Homo sapiens
catttagtcaaggacacgtggc

SEQ ID NO: 7691701 - DNA, 19 bp, Homo sapiens
catttagaagtacatatta

SEQ ID NO: 7691702 - DNA, 19 bp, Homo sapiens
catttagaagtacatatta

SEQ ID NO: 7691703 - DNA, 19 bp, Homo sapiens
catttagaagtacatatta

SEQ ID NO: 7691704 - DNA, 19 bp, Homo sapiens
catttagaagtacatatta

SEQ ID NO: 7691705 - DNA, 19 bp, Homo sapiens
catttagaagtacatatta

SEQ ID NO: 7691706 - DNA, 22 bp, Homo sapiens
catttagaagtcttagaactat

SEQ ID NO: 7691707 - DNA, 19 bp, Homo sapiens
catttagaagtacatatta

SEQ ID NO: 7691708 - DNA, 22 bp, Homo sapiens
catttagagagtaaaaattagc

SEQ ID NO: 7691709 - DNA, 22 bp, Homo sapiens
catttagagagtaaaaattagc

SEQ ID NO: 7691710 - DNA, 22 bp, Homo sapiens
catttagagaagattacaagga

SEQ ID NO: 7691711 - DNA, 22 bp, Homo sapiens
catttagagaagattacaagga

SEQ ID NO: 7691712 - DNA, 22 bp, Homo sapiens
catttagaagtcttagaactat

SEQ ID NO: 7691713 - DNA, 22 bp, Homo sapiens
catttagaagtcttagaactat

SEQ ID NO: 7691714 - DNA, 22 bp, Homo sapiens
catttagagaagattacaagga

SEQ ID NO: 7691715 - DNA, 22 bp, Homo sapiens
catttagagaagattacaagga

SEQ ID NO: 7691716 - DNA, 22 bp, Homo sapiens
catttagacatttgatttgggg

SEQ ID NO: 7691717 - DNA, 22 bp, Homo sapiens
catttagagaagattacaagga

SEQ ID NO: 7691718 - DNA, 22 bp, Homo sapiens
catttagacatttgatttgggg

SEQ ID NO: 7691719 - DNA, 22 bp, Homo sapiens
tccaggcacgaggccctgtgca

SEQ ID NO: 7691720 - DNA, 22 bp, Homo sapiens
tccaggcacgaggccctgtgca

SEQ ID NO: 7691721 - DNA, 22 bp, Homo sapiens
tccaggcacagagttggtcagt

SEQ ID NO: 7691722 - DNA, 23 bp, Homo sapiens
tccaggcacgcatttcttctagc

SEQ ID NO: 7691723 - DNA, 23 bp, Homo sapiens
tccaggcacgcatttcttctagc

SEQ ID NO: 7691724 - DNA, 23 bp, Homo sapiens
tccaggcacgcatttcttctagc

SEQ ID NO: 7691725 - DNA, 22 bp, Homo sapiens
tccaggcactatatatactttt

SEQ ID NO: 7691726 - DNA, 22 bp, Homo sapiens
tccaggcactatatatactttt

SEQ ID NO: 7691727 - DNA, 22 bp, Homo sapiens
tccaggcactatatatactttt

SEQ ID NO: 7691728 - DNA, 20 bp, Homo sapiens
tccaggcagacagctatggg

SEQ ID NO: 7691729 - DNA, 20 bp, Homo sapiens
tccaggcagacagctatggg

SEQ ID NO: 7691730 - DNA, 22 bp, Homo sapiens
tccaggcactatatatactttt

SEQ ID NO: 7691731 - DNA, 17 bp, Homo sapiens
tccaggcagcaactgag

SEQ ID NO: 7691732 - DNA, 17 bp, Homo sapiens
tccaggcagcaactgag

SEQ ID NO: 7691733 - DNA, 17 bp, Homo sapiens
tccaggcagcaactgag

SEQ ID NO: 7691734 - DNA, 22 bp, Homo sapiens
tccaggcagagcaacaaaatat

SEQ ID NO: 7691735 - DNA, 22 bp, Homo sapiens
tccaggcagagcaacaaaatat

SEQ ID NO: 7691736 - DNA, 22 bp, Homo sapiens
catttagaaactgtttttaaca

SEQ ID NO: 7691737 - DNA, 22 bp, Homo sapiens
catttagaaactgtttttaaca

SEQ ID NO: 7691738 - DNA, 22 bp, Homo sapiens
catttagaaactgtttttaaca

SEQ ID NO: 7691739 - DNA, 22 bp, Homo sapiens
catttagaaaatgataaccctt

SEQ ID NO: 7691740 - DNA, 22 bp, Homo sapiens
catttacttaaatctttacaag

SEQ ID NO: 7691741 - DNA, 22 bp, Homo sapiens
catttacttaaatctttacaag

SEQ ID NO: 7691742 - DNA, 22 bp, Homo sapiens
catttacagcagactgatgaaa

SEQ ID NO: 7691743 - DNA, 22 bp, Homo sapiens
catttacagcagactgatgaaa

SEQ ID NO: 7691744 - DNA, 22 bp, Homo sapiens
catttacagcagactgatgaaa

SEQ ID NO: 7691745 - DNA, 22 bp, Homo sapiens
catttacagcagactgatgaaa

SEQ ID NO: 7691746 - DNA, 22 bp, Homo sapiens
catttacagcagactgatgaaa

SEQ ID NO: 7691747 - DNA, 22 bp, Homo sapiens
catttacagcagactgatgaaa

SEQ ID NO: 7691748 - DNA, 22 bp, Homo sapiens
catttacagcagactgatgaaa

SEQ ID NO: 7691749 - DNA, 22 bp, Homo sapiens
catttacacttctaaccacaag

SEQ ID NO: 7691750 - DNA, 22 bp, Homo sapiens
catttacacttctaaccacaag

SEQ ID NO: 7691751 - DNA, 17 bp, Homo sapiens
tccaggcagcaactgag

SEQ ID NO: 7691752 - DNA, 17 bp, Homo sapiens
tccaggcagcaactgag

SEQ ID NO: 7691753 - DNA, 17 bp, Homo sapiens
tccaggcagcaactgag

SEQ ID NO: 7691754 - DNA, 22 bp, Homo sapiens
tcccagggctctagagtgctgg

SEQ ID NO: 7691755 - DNA, 22 bp, Homo sapiens
tcccagggctctagagtgctgg

SEQ ID NO: 7691756 - DNA, 22 bp, Homo sapiens
tcccagggctctagagtgctgg

SEQ ID NO: 7691757 - DNA, 22 bp, Homo sapiens
tcccagggctctagagtgctgg

SEQ ID NO: 7691758 - DNA, 22 bp, Homo sapiens
tcccagggccgcaaacgagttt

SEQ ID NO: 7691759 - DNA, 22 bp, Homo sapiens
tcccagggctctagagtgctgg

SEQ ID NO: 7691760 - DNA, 22 bp, Homo sapiens
tcccagggctctagagtgctgg

SEQ ID NO: 7691761 - DNA, 22 bp, Homo sapiens
tcccagggcttttctcatgctt

SEQ ID NO: 7691762 - DNA, 22 bp, Homo sapiens
tcccagggctctagagtgctgg

SEQ ID NO: 7691763 - DNA, 22 bp, Homo sapiens
tcccagggggatgaacactgcc

SEQ ID NO: 7691764 - DNA, 22 bp, Homo sapiens
tcccagggggatgaacactgcc

SEQ ID NO: 7691765 - DNA, 22 bp, Homo sapiens
tcccagggcttttctcatgctt

SEQ ID NO: 7691766 - DNA, 22 bp, Homo sapiens
tcccagggcttttctcatgctt

SEQ ID NO: 7691767 - DNA, 22 bp, Homo sapiens
tcccagggcttttctcatgctt

SEQ ID NO: 7691768 - DNA, 22 bp, Homo sapiens
tcccagggcttttctcatgctt

SEQ ID NO: 7691769 - DNA, 22 bp, Homo sapiens
tcccagggtcagtggtgaggcc

SEQ ID NO: 7691770 - DNA, 22 bp, Homo sapiens
tcccagggtcagtggtgaggcc

SEQ ID NO: 7691771 - DNA, 22 bp, Homo sapiens
catttctcactccagcaacttt

SEQ ID NO: 7691772 - DNA, 22 bp, Homo sapiens
catttctcactccagcaacttt

SEQ ID NO: 7691773 - DNA, 22 bp, Homo sapiens
catttctcactccagcaacttt

SEQ ID NO: 7691774 - DNA, 22 bp, Homo sapiens
tcccagggtcagtggtgaggcc

SEQ ID NO: 7691775 - DNA, 21 bp, Homo sapiens
catttctattgatgagaaaag

SEQ ID NO: 7691776 - DNA, 22 bp, Homo sapiens
tcccagggtatcctgtagtaaa

SEQ ID NO: 7691777 - DNA, 22 bp, Homo sapiens
tcccagggtatcctgtagtaaa

SEQ ID NO: 7691778 - DNA, 22 bp, Homo sapiens
tcccagggggatgaacactgcc

SEQ ID NO: 7691779 - DNA, 22 bp, Homo sapiens
tcccagggggatgaacactgcc

SEQ ID NO: 7691780 - DNA, 22 bp, Homo sapiens
tcccagggggatgaacactgcc

SEQ ID NO: 7691781 - DNA, 22 bp, Homo sapiens
tcccagggtcagtggtgaggcc

SEQ ID NO: 7691782 - DNA, 22 bp, Homo sapiens
tcccagggtcagtggtgaggcc

SEQ ID NO: 7691783 - DNA, 22 bp, Homo sapiens
tcccagggtcagtggtgaggcc

SEQ ID NO: 7691784 - DNA, 21 bp, Homo sapiens
tcccagggccaggtgccatca

SEQ ID NO: 7691785 - DNA, 21 bp, Homo sapiens
tcccagggccaggtgccatca

SEQ ID NO: 7691786 - DNA, 21 bp, Homo sapiens
tcccagggccaggtgccatca

SEQ ID NO: 7691787 - DNA, 21 bp, Homo sapiens
tcccagggccaggtgccatca

SEQ ID NO: 7691788 - DNA, 22 bp, Homo sapiens
tcccagggccgcaaacgagttt

SEQ ID NO: 7691789 - DNA, 22 bp, Homo sapiens
tcccagggccgcaaacgagttt

SEQ ID NO: 7691790 - DNA, 22 bp, Homo sapiens
tcccagggccgcaaacgagttt

SEQ ID NO: 7691791 - DNA, 22 bp, Homo sapiens
tcccagggccgcaaacgagttt

SEQ ID NO: 7691792 - DNA, 22 bp, Homo sapiens
tcccagggcagctgtccagaag

SEQ ID NO: 7691793 - DNA, 22 bp, Homo sapiens
tcccagggcagctgtccagaag

SEQ ID NO: 7691794 - DNA, 22 bp, Homo sapiens
tcccagggcagctgtccagaag

SEQ ID NO: 7691795 - DNA, 22 bp, Homo sapiens
tcccagggcagctgtccagaag

SEQ ID NO: 7691796 - DNA, 22 bp, Homo sapiens
tcccagggcactcaccctccct

SEQ ID NO: 7691797 - DNA, 22 bp, Homo sapiens
tcccagggcactcaccctccct

SEQ ID NO: 7691798 - DNA, 22 bp, Homo sapiens
catttattagttagttcgatgt

SEQ ID NO: 7691799 - DNA, 22 bp, Homo sapiens
catttattagttagttcgatgt

SEQ ID NO: 7691800 - DNA, 22 bp, Homo sapiens
catttattagttagttcgatgt

SEQ ID NO: 7691801 - DNA, 22 bp, Homo sapiens
catttattagttagttcgatgt

SEQ ID NO: 7691802 - DNA, 22 bp, Homo sapiens
tcccagggcactcaccctccct

SEQ ID NO: 7691803 - DNA, 22 bp, Homo sapiens
catttattagttagttcgatgt

SEQ ID NO: 7691804 - DNA, 22 bp, Homo sapiens
catttattagttagttcgatgt

SEQ ID NO: 7691805 - DNA, 22 bp, Homo sapiens
catttatcttggccctaaggcc

SEQ ID NO: 7691806 - DNA, 22 bp, Homo sapiens
catttatcttggccctaaggcc

SEQ ID NO: 7691807 - DNA, 22 bp, Homo sapiens
catttatgatagtaatatgaaa

SEQ ID NO: 7691808 - DNA, 22 bp, Homo sapiens
catttatataaaatgtccagaa

SEQ ID NO: 7691809 - DNA, 22 bp, Homo sapiens
catttatataaaatgtccagaa

SEQ ID NO: 7691810 - DNA, 22 bp, Homo sapiens
catttatataaaatgtccagaa

SEQ ID NO: 7691811 - DNA, 22 bp, Homo sapiens
catttatataaaatgtccagaa

SEQ ID NO: 7691812 - DNA, 22 bp, Homo sapiens
ccaaagtgctaggattacaggt

SEQ ID NO: 7691813 - DNA, 22 bp, Homo sapiens
ccaaagtgctgagattacaggt

SEQ ID NO: 7691814 - DNA, 22 bp, Homo sapiens
ccaaagtgctgggattacaggc

SEQ ID NO: 7691815 - DNA, 22 bp, Homo sapiens
ccaaagtgctgggattacaggt

SEQ ID NO: 7691816 - DNA, 23 bp, Homo sapiens
ccaaagtcgaagtctagtccaga

SEQ ID NO: 7691817 - DNA, 22 bp, Homo sapiens
ccaaagtctggagcagcagagc

SEQ ID NO: 7691818 - DNA, 22 bp, Homo sapiens
ccaaagtaaggcaattcctaaa

SEQ ID NO: 7691819 - DNA, 22 bp, Homo sapiens
ccaaagtgatatgtgctgtaag

SEQ ID NO: 7691820 - DNA, 22 bp, Homo sapiens
ccaaagtgatatgtgctgtaag

SEQ ID NO: 7691821 - DNA, 22 bp, Homo sapiens
ccaaagtgctaggattacaggc

SEQ ID NO: 7691822 - DNA, 22 bp, Homo sapiens
ccaaaaattagatacacatata

SEQ ID NO: 7691823 - DNA, 19 bp, Homo sapiens
ccaaaagcaattccaagta

SEQ ID NO: 7691824 - DNA, 19 bp, Homo sapiens
ccaaaagcaattccaagta

SEQ ID NO: 7691825 - DNA, 22 bp, Homo sapiens
ccaaaaattagatacacatata

SEQ ID NO: 7691826 - DNA, 22 bp, Homo sapiens
ccaaaaattagatacacatata

SEQ ID NO: 7691827 - DNA, 21 bp, Homo sapiens
tccctgctttctggcccagtc

SEQ ID NO: 7691828 - DNA, 22 bp, Homo sapiens
tccctgctttcttgtgagggga

SEQ ID NO: 7691829 - DNA, 22 bp, Homo sapiens
tccctgctttcttgtgagggga

SEQ ID NO: 7691830 - DNA, 22 bp, Homo sapiens
ccaaaagcagctgtctgtgaat

SEQ ID NO: 7691831 - DNA, 22 bp, Homo sapiens
ccaaaagcagctgtctgtgaat

SEQ ID NO: 7691832 - DNA, 23 bp, Homo sapiens
ccaaaagcgagtctgttgttccc

SEQ ID NO: 7691833 - DNA, 23 bp, Homo sapiens
ccaaaagcgagtctgttgttccc

SEQ ID NO: 7691834 - DNA, 19 bp, Homo sapiens
ccaaaagcaattccaagta

SEQ ID NO: 7691835 - DNA, 22 bp, Homo sapiens
ccaaaagcagctgtctgtgaat

SEQ ID NO: 7691836 - DNA, 22 bp, Homo sapiens
ccaaaggtgttggccttcagtg

SEQ ID NO: 7691837 - DNA, 22 bp, Homo sapiens
ccaaaggtgttggccttcagtg

SEQ ID NO: 7691838 - DNA, 22 bp, Homo sapiens
ccaaagtattaaatcttagcaa

SEQ ID NO: 7691839 - DNA, 22 bp, Homo sapiens
ccaaagtccacagtttacatta

SEQ ID NO: 7691840 - DNA, 22 bp, Homo sapiens
ccaaagtccatagtttacataa

SEQ ID NO: 7691841 - DNA, 22 bp, Homo sapiens
ccaaagtccatagtttacttta

SEQ ID NO: 7691842 - DNA, 22 bp, Homo sapiens
ccaaagtccatagtttacatta

SEQ ID NO: 7691843 - DNA, 21 bp, Homo sapiens
tccctgctttctggcccagtc

SEQ ID NO: 7691844 - DNA, 21 bp, Homo sapiens
tccctgctttctggcccagtc

SEQ ID NO: 7691845 - DNA, 21 bp, Homo sapiens
tccctgctttctggcccagtc

SEQ ID NO: 7691846 - DNA, 21 bp, Homo sapiens
tccctgctttctggcccagtc

SEQ ID NO: 7691847 - DNA, 21 bp, Homo sapiens
tccctgctttctggcccagtc

SEQ ID NO: 7691848 - DNA, 21 bp, Homo sapiens
tccctgctttctggcccagtc

SEQ ID NO: 7691849 - DNA, 22 bp, Homo sapiens
tccctgcttggaatgaccctta

SEQ ID NO: 7691850 - DNA, 22 bp, Homo sapiens
tccctgcttggaatgaccctta

SEQ ID NO: 7691851 - DNA, 22 bp, Homo sapiens
tccctgcttgctctcagccctt

SEQ ID NO: 7691852 - DNA, 22 bp, Homo sapiens
tccctgcttggaatgaccctta

SEQ ID NO: 7691853 - DNA, 22 bp, Homo sapiens
tccctgcttggaatgaccctta

SEQ ID NO: 7691854 - DNA, 22 bp, Homo sapiens
tccctgcttggaatgaccctta

SEQ ID NO: 7691855 - DNA, 22 bp, Homo sapiens
tccctgctgggagatgacctta

SEQ ID NO: 7691856 - DNA, 22 bp, Homo sapiens
tccctgctgcactcacacctac

SEQ ID NO: 7691857 - DNA, 22 bp, Homo sapiens
tccctgctgcactcacacctac

SEQ ID NO: 7691858 - DNA, 22 bp, Homo sapiens
tccctgcttgctctcagccctt

SEQ ID NO: 7691859 - DNA, 22 bp, Homo sapiens
tccctgcttgctctcagccctt

SEQ ID NO: 7691860 - DNA, 15 bp, Homo sapiens
tccctgctggtcaaa

SEQ ID NO: 7691861 - DNA, 22 bp, Homo sapiens
tccctgctgggagatgacctta

SEQ ID NO: 7691862 - DNA, 19 bp, Homo sapiens
tccctgcgtttcggcccac

SEQ ID NO: 7691863 - DNA, 19 bp, Homo sapiens
tccctgcgtttcggcccac

SEQ ID NO: 7691864 - DNA, 22 bp, Homo sapiens
tccctgctaattggaatgtata

SEQ ID NO: 7691865 - DNA, 22 bp, Homo sapiens
tccctgctcagctcacctggca

SEQ ID NO: 7691866 - DNA, 22 bp, Homo sapiens
tccctgctcagctcacctggca

SEQ ID NO: 7691867 - DNA, 22 bp, Homo sapiens
tccctgctgagagtgctctccc

SEQ ID NO: 7691868 - DNA, 19 bp, Homo sapiens
tccctgcgtttcggcccac

SEQ ID NO: 7691869 - DNA, 22 bp, Homo sapiens
tccctgctcagctcacctggca

SEQ ID NO: 7691870 - DNA, 22 bp, Homo sapiens
tccctgctcagctcacctggca

SEQ ID NO: 7691871 - DNA, 22 bp, Homo sapiens
tccctgctgcactcacacctac

SEQ ID NO: 7691872 - DNA, 22 bp, Homo sapiens
tccctgctgcactcacacctac

SEQ ID NO: 7691873 - DNA, 22 bp, Homo sapiens
tccctgctgcactcacacctac

SEQ ID NO: 7691874 - DNA, 22 bp, Homo sapiens
tccctgctgcactcacacctac

SEQ ID NO: 7691875 - DNA, 22 bp, Homo sapiens
tccctgctgagagtgctctccc

SEQ ID NO: 7691876 - DNA, 22 bp, Homo sapiens
tccctgctgagagtgctctccc

SEQ ID NO: 7691877 - DNA, 22 bp, Homo sapiens
tccctgctgagagtgctctccc

SEQ ID NO: 7691878 - DNA, 22 bp, Homo sapiens
tccctgctgagagtgctctccc

SEQ ID NO: 7691879 - DNA, 22 bp, Homo sapiens
tccctgctgagagtgctctccc

SEQ ID NO: 7691880 - DNA, 22 bp, Homo sapiens
catttgaagaagaaacgtacta

SEQ ID NO: 7691881 - DNA, 22 bp, Homo sapiens
catttgaagaagaaacgtacta

SEQ ID NO: 7691882 - DNA, 22 bp, Homo sapiens
catttgaactaataactgtgct

SEQ ID NO: 7691883 - DNA, 22 bp, Homo sapiens
catttgaactaataactgtgct

SEQ ID NO: 7691884 - DNA, 22 bp, Homo sapiens
catttgaatgagattgctgtaa

SEQ ID NO: 7691885 - DNA, 22 bp, Homo sapiens
catttgaagacttagaagagga

SEQ ID NO: 7691886 - DNA, 22 bp, Homo sapiens
catttgaacctggatgttctta

SEQ ID NO: 7691887 - DNA, 22 bp, Homo sapiens
catttgaactaataactgtgct

SEQ ID NO: 7691888 - DNA, 22 bp, Homo sapiens
catttgaactaataactgtgct

SEQ ID NO: 7691889 - DNA, 22 bp, Homo sapiens
catttctcataatattagcact

SEQ ID NO: 7691890 - DNA, 22 bp, Homo sapiens
catttgaacctggatgttctta

SEQ ID NO: 7691891 - DNA, 22 bp, Homo sapiens
catttgaacctggatgttctta

SEQ ID NO: 7691892 - DNA, 22 bp, Homo sapiens
catttgaacctggatgttctta

SEQ ID NO: 7691893 - DNA, 22 bp, Homo sapiens
catttgaacctggatgttctta

SEQ ID NO: 7691894 - DNA, 22 bp, Homo sapiens
catttctcataatattagcact

SEQ ID NO: 7691895 - DNA, 22 bp, Homo sapiens
catttgaatggcatttcacttt

SEQ ID NO: 7691896 - DNA, 22 bp, Homo sapiens
catttgaatggcatttcacttt

SEQ ID NO: 7691897 - DNA, 22 bp, Homo sapiens
catttgaatggcatttcacttt

SEQ ID NO: 7691898 - DNA, 22 bp, Homo sapiens
catttgaatggcatttcacttt

SEQ ID NO: 7691899 - DNA, 22 bp, Homo sapiens
catttgaattgttctgtgggaa

SEQ ID NO: 7691900 - DNA, 22 bp, Homo sapiens
catttgacagtgagtcacagca

SEQ ID NO: 7691901 - DNA, 22 bp, Homo sapiens
catttgatcctcacaacaatct

SEQ ID NO: 7691902 - DNA, 22 bp, Homo sapiens
catttgatcctcacaacaatct

SEQ ID NO: 7691903 - DNA, 22 bp, Homo sapiens
catttgatctcctgaataaaca

SEQ ID NO: 7691904 - DNA, 23 bp, Homo sapiens
catttgatcctcacaataaatgg

SEQ ID NO: 7691905 - DNA, 23 bp, Homo sapiens
catttgatcctcacaataaatgg

SEQ ID NO: 7691906 - DNA, 23 bp, Homo sapiens
catttgatcctcacaataaatgg

SEQ ID NO: 7691907 - DNA, 22 bp, Homo sapiens
catttgattactaaagataatt

SEQ ID NO: 7691908 - DNA, 22 bp, Homo sapiens
catttgattactaaagataatt

SEQ ID NO: 7691909 - DNA, 22 bp, Homo sapiens
catttgattactaaagataatt

SEQ ID NO: 7691910 - DNA, 22 bp, Homo sapiens
catttgatgactcaactcataa

SEQ ID NO: 7691911 - DNA, 22 bp, Homo sapiens
catttgatctcctgaataaaca

SEQ ID NO: 7691912 - DNA, 22 bp, Homo sapiens
catttgatgactcaactcataa

SEQ ID NO: 7691913 - DNA, 22 bp, Homo sapiens
catttgcaaaccaacaagatga

SEQ ID NO: 7691914 - DNA, 22 bp, Homo sapiens
catttgcaaaccaacaagatga

SEQ ID NO: 7691915 - DNA, 22 bp, Homo sapiens
catttgcaagagataaatgttt

SEQ ID NO: 7691916 - DNA, 22 bp, Homo sapiens
catttgctgaggccttcagagg

SEQ ID NO: 7691917 - DNA, 22 bp, Homo sapiens
catttgctgaggccttcagagg

SEQ ID NO: 7691918 - DNA, 22 bp, Homo sapiens
catttgctctgtgtcagtggca

SEQ ID NO: 7691919 - DNA, 22 bp, Homo sapiens
catttgctcttcatccccaact

SEQ ID NO: 7691920 - DNA, 22 bp, Homo sapiens
catttgctggggtcttgggagt

SEQ ID NO: 7691921 - DNA, 22 bp, Homo sapiens
catttgctggagatggaccaca

SEQ ID NO: 7691922 - DNA, 22 bp, Homo sapiens
catttgctgaggccttcagagg

SEQ ID NO: 7691923 - DNA, 22 bp, Homo sapiens
catttgctctggttccttctgg

SEQ ID NO: 7691924 - DNA, 22 bp, Homo sapiens
catttgctagcaggccttttat

SEQ ID NO: 7691925 - DNA, 22 bp, Homo sapiens
catttgctctgtgtcagtggca

SEQ ID NO: 7691926 - DNA, 22 bp, Homo sapiens
catttgctctgtgtcagtggca

SEQ ID NO: 7691927 - DNA, 22 bp, Homo sapiens
catttgcatatgaagaagtaag

SEQ ID NO: 7691928 - DNA, 22 bp, Homo sapiens
catttgcatatgaagaagtaag

SEQ ID NO: 7691929 - DNA, 22 bp, Homo sapiens
catttgctagcaggccttttat

SEQ ID NO: 7691930 - DNA, 22 bp, Homo sapiens
catttggaaagagactagagaa

SEQ ID NO: 7691931 - DNA, 22 bp, Homo sapiens
catttgcttgcctcccccaggt

SEQ ID NO: 7691932 - DNA, 22 bp, Homo sapiens
catttggaaagagactagagaa

SEQ ID NO: 7691933 - DNA, 22 bp, Homo sapiens
catttgcttcctgggtcttgaa

SEQ ID NO: 7691934 - DNA, 22 bp, Homo sapiens
catttggaaagagactagagaa

SEQ ID NO: 7691935 - DNA, 22 bp, Homo sapiens
tccctgcctctcagacttcctt

SEQ ID NO: 7691936 - DNA, 22 bp, Homo sapiens
catttgctgtattttcagattc

SEQ ID NO: 7691937 - DNA, 22 bp, Homo sapiens
catttgctgtattttcagattc

SEQ ID NO: 7691938 - DNA, 22 bp, Homo sapiens
catttgctgtaatgacaataag

SEQ ID NO: 7691939 - DNA, 17 bp, Homo sapiens
catttgctggttggctc

SEQ ID NO: 7691940 - DNA, 17 bp, Homo sapiens
catttgctggttggctc

SEQ ID NO: 7691941 - DNA, 22 bp, Homo sapiens
tccctgcctgacagcacccacc

SEQ ID NO: 7691942 - DNA, 22 bp, Homo sapiens
tccctgcctgacagcacccacc

SEQ ID NO: 7691943 - DNA, 22 bp, Homo sapiens
tccctgcctgacagcacccacc

SEQ ID NO: 7691944 - DNA, 22 bp, Homo sapiens
tccctgcctgacagcacccacc

SEQ ID NO: 7691945 - DNA, 22 bp, Homo sapiens
tccctgcctgacagcacccacc

SEQ ID NO: 7691946 - DNA, 22 bp, Homo sapiens
tccctgcctgacagcacccacc

SEQ ID NO: 7691947 - DNA, 20 bp, Homo sapiens
tccctgccttttactgctgg

SEQ ID NO: 7691948 - DNA, 20 bp, Homo sapiens
tccctgccttttactgctgg

SEQ ID NO: 7691949 - DNA, 20 bp, Homo sapiens
tccctgccttttactgctgg

SEQ ID NO: 7691950 - DNA, 22 bp, Homo sapiens
tccctgcctgacagcacccacc

SEQ ID NO: 7691951 - DNA, 22 bp, Homo sapiens
ccaggaaagaggaagaacgcat

SEQ ID NO: 7691952 - DNA, 22 bp, Homo sapiens
ccaggaaagaggaagaacgcat

SEQ ID NO: 7691953 - DNA, 23 bp, Homo sapiens
ccaggaaagatccaggaagaggc

SEQ ID NO: 7691954 - DNA, 22 bp, Homo sapiens
ccaggaaagaggaagaacgcat

SEQ ID NO: 7691955 - DNA, 23 bp, Homo sapiens
ccaggaaagatccaggaagaggc

SEQ ID NO: 7691956 - DNA, 22 bp, Homo sapiens
ccaggaaatagtgctgtgatct

SEQ ID NO: 7691957 - DNA, 22 bp, Homo sapiens
ccaggaaatagtgctgtgatct

SEQ ID NO: 7691958 - DNA, 22 bp, Homo sapiens
ccaggaaatagtgctgtgatct

SEQ ID NO: 7691959 - DNA, 22 bp, Homo sapiens
ccaggaaagaggaagaacgcat

SEQ ID NO: 7691960 - DNA, 22 bp, Homo sapiens
ccaggaaagaggaagaacgcat

SEQ ID NO: 7691961 - DNA, 22 bp, Homo sapiens
ccaggaaagaggaagaacgcat

SEQ ID NO: 7691962 - DNA, 22 bp, Homo sapiens
ccaggaaaataccaagctttaa

SEQ ID NO: 7691963 - DNA, 22 bp, Homo sapiens
ccaggaaaataccaagctttaa

SEQ ID NO: 7691964 - DNA, 22 bp, Homo sapiens
ccaggaaacctgcgccatccag

SEQ ID NO: 7691965 - DNA, 22 bp, Homo sapiens
ccagcttcggcaagcagacttt

SEQ ID NO: 7691966 - DNA, 22 bp, Homo sapiens
ccagcttcggcaagcagacttt

SEQ ID NO: 7691967 - DNA, 22 bp, Homo sapiens
ccagcttcatgggcatgcacca

SEQ ID NO: 7691968 - DNA, 22 bp, Homo sapiens
ccagcttcatgggcatgcacca

SEQ ID NO: 7691969 - DNA, 22 bp, Homo sapiens
ccagcttctccttatgtcctca

SEQ ID NO: 7691970 - DNA, 22 bp, Homo sapiens
ccaggaaaaacacattgaagag

SEQ ID NO: 7691971 - DNA, 22 bp, Homo sapiens
ccaggaaaaagagaaacatggt

SEQ ID NO: 7691972 - DNA, 22 bp, Homo sapiens
ccaggaaaaagagaaacatggt

SEQ ID NO: 7691973 - DNA, 22 bp, Homo sapiens
ccaggaagaaacagtctttata

SEQ ID NO: 7691974 - DNA, 22 bp, Homo sapiens
ccaggaagaaacagtctttata

SEQ ID NO: 7691975 - DNA, 22 bp, Homo sapiens
ccaggaagaaacagtctttata

SEQ ID NO: 7691976 - DNA, 22 bp, Homo sapiens
ccaggaagacacatgctcatcc

SEQ ID NO: 7691977 - DNA, 22 bp, Homo sapiens
ccaggaagaaacagtctttata

SEQ ID NO: 7691978 - DNA, 22 bp, Homo sapiens
ccaggaagaaacagtctttata

SEQ ID NO: 7691979 - DNA, 22 bp, Homo sapiens
ccaggaagacacatgctcatcc

SEQ ID NO: 7691980 - DNA, 22 bp, Homo sapiens
ccaggaagacacatgctcatcc

SEQ ID NO: 7691981 - DNA, 22 bp, Homo sapiens
ccaggaagacacatgctcatcc

SEQ ID NO: 7691982 - DNA, 22 bp, Homo sapiens
ccaggaagacacatgctcatcc

SEQ ID NO: 7691983 - DNA, 22 bp, Homo sapiens
ccaggaagacacatgctcatcc

SEQ ID NO: 7691984 - DNA, 22 bp, Homo sapiens
ccaggaagacacatgctcatcc

SEQ ID NO: 7691985 - DNA, 22 bp, Homo sapiens
ccaggaagacacatgctcatcc

SEQ ID NO: 7691986 - DNA, 22 bp, Homo sapiens
ccaggaagacacatgctcatcc

SEQ ID NO: 7691987 - DNA, 22 bp, Homo sapiens
ccaggaaatggcttgcttcttt

SEQ ID NO: 7691988 - DNA, 22 bp, Homo sapiens
ccaggaaatagtgctgtgatct

SEQ ID NO: 7691989 - DNA, 22 bp, Homo sapiens
ccaggaaatagtgctgtgatct

SEQ ID NO: 7691990 - DNA, 16 bp, Homo sapiens
ccaggaacacacagct

SEQ ID NO: 7691991 - DNA, 22 bp, Homo sapiens
ccaggaacaaagccccatccac

SEQ ID NO: 7691992 - DNA, 22 bp, Homo sapiens
ccaggaacaaagccccatccac

SEQ ID NO: 7691993 - DNA, 22 bp, Homo sapiens
ccaggaaatggcttgcttcttt

SEQ ID NO: 7691994 - DNA, 22 bp, Homo sapiens
ccaggaactaagaatcctttag

SEQ ID NO: 7691995 - DNA, 22 bp, Homo sapiens
ccaggaactcagctctgcactt

SEQ ID NO: 7691996 - DNA, 22 bp, Homo sapiens
ccaggaactcagctctgcactt

SEQ ID NO: 7691997 - DNA, 22 bp, Homo sapiens
ccaggaaccgatgatcagaggg

SEQ ID NO: 7691998 - DNA, 16 bp, Homo sapiens
ccaggaacacacagct

SEQ ID NO: 7691999 - DNA, 19 bp, Homo sapiens
ccaggaacccctagctacc

SEQ ID NO: 7692000 - DNA, 22 bp, Homo sapiens
ccaggaaccgatgatcagaggg

SEQ ID NO: 7692001 - DNA, 22 bp, Homo sapiens
ccaggaaccgatgatcagaggg

SEQ ID NO: 7692002 - DNA, 22 bp, Homo sapiens
ccaggaagcctgtgtctctgga

SEQ ID NO: 7692003 - DNA, 22 bp, Homo sapiens
ccaggaagcctgtgtctctgga

SEQ ID NO: 7692004 - DNA, 22 bp, Homo sapiens
ccaggaagcctgtgtctctgga

SEQ ID NO: 7692005 - DNA, 22 bp, Homo sapiens
ccaggaagcctcagatgctgag

SEQ ID NO: 7692006 - DNA, 22 bp, Homo sapiens
ccaggaagcctcagatgctgag

SEQ ID NO: 7692007 - DNA, 22 bp, Homo sapiens
ccaggaagcctcagatgctgag

SEQ ID NO: 7692008 - DNA, 22 bp, Homo sapiens
ccaggaagcctgtgtctctgga

SEQ ID NO: 7692009 - DNA, 22 bp, Homo sapiens
ccaggaagcctgtgtctctgga

SEQ ID NO: 7692010 - DNA, 22 bp, Homo sapiens
ccaggaagcctgtgtctctgga

SEQ ID NO: 7692011 - DNA, 22 bp, Homo sapiens
ccaggaagcctgtgtctctgga

SEQ ID NO: 7692012 - DNA, 22 bp, Homo sapiens
ccaggaagcctgtgtctctgga

SEQ ID NO: 7692013 - DNA, 22 bp, Homo sapiens
ccaggaagcctcagatgctgag

SEQ ID NO: 7692014 - DNA, 22 bp, Homo sapiens
ccaggaagcctcagatgctgag

SEQ ID NO: 7692015 - DNA, 22 bp, Homo sapiens
ccaggaagcctcagatgctgag

SEQ ID NO: 7692016 - DNA, 22 bp, Homo sapiens
ccaggaagcctcagatgctgag

SEQ ID NO: 7692017 - DNA, 22 bp, Homo sapiens
ccaggaagcctcagatgctgag

SEQ ID NO: 7692018 - DNA, 22 bp, Homo sapiens
ccaggaagcataatgtagtggg

SEQ ID NO: 7692019 - DNA, 22 bp, Homo sapiens
ccaggaagcataatgtagtggg

SEQ ID NO: 7692020 - DNA, 22 bp, Homo sapiens
ccaggaagcataatgtagtggg

SEQ ID NO: 7692021 - DNA, 22 bp, Homo sapiens
ccaggaagcctcagatgctgag

SEQ ID NO: 7692022 - DNA, 22 bp, Homo sapiens
ccaggaagcctcagatgctgag

SEQ ID NO: 7692023 - DNA, 23 bp, Homo sapiens
ccaggaagaggccatccacagtc

SEQ ID NO: 7692024 - DNA, 23 bp, Homo sapiens
ccaggaagaggccatccacagtc

SEQ ID NO: 7692025 - DNA, 23 bp, Homo sapiens
ccaggaagaggccatccacagtc

SEQ ID NO: 7692026 - DNA, 23 bp, Homo sapiens
ccaggaagaggccatccacagtc

SEQ ID NO: 7692027 - DNA, 23 bp, Homo sapiens
ccaggaagaggccatccacagtc

SEQ ID NO: 7692028 - DNA, 22 bp, Homo sapiens
ccaggaagacacatgctcatcc

SEQ ID NO: 7692029 - DNA, 23 bp, Homo sapiens
ccaggaagaggccatccacagtc

SEQ ID NO: 7692030 - DNA, 23 bp, Homo sapiens
ccaggaagaggccatccacagtc

SEQ ID NO: 7692031 - DNA, 23 bp, Homo sapiens
ccaggaagaggccatccacagtc

SEQ ID NO: 7692032 - DNA, 23 bp, Homo sapiens
ccaggaagaggccatccacagtc

SEQ ID NO: 7692033 - DNA, 22 bp, Homo sapiens
ccaggaagatttattttggctt

SEQ ID NO: 7692034 - DNA, 22 bp, Homo sapiens
ccaggaagcataatgtagtggg

SEQ ID NO: 7692035 - DNA, 22 bp, Homo sapiens
ccaggaagcataatgtagtggg

SEQ ID NO: 7692036 - DNA, 22 bp, Homo sapiens
ccaggaagatttattttggctt

SEQ ID NO: 7692037 - DNA, 22 bp, Homo sapiens
ccaggaagcataatgtagtggg

SEQ ID NO: 7692038 - DNA, 22 bp, Homo sapiens
ccaggaagcataatgtagtggg

SEQ ID NO: 7692039 - DNA, 22 bp, Homo sapiens
ccaggaagcataatgtagtggg

SEQ ID NO: 7692040 - DNA, 23 bp, Homo sapiens
ccaggaagaggccatccacagtc

SEQ ID NO: 7692041 - DNA, 23 bp, Homo sapiens
ccaggaagaggccatccacagtc

SEQ ID NO: 7692042 - DNA, 23 bp, Homo sapiens
ccaggaagaggccatccacagtc

SEQ ID NO: 7692043 - DNA, 22 bp, Homo sapiens
ccaggaagatttattttggctt

SEQ ID NO: 7692044 - DNA, 22 bp, Homo sapiens
ccaggaagatttattttggctt

SEQ ID NO: 7692045 - DNA, 22 bp, Homo sapiens
ccaggaagatttattttggctt

SEQ ID NO: 7692046 - DNA, 22 bp, Homo sapiens
ccaggaagcggtgagggctgcc

SEQ ID NO: 7692047 - DNA, 22 bp, Homo sapiens
ccaggaagcggtgagggctgcc

SEQ ID NO: 7692048 - DNA, 22 bp, Homo sapiens
ccaggaagcggtgagggctgcc

SEQ ID NO: 7692049 - DNA, 22 bp, Homo sapiens
ccaggaagcggtgagggctgcc

SEQ ID NO: 7692050 - DNA, 22 bp, Homo sapiens
ccaggaagcctttttctttgac

SEQ ID NO: 7692051 - DNA, 22 bp, Homo sapiens
ccaggaagcggtgagggctgcc

SEQ ID NO: 7692052 - DNA, 22 bp, Homo sapiens
ccaggaagcggtgagggctgcc

SEQ ID NO: 7692053 - DNA, 22 bp, Homo sapiens
ccaggaagcggtgagggctgcc

SEQ ID NO: 7692054 - DNA, 22 bp, Homo sapiens
ccaggaagcctttttctttgac

SEQ ID NO: 7692055 - DNA, 22 bp, Homo sapiens
ccaggaagcctttttctttgac

SEQ ID NO: 7692056 - DNA, 22 bp, Homo sapiens
ccaggaagcctgtgtctctgga

SEQ ID NO: 7692057 - DNA, 22 bp, Homo sapiens
ccaggaagcctgtgtctctgga

SEQ ID NO: 7692058 - DNA, 22 bp, Homo sapiens
ccaggaagcctttttctttgac

SEQ ID NO: 7692059 - DNA, 22 bp, Homo sapiens
ccaggaagcctttttctttgac

SEQ ID NO: 7692060 - DNA, 22 bp, Homo sapiens
ccaggaagcctttttctttgac

SEQ ID NO: 7692061 - DNA, 22 bp, Homo sapiens
ccaggaagctctgctccacggg

SEQ ID NO: 7692062 - DNA, 22 bp, Homo sapiens
ccaggaagctctgctccacggg

SEQ ID NO: 7692063 - DNA, 22 bp, Homo sapiens
ccaggaagctctgctccacggg

SEQ ID NO: 7692064 - DNA, 22 bp, Homo sapiens
ccaggaagcggtgagggctgcc

SEQ ID NO: 7692065 - DNA, 22 bp, Homo sapiens
ccaggaagcggtgagggctgcc

SEQ ID NO: 7692066 - DNA, 22 bp, Homo sapiens
ccaggaagcggtgagggctgcc

SEQ ID NO: 7692067 - DNA, 22 bp, Homo sapiens
ccaggaagcggtgagggctgcc

SEQ ID NO: 7692068 - DNA, 22 bp, Homo sapiens
ccaggaagcggtgagggctgcc

SEQ ID NO: 7692069 - DNA, 22 bp, Homo sapiens
ccaggaagcggtgagggctgcc

SEQ ID NO: 7692070 - DNA, 22 bp, Homo sapiens
ccaggaagctctgctccacggg

SEQ ID NO: 7692071 - DNA, 22 bp, Homo sapiens
ccaggaagctctgctccacggg

SEQ ID NO: 7692072 - DNA, 22 bp, Homo sapiens
ccaggaagctctgctccacggg

SEQ ID NO: 7692073 - DNA, 22 bp, Homo sapiens
ccaggaagctctgctccacggg

SEQ ID NO: 7692074 - DNA, 22 bp, Homo sapiens
ccaggaagctctgctccacggg

SEQ ID NO: 7692075 - DNA, 22 bp, Homo sapiens
ccaggaagctctgctccacggg

SEQ ID NO: 7692076 - DNA, 22 bp, Homo sapiens
ccaggaagctgtctgatatgaa

SEQ ID NO: 7692077 - DNA, 22 bp, Homo sapiens
ccaggaagctgtctgatatgaa

SEQ ID NO: 7692078 - DNA, 22 bp, Homo sapiens
ccaggaagctgtctgatatgaa

SEQ ID NO: 7692079 - DNA, 22 bp, Homo sapiens
ccaggaagctgtctgatatgaa

SEQ ID NO: 7692080 - DNA, 22 bp, Homo sapiens
ccaggaagctgtctgatatgaa

SEQ ID NO: 7692081 - DNA, 22 bp, Homo sapiens
ccaggaagctgtctgatatgaa

SEQ ID NO: 7692082 - DNA, 22 bp, Homo sapiens
ccaggaaggaagcaggggtttc

SEQ ID NO: 7692083 - DNA, 22 bp, Homo sapiens
ccaggaaggaagcaggggtttc

SEQ ID NO: 7692084 - DNA, 22 bp, Homo sapiens
ccaggaaggaagcaggggtttc

SEQ ID NO: 7692085 - DNA, 22 bp, Homo sapiens
ccaggaagctgtgagattccaa

SEQ ID NO: 7692086 - DNA, 22 bp, Homo sapiens
ccaggaagctgtgagattccaa

SEQ ID NO: 7692087 - DNA, 22 bp, Homo sapiens
ccaggaagctgtgagattccaa

SEQ ID NO: 7692088 - DNA, 22 bp, Homo sapiens
ccaggaagctgtgagattccaa

SEQ ID NO: 7692089 - DNA, 21 bp, Homo sapiens
ccaggaaggactgagctccct

SEQ ID NO: 7692090 - DNA, 21 bp, Homo sapiens
ccaggaaggactgagctccct

SEQ ID NO: 7692091 - DNA, 21 bp, Homo sapiens
ccaggaaggactgagctccct

SEQ ID NO: 7692092 - DNA, 22 bp, Homo sapiens
ccaggaaggaagcaggggtttc

SEQ ID NO: 7692093 - DNA, 22 bp, Homo sapiens
ccaggaaggaagcaggggtttc

SEQ ID NO: 7692094 - DNA, 22 bp, Homo sapiens
ccaggaaggaagcaggggtttc

SEQ ID NO: 7692095 - DNA, 22 bp, Homo sapiens
ccaggaaggaagcaggggtttc

SEQ ID NO: 7692096 - DNA, 22 bp, Homo sapiens
ccaggaaggaagcaggggtttc

SEQ ID NO: 7692097 - DNA, 22 bp, Homo sapiens
ccaggaggatggttgttaggtg

SEQ ID NO: 7692098 - DNA, 22 bp, Homo sapiens
ccaggaggatgattttaagagg

SEQ ID NO: 7692099 - DNA, 22 bp, Homo sapiens
ccaggaggatggttgttaggtg

SEQ ID NO: 7692100 - DNA, 22 bp, Homo sapiens
ccaggaggatggttgttaggtg

SEQ ID NO: 7692101 - DNA, 22 bp, Homo sapiens
ccaggaggatggttgttaggtg

SEQ ID NO: 7692102 - DNA, 22 bp, Homo sapiens
ccaggaggatgattttaagagg

SEQ ID NO: 7692103 - DNA, 22 bp, Homo sapiens
ccaggaggatgattttaagagg

SEQ ID NO: 7692104 - DNA, 22 bp, Homo sapiens
ccaggaggatgattttaagagg

SEQ ID NO: 7692105 - DNA, 22 bp, Homo sapiens
ccaggagcgcgtgaacaggctg

SEQ ID NO: 7692106 - DNA, 22 bp, Homo sapiens
ccaggagcgcgtgaacaggctg

SEQ ID NO: 7692107 - DNA, 21 bp, Homo sapiens
ccaggaaggactgagctccct

SEQ ID NO: 7692108 - DNA, 21 bp, Homo sapiens
ccaggaaggactgagctccct

SEQ ID NO: 7692109 - DNA, 21 bp, Homo sapiens
ccaggaaggactgagctccct

SEQ ID NO: 7692110 - DNA, 21 bp, Homo sapiens
ccaggaaggactgagctccct

SEQ ID NO: 7692111 - DNA, 22 bp, Homo sapiens
ccaggagcgcgtgaacaggctg

SEQ ID NO: 7692112 - DNA, 22 bp, Homo sapiens
ccaggagcgcgtgaacaggctg

SEQ ID NO: 7692113 - DNA, 21 bp, Homo sapiens
ccaggaaggactgagctccct

SEQ ID NO: 7692114 - DNA, 22 bp, Homo sapiens
ccaggagcctgggccaggctgg

SEQ ID NO: 7692115 - DNA, 22 bp, Homo sapiens
ccaggaggcaatatcaagtcca

SEQ ID NO: 7692116 - DNA, 22 bp, Homo sapiens
ccaggaggcaatatcaagtcca

SEQ ID NO: 7692117 - DNA, 22 bp, Homo sapiens
ccaggaggcaatatcaagtcca

SEQ ID NO: 7692118 - DNA, 22 bp, Homo sapiens
ccaggaggcaatatcaagtcca

SEQ ID NO: 7692119 - DNA, 22 bp, Homo sapiens
ccaggaggcaatatcaagtcca

SEQ ID NO: 7692120 - DNA, 22 bp, Homo sapiens
ccaggaggatggttgttaggtg

SEQ ID NO: 7692121 - DNA, 22 bp, Homo sapiens
ccaggaggcagaagttgcagtg

SEQ ID NO: 7692122 - DNA, 22 bp, Homo sapiens
ccaggaggcaatatcaagtcca

SEQ ID NO: 7692123 - DNA, 22 bp, Homo sapiens
ccaggaggcaatatcaagtcca

SEQ ID NO: 7692124 - DNA, 22 bp, Homo sapiens
ccaggaggcaatatcaagtcca

SEQ ID NO: 7692125 - DNA, 22 bp, Homo sapiens
ccaggaggcagaagttgcagtg

SEQ ID NO: 7692126 - DNA, 22 bp, Homo sapiens
ccaggaggcagaagttgcagtg

SEQ ID NO: 7692127 - DNA, 22 bp, Homo sapiens
ccaggaggcagaagttgcagtg

SEQ ID NO: 7692128 - DNA, 22 bp, Homo sapiens
ccaggaggcagaagttgcagtg

SEQ ID NO: 7692129 - DNA, 22 bp, Homo sapiens
ccaggaggcagaagttgcagtg

SEQ ID NO: 7692130 - DNA, 22 bp, Homo sapiens
ccaggaggcagaagttgcagtg

SEQ ID NO: 7692131 - DNA, 22 bp, Homo sapiens
ccaggaggcagaagttgcagtg

SEQ ID NO: 7692132 - DNA, 22 bp, Homo sapiens
tctgtcataaacacacacaagc

SEQ ID NO: 7692133 - DNA, 22 bp, Homo sapiens
tctgtcataaacacacacaagc

SEQ ID NO: 7692134 - DNA, 19 bp, Homo sapiens
tctgtcagtgcatcacctc

SEQ ID NO: 7692135 - DNA, 19 bp, Homo sapiens
tctgtcagtgcatcacctc

SEQ ID NO: 7692136 - DNA, 22 bp, Homo sapiens
tctgtcagcccctcagctgtca

SEQ ID NO: 7692137 - DNA, 22 bp, Homo sapiens
tctgtcagcccctcagctgtca

SEQ ID NO: 7692138 - DNA, 22 bp, Homo sapiens
tctgtcaggagattggcagctg

SEQ ID NO: 7692139 - DNA, 22 bp, Homo sapiens
tctgtcacttttatttactgaa

SEQ ID NO: 7692140 - DNA, 23 bp, Homo sapiens
tctgtcactttctgctgtggagt

SEQ ID NO: 7692141 - DNA, 21 bp, Homo sapiens
tctgtcagaaaagctgaggct

SEQ ID NO: 7692142 - DNA, 21 bp, Homo sapiens
tctgtcagaaaagctgaggct

SEQ ID NO: 7692143 - DNA, 19 bp, Homo sapiens
tctgtcactgggggtattc

SEQ ID NO: 7692144 - DNA, 22 bp, Homo sapiens
tctgtcactgagctcaggattc

SEQ ID NO: 7692145 - DNA, 22 bp, Homo sapiens
tctgtcacttaagaattgccta

SEQ ID NO: 7692146 - DNA, 22 bp, Homo sapiens
tctgtcacttaagaattgccta

SEQ ID NO: 7692147 - DNA, 22 bp, Homo sapiens
tctgtcacttattaagatggat

SEQ ID NO: 7692148 - DNA, 23 bp, Homo sapiens
tctgtcactttctgctgtggagt

SEQ ID NO: 7692149 - DNA, 22 bp, Homo sapiens
tctgtcacttattaagatggat

SEQ ID NO: 7692150 - DNA, 23 bp, Homo sapiens
tctgtcactttctgctgtggagt

SEQ ID NO: 7692151 - DNA, 23 bp, Homo sapiens
tctgtcacctatggctgctcttc

SEQ ID NO: 7692152 - DNA, 23 bp, Homo sapiens
tctgtcacctatggctgctcttc

SEQ ID NO: 7692153 - DNA, 22 bp, Homo sapiens
tctgtcaccgagggcatccaaa

SEQ ID NO: 7692154 - DNA, 22 bp, Homo sapiens
tctgtcaccgagggcatccaaa

SEQ ID NO: 7692155 - DNA, 22 bp, Homo sapiens
tctgtcacccgagcaggcgaga

SEQ ID NO: 7692156 - DNA, 22 bp, Homo sapiens
tctgtcacccaggctggagtgc

SEQ ID NO: 7692157 - DNA, 22 bp, Homo sapiens
tctgtcacccctgtttctggct

SEQ ID NO: 7692158 - DNA, 22 bp, Homo sapiens
tctgtcacccctgtttctggct

SEQ ID NO: 7692159 - DNA, 22 bp, Homo sapiens
tctgtcactccctgatgatgaa

SEQ ID NO: 7692160 - DNA, 23 bp, Homo sapiens
tctgtcacctatggctgctcttc

SEQ ID NO: 7692161 - DNA, 22 bp, Homo sapiens
tctgtcactccctgatgatgaa

SEQ ID NO: 7692162 - DNA, 22 bp, Homo sapiens
tctgtcactctagagatggcag

SEQ ID NO: 7692163 - DNA, 22 bp, Homo sapiens
tctgtcactctagagatggcag

SEQ ID NO: 7692164 - DNA, 22 bp, Homo sapiens
tctgtcactattggccagaaca

SEQ ID NO: 7692165 - DNA, 22 bp, Homo sapiens
ccaggaggcggaaggtacagtg

SEQ ID NO: 7692166 - DNA, 22 bp, Homo sapiens
ccaggaggcggaaggtacagtg

SEQ ID NO: 7692167 - DNA, 22 bp, Homo sapiens
ccaggaggcggaaggtacagtg

SEQ ID NO: 7692168 - DNA, 22 bp, Homo sapiens
ccaggaggcggaaggtacagtg

SEQ ID NO: 7692169 - DNA, 22 bp, Homo sapiens
ccaggaggcggaaggtacagtg

SEQ ID NO: 7692170 - DNA, 22 bp, Homo sapiens
ccaggaggcggaaggtacagtg

SEQ ID NO: 7692171 - DNA, 22 bp, Homo sapiens
ccaggaggcggaaggtacagtg

SEQ ID NO: 7692172 - DNA, 22 bp, Homo sapiens
ccaggaggcagaggttgtagtg

SEQ ID NO: 7692173 - DNA, 22 bp, Homo sapiens
ccaggaggcagaggttgtagtg

SEQ ID NO: 7692174 - DNA, 22 bp, Homo sapiens
ccaggaggcagaggttgtagtg

SEQ ID NO: 7692175 - DNA, 22 bp, Homo sapiens
ccaggaggcagaggttgtagtg

SEQ ID NO: 7692176 - DNA, 22 bp, Homo sapiens
ccaggaggcagaggttgtagtg

SEQ ID NO: 7692177 - DNA, 22 bp, Homo sapiens
ccaggaggcagaggttacagtg

SEQ ID NO: 7692178 - DNA, 22 bp, Homo sapiens
ccaggaggcagaggttacagtg

SEQ ID NO: 7692179 - DNA, 22 bp, Homo sapiens
ccaggaggcagaggttacagtg

SEQ ID NO: 7692180 - DNA, 22 bp, Homo sapiens
ccaggaggcagaggttacagtg

SEQ ID NO: 7692181 - DNA, 22 bp, Homo sapiens
ccaggaggcagaggttacagtg

SEQ ID NO: 7692182 - DNA, 22 bp, Homo sapiens
ccaggaggcagaggttacagtg

SEQ ID NO: 7692183 - DNA, 22 bp, Homo sapiens
ccaggaggcagaggttacagtg

SEQ ID NO: 7692184 - DNA, 22 bp, Homo sapiens
ccaggaggcagaagttgcagtg

SEQ ID NO: 7692185 - DNA, 22 bp, Homo sapiens
tctgtcacccctgtttctggct

SEQ ID NO: 7692186 - DNA, 22 bp, Homo sapiens
tctgtcacccaggctggagtgc

SEQ ID NO: 7692187 - DNA, 22 bp, Homo sapiens
ccaggaggcggaggttgcagcg

SEQ ID NO: 7692188 - DNA, 22 bp, Homo sapiens
ccaggaggcggaggttgcagcg

SEQ ID NO: 7692189 - DNA, 22 bp, Homo sapiens
ccaggaggcggaggttgcagcg

SEQ ID NO: 7692190 - DNA, 22 bp, Homo sapiens
ccaggaggcggaggttgcagcg

SEQ ID NO: 7692191 - DNA, 22 bp, Homo sapiens
ccaggaggcggaggttgcagcg

SEQ ID NO: 7692192 - DNA, 22 bp, Homo sapiens
ccaggaggcggaaggtacagtg

SEQ ID NO: 7692193 - DNA, 22 bp, Homo sapiens
ccaggaggcggaaggtacagtg

SEQ ID NO: 7692194 - DNA, 22 bp, Homo sapiens
ccaggaggcggaaggtacagtg

SEQ ID NO: 7692195 - DNA, 22 bp, Homo sapiens
ccaggaggcggaaggtacagtg

SEQ ID NO: 7692196 - DNA, 22 bp, Homo sapiens
ccaggaggcggaaggtacagtg

SEQ ID NO: 7692197 - DNA, 22 bp, Homo sapiens
ccaggaggcggaaggtacagtg

SEQ ID NO: 7692198 - DNA, 22 bp, Homo sapiens
tctgtcttggccagccatctgg

SEQ ID NO: 7692199 - DNA, 17 bp, Homo sapiens
tctgtcttgactgtcac

SEQ ID NO: 7692200 - DNA, 17 bp, Homo sapiens
tctgtcttgactgtcac

SEQ ID NO: 7692201 - DNA, 17 bp, Homo sapiens
tctgtcttgactgtcac

SEQ ID NO: 7692202 - DNA, 17 bp, Homo sapiens
tctgtcttgactgtcac

SEQ ID NO: 7692203 - DNA, 17 bp, Homo sapiens
tctgtcttgactgtcac

SEQ ID NO: 7692204 - DNA, 22 bp, Homo sapiens
tctgtcttggccagccatctgg

SEQ ID NO: 7692205 - DNA, 22 bp, Homo sapiens
tctgtcttcttcattgcctata

SEQ ID NO: 7692206 - DNA, 22 bp, Homo sapiens
tctgtcttctgtagctaataat

SEQ ID NO: 7692207 - DNA, 21 bp, Homo sapiens
tctgtcttcctcagcctaagg

SEQ ID NO: 7692208 - DNA, 22 bp, Homo sapiens
tctgtcttctgtagctaataat

SEQ ID NO: 7692209 - DNA, 21 bp, Homo sapiens
tctgtcttcctcagcctaagg

SEQ ID NO: 7692210 - DNA, 22 bp, Homo sapiens
tctgtggcacgattgcactgca

SEQ ID NO: 7692211 - DNA, 19 bp, Homo sapiens
tctgtggcacctgggaggg

SEQ ID NO: 7692212 - DNA, 19 bp, Homo sapiens
tctgtggcacctgggaggg

SEQ ID NO: 7692213 - DNA, 22 bp, Homo sapiens
tctgtggcaaacacagtgacca

SEQ ID NO: 7692214 - DNA, 22 bp, Homo sapiens
tctgtggcaaacacagtgacca

SEQ ID NO: 7692215 - DNA, 19 bp, Homo sapiens
tctgtggcacctgggaggg

SEQ ID NO: 7692216 - DNA, 19 bp, Homo sapiens
tctgtggcacctgggaggg

SEQ ID NO: 7692217 - DNA, 18 bp, Homo sapiens
tctgtggcagcagtgcac

SEQ ID NO: 7692218 - DNA, 21 bp, Homo sapiens
tctgtggcagcatgatgaggt

SEQ ID NO: 7692219 - DNA, 21 bp, Homo sapiens
tctgtggcagcatgatgaggt

SEQ ID NO: 7692220 - DNA, 20 bp, Homo sapiens
tctgtggcaggtggcgcttg

SEQ ID NO: 7692221 - DNA, 18 bp, Homo sapiens
tctgtggcagcagtgcac

SEQ ID NO: 7692222 - DNA, 18 bp, Homo sapiens
tctgtggcagcagtgcac

SEQ ID NO: 7692223 - DNA, 22 bp, Homo sapiens
tctgtcttagcatctttgctca

SEQ ID NO: 7692224 - DNA, 22 bp, Homo sapiens
tctgtcttagccatctcaggct

SEQ ID NO: 7692225 - DNA, 22 bp, Homo sapiens
tctgtcttagccatctcaggct

SEQ ID NO: 7692226 - DNA, 22 bp, Homo sapiens
tctgtcttcatcagcatgtgat

SEQ ID NO: 7692227 - DNA, 23 bp, Homo sapiens
tctgtctgtgtatgtgcagaaag

SEQ ID NO: 7692228 - DNA, 23 bp, Homo sapiens
tctgtctgtgtatgtgcagaaag

SEQ ID NO: 7692229 - DNA, 17 bp, Homo sapiens
tctgtctgtggtccact

SEQ ID NO: 7692230 - DNA, 17 bp, Homo sapiens
tctgtctgtggtccact

SEQ ID NO: 7692231 - DNA, 18 bp, Homo sapiens
tctgtctgtgttgtcttt

SEQ ID NO: 7692232 - DNA, 22 bp, Homo sapiens
tctgtcttagcatctttgctca

SEQ ID NO: 7692233 - DNA, 18 bp, Homo sapiens
tctgtctgtgttgtcttt

SEQ ID NO: 7692234 - DNA, 22 bp, Homo sapiens
tctgtctgggtgcctcgagtac

SEQ ID NO: 7692235 - DNA, 22 bp, Homo sapiens
tctgtctggtccaggaagatgt

SEQ ID NO: 7692236 - DNA, 21 bp, Homo sapiens
tctgtctggttttagagtggc

SEQ ID NO: 7692237 - DNA, 22 bp, Homo sapiens
tctgtcatcaaatatgctttct

SEQ ID NO: 7692238 - DNA, 22 bp, Homo sapiens
tctgtcatccaggctggaatat

SEQ ID NO: 7692239 - DNA, 22 bp, Homo sapiens
tctgtcatccaggctggaatat

SEQ ID NO: 7692240 - DNA, 22 bp, Homo sapiens
tctgtctgggtgcctcgagtac

SEQ ID NO: 7692241 - DNA, 22 bp, Homo sapiens
tctgtctgtagttttacatgat

SEQ ID NO: 7692242 - DNA, 22 bp, Homo sapiens
tctgtctgtccagggcccccgc

SEQ ID NO: 7692243 - DNA, 22 bp, Homo sapiens
tctgtctgtccagggcccccgc

SEQ ID NO: 7692244 - DNA, 17 bp, Homo sapiens
tctgtctgtggtccact

SEQ ID NO: 7692245 - DNA, 21 bp, Homo sapiens
tctgtctggttttagagtggc

SEQ ID NO: 7692246 - DNA, 21 bp, Homo sapiens
tctgtctggttttagagtggc

SEQ ID NO: 7692247 - DNA, 18 bp, Homo sapiens
tctgtctgtacaagtatc

SEQ ID NO: 7692248 - DNA, 19 bp, Homo sapiens
tctgcctctggtcaggctc

SEQ ID NO: 7692249 - DNA, 19 bp, Homo sapiens
tctgcctctggtcaggctc

SEQ ID NO: 7692250 - DNA, 22 bp, Homo sapiens
tctgcctctttcaggcctggca

SEQ ID NO: 7692251 - DNA, 22 bp, Homo sapiens
tctgcctctttcaggcctggca

SEQ ID NO: 7692252 - DNA, 22 bp, Homo sapiens
tctgcctctttcaggcctggca

SEQ ID NO: 7692253 - DNA, 22 bp, Homo sapiens
tctgcctctttcaggcctggca

SEQ ID NO: 7692254 - DNA, 22 bp, Homo sapiens
tctgcctctttcaggcctggca

SEQ ID NO: 7692255 - DNA, 22 bp, Homo sapiens
tctgcctgaaattcacatgtaa

SEQ ID NO: 7692256 - DNA, 22 bp, Homo sapiens
tctgcctgaaattcacatgtaa

SEQ ID NO: 7692257 - DNA, 22 bp, Homo sapiens
tctgcctgaaattcacatgtaa

SEQ ID NO: 7692258 - DNA, 22 bp, Homo sapiens
tctgcctgaaattcacatgtaa

SEQ ID NO: 7692259 - DNA, 22 bp, Homo sapiens
tctgcctctttcaggcctggca

SEQ ID NO: 7692260 - DNA, 22 bp, Homo sapiens
tctgcctgaaattcacatgtaa

SEQ ID NO: 7692261 - DNA, 22 bp, Homo sapiens
tctgcctgaaattcacatgtaa

SEQ ID NO: 7692262 - DNA, 22 bp, Homo sapiens
tctgcctgaaattcacatgtaa

SEQ ID NO: 7692263 - DNA, 22 bp, Homo sapiens
tctgccttgccgaattccaggc

SEQ ID NO: 7692264 - DNA, 22 bp, Homo sapiens
tctgccttgccgaattccaggc

SEQ ID NO: 7692265 - DNA, 22 bp, Homo sapiens
tctgccttgccgaattccaggc

SEQ ID NO: 7692266 - DNA, 22 bp, Homo sapiens
tctgcctgagaagtggggtgcc

SEQ ID NO: 7692267 - DNA, 22 bp, Homo sapiens
tctgccttgccgaattccaggc

SEQ ID NO: 7692268 - DNA, 22 bp, Homo sapiens
tctgccttggcaaccacagctt

SEQ ID NO: 7692269 - DNA, 22 bp, Homo sapiens
tctgccttggaaatttcaacag

SEQ ID NO: 7692270 - DNA, 22 bp, Homo sapiens
tctgccttggaaatttcaacag

SEQ ID NO: 7692271 - DNA, 22 bp, Homo sapiens
tctgccttggcaaccacagctt

SEQ ID NO: 7692272 - DNA, 22 bp, Homo sapiens
tctgcctgaaccactcttggag

SEQ ID NO: 7692273 - DNA, 22 bp, Homo sapiens
tctgcctgaaccactcttggag

SEQ ID NO: 7692274 - DNA, 22 bp, Homo sapiens
tctgcctgaaccactcttggag

SEQ ID NO: 7692275 - DNA, 22 bp, Homo sapiens
tctgcctgaaccactcttggag

SEQ ID NO: 7692276 - DNA, 22 bp, Homo sapiens
tctgcctgaatctcttagaaca

SEQ ID NO: 7692277 - DNA, 22 bp, Homo sapiens
tctgcctgaatctcttagaaca

SEQ ID NO: 7692278 - DNA, 22 bp, Homo sapiens
tctgcctgaaccactcttggag

SEQ ID NO: 7692279 - DNA, 22 bp, Homo sapiens
tctgcctgagaagtggggtgcc

SEQ ID NO: 7692280 - DNA, 22 bp, Homo sapiens
tctgcctgagaagtggggtgcc

SEQ ID NO: 7692281 - DNA, 22 bp, Homo sapiens
tctgcctttcacacagacggcc

SEQ ID NO: 7692282 - DNA, 22 bp, Homo sapiens
tctgcctttcacacagacggcc

SEQ ID NO: 7692283 - DNA, 22 bp, Homo sapiens
tctgcctttcccaggctactgt

SEQ ID NO: 7692284 - DNA, 22 bp, Homo sapiens
tctgcctttcccaggctactgt

SEQ ID NO: 7692285 - DNA, 22 bp, Homo sapiens
tctgccttgtttgagctttgac

SEQ ID NO: 7692286 - DNA, 22 bp, Homo sapiens
tctgccttgtttgagctttgac

SEQ ID NO: 7692287 - DNA, 22 bp, Homo sapiens
tctgccttgtttgagctttgac

SEQ ID NO: 7692288 - DNA, 22 bp, Homo sapiens
tctgccttgttgcaggcgctat

SEQ ID NO: 7692289 - DNA, 22 bp, Homo sapiens
tctgccttgttgcaggcgctat

SEQ ID NO: 7692290 - DNA, 22 bp, Homo sapiens
tctgccttgttgcaggcgctat

SEQ ID NO: 7692291 - DNA, 22 bp, Homo sapiens
tctgcctttctcaagggcaaaa

SEQ ID NO: 7692292 - DNA, 22 bp, Homo sapiens
tctgcctttcccaggctactgt

SEQ ID NO: 7692293 - DNA, 22 bp, Homo sapiens
tctgcctttctcaagggcaaaa

SEQ ID NO: 7692294 - DNA, 22 bp, Homo sapiens
tctgcctttgctttggctgtca

SEQ ID NO: 7692295 - DNA, 22 bp, Homo sapiens
tctgcctttcccaggctactgt

SEQ ID NO: 7692296 - DNA, 22 bp, Homo sapiens
tctgcctttgtggtcgggagaa

SEQ ID NO: 7692297 - DNA, 22 bp, Homo sapiens
tctgcctttgtggtcgggagaa

SEQ ID NO: 7692298 - DNA, 22 bp, Homo sapiens
tctgccttttactagctggatg

SEQ ID NO: 7692299 - DNA, 22 bp, Homo sapiens
tctgccttttactagctggatg

SEQ ID NO: 7692300 - DNA, 22 bp, Homo sapiens
tctgcctttgctttggctgtca

SEQ ID NO: 7692301 - DNA, 22 bp, Homo sapiens
tctgccttttactagctggatg

SEQ ID NO: 7692302 - DNA, 22 bp, Homo sapiens
tctgccttttcactgccactaa

SEQ ID NO: 7692303 - DNA, 22 bp, Homo sapiens
tctgccttttcactgccactaa

SEQ ID NO: 7692304 - DNA, 22 bp, Homo sapiens
tctgccttttcactgccactaa

SEQ ID NO: 7692305 - DNA, 22 bp, Homo sapiens
tctgccttttcactgccactaa

SEQ ID NO: 7692306 - DNA, 22 bp, Homo sapiens
tctgcgccctgtcgcctgctcc

SEQ ID NO: 7692307 - DNA, 22 bp, Homo sapiens
tctgcgccaccttgtgcttgtg

SEQ ID NO: 7692308 - DNA, 22 bp, Homo sapiens
tctgcgccctgtcgcctgctcc

SEQ ID NO: 7692309 - DNA, 22 bp, Homo sapiens
tctgcgccctgtcgcctgctcc

SEQ ID NO: 7692310 - DNA, 22 bp, Homo sapiens
tctgcgccgcatgtgttctttc

SEQ ID NO: 7692311 - DNA, 22 bp, Homo sapiens
tctgcgcgctgctggtaccgaa

SEQ ID NO: 7692312 - DNA, 22 bp, Homo sapiens
tctgcggtccccttctcgccct

SEQ ID NO: 7692313 - DNA, 22 bp, Homo sapiens
tctgcggtccccttctcgccct

SEQ ID NO: 7692314 - DNA, 22 bp, Homo sapiens
tctgcggtccccttctcgccct

SEQ ID NO: 7692315 - DNA, 22 bp, Homo sapiens
tctgcgtgaatttgcattgtgg

SEQ ID NO: 7692316 - DNA, 22 bp, Homo sapiens
tctgcgtgatgagggtgcagca

SEQ ID NO: 7692317 - DNA, 22 bp, Homo sapiens
tctgcgtggcgtggttctgtgc

SEQ ID NO: 7692318 - DNA, 22 bp, Homo sapiens
tctgcgtggctgctgtgagcgt

SEQ ID NO: 7692319 - DNA, 22 bp, Homo sapiens
tctgcgtgggactgaggaggct

SEQ ID NO: 7692320 - DNA, 22 bp, Homo sapiens
tctgcgttattgaaaagcagcc

SEQ ID NO: 7692321 - DNA, 22 bp, Homo sapiens
ccagctgcttgggaaaatgtct

SEQ ID NO: 7692322 - DNA, 22 bp, Homo sapiens
tctgctaaggcatttgcttgga

SEQ ID NO: 7692323 - DNA, 22 bp, Homo sapiens
tctgctaacaatattgcagact

SEQ ID NO: 7692324 - DNA, 22 bp, Homo sapiens
tctgctaacaatattgcagact

SEQ ID NO: 7692325 - DNA, 22 bp, Homo sapiens
tctgcgttgctcacgctgggag

SEQ ID NO: 7692326 - DNA, 22 bp, Homo sapiens
tctgctaaatagatttggcaat

SEQ ID NO: 7692327 - DNA, 22 bp, Homo sapiens
ccagctgctttttgtcacatgg

SEQ ID NO: 7692328 - DNA, 22 bp, Homo sapiens
ccagctgctttttgtcacatgg

SEQ ID NO: 7692329 - DNA, 22 bp, Homo sapiens
ccagctgctttttgtcacatgg

SEQ ID NO: 7692330 - DNA, 22 bp, Homo sapiens
ccagctgcttgggaaaatgtct

SEQ ID NO: 7692331 - DNA, 22 bp, Homo sapiens
ccagctgcttgggaaaatgtct

SEQ ID NO: 7692332 - DNA, 22 bp, Homo sapiens
ccagctgctttttgtcacatgg

SEQ ID NO: 7692333 - DNA, 22 bp, Homo sapiens
ccagctgctttttgtcacatgg

SEQ ID NO: 7692334 - DNA, 22 bp, Homo sapiens
ccagctgctttttgtcacatgg

SEQ ID NO: 7692335 - DNA, 22 bp, Homo sapiens
ccagctggaaacaaatagagtg

SEQ ID NO: 7692336 - DNA, 22 bp, Homo sapiens
ccagctgggattaagggaaaat

SEQ ID NO: 7692337 - DNA, 22 bp, Homo sapiens
ccagctgggattaagggaaaat

SEQ ID NO: 7692338 - DNA, 22 bp, Homo sapiens
ccagctgggattaagggaaaat

SEQ ID NO: 7692339 - DNA, 22 bp, Homo sapiens
ccagctggggaagtggggcata

SEQ ID NO: 7692340 - DNA, 22 bp, Homo sapiens
ccagctggggaagtggggcata

SEQ ID NO: 7692341 - DNA, 22 bp, Homo sapiens
ccagctggggaagtggggcata

SEQ ID NO: 7692342 - DNA, 22 bp, Homo sapiens
ccagctggggaagtggggcata

SEQ ID NO: 7692343 - DNA, 22 bp, Homo sapiens
ccagctggggaagtggggcata

SEQ ID NO: 7692344 - DNA, 22 bp, Homo sapiens
ccagctggggaagtggggcata

SEQ ID NO: 7692345 - DNA, 22 bp, Homo sapiens
ccagctggggaagtggggcata

SEQ ID NO: 7692346 - DNA, 22 bp, Homo sapiens
ccagctgggtccctgctggggc

SEQ ID NO: 7692347 - DNA, 22 bp, Homo sapiens
ccagctgggtccctgctggggc

SEQ ID NO: 7692348 - DNA, 22 bp, Homo sapiens
ccagctgggtccctgctggggc

SEQ ID NO: 7692349 - DNA, 22 bp, Homo sapiens
ccagctgggtccctgctggggc

SEQ ID NO: 7692350 - DNA, 22 bp, Homo sapiens
ccagctggtaagtgatggagcc

SEQ ID NO: 7692351 - DNA, 22 bp, Homo sapiens
ccagctggtaagtgatggagcc

SEQ ID NO: 7692352 - DNA, 22 bp, Homo sapiens
ccagctggtaagtgatggagcc

SEQ ID NO: 7692353 - DNA, 22 bp, Homo sapiens
ccagctggtaagtgatggagcc

SEQ ID NO: 7692354 - DNA, 22 bp, Homo sapiens
ccagctggtaagtgatggagcc

SEQ ID NO: 7692355 - DNA, 22 bp, Homo sapiens
ccagctggtaagtgatggagcc

SEQ ID NO: 7692356 - DNA, 22 bp, Homo sapiens
ccagctggtaagtgatggagcc

SEQ ID NO: 7692357 - DNA, 22 bp, Homo sapiens
ccagctggtaagtgatggagcc

SEQ ID NO: 7692358 - DNA, 22 bp, Homo sapiens
tctggagcgaggtccctgtctg

SEQ ID NO: 7692359 - DNA, 19 bp, Homo sapiens
tctggagctgatgcaggtg

SEQ ID NO: 7692360 - DNA, 19 bp, Homo sapiens
tctggagctgatgcaggtg

SEQ ID NO: 7692361 - DNA, 19 bp, Homo sapiens
tctggagctgatgcaggtg

SEQ ID NO: 7692362 - DNA, 21 bp, Homo sapiens
tctggagccctaagctgagaa

SEQ ID NO: 7692363 - DNA, 21 bp, Homo sapiens
tctggagccctaagctgagaa

SEQ ID NO: 7692364 - DNA, 22 bp, Homo sapiens
ccagctggttaaaatagagaaa

SEQ ID NO: 7692365 - DNA, 22 bp, Homo sapiens
ccagctggtgttccttaggacc

SEQ ID NO: 7692366 - DNA, 22 bp, Homo sapiens
ccagctggtgttccttaggacc

SEQ ID NO: 7692367 - DNA, 22 bp, Homo sapiens
ccagctggtgttccttaggacc

SEQ ID NO: 7692368 - DNA, 22 bp, Homo sapiens
ccagctggttaaaatagagaaa

SEQ ID NO: 7692369 - DNA, 22 bp, Homo sapiens
ccagctggttaaaatagagaaa

SEQ ID NO: 7692370 - DNA, 22 bp, Homo sapiens
ccagctggttaaaatagagaaa

SEQ ID NO: 7692371 - DNA, 22 bp, Homo sapiens
ccagctggtctgtgctcatgtt

SEQ ID NO: 7692372 - DNA, 22 bp, Homo sapiens
ccagctggtctgtgctcatgtt

SEQ ID NO: 7692373 - DNA, 22 bp, Homo sapiens
ccagctggtctgtgctcatgtt

SEQ ID NO: 7692374 - DNA, 22 bp, Homo sapiens
ccagctggtctgtgctcatgtt

SEQ ID NO: 7692375 - DNA, 22 bp, Homo sapiens
ccagctggtctgtgctcatgtt

SEQ ID NO: 7692376 - DNA, 22 bp, Homo sapiens
ccagctggtaagtgatggagcc

SEQ ID NO: 7692377 - DNA, 22 bp, Homo sapiens
ccagctggtctgtgctcatgtt

SEQ ID NO: 7692378 - DNA, 22 bp, Homo sapiens
ccagctggtctgtgctcatgtt

SEQ ID NO: 7692379 - DNA, 22 bp, Homo sapiens
ccagctggtctgtgctcatgtt

SEQ ID NO: 7692380 - DNA, 22 bp, Homo sapiens
ccagctggtgggtctttctctg

SEQ ID NO: 7692381 - DNA, 22 bp, Homo sapiens
ccagctggtgttccttaggacc

SEQ ID NO: 7692382 - DNA, 22 bp, Homo sapiens
ccagctggtgggtctttctctg

SEQ ID NO: 7692383 - DNA, 22 bp, Homo sapiens
ccagctggtgacatccccaacc

SEQ ID NO: 7692384 - DNA, 22 bp, Homo sapiens
ccagctggtctgtgctcatgtt

SEQ ID NO: 7692385 - DNA, 22 bp, Homo sapiens
ccagctggtgacatccccaacc

SEQ ID NO: 7692386 - DNA, 22 bp, Homo sapiens
ccagctggtgacatccccaacc

SEQ ID NO: 7692387 - DNA, 22 bp, Homo sapiens
ccagctggtgggtctttctctg

SEQ ID NO: 7692388 - DNA, 22 bp, Homo sapiens
tctggctgttgttaggttcctg

SEQ ID NO: 7692389 - DNA, 22 bp, Homo sapiens
tctggctgttaggcctgacctt

SEQ ID NO: 7692390 - DNA, 22 bp, Homo sapiens
tctggctgttaggcctgacctt

SEQ ID NO: 7692391 - DNA, 22 bp, Homo sapiens
tctggctgttgttaggttcctg

SEQ ID NO: 7692392 - DNA, 22 bp, Homo sapiens
tctggctgttgttaggttcctg

SEQ ID NO: 7692393 - DNA, 22 bp, Homo sapiens
tctggctgttgttaggttcctg

SEQ ID NO: 7692394 - DNA, 22 bp, Homo sapiens
tctggctgttaggcctgacctt

SEQ ID NO: 7692395 - DNA, 22 bp, Homo sapiens
tctggctgttgttaggttcctg

SEQ ID NO: 7692396 - DNA, 22 bp, Homo sapiens
tctggctcataggaaggccatt

SEQ ID NO: 7692397 - DNA, 22 bp, Homo sapiens
tctggctcataggaaggccatt

SEQ ID NO: 7692398 - DNA, 22 bp, Homo sapiens
tctggctcatctctccaggtaa

SEQ ID NO: 7692399 - DNA, 22 bp, Homo sapiens
tctggctcataggaaggccatt

SEQ ID NO: 7692400 - DNA, 22 bp, Homo sapiens
tctggctcatctctccaggtaa

SEQ ID NO: 7692401 - DNA, 22 bp, Homo sapiens
tctggctcatctctccaggtaa

SEQ ID NO: 7692402 - DNA, 22 bp, Homo sapiens
tctggctgttaggcctgacctt

SEQ ID NO: 7692403 - DNA, 22 bp, Homo sapiens
tctggcttcacactgaagtttg

SEQ ID NO: 7692404 - DNA, 22 bp, Homo sapiens
tctggcttcacactgaagtttg

SEQ ID NO: 7692405 - DNA, 22 bp, Homo sapiens
tctggcttcaagtcccagctct

SEQ ID NO: 7692406 - DNA, 22 bp, Homo sapiens
tctggcttcaagtcccagctct

SEQ ID NO: 7692407 - DNA, 22 bp, Homo sapiens
tctggcttcaactttactgaaa

SEQ ID NO: 7692408 - DNA, 22 bp, Homo sapiens
tctggctgttttagatgagctc

SEQ ID NO: 7692409 - DNA, 22 bp, Homo sapiens
tctggctgttttagatgagctc

SEQ ID NO: 7692410 - DNA, 22 bp, Homo sapiens
tctggctgttttagatgagctc

SEQ ID NO: 7692411 - DNA, 22 bp, Homo sapiens
tctggctgttttagatgagctc

SEQ ID NO: 7692412 - DNA, 22 bp, Homo sapiens
tctggctgttttagatgagctc

SEQ ID NO: 7692413 - DNA, 22 bp, Homo sapiens
tctggcttcacactgaagtttg

SEQ ID NO: 7692414 - DNA, 22 bp, Homo sapiens
tctggcttcagtagggttcact

SEQ ID NO: 7692415 - DNA, 22 bp, Homo sapiens
tctggcttcagtagggttcact

SEQ ID NO: 7692416 - DNA, 23 bp, Homo sapiens
tctggcttccagtgggttcaacc

SEQ ID NO: 7692417 - DNA, 23 bp, Homo sapiens
tctggcttccagtgggttcaacc

SEQ ID NO: 7692418 - DNA, 22 bp, Homo sapiens
tctggcttcagtagggttcact

SEQ ID NO: 7692419 - DNA, 23 bp, Homo sapiens
tctggcttccagtgggttcaacc

SEQ ID NO: 7692420 - DNA, 22 bp, Homo sapiens
tctggcttcccactctgccggg

SEQ ID NO: 7692421 - DNA, 22 bp, Homo sapiens
tctggcttccctacttactatg

SEQ ID NO: 7692422 - DNA, 22 bp, Homo sapiens
tctggcttccctacttactatg

SEQ ID NO: 7692423 - DNA, 22 bp, Homo sapiens
tctggcttctatgaatgtcctt

SEQ ID NO: 7692424 - DNA, 22 bp, Homo sapiens
tctggcttctatgaatgtcctt

SEQ ID NO: 7692425 - DNA, 22 bp, Homo sapiens
tctggcttcgcagctcccagcc

SEQ ID NO: 7692426 - DNA, 22 bp, Homo sapiens
tctggcttcgcagctcccagcc

SEQ ID NO: 7692427 - DNA, 22 bp, Homo sapiens
tctggcttctcctagagcaatg

SEQ ID NO: 7692428 - DNA, 22 bp, Homo sapiens
tctggcttctcctagagcaatg

SEQ ID NO: 7692429 - DNA, 22 bp, Homo sapiens
tctggcttctcctagagcaatg

SEQ ID NO: 7692430 - DNA, 22 bp, Homo sapiens
tctggcttctgcaggattacta

SEQ ID NO: 7692431 - DNA, 22 bp, Homo sapiens
tctggcttctgcaggattacta

SEQ ID NO: 7692432 - DNA, 22 bp, Homo sapiens
tctggctcatacaagcctgcaa

SEQ ID NO: 7692433 - DNA, 22 bp, Homo sapiens
tctggctcatacaagcctgcaa

SEQ ID NO: 7692434 - DNA, 22 bp, Homo sapiens
tctggctcatacaagcctgcaa

SEQ ID NO: 7692435 - DNA, 22 bp, Homo sapiens
tctggctcataggaaggccatt

SEQ ID NO: 7692436 - DNA, 22 bp, Homo sapiens
tctggaggcaactaacctagtt

SEQ ID NO: 7692437 - DNA, 22 bp, Homo sapiens
tctggaggcaggctgccaggat

SEQ ID NO: 7692438 - DNA, 22 bp, Homo sapiens
tctggaggcaggctgccaggat

SEQ ID NO: 7692439 - DNA, 22 bp, Homo sapiens
tctggaggcaggctgccaggat

SEQ ID NO: 7692440 - DNA, 22 bp, Homo sapiens
tctggaggcaggctgccaggat

SEQ ID NO: 7692441 - DNA, 22 bp, Homo sapiens
tctggagcgaggtccctgtctg

SEQ ID NO: 7692442 - DNA, 22 bp, Homo sapiens
tctggaggcaactaacctagtt

SEQ ID NO: 7692443 - DNA, 22 bp, Homo sapiens
tctggagcttgtttcagatggt

SEQ ID NO: 7692444 - DNA, 22 bp, Homo sapiens
tctggagcttgaagctttggtt

SEQ ID NO: 7692445 - DNA, 22 bp, Homo sapiens
tctggagcttgtttcagatggt

SEQ ID NO: 7692446 - DNA, 22 bp, Homo sapiens
tctggagcttgtttcagatggt

SEQ ID NO: 7692447 - DNA, 22 bp, Homo sapiens
tctggagcttgtttcagatggt

SEQ ID NO: 7692448 - DNA, 22 bp, Homo sapiens
tctggagcttgtttcagatggt

SEQ ID NO: 7692449 - DNA, 22 bp, Homo sapiens
tctggagcttgaagctttggtt

SEQ ID NO: 7692450 - DNA, 22 bp, Homo sapiens
tctggagcttgaagctttggtt

SEQ ID NO: 7692451 - DNA, 22 bp, Homo sapiens
tctggagcttgaagctttggtt

SEQ ID NO: 7692452 - DNA, 22 bp, Homo sapiens
tctggagctggagggcaaggca

SEQ ID NO: 7692453 - DNA, 21 bp, Homo sapiens
tctggagctgcaggctgggca

SEQ ID NO: 7692454 - DNA, 21 bp, Homo sapiens
tctggagctgcaggctgggca

SEQ ID NO: 7692455 - DNA, 21 bp, Homo sapiens
tctggagctgcaggctgggca

SEQ ID NO: 7692456 - DNA, 21 bp, Homo sapiens
tctggagctgcaggctgggca

SEQ ID NO: 7692457 - DNA, 19 bp, Homo sapiens
tctggagctgatgcaggtg

SEQ ID NO: 7692458 - DNA, 19 bp, Homo sapiens
tctggagctgatgcaggtg

SEQ ID NO: 7692459 - DNA, 22 bp, Homo sapiens
tctggagctggagggcaaggca

SEQ ID NO: 7692460 - DNA, 22 bp, Homo sapiens
tctggagctggcagggccctgg

SEQ ID NO: 7692461 - DNA, 22 bp, Homo sapiens
tctggagcttcctcatttacag

SEQ ID NO: 7692462 - DNA, 22 bp, Homo sapiens
tctggagctgggggcttagtat

SEQ ID NO: 7692463 - DNA, 22 bp, Homo sapiens
tctggagctgggggcttagtat

SEQ ID NO: 7692464 - DNA, 22 bp, Homo sapiens
tctggagctgggggcttagtat

SEQ ID NO: 7692465 - DNA, 22 bp, Homo sapiens
ccagctgtgcctaggagcaggg

SEQ ID NO: 7692466 - DNA, 23 bp, Homo sapiens
ccagctgtgcctggcccaggagc

SEQ ID NO: 7692467 - DNA, 23 bp, Homo sapiens
ccagctgtgcctggcccaggagc

SEQ ID NO: 7692468 - DNA, 23 bp, Homo sapiens
ccagctgtgcctggcccaggagc

SEQ ID NO: 7692469 - DNA, 22 bp, Homo sapiens
ccagctgtgctgttggcttgtc

SEQ ID NO: 7692470 - DNA, 22 bp, Homo sapiens
ccagctgtgctgttggcttgtc

SEQ ID NO: 7692471 - DNA, 22 bp, Homo sapiens
ccagctgtgctgttggcttgtc

SEQ ID NO: 7692472 - DNA, 22 bp, Homo sapiens
ccagctgtgctgttggcttgtc

SEQ ID NO: 7692473 - DNA, 21 bp, Homo sapiens
ccagctgttcctcgtccgatg

SEQ ID NO: 7692474 - DNA, 22 bp, Homo sapiens
ccagctgttggagtttcactgc

SEQ ID NO: 7692475 - DNA, 21 bp, Homo sapiens
ccagctgttcctcgtccgatg

SEQ ID NO: 7692476 - DNA, 21 bp, Homo sapiens
ccagctgttcctcgtccgatg

SEQ ID NO: 7692477 - DNA, 22 bp, Homo sapiens
ccagcttcatgggcatgcacca

SEQ ID NO: 7692478 - DNA, 22 bp, Homo sapiens
ccagctgtttctgatgctaggc

SEQ ID NO: 7692479 - DNA, 22 bp, Homo sapiens
ccagctgtttctgatgctaggc

SEQ ID NO: 7692480 - DNA, 22 bp, Homo sapiens
ccagctgtttctgatgctaggc

SEQ ID NO: 7692481 - DNA, 22 bp, Homo sapiens
ccagctgtttctgatgctaggc

SEQ ID NO: 7692482 - DNA, 22 bp, Homo sapiens
ccagctgttggagtttcactgc

SEQ ID NO: 7692483 - DNA, 22 bp, Homo sapiens
ccagctgtttctgatgctaggc

SEQ ID NO: 7692484 - DNA, 22 bp, Homo sapiens
ccagctgtttctgatgctaggc

SEQ ID NO: 7692485 - DNA, 22 bp, Homo sapiens
ccagctgtctggttccagagcc

SEQ ID NO: 7692486 - DNA, 22 bp, Homo sapiens
ccagctgtctggttccagagcc

SEQ ID NO: 7692487 - DNA, 22 bp, Homo sapiens
ccagctgtctggttccagagcc

SEQ ID NO: 7692488 - DNA, 22 bp, Homo sapiens
ccagctgtctggttccagagcc

SEQ ID NO: 7692489 - DNA, 21 bp, Homo sapiens
ccagctgtctgtccttaggca

SEQ ID NO: 7692490 - DNA, 22 bp, Homo sapiens
ccagctgtctggttccagagcc

SEQ ID NO: 7692491 - DNA, 21 bp, Homo sapiens
ccagctgtctgtccttaggca

SEQ ID NO: 7692492 - DNA, 22 bp, Homo sapiens
ccagctgtcttgagaggaggca

SEQ ID NO: 7692493 - DNA, 22 bp, Homo sapiens
ccagctgtcttgagaggaggca

SEQ ID NO: 7692494 - DNA, 22 bp, Homo sapiens
ccagctgtcttgagaggaggca

SEQ ID NO: 7692495 - DNA, 18 bp, Homo sapiens
ccagctgtgcagcatctg

SEQ ID NO: 7692496 - DNA, 18 bp, Homo sapiens
ccagctgtgcagcatctg

SEQ ID NO: 7692497 - DNA, 18 bp, Homo sapiens
ccagctgtgcagcatctg

SEQ ID NO: 7692498 - DNA, 18 bp, Homo sapiens
ccagctgtgcagcatctg

SEQ ID NO: 7692499 - DNA, 18 bp, Homo sapiens
ccagctgtgcagcatctg

SEQ ID NO: 7692500 - DNA, 22 bp, Homo sapiens
ccagctgtgccggggacctggg

SEQ ID NO: 7692501 - DNA, 18 bp, Homo sapiens
ccagctgtgcagcatctg

SEQ ID NO: 7692502 - DNA, 22 bp, Homo sapiens
ccagctgtgccggggacctggg

SEQ ID NO: 7692503 - DNA, 22 bp, Homo sapiens
ccagctgtgcctaggagcaggg

SEQ ID NO: 7692504 - DNA, 22 bp, Homo sapiens
ccagctgtgcctaggagcaggg

SEQ ID NO: 7692505 - DNA, 22 bp, Homo sapiens
ccagctgtgcctaggagcaggg

SEQ ID NO: 7692506 - DNA, 22 bp, Homo sapiens
ccagctgtgccggggacctggg

SEQ ID NO: 7692507 - DNA, 22 bp, Homo sapiens
ccagctgtgccgtgtggatagc

SEQ ID NO: 7692508 - DNA, 22 bp, Homo sapiens
ccagctgtcactcagaaaggcc

SEQ ID NO: 7692509 - DNA, 22 bp, Homo sapiens
ccagctgtcagtgtgaaaataa

SEQ ID NO: 7692510 - DNA, 22 bp, Homo sapiens
ccagctgtcagtgtgaaaataa

SEQ ID NO: 7692511 - DNA, 22 bp, Homo sapiens
ccagctgtcagtgtgaaaataa

SEQ ID NO: 7692512 - DNA, 22 bp, Homo sapiens
ccagctgtctggttccagagcc

SEQ ID NO: 7692513 - DNA, 22 bp, Homo sapiens
ccagctgtctggttccagagcc

SEQ ID NO: 7692514 - DNA, 23 bp, Homo sapiens
tctggctttcacgggtattctta

SEQ ID NO: 7692515 - DNA, 23 bp, Homo sapiens
tctggctttcacgggtattctta

SEQ ID NO: 7692516 - DNA, 22 bp, Homo sapiens
ccagctgtaggcagggggttta

SEQ ID NO: 7692517 - DNA, 22 bp, Homo sapiens
ccagctgtaggcagggggttta

SEQ ID NO: 7692518 - DNA, 22 bp, Homo sapiens
ccagctgtcactcagaaaggcc

SEQ ID NO: 7692519 - DNA, 22 bp, Homo sapiens
ccagctgtcactcagaaaggcc

SEQ ID NO: 7692520 - DNA, 22 bp, Homo sapiens
tctggctttattccttcactga

SEQ ID NO: 7692521 - DNA, 22 bp, Homo sapiens
tctggctttattttcatcatct

SEQ ID NO: 7692522 - DNA, 22 bp, Homo sapiens
ccagctggtttatattccccac

SEQ ID NO: 7692523 - DNA, 22 bp, Homo sapiens
tctggctttattccttcactga

SEQ ID NO: 7692524 - DNA, 22 bp, Homo sapiens
tctggcttgtgtccttccttgc

SEQ ID NO: 7692525 - DNA, 22 bp, Homo sapiens
tctggcttgtgtccttccttgc

SEQ ID NO: 7692526 - DNA, 22 bp, Homo sapiens
tctggcttgtctcagggtctga

SEQ ID NO: 7692527 - DNA, 22 bp, Homo sapiens
tctggcttgtgtccttccttgc

SEQ ID NO: 7692528 - DNA, 22 bp, Homo sapiens
tctggcttgagcttcgaccagt

SEQ ID NO: 7692529 - DNA, 22 bp, Homo sapiens
tctggcttgagaggtaattatt

SEQ ID NO: 7692530 - DNA, 22 bp, Homo sapiens
tctggcttctgcaggattacta

SEQ ID NO: 7692531 - DNA, 22 bp, Homo sapiens
tctggcttgaacaattaggtaa

SEQ ID NO: 7692532 - DNA, 22 bp, Homo sapiens
tctggcttgctggcttggtccc

SEQ ID NO: 7692533 - DNA, 22 bp, Homo sapiens
tctggcttggacacaatcttcc

SEQ ID NO: 7692534 - DNA, 22 bp, Homo sapiens
tctggcttgagcttcgaccagt

SEQ ID NO: 7692535 - DNA, 22 bp, Homo sapiens
tctggcttggctggcatctctg

SEQ ID NO: 7692536 - DNA, 22 bp, Homo sapiens
tctggcttggctggcatctctg

SEQ ID NO: 7692537 - DNA, 22 bp, Homo sapiens
tctggcttgggtaggtagttca

SEQ ID NO: 7692538 - DNA, 22 bp, Homo sapiens
tctggcttgtctcagggtctga

SEQ ID NO: 7692539 - DNA, 22 bp, Homo sapiens
tctggcttgtctcagggtctga

SEQ ID NO: 7692540 - DNA, 22 bp, Homo sapiens
tctggcttggctggcatctctg

SEQ ID NO: 7692541 - DNA, 22 bp, Homo sapiens
tctggcttggctggcatctctg

SEQ ID NO: 7692542 - DNA, 22 bp, Homo sapiens
tctggcttggcgctgccctctg

SEQ ID NO: 7692543 - DNA, 22 bp, Homo sapiens
tctggcttggcgctgccctctg

SEQ ID NO: 7692544 - DNA, 22 bp, Homo sapiens
tctgaggcatacccaggccccc

SEQ ID NO: 7692545 - DNA, 22 bp, Homo sapiens
tctgaggcatacccaggccccc

SEQ ID NO: 7692546 - DNA, 22 bp, Homo sapiens
tctgaggcatacccaggccccc

SEQ ID NO: 7692547 - DNA, 22 bp, Homo sapiens
tctgaggcatacccaggccccc

SEQ ID NO: 7692548 - DNA, 22 bp, Homo sapiens
tctgaggcataacctgttctgc

SEQ ID NO: 7692549 - DNA, 22 bp, Homo sapiens
tctgaggcatttaattatgacc

SEQ ID NO: 7692550 - DNA, 22 bp, Homo sapiens
tctgaggcatacccaggccccc

SEQ ID NO: 7692551 - DNA, 22 bp, Homo sapiens
tctgaggcatacccaggccccc

SEQ ID NO: 7692552 - DNA, 22 bp, Homo sapiens
tctgaggcccagttcaactctt

SEQ ID NO: 7692553 - DNA, 22 bp, Homo sapiens
tctgaggcccagttcaactctt

SEQ ID NO: 7692554 - DNA, 22 bp, Homo sapiens
tctgaggcccagttcaactctt

SEQ ID NO: 7692555 - DNA, 22 bp, Homo sapiens
tctgaggccccagccctgcaca

SEQ ID NO: 7692556 - DNA, 22 bp, Homo sapiens
tctgaggccccagccctgcaca

SEQ ID NO: 7692557 - DNA, 22 bp, Homo sapiens
tctgaggccccagccctgcaca

SEQ ID NO: 7692558 - DNA, 22 bp, Homo sapiens
tctgaggccccagccctgcaca

SEQ ID NO: 7692559 - DNA, 22 bp, Homo sapiens
tctgaggcccctgggcaggatg

SEQ ID NO: 7692560 - DNA, 22 bp, Homo sapiens
tctgaggcccctgggcaggatg

SEQ ID NO: 7692561 - DNA, 22 bp, Homo sapiens
tctgaggccctaccctgagcct

SEQ ID NO: 7692562 - DNA, 22 bp, Homo sapiens
tctgaggccctaccctgagcct

SEQ ID NO: 7692563 - DNA, 22 bp, Homo sapiens
tctgaggccctaccctgagcct

SEQ ID NO: 7692564 - DNA, 22 bp, Homo sapiens
tctgaggttccctcaactacct

SEQ ID NO: 7692565 - DNA, 22 bp, Homo sapiens
tctgaggttctgttttcaactg

SEQ ID NO: 7692566 - DNA, 22 bp, Homo sapiens
tctgaggttctgttttcaactg

SEQ ID NO: 7692567 - DNA, 22 bp, Homo sapiens
tctgaggttgaactttgcaaag

SEQ ID NO: 7692568 - DNA, 22 bp, Homo sapiens
tctgaggttttcatgttttctg

SEQ ID NO: 7692569 - DNA, 22 bp, Homo sapiens
tctgagtcctaaacccccaggg

SEQ ID NO: 7692570 - DNA, 22 bp, Homo sapiens
tctgaggagtgaccctcttgca

SEQ ID NO: 7692571 - DNA, 22 bp, Homo sapiens
tctgaggagtgaccctcttgca

SEQ ID NO: 7692572 - DNA, 21 bp, Homo sapiens
tctgaggagaaactcttggtg

SEQ ID NO: 7692573 - DNA, 22 bp, Homo sapiens
tctgaggacctactgaagagtt

SEQ ID NO: 7692574 - DNA, 22 bp, Homo sapiens
tctgaggacctactgaagagtt

SEQ ID NO: 7692575 - DNA, 22 bp, Homo sapiens
tctgaggactattgcaatactt

SEQ ID NO: 7692576 - DNA, 22 bp, Homo sapiens
tctgaggatagaggcaatagga

SEQ ID NO: 7692577 - DNA, 22 bp, Homo sapiens
tctgaggagttgggccagtgct

SEQ ID NO: 7692578 - DNA, 22 bp, Homo sapiens
tctgaggatagaggcaatagga

SEQ ID NO: 7692579 - DNA, 22 bp, Homo sapiens
tctgaggatctgaagggaacag

SEQ ID NO: 7692580 - DNA, 22 bp, Homo sapiens
tctgaggagttgggccagtgct

SEQ ID NO: 7692581 - DNA, 22 bp, Homo sapiens
tctgaggagttgggccagtgct

SEQ ID NO: 7692582 - DNA, 22 bp, Homo sapiens
tctgaggagttgggccagtgct

SEQ ID NO: 7692583 - DNA, 22 bp, Homo sapiens
tctgaggcagcttgccactcta

SEQ ID NO: 7692584 - DNA, 22 bp, Homo sapiens
tctgaggcagcttgccactcta

SEQ ID NO: 7692585 - DNA, 22 bp, Homo sapiens
tctgaggcagcttgccactcta

SEQ ID NO: 7692586 - DNA, 22 bp, Homo sapiens
tctgaggcagcttgccactcta

SEQ ID NO: 7692587 - DNA, 23 bp, Homo sapiens
tctgaggatgaaggatagcaagt

SEQ ID NO: 7692588 - DNA, 23 bp, Homo sapiens
tctgaggatgaaggatagcaagt

SEQ ID NO: 7692589 - DNA, 22 bp, Homo sapiens
tctgaggcaaacagaggagtgt

SEQ ID NO: 7692590 - DNA, 22 bp, Homo sapiens
tctgaggcaaacagaggagtgt

SEQ ID NO: 7692591 - DNA, 22 bp, Homo sapiens
tctgaggatctgaagggaacag

SEQ ID NO: 7692592 - DNA, 22 bp, Homo sapiens
ccagccctcactgaggcctctc

SEQ ID NO: 7692593 - DNA, 22 bp, Homo sapiens
ccagccctacagtatcacctgt

SEQ ID NO: 7692594 - DNA, 22 bp, Homo sapiens
ccagccctcactgaggcctctc

SEQ ID NO: 7692595 - DNA, 20 bp, Homo sapiens
tctgagagtctgagtgatga

SEQ ID NO: 7692596 - DNA, 22 bp, Homo sapiens
tctgagattaagcagagatgga

SEQ ID NO: 7692597 - DNA, 22 bp, Homo sapiens
tctgagatccttgtgttgtttt

SEQ ID NO: 7692598 - DNA, 22 bp, Homo sapiens
tctgagatttgtatggtgagac

SEQ ID NO: 7692599 - DNA, 22 bp, Homo sapiens
tctgagattaagcagagatgga

SEQ ID NO: 7692600 - DNA, 22 bp, Homo sapiens
tctgagagtctttcttcaagtg

SEQ ID NO: 7692601 - DNA, 22 bp, Homo sapiens
tctgagagtctttcttcaagtg

SEQ ID NO: 7692602 - DNA, 22 bp, Homo sapiens
tctgagagtctttcttcaagtg

SEQ ID NO: 7692603 - DNA, 22 bp, Homo sapiens
tctgaggacctactgaagagtt

SEQ ID NO: 7692604 - DNA, 22 bp, Homo sapiens
tctgaggacagtgctgtgcctg

SEQ ID NO: 7692605 - DNA, 22 bp, Homo sapiens
tctgaggaccatcggggagctg

SEQ ID NO: 7692606 - DNA, 22 bp, Homo sapiens
tctgaggaccatcggggagctg

SEQ ID NO: 7692607 - DNA, 22 bp, Homo sapiens
tctgaggacaaactgcatgctg

SEQ ID NO: 7692608 - DNA, 22 bp, Homo sapiens
tctgaggacagtgctgtgcctg

SEQ ID NO: 7692609 - DNA, 22 bp, Homo sapiens
ccagcccctatcctcgctccac

SEQ ID NO: 7692610 - DNA, 22 bp, Homo sapiens
ccagcccctatcctcgctccac

SEQ ID NO: 7692611 - DNA, 22 bp, Homo sapiens
ccagccccgggccttaccgtgc

SEQ ID NO: 7692612 - DNA, 22 bp, Homo sapiens
ccagccccgggccttaccgtgc

SEQ ID NO: 7692613 - DNA, 22 bp, Homo sapiens
ccagccccgggaacctggccgt

SEQ ID NO: 7692614 - DNA, 22 bp, Homo sapiens
ccagccccgggaacctggccgt

SEQ ID NO: 7692615 - DNA, 22 bp, Homo sapiens
ccagcccctatcctcgctccac

SEQ ID NO: 7692616 - DNA, 22 bp, Homo sapiens
ccagcccgaatccctaaagcaa

SEQ ID NO: 7692617 - DNA, 22 bp, Homo sapiens
ccagcccgaatccctaaagcaa

SEQ ID NO: 7692618 - DNA, 22 bp, Homo sapiens
ccagcccgaatccctggccagg

SEQ ID NO: 7692619 - DNA, 22 bp, Homo sapiens
ccagccctacagtatcacctgt

SEQ ID NO: 7692620 - DNA, 22 bp, Homo sapiens
ccagcccctatcctcgctccac

SEQ ID NO: 7692621 - DNA, 22 bp, Homo sapiens
ccagcccctatcctcgctccac

SEQ ID NO: 7692622 - DNA, 22 bp, Homo sapiens
ccagcccctatcctcgctccac

SEQ ID NO: 7692623 - DNA, 22 bp, Homo sapiens
ccagccccgggaacctggccgt

SEQ ID NO: 7692624 - DNA, 22 bp, Homo sapiens
ccagccccgggaacctggccgt

SEQ ID NO: 7692625 - DNA, 22 bp, Homo sapiens
ccagccccgggaacctggccgt

SEQ ID NO: 7692626 - DNA, 22 bp, Homo sapiens
ccagcccatgcccttatagcat

SEQ ID NO: 7692627 - DNA, 22 bp, Homo sapiens
ccagcccatgcccttatagcat

SEQ ID NO: 7692628 - DNA, 19 bp, Homo sapiens
ccagcccatagtccatcac

SEQ ID NO: 7692629 - DNA, 22 bp, Homo sapiens
ccagcccatgcccttatagcat

SEQ ID NO: 7692630 - DNA, 22 bp, Homo sapiens
ccagccccgggaacctggccgt

SEQ ID NO: 7692631 - DNA, 19 bp, Homo sapiens
ccagcccatagtccatcac

SEQ ID NO: 7692632 - DNA, 19 bp, Homo sapiens
ccagcccatagtccatcac

SEQ ID NO: 7692633 - DNA, 22 bp, Homo sapiens
ccagcccatgcccttatagcat

SEQ ID NO: 7692634 - DNA, 22 bp, Homo sapiens
ccagcccatgcccttatagcat

SEQ ID NO: 7692635 - DNA, 19 bp, Homo sapiens
ccagcccatagtccatcac

SEQ ID NO: 7692636 - DNA, 19 bp, Homo sapiens
ccagcccatagtccatcac

SEQ ID NO: 7692637 - DNA, 19 bp, Homo sapiens
ccagcccatagtccatcac

SEQ ID NO: 7692638 - DNA, 19 bp, Homo sapiens
ccagcccatagtccatcac

SEQ ID NO: 7692639 - DNA, 19 bp, Homo sapiens
ccagcccatagtccatcac

SEQ ID NO: 7692640 - DNA, 22 bp, Homo sapiens
ccagccataatacgaacccagc

SEQ ID NO: 7692641 - DNA, 22 bp, Homo sapiens
ccagccataatacgaacccagc

SEQ ID NO: 7692642 - DNA, 22 bp, Homo sapiens
ccagccataatacgaacccagc

SEQ ID NO: 7692643 - DNA, 22 bp, Homo sapiens
ccagccataatacgaacccagc

SEQ ID NO: 7692644 - DNA, 22 bp, Homo sapiens
ccagccatgggccacctagctg

SEQ ID NO: 7692645 - DNA, 22 bp, Homo sapiens
ccagcccaaacaagccgccttc

SEQ ID NO: 7692646 - DNA, 22 bp, Homo sapiens
ccagccatgggccacctagctg

SEQ ID NO: 7692647 - DNA, 22 bp, Homo sapiens
ccagcccaaacaagccgccttc

SEQ ID NO: 7692648 - DNA, 22 bp, Homo sapiens
ccagcccaaacaagccgccttc

SEQ ID NO: 7692649 - DNA, 22 bp, Homo sapiens
ccagcccaaacaagccgccttc

SEQ ID NO: 7692650 - DNA, 22 bp, Homo sapiens
ccagccatgggccacctagctg

SEQ ID NO: 7692651 - DNA, 22 bp, Homo sapiens
ccagccatgggccacctagctg

SEQ ID NO: 7692652 - DNA, 22 bp, Homo sapiens
ccagcccaaacaagccgccttc

SEQ ID NO: 7692653 - DNA, 22 bp, Homo sapiens
ccagcccaaacaagccgccttc

SEQ ID NO: 7692654 - DNA, 22 bp, Homo sapiens
ccagcccaaacaagccgccttc

SEQ ID NO: 7692655 - DNA, 22 bp, Homo sapiens
ccagcccaaagtcaccccggga

SEQ ID NO: 7692656 - DNA, 22 bp, Homo sapiens
ccagcccaaagtcaccccggga

SEQ ID NO: 7692657 - DNA, 22 bp, Homo sapiens
ccagcccaaagtcaccccggga

SEQ ID NO: 7692658 - DNA, 22 bp, Homo sapiens
ccagcccaaacaagccgccttc

SEQ ID NO: 7692659 - DNA, 21 bp, Homo sapiens
ccagcccagcctccttctctt

SEQ ID NO: 7692660 - DNA, 21 bp, Homo sapiens
ccagcccagcctccttctctt

SEQ ID NO: 7692661 - DNA, 21 bp, Homo sapiens
ccagcccagcctccttctctt

SEQ ID NO: 7692662 - DNA, 21 bp, Homo sapiens
ccagcccagcctccttctctt

SEQ ID NO: 7692663 - DNA, 22 bp, Homo sapiens
ccagcccaaagtcaccccggga

SEQ ID NO: 7692664 - DNA, 19 bp, Homo sapiens
ccagcccacagtgactttc

SEQ ID NO: 7692665 - DNA, 19 bp, Homo sapiens
ccagcccacagtgactttc

SEQ ID NO: 7692666 - DNA, 19 bp, Homo sapiens
ccagcccacagtgactttc

SEQ ID NO: 7692667 - DNA, 19 bp, Homo sapiens
ccagcccacagtgactttc

SEQ ID NO: 7692668 - DNA, 21 bp, Homo sapiens
ccagcccagctgtgtcccagc

SEQ ID NO: 7692669 - DNA, 21 bp, Homo sapiens
ccagcccagctgtgtcccagc

SEQ ID NO: 7692670 - DNA, 19 bp, Homo sapiens
ccagcccatagtccatcac

SEQ ID NO: 7692671 - DNA, 21 bp, Homo sapiens
ccagcccagctgtgtcccagc

SEQ ID NO: 7692672 - DNA, 21 bp, Homo sapiens
ccagcccagctgtgtcccagc

SEQ ID NO: 7692673 - DNA, 21 bp, Homo sapiens
ccagcccagcctccttctctt

SEQ ID NO: 7692674 - DNA, 22 bp, Homo sapiens
ccagccagtcccgcatgaccgc

SEQ ID NO: 7692675 - DNA, 22 bp, Homo sapiens
ccagccagtcccgcatgaccgc

SEQ ID NO: 7692676 - DNA, 22 bp, Homo sapiens
ccagccagtcccgcatgaccgc

SEQ ID NO: 7692677 - DNA, 22 bp, Homo sapiens
ccagccagtcccgcatgaccgc

SEQ ID NO: 7692678 - DNA, 22 bp, Homo sapiens
ccagccagtcccgcatgaccgc

SEQ ID NO: 7692679 - DNA, 22 bp, Homo sapiens
ccagccagtccagcattggtgt

SEQ ID NO: 7692680 - DNA, 22 bp, Homo sapiens
ccagccataaacccagatgact

SEQ ID NO: 7692681 - DNA, 22 bp, Homo sapiens
ccagccataaacccagatgact

SEQ ID NO: 7692682 - DNA, 22 bp, Homo sapiens
ccagccataaacccagatgact

SEQ ID NO: 7692683 - DNA, 22 bp, Homo sapiens
ccagccataaacccagatgact

SEQ ID NO: 7692684 - DNA, 22 bp, Homo sapiens
ccagccataaacccagatgact

SEQ ID NO: 7692685 - DNA, 22 bp, Homo sapiens
ccagccagtcccgcatgaccgc

SEQ ID NO: 7692686 - DNA, 22 bp, Homo sapiens
ccagccagtcccgcatgaccgc

SEQ ID NO: 7692687 - DNA, 22 bp, Homo sapiens
tctgaaatctgtaagcactagc

SEQ ID NO: 7692688 - DNA, 22 bp, Homo sapiens
tctgaaatcctttatcttggct

SEQ ID NO: 7692689 - DNA, 22 bp, Homo sapiens
tctgaaatctgtaagcactagc

SEQ ID NO: 7692690 - DNA, 22 bp, Homo sapiens
tctgaaatcctttatcttggct

SEQ ID NO: 7692691 - DNA, 22 bp, Homo sapiens
tctgaaatcctttatcttggct

SEQ ID NO: 7692692 - DNA, 22 bp, Homo sapiens
tctgaaatcctttatcttggct

SEQ ID NO: 7692693 - DNA, 22 bp, Homo sapiens
tctgaaatctaatgctctgtgg

SEQ ID NO: 7692694 - DNA, 22 bp, Homo sapiens
ccagccactgggccactgccag

SEQ ID NO: 7692695 - DNA, 22 bp, Homo sapiens
ccagccactgggccactgccag

SEQ ID NO: 7692696 - DNA, 22 bp, Homo sapiens
ccagccacgaagctcccttcat

SEQ ID NO: 7692697 - DNA, 22 bp, Homo sapiens
ccagccacgaagctcccttcat

SEQ ID NO: 7692698 - DNA, 22 bp, Homo sapiens
ccagccactgggccactgccag

SEQ ID NO: 7692699 - DNA, 22 bp, Homo sapiens
ccagccactgggccactgccag

SEQ ID NO: 7692700 - DNA, 22 bp, Homo sapiens
ccagccactgggccactgccag

SEQ ID NO: 7692701 - DNA, 22 bp, Homo sapiens
ccagccactgggccactgccag

SEQ ID NO: 7692702 - DNA, 22 bp, Homo sapiens
tctgaaatctgtaagcactagc

SEQ ID NO: 7692703 - DNA, 22 bp, Homo sapiens
ccagccacgaagctcccttcat

SEQ ID NO: 7692704 - DNA, 22 bp, Homo sapiens
ccagccacgaagctcccttcat

SEQ ID NO: 7692705 - DNA, 22 bp, Homo sapiens
tctcttgtaatttaaaaaatct

SEQ ID NO: 7692706 - DNA, 22 bp, Homo sapiens
tctcttggtgacttaaaatgtt

SEQ ID NO: 7692707 - DNA, 22 bp, Homo sapiens
tctcttggtgatagtctttctt

SEQ ID NO: 7692708 - DNA, 22 bp, Homo sapiens
tctcttgggaggaaagagagaa

SEQ ID NO: 7692709 - DNA, 22 bp, Homo sapiens
tctcttggtgacttaaaatgtt

SEQ ID NO: 7692710 - DNA, 22 bp, Homo sapiens
tctcttggtacacagatgatca

SEQ ID NO: 7692711 - DNA, 22 bp, Homo sapiens
tctcttggtacacagatgatca

SEQ ID NO: 7692712 - DNA, 17 bp, Homo sapiens
tctcttgttcactgctg

SEQ ID NO: 7692713 - DNA, 17 bp, Homo sapiens
tctcttgttcactgctg

SEQ ID NO: 7692714 - DNA, 22 bp, Homo sapiens
tctgaaataggaaagcaaatgg

SEQ ID NO: 7692715 - DNA, 22 bp, Homo sapiens
tctgaaataggaaagcaaatgg

SEQ ID NO: 7692716 - DNA, 22 bp, Homo sapiens
tctgaaataggaaagcaaatgg

SEQ ID NO: 7692717 - DNA, 22 bp, Homo sapiens
tctgaaataggaaagcaaatgg

SEQ ID NO: 7692718 - DNA, 22 bp, Homo sapiens
tctgaaataggaaagcaaatgg

SEQ ID NO: 7692719 - DNA, 22 bp, Homo sapiens
tctgaaataggaaagcaaatgg

SEQ ID NO: 7692720 - DNA, 17 bp, Homo sapiens
tctcttgttcactgctg

SEQ ID NO: 7692721 - DNA, 22 bp, Homo sapiens
tctcttgtaatttaaaaaatct

SEQ ID NO: 7692722 - DNA, 22 bp, Homo sapiens
tctcttgtaatttaaaaaatct

SEQ ID NO: 7692723 - DNA, 22 bp, Homo sapiens
tctgaaataggcttcttttggt

SEQ ID NO: 7692724 - DNA, 22 bp, Homo sapiens
tctgaaataggagccatgtaga

SEQ ID NO: 7692725 - DNA, 22 bp, Homo sapiens
tctgaaataggcttcttttggt

SEQ ID NO: 7692726 - DNA, 22 bp, Homo sapiens
tctgaaatatattttgagtgtt

SEQ ID NO: 7692727 - DNA, 22 bp, Homo sapiens
tctgaaatatattttgagtgtt

SEQ ID NO: 7692728 - DNA, 22 bp, Homo sapiens
tctgaaatatattttgagtgtt

SEQ ID NO: 7692729 - DNA, 22 bp, Homo sapiens
tctgaaatcctttatcttggct

SEQ ID NO: 7692730 - DNA, 22 bp, Homo sapiens
tctgaaatattggtaatacttt

SEQ ID NO: 7692731 - DNA, 22 bp, Homo sapiens
tctgaaatattggtaatacttt

SEQ ID NO: 7692732 - DNA, 22 bp, Homo sapiens
tctgaaatatattttgagtgtt

SEQ ID NO: 7692733 - DNA, 22 bp, Homo sapiens
tctgaaatatattttgagtgtt

SEQ ID NO: 7692734 - DNA, 22 bp, Homo sapiens
tctgaaatatattttgagtgtt

SEQ ID NO: 7692735 - DNA, 22 bp, Homo sapiens
tctgaaatattggtaatacttt

SEQ ID NO: 7692736 - DNA, 22 bp, Homo sapiens
tctgaaatattggtaatacttt

SEQ ID NO: 7692737 - DNA, 23 bp, Homo sapiens
tctctcttagctatgcttatggc

SEQ ID NO: 7692738 - DNA, 23 bp, Homo sapiens
tctctcttagctatgcttatggc

SEQ ID NO: 7692739 - DNA, 22 bp, Homo sapiens
tctctctgtgacagctttgctg

SEQ ID NO: 7692740 - DNA, 23 bp, Homo sapiens
tctctcttagctatgcttatggc

SEQ ID NO: 7692741 - DNA, 22 bp, Homo sapiens
tctctctgtgacagctttgctg

SEQ ID NO: 7692742 - DNA, 19 bp, Homo sapiens
tctctctgtacattagata

SEQ ID NO: 7692743 - DNA, 20 bp, Homo sapiens
tctctctggttggaggagct

SEQ ID NO: 7692744 - DNA, 19 bp, Homo sapiens
tctctctgtacattagata

SEQ ID NO: 7692745 - DNA, 19 bp, Homo sapiens
tctctctgtacattagata

SEQ ID NO: 7692746 - DNA, 16 bp, Homo sapiens
tctctctgtatttgct

SEQ ID NO: 7692747 - DNA, 16 bp, Homo sapiens
tctctctgtatttgct

SEQ ID NO: 7692748 - DNA, 22 bp, Homo sapiens
tctctctgtgacagctttgctg

SEQ ID NO: 7692749 - DNA, 22 bp, Homo sapiens
tctctctgtgacagctttgctg

SEQ ID NO: 7692750 - DNA, 22 bp, Homo sapiens
tctctcttcaacccttaactag

SEQ ID NO: 7692751 - DNA, 22 bp, Homo sapiens
tctctcttcaacccttaactag

SEQ ID NO: 7692752 - DNA, 22 bp, Homo sapiens
tctctcttcaacccttaactag

SEQ ID NO: 7692753 - DNA, 22 bp, Homo sapiens
tctctcttcaacccttaactag

SEQ ID NO: 7692754 - DNA, 22 bp, Homo sapiens
tctctcttcaacccttaactag

SEQ ID NO: 7692755 - DNA, 22 bp, Homo sapiens
tctctcttcagagataccttgc

SEQ ID NO: 7692756 - DNA, 22 bp, Homo sapiens
tctctcttcagagataccttgc

SEQ ID NO: 7692757 - DNA, 22 bp, Homo sapiens
tctctcttcagagataccttgc

SEQ ID NO: 7692758 - DNA, 22 bp, Homo sapiens
tctctcttcagagataccttgc

SEQ ID NO: 7692759 - DNA, 22 bp, Homo sapiens
tctctcttgaagtattagctag

SEQ ID NO: 7692760 - DNA, 22 bp, Homo sapiens
tctctcttgaagtattagctag

SEQ ID NO: 7692761 - DNA, 22 bp, Homo sapiens
tctctcttgaagtattagctag

SEQ ID NO: 7692762 - DNA, 22 bp, Homo sapiens
tctctcttgtcaccccatctgc

SEQ ID NO: 7692763 - DNA, 22 bp, Homo sapiens
tctctcttgtcaccccatctgc

SEQ ID NO: 7692764 - DNA, 22 bp, Homo sapiens
tctctcttgtcaccccatctgc

SEQ ID NO: 7692765 - DNA, 22 bp, Homo sapiens
tctctcttcatgcttttagaat

SEQ ID NO: 7692766 - DNA, 22 bp, Homo sapiens
tctctcttcatgcttttagaat

SEQ ID NO: 7692767 - DNA, 22 bp, Homo sapiens
tctctcttcatgcttttagaat

SEQ ID NO: 7692768 - DNA, 22 bp, Homo sapiens
tctctcttcagagataccttgc

SEQ ID NO: 7692769 - DNA, 22 bp, Homo sapiens
tctctcttgaagtattagctag

SEQ ID NO: 7692770 - DNA, 22 bp, Homo sapiens
tctctcttctttgttaagaatg

SEQ ID NO: 7692771 - DNA, 22 bp, Homo sapiens
tctctcttcatgcttttagaat

SEQ ID NO: 7692772 - DNA, 22 bp, Homo sapiens
tctctcttctttgttaagaatg

SEQ ID NO: 7692773 - DNA, 22 bp, Homo sapiens
tctctcttctttgttaagaatg

SEQ ID NO: 7692774 - DNA, 22 bp, Homo sapiens
tctcttggaggttcttcctgtt

SEQ ID NO: 7692775 - DNA, 22 bp, Homo sapiens
tctcttggaggttcttcctgtt

SEQ ID NO: 7692776 - DNA, 22 bp, Homo sapiens
tctcttggaggttcttcctgtt

SEQ ID NO: 7692777 - DNA, 22 bp, Homo sapiens
tctcttggagagtccatcatca

SEQ ID NO: 7692778 - DNA, 22 bp, Homo sapiens
tctcttggagagtccatcatca

SEQ ID NO: 7692779 - DNA, 22 bp, Homo sapiens
tctcttggaggttcttcctgtt

SEQ ID NO: 7692780 - DNA, 22 bp, Homo sapiens
tctcttgggaggaaagagagaa

SEQ ID NO: 7692781 - DNA, 22 bp, Homo sapiens
tctcttggacatgtggctctgc

SEQ ID NO: 7692782 - DNA, 22 bp, Homo sapiens
tctcttggacatgtggctctgc

SEQ ID NO: 7692783 - DNA, 22 bp, Homo sapiens
tctcttggaacacttgctctta

SEQ ID NO: 7692784 - DNA, 22 bp, Homo sapiens
tctcttggaacacttgctctta

SEQ ID NO: 7692785 - DNA, 22 bp, Homo sapiens
tctcttggaaagcttgcccact

SEQ ID NO: 7692786 - DNA, 22 bp, Homo sapiens
tctcttgatgttcccagacagc

SEQ ID NO: 7692787 - DNA, 22 bp, Homo sapiens
tctcttgatatattacatagag

SEQ ID NO: 7692788 - DNA, 18 bp, Homo sapiens
tctcttgcatcttctgta

SEQ ID NO: 7692789 - DNA, 22 bp, Homo sapiens
tctcttgatgttcccagacagc

SEQ ID NO: 7692790 - DNA, 22 bp, Homo sapiens
tctcttaagttaagtgtaattc

SEQ ID NO: 7692791 - DNA, 22 bp, Homo sapiens
tctcttaactggttcagcaatt

SEQ ID NO: 7692792 - DNA, 22 bp, Homo sapiens
tctcttaactggttcagcaatt

SEQ ID NO: 7692793 - DNA, 22 bp, Homo sapiens
tctcttaataagtaaatactga

SEQ ID NO: 7692794 - DNA, 22 bp, Homo sapiens
tctcttaataagtaaatactga

SEQ ID NO: 7692795 - DNA, 22 bp, Homo sapiens
tctcttgaagattgaagacaaa

SEQ ID NO: 7692796 - DNA, 22 bp, Homo sapiens
tctcttctttggggtgggctca

SEQ ID NO: 7692797 - DNA, 22 bp, Homo sapiens
tctcttaatccggtgctttctg

SEQ ID NO: 7692798 - DNA, 22 bp, Homo sapiens
tctcttaataagtaaatactga

SEQ ID NO: 7692799 - DNA, 22 bp, Homo sapiens
tctcttgactgctaaaattaga

SEQ ID NO: 7692800 - DNA, 22 bp, Homo sapiens
tctcttgagctcagttctgatg

SEQ ID NO: 7692801 - DNA, 22 bp, Homo sapiens
tctcttgatatattacatagag

SEQ ID NO: 7692802 - DNA, 22 bp, Homo sapiens
tctcttgatatattacatagag

SEQ ID NO: 7692803 - DNA, 22 bp, Homo sapiens
tctcttgactgctaaaattaga

SEQ ID NO: 7692804 - DNA, 19 bp, Homo sapiens
tctcttgaataggtcaaac

SEQ ID NO: 7692805 - DNA, 22 bp, Homo sapiens
tctcttgactgctaaaattaga

SEQ ID NO: 7692806 - DNA, 22 bp, Homo sapiens
tctcttgaagattgaagacaaa

SEQ ID NO: 7692807 - DNA, 22 bp, Homo sapiens
tctcttgaagattgaagacaaa

SEQ ID NO: 7692808 - DNA, 22 bp, Homo sapiens
ccagctctaaacggctctgtgg

SEQ ID NO: 7692809 - DNA, 22 bp, Homo sapiens
ccagctctaaacggctctgtgg

SEQ ID NO: 7692810 - DNA, 22 bp, Homo sapiens
ccagctctaaacggctctgtgg

SEQ ID NO: 7692811 - DNA, 22 bp, Homo sapiens
ccagctctaaacggctctgtgg

SEQ ID NO: 7692812 - DNA, 22 bp, Homo sapiens
ccagctctaaacggctctgtgg

SEQ ID NO: 7692813 - DNA, 22 bp, Homo sapiens
ccagctccttctgtctgtggag

SEQ ID NO: 7692814 - DNA, 22 bp, Homo sapiens
ccagctctaaacggctctgtgg

SEQ ID NO: 7692815 - DNA, 22 bp, Homo sapiens
ccagctctaaacggctctgtgg

SEQ ID NO: 7692816 - DNA, 22 bp, Homo sapiens
ccagctcctgggtcttagtcag

SEQ ID NO: 7692817 - DNA, 22 bp, Homo sapiens
ccagctcctgggtcttagtcag

SEQ ID NO: 7692818 - DNA, 22 bp, Homo sapiens
ccagctcctgagcatggtttcc

SEQ ID NO: 7692819 - DNA, 22 bp, Homo sapiens
ccagctcctgggtcttagtcag

SEQ ID NO: 7692820 - DNA, 22 bp, Homo sapiens
ccagctccttctgtctgtggag

SEQ ID NO: 7692821 - DNA, 22 bp, Homo sapiens
ccagctccttctgtctgtggag

SEQ ID NO: 7692822 - DNA, 22 bp, Homo sapiens
ccagctcctgggtcttagtcag

SEQ ID NO: 7692823 - DNA, 22 bp, Homo sapiens
ccagctccttctgtctgtggag

SEQ ID NO: 7692824 - DNA, 22 bp, Homo sapiens
ccagctctcagcgggagactca

SEQ ID NO: 7692825 - DNA, 22 bp, Homo sapiens
ccagctctcagcgggagactca

SEQ ID NO: 7692826 - DNA, 22 bp, Homo sapiens
ccagctctcagcgggagactca

SEQ ID NO: 7692827 - DNA, 22 bp, Homo sapiens
ccagctctcagcgggagactca

SEQ ID NO: 7692828 - DNA, 22 bp, Homo sapiens
tctgccaccacctacactagta

SEQ ID NO: 7692829 - DNA, 22 bp, Homo sapiens
tctgccaccacctacactagta

SEQ ID NO: 7692830 - DNA, 20 bp, Homo sapiens
tctgccacgtctggtgactg

SEQ ID NO: 7692831 - DNA, 22 bp, Homo sapiens
tctgccaccttcatcctccact

SEQ ID NO: 7692832 - DNA, 22 bp, Homo sapiens
tctgccaccttcatcctccact

SEQ ID NO: 7692833 - DNA, 22 bp, Homo sapiens
ccagctctcaaggctccctggg

SEQ ID NO: 7692834 - DNA, 22 bp, Homo sapiens
ccagctctcaaggctccctggg

SEQ ID NO: 7692835 - DNA, 22 bp, Homo sapiens
ccagctctagccccatgtggct

SEQ ID NO: 7692836 - DNA, 22 bp, Homo sapiens
ccagctctcaaggctccctggg

SEQ ID NO: 7692837 - DNA, 22 bp, Homo sapiens
ccagctctcaaggctccctggg

SEQ ID NO: 7692838 - DNA, 22 bp, Homo sapiens
ccagctctagccccatgtggct

SEQ ID NO: 7692839 - DNA, 22 bp, Homo sapiens
ccagctctagccccatgtggct

SEQ ID NO: 7692840 - DNA, 22 bp, Homo sapiens
ccagctctagccccatgtggct

SEQ ID NO: 7692841 - DNA, 22 bp, Homo sapiens
ccagctctagccccatgtggct

SEQ ID NO: 7692842 - DNA, 22 bp, Homo sapiens
ccagctcctcttcccagtgtca

SEQ ID NO: 7692843 - DNA, 22 bp, Homo sapiens
ccagctcctcttcccagtgtca

SEQ ID NO: 7692844 - DNA, 22 bp, Homo sapiens
ccagctcctcttcccagtgtca

SEQ ID NO: 7692845 - DNA, 23 bp, Homo sapiens
ccagctccgtgagcctcgggctc

SEQ ID NO: 7692846 - DNA, 22 bp, Homo sapiens
ccagctccaggactgggagctg

SEQ ID NO: 7692847 - DNA, 22 bp, Homo sapiens
ccagctccaggactgggagctg

SEQ ID NO: 7692848 - DNA, 22 bp, Homo sapiens
ccagctccaggactgggagctg

SEQ ID NO: 7692849 - DNA, 22 bp, Homo sapiens
ccagctccaggactgggagctg

SEQ ID NO: 7692850 - DNA, 23 bp, Homo sapiens
ccagctccgtgagcctcgggctc

SEQ ID NO: 7692851 - DNA, 21 bp, Homo sapiens
ccagctccaggaccttggatc

SEQ ID NO: 7692852 - DNA, 21 bp, Homo sapiens
ccagctccaggaccttggatc

SEQ ID NO: 7692853 - DNA, 22 bp, Homo sapiens
ccagctccaggactgggagctg

SEQ ID NO: 7692854 - DNA, 22 bp, Homo sapiens
ccagctccaggactgggagctg

SEQ ID NO: 7692855 - DNA, 22 bp, Homo sapiens
ccagctccaggactgggagctg

SEQ ID NO: 7692856 - DNA, 22 bp, Homo sapiens
ccagctccaggactgggagctg

SEQ ID NO: 7692857 - DNA, 22 bp, Homo sapiens
ccagctcctcttgtctctagca

SEQ ID NO: 7692858 - DNA, 22 bp, Homo sapiens
ccagctcctcttgtctctagca

SEQ ID NO: 7692859 - DNA, 22 bp, Homo sapiens
ccagctcctcttgtctctagca

SEQ ID NO: 7692860 - DNA, 22 bp, Homo sapiens
ccagctcctgggtcttagtcag

SEQ ID NO: 7692861 - DNA, 22 bp, Homo sapiens
ccagctcctgagcatggtttcc

SEQ ID NO: 7692862 - DNA, 22 bp, Homo sapiens
ccagctcctgagcatggtttcc

SEQ ID NO: 7692863 - DNA, 22 bp, Homo sapiens
ccagctcctgagcatggtttcc

SEQ ID NO: 7692864 - DNA, 22 bp, Homo sapiens
ccagctcctcttcccagtgtca

SEQ ID NO: 7692865 - DNA, 22 bp, Homo sapiens
ccagctcctcttcccagtgtca

SEQ ID NO: 7692866 - DNA, 22 bp, Homo sapiens
ccagctcctcttgtctctagca

SEQ ID NO: 7692867 - DNA, 22 bp, Homo sapiens
ccagctcctcttgtctctagca

SEQ ID NO: 7692868 - DNA, 22 bp, Homo sapiens
ccagctcctcttgtctctagca

SEQ ID NO: 7692869 - DNA, 22 bp, Homo sapiens
ccagctcctcttcccagtgtca

SEQ ID NO: 7692870 - DNA, 22 bp, Homo sapiens
ccagctcctcttcccagtgtca

SEQ ID NO: 7692871 - DNA, 22 bp, Homo sapiens
ccagctcctcttcccagtgtca

SEQ ID NO: 7692872 - DNA, 22 bp, Homo sapiens
ccagctcctcttcccagtgtca

SEQ ID NO: 7692873 - DNA, 22 bp, Homo sapiens
ccagctcctcttcccagtgtca

SEQ ID NO: 7692874 - DNA, 22 bp, Homo sapiens
ccagctcctcttcccagtgtca

SEQ ID NO: 7692875 - DNA, 22 bp, Homo sapiens
tctgccagcaccatgatccttc

SEQ ID NO: 7692876 - DNA, 22 bp, Homo sapiens
tctgccagcaccatgatccttc

SEQ ID NO: 7692877 - DNA, 22 bp, Homo sapiens
tctgccagcaccatgatccttc

SEQ ID NO: 7692878 - DNA, 22 bp, Homo sapiens
tctgccagacctgactcagtag

SEQ ID NO: 7692879 - DNA, 22 bp, Homo sapiens
tctgccagacctgactcagtag

SEQ ID NO: 7692880 - DNA, 22 bp, Homo sapiens
tctgccagacctgactcagtag

SEQ ID NO: 7692881 - DNA, 22 bp, Homo sapiens
tctgccagataatcattttctc

SEQ ID NO: 7692882 - DNA, 22 bp, Homo sapiens
tctgccagccctgtgagtcttg

SEQ ID NO: 7692883 - DNA, 22 bp, Homo sapiens
tctgccagccctgtgagtcttg

SEQ ID NO: 7692884 - DNA, 22 bp, Homo sapiens
tctgccagccctgtgagtcttg

SEQ ID NO: 7692885 - DNA, 22 bp, Homo sapiens
tctgccagctctgtgggtctcg

SEQ ID NO: 7692886 - DNA, 22 bp, Homo sapiens
tctgccagccctgtgagtcttg

SEQ ID NO: 7692887 - DNA, 22 bp, Homo sapiens
tctgccagctctgtgggtctcg

SEQ ID NO: 7692888 - DNA, 22 bp, Homo sapiens
tctgccagctctgtgggtctcg

SEQ ID NO: 7692889 - DNA, 22 bp, Homo sapiens
tctgccagctctgtgggtctcg

SEQ ID NO: 7692890 - DNA, 22 bp, Homo sapiens
tctgccagaagttctgagagta

SEQ ID NO: 7692891 - DNA, 22 bp, Homo sapiens
tctgccagaagttctgagagta

SEQ ID NO: 7692892 - DNA, 22 bp, Homo sapiens
tctgccagaagccagggtctgg

SEQ ID NO: 7692893 - DNA, 22 bp, Homo sapiens
tctgccagaagttctgagagta

SEQ ID NO: 7692894 - DNA, 22 bp, Homo sapiens
tctgccagaagttctgagagta

SEQ ID NO: 7692895 - DNA, 22 bp, Homo sapiens
tctgccagaagttctgagagta

SEQ ID NO: 7692896 - DNA, 20 bp, Homo sapiens
tctgccactttttctgtcac

SEQ ID NO: 7692897 - DNA, 22 bp, Homo sapiens
tctgccagaaccagtcaccgat

SEQ ID NO: 7692898 - DNA, 22 bp, Homo sapiens
tctgccacttttgcttactggg

SEQ ID NO: 7692899 - DNA, 22 bp, Homo sapiens
tctgccagaagccagggtctgg

SEQ ID NO: 7692900 - DNA, 22 bp, Homo sapiens
tctgccagaagccagggtctgg

SEQ ID NO: 7692901 - DNA, 22 bp, Homo sapiens
tctgccagaagccagggtctgg

SEQ ID NO: 7692902 - DNA, 22 bp, Homo sapiens
tctgccagaactccattagaaa

SEQ ID NO: 7692903 - DNA, 22 bp, Homo sapiens
tctgccagaactccattagaaa

SEQ ID NO: 7692904 - DNA, 22 bp, Homo sapiens
tctgccagaagccagggtctgg

SEQ ID NO: 7692905 - DNA, 22 bp, Homo sapiens
tctgccagaagccagggtctgg

SEQ ID NO: 7692906 - DNA, 22 bp, Homo sapiens
tctgccagaagccagggtctgg

SEQ ID NO: 7692907 - DNA, 20 bp, Homo sapiens
tctgccactgcactctgccc

SEQ ID NO: 7692908 - DNA, 22 bp, Homo sapiens
tctgccactgtgatgcatgata

SEQ ID NO: 7692909 - DNA, 20 bp, Homo sapiens
tctgccactgcactctgccc

SEQ ID NO: 7692910 - DNA, 22 bp, Homo sapiens
tctgccacttacctccatgtac

SEQ ID NO: 7692911 - DNA, 22 bp, Homo sapiens
tctgccactgtggccatgggag

SEQ ID NO: 7692912 - DNA, 20 bp, Homo sapiens
tctgccactgcactctgccc

SEQ ID NO: 7692913 - DNA, 22 bp, Homo sapiens
tctgccactgtgatgcatgata

SEQ ID NO: 7692914 - DNA, 22 bp, Homo sapiens
tctgccactgtggccatgggag

SEQ ID NO: 7692915 - DNA, 22 bp, Homo sapiens
tctgccaggcattgtgctgctc

SEQ ID NO: 7692916 - DNA, 22 bp, Homo sapiens
tctgccaggcattgtgctgctc

SEQ ID NO: 7692917 - DNA, 22 bp, Homo sapiens
tctgccaggcattgtgctgctc

SEQ ID NO: 7692918 - DNA, 22 bp, Homo sapiens
tctgccaggcattgtgctgctc

SEQ ID NO: 7692919 - DNA, 22 bp, Homo sapiens
tctgccaggagccatgagcaag

SEQ ID NO: 7692920 - DNA, 22 bp, Homo sapiens
tctgccaggagccatgagcaag

SEQ ID NO: 7692921 - DNA, 22 bp, Homo sapiens
tctgccaggagccatgagcaag

SEQ ID NO: 7692922 - DNA, 22 bp, Homo sapiens
tctgcctcctgcttgtcccgac

SEQ ID NO: 7692923 - DNA, 22 bp, Homo sapiens
tctgcctcctgcttgtcccgac

SEQ ID NO: 7692924 - DNA, 22 bp, Homo sapiens
tctgcctatgctgtacctttgt

SEQ ID NO: 7692925 - DNA, 22 bp, Homo sapiens
tctgccagcttctggtggttgc

SEQ ID NO: 7692926 - DNA, 22 bp, Homo sapiens
tctgccaggaagaaagcacaat

SEQ ID NO: 7692927 - DNA, 22 bp, Homo sapiens
tctgccaggaagaaagcacaat

SEQ ID NO: 7692928 - DNA, 22 bp, Homo sapiens
tctgccagcttctggtggttgc

SEQ ID NO: 7692929 - DNA, 22 bp, Homo sapiens
tctgccagcttctggtggttgc

SEQ ID NO: 7692930 - DNA, 21 bp, Homo sapiens
tctgccagctgaagaggtgga

SEQ ID NO: 7692931 - DNA, 21 bp, Homo sapiens
tctgccagctgaagaggtgga

SEQ ID NO: 7692932 - DNA, 21 bp, Homo sapiens
tctgccagctgaagaggtgga

SEQ ID NO: 7692933 - DNA, 22 bp, Homo sapiens
tctgccagctctgtgggtctcg

SEQ ID NO: 7692934 - DNA, 21 bp, Homo sapiens
tctgccagctgaagaggtgga

SEQ ID NO: 7692935 - DNA, 21 bp, Homo sapiens
tctgccagctgaagaggtgga

SEQ ID NO: 7692936 - DNA, 22 bp, Homo sapiens
tctgcctcgctaacagcagcca

SEQ ID NO: 7692937 - DNA, 22 bp, Homo sapiens
tctgcctcgctaacagcagcca

SEQ ID NO: 7692938 - DNA, 22 bp, Homo sapiens
tctgcctcgctaacagcagcca

SEQ ID NO: 7692939 - DNA, 22 bp, Homo sapiens
tctgcctcgctaacagcagcca

SEQ ID NO: 7692940 - DNA, 22 bp, Homo sapiens
tctgcctcgctaacagcagcca

SEQ ID NO: 7692941 - DNA, 22 bp, Homo sapiens
tctgcctcctgcttgtcccgac

SEQ ID NO: 7692942 - DNA, 22 bp, Homo sapiens
tctgcctcctgcttgtcccgac

SEQ ID NO: 7692943 - DNA, 22 bp, Homo sapiens
tctgcctcctgcttgtcccgac

SEQ ID NO: 7692944 - DNA, 22 bp, Homo sapiens
tctgcctcgctaacagcagcca

SEQ ID NO: 7692945 - DNA, 19 bp, Homo sapiens
tctgcctctggtcaggctc

SEQ ID NO: 7692946 - DNA, 19 bp, Homo sapiens
tctgcctctggtcaggctc

SEQ ID NO: 7692947 - DNA, 19 bp, Homo sapiens
tctgcctctggtcaggctc

SEQ ID NO: 7692948 - DNA, 19 bp, Homo sapiens
tctgcctctggtcaggctc

SEQ ID NO: 7692949 - DNA, 19 bp, Homo sapiens
tctgcctctggtcaggctc

SEQ ID NO: 7692950 - DNA, 19 bp, Homo sapiens
tctgcctctggtcaggctc

SEQ ID NO: 7692951 - DNA, 22 bp, Homo sapiens
tctgcctcgctaacagcagcca

SEQ ID NO: 7692952 - DNA, 22 bp, Homo sapiens
tctgcctcgctaacagcagcca

SEQ ID NO: 7692953 - DNA, 22 bp, Homo sapiens
tctgcctcgctaacagcagcca

SEQ ID NO: 7692954 - DNA, 22 bp, Homo sapiens
tctgcctcgctaacagcagcca

SEQ ID NO: 7692955 - DNA, 19 bp, Homo sapiens
tctgagtgagggttatcct

SEQ ID NO: 7692956 - DNA, 22 bp, Homo sapiens
tctgagtgacgtcctgacagga

SEQ ID NO: 7692957 - DNA, 22 bp, Homo sapiens
tctgagtgagtgtaggcctgac

SEQ ID NO: 7692958 - DNA, 22 bp, Homo sapiens
tctgagtgagtgtaggcctgac

SEQ ID NO: 7692959 - DNA, 22 bp, Homo sapiens
tctgagtgagcacatggttaga

SEQ ID NO: 7692960 - DNA, 22 bp, Homo sapiens
tctgagtgagggtgtgagatat

SEQ ID NO: 7692961 - DNA, 22 bp, Homo sapiens
tctgagtgacgtcctgacagga

SEQ ID NO: 7692962 - DNA, 22 bp, Homo sapiens
tctgagtgacgtcctgacagga

SEQ ID NO: 7692963 - DNA, 22 bp, Homo sapiens
tctgagtgatcagatgcattgc

SEQ ID NO: 7692964 - DNA, 22 bp, Homo sapiens
tctgagtgatgttgagtcagaa

SEQ ID NO: 7692965 - DNA, 22 bp, Homo sapiens
tctgagtgatgttgagtcagaa

SEQ ID NO: 7692966 - DNA, 22 bp, Homo sapiens
tctgagtgatgttgagtcagaa

SEQ ID NO: 7692967 - DNA, 22 bp, Homo sapiens
tctgagtgatgttgagtcagaa

SEQ ID NO: 7692968 - DNA, 22 bp, Homo sapiens
tctgagtgtcttaataggctct

SEQ ID NO: 7692969 - DNA, 22 bp, Homo sapiens
tctgagtgagcacatggttaga

SEQ ID NO: 7692970 - DNA, 22 bp, Homo sapiens
tctgagtgggaactctcatgac

SEQ ID NO: 7692971 - DNA, 22 bp, Homo sapiens
tctgagtgggaactctcatgac

SEQ ID NO: 7692972 - DNA, 22 bp, Homo sapiens
tctgagtggactgtcctgcagg

SEQ ID NO: 7692973 - DNA, 23 bp, Homo sapiens
tctgagtgattagcctctggggt

SEQ ID NO: 7692974 - DNA, 22 bp, Homo sapiens
tctgagtgcactaggaggggca

SEQ ID NO: 7692975 - DNA, 22 bp, Homo sapiens
tctgagtgtgactggttaatga

SEQ ID NO: 7692976 - DNA, 22 bp, Homo sapiens
tctgagttacacaagcaagggt

SEQ ID NO: 7692977 - DNA, 23 bp, Homo sapiens
tctgagttatgtccttacatttg

SEQ ID NO: 7692978 - DNA, 23 bp, Homo sapiens
tctgagttatgtccttacatttg

SEQ ID NO: 7692979 - DNA, 22 bp, Homo sapiens
tctgagttcataccaggctacc

SEQ ID NO: 7692980 - DNA, 22 bp, Homo sapiens
tctgagttgaggaaatgcattt

SEQ ID NO: 7692981 - DNA, 22 bp, Homo sapiens
tctgagttgaggaaatgcattt

SEQ ID NO: 7692982 - DNA, 22 bp, Homo sapiens
tctgagttcataccaggctacc

SEQ ID NO: 7692983 - DNA, 22 bp, Homo sapiens
tctgataagtggtgtatactgt

SEQ ID NO: 7692984 - DNA, 20 bp, Homo sapiens
tctgataactggttgtgatt

SEQ ID NO: 7692985 - DNA, 22 bp, Homo sapiens
tctgataagacagctgatttga

SEQ ID NO: 7692986 - DNA, 22 bp, Homo sapiens
tctgataagacagctgatttga

SEQ ID NO: 7692987 - DNA, 22 bp, Homo sapiens
tctgataagacagctgatttga

SEQ ID NO: 7692988 - DNA, 22 bp, Homo sapiens
tctgataacaaccatgtctggc

SEQ ID NO: 7692989 - DNA, 22 bp, Homo sapiens
tctgataacaaccatgtctggc

SEQ ID NO: 7692990 - DNA, 22 bp, Homo sapiens
tctgataaatgccatctttttg

SEQ ID NO: 7692991 - DNA, 22 bp, Homo sapiens
tctgataaatgccatctttttg

SEQ ID NO: 7692992 - DNA, 22 bp, Homo sapiens
tctgagtttttgcagctgctgt

SEQ ID NO: 7692993 - DNA, 22 bp, Homo sapiens
tctgagtttaggaccaggctga

SEQ ID NO: 7692994 - DNA, 22 bp, Homo sapiens
tctgagtttataggttttccag

SEQ ID NO: 7692995 - DNA, 22 bp, Homo sapiens
tctgagttttctgagaagctta

SEQ ID NO: 7692996 - DNA, 22 bp, Homo sapiens
ccagcctcatcatattcctgct

SEQ ID NO: 7692997 - DNA, 22 bp, Homo sapiens
ccagcctcatcatattcctgct

SEQ ID NO: 7692998 - DNA, 22 bp, Homo sapiens
ccagcctcatcatattcctgct

SEQ ID NO: 7692999 - DNA, 22 bp, Homo sapiens
ccagcctcatcatattcctgct

SEQ ID NO: 7693000 - DNA, 22 bp, Homo sapiens
ccagcctcatcatattcctgct

SEQ ID NO: 7693001 - DNA, 21 bp, Homo sapiens
ccagcctcagatcagggagct

SEQ ID NO: 7693002 - DNA, 22 bp, Homo sapiens
ccagcctcatcatattcctgct

SEQ ID NO: 7693003 - DNA, 22 bp, Homo sapiens
ccagcctggactgggtcttgtg

SEQ ID NO: 7693004 - DNA, 22 bp, Homo sapiens
ccagcctggactgggtcttgtg

SEQ ID NO: 7693005 - DNA, 22 bp, Homo sapiens
ccagcctggactgggtcttgtg

SEQ ID NO: 7693006 - DNA, 22 bp, Homo sapiens
tctgataggtggtagaaggagg

SEQ ID NO: 7693007 - DNA, 22 bp, Homo sapiens
tctgatagataccatgaggcaa

SEQ ID NO: 7693008 - DNA, 22 bp, Homo sapiens
tctgataatgtgcttcgtgacc

SEQ ID NO: 7693009 - DNA, 22 bp, Homo sapiens
tctgataatggacttctcatct

SEQ ID NO: 7693010 - DNA, 22 bp, Homo sapiens
ccagcctggagggcagtggtgg

SEQ ID NO: 7693011 - DNA, 22 bp, Homo sapiens
ccagcctggagggcagtggtgg

SEQ ID NO: 7693012 - DNA, 22 bp, Homo sapiens
ccagcctggagggcagtggtgg

SEQ ID NO: 7693013 - DNA, 22 bp, Homo sapiens
ccagcctggagggcagtggtgg

SEQ ID NO: 7693014 - DNA, 22 bp, Homo sapiens
ccagcctggagggcagtggtgg

SEQ ID NO: 7693015 - DNA, 22 bp, Homo sapiens
ccagcctggagggcagtggtgg

SEQ ID NO: 7693016 - DNA, 22 bp, Homo sapiens
ccagcctggagggcagtggtgg

SEQ ID NO: 7693017 - DNA, 22 bp, Homo sapiens
ccagcctggagggcagtggtgg

SEQ ID NO: 7693018 - DNA, 22 bp, Homo sapiens
ccagcctggagggcagtggtgg

SEQ ID NO: 7693019 - DNA, 22 bp, Homo sapiens
ccagcctggagggcagtggtgg

SEQ ID NO: 7693020 - DNA, 22 bp, Homo sapiens
ccagcctggggaggcagcttct

SEQ ID NO: 7693021 - DNA, 22 bp, Homo sapiens
ccagcctggggaggcagcttct

SEQ ID NO: 7693022 - DNA, 22 bp, Homo sapiens
ccagcctggagggcagtggtgg

SEQ ID NO: 7693023 - DNA, 22 bp, Homo sapiens
ccagcctggagggcagtggtgg

SEQ ID NO: 7693024 - DNA, 22 bp, Homo sapiens
ccagcctggagggcagtggtgg

SEQ ID NO: 7693025 - DNA, 22 bp, Homo sapiens
ccagcctggggaggcagcttct

SEQ ID NO: 7693026 - DNA, 22 bp, Homo sapiens
ccagcctggggaggcagcttct

SEQ ID NO: 7693027 - DNA, 22 bp, Homo sapiens
ccagcctggggaggcagcttct

SEQ ID NO: 7693028 - DNA, 22 bp, Homo sapiens
ccagcctggggaggcagcttct

SEQ ID NO: 7693029 - DNA, 22 bp, Homo sapiens
ccagcctggggaggcagcttct

SEQ ID NO: 7693030 - DNA, 22 bp, Homo sapiens
ccagcctggggaggcagcttct

SEQ ID NO: 7693031 - DNA, 22 bp, Homo sapiens
ccagctccagcatagccaccat

SEQ ID NO: 7693032 - DNA, 22 bp, Homo sapiens
ccagctccagcatagccaccat

SEQ ID NO: 7693033 - DNA, 22 bp, Homo sapiens
ccagctccactgtcagatgaga

SEQ ID NO: 7693034 - DNA, 22 bp, Homo sapiens
ccagctccactgtcagatgaga

SEQ ID NO: 7693035 - DNA, 22 bp, Homo sapiens
ccagctccactgtcagatgaga

SEQ ID NO: 7693036 - DNA, 22 bp, Homo sapiens
ccagctccactgtcagatgaga

SEQ ID NO: 7693037 - DNA, 22 bp, Homo sapiens
ccagctccactgtcagatgaga

SEQ ID NO: 7693038 - DNA, 22 bp, Homo sapiens
ccagctccaagtttgggcatca

SEQ ID NO: 7693039 - DNA, 22 bp, Homo sapiens
ccagctccaagtttgggcatca

SEQ ID NO: 7693040 - DNA, 22 bp, Homo sapiens
ccagctccaagtttgggcatca

SEQ ID NO: 7693041 - DNA, 22 bp, Homo sapiens
ccagctccaagtttgggcatca

SEQ ID NO: 7693042 - DNA, 21 bp, Homo sapiens
ccagctccaggaccttggatc

SEQ ID NO: 7693043 - DNA, 21 bp, Homo sapiens
ccagctccaggaccttggatc

SEQ ID NO: 7693044 - DNA, 21 bp, Homo sapiens
ccagctccaggaccttggatc

SEQ ID NO: 7693045 - DNA, 22 bp, Homo sapiens
ccagctccagcatagccaccat

SEQ ID NO: 7693046 - DNA, 22 bp, Homo sapiens
ccagctccagcatagccaccat

SEQ ID NO: 7693047 - DNA, 22 bp, Homo sapiens
ccagctccagcatagccaccat

SEQ ID NO: 7693048 - DNA, 22 bp, Homo sapiens
ccagctccagcatagccaccat

SEQ ID NO: 7693049 - DNA, 22 bp, Homo sapiens
ccagctccagcatagccaccat

SEQ ID NO: 7693050 - DNA, 22 bp, Homo sapiens
ccagctccagcatagccaccat

SEQ ID NO: 7693051 - DNA, 22 bp, Homo sapiens
ccagcgcttcccatcagggagg

SEQ ID NO: 7693052 - DNA, 22 bp, Homo sapiens
ccagcgcttcccatcagggagg

SEQ ID NO: 7693053 - DNA, 23 bp, Homo sapiens
ccagcgctcactcagagcatgtt

SEQ ID NO: 7693054 - DNA, 22 bp, Homo sapiens
ccagcgtcccgtgatattctgc

SEQ ID NO: 7693055 - DNA, 22 bp, Homo sapiens
ccagctaggcttgcactcttgt

SEQ ID NO: 7693056 - DNA, 22 bp, Homo sapiens
ccagctaggcttgcactcttgt

SEQ ID NO: 7693057 - DNA, 22 bp, Homo sapiens
ccagctagtaagcacctgcatc

SEQ ID NO: 7693058 - DNA, 22 bp, Homo sapiens
ccagctagtaagcacctgcatc

SEQ ID NO: 7693059 - DNA, 22 bp, Homo sapiens
ccagctagtaagcacctgcatc

SEQ ID NO: 7693060 - DNA, 22 bp, Homo sapiens
ccagctagtaagcacctgcatc

SEQ ID NO: 7693061 - DNA, 22 bp, Homo sapiens
ccagctagtaagcacctgcatc

SEQ ID NO: 7693062 - DNA, 22 bp, Homo sapiens
ccagctatggctattcaaggtc

SEQ ID NO: 7693063 - DNA, 22 bp, Homo sapiens
ccagctattgctgtgtaacagt

SEQ ID NO: 7693064 - DNA, 22 bp, Homo sapiens
ccagctagtaagcacctgcatc

SEQ ID NO: 7693065 - DNA, 22 bp, Homo sapiens
ccagctcaagcactgtgtgaag

SEQ ID NO: 7693066 - DNA, 22 bp, Homo sapiens
ccagctccaagtttgggcatca

SEQ ID NO: 7693067 - DNA, 22 bp, Homo sapiens
ccagctcatctcagtgaaatgc

SEQ ID NO: 7693068 - DNA, 22 bp, Homo sapiens
ccagctcatctcagtgaaatgc

SEQ ID NO: 7693069 - DNA, 22 bp, Homo sapiens
ccagctcagggtcacatggcac

SEQ ID NO: 7693070 - DNA, 22 bp, Homo sapiens
ccagctcagggtcacatggcac

SEQ ID NO: 7693071 - DNA, 23 bp, Homo sapiens
ccagctcatccattacctctctt

SEQ ID NO: 7693072 - DNA, 22 bp, Homo sapiens
ccagctcagggtcacatggcac

SEQ ID NO: 7693073 - DNA, 22 bp, Homo sapiens
ccagctcagggtcacatggcac

SEQ ID NO: 7693074 - DNA, 22 bp, Homo sapiens
ccagccttggctttcctagccc

SEQ ID NO: 7693075 - DNA, 22 bp, Homo sapiens
ccagccttgcaccgagccagcc

SEQ ID NO: 7693076 - DNA, 22 bp, Homo sapiens
ccagccttgaatcagttgctgc

SEQ ID NO: 7693077 - DNA, 22 bp, Homo sapiens
ccagccttgactgccccagcac

SEQ ID NO: 7693078 - DNA, 22 bp, Homo sapiens
ccagccttgactgccccagcac

SEQ ID NO: 7693079 - DNA, 23 bp, Homo sapiens
ccagcgctcactcagagcatgtt

SEQ ID NO: 7693080 - DNA, 23 bp, Homo sapiens
ccagcgctcactcagagcatgtt

SEQ ID NO: 7693081 - DNA, 22 bp, Homo sapiens
ccagcgactgtgacctcagcta

SEQ ID NO: 7693082 - DNA, 22 bp, Homo sapiens
ccagcgactgtgacctcagcta

SEQ ID NO: 7693083 - DNA, 23 bp, Homo sapiens
ccagcgctcactcagagcatgtt

SEQ ID NO: 7693084 - DNA, 22 bp, Homo sapiens
ccagccttcacctgctctggtc

SEQ ID NO: 7693085 - DNA, 22 bp, Homo sapiens
ccagccttactgcccttcagtg

SEQ ID NO: 7693086 - DNA, 22 bp, Homo sapiens
ccagcctggttcagaattggct

SEQ ID NO: 7693087 - DNA, 22 bp, Homo sapiens
ccagcctggttcagaattggct

SEQ ID NO: 7693088 - DNA, 22 bp, Homo sapiens
ccagcctggttcagaattggct

SEQ ID NO: 7693089 - DNA, 22 bp, Homo sapiens
ccagccttccagccaatggctg

SEQ ID NO: 7693090 - DNA, 22 bp, Homo sapiens
ccagccttcacctgctctggtc

SEQ ID NO: 7693091 - DNA, 22 bp, Homo sapiens
ccagccttctgagctgcctgga

SEQ ID NO: 7693092 - DNA, 22 bp, Homo sapiens
ccagcctgggtgttagaagaca

SEQ ID NO: 7693093 - DNA, 22 bp, Homo sapiens
ccagcctgggtgttagaagaca

SEQ ID NO: 7693094 - DNA, 22 bp, Homo sapiens
ccagcctgggtgttagaagaca

SEQ ID NO: 7693095 - DNA, 22 bp, Homo sapiens
ccagcctggggaggcagcttct

SEQ ID NO: 7693096 - DNA, 22 bp, Homo sapiens
ccagcctggggaggcagcttct

SEQ ID NO: 7693097 - DNA, 22 bp, Homo sapiens
ccagcctggggaggcagcttct

SEQ ID NO: 7693098 - DNA, 22 bp, Homo sapiens
ccagcctgggtgttagaagaca

SEQ ID NO: 7693099 - DNA, 22 bp, Homo sapiens
ccagcctgggtgttagaagaca

SEQ ID NO: 7693100 - DNA, 17 bp, Homo sapiens
tatctctgcttcatggt

SEQ ID NO: 7693101 - DNA, 22 bp, Homo sapiens
tatctctagcgcacagaagaaa

SEQ ID NO: 7693102 - DNA, 22 bp, Homo sapiens
tatctctgtaaaagaaatcaca

SEQ ID NO: 7693103 - DNA, 17 bp, Homo sapiens
tatctcttcaagtttca

SEQ ID NO: 7693104 - DNA, 22 bp, Homo sapiens
tatctcttgcatgctttttaga

SEQ ID NO: 7693105 - DNA, 22 bp, Homo sapiens
tatctcttgcatgctttttaga

SEQ ID NO: 7693106 - DNA, 22 bp, Homo sapiens
tatctcattttattgcaaatgt

SEQ ID NO: 7693107 - DNA, 22 bp, Homo sapiens
tatctcagctggatcagtggaa

SEQ ID NO: 7693108 - DNA, 22 bp, Homo sapiens
tatctccatctggagagcaaaa

SEQ ID NO: 7693109 - DNA, 20 bp, Homo sapiens
tatctcagtttgtcctaaac

SEQ ID NO: 7693110 - DNA, 22 bp, Homo sapiens
tatctccagtttctgagcctca

SEQ ID NO: 7693111 - DNA, 22 bp, Homo sapiens
tatctccatctggagagcaaaa

SEQ ID NO: 7693112 - DNA, 22 bp, Homo sapiens
tatctgagaaagaagcaccaga

SEQ ID NO: 7693113 - DNA, 22 bp, Homo sapiens
tatctgatgcctgttctgttca

SEQ ID NO: 7693114 - DNA, 22 bp, Homo sapiens
tatctgattaatcagtgctttg

SEQ ID NO: 7693115 - DNA, 22 bp, Homo sapiens
tatctgcatctgcatgtgtatt

SEQ ID NO: 7693116 - DNA, 22 bp, Homo sapiens
tatctgcatctgcatgtgtatt

SEQ ID NO: 7693117 - DNA, 22 bp, Homo sapiens
tatctgcatctgcatgtgtatt

SEQ ID NO: 7693118 - DNA, 20 bp, Homo sapiens
tatctgctctagtagcagtt

SEQ ID NO: 7693119 - DNA, 22 bp, Homo sapiens
tatctgaacaacctttattact

SEQ ID NO: 7693120 - DNA, 22 bp, Homo sapiens
tatctgaacaacctttattact

SEQ ID NO: 7693121 - DNA, 22 bp, Homo sapiens
tatctgaatcagttaggactct

SEQ ID NO: 7693122 - DNA, 22 bp, Homo sapiens
tatctgaatcagttaggactct

SEQ ID NO: 7693123 - DNA, 22 bp, Homo sapiens
tatctgacaaaccctgtgccca

SEQ ID NO: 7693124 - DNA, 22 bp, Homo sapiens
tatctgagaaagaagcaccaga

SEQ ID NO: 7693125 - DNA, 22 bp, Homo sapiens
tatctgatacaacagaataaca

SEQ ID NO: 7693126 - DNA, 22 bp, Homo sapiens
tatctgatacaacagaataaca

SEQ ID NO: 7693127 - DNA, 22 bp, Homo sapiens
tatctctttattgacaataaaa

SEQ ID NO: 7693128 - DNA, 22 bp, Homo sapiens
tatctctttattgacaataaaa

SEQ ID NO: 7693129 - DNA, 22 bp, Homo sapiens
tatctctttcattttagagtca

SEQ ID NO: 7693130 - DNA, 22 bp, Homo sapiens
tatctcttgtctgttttgcaaa

SEQ ID NO: 7693131 - DNA, 22 bp, Homo sapiens
tatctcttgcatgctttttaga

SEQ ID NO: 7693132 - DNA, 22 bp, Homo sapiens
tatctctttattgacaataaaa

SEQ ID NO: 7693133 - DNA, 22 bp, Homo sapiens
tatggcagaggagaggcactag

SEQ ID NO: 7693134 - DNA, 19 bp, Homo sapiens
tatggcaggccgaggcact

SEQ ID NO: 7693135 - DNA, 22 bp, Homo sapiens
tatggcagaggagaggcactag

SEQ ID NO: 7693136 - DNA, 22 bp, Homo sapiens
tatggcagttacccttgatgat

SEQ ID NO: 7693137 - DNA, 22 bp, Homo sapiens
tatggcagttacccttgatgat

SEQ ID NO: 7693138 - DNA, 19 bp, Homo sapiens
tatggcaggccgaggcact

SEQ ID NO: 7693139 - DNA, 19 bp, Homo sapiens
tatggcaggccgaggcact

SEQ ID NO: 7693140 - DNA, 22 bp, Homo sapiens
tatggcatatagtccagcataa

SEQ ID NO: 7693141 - DNA, 22 bp, Homo sapiens
tatggcatatctgggagactct

SEQ ID NO: 7693142 - DNA, 23 bp, Homo sapiens
tatggcatggtacttccagcaga

SEQ ID NO: 7693143 - DNA, 22 bp, Homo sapiens
tatggcaatatgtatcaagatc

SEQ ID NO: 7693144 - DNA, 22 bp, Homo sapiens
tatggcaagatgacatgttctc

SEQ ID NO: 7693145 - DNA, 22 bp, Homo sapiens
tatggcaatatgtatcaagatc

SEQ ID NO: 7693146 - DNA, 22 bp, Homo sapiens
tatggcaagagaatcaactgaa

SEQ ID NO: 7693147 - DNA, 22 bp, Homo sapiens
tatggcaagatgacatgttctc

SEQ ID NO: 7693148 - DNA, 22 bp, Homo sapiens
tatggatataatcagactggaa

SEQ ID NO: 7693149 - DNA, 22 bp, Homo sapiens
tatggatgagttcctgaggagt

SEQ ID NO: 7693150 - DNA, 22 bp, Homo sapiens
tatggataggtttcaagaatgc

SEQ ID NO: 7693151 - DNA, 22 bp, Homo sapiens
tatggatggaaagggccaagct

SEQ ID NO: 7693152 - DNA, 22 bp, Homo sapiens
tatggatgtttatctacaggct

SEQ ID NO: 7693153 - DNA, 22 bp, Homo sapiens
tatggagattcaaaagcatctt

SEQ ID NO: 7693154 - DNA, 22 bp, Homo sapiens
tatggacttgcagctgccagat

SEQ ID NO: 7693155 - DNA, 22 bp, Homo sapiens
tatggagattcaaaagcatctt

SEQ ID NO: 7693156 - DNA, 22 bp, Homo sapiens
tatctggtttagtatgatgtta

SEQ ID NO: 7693157 - DNA, 22 bp, Homo sapiens
tatggactattgtatgacagag

SEQ ID NO: 7693158 - DNA, 22 bp, Homo sapiens
tatggacatgctgggctggata

SEQ ID NO: 7693159 - DNA, 22 bp, Homo sapiens
tatgcacagttacaagaatatc

SEQ ID NO: 7693160 - DNA, 22 bp, Homo sapiens
tatctggttcctttgaggagat

SEQ ID NO: 7693161 - DNA, 22 bp, Homo sapiens
tatctggtttagtatgatgtta

SEQ ID NO: 7693162 - DNA, 22 bp, Homo sapiens
tatgcacacatgtatgcatgtg

SEQ ID NO: 7693163 - DNA, 22 bp, Homo sapiens
tatgcacacattagcacagggt

SEQ ID NO: 7693164 - DNA, 22 bp, Homo sapiens
tatgcacacattagcacagggt

SEQ ID NO: 7693165 - DNA, 22 bp, Homo sapiens
tatgcacacctgggtccttgtc

SEQ ID NO: 7693166 - DNA, 22 bp, Homo sapiens
tatgcacacctgggtccttgtc

SEQ ID NO: 7693167 - DNA, 22 bp, Homo sapiens
tatgcacacattagcacagggt

SEQ ID NO: 7693168 - DNA, 22 bp, Homo sapiens
tatgcacagaagtttgctgaat

SEQ ID NO: 7693169 - DNA, 22 bp, Homo sapiens
tatgcacagttacaagaatatc

SEQ ID NO: 7693170 - DNA, 22 bp, Homo sapiens
tatgcacagaagtttgctgaat

SEQ ID NO: 7693171 - DNA, 22 bp, Homo sapiens
tatgcacagaagtttgctgaat

SEQ ID NO: 7693172 - DNA, 22 bp, Homo sapiens
tatggcttaaaatttcagcatg

SEQ ID NO: 7693173 - DNA, 23 bp, Homo sapiens
tatggcttacagtgctttaggta

SEQ ID NO: 7693174 - DNA, 23 bp, Homo sapiens
tatggcttacagtgctttaggta

SEQ ID NO: 7693175 - DNA, 22 bp, Homo sapiens
tatggctcatggggctagcaag

SEQ ID NO: 7693176 - DNA, 22 bp, Homo sapiens
tatggctactacgaataatgct

SEQ ID NO: 7693177 - DNA, 22 bp, Homo sapiens
tatggctaattctttactgacc

SEQ ID NO: 7693178 - DNA, 23 bp, Homo sapiens
tatggctcataaaacagagcagg

SEQ ID NO: 7693179 - DNA, 22 bp, Homo sapiens
tatggctaattctttactgacc

SEQ ID NO: 7693180 - DNA, 22 bp, Homo sapiens
tatggccatgatggccaattgg

SEQ ID NO: 7693181 - DNA, 22 bp, Homo sapiens
tatggccacagcttgtttgcaa

SEQ ID NO: 7693182 - DNA, 22 bp, Homo sapiens
tatggccacaatggggagaaac

SEQ ID NO: 7693183 - DNA, 22 bp, Homo sapiens
tatggccaatcgggtggacgcc

SEQ ID NO: 7693184 - DNA, 22 bp, Homo sapiens
tatggcatttagaaatgtcaga

SEQ ID NO: 7693185 - DNA, 22 bp, Homo sapiens
tatggcatttagaaatgtcaga

SEQ ID NO: 7693186 - DNA, 22 bp, Homo sapiens
tatggcatttagaaatgtcaga

SEQ ID NO: 7693187 - DNA, 22 bp, Homo sapiens
tatggcatttagaaatgtcaga

SEQ ID NO: 7693188 - DNA, 22 bp, Homo sapiens
tatggcattttgtaagggcttg

SEQ ID NO: 7693189 - DNA, 22 bp, Homo sapiens
tatggcttcattgtgctccgca

SEQ ID NO: 7693190 - DNA, 22 bp, Homo sapiens
tatggcttaggagagtttaact

SEQ ID NO: 7693191 - DNA, 22 bp, Homo sapiens
tatggcttatgctgaacacctg

SEQ ID NO: 7693192 - DNA, 22 bp, Homo sapiens
tatggcttatgctgaacacctg

SEQ ID NO: 7693193 - DNA, 23 bp, Homo sapiens
tatggcttacagtgctttaggta

SEQ ID NO: 7693194 - DNA, 22 bp, Homo sapiens
tatggcttccaggctggccagg

SEQ ID NO: 7693195 - DNA, 22 bp, Homo sapiens
tatggcttctataaggaagctt

SEQ ID NO: 7693196 - DNA, 22 bp, Homo sapiens
tatggcttccaggctggccagg

SEQ ID NO: 7693197 - DNA, 22 bp, Homo sapiens
tatggcttctgctttcttgact

SEQ ID NO: 7693198 - DNA, 22 bp, Homo sapiens
tatggcttctcagtcatgaaaa

SEQ ID NO: 7693199 - DNA, 22 bp, Homo sapiens
tatggcttctgctttcttgact

SEQ ID NO: 7693200 - DNA, 22 bp, Homo sapiens
caggtctgggttgatggcctgg

SEQ ID NO: 7693201 - DNA, 22 bp, Homo sapiens
caggtctggtgagagaacagtt

SEQ ID NO: 7693202 - DNA, 22 bp, Homo sapiens
caggtctggtgagagaacagtt

SEQ ID NO: 7693203 - DNA, 22 bp, Homo sapiens
caggtctggtgagagaacagtt

SEQ ID NO: 7693204 - DNA, 21 bp, Homo sapiens
caggtctggtgaacactctca

SEQ ID NO: 7693205 - DNA, 22 bp, Homo sapiens
caggtctggtgagagaacagtt

SEQ ID NO: 7693206 - DNA, 22 bp, Homo sapiens
tatgtactaactttcattctag

SEQ ID NO: 7693207 - DNA, 22 bp, Homo sapiens
tatgtacatgttaaagggcaaa

SEQ ID NO: 7693208 - DNA, 22 bp, Homo sapiens
tatgtacatgttaaagggcaaa

SEQ ID NO: 7693209 - DNA, 22 bp, Homo sapiens
caggtgaagaggataaaaagtt

SEQ ID NO: 7693210 - DNA, 22 bp, Homo sapiens
caggtgaacccagtctaatcat

SEQ ID NO: 7693211 - DNA, 22 bp, Homo sapiens
caggtgaaaaagcaaccatatt

SEQ ID NO: 7693212 - DNA, 22 bp, Homo sapiens
caggtctttgttgcagcatgga

SEQ ID NO: 7693213 - DNA, 19 bp, Homo sapiens
caggtcttcttggaggact

SEQ ID NO: 7693214 - DNA, 22 bp, Homo sapiens
caggtgaactcagttttgtatt

SEQ ID NO: 7693215 - DNA, 22 bp, Homo sapiens
caggtgaactcagttttgtatt

SEQ ID NO: 7693216 - DNA, 22 bp, Homo sapiens
caggtgaacccagtctaatcat

SEQ ID NO: 7693217 - DNA, 22 bp, Homo sapiens
caggtgaacccagtctaatcat

SEQ ID NO: 7693218 - DNA, 22 bp, Homo sapiens
caggtctgttttcaaggtcagt

SEQ ID NO: 7693219 - DNA, 22 bp, Homo sapiens
caggtgaaaaagcaaccatatt

SEQ ID NO: 7693220 - DNA, 22 bp, Homo sapiens
caggtctttgttgcagcatgga

SEQ ID NO: 7693221 - DNA, 22 bp, Homo sapiens
caggtctgtattaacagagggt

SEQ ID NO: 7693222 - DNA, 22 bp, Homo sapiens
caggtctgtattaacagagggt

SEQ ID NO: 7693223 - DNA, 22 bp, Homo sapiens
caggtctgtattaacagagggt

SEQ ID NO: 7693224 - DNA, 18 bp, Homo sapiens
caggtctgtctgcctccc

SEQ ID NO: 7693225 - DNA, 18 bp, Homo sapiens
caggtctgtctgcctccc

SEQ ID NO: 7693226 - DNA, 18 bp, Homo sapiens
caggtctgtctgcctccc

SEQ ID NO: 7693227 - DNA, 22 bp, Homo sapiens
caggtctgttttcaaggtcagt

SEQ ID NO: 7693228 - DNA, 22 bp, Homo sapiens
caggtctgtttccatcagtgct

SEQ ID NO: 7693229 - DNA, 22 bp, Homo sapiens
caggtctgtttccatcagtgct

SEQ ID NO: 7693230 - DNA, 22 bp, Homo sapiens
caggtctgtttccatcagtgct

SEQ ID NO: 7693231 - DNA, 22 bp, Homo sapiens
tatgttttaggaattaattgtt

SEQ ID NO: 7693232 - DNA, 22 bp, Homo sapiens
tatgtttttaagagaatgcatt

SEQ ID NO: 7693233 - DNA, 22 bp, Homo sapiens
tatgtttttaagagaatgcatt

SEQ ID NO: 7693234 - DNA, 22 bp, Homo sapiens
tatgtttttaagagaatgcatt

SEQ ID NO: 7693235 - DNA, 22 bp, Homo sapiens
tatgtttttaagagaatgcatt

SEQ ID NO: 7693236 - DNA, 22 bp, Homo sapiens
tatgtttttaagagaatgcatt

SEQ ID NO: 7693237 - DNA, 22 bp, Homo sapiens
tatgtttttaagagaatgcatt

SEQ ID NO: 7693238 - DNA, 22 bp, Homo sapiens
tatgtttgttatcacaactagg

SEQ ID NO: 7693239 - DNA, 22 bp, Homo sapiens
tatgtttgttatcacaactagg

SEQ ID NO: 7693240 - DNA, 22 bp, Homo sapiens
tatgttttaggaattaattgtt

SEQ ID NO: 7693241 - DNA, 22 bp, Homo sapiens
tatgtttgttatcacaactagg

SEQ ID NO: 7693242 - DNA, 22 bp, Homo sapiens
tatgttttaggaattaattgtt

SEQ ID NO: 7693243 - DNA, 22 bp, Homo sapiens
tatgttttaggaattaattgtt

SEQ ID NO: 7693244 - DNA, 22 bp, Homo sapiens
tatgttttaggaattaattgtt

SEQ ID NO: 7693245 - DNA, 22 bp, Homo sapiens
tatgttttaggaattaattgtt

SEQ ID NO: 7693246 - DNA, 22 bp, Homo sapiens
tatgttttaggaattaattgtt

SEQ ID NO: 7693247 - DNA, 22 bp, Homo sapiens
tatgttttaggaattaattgtt

SEQ ID NO: 7693248 - DNA, 22 bp, Homo sapiens
tatgttttaggaattaattgtt

SEQ ID NO: 7693249 - DNA, 22 bp, Homo sapiens
tatgtgtatttagttctataca

SEQ ID NO: 7693250 - DNA, 22 bp, Homo sapiens
tatgtgtatgtacatacataca

SEQ ID NO: 7693251 - DNA, 22 bp, Homo sapiens
tatgtgtatgtacatacataca

SEQ ID NO: 7693252 - DNA, 22 bp, Homo sapiens
tatgtgtatgtacatacataca

SEQ ID NO: 7693253 - DNA, 22 bp, Homo sapiens
tatgtgtatgtacatacataca

SEQ ID NO: 7693254 - DNA, 19 bp, Homo sapiens
tatgtgtatatgtatctgt

SEQ ID NO: 7693255 - DNA, 22 bp, Homo sapiens
tatgtgtatgtacatacataca

SEQ ID NO: 7693256 - DNA, 22 bp, Homo sapiens
tatgtactaactttcattctag

SEQ ID NO: 7693257 - DNA, 22 bp, Homo sapiens
tatgtgcatatgcatacacaca

SEQ ID NO: 7693258 - DNA, 23 bp, Homo sapiens
tatgtgcatatgtgtaagaatac

SEQ ID NO: 7693259 - DNA, 23 bp, Homo sapiens
tatgtgcatatgtgtaagaatac

SEQ ID NO: 7693260 - DNA, 22 bp, Homo sapiens
tatgtgcattattaccagtgga

SEQ ID NO: 7693261 - DNA, 22 bp, Homo sapiens
tatgtgcattatctagttcatt

SEQ ID NO: 7693262 - DNA, 22 bp, Homo sapiens
tatgtgcatgctgacttgagga

SEQ ID NO: 7693263 - DNA, 22 bp, Homo sapiens
tatgtgctgccaccagggagag

SEQ ID NO: 7693264 - DNA, 22 bp, Homo sapiens
tatgtgcttaatacatggtgtt

SEQ ID NO: 7693265 - DNA, 22 bp, Homo sapiens
tatgtgctgccaccagggagag

SEQ ID NO: 7693266 - DNA, 22 bp, Homo sapiens
tatgtgctttgcactgtgctat

SEQ ID NO: 7693267 - DNA, 22 bp, Homo sapiens
tatgtgctgaagtctttacacc

SEQ ID NO: 7693268 - DNA, 22 bp, Homo sapiens
tatgtgctaagctccagatcag

SEQ ID NO: 7693269 - DNA, 22 bp, Homo sapiens
tatgtgctaaacaccttccata

SEQ ID NO: 7693270 - DNA, 22 bp, Homo sapiens
tatgtgcattattaccagtgga

SEQ ID NO: 7693271 - DNA, 22 bp, Homo sapiens
tatgtgtaatcaaacacatgct

SEQ ID NO: 7693272 - DNA, 22 bp, Homo sapiens
tatgtgtaatcaaacacatgct

SEQ ID NO: 7693273 - DNA, 23 bp, Homo sapiens
tatgtgtaaggagaaggagtgag

SEQ ID NO: 7693274 - DNA, 22 bp, Homo sapiens
tatgtgtaagctgtttatcttt

SEQ ID NO: 7693275 - DNA, 22 bp, Homo sapiens
tatgtgtactcgttaaatattt

SEQ ID NO: 7693276 - DNA, 22 bp, Homo sapiens
tatgtgtacatctggttgagca

SEQ ID NO: 7693277 - DNA, 22 bp, Homo sapiens
tatgtgtaggaggaggacaggg

SEQ ID NO: 7693278 - DNA, 22 bp, Homo sapiens
tatgtgtatatctgtatgtgca

SEQ ID NO: 7693279 - DNA, 22 bp, Homo sapiens
tatgtgtatacctatacatgtg

SEQ ID NO: 7693280 - DNA, 22 bp, Homo sapiens
tatgtgtatatctgtatgtgca

SEQ ID NO: 7693281 - DNA, 22 bp, Homo sapiens
tattgctggggtgggccatgtt

SEQ ID NO: 7693282 - DNA, 22 bp, Homo sapiens
tattgctggtgctgttctgaat

SEQ ID NO: 7693283 - DNA, 22 bp, Homo sapiens
tattgctggtgctgttctgaat

SEQ ID NO: 7693284 - DNA, 22 bp, Homo sapiens
tattgctgttctttaaatgaag

SEQ ID NO: 7693285 - DNA, 22 bp, Homo sapiens
tattgctgttctttaaatgaag

SEQ ID NO: 7693286 - DNA, 22 bp, Homo sapiens
tattgcttaaaaaatatgtgag

SEQ ID NO: 7693287 - DNA, 22 bp, Homo sapiens
tattgcttaaaaaatatgtgag

SEQ ID NO: 7693288 - DNA, 22 bp, Homo sapiens
tattgcttataatttgttgcaa

SEQ ID NO: 7693289 - DNA, 22 bp, Homo sapiens
tattgcttataatttgttgcaa

SEQ ID NO: 7693290 - DNA, 22 bp, Homo sapiens
tattgcttataatttgttgcaa

SEQ ID NO: 7693291 - DNA, 22 bp, Homo sapiens
tattgctttcagttgctttgag

SEQ ID NO: 7693292 - DNA, 21 bp, Homo sapiens
tattgcttgtaggtcatcctg

SEQ ID NO: 7693293 - DNA, 22 bp, Homo sapiens
tattgcttcataattgttgcca

SEQ ID NO: 7693294 - DNA, 22 bp, Homo sapiens
tattgcttggggtacaaggtat

SEQ ID NO: 7693295 - DNA, 22 bp, Homo sapiens
tattgcttggggtacaaggtat

SEQ ID NO: 7693296 - DNA, 22 bp, Homo sapiens
tattgcttattcttgagagtca

SEQ ID NO: 7693297 - DNA, 22 bp, Homo sapiens
tattgcttattcttgagagtca

SEQ ID NO: 7693298 - DNA, 22 bp, Homo sapiens
tattgcttcagcttcctgggct

SEQ ID NO: 7693299 - DNA, 22 bp, Homo sapiens
tattgcttcataattgttgcca

SEQ ID NO: 7693300 - DNA, 22 bp, Homo sapiens
tattgcttcataattgttgcca

SEQ ID NO: 7693301 - DNA, 22 bp, Homo sapiens
tattgcttttatttctatggac

SEQ ID NO: 7693302 - DNA, 22 bp, Homo sapiens
tattgctttgtgtcataagcaa

SEQ ID NO: 7693303 - DNA, 22 bp, Homo sapiens
tattgctttctcagacgtttag

SEQ ID NO: 7693304 - DNA, 22 bp, Homo sapiens
tattgctttctcagacgtttag

SEQ ID NO: 7693305 - DNA, 22 bp, Homo sapiens
tattggaaggaagcaagagagg

SEQ ID NO: 7693306 - DNA, 22 bp, Homo sapiens
tattgctgctattgtcagttca

SEQ ID NO: 7693307 - DNA, 22 bp, Homo sapiens
tattgctggaaaatggtgtgat

SEQ ID NO: 7693308 - DNA, 22 bp, Homo sapiens
tattgctgccaggaccctatcc

SEQ ID NO: 7693309 - DNA, 22 bp, Homo sapiens
tattgctgccattttccaatgt

SEQ ID NO: 7693310 - DNA, 22 bp, Homo sapiens
tattgctgcctcgtccaggctg

SEQ ID NO: 7693311 - DNA, 22 bp, Homo sapiens
tattgctgccaggaccctatcc

SEQ ID NO: 7693312 - DNA, 22 bp, Homo sapiens
tattgctgaggattgaggcttg

SEQ ID NO: 7693313 - DNA, 22 bp, Homo sapiens
tattgctgatgctgaagggaag

SEQ ID NO: 7693314 - DNA, 22 bp, Homo sapiens
tattgctgatgctgaagggaag

SEQ ID NO: 7693315 - DNA, 22 bp, Homo sapiens
tattgctgacttgttcagtgtt

SEQ ID NO: 7693316 - DNA, 22 bp, Homo sapiens
tattgctgactgtcttctgagt

SEQ ID NO: 7693317 - DNA, 22 bp, Homo sapiens
tattgctgactgtcttctgagt

SEQ ID NO: 7693318 - DNA, 22 bp, Homo sapiens
tattgctgacttgttcagtgtt

SEQ ID NO: 7693319 - DNA, 22 bp, Homo sapiens
tattgctgacttgttcagtgtt

SEQ ID NO: 7693320 - DNA, 22 bp, Homo sapiens
tattgctgaaatgctgagttca

SEQ ID NO: 7693321 - DNA, 22 bp, Homo sapiens
tattgcgaatgtggtgataaat

SEQ ID NO: 7693322 - DNA, 20 bp, Homo sapiens
tattgccttaatggagctta

SEQ ID NO: 7693323 - DNA, 22 bp, Homo sapiens
tattgctatgagcattgttctt

SEQ ID NO: 7693324 - DNA, 22 bp, Homo sapiens
tattgcctgagtgtttcataat

SEQ ID NO: 7693325 - DNA, 22 bp, Homo sapiens
tattgccaaatgtctgctggaa

SEQ ID NO: 7693326 - DNA, 22 bp, Homo sapiens
tattgccaaatgtctgctggaa

SEQ ID NO: 7693327 - DNA, 20 bp, Homo sapiens
tattgcctaaataccagaat

SEQ ID NO: 7693328 - DNA, 22 bp, Homo sapiens
tattgccgtggaaggggccagg

SEQ ID NO: 7693329 - DNA, 22 bp, Homo sapiens
tattgcctaggttaacgaggtt

SEQ ID NO: 7693330 - DNA, 17 bp, Homo sapiens
tattgcctctgaggtca

SEQ ID NO: 7693331 - DNA, 22 bp, Homo sapiens
tattcctgggttccagcccaga

SEQ ID NO: 7693332 - DNA, 23 bp, Homo sapiens
tattcctggtaagcctgtcactg

SEQ ID NO: 7693333 - DNA, 23 bp, Homo sapiens
tattcctggtaagcctgtcactg

SEQ ID NO: 7693334 - DNA, 22 bp, Homo sapiens
tattcctgggccccattccaga

SEQ ID NO: 7693335 - DNA, 22 bp, Homo sapiens
tattcctgggttccagcccaga

SEQ ID NO: 7693336 - DNA, 22 bp, Homo sapiens
tattcctggtccctaccacaga

SEQ ID NO: 7693337 - DNA, 22 bp, Homo sapiens
tattcctggtgttggctgggtc

SEQ ID NO: 7693338 - DNA, 23 bp, Homo sapiens
tattcctggtaagcctgtcactg

SEQ ID NO: 7693339 - DNA, 22 bp, Homo sapiens
tattcctcctttctgctcagcc

SEQ ID NO: 7693340 - DNA, 22 bp, Homo sapiens
tattaaatatatctgttagttg

SEQ ID NO: 7693341 - DNA, 22 bp, Homo sapiens
tattcctcctttctgctcagcc

SEQ ID NO: 7693342 - DNA, 22 bp, Homo sapiens
tattcctcctttctgctcagcc

SEQ ID NO: 7693343 - DNA, 18 bp, Homo sapiens
tattcctgagtcatccct

SEQ ID NO: 7693344 - DNA, 18 bp, Homo sapiens
tattcctgagtcatccct

SEQ ID NO: 7693345 - DNA, 22 bp, Homo sapiens
tattaaatatatctgttagttg

SEQ ID NO: 7693346 - DNA, 22 bp, Homo sapiens
tattaaatatatctgttagttg

SEQ ID NO: 7693347 - DNA, 22 bp, Homo sapiens
tattaaatatatctgttagttg

SEQ ID NO: 7693348 - DNA, 22 bp, Homo sapiens
tattaaatatatctgttagttg

SEQ ID NO: 7693349 - DNA, 22 bp, Homo sapiens
tattaaatatatctgttagttg

SEQ ID NO: 7693350 - DNA, 22 bp, Homo sapiens
tattaaatatatctgttagttg

SEQ ID NO: 7693351 - DNA, 22 bp, Homo sapiens
tattaaatatatctgttagttg

SEQ ID NO: 7693352 - DNA, 22 bp, Homo sapiens
tattaaatatatctgttagttg

SEQ ID NO: 7693353 - DNA, 22 bp, Homo sapiens
tattaaagagagaatcatcatc

SEQ ID NO: 7693354 - DNA, 22 bp, Homo sapiens
tattaaagagagaatcatcatc

SEQ ID NO: 7693355 - DNA, 22 bp, Homo sapiens
tattaaagggaagttatgcatg

SEQ ID NO: 7693356 - DNA, 22 bp, Homo sapiens
tattaaagggaagttatgcatg

SEQ ID NO: 7693357 - DNA, 22 bp, Homo sapiens
tattaaagggaagttatgcatg

SEQ ID NO: 7693358 - DNA, 22 bp, Homo sapiens
tattaaagggaagttatgcatg

SEQ ID NO: 7693359 - DNA, 22 bp, Homo sapiens
tattaaagagagaatcatcatc

SEQ ID NO: 7693360 - DNA, 22 bp, Homo sapiens
tattaaagagagaatcatcatc

SEQ ID NO: 7693361 - DNA, 22 bp, Homo sapiens
tatgtttttcagacgtcctaca

SEQ ID NO: 7693362 - DNA, 22 bp, Homo sapiens
tatgtttttcagacgtcctaca

SEQ ID NO: 7693363 - DNA, 22 bp, Homo sapiens
tattaaagagagaatcatcatc

SEQ ID NO: 7693364 - DNA, 22 bp, Homo sapiens
tatgtttttcagacgtcctaca

SEQ ID NO: 7693365 - DNA, 22 bp, Homo sapiens
tatgtttttcagacgtcctaca

SEQ ID NO: 7693366 - DNA, 22 bp, Homo sapiens
tatgtttttcaagtgcacacta

SEQ ID NO: 7693367 - DNA, 22 bp, Homo sapiens
tatgtttttcaagtgcacacta

SEQ ID NO: 7693368 - DNA, 22 bp, Homo sapiens
tatgtttttcaagtgcacacta

SEQ ID NO: 7693369 - DNA, 22 bp, Homo sapiens
tatgtttttcaagtgcacacta

SEQ ID NO: 7693370 - DNA, 22 bp, Homo sapiens
tatgtttttcaagtgcacacta

SEQ ID NO: 7693371 - DNA, 22 bp, Homo sapiens
tatgtttttcaagtgcacacta

SEQ ID NO: 7693372 - DNA, 22 bp, Homo sapiens
tatgtttttcaagtgcacacta

SEQ ID NO: 7693373 - DNA, 22 bp, Homo sapiens
cagggtggcacatcacagcatt

SEQ ID NO: 7693374 - DNA, 22 bp, Homo sapiens
cagggtggcacatcacagcatt

SEQ ID NO: 7693375 - DNA, 22 bp, Homo sapiens
cagggtggcacatcacagcatt

SEQ ID NO: 7693376 - DNA, 22 bp, Homo sapiens
cagggtggcacatcacagcatt

SEQ ID NO: 7693377 - DNA, 22 bp, Homo sapiens
cagggtggaatggaatgctggc

SEQ ID NO: 7693378 - DNA, 22 bp, Homo sapiens
cagggtggcacatcacagcatt

SEQ ID NO: 7693379 - DNA, 22 bp, Homo sapiens
cagggtggcacatcacagcatt

SEQ ID NO: 7693380 - DNA, 22 bp, Homo sapiens
cagggtggcacatcacagcatt

SEQ ID NO: 7693381 - DNA, 22 bp, Homo sapiens
cagggtggcacatcacagcatt

SEQ ID NO: 7693382 - DNA, 22 bp, Homo sapiens
cagggtggcacatcacagcatt

SEQ ID NO: 7693383 - DNA, 22 bp, Homo sapiens
cagggtggaagctgtagagtgg

SEQ ID NO: 7693384 - DNA, 22 bp, Homo sapiens
cagggtggaagctgtagagtgg

SEQ ID NO: 7693385 - DNA, 22 bp, Homo sapiens
cagggtggaagctgtagagtgg

SEQ ID NO: 7693386 - DNA, 22 bp, Homo sapiens
cagggtggaatggaatgctggc

SEQ ID NO: 7693387 - DNA, 22 bp, Homo sapiens
cagggtggaatggaatgctggc

SEQ ID NO: 7693388 - DNA, 22 bp, Homo sapiens
cagggtggaatggaatgctggc

SEQ ID NO: 7693389 - DNA, 22 bp, Homo sapiens
cagggtggaatggaatgctggc

SEQ ID NO: 7693390 - DNA, 22 bp, Homo sapiens
cagggtggcacatcacagcatt

SEQ ID NO: 7693391 - DNA, 22 bp, Homo sapiens
cagggtggcacatcacagcatt

SEQ ID NO: 7693392 - DNA, 22 bp, Homo sapiens
cagggtggcactcagcgcatct

SEQ ID NO: 7693393 - DNA, 22 bp, Homo sapiens
cagggtggcactcagcgcatct

SEQ ID NO: 7693394 - DNA, 22 bp, Homo sapiens
cagggtggcactcagcgcatct

SEQ ID NO: 7693395 - DNA, 22 bp, Homo sapiens
cagggtggcactcagcgcatct

SEQ ID NO: 7693396 - DNA, 22 bp, Homo sapiens
cagggtggcactcagcgcatct

SEQ ID NO: 7693397 - DNA, 22 bp, Homo sapiens
cagggtggcactcagcgcatct

SEQ ID NO: 7693398 - DNA, 22 bp, Homo sapiens
cagggtggcactcagcgcatct

SEQ ID NO: 7693399 - DNA, 22 bp, Homo sapiens
tatacagatggaaagatacaca

SEQ ID NO: 7693400 - DNA, 22 bp, Homo sapiens
tatacagatggaaagatacaca

SEQ ID NO: 7693401 - DNA, 22 bp, Homo sapiens
tatacagatggaaagatacaca

SEQ ID NO: 7693402 - DNA, 22 bp, Homo sapiens
tatacagatggaaagatacaca

SEQ ID NO: 7693403 - DNA, 22 bp, Homo sapiens
tatacagatggaaagatacaca

SEQ ID NO: 7693404 - DNA, 22 bp, Homo sapiens
cagggtggcactcagcgcatct

SEQ ID NO: 7693405 - DNA, 22 bp, Homo sapiens
tatacagatggaaagatacaca

SEQ ID NO: 7693406 - DNA, 22 bp, Homo sapiens
tatacagatggaaagatacaca

SEQ ID NO: 7693407 - DNA, 22 bp, Homo sapiens
tatacagatggaaagatacaca

SEQ ID NO: 7693408 - DNA, 22 bp, Homo sapiens
tatacagatggaaagatacaca

SEQ ID NO: 7693409 - DNA, 20 bp, Homo sapiens
tatacagtcttttgggaaaa

SEQ ID NO: 7693410 - DNA, 22 bp, Homo sapiens
tatacagtcttttgctatattc

SEQ ID NO: 7693411 - DNA, 22 bp, Homo sapiens
tatacagtcttttgctatattc

SEQ ID NO: 7693412 - DNA, 22 bp, Homo sapiens
tatacagtgcctcttccattag

SEQ ID NO: 7693413 - DNA, 22 bp, Homo sapiens
tatacagtgcctcttccattag

SEQ ID NO: 7693414 - DNA, 22 bp, Homo sapiens
tatacagtgcctcttccattag

SEQ ID NO: 7693415 - DNA, 20 bp, Homo sapiens
tatacagtcttttgggaaaa

SEQ ID NO: 7693416 - DNA, 22 bp, Homo sapiens
tatacagtgcctcttccattag

SEQ ID NO: 7693417 - DNA, 22 bp, Homo sapiens
tatacagttaagtttcttcagt

SEQ ID NO: 7693418 - DNA, 22 bp, Homo sapiens
tatacagttaagtttcttcagt

SEQ ID NO: 7693419 - DNA, 22 bp, Homo sapiens
tatacagttaagtttcttcagt

SEQ ID NO: 7693420 - DNA, 22 bp, Homo sapiens
tatacagttaagtttcttcagt

SEQ ID NO: 7693421 - DNA, 22 bp, Homo sapiens
tatacagtcttttgctatattc

SEQ ID NO: 7693422 - DNA, 22 bp, Homo sapiens
tatacagtatcttttgaaggca

SEQ ID NO: 7693423 - DNA, 22 bp, Homo sapiens
tatacagtatcttttgaaggca

SEQ ID NO: 7693424 - DNA, 22 bp, Homo sapiens
tatacagtcttttgctatattc

SEQ ID NO: 7693425 - DNA, 22 bp, Homo sapiens
tatacagtcttttgctatattc

SEQ ID NO: 7693426 - DNA, 22 bp, Homo sapiens
tatacagtcttttgctatattc

SEQ ID NO: 7693427 - DNA, 21 bp, Homo sapiens
tatacagtaattaagtggtat

SEQ ID NO: 7693428 - DNA, 21 bp, Homo sapiens
tatacagtaattaagtggtat

SEQ ID NO: 7693429 - DNA, 22 bp, Homo sapiens
tatacagtatcttttgaaggca

SEQ ID NO: 7693430 - DNA, 22 bp, Homo sapiens
tatacaggaaattttggaacag

SEQ ID NO: 7693431 - DNA, 22 bp, Homo sapiens
tatacaggaaattttggaacag

SEQ ID NO: 7693432 - DNA, 22 bp, Homo sapiens
tatacaggaactgttggctccc

SEQ ID NO: 7693433 - DNA, 21 bp, Homo sapiens
tatacagtaattaagtggtat

SEQ ID NO: 7693434 - DNA, 21 bp, Homo sapiens
tatacagcaaagtctggagca

SEQ ID NO: 7693435 - DNA, 22 bp, Homo sapiens
tatacagatttctgggcaatct

SEQ ID NO: 7693436 - DNA, 22 bp, Homo sapiens
tatacagctatggcaagacaaa

SEQ ID NO: 7693437 - DNA, 22 bp, Homo sapiens
tatacagctatggcaagacaaa

SEQ ID NO: 7693438 - DNA, 22 bp, Homo sapiens
tatacagctatggcaagacaaa

SEQ ID NO: 7693439 - DNA, 22 bp, Homo sapiens
tatacagctatggcaagacaaa

SEQ ID NO: 7693440 - DNA, 22 bp, Homo sapiens
tatacagattaacagatttaaa

SEQ ID NO: 7693441 - DNA, 22 bp, Homo sapiens
tatacagattaacagatttaaa

SEQ ID NO: 7693442 - DNA, 22 bp, Homo sapiens
tatacagattaacagatttaaa

SEQ ID NO: 7693443 - DNA, 22 bp, Homo sapiens
tatacagattaacagatttaaa

SEQ ID NO: 7693444 - DNA, 22 bp, Homo sapiens
tatacagattaacagatttaaa

SEQ ID NO: 7693445 - DNA, 22 bp, Homo sapiens
tatacagattaacagatttaaa

SEQ ID NO: 7693446 - DNA, 22 bp, Homo sapiens
tatacagatggaaagatacaca

SEQ ID NO: 7693447 - DNA, 22 bp, Homo sapiens
tatacagattaacagatttaaa

SEQ ID NO: 7693448 - DNA, 22 bp, Homo sapiens
tatacagttaagtttcttcagt

SEQ ID NO: 7693449 - DNA, 22 bp, Homo sapiens
caggtccacggcgcccaggggt

SEQ ID NO: 7693450 - DNA, 22 bp, Homo sapiens
caggtccagaaaccaaaggatt

SEQ ID NO: 7693451 - DNA, 22 bp, Homo sapiens
caggtccagaaaccaaaggatt

SEQ ID NO: 7693452 - DNA, 22 bp, Homo sapiens
caggtccagaaaccaaaggatt

SEQ ID NO: 7693453 - DNA, 22 bp, Homo sapiens
caggtccacggcgcccaggggt

SEQ ID NO: 7693454 - DNA, 22 bp, Homo sapiens
caggtccacggcgcccaggggt

SEQ ID NO: 7693455 - DNA, 22 bp, Homo sapiens
caggtctcgggttcagcagtga

SEQ ID NO: 7693456 - DNA, 22 bp, Homo sapiens
caggtctcgggttcagcagtga

SEQ ID NO: 7693457 - DNA, 22 bp, Homo sapiens
caggtctcgggttcagcagtga

SEQ ID NO: 7693458 - DNA, 22 bp, Homo sapiens
caggtctcccatcccctctgtt

SEQ ID NO: 7693459 - DNA, 22 bp, Homo sapiens
caggtctccattttgatgagtt

SEQ ID NO: 7693460 - DNA, 22 bp, Homo sapiens
caggtctccattttgatgagtt

SEQ ID NO: 7693461 - DNA, 22 bp, Homo sapiens
caggtctcccatcccctctgtt

SEQ ID NO: 7693462 - DNA, 22 bp, Homo sapiens
caggtctccagctcagggtcca

SEQ ID NO: 7693463 - DNA, 20 bp, Homo sapiens
caggtccagcacgtgcacgg

SEQ ID NO: 7693464 - DNA, 22 bp, Homo sapiens
caggtctccagctcagggtcca

SEQ ID NO: 7693465 - DNA, 22 bp, Homo sapiens
caggtccacggcgcccaggggt

SEQ ID NO: 7693466 - DNA, 22 bp, Homo sapiens
caggtctccagctcagggtcca

SEQ ID NO: 7693467 - DNA, 22 bp, Homo sapiens
caggtctgaagagtcacatgcc

SEQ ID NO: 7693468 - DNA, 22 bp, Homo sapiens
caggtctgaagagtcacatgcc

SEQ ID NO: 7693469 - DNA, 22 bp, Homo sapiens
caggtctgaagagtcacatgcc

SEQ ID NO: 7693470 - DNA, 17 bp, Homo sapiens
caggtctgaggccaggc

SEQ ID NO: 7693471 - DNA, 17 bp, Homo sapiens
caggtctgaggccaggc

SEQ ID NO: 7693472 - DNA, 22 bp, Homo sapiens
caggtctgaagagtcacatgcc

SEQ ID NO: 7693473 - DNA, 17 bp, Homo sapiens
caggtctgaggccaggc

SEQ ID NO: 7693474 - DNA, 22 bp, Homo sapiens
caggtctctgcagcccctctgt

SEQ ID NO: 7693475 - DNA, 22 bp, Homo sapiens
caggtctcttttgtcacaccac

SEQ ID NO: 7693476 - DNA, 22 bp, Homo sapiens
caggtctcttttgtcacaccac

SEQ ID NO: 7693477 - DNA, 22 bp, Homo sapiens
caggtctcttttgtcacaccac

SEQ ID NO: 7693478 - DNA, 22 bp, Homo sapiens
caggtctcgggttcagcagtga

SEQ ID NO: 7693479 - DNA, 22 bp, Homo sapiens
caggtctctcccaagctacaat

SEQ ID NO: 7693480 - DNA, 22 bp, Homo sapiens
caggtctctcccaagctacaat

SEQ ID NO: 7693481 - DNA, 22 bp, Homo sapiens
caggtctctgcagcccctctgt

SEQ ID NO: 7693482 - DNA, 22 bp, Homo sapiens
tatctattatgttctatgtgtc

SEQ ID NO: 7693483 - DNA, 22 bp, Homo sapiens
tatctattatgttctatgtgtc

SEQ ID NO: 7693484 - DNA, 22 bp, Homo sapiens
tatctatgtggtgatcttattt

SEQ ID NO: 7693485 - DNA, 22 bp, Homo sapiens
tatctattccaaatatcagcgt

SEQ ID NO: 7693486 - DNA, 22 bp, Homo sapiens
tatctattccaaatatcagcgt

SEQ ID NO: 7693487 - DNA, 23 bp, Homo sapiens
tatctcagaggaatgtagttact

SEQ ID NO: 7693488 - DNA, 22 bp, Homo sapiens
tatctatgtgctctgacctctc

SEQ ID NO: 7693489 - DNA, 22 bp, Homo sapiens
tatctatgtgctctgacctctc

SEQ ID NO: 7693490 - DNA, 22 bp, Homo sapiens
tatctatgtggtgatcttattt

SEQ ID NO: 7693491 - DNA, 22 bp, Homo sapiens
tatctatgtgctctgacctctc

SEQ ID NO: 7693492 - DNA, 22 bp, Homo sapiens
caggtctggcatcagctgtgtg

SEQ ID NO: 7693493 - DNA, 22 bp, Homo sapiens
caggtctggcatcagctgtgtg

SEQ ID NO: 7693494 - DNA, 22 bp, Homo sapiens
caggtctggcatcagctgtgtg

SEQ ID NO: 7693495 - DNA, 22 bp, Homo sapiens
caggtctgggttgatggcctgg

SEQ ID NO: 7693496 - DNA, 17 bp, Homo sapiens
caggtctgaggccaggc

SEQ ID NO: 7693497 - DNA, 17 bp, Homo sapiens
caggtctgaggccaggc

SEQ ID NO: 7693498 - DNA, 17 bp, Homo sapiens
caggtctgaggccaggc

SEQ ID NO: 7693499 - DNA, 22 bp, Homo sapiens
caggtctgcagacagggccatg

SEQ ID NO: 7693500 - DNA, 22 bp, Homo sapiens
caggtctgcagacagggccatg

SEQ ID NO: 7693501 - DNA, 22 bp, Homo sapiens
caggtctgcagacagggccatg

SEQ ID NO: 7693502 - DNA, 22 bp, Homo sapiens
caggtctggcatcagctgtgtg

SEQ ID NO: 7693503 - DNA, 22 bp, Homo sapiens
caggtctgcaggctggagtcca

SEQ ID NO: 7693504 - DNA, 22 bp, Homo sapiens
caggtctgcagacagggccatg

SEQ ID NO: 7693505 - DNA, 22 bp, Homo sapiens
caggtctgcagacagggccatg

SEQ ID NO: 7693506 - DNA, 22 bp, Homo sapiens
caggtctgcaggctggagtcca

SEQ ID NO: 7693507 - DNA, 22 bp, Homo sapiens
caggtctgcaggctggagtcca

SEQ ID NO: 7693508 - DNA, 22 bp, Homo sapiens
caggtctgcagacagggccatg

SEQ ID NO: 7693509 - DNA, 22 bp, Homo sapiens
caggtctgcagacagggccatg

SEQ ID NO: 7693510 - DNA, 22 bp, Homo sapiens
tacatgtggtagggagggcagt

SEQ ID NO: 7693511 - DNA, 22 bp, Homo sapiens
tacatgtgggttaaaaacactc

SEQ ID NO: 7693512 - DNA, 17 bp, Homo sapiens
tacatgtgtatctgatt

SEQ ID NO: 7693513 - DNA, 22 bp, Homo sapiens
tacatgtggtagggagggcagt

SEQ ID NO: 7693514 - DNA, 22 bp, Homo sapiens
tacatgttatttcactattggt

SEQ ID NO: 7693515 - DNA, 22 bp, Homo sapiens
tagttttagtcccattttacag

SEQ ID NO: 7693516 - DNA, 22 bp, Homo sapiens
tagttttagtcccattttacag

SEQ ID NO: 7693517 - DNA, 22 bp, Homo sapiens
tagttttagtcccattttacag

SEQ ID NO: 7693518 - DNA, 22 bp, Homo sapiens
tagttttagtcccattttacag

SEQ ID NO: 7693519 - DNA, 22 bp, Homo sapiens
tataagaaattgccaacctgtt

SEQ ID NO: 7693520 - DNA, 22 bp, Homo sapiens
tataagaaattgccaacctgtt

SEQ ID NO: 7693521 - DNA, 22 bp, Homo sapiens
tataagaaattgccaacctgtt

SEQ ID NO: 7693522 - DNA, 22 bp, Homo sapiens
tataagaaacaaggcaaatttt

SEQ ID NO: 7693523 - DNA, 22 bp, Homo sapiens
tataagaaacaaggcaaatttt

SEQ ID NO: 7693524 - DNA, 22 bp, Homo sapiens
tagttttataatgttaacatct

SEQ ID NO: 7693525 - DNA, 22 bp, Homo sapiens
tataagaaacaaggcaaatttt

SEQ ID NO: 7693526 - DNA, 22 bp, Homo sapiens
tagttttagtcccattttacag

SEQ ID NO: 7693527 - DNA, 22 bp, Homo sapiens
tagttttagtcccattttacag

SEQ ID NO: 7693528 - DNA, 22 bp, Homo sapiens
tataagaatgcttgtttggggt

SEQ ID NO: 7693529 - DNA, 22 bp, Homo sapiens
tataagaatgcttgtttggggt

SEQ ID NO: 7693530 - DNA, 22 bp, Homo sapiens
tataagaagtgaagaagagtta

SEQ ID NO: 7693531 - DNA, 22 bp, Homo sapiens
tataagatacttggcatagtgc

SEQ ID NO: 7693532 - DNA, 22 bp, Homo sapiens
tataagaagtgaagaagagtta

SEQ ID NO: 7693533 - DNA, 22 bp, Homo sapiens
tataagaagtgaagaagagtta

SEQ ID NO: 7693534 - DNA, 22 bp, Homo sapiens
tataagaagtgaagaagagtta

SEQ ID NO: 7693535 - DNA, 22 bp, Homo sapiens
tataagaaattgccaacctgtt

SEQ ID NO: 7693536 - DNA, 22 bp, Homo sapiens
tataagaagtgaagaagagtta

SEQ ID NO: 7693537 - DNA, 22 bp, Homo sapiens
tataagaagtgaagaagagtta

SEQ ID NO: 7693538 - DNA, 22 bp, Homo sapiens
tataagaagtgaagaagagtta

SEQ ID NO: 7693539 - DNA, 22 bp, Homo sapiens
tataatattccttgttgtaggt

SEQ ID NO: 7693540 - DNA, 22 bp, Homo sapiens
tataatattccttgttgtaggt

SEQ ID NO: 7693541 - DNA, 22 bp, Homo sapiens
tataatatgaggcaggagtgat

SEQ ID NO: 7693542 - DNA, 22 bp, Homo sapiens
tataatatgaggcaggagtgat

SEQ ID NO: 7693543 - DNA, 22 bp, Homo sapiens
tataatatgaggcaggagtgat

SEQ ID NO: 7693544 - DNA, 22 bp, Homo sapiens
tataagtgtagtttcaaatgtt

SEQ ID NO: 7693545 - DNA, 22 bp, Homo sapiens
tataagtgacagattatccaaa

SEQ ID NO: 7693546 - DNA, 22 bp, Homo sapiens
tataatatgaggcaggagtgat

SEQ ID NO: 7693547 - DNA, 22 bp, Homo sapiens
tataagtgtagtttcaaatgtt

SEQ ID NO: 7693548 - DNA, 22 bp, Homo sapiens
tataagtgtgtcagcttccaac

SEQ ID NO: 7693549 - DNA, 22 bp, Homo sapiens
tataagtctggcatatgtatgc

SEQ ID NO: 7693550 - DNA, 22 bp, Homo sapiens
tataagtgacagattatccaaa

SEQ ID NO: 7693551 - DNA, 22 bp, Homo sapiens
tataagtagttgttgaagactt

SEQ ID NO: 7693552 - DNA, 22 bp, Homo sapiens
tataagtagttgttgaagactt

SEQ ID NO: 7693553 - DNA, 22 bp, Homo sapiens
tataagcatgcttcatatggat

SEQ ID NO: 7693554 - DNA, 22 bp, Homo sapiens
tataagcacatccttgactgat

SEQ ID NO: 7693555 - DNA, 22 bp, Homo sapiens
caggggcaagaatgctgtcagc

SEQ ID NO: 7693556 - DNA, 22 bp, Homo sapiens
tataattagtaaatggcagatt

SEQ ID NO: 7693557 - DNA, 22 bp, Homo sapiens
tataattagtaaatggcagatt

SEQ ID NO: 7693558 - DNA, 22 bp, Homo sapiens
caggggcaagaatgctgtcagc

SEQ ID NO: 7693559 - DNA, 22 bp, Homo sapiens
tataattagtaaatggcagatt

SEQ ID NO: 7693560 - DNA, 22 bp, Homo sapiens
tataatgttttccatggactga

SEQ ID NO: 7693561 - DNA, 22 bp, Homo sapiens
tataattagtaaatggcagatt

SEQ ID NO: 7693562 - DNA, 22 bp, Homo sapiens
tataattagtaaatggcagatt

SEQ ID NO: 7693563 - DNA, 22 bp, Homo sapiens
tataatctggttttattaagag

SEQ ID NO: 7693564 - DNA, 22 bp, Homo sapiens
tataatattccttgttgtaggt

SEQ ID NO: 7693565 - DNA, 22 bp, Homo sapiens
tataatccattcattgatttct

SEQ ID NO: 7693566 - DNA, 22 bp, Homo sapiens
tataatattccttgttgtaggt

SEQ ID NO: 7693567 - DNA, 22 bp, Homo sapiens
tataatattccttgttgtaggt

SEQ ID NO: 7693568 - DNA, 22 bp, Homo sapiens
tataatattccttgttgtaggt

SEQ ID NO: 7693569 - DNA, 22 bp, Homo sapiens
tataatccattcattgatttct

SEQ ID NO: 7693570 - DNA, 22 bp, Homo sapiens
tataatctggttttattaagag

SEQ ID NO: 7693571 - DNA, 22 bp, Homo sapiens
tataatctggttttattaagag

SEQ ID NO: 7693572 - DNA, 22 bp, Homo sapiens
cagggtggaagctgtagagtgg

SEQ ID NO: 7693573 - DNA, 22 bp, Homo sapiens
cagggtggaagctgtagagtgg

SEQ ID NO: 7693574 - DNA, 22 bp, Homo sapiens
cagggtggaacaggcaatactt

SEQ ID NO: 7693575 - DNA, 22 bp, Homo sapiens
cagggtggaacaggcaatactt

SEQ ID NO: 7693576 - DNA, 22 bp, Homo sapiens
cagggtggaagctgtagagtgg

SEQ ID NO: 7693577 - DNA, 22 bp, Homo sapiens
cagggtggaagctgtagagtgg

SEQ ID NO: 7693578 - DNA, 22 bp, Homo sapiens
cagggtggaagctgtagagtgg

SEQ ID NO: 7693579 - DNA, 22 bp, Homo sapiens
cagggtggaacaggcaatactt

SEQ ID NO: 7693580 - DNA, 22 bp, Homo sapiens
cagggtggaaaagctagttgga

SEQ ID NO: 7693581 - DNA, 22 bp, Homo sapiens
cagggtggaacaggcaatactt

SEQ ID NO: 7693582 - DNA, 22 bp, Homo sapiens
cagggtggaacaggcaatactt

SEQ ID NO: 7693583 - DNA, 22 bp, Homo sapiens
cagggtggaacaggcaatactt

SEQ ID NO: 7693584 - DNA, 22 bp, Homo sapiens
cagggtgcttccgtggagctgt

SEQ ID NO: 7693585 - DNA, 22 bp, Homo sapiens
cagggtggaaaagctagttgga

SEQ ID NO: 7693586 - DNA, 22 bp, Homo sapiens
caggggcctgtcctggcttctg

SEQ ID NO: 7693587 - DNA, 22 bp, Homo sapiens
caggggcctggctgtctaggaa

SEQ ID NO: 7693588 - DNA, 22 bp, Homo sapiens
caggggcctggctgtctaggaa

SEQ ID NO: 7693589 - DNA, 22 bp, Homo sapiens
caggggcctggctgtctaggaa

SEQ ID NO: 7693590 - DNA, 22 bp, Homo sapiens
caggggcctggctgtctaggaa

SEQ ID NO: 7693591 - DNA, 22 bp, Homo sapiens
caggggcctggctgtctaggaa

SEQ ID NO: 7693592 - DNA, 22 bp, Homo sapiens
caggggcctggctgtctaggaa

SEQ ID NO: 7693593 - DNA, 22 bp, Homo sapiens
caggggcctggctgtctaggaa

SEQ ID NO: 7693594 - DNA, 22 bp, Homo sapiens
caggggcctggctgtctaggaa

SEQ ID NO: 7693595 - DNA, 22 bp, Homo sapiens
cagggtcttggcgccatcaccc

SEQ ID NO: 7693596 - DNA, 22 bp, Homo sapiens
cagggtcttggcgccatcaccc

SEQ ID NO: 7693597 - DNA, 22 bp, Homo sapiens
cagggtgcttccgtggagctgt

SEQ ID NO: 7693598 - DNA, 22 bp, Homo sapiens
cagggtgcttccgtggagctgt

SEQ ID NO: 7693599 - DNA, 22 bp, Homo sapiens
cagggtgcttccgtggagctgt

SEQ ID NO: 7693600 - DNA, 22 bp, Homo sapiens
caggggcctgtcctggcttctg

SEQ ID NO: 7693601 - DNA, 22 bp, Homo sapiens
caggggcagtctgtgtgcgtgg

SEQ ID NO: 7693602 - DNA, 22 bp, Homo sapiens
caggggccaagggtccagacct

SEQ ID NO: 7693603 - DNA, 22 bp, Homo sapiens
caggggccaagggtccagacct

SEQ ID NO: 7693604 - DNA, 22 bp, Homo sapiens
caggggccaagggtccagacct

SEQ ID NO: 7693605 - DNA, 22 bp, Homo sapiens
caggggcagtctgtgtgcgtgg

SEQ ID NO: 7693606 - DNA, 22 bp, Homo sapiens
caggggcagtctgtgtgcgtgg

SEQ ID NO: 7693607 - DNA, 22 bp, Homo sapiens
caggggcagtctgtgtgcgtgg

SEQ ID NO: 7693608 - DNA, 22 bp, Homo sapiens
caggggcagtctgtgtgcgtgg

SEQ ID NO: 7693609 - DNA, 22 bp, Homo sapiens
caggggcagtctgtgtgcgtgg

SEQ ID NO: 7693610 - DNA, 22 bp, Homo sapiens
caggggcagtctgtgtgcgtgg

SEQ ID NO: 7693611 - DNA, 22 bp, Homo sapiens
caggggcagtctgtgtgcgtgg

SEQ ID NO: 7693612 - DNA, 22 bp, Homo sapiens
caggggcaggtgtgagatcatc

SEQ ID NO: 7693613 - DNA, 22 bp, Homo sapiens
caggggcaggtgtgagatcatc

SEQ ID NO: 7693614 - DNA, 22 bp, Homo sapiens
caggggcaggtgtgagatcatc

SEQ ID NO: 7693615 - DNA, 22 bp, Homo sapiens
caggggcaggtgtgagatcatc

SEQ ID NO: 7693616 - DNA, 22 bp, Homo sapiens
caggggcaggtgtgagatcatc

SEQ ID NO: 7693617 - DNA, 22 bp, Homo sapiens
caggggcaggtgtgagatcatc

SEQ ID NO: 7693618 - DNA, 22 bp, Homo sapiens
caggggcaggtgtgagatcatc

SEQ ID NO: 7693619 - DNA, 22 bp, Homo sapiens
caggggcaagaatgctgtcagc

SEQ ID NO: 7693620 - DNA, 22 bp, Homo sapiens
caggggcaggtgtgagatcatc

SEQ ID NO: 7693621 - DNA, 22 bp, Homo sapiens
caggggccaggctgtctgctgt

SEQ ID NO: 7693622 - DNA, 22 bp, Homo sapiens
caggggccaggctgtctgctgt

SEQ ID NO: 7693623 - DNA, 22 bp, Homo sapiens
caggggccaggctgtctgctgt

SEQ ID NO: 7693624 - DNA, 22 bp, Homo sapiens
caggggccaggctgtctgctgt

SEQ ID NO: 7693625 - DNA, 22 bp, Homo sapiens
caggggccaagggtccagacct

SEQ ID NO: 7693626 - DNA, 22 bp, Homo sapiens
caggggccaagggtccagacct

SEQ ID NO: 7693627 - DNA, 22 bp, Homo sapiens
caggggccaagggtccagacct

SEQ ID NO: 7693628 - DNA, 22 bp, Homo sapiens
caggggccggctgtccgtgccc

SEQ ID NO: 7693629 - DNA, 22 bp, Homo sapiens
caggggccggctgtccgtgccc

SEQ ID NO: 7693630 - DNA, 22 bp, Homo sapiens
caggggccaggctgtctgctgt

SEQ ID NO: 7693631 - DNA, 22 bp, Homo sapiens
caggggccaggctgtctgctgt

SEQ ID NO: 7693632 - DNA, 22 bp, Homo sapiens
caggggccggctgtccgtgccc

SEQ ID NO: 7693633 - DNA, 22 bp, Homo sapiens
caggggccggctgtccgtgccc

SEQ ID NO: 7693634 - DNA, 22 bp, Homo sapiens
caggggcctggctgtctaggaa

SEQ ID NO: 7693635 - DNA, 22 bp, Homo sapiens
caggggccggctgtccgtgccc

SEQ ID NO: 7693636 - DNA, 22 bp, Homo sapiens
tattggagtactgcgagctgcc

SEQ ID NO: 7693637 - DNA, 22 bp, Homo sapiens
tattggagtatggggctggagt

SEQ ID NO: 7693638 - DNA, 20 bp, Homo sapiens
tattggatctaagaaatggg

SEQ ID NO: 7693639 - DNA, 22 bp, Homo sapiens
tattggatcttttattgctcag

SEQ ID NO: 7693640 - DNA, 22 bp, Homo sapiens
tattggatgaagaaaggaagga

SEQ ID NO: 7693641 - DNA, 22 bp, Homo sapiens
tattggattgagacattttaga

SEQ ID NO: 7693642 - DNA, 22 bp, Homo sapiens
tattggaaggcattagtgaata

SEQ ID NO: 7693643 - DNA, 22 bp, Homo sapiens
tattggaagtgaacaccaggct

SEQ ID NO: 7693644 - DNA, 22 bp, Homo sapiens
tattggaagtgaacaccaggct

SEQ ID NO: 7693645 - DNA, 22 bp, Homo sapiens
tattggaccacagactttaagg

SEQ ID NO: 7693646 - DNA, 22 bp, Homo sapiens
tattgggaaaagggcgatggct

SEQ ID NO: 7693647 - DNA, 22 bp, Homo sapiens
tattgggacttaaaggtaaaga

SEQ ID NO: 7693648 - DNA, 22 bp, Homo sapiens
tattgggcagacatcaggctta

SEQ ID NO: 7693649 - DNA, 22 bp, Homo sapiens
tattgggcagacatcaggctta

SEQ ID NO: 7693650 - DNA, 22 bp, Homo sapiens
tattgggtaaagatccagtttt

SEQ ID NO: 7693651 - DNA, 22 bp, Homo sapiens
tattggctgcagcttcctctgt

SEQ ID NO: 7693652 - DNA, 22 bp, Homo sapiens
tattggcttttccagacctggc

SEQ ID NO: 7693653 - DNA, 22 bp, Homo sapiens
tattggcttttccagacctggc

SEQ ID NO: 7693654 - DNA, 22 bp, Homo sapiens
tattggccgggcgcggtggctc

SEQ ID NO: 7693655 - DNA, 22 bp, Homo sapiens
tattggatttctgaaagatgag

SEQ ID NO: 7693656 - DNA, 20 bp, Homo sapiens
tatttacaacttagagcctc

SEQ ID NO: 7693657 - DNA, 20 bp, Homo sapiens
tatttacaacttagagcctc

SEQ ID NO: 7693658 - DNA, 20 bp, Homo sapiens
tatttacaacttagagcctc

SEQ ID NO: 7693659 - DNA, 23 bp, Homo sapiens
tattggctttttaaaggagtata

SEQ ID NO: 7693660 - DNA, 20 bp, Homo sapiens
tatttacaacttagagcctc

SEQ ID NO: 7693661 - DNA, 20 bp, Homo sapiens
tatttacaacttagagcctc

SEQ ID NO: 7693662 - DNA, 20 bp, Homo sapiens
tatttacaacttagagcctc

SEQ ID NO: 7693663 - DNA, 20 bp, Homo sapiens
tatttacaacttagagcctc

SEQ ID NO: 7693664 - DNA, 20 bp, Homo sapiens
tatttacaacttagagcctc

SEQ ID NO: 7693665 - DNA, 20 bp, Homo sapiens
tatttacaacttagagcctc

SEQ ID NO: 7693666 - DNA, 22 bp, Homo sapiens
tatttagatgcatttggattgc

SEQ ID NO: 7693667 - DNA, 22 bp, Homo sapiens
tatttagaggagaaaagtggct

SEQ ID NO: 7693668 - DNA, 20 bp, Homo sapiens
tatttagattcaagtatgga

SEQ ID NO: 7693669 - DNA, 20 bp, Homo sapiens
tatttagattcaagtatgga

SEQ ID NO: 7693670 - DNA, 20 bp, Homo sapiens
tatttagattcaagtatgga

SEQ ID NO: 7693671 - DNA, 22 bp, Homo sapiens
tatttagatgcatttggattgc

SEQ ID NO: 7693672 - DNA, 22 bp, Homo sapiens
tatttagatgcatttggattgc

SEQ ID NO: 7693673 - DNA, 22 bp, Homo sapiens
tatttagctggagtcagtgctt

SEQ ID NO: 7693674 - DNA, 20 bp, Homo sapiens
tatttagattcaagtatgga

SEQ ID NO: 7693675 - DNA, 20 bp, Homo sapiens
tatttagattcaagtatgga

SEQ ID NO: 7693676 - DNA, 21 bp, Homo sapiens
tatttagttttacaaatgtgg

SEQ ID NO: 7693677 - DNA, 21 bp, Homo sapiens
tatttagttttacaaatgtgg

SEQ ID NO: 7693678 - DNA, 22 bp, Homo sapiens
tatttagttatctttcataaaa

SEQ ID NO: 7693679 - DNA, 22 bp, Homo sapiens
tatttagttatctttcataaaa

SEQ ID NO: 7693680 - DNA, 22 bp, Homo sapiens
tatttagtgatagaagcaagga

SEQ ID NO: 7693681 - DNA, 20 bp, Homo sapiens
tatttagattcaagtatgga

SEQ ID NO: 7693682 - DNA, 22 bp, Homo sapiens
tatttagttatctttcataaaa

SEQ ID NO: 7693683 - DNA, 22 bp, Homo sapiens
tatttagtgatagaagcaagga

SEQ ID NO: 7693684 - DNA, 19 bp, Homo sapiens
tatttacttcttgattgca

SEQ ID NO: 7693685 - DNA, 19 bp, Homo sapiens
tatttacttcttgattgca

SEQ ID NO: 7693686 - DNA, 22 bp, Homo sapiens
tatttacttttaaattgagaac

SEQ ID NO: 7693687 - DNA, 19 bp, Homo sapiens
tatttacttcttgattgca

SEQ ID NO: 7693688 - DNA, 19 bp, Homo sapiens
tatttacttcttgattgca

SEQ ID NO: 7693689 - DNA, 19 bp, Homo sapiens
tatttacttcttgattgca

SEQ ID NO: 7693690 - DNA, 22 bp, Homo sapiens
tatttactgtatttgaagttga

SEQ ID NO: 7693691 - DNA, 22 bp, Homo sapiens
tatttactgtatttgaagttga

SEQ ID NO: 7693692 - DNA, 20 bp, Homo sapiens
tatttacaacttagagcctc

SEQ ID NO: 7693693 - DNA, 22 bp, Homo sapiens
tatttacttttaaattgagaac

SEQ ID NO: 7693694 - DNA, 22 bp, Homo sapiens
tatttacttttaaattgagaac

SEQ ID NO: 7693695 - DNA, 22 bp, Homo sapiens
tatttacttttaaattgagaac

SEQ ID NO: 7693696 - DNA, 22 bp, Homo sapiens
tatttacttttaaattgagaac

SEQ ID NO: 7693697 - DNA, 22 bp, Homo sapiens
tatttagaacagacaatagaaa

SEQ ID NO: 7693698 - DNA, 22 bp, Homo sapiens
tatttagaacagacaatagaaa

SEQ ID NO: 7693699 - DNA, 22 bp, Homo sapiens
tatttagaacagacaatagaaa

SEQ ID NO: 7693700 - DNA, 22 bp, Homo sapiens
tatttagaatgcgtgtacgtgt

SEQ ID NO: 7693701 - DNA, 22 bp, Homo sapiens
tatttagaacagacaatagaaa

SEQ ID NO: 7693702 - DNA, 22 bp, Homo sapiens
cagtcctggggaccaggctgag

SEQ ID NO: 7693703 - DNA, 22 bp, Homo sapiens
cagtcctgggcaggtcaggcca

SEQ ID NO: 7693704 - DNA, 22 bp, Homo sapiens
cagtcctggggaccaggctgag

SEQ ID NO: 7693705 - DNA, 22 bp, Homo sapiens
cagtcctgggcaggtcaggcca

SEQ ID NO: 7693706 - DNA, 22 bp, Homo sapiens
cagtcctgggcaggtcaggcca

SEQ ID NO: 7693707 - DNA, 22 bp, Homo sapiens
cagtcctgggcacagccctggg

SEQ ID NO: 7693708 - DNA, 22 bp, Homo sapiens
cagtcctgggcaggtcaggcca

SEQ ID NO: 7693709 - DNA, 22 bp, Homo sapiens
cagtcctgggcacagccctggg

SEQ ID NO: 7693710 - DNA, 22 bp, Homo sapiens
cagtcctgggcacagccctggg

SEQ ID NO: 7693711 - DNA, 22 bp, Homo sapiens
cagtcctgggcacagccctggg

SEQ ID NO: 7693712 - DNA, 22 bp, Homo sapiens
cagtcctctctgtgtctgcacc

SEQ ID NO: 7693713 - DNA, 22 bp, Homo sapiens
cagtcctctgcaacaccccttc

SEQ ID NO: 7693714 - DNA, 22 bp, Homo sapiens
cagtcctgggcacagccctggg

SEQ ID NO: 7693715 - DNA, 22 bp, Homo sapiens
cagtcctctctgtgtctgcacc

SEQ ID NO: 7693716 - DNA, 22 bp, Homo sapiens
cagtcctctcactcaggccttt

SEQ ID NO: 7693717 - DNA, 20 bp, Homo sapiens
cagtcctgtccctgctgccc

SEQ ID NO: 7693718 - DNA, 20 bp, Homo sapiens
cagtcctgtccctgctgccc

SEQ ID NO: 7693719 - DNA, 20 bp, Homo sapiens
cagtcctgtccctgctgccc

SEQ ID NO: 7693720 - DNA, 22 bp, Homo sapiens
cagtcctgggtgcagcaggaaa

SEQ ID NO: 7693721 - DNA, 22 bp, Homo sapiens
cagtcctgggtgcagcaggaaa

SEQ ID NO: 7693722 - DNA, 22 bp, Homo sapiens
cagtcctgggtgcagcaggaaa

SEQ ID NO: 7693723 - DNA, 22 bp, Homo sapiens
cagtcctgggtgcagcaggaaa

SEQ ID NO: 7693724 - DNA, 22 bp, Homo sapiens
cagtcctgggtgcagcaggaaa

SEQ ID NO: 7693725 - DNA, 22 bp, Homo sapiens
cagtcctgggtgcagcaggaaa

SEQ ID NO: 7693726 - DNA, 22 bp, Homo sapiens
cagtcctggggaccaggctgag

SEQ ID NO: 7693727 - DNA, 22 bp, Homo sapiens
cagtcctggggaccaggctgag

SEQ ID NO: 7693728 - DNA, 22 bp, Homo sapiens
cagtcctggggaccaggctgag

SEQ ID NO: 7693729 - DNA, 22 bp, Homo sapiens
cagtcctggggaccaggctgag

SEQ ID NO: 7693730 - DNA, 22 bp, Homo sapiens
cagtcctggggaccaggctgag

SEQ ID NO: 7693731 - DNA, 22 bp, Homo sapiens
cagtcctggggaccaggctgag

SEQ ID NO: 7693732 - DNA, 22 bp, Homo sapiens
cagtcctgtgtcccttggtggg

SEQ ID NO: 7693733 - DNA, 22 bp, Homo sapiens
cagtcctgtgtcccttggtggg

SEQ ID NO: 7693734 - DNA, 22 bp, Homo sapiens
cagtcctgtgtcccttggtggg

SEQ ID NO: 7693735 - DNA, 22 bp, Homo sapiens
cagtcctgtctttatgacttca

SEQ ID NO: 7693736 - DNA, 22 bp, Homo sapiens
cagtcctgtgtcccttggtggg

SEQ ID NO: 7693737 - DNA, 22 bp, Homo sapiens
cagtcctgtgttaaacaagagc

SEQ ID NO: 7693738 - DNA, 22 bp, Homo sapiens
cagtcctgtgtcccttggtggg

SEQ ID NO: 7693739 - DNA, 22 bp, Homo sapiens
cagtcctgtgtcccttggtggg

SEQ ID NO: 7693740 - DNA, 22 bp, Homo sapiens
cagtcctgttcctggagtagtt

SEQ ID NO: 7693741 - DNA, 22 bp, Homo sapiens
cagtcctgttcctggagtagtt

SEQ ID NO: 7693742 - DNA, 18 bp, Homo sapiens
cagtcctgtttctacagg

SEQ ID NO: 7693743 - DNA, 22 bp, Homo sapiens
cagtcctgttcctggagtagtt

SEQ ID NO: 7693744 - DNA, 22 bp, Homo sapiens
cagtcctgtgttaaacaagagc

SEQ ID NO: 7693745 - DNA, 22 bp, Homo sapiens
cagtcctgttcctggagtagtt

SEQ ID NO: 7693746 - DNA, 22 bp, Homo sapiens
cagtcctgttcctggagtagtt

SEQ ID NO: 7693747 - DNA, 22 bp, Homo sapiens
cagtccttaaggaaacatttgt

SEQ ID NO: 7693748 - DNA, 22 bp, Homo sapiens
cagtccttaaggaaacatttgt

SEQ ID NO: 7693749 - DNA, 22 bp, Homo sapiens
cagtccttaaggaaacatttgt

SEQ ID NO: 7693750 - DNA, 18 bp, Homo sapiens
cagtcctgtttctacagg

SEQ ID NO: 7693751 - DNA, 22 bp, Homo sapiens
cagtccttagattttactgcca

SEQ ID NO: 7693752 - DNA, 22 bp, Homo sapiens
cagtccttagattttactgcca

SEQ ID NO: 7693753 - DNA, 22 bp, Homo sapiens
cagtccttggcttcatccgagt

SEQ ID NO: 7693754 - DNA, 22 bp, Homo sapiens
cagtccttggcaagttctcagt

SEQ ID NO: 7693755 - DNA, 22 bp, Homo sapiens
cagtccttggcaagttctcagt

SEQ ID NO: 7693756 - DNA, 22 bp, Homo sapiens
cagtccttggcaagttctcagt

SEQ ID NO: 7693757 - DNA, 22 bp, Homo sapiens
cagtccttgctatgaccctgag

SEQ ID NO: 7693758 - DNA, 22 bp, Homo sapiens
cagtccttgatccaatagtggg

SEQ ID NO: 7693759 - DNA, 22 bp, Homo sapiens
cagtccttccttgccccttggg

SEQ ID NO: 7693760 - DNA, 22 bp, Homo sapiens
cagtccttagtctggatggctt

SEQ ID NO: 7693761 - DNA, 22 bp, Homo sapiens
cagtccttagtctggatggctt

SEQ ID NO: 7693762 - DNA, 22 bp, Homo sapiens
cagtccttattcctatattcct

SEQ ID NO: 7693763 - DNA, 22 bp, Homo sapiens
cagtccttattcctatattcct

SEQ ID NO: 7693764 - DNA, 22 bp, Homo sapiens
cagtccttattcctatattcct

SEQ ID NO: 7693765 - DNA, 22 bp, Homo sapiens
cagtgcaacttttgcctcccgg

SEQ ID NO: 7693766 - DNA, 22 bp, Homo sapiens
cagtgcaacttttgcctcccgg

SEQ ID NO: 7693767 - DNA, 22 bp, Homo sapiens
cagtgcaacttttgcctcccgg

SEQ ID NO: 7693768 - DNA, 20 bp, Homo sapiens
cagtgcaactgaagaactga

SEQ ID NO: 7693769 - DNA, 20 bp, Homo sapiens
cagtgcaactgaagaactga

SEQ ID NO: 7693770 - DNA, 22 bp, Homo sapiens
cagtgcaatattcaaagtggag

SEQ ID NO: 7693771 - DNA, 22 bp, Homo sapiens
cagtgcaatattcaaagtggag

SEQ ID NO: 7693772 - DNA, 22 bp, Homo sapiens
cagtgcaatattcaaagtggag

SEQ ID NO: 7693773 - DNA, 22 bp, Homo sapiens
cagtgcaagtgactgatcaagg

SEQ ID NO: 7693774 - DNA, 22 bp, Homo sapiens
cagtgcaagtgactgatcaagg

SEQ ID NO: 7693775 - DNA, 22 bp, Homo sapiens
cagtgcaagggtgctgggggca

SEQ ID NO: 7693776 - DNA, 22 bp, Homo sapiens
cagtgcaagctgatactgaggt

SEQ ID NO: 7693777 - DNA, 22 bp, Homo sapiens
cagtgcaagctgatactgaggt

SEQ ID NO: 7693778 - DNA, 22 bp, Homo sapiens
cagtgcaatgcagatgacacca

SEQ ID NO: 7693779 - DNA, 22 bp, Homo sapiens
cagtgcaatgcagatgacacca

SEQ ID NO: 7693780 - DNA, 22 bp, Homo sapiens
cagtgcaatgttaaataggaaa

SEQ ID NO: 7693781 - DNA, 22 bp, Homo sapiens
cagtgcaatgttaaataggaaa

SEQ ID NO: 7693782 - DNA, 22 bp, Homo sapiens
cagtgcaattacaagctaattc

SEQ ID NO: 7693783 - DNA, 22 bp, Homo sapiens
cagtgcaattacaagctaattc

SEQ ID NO: 7693784 - DNA, 22 bp, Homo sapiens
cagtgcaatgttaaataggaaa

SEQ ID NO: 7693785 - DNA, 22 bp, Homo sapiens
cagtgcaatgcagatgacacca

SEQ ID NO: 7693786 - DNA, 22 bp, Homo sapiens
cagtgcaatgcagatgacacca

SEQ ID NO: 7693787 - DNA, 22 bp, Homo sapiens
cagtgcaattagaacttattta

SEQ ID NO: 7693788 - DNA, 22 bp, Homo sapiens
cagtgcaattacaagctaattc

SEQ ID NO: 7693789 - DNA, 22 bp, Homo sapiens
cagtgcaattacaagctaattc

SEQ ID NO: 7693790 - DNA, 21 bp, Homo sapiens
cagtgcaattgattttttaga

SEQ ID NO: 7693791 - DNA, 22 bp, Homo sapiens
cagtgcaattagaacttattta

SEQ ID NO: 7693792 - DNA, 21 bp, Homo sapiens
cagtgcaattgattttttaga

SEQ ID NO: 7693793 - DNA, 22 bp, Homo sapiens
cagtgcaattagaacttattta

SEQ ID NO: 7693794 - DNA, 22 bp, Homo sapiens
cagtgcagacgtggagggggca

SEQ ID NO: 7693795 - DNA, 22 bp, Homo sapiens
cagtgcagacgtggagggggca

SEQ ID NO: 7693796 - DNA, 17 bp, Homo sapiens
cagtgcagagccctttc

SEQ ID NO: 7693797 - DNA, 22 bp, Homo sapiens
cagtgcagaggccagggaggat

SEQ ID NO: 7693798 - DNA, 17 bp, Homo sapiens
cagtgcagagccctttc

SEQ ID NO: 7693799 - DNA, 22 bp, Homo sapiens
cagtgcagacgtggagggggca

SEQ ID NO: 7693800 - DNA, 22 bp, Homo sapiens
cagtgcagacgtggagggggca

SEQ ID NO: 7693801 - DNA, 22 bp, Homo sapiens
cagtgcagaacacatggaaaat

SEQ ID NO: 7693802 - DNA, 22 bp, Homo sapiens
cagtgcacacaatcctctgccg

SEQ ID NO: 7693803 - DNA, 22 bp, Homo sapiens
cagtgcagaacacatggaaaat

SEQ ID NO: 7693804 - DNA, 22 bp, Homo sapiens
cagtgcagaacacatggaaaat

SEQ ID NO: 7693805 - DNA, 22 bp, Homo sapiens
cagtgcacacaatcctctgccg

SEQ ID NO: 7693806 - DNA, 22 bp, Homo sapiens
cagtgcacacaatcctctgccg

SEQ ID NO: 7693807 - DNA, 21 bp, Homo sapiens
cagtgcaattgattttttaga

SEQ ID NO: 7693808 - DNA, 22 bp, Homo sapiens
cagtgcacgggccagtcctgcc

SEQ ID NO: 7693809 - DNA, 22 bp, Homo sapiens
cagtgcacgggccagtcctgcc

SEQ ID NO: 7693810 - DNA, 22 bp, Homo sapiens
cagtgcacgggccagtcctgcc

SEQ ID NO: 7693811 - DNA, 22 bp, Homo sapiens
cagtgattaaaacatgacagcc

SEQ ID NO: 7693812 - DNA, 22 bp, Homo sapiens
cagtgattaaaacatgacagcc

SEQ ID NO: 7693813 - DNA, 22 bp, Homo sapiens
cagtgatgtttctgcatcagag

SEQ ID NO: 7693814 - DNA, 22 bp, Homo sapiens
cagtgatggatatggagaagtc

SEQ ID NO: 7693815 - DNA, 22 bp, Homo sapiens
cagtgatgtttctgcatcagag

SEQ ID NO: 7693816 - DNA, 22 bp, Homo sapiens
cagtgatgatcattgtaacatc

SEQ ID NO: 7693817 - DNA, 22 bp, Homo sapiens
cagtgatcgcactcaacagttt

SEQ ID NO: 7693818 - DNA, 17 bp, Homo sapiens
cagtgatcattacatta

SEQ ID NO: 7693819 - DNA, 22 bp, Homo sapiens
cagtgatgaatgaaccacaggt

SEQ ID NO: 7693820 - DNA, 22 bp, Homo sapiens
cagtgatgaatgaaccacaggt

SEQ ID NO: 7693821 - DNA, 22 bp, Homo sapiens
cagtgatggatatggagaagtc

SEQ ID NO: 7693822 - DNA, 22 bp, Homo sapiens
cagtgatgatcattgtaacatc

SEQ ID NO: 7693823 - DNA, 22 bp, Homo sapiens
cagtgatgatcattgtaacatc

SEQ ID NO: 7693824 - DNA, 22 bp, Homo sapiens
cagtgattcagactcatcattt

SEQ ID NO: 7693825 - DNA, 22 bp, Homo sapiens
cagtgattcagactcatcattt

SEQ ID NO: 7693826 - DNA, 22 bp, Homo sapiens
cagtgattcacgcccttgggcc

SEQ ID NO: 7693827 - DNA, 22 bp, Homo sapiens
cagtgattattgattgcattca

SEQ ID NO: 7693828 - DNA, 22 bp, Homo sapiens
cagtgattactgtgcttttggt

SEQ ID NO: 7693829 - DNA, 22 bp, Homo sapiens
cagtgattaagatacccaggct

SEQ ID NO: 7693830 - DNA, 19 bp, Homo sapiens
cagtgattaattcatctta

SEQ ID NO: 7693831 - DNA, 19 bp, Homo sapiens
cagtgattaattcatctta

SEQ ID NO: 7693832 - DNA, 22 bp, Homo sapiens
cagtgattaaaacatgacagcc

SEQ ID NO: 7693833 - DNA, 22 bp, Homo sapiens
cagtgatttttacagtaaggaa

SEQ ID NO: 7693834 - DNA, 22 bp, Homo sapiens
cagtgatttttacagtaaggaa

SEQ ID NO: 7693835 - DNA, 22 bp, Homo sapiens
cagtgcaaactccctgaggtgg

SEQ ID NO: 7693836 - DNA, 22 bp, Homo sapiens
cagtgcaacagattcgagaagc

SEQ ID NO: 7693837 - DNA, 22 bp, Homo sapiens
cagtgcaaactccctgaggtgg

SEQ ID NO: 7693838 - DNA, 22 bp, Homo sapiens
cagtgcaaactccctgaggtgg

SEQ ID NO: 7693839 - DNA, 22 bp, Homo sapiens
cagtgcaaactccctgaggtgg

SEQ ID NO: 7693840 - DNA, 22 bp, Homo sapiens
cagtgcaacgttgtgcattcaa

SEQ ID NO: 7693841 - DNA, 20 bp, Homo sapiens
cagtgcaactgaagaactga

SEQ ID NO: 7693842 - DNA, 20 bp, Homo sapiens
cagtgcaactgaagaactga

SEQ ID NO: 7693843 - DNA, 22 bp, Homo sapiens
cagtgcaacgttgtgcattcaa

SEQ ID NO: 7693844 - DNA, 22 bp, Homo sapiens
cagtgcaacgttgtgcattcaa

SEQ ID NO: 7693845 - DNA, 22 bp, Homo sapiens
cagtgcaacagattcgagaagc

SEQ ID NO: 7693846 - DNA, 22 bp, Homo sapiens
cagtgcaacgttgtgcattcaa

SEQ ID NO: 7693847 - DNA, 22 bp, Homo sapiens
cagtgatttcagaatggattat

SEQ ID NO: 7693848 - DNA, 22 bp, Homo sapiens
cagtgattgtactgttgtgcct

SEQ ID NO: 7693849 - DNA, 22 bp, Homo sapiens
cagtgattcaggtgcctgttgg

SEQ ID NO: 7693850 - DNA, 22 bp, Homo sapiens
cagtgattcagactcatcattt

SEQ ID NO: 7693851 - DNA, 22 bp, Homo sapiens
cagtgattcagactcatcattt

SEQ ID NO: 7693852 - DNA, 22 bp, Homo sapiens
cagtgattcaggtctccagttt

SEQ ID NO: 7693853 - DNA, 22 bp, Homo sapiens
cagtgattttggtctgccttag

SEQ ID NO: 7693854 - DNA, 22 bp, Homo sapiens
cagtgattttctcagaacttga

SEQ ID NO: 7693855 - DNA, 22 bp, Homo sapiens
cagtgattttaaactatggatg

SEQ ID NO: 7693856 - DNA, 22 bp, Homo sapiens
cagtctcagaggtgggagtggg

SEQ ID NO: 7693857 - DNA, 22 bp, Homo sapiens
cagtctcaccctggaggcccca

SEQ ID NO: 7693858 - DNA, 22 bp, Homo sapiens
cagtctcaccctggaggcccca

SEQ ID NO: 7693859 - DNA, 22 bp, Homo sapiens
cagtctcaccctggaggcccca

SEQ ID NO: 7693860 - DNA, 22 bp, Homo sapiens
cagtctacctttcagacattga

SEQ ID NO: 7693861 - DNA, 18 bp, Homo sapiens
cagtctaattcccttccc

SEQ ID NO: 7693862 - DNA, 22 bp, Homo sapiens
cagtctacctttcagacattga

SEQ ID NO: 7693863 - DNA, 22 bp, Homo sapiens
cagtctaatctgttactcatta

SEQ ID NO: 7693864 - DNA, 18 bp, Homo sapiens
cagtctaattcccttccc

SEQ ID NO: 7693865 - DNA, 22 bp, Homo sapiens
cagtcctttctgaaatcctata

SEQ ID NO: 7693866 - DNA, 22 bp, Homo sapiens
cagtctaagactcacgccaaga

SEQ ID NO: 7693867 - DNA, 22 bp, Homo sapiens
cagtctaagttaatttccacaa

SEQ ID NO: 7693868 - DNA, 17 bp, Homo sapiens
cagtcgaggaggacctg

SEQ ID NO: 7693869 - DNA, 22 bp, Homo sapiens
cagtctaacttcacagcctgga

SEQ ID NO: 7693870 - DNA, 22 bp, Homo sapiens
cagtctccgccagctcctcaca

SEQ ID NO: 7693871 - DNA, 22 bp, Homo sapiens
cagtctccgccagctcctcaca

SEQ ID NO: 7693872 - DNA, 22 bp, Homo sapiens
cagtctccgccagctcctcaca

SEQ ID NO: 7693873 - DNA, 22 bp, Homo sapiens
cagtctccaaatcagtctgaat

SEQ ID NO: 7693874 - DNA, 22 bp, Homo sapiens
cagtctccaaatcagtctgaat

SEQ ID NO: 7693875 - DNA, 22 bp, Homo sapiens
cagtctccaaatcaatctgaat

SEQ ID NO: 7693876 - DNA, 22 bp, Homo sapiens
cagtctccaaatcaatctgaat

SEQ ID NO: 7693877 - DNA, 22 bp, Homo sapiens
cagtctcatagttgtttcttat

SEQ ID NO: 7693878 - DNA, 22 bp, Homo sapiens
cagtctcagaggtgggagtggg

SEQ ID NO: 7693879 - DNA, 22 bp, Homo sapiens
cagtctcctgggggctgttgtt

SEQ ID NO: 7693880 - DNA, 22 bp, Homo sapiens
cagtctcctgggggctgttgtt

SEQ ID NO: 7693881 - DNA, 22 bp, Homo sapiens
cagtctccgccagctcctcaca

SEQ ID NO: 7693882 - DNA, 20 bp, Homo sapiens
cagtgaggaggtgctggggg

SEQ ID NO: 7693883 - DNA, 20 bp, Homo sapiens
cagtgaggaggtgctggggg

SEQ ID NO: 7693884 - DNA, 20 bp, Homo sapiens
cagtgaggaggtgctggggg

SEQ ID NO: 7693885 - DNA, 20 bp, Homo sapiens
cagtgaggaggtgctggggg

SEQ ID NO: 7693886 - DNA, 20 bp, Homo sapiens
cagtgaggaggtgctggggg

SEQ ID NO: 7693887 - DNA, 20 bp, Homo sapiens
cagtgaggaggtgctggggg

SEQ ID NO: 7693888 - DNA, 22 bp, Homo sapiens
cagtgaggtagacagctttttc

SEQ ID NO: 7693889 - DNA, 22 bp, Homo sapiens
cagtgaggtagacagctttttc

SEQ ID NO: 7693890 - DNA, 21 bp, Homo sapiens
cagtgaggtccccagcctagg

SEQ ID NO: 7693891 - DNA, 21 bp, Homo sapiens
cagtgaggtccccagcctagg

SEQ ID NO: 7693892 - DNA, 22 bp, Homo sapiens
cagtgagggcccccttccaggt

SEQ ID NO: 7693893 - DNA, 22 bp, Homo sapiens
cagtgagggcccccttccaggt

SEQ ID NO: 7693894 - DNA, 22 bp, Homo sapiens
cagtgagggcccccttccaggt

SEQ ID NO: 7693895 - DNA, 20 bp, Homo sapiens
cagtgaggaggtgctggggg

SEQ ID NO: 7693896 - DNA, 20 bp, Homo sapiens
cagtgaggaggtgctggggg

SEQ ID NO: 7693897 - DNA, 22 bp, Homo sapiens
cagtgaggtggatggatggcct

SEQ ID NO: 7693898 - DNA, 22 bp, Homo sapiens
cagtgaggtgcccagcctgccc

SEQ ID NO: 7693899 - DNA, 22 bp, Homo sapiens
cagtgaggtggagtagttccca

SEQ ID NO: 7693900 - DNA, 22 bp, Homo sapiens
cagtgaggtgcccagcctgccc

SEQ ID NO: 7693901 - DNA, 21 bp, Homo sapiens
cagtgaggtccccagcctagg

SEQ ID NO: 7693902 - DNA, 21 bp, Homo sapiens
cagtgaggtccccagcctagg

SEQ ID NO: 7693903 - DNA, 22 bp, Homo sapiens
cagtgaggtgcccagcctgccc

SEQ ID NO: 7693904 - DNA, 22 bp, Homo sapiens
cagtgaggtgcccagcctgccc

SEQ ID NO: 7693905 - DNA, 22 bp, Homo sapiens
cagtgaggtgcccagcctgccc

SEQ ID NO: 7693906 - DNA, 22 bp, Homo sapiens
cagtgaggtgcccagcctgccc

SEQ ID NO: 7693907 - DNA, 22 bp, Homo sapiens
cagtgaggtgcccagcctgccc

SEQ ID NO: 7693908 - DNA, 22 bp, Homo sapiens
cagtgaggtggatggatggcct

SEQ ID NO: 7693909 - DNA, 22 bp, Homo sapiens
cagtgaggtggatggatggcct

SEQ ID NO: 7693910 - DNA, 22 bp, Homo sapiens
cagtgaggtggatggatggcct

SEQ ID NO: 7693911 - DNA, 22 bp, Homo sapiens
cagtgaggtggatggatggcct

SEQ ID NO: 7693912 - DNA, 22 bp, Homo sapiens
cagtgaggtggatggatggcct

SEQ ID NO: 7693913 - DNA, 22 bp, Homo sapiens
cagtgaggtggatggatggcct

SEQ ID NO: 7693914 - DNA, 22 bp, Homo sapiens
cagtgaggtggatggatggcct

SEQ ID NO: 7693915 - DNA, 22 bp, Homo sapiens
cagtgagtccaagatggctgaa

SEQ ID NO: 7693916 - DNA, 22 bp, Homo sapiens
cagtgagtaagtagacagctta

SEQ ID NO: 7693917 - DNA, 22 bp, Homo sapiens
cagtgaggtggatggatggcct

SEQ ID NO: 7693918 - DNA, 22 bp, Homo sapiens
cagtgagtaagtagacagctta

SEQ ID NO: 7693919 - DNA, 22 bp, Homo sapiens
cagtgagtaagtagacagctta

SEQ ID NO: 7693920 - DNA, 17 bp, Homo sapiens
cagtgatcattacatta

SEQ ID NO: 7693921 - DNA, 17 bp, Homo sapiens
cagtgatcattacatta

SEQ ID NO: 7693922 - DNA, 22 bp, Homo sapiens
cagtgatatttatcctactcac

SEQ ID NO: 7693923 - DNA, 22 bp, Homo sapiens
cagtgataggacagctagaact

SEQ ID NO: 7693924 - DNA, 22 bp, Homo sapiens
cagtgatatttatcctactcac

SEQ ID NO: 7693925 - DNA, 22 bp, Homo sapiens
cagtgagtccaagatggctgaa

SEQ ID NO: 7693926 - DNA, 22 bp, Homo sapiens
cagtgagtccaagatggctgaa

SEQ ID NO: 7693927 - DNA, 22 bp, Homo sapiens
cagtgagttgtgctgaggacca

SEQ ID NO: 7693928 - DNA, 22 bp, Homo sapiens
cagtgagtgtgggaagtctctg

SEQ ID NO: 7693929 - DNA, 22 bp, Homo sapiens
cagtgagttcatcaagacatga

SEQ ID NO: 7693930 - DNA, 22 bp, Homo sapiens
tcactcagagatagcctcattt

SEQ ID NO: 7693931 - DNA, 22 bp, Homo sapiens
tcactcagagatagcctcattt

SEQ ID NO: 7693932 - DNA, 22 bp, Homo sapiens
tcactcaatggtatcaggaggt

SEQ ID NO: 7693933 - DNA, 22 bp, Homo sapiens
tcactcagctagcttcaggagc

SEQ ID NO: 7693934 - DNA, 22 bp, Homo sapiens
tcactcagcattcactgggcct

SEQ ID NO: 7693935 - DNA, 22 bp, Homo sapiens
tcactcagcctgcctggttcct

SEQ ID NO: 7693936 - DNA, 22 bp, Homo sapiens
tcactcaatatcccagtggggc

SEQ ID NO: 7693937 - DNA, 22 bp, Homo sapiens
tcactataatatgtcaaaatac

SEQ ID NO: 7693938 - DNA, 22 bp, Homo sapiens
tcacccagcagctgcttctgct

SEQ ID NO: 7693939 - DNA, 22 bp, Homo sapiens
tcacccagcagctgcttctgct

SEQ ID NO: 7693940 - DNA, 22 bp, Homo sapiens
tcactcaagcatctacagggat

SEQ ID NO: 7693941 - DNA, 22 bp, Homo sapiens
tcacccagcagctgcttctgct

SEQ ID NO: 7693942 - DNA, 22 bp, Homo sapiens
tcacccagattacatcctgtca

SEQ ID NO: 7693943 - DNA, 22 bp, Homo sapiens
tcacccagatagtgagcatagt

SEQ ID NO: 7693944 - DNA, 22 bp, Homo sapiens
tcacccagattacatcctgtca

SEQ ID NO: 7693945 - DNA, 22 bp, Homo sapiens
tcacccagatagtgagcatagt

SEQ ID NO: 7693946 - DNA, 22 bp, Homo sapiens
tcacccagatagtgagcatagt

SEQ ID NO: 7693947 - DNA, 22 bp, Homo sapiens
tcacccagatagtgagcatagt

SEQ ID NO: 7693948 - DNA, 22 bp, Homo sapiens
tcacccagacttgtgaatgtgt

SEQ ID NO: 7693949 - DNA, 22 bp, Homo sapiens
tcacccagacttgtgaatgtgt

SEQ ID NO: 7693950 - DNA, 22 bp, Homo sapiens
tcacccagacttgtgaatgtgt

SEQ ID NO: 7693951 - DNA, 22 bp, Homo sapiens
tcacccaagaccatcggaagtg

SEQ ID NO: 7693952 - DNA, 22 bp, Homo sapiens
tcacccagaaaagacagcagat

SEQ ID NO: 7693953 - DNA, 22 bp, Homo sapiens
tcacccagacagcttgcactga

SEQ ID NO: 7693954 - DNA, 22 bp, Homo sapiens
tcacccagacagcttgcactga

SEQ ID NO: 7693955 - DNA, 22 bp, Homo sapiens
tcacccagacagcttgcactga

SEQ ID NO: 7693956 - DNA, 22 bp, Homo sapiens
tcaccagtctttcttaccattg

SEQ ID NO: 7693957 - DNA, 22 bp, Homo sapiens
tcacccagactgtctgactctt

SEQ ID NO: 7693958 - DNA, 22 bp, Homo sapiens
tcacccagactgtctgactctt

SEQ ID NO: 7693959 - DNA, 22 bp, Homo sapiens
tcacccagactgtctgactctt

SEQ ID NO: 7693960 - DNA, 22 bp, Homo sapiens
tcacccagacagcttgcactga

SEQ ID NO: 7693961 - DNA, 22 bp, Homo sapiens
tcacccagactgtctgactctt

SEQ ID NO: 7693962 - DNA, 22 bp, Homo sapiens
tcacccagacagcttgcactga

SEQ ID NO: 7693963 - DNA, 22 bp, Homo sapiens
tcactcctcaggctagcatcat

SEQ ID NO: 7693964 - DNA, 22 bp, Homo sapiens
tcactccatctttgctactggt

SEQ ID NO: 7693965 - DNA, 22 bp, Homo sapiens
tcactcctcaggctagcatcat

SEQ ID NO: 7693966 - DNA, 22 bp, Homo sapiens
tcactccatctttgctactggt

SEQ ID NO: 7693967 - DNA, 22 bp, Homo sapiens
tcactccatctttgctactggt

SEQ ID NO: 7693968 - DNA, 22 bp, Homo sapiens
tcactcctcattgctgcccatt

SEQ ID NO: 7693969 - DNA, 22 bp, Homo sapiens
tcacttcccagacggggtggca

SEQ ID NO: 7693970 - DNA, 22 bp, Homo sapiens
tcacttcccagacggggtggca

SEQ ID NO: 7693971 - DNA, 22 bp, Homo sapiens
tcacttcccagacggggtggca

SEQ ID NO: 7693972 - DNA, 22 bp, Homo sapiens
tcacttcccagacggggtggca

SEQ ID NO: 7693973 - DNA, 22 bp, Homo sapiens
tcacttccctcttcagctccca

SEQ ID NO: 7693974 - DNA, 22 bp, Homo sapiens
tcacttcgtaaacccctcccat

SEQ ID NO: 7693975 - DNA, 22 bp, Homo sapiens
tcacttcccagacggggtggca

SEQ ID NO: 7693976 - DNA, 22 bp, Homo sapiens
tcagaaaggttgagtcatgtgc

SEQ ID NO: 7693977 - DNA, 22 bp, Homo sapiens
tcagaaagtgaactgttgacat

SEQ ID NO: 7693978 - DNA, 22 bp, Homo sapiens
tcagaaagtgaactgttgacat

SEQ ID NO: 7693979 - DNA, 22 bp, Homo sapiens
tcagaaagtgaactgttgacat

SEQ ID NO: 7693980 - DNA, 22 bp, Homo sapiens
tcactcagtttttggcctctgc

SEQ ID NO: 7693981 - DNA, 22 bp, Homo sapiens
tcactcagtttttggcctctgc

SEQ ID NO: 7693982 - DNA, 22 bp, Homo sapiens
tcactcaggttcatgtctttgt

SEQ ID NO: 7693983 - DNA, 22 bp, Homo sapiens
tcactcaggttcatgtctttgt

SEQ ID NO: 7693984 - DNA, 22 bp, Homo sapiens
tcactcaggttcatgtctttgt

SEQ ID NO: 7693985 - DNA, 22 bp, Homo sapiens
tcactcaggctggagtgcagtg

SEQ ID NO: 7693986 - DNA, 22 bp, Homo sapiens
tcactcaggctggagtgcagtg

SEQ ID NO: 7693987 - DNA, 22 bp, Homo sapiens
tcactcaggctggagtgcagtg

SEQ ID NO: 7693988 - DNA, 22 bp, Homo sapiens
tcactcaggctggagtgcagtg

SEQ ID NO: 7693989 - DNA, 22 bp, Homo sapiens
tcactccaaaccccaggcttgt

SEQ ID NO: 7693990 - DNA, 18 bp, Homo sapiens
tcactcatagacatctat

SEQ ID NO: 7693991 - DNA, 18 bp, Homo sapiens
tcactcatagacatctat

SEQ ID NO: 7693992 - DNA, 22 bp, Homo sapiens
tcactccatagcttaactcttt

SEQ ID NO: 7693993 - DNA, 22 bp, Homo sapiens
tcactccatagcttaactcttt

SEQ ID NO: 7693994 - DNA, 22 bp, Homo sapiens
tcactccatagcttaactcttt

SEQ ID NO: 7693995 - DNA, 22 bp, Homo sapiens
tcactccatctttgctactggt

SEQ ID NO: 7693996 - DNA, 22 bp, Homo sapiens
tcactccatctttgctactggt

SEQ ID NO: 7693997 - DNA, 22 bp, Homo sapiens
tcagaaatacaaaacacttact

SEQ ID NO: 7693998 - DNA, 22 bp, Homo sapiens
tcagaaatacaaaacacttact

SEQ ID NO: 7693999 - DNA, 22 bp, Homo sapiens
tcagaaatacaaaacacttact

SEQ ID NO: 7694000 - DNA, 22 bp, Homo sapiens
tcagaaatacaaaacacttact

SEQ ID NO: 7694001 - DNA, 22 bp, Homo sapiens
tcagaaatacaaaacacttact

SEQ ID NO: 7694002 - DNA, 22 bp, Homo sapiens
tcagaaatacaaaacacttact

SEQ ID NO: 7694003 - DNA, 22 bp, Homo sapiens
tcagaaataatgaatgatgggg

SEQ ID NO: 7694004 - DNA, 22 bp, Homo sapiens
tcagaaataatgaatgatgggg

SEQ ID NO: 7694005 - DNA, 22 bp, Homo sapiens
tcagaaataatgaatgatgggg

SEQ ID NO: 7694006 - DNA, 22 bp, Homo sapiens
tcagaaataatgaatgatgggg

SEQ ID NO: 7694007 - DNA, 22 bp, Homo sapiens
tcagaaataatgaatgatgggg

SEQ ID NO: 7694008 - DNA, 22 bp, Homo sapiens
tcagaaatagtctttaaaatga

SEQ ID NO: 7694009 - DNA, 22 bp, Homo sapiens
tcagaaatagtctttaaaatga

SEQ ID NO: 7694010 - DNA, 22 bp, Homo sapiens
tcagaaatagtctttaaaatga

SEQ ID NO: 7694011 - DNA, 22 bp, Homo sapiens
tcagaaatagtctttaaaatga

SEQ ID NO: 7694012 - DNA, 22 bp, Homo sapiens
tcagaaatagctctaagctcct

SEQ ID NO: 7694013 - DNA, 22 bp, Homo sapiens
tcagaaatagctctaagctcct

SEQ ID NO: 7694014 - DNA, 22 bp, Homo sapiens
tcagaaatagctctaagctcct

SEQ ID NO: 7694015 - DNA, 22 bp, Homo sapiens
tcagaaatactatcagcttttg

SEQ ID NO: 7694016 - DNA, 22 bp, Homo sapiens
tcagaaatactatcagcttttg

SEQ ID NO: 7694017 - DNA, 22 bp, Homo sapiens
tcagaaatactatcagcttttg

SEQ ID NO: 7694018 - DNA, 22 bp, Homo sapiens
tcagaaatacaaaacacttact

SEQ ID NO: 7694019 - DNA, 22 bp, Homo sapiens
tcagaaatgatcgttattcatt

SEQ ID NO: 7694020 - DNA, 22 bp, Homo sapiens
tcagaaatgatcgttattcatt

SEQ ID NO: 7694021 - DNA, 22 bp, Homo sapiens
tcagaaatgatcgttattcatt

SEQ ID NO: 7694022 - DNA, 22 bp, Homo sapiens
tcagaaatcttgtcaaggcatc

SEQ ID NO: 7694023 - DNA, 22 bp, Homo sapiens
tcagaaatcttgtcaaggcatc

SEQ ID NO: 7694024 - DNA, 22 bp, Homo sapiens
tcagaaatcttgtcaaggcatc

SEQ ID NO: 7694025 - DNA, 22 bp, Homo sapiens
tcagaaatagtctttaaaatga

SEQ ID NO: 7694026 - DNA, 22 bp, Homo sapiens
tcagaaatagtctttaaaatga

SEQ ID NO: 7694027 - DNA, 22 bp, Homo sapiens
tcagaaatagtctttaaaatga

SEQ ID NO: 7694028 - DNA, 22 bp, Homo sapiens
tcagaaatagtctttaaaatga

SEQ ID NO: 7694029 - DNA, 22 bp, Homo sapiens
tcagaaatagtctttaaaatga

SEQ ID NO: 7694030 - DNA, 22 bp, Homo sapiens
tcagaaatgtaagctgatgact

SEQ ID NO: 7694031 - DNA, 22 bp, Homo sapiens
tcagaaatgtaagctgatgact

SEQ ID NO: 7694032 - DNA, 22 bp, Homo sapiens
tcagaaatgtaagctgatgact

SEQ ID NO: 7694033 - DNA, 22 bp, Homo sapiens
tcagaaatgtaagctgatgact

SEQ ID NO: 7694034 - DNA, 22 bp, Homo sapiens
tcagaaatgtaagctgatgact

SEQ ID NO: 7694035 - DNA, 22 bp, Homo sapiens
tcagaaatgatcgttattcatt

SEQ ID NO: 7694036 - DNA, 22 bp, Homo sapiens
tcagaaatgatcgttattcatt

SEQ ID NO: 7694037 - DNA, 22 bp, Homo sapiens
tcagaaatgatcgttattcatt

SEQ ID NO: 7694038 - DNA, 22 bp, Homo sapiens
tcagaaatgatcgttattcatt

SEQ ID NO: 7694039 - DNA, 22 bp, Homo sapiens
tcagaaatgatcgttattcatt

SEQ ID NO: 7694040 - DNA, 22 bp, Homo sapiens
tcagaaattttctcagtagttc

SEQ ID NO: 7694041 - DNA, 22 bp, Homo sapiens
tcagaaattttctcagtagttc

SEQ ID NO: 7694042 - DNA, 23 bp, Homo sapiens
tcagaacaatgccttaggggcat

SEQ ID NO: 7694043 - DNA, 23 bp, Homo sapiens
tcagaacaatgccttaggggcat

SEQ ID NO: 7694044 - DNA, 22 bp, Homo sapiens
tcagaaattttctcagtagttc

SEQ ID NO: 7694045 - DNA, 22 bp, Homo sapiens
tcagaaattttctcagtagttc

SEQ ID NO: 7694046 - DNA, 22 bp, Homo sapiens
tcagaaatttaggctggacttg

SEQ ID NO: 7694047 - DNA, 22 bp, Homo sapiens
tcagaaatttaggctggacttg

SEQ ID NO: 7694048 - DNA, 22 bp, Homo sapiens
tcagaaatgtaagctgatgact

SEQ ID NO: 7694049 - DNA, 22 bp, Homo sapiens
tcagaaatttaggctggacttg

SEQ ID NO: 7694050 - DNA, 21 bp, Homo sapiens
tcagaacaattccatgcctcc

SEQ ID NO: 7694051 - DNA, 21 bp, Homo sapiens
tcagaacaattccatgcctcc

SEQ ID NO: 7694052 - DNA, 21 bp, Homo sapiens
tcagaacaattccatgcctcc

SEQ ID NO: 7694053 - DNA, 22 bp, Homo sapiens
tcagaacaattcctttataaca

SEQ ID NO: 7694054 - DNA, 22 bp, Homo sapiens
tcagaacaattcctttataaca

SEQ ID NO: 7694055 - DNA, 22 bp, Homo sapiens
tcagaagctaaatttgatattt

SEQ ID NO: 7694056 - DNA, 22 bp, Homo sapiens
tcagaagctaaatttgatattt

SEQ ID NO: 7694057 - DNA, 22 bp, Homo sapiens
tcagaagctgggtctcagaagc

SEQ ID NO: 7694058 - DNA, 22 bp, Homo sapiens
tcagaagctgggtctcagaagc

SEQ ID NO: 7694059 - DNA, 22 bp, Homo sapiens
tcagaagctggtgtcctttgaa

SEQ ID NO: 7694060 - DNA, 22 bp, Homo sapiens
tcagaagctggtgtcctttgaa

SEQ ID NO: 7694061 - DNA, 22 bp, Homo sapiens
tcagaaggaaacgatgccagct

SEQ ID NO: 7694062 - DNA, 22 bp, Homo sapiens
tcagaaggaaacgatgccagct

SEQ ID NO: 7694063 - DNA, 22 bp, Homo sapiens
tcagaaggaaacgatgccagct

SEQ ID NO: 7694064 - DNA, 22 bp, Homo sapiens
tcagaaggaaacgatgccagct

SEQ ID NO: 7694065 - DNA, 22 bp, Homo sapiens
tcagaaggaagttagagtatgg

SEQ ID NO: 7694066 - DNA, 22 bp, Homo sapiens
tcagaaggaagttagagtatgg

SEQ ID NO: 7694067 - DNA, 22 bp, Homo sapiens
tcagaaggaagaagtcatggga

SEQ ID NO: 7694068 - DNA, 20 bp, Homo sapiens
tcagaaggctccagagcaga

SEQ ID NO: 7694069 - DNA, 22 bp, Homo sapiens
tcagaaggcccgttgctaagag

SEQ ID NO: 7694070 - DNA, 22 bp, Homo sapiens
tcagaaggcccgttgctaagag

SEQ ID NO: 7694071 - DNA, 22 bp, Homo sapiens
tcagaaggcccgttgctaagag

SEQ ID NO: 7694072 - DNA, 19 bp, Homo sapiens
tcagaaggcaggagaggcc

SEQ ID NO: 7694073 - DNA, 19 bp, Homo sapiens
tcagaaggcaggagaggcc

SEQ ID NO: 7694074 - DNA, 22 bp, Homo sapiens
tcagaaggatgtgcaggtggca

SEQ ID NO: 7694075 - DNA, 22 bp, Homo sapiens
tcagaaggatgtgcaggtggca

SEQ ID NO: 7694076 - DNA, 22 bp, Homo sapiens
tcagaaggatgtgcaggtggca

SEQ ID NO: 7694077 - DNA, 22 bp, Homo sapiens
tcagaaggatgtgcaggtggca

SEQ ID NO: 7694078 - DNA, 22 bp, Homo sapiens
tcagaaggatgtgcaggtggca

SEQ ID NO: 7694079 - DNA, 22 bp, Homo sapiens
tcagaaggaagttagagtatgg

SEQ ID NO: 7694080 - DNA, 22 bp, Homo sapiens
tcaccagggaggcttaacttat

SEQ ID NO: 7694081 - DNA, 22 bp, Homo sapiens
tcaccagggagcttgtcctctg

SEQ ID NO: 7694082 - DNA, 22 bp, Homo sapiens
tcaccagggctccagccagcct

SEQ ID NO: 7694083 - DNA, 22 bp, Homo sapiens
tcaccagggctccagccagcct

SEQ ID NO: 7694084 - DNA, 22 bp, Homo sapiens
tcaccaggctggagtgcagtgg

SEQ ID NO: 7694085 - DNA, 22 bp, Homo sapiens
tcaccaggctggagtgcagtgg

SEQ ID NO: 7694086 - DNA, 22 bp, Homo sapiens
tcaccagggagcttgtcctctg

SEQ ID NO: 7694087 - DNA, 22 bp, Homo sapiens
tcaccagggagcttgtcctctg

SEQ ID NO: 7694088 - DNA, 22 bp, Homo sapiens
tcaccagttaaaataacagtaa

SEQ ID NO: 7694089 - DNA, 22 bp, Homo sapiens
tcaccagttaaaataacagtaa

SEQ ID NO: 7694090 - DNA, 22 bp, Homo sapiens
tcaccagggctccagccagcct

SEQ ID NO: 7694091 - DNA, 22 bp, Homo sapiens
tcaccagggctccagccagcct

SEQ ID NO: 7694092 - DNA, 22 bp, Homo sapiens
tcaccatcctcacctagaaatg

SEQ ID NO: 7694093 - DNA, 22 bp, Homo sapiens
tcacccaagaccatcggaagtg

SEQ ID NO: 7694094 - DNA, 22 bp, Homo sapiens
tcacccagaaaagacagcagat

SEQ ID NO: 7694095 - DNA, 22 bp, Homo sapiens
tcacccagaaaagacagcagat

SEQ ID NO: 7694096 - DNA, 22 bp, Homo sapiens
tcaccatcaggataaaatctca

SEQ ID NO: 7694097 - DNA, 22 bp, Homo sapiens
tcaccataggaacacagtcaga

SEQ ID NO: 7694098 - DNA, 22 bp, Homo sapiens
tcaccaggctggaatgcagtgg

SEQ ID NO: 7694099 - DNA, 22 bp, Homo sapiens
tcacattgattacattccatgt

SEQ ID NO: 7694100 - DNA, 22 bp, Homo sapiens
tcaccaggctggagtgcagtgg

SEQ ID NO: 7694101 - DNA, 22 bp, Homo sapiens
tcaccaggctggaatgcagtgg

SEQ ID NO: 7694102 - DNA, 22 bp, Homo sapiens
tcacattgccattagttcagtt

SEQ ID NO: 7694103 - DNA, 22 bp, Homo sapiens
tcaccaggctcctgttaagatg

SEQ ID NO: 7694104 - DNA, 22 bp, Homo sapiens
tcaccaggctcctgttaagatg

SEQ ID NO: 7694105 - DNA, 22 bp, Homo sapiens
tcaccaggctcctgttaagatg

SEQ ID NO: 7694106 - DNA, 22 bp, Homo sapiens
tcacattgccattagttcagtt

SEQ ID NO: 7694107 - DNA, 22 bp, Homo sapiens
tcacattgaatggaagaataga

SEQ ID NO: 7694108 - DNA, 22 bp, Homo sapiens
tcacattctttatttgccatcc

SEQ ID NO: 7694109 - DNA, 22 bp, Homo sapiens
tcacattgaagaaattttaagt

SEQ ID NO: 7694110 - DNA, 22 bp, Homo sapiens
cagtgctgttgtaagctcattg

SEQ ID NO: 7694111 - DNA, 22 bp, Homo sapiens
cagtgctgttgtaagctcattg

SEQ ID NO: 7694112 - DNA, 22 bp, Homo sapiens
cagtgctgtgctggaagctgtt

SEQ ID NO: 7694113 - DNA, 22 bp, Homo sapiens
cagtgctgtgctggaagctgtt

SEQ ID NO: 7694114 - DNA, 22 bp, Homo sapiens
cagtgctgtgctggaagctgtt

SEQ ID NO: 7694115 - DNA, 22 bp, Homo sapiens
cagtgctgtgctggaagctgtt

SEQ ID NO: 7694116 - DNA, 22 bp, Homo sapiens
cagtgctgtgctggaagctgtt

SEQ ID NO: 7694117 - DNA, 22 bp, Homo sapiens
cagtgctgtgtttgctgcctgg

SEQ ID NO: 7694118 - DNA, 22 bp, Homo sapiens
cagtgctgtgtttgctgcctgg

SEQ ID NO: 7694119 - DNA, 22 bp, Homo sapiens
cagtgctgtgtttgctgcctgg

SEQ ID NO: 7694120 - DNA, 22 bp, Homo sapiens
cagtgctgtgtttgctgcctgg

SEQ ID NO: 7694121 - DNA, 22 bp, Homo sapiens
cagtgctgtgctggaagctgtt

SEQ ID NO: 7694122 - DNA, 23 bp, Homo sapiens
cagtgctggttctgcctgtgggg

SEQ ID NO: 7694123 - DNA, 23 bp, Homo sapiens
cagtgctggttctgcctgtgggg

SEQ ID NO: 7694124 - DNA, 22 bp, Homo sapiens
cagtgctgtgctggaagctgtt

SEQ ID NO: 7694125 - DNA, 22 bp, Homo sapiens
cagtgctgtgctggaagctgtt

SEQ ID NO: 7694126 - DNA, 23 bp, Homo sapiens
cagtgctggttctgcctgtgggg

SEQ ID NO: 7694127 - DNA, 23 bp, Homo sapiens
cagtgctggttctgcctgtgggg

SEQ ID NO: 7694128 - DNA, 23 bp, Homo sapiens
cagtgctggttctgcctgtgggg

SEQ ID NO: 7694129 - DNA, 23 bp, Homo sapiens
cagtgctggttctgcctgtgggg

SEQ ID NO: 7694130 - DNA, 22 bp, Homo sapiens
cagtgctggtgtaggctgacca

SEQ ID NO: 7694131 - DNA, 22 bp, Homo sapiens
cagtgctggtgtaggctgacca

SEQ ID NO: 7694132 - DNA, 22 bp, Homo sapiens
cagtgctgttgggcccagagag

SEQ ID NO: 7694133 - DNA, 22 bp, Homo sapiens
cagtgctgttgggcccagagag

SEQ ID NO: 7694134 - DNA, 19 bp, Homo sapiens
cagtgctgttcattcagtg

SEQ ID NO: 7694135 - DNA, 19 bp, Homo sapiens
cagtgctgttcattcagtg

SEQ ID NO: 7694136 - DNA, 22 bp, Homo sapiens
cagtgctgttgggcccagagag

SEQ ID NO: 7694137 - DNA, 22 bp, Homo sapiens
cagtgctgttgggcccagagag

SEQ ID NO: 7694138 - DNA, 22 bp, Homo sapiens
cagtgctgttgggcccagagag

SEQ ID NO: 7694139 - DNA, 19 bp, Homo sapiens
cagtgctgttcattcagtg

SEQ ID NO: 7694140 - DNA, 19 bp, Homo sapiens
cagtgctgttcattcagtg

SEQ ID NO: 7694141 - DNA, 19 bp, Homo sapiens
cagtgctgttcattcagtg

SEQ ID NO: 7694142 - DNA, 18 bp, Homo sapiens
cagtgctgttaacagtga

SEQ ID NO: 7694143 - DNA, 22 bp, Homo sapiens
cagtgctgttaataaacacaaa

SEQ ID NO: 7694144 - DNA, 22 bp, Homo sapiens
cagtgctgttaataaacacaaa

SEQ ID NO: 7694145 - DNA, 22 bp, Homo sapiens
cagtgctgtgtttgctgcctgg

SEQ ID NO: 7694146 - DNA, 22 bp, Homo sapiens
cagtgctgtgtttgctgcctgg

SEQ ID NO: 7694147 - DNA, 18 bp, Homo sapiens
cagtgctgttaacagtga

SEQ ID NO: 7694148 - DNA, 22 bp, Homo sapiens
cagtgctggaggggtgcttgca

SEQ ID NO: 7694149 - DNA, 22 bp, Homo sapiens
cagtgctggaggggtgcttgca

SEQ ID NO: 7694150 - DNA, 22 bp, Homo sapiens
cagtgctggaggggtgcttgca

SEQ ID NO: 7694151 - DNA, 22 bp, Homo sapiens
cagtgctggaggctggagggaa

SEQ ID NO: 7694152 - DNA, 22 bp, Homo sapiens
cagtgctggaggggtgcttgca

SEQ ID NO: 7694153 - DNA, 22 bp, Homo sapiens
cagtgctggctgttaggacagt

SEQ ID NO: 7694154 - DNA, 22 bp, Homo sapiens
cagtgctggctgttaggacagt

SEQ ID NO: 7694155 - DNA, 22 bp, Homo sapiens
cagtgctggctgttaggacagt

SEQ ID NO: 7694156 - DNA, 22 bp, Homo sapiens
cagtgctggaggctggagggaa

SEQ ID NO: 7694157 - DNA, 22 bp, Homo sapiens
cagtgctggaggctggagggaa

SEQ ID NO: 7694158 - DNA, 22 bp, Homo sapiens
cagtgctggaggctggagggaa

SEQ ID NO: 7694159 - DNA, 22 bp, Homo sapiens
cagtgctggaggctggagggaa

SEQ ID NO: 7694160 - DNA, 22 bp, Homo sapiens
cagtgctggagatgggtggaac

SEQ ID NO: 7694161 - DNA, 22 bp, Homo sapiens
cagtgctgctctctgtaagaga

SEQ ID NO: 7694162 - DNA, 22 bp, Homo sapiens
cagtgctgctctctgtaagaga

SEQ ID NO: 7694163 - DNA, 22 bp, Homo sapiens
cagtgctgctctctgtaagaga

SEQ ID NO: 7694164 - DNA, 21 bp, Homo sapiens
cagtgctgcctaatagggagt

SEQ ID NO: 7694165 - DNA, 22 bp, Homo sapiens
cagtgctgctctctgtaagaga

SEQ ID NO: 7694166 - DNA, 22 bp, Homo sapiens
cagtgctggtgtaggctgacca

SEQ ID NO: 7694167 - DNA, 22 bp, Homo sapiens
cagtgctggtgtaggctgacca

SEQ ID NO: 7694168 - DNA, 22 bp, Homo sapiens
cagtgctgggcagaggagagcg

SEQ ID NO: 7694169 - DNA, 22 bp, Homo sapiens
cagtgctgggcagaggagagcg

SEQ ID NO: 7694170 - DNA, 22 bp, Homo sapiens
cagtgctgggcagaggagagcg

SEQ ID NO: 7694171 - DNA, 22 bp, Homo sapiens
cagtgctgggcagaggagagcg

SEQ ID NO: 7694172 - DNA, 22 bp, Homo sapiens
cagtgctgggcagaggagagcg

SEQ ID NO: 7694173 - DNA, 22 bp, Homo sapiens
cagtgctgggcagaggagagcg

SEQ ID NO: 7694174 - DNA, 22 bp, Homo sapiens
cagtgctgggcagaggagagcg

SEQ ID NO: 7694175 - DNA, 22 bp, Homo sapiens
cagtgctgggcagaggagagcg

SEQ ID NO: 7694176 - DNA, 22 bp, Homo sapiens
cagtgctgggcagaggagagcg

SEQ ID NO: 7694177 - DNA, 22 bp, Homo sapiens
cagtgctgggcagaggagagcg

SEQ ID NO: 7694178 - DNA, 22 bp, Homo sapiens
cagtgctggctgttaggacagt

SEQ ID NO: 7694179 - DNA, 22 bp, Homo sapiens
cagtgctggctgttaggacagt

SEQ ID NO: 7694180 - DNA, 22 bp, Homo sapiens
cagtgctggctgttaggacagt

SEQ ID NO: 7694181 - DNA, 22 bp, Homo sapiens
cagtgctggctgttaggacagt

SEQ ID NO: 7694182 - DNA, 22 bp, Homo sapiens
cagtgctggctgttaggacagt

SEQ ID NO: 7694183 - DNA, 22 bp, Homo sapiens
cagtgctggctgttaggacagt

SEQ ID NO: 7694184 - DNA, 22 bp, Homo sapiens
cagtgctggctgttaggacagt

SEQ ID NO: 7694185 - DNA, 22 bp, Homo sapiens
cagtgctggctgttaggacagt

SEQ ID NO: 7694186 - DNA, 22 bp, Homo sapiens
cagtgctggctgttaggacagt

SEQ ID NO: 7694187 - DNA, 22 bp, Homo sapiens
cagtgctgcaggcgcctgcggt

SEQ ID NO: 7694188 - DNA, 22 bp, Homo sapiens
cagtgctgcatctccatgccag

SEQ ID NO: 7694189 - DNA, 22 bp, Homo sapiens
cagtgctgcatctccatgccag

SEQ ID NO: 7694190 - DNA, 22 bp, Homo sapiens
cagtgctgcatctccatgccag

SEQ ID NO: 7694191 - DNA, 21 bp, Homo sapiens
cagtgctgcctaatagggagt

SEQ ID NO: 7694192 - DNA, 21 bp, Homo sapiens
cagtgctgcctaatagggagt

SEQ ID NO: 7694193 - DNA, 21 bp, Homo sapiens
cagtgctgcctaatagggagt

SEQ ID NO: 7694194 - DNA, 22 bp, Homo sapiens
cagtgctgccaaagggaccttg

SEQ ID NO: 7694195 - DNA, 22 bp, Homo sapiens
cagtgctgccaaagggaccttg

SEQ ID NO: 7694196 - DNA, 22 bp, Homo sapiens
cagtgctgccaaagggaccttg

SEQ ID NO: 7694197 - DNA, 22 bp, Homo sapiens
cagtgctgccaaagggaccttg

SEQ ID NO: 7694198 - DNA, 22 bp, Homo sapiens
cagtgctgcaggcgcctgcggt

SEQ ID NO: 7694199 - DNA, 22 bp, Homo sapiens
cagtgctgcaggcgcctgcggt

SEQ ID NO: 7694200 - DNA, 22 bp, Homo sapiens
cagtgctgagagcctggccagg

SEQ ID NO: 7694201 - DNA, 22 bp, Homo sapiens
cagtgctgagagcctggccagg

SEQ ID NO: 7694202 - DNA, 22 bp, Homo sapiens
cagtgctgagagcctggccagg

SEQ ID NO: 7694203 - DNA, 22 bp, Homo sapiens
cagtgctgagagcctggccagg

SEQ ID NO: 7694204 - DNA, 22 bp, Homo sapiens
cagtgctgacagggaggaacct

SEQ ID NO: 7694205 - DNA, 22 bp, Homo sapiens
cagtgctgacagggaggaacct

SEQ ID NO: 7694206 - DNA, 22 bp, Homo sapiens
cagtgctgacagggaggaacct

SEQ ID NO: 7694207 - DNA, 22 bp, Homo sapiens
cagtgctcctgatgtacccttg

SEQ ID NO: 7694208 - DNA, 21 bp, Homo sapiens
cagtgccccagctacaaaagg

SEQ ID NO: 7694209 - DNA, 22 bp, Homo sapiens
cagtgctgacagggaggaacct

SEQ ID NO: 7694210 - DNA, 19 bp, Homo sapiens
cagtgcccgacgcaggtct

SEQ ID NO: 7694211 - DNA, 21 bp, Homo sapiens
cagtgccccagctacaaaagg

SEQ ID NO: 7694212 - DNA, 19 bp, Homo sapiens
cagtgcccaccctagcaca

SEQ ID NO: 7694213 - DNA, 19 bp, Homo sapiens
cagtgcccaccctagcaca

SEQ ID NO: 7694214 - DNA, 19 bp, Homo sapiens
cagtgcccaccctagcaca

SEQ ID NO: 7694215 - DNA, 19 bp, Homo sapiens
cagtgcccaccctagcaca

SEQ ID NO: 7694216 - DNA, 22 bp, Homo sapiens
cagtgcccaagatgtgccatgc

SEQ ID NO: 7694217 - DNA, 22 bp, Homo sapiens
cagtgcccaagatgtgccatgc

SEQ ID NO: 7694218 - DNA, 22 bp, Homo sapiens
cagtgcccaagatgtgccatgc

SEQ ID NO: 7694219 - DNA, 22 bp, Homo sapiens
cagtgcagaggccagggaggat

SEQ ID NO: 7694220 - DNA, 22 bp, Homo sapiens
cagtgcagaggccagggaggat

SEQ ID NO: 7694221 - DNA, 22 bp, Homo sapiens
cagtgcagaggccagggaggat

SEQ ID NO: 7694222 - DNA, 22 bp, Homo sapiens
cagtgcagaggccagggaggat

SEQ ID NO: 7694223 - DNA, 22 bp, Homo sapiens
cagtgcagaggccagggaggat

SEQ ID NO: 7694224 - DNA, 22 bp, Homo sapiens
cagtgcagaggccagggaggat

SEQ ID NO: 7694225 - DNA, 17 bp, Homo sapiens
cagtgcagagccctttc

SEQ ID NO: 7694226 - DNA, 22 bp, Homo sapiens
cagtgcagaggccagggaggat

SEQ ID NO: 7694227 - DNA, 22 bp, Homo sapiens
cagtgcagaggccagggaggat

SEQ ID NO: 7694228 - DNA, 22 bp, Homo sapiens
cagtgcagaggccagggaggat

SEQ ID NO: 7694229 - DNA, 21 bp, Homo sapiens
catgataatgaaggtgttatt

SEQ ID NO: 7694230 - DNA, 22 bp, Homo sapiens
catgataattgttaacaaagta

SEQ ID NO: 7694231 - DNA, 22 bp, Homo sapiens
catgatacttgacatttgcgat

SEQ ID NO: 7694232 - DNA, 22 bp, Homo sapiens
catgatacttgaatttggaagg

SEQ ID NO: 7694233 - DNA, 21 bp, Homo sapiens
catgataatgaaggtgttatt

SEQ ID NO: 7694234 - DNA, 22 bp, Homo sapiens
catgataacttcattacacaat

SEQ ID NO: 7694235 - DNA, 22 bp, Homo sapiens
catgataacttcattacacaat

SEQ ID NO: 7694236 - DNA, 22 bp, Homo sapiens
catgagttcaaaatgcctgcct

SEQ ID NO: 7694237 - DNA, 22 bp, Homo sapiens
catgataacttcattacacaat

SEQ ID NO: 7694238 - DNA, 22 bp, Homo sapiens
catgatataaagtagtagataa

SEQ ID NO: 7694239 - DNA, 22 bp, Homo sapiens
catgataggtatttaattaaat

SEQ ID NO: 7694240 - DNA, 20 bp, Homo sapiens
catgatacttggaagggctt

SEQ ID NO: 7694241 - DNA, 22 bp, Homo sapiens
catgataggtatttaattaaat

SEQ ID NO: 7694242 - DNA, 22 bp, Homo sapiens
catgatataaagtagtagataa

SEQ ID NO: 7694243 - DNA, 22 bp, Homo sapiens
catgatataaagtagtagataa

SEQ ID NO: 7694244 - DNA, 22 bp, Homo sapiens
catgattatattaatggcttca

SEQ ID NO: 7694245 - DNA, 23 bp, Homo sapiens
catgatgttaactttgttatgct

SEQ ID NO: 7694246 - DNA, 22 bp, Homo sapiens
catgatgttaggcaggatacta

SEQ ID NO: 7694247 - DNA, 22 bp, Homo sapiens
catgatgttatcaagcacaaag

SEQ ID NO: 7694248 - DNA, 22 bp, Homo sapiens
catgatggttcttacaaaggtg

SEQ ID NO: 7694249 - DNA, 22 bp, Homo sapiens
catgatggcgagtttctaggtt

SEQ ID NO: 7694250 - DNA, 22 bp, Homo sapiens
catgatgtcacagagaagcaca

SEQ ID NO: 7694251 - DNA, 22 bp, Homo sapiens
catgatgtcacagagaagcaca

SEQ ID NO: 7694252 - DNA, 23 bp, Homo sapiens
catgatatttatcttccctgggt

SEQ ID NO: 7694253 - DNA, 23 bp, Homo sapiens
catgatatttatcttccctgggt

SEQ ID NO: 7694254 - DNA, 22 bp, Homo sapiens
catgatctggtcctactgtggg

SEQ ID NO: 7694255 - DNA, 22 bp, Homo sapiens
catgatctggtcctactgtggg

SEQ ID NO: 7694256 - DNA, 22 bp, Homo sapiens
catgatggatgtgcacttcgct

SEQ ID NO: 7694257 - DNA, 19 bp, Homo sapiens
catgatgagcatcctgcag

SEQ ID NO: 7694258 - DNA, 22 bp, Homo sapiens
tcagtttcacagtctgtgcaga

SEQ ID NO: 7694259 - DNA, 22 bp, Homo sapiens
tcagtttatttcttgttccaca

SEQ ID NO: 7694260 - DNA, 22 bp, Homo sapiens
catgagaaggttttggcatata

SEQ ID NO: 7694261 - DNA, 22 bp, Homo sapiens
catgagaaggttttggcatata

SEQ ID NO: 7694262 - DNA, 22 bp, Homo sapiens
catgagaaggttttggcatata

SEQ ID NO: 7694263 - DNA, 22 bp, Homo sapiens
catgagaagtggccttcaaaaa

SEQ ID NO: 7694264 - DNA, 22 bp, Homo sapiens
catgagaatgaagaagacttaa

SEQ ID NO: 7694265 - DNA, 22 bp, Homo sapiens
catgagaatgaagaagacttaa

SEQ ID NO: 7694266 - DNA, 22 bp, Homo sapiens
catgagaatgaagaagacttaa

SEQ ID NO: 7694267 - DNA, 22 bp, Homo sapiens
catgagtgtcatctcagcagct

SEQ ID NO: 7694268 - DNA, 22 bp, Homo sapiens
catgagtgtgccagtctgatat

SEQ ID NO: 7694269 - DNA, 22 bp, Homo sapiens
catgagttcaaaatgcctgcct

SEQ ID NO: 7694270 - DNA, 22 bp, Homo sapiens
catgagttttttagttcatgca

SEQ ID NO: 7694271 - DNA, 22 bp, Homo sapiens
catgagttcatctgcttctctt

SEQ ID NO: 7694272 - DNA, 22 bp, Homo sapiens
catgagttcatctgcttctctt

SEQ ID NO: 7694273 - DNA, 22 bp, Homo sapiens
catgagttttttagttcatgca

SEQ ID NO: 7694274 - DNA, 22 bp, Homo sapiens
catgataacacttctgtttaat

SEQ ID NO: 7694275 - DNA, 22 bp, Homo sapiens
catgataacacttctgtttaat

SEQ ID NO: 7694276 - DNA, 22 bp, Homo sapiens
tcagtttagatgcatttgtcgt

SEQ ID NO: 7694277 - DNA, 22 bp, Homo sapiens
tcagtttagatgcatttgtcgt

SEQ ID NO: 7694278 - DNA, 22 bp, Homo sapiens
tcagtttaatacccagatgcct

SEQ ID NO: 7694279 - DNA, 22 bp, Homo sapiens
tcagtttacctcaccttaccta

SEQ ID NO: 7694280 - DNA, 22 bp, Homo sapiens
tcagtttacctcaccttaccta

SEQ ID NO: 7694281 - DNA, 22 bp, Homo sapiens
tcagtttagagttatttaatct

SEQ ID NO: 7694282 - DNA, 22 bp, Homo sapiens
tcagtttagagttatttaatct

SEQ ID NO: 7694283 - DNA, 22 bp, Homo sapiens
tcagtttagagttatttaatct

SEQ ID NO: 7694284 - DNA, 22 bp, Homo sapiens
tcagtttaagatgactaacaat

SEQ ID NO: 7694285 - DNA, 22 bp, Homo sapiens
tcagtttaatacccagatgcct

SEQ ID NO: 7694286 - DNA, 22 bp, Homo sapiens
tcagtttaatacccagatgcct

SEQ ID NO: 7694287 - DNA, 22 bp, Homo sapiens
tcagtttaagatgactaacaat

SEQ ID NO: 7694288 - DNA, 22 bp, Homo sapiens
tcagtttaagatgactaacaat

SEQ ID NO: 7694289 - DNA, 22 bp, Homo sapiens
tcagtttatttcttgttccaca

SEQ ID NO: 7694290 - DNA, 22 bp, Homo sapiens
tcagtttatttcttgttccaca

SEQ ID NO: 7694291 - DNA, 22 bp, Homo sapiens
tcagtttatttcttgttccaca

SEQ ID NO: 7694292 - DNA, 22 bp, Homo sapiens
tcagtttatggtctagttcatg

SEQ ID NO: 7694293 - DNA, 22 bp, Homo sapiens
tcagtttatagatattgctgat

SEQ ID NO: 7694294 - DNA, 22 bp, Homo sapiens
tcagtttatggtctagttcatg

SEQ ID NO: 7694295 - DNA, 22 bp, Homo sapiens
tcagtttatggtctagttcatg

SEQ ID NO: 7694296 - DNA, 22 bp, Homo sapiens
tcagtttatggtctagttcatg

SEQ ID NO: 7694297 - DNA, 22 bp, Homo sapiens
tcagtttatggtctagttcatg

SEQ ID NO: 7694298 - DNA, 22 bp, Homo sapiens
tcagtttataaattgtatttag

SEQ ID NO: 7694299 - DNA, 22 bp, Homo sapiens
tcagtttataaattgtatttag

SEQ ID NO: 7694300 - DNA, 22 bp, Homo sapiens
tcagtttagatgcatttgtcgt

SEQ ID NO: 7694301 - DNA, 22 bp, Homo sapiens
tcagtttataaattgtatttag

SEQ ID NO: 7694302 - DNA, 22 bp, Homo sapiens
tcagtttataaattgtatttag

SEQ ID NO: 7694303 - DNA, 22 bp, Homo sapiens
tcagtttataaattgtatttag

SEQ ID NO: 7694304 - DNA, 22 bp, Homo sapiens
tcagtttataaattgtatttag

SEQ ID NO: 7694305 - DNA, 22 bp, Homo sapiens
tcagtttatagatattgctgat

SEQ ID NO: 7694306 - DNA, 22 bp, Homo sapiens
tcagtttatagatattgctgat

SEQ ID NO: 7694307 - DNA, 22 bp, Homo sapiens
catgatttactaaaatttgttt

SEQ ID NO: 7694308 - DNA, 22 bp, Homo sapiens
catgattgatccttctaaatgc

SEQ ID NO: 7694309 - DNA, 22 bp, Homo sapiens
catgatttactaaaatttgttt

SEQ ID NO: 7694310 - DNA, 22 bp, Homo sapiens
catgattatgtgttagagtttg

SEQ ID NO: 7694311 - DNA, 22 bp, Homo sapiens
tcatggctttttcactgttcgc

SEQ ID NO: 7694312 - DNA, 22 bp, Homo sapiens
tcatggctttttcactgttcgc

SEQ ID NO: 7694313 - DNA, 21 bp, Homo sapiens
tcatgggcaggtcacttcttt

SEQ ID NO: 7694314 - DNA, 22 bp, Homo sapiens
tcatgggcagctactggttccc

SEQ ID NO: 7694315 - DNA, 22 bp, Homo sapiens
tcatggggaaagcccgccctca

SEQ ID NO: 7694316 - DNA, 22 bp, Homo sapiens
tcatggggccacagctgccagc

SEQ ID NO: 7694317 - DNA, 22 bp, Homo sapiens
tcatggggtgacagaagggagg

SEQ ID NO: 7694318 - DNA, 22 bp, Homo sapiens
tcatggggtgacagaagggagg

SEQ ID NO: 7694319 - DNA, 22 bp, Homo sapiens
tcatggggtagaagcatgttta

SEQ ID NO: 7694320 - DNA, 22 bp, Homo sapiens
tcatggggtagaagcatgttta

SEQ ID NO: 7694321 - DNA, 22 bp, Homo sapiens
tcatggggtgaattagtatgct

SEQ ID NO: 7694322 - DNA, 22 bp, Homo sapiens
tcatggggccacagctgccagc

SEQ ID NO: 7694323 - DNA, 22 bp, Homo sapiens
tcatggggccacagctgccagc

SEQ ID NO: 7694324 - DNA, 22 bp, Homo sapiens
tcatggggctcttcaagtggag

SEQ ID NO: 7694325 - DNA, 22 bp, Homo sapiens
tcatgggaacaccagtattctc

SEQ ID NO: 7694326 - DNA, 21 bp, Homo sapiens
tcatgtaatgcatgaagtaaa

SEQ ID NO: 7694327 - DNA, 22 bp, Homo sapiens
tcatgtaagtatagaaagcagt

SEQ ID NO: 7694328 - DNA, 21 bp, Homo sapiens
tcatgtaatgcatgaagtaaa

SEQ ID NO: 7694329 - DNA, 22 bp, Homo sapiens
tcatgtattgaaaagcatttta

SEQ ID NO: 7694330 - DNA, 22 bp, Homo sapiens
tcatgtattgaaaagcatttta

SEQ ID NO: 7694331 - DNA, 22 bp, Homo sapiens
tcatgtatttgtgatagatgac

SEQ ID NO: 7694332 - DNA, 22 bp, Homo sapiens
tcatgtatttgtgatagatgac

SEQ ID NO: 7694333 - DNA, 22 bp, Homo sapiens
tcatgtacatgtaagtcagaaa

SEQ ID NO: 7694334 - DNA, 22 bp, Homo sapiens
tcatgtacatgtaagtcagaaa

SEQ ID NO: 7694335 - DNA, 22 bp, Homo sapiens
tcatgtattgaaaagcatttta

SEQ ID NO: 7694336 - DNA, 22 bp, Homo sapiens
tcatgtattgaaaagcatttta

SEQ ID NO: 7694337 - DNA, 22 bp, Homo sapiens
tcatgtaaagtgtaggtttaga

SEQ ID NO: 7694338 - DNA, 22 bp, Homo sapiens
tcatggtatatttcactcttta

SEQ ID NO: 7694339 - DNA, 22 bp, Homo sapiens
tcatgtaaatgtggatgcttcc

SEQ ID NO: 7694340 - DNA, 22 bp, Homo sapiens
tcatggggtttggctggatgtc

SEQ ID NO: 7694341 - DNA, 22 bp, Homo sapiens
tcatggggtttggctggatgtc

SEQ ID NO: 7694342 - DNA, 22 bp, Homo sapiens
tcatgggtgctccaggtggctg

SEQ ID NO: 7694343 - DNA, 22 bp, Homo sapiens
tcatggttcatgagtgtccttt

SEQ ID NO: 7694344 - DNA, 19 bp, Homo sapiens
tcatgtctctcatctgtga

SEQ ID NO: 7694345 - DNA, 19 bp, Homo sapiens
tcatgtctctcatctgtga

SEQ ID NO: 7694346 - DNA, 22 bp, Homo sapiens
tcatgtctctatgtgcctatta

SEQ ID NO: 7694347 - DNA, 22 bp, Homo sapiens
tcatgtctctatgtgcctatta

SEQ ID NO: 7694348 - DNA, 22 bp, Homo sapiens
tcatttcaagttctgacagcta

SEQ ID NO: 7694349 - DNA, 22 bp, Homo sapiens
tcatttcaagttctgacagcta

SEQ ID NO: 7694350 - DNA, 18 bp, Homo sapiens
tcatgtcactgtgctccc

SEQ ID NO: 7694351 - DNA, 22 bp, Homo sapiens
tcatgtcagctgttgatgtgca

SEQ ID NO: 7694352 - DNA, 22 bp, Homo sapiens
tcatgtcagtttcttctataaa

SEQ ID NO: 7694353 - DNA, 22 bp, Homo sapiens
tcatgtcagctgttgatgtgca

SEQ ID NO: 7694354 - DNA, 22 bp, Homo sapiens
tcatgtcagtttcttctataaa

SEQ ID NO: 7694355 - DNA, 22 bp, Homo sapiens
tcatgtcccgttgctggctgcc

SEQ ID NO: 7694356 - DNA, 22 bp, Homo sapiens
tcatgtcccgttgctggctgcc

SEQ ID NO: 7694357 - DNA, 22 bp, Homo sapiens
tcatgtcagtttcttctataaa

SEQ ID NO: 7694358 - DNA, 22 bp, Homo sapiens
tcatgtcccgttgctggctgcc

SEQ ID NO: 7694359 - DNA, 22 bp, Homo sapiens
tcatgtcccgttgctggctgcc

SEQ ID NO: 7694360 - DNA, 22 bp, Homo sapiens
tcatgtccctattactgtgacc

SEQ ID NO: 7694361 - DNA, 18 bp, Homo sapiens
tcatgtctcacaggtgat

SEQ ID NO: 7694362 - DNA, 18 bp, Homo sapiens
tcatgtctcacaggtgat

SEQ ID NO: 7694363 - DNA, 22 bp, Homo sapiens
tcatttgttgaactttagtgcg

SEQ ID NO: 7694364 - DNA, 22 bp, Homo sapiens
tcatttgttgaactttagtgcg

SEQ ID NO: 7694365 - DNA, 22 bp, Homo sapiens
tcatttgttgaactttagtgcg

SEQ ID NO: 7694366 - DNA, 22 bp, Homo sapiens
tcatttgttgaactttagtgcg

SEQ ID NO: 7694367 - DNA, 22 bp, Homo sapiens
tcatttgttctcattctctact

SEQ ID NO: 7694368 - DNA, 22 bp, Homo sapiens
tcatttcaatgatactactaag

SEQ ID NO: 7694369 - DNA, 22 bp, Homo sapiens
tcatttcaagttctgacagcta

SEQ ID NO: 7694370 - DNA, 17 bp, Homo sapiens
tcatttgttgtgactag

SEQ ID NO: 7694371 - DNA, 22 bp, Homo sapiens
tcatttgttgctgttacctgag

SEQ ID NO: 7694372 - DNA, 17 bp, Homo sapiens
tcatttgttgtgactag

SEQ ID NO: 7694373 - DNA, 17 bp, Homo sapiens
tcatttgttgtgactag

SEQ ID NO: 7694374 - DNA, 18 bp, Homo sapiens
tcatttgttttgcatgaa

SEQ ID NO: 7694375 - DNA, 18 bp, Homo sapiens
tcatttgttttgcatgaa

SEQ ID NO: 7694376 - DNA, 22 bp, Homo sapiens
catccccaattagcgcccagct

SEQ ID NO: 7694377 - DNA, 22 bp, Homo sapiens
catcccattggctaaggcaaat

SEQ ID NO: 7694378 - DNA, 22 bp, Homo sapiens
catccccaattagcgcccagct

SEQ ID NO: 7694379 - DNA, 22 bp, Homo sapiens
catccccaattagcgcccagct

SEQ ID NO: 7694380 - DNA, 22 bp, Homo sapiens
catccccaattagcgcccagct

SEQ ID NO: 7694381 - DNA, 22 bp, Homo sapiens
catccctgacttctaggtgaca

SEQ ID NO: 7694382 - DNA, 22 bp, Homo sapiens
catccctgacttctaggtgaca

SEQ ID NO: 7694383 - DNA, 22 bp, Homo sapiens
catccccagagcagttccacta

SEQ ID NO: 7694384 - DNA, 22 bp, Homo sapiens
catcccctgatgctcttgagta

SEQ ID NO: 7694385 - DNA, 22 bp, Homo sapiens
catccatagcctcaataaatag

SEQ ID NO: 7694386 - DNA, 22 bp, Homo sapiens
catccatagcttgatctgttcc

SEQ ID NO: 7694387 - DNA, 22 bp, Homo sapiens
catccatatgaggcacattggt

SEQ ID NO: 7694388 - DNA, 22 bp, Homo sapiens
catccattaactcatttgtttc

SEQ ID NO: 7694389 - DNA, 22 bp, Homo sapiens
catccattaactcatttgtttc

SEQ ID NO: 7694390 - DNA, 22 bp, Homo sapiens
catccattcagtgcaaatcaca

SEQ ID NO: 7694391 - DNA, 22 bp, Homo sapiens
catccattcattaattctaaag

SEQ ID NO: 7694392 - DNA, 22 bp, Homo sapiens
catccagtggtcagggaagttg

SEQ ID NO: 7694393 - DNA, 22 bp, Homo sapiens
catccattcagtgcaaatcaca

SEQ ID NO: 7694394 - DNA, 22 bp, Homo sapiens
tcaggtggcttggagggggacg

SEQ ID NO: 7694395 - DNA, 22 bp, Homo sapiens
tcaggtggcttcggggagtggc

SEQ ID NO: 7694396 - DNA, 22 bp, Homo sapiens
tcaggtggctggttgctggcta

SEQ ID NO: 7694397 - DNA, 22 bp, Homo sapiens
tcaggtggctggttgctggcta

SEQ ID NO: 7694398 - DNA, 22 bp, Homo sapiens
catccctgggcgggacactctt

SEQ ID NO: 7694399 - DNA, 22 bp, Homo sapiens
catccctggttcctgtgtttaa

SEQ ID NO: 7694400 - DNA, 22 bp, Homo sapiens
catccctgctggtggaaggggt

SEQ ID NO: 7694401 - DNA, 22 bp, Homo sapiens
catccctgctggtggaaggggt

SEQ ID NO: 7694402 - DNA, 22 bp, Homo sapiens
catccctgccctcatgcctata

SEQ ID NO: 7694403 - DNA, 22 bp, Homo sapiens
catctttaaaggggagacaccc

SEQ ID NO: 7694404 - DNA, 22 bp, Homo sapiens
catctttaaaggggagacaccc

SEQ ID NO: 7694405 - DNA, 22 bp, Homo sapiens
catctttaacaatttacaatgt

SEQ ID NO: 7694406 - DNA, 22 bp, Homo sapiens
catctttaaaggggagacaccc

SEQ ID NO: 7694407 - DNA, 22 bp, Homo sapiens
catctttaaaggggagacaccc

SEQ ID NO: 7694408 - DNA, 22 bp, Homo sapiens
catctttaacaatttacaatgt

SEQ ID NO: 7694409 - DNA, 22 bp, Homo sapiens
catctttaacaatttacaatgt

SEQ ID NO: 7694410 - DNA, 22 bp, Homo sapiens
catctttaacaatttacaatgt

SEQ ID NO: 7694411 - DNA, 22 bp, Homo sapiens
catctttaacaatttacaatgt

SEQ ID NO: 7694412 - DNA, 22 bp, Homo sapiens
catctttaacaatttacaatgt

SEQ ID NO: 7694413 - DNA, 22 bp, Homo sapiens
catcttaataaatctcctccct

SEQ ID NO: 7694414 - DNA, 22 bp, Homo sapiens
catctttaaaatgggaacaaca

SEQ ID NO: 7694415 - DNA, 22 bp, Homo sapiens
catctttaaaatgggaacaaca

SEQ ID NO: 7694416 - DNA, 22 bp, Homo sapiens
catctttaaaggggagacaccc

SEQ ID NO: 7694417 - DNA, 22 bp, Homo sapiens
tcaggtgggagtagaatgctag

SEQ ID NO: 7694418 - DNA, 22 bp, Homo sapiens
tcaggtgggacctgctaggaca

SEQ ID NO: 7694419 - DNA, 22 bp, Homo sapiens
tcaggtgggcagtgggttgagc

SEQ ID NO: 7694420 - DNA, 22 bp, Homo sapiens
tcaggtgggcgttccggtgcgg

SEQ ID NO: 7694421 - DNA, 22 bp, Homo sapiens
tcaggtgggcgttccggtgcgg

SEQ ID NO: 7694422 - DNA, 22 bp, Homo sapiens
tcaggtggtcctaagtgccatc

SEQ ID NO: 7694423 - DNA, 22 bp, Homo sapiens
tcaggtggtcctaagtgccatc

SEQ ID NO: 7694424 - DNA, 21 bp, Homo sapiens
tcagttctctgcctgtgcttg

SEQ ID NO: 7694425 - DNA, 21 bp, Homo sapiens
tcagttctctgcctgtgcttg

SEQ ID NO: 7694426 - DNA, 22 bp, Homo sapiens
tcagttctctcatgcctgccct

SEQ ID NO: 7694427 - DNA, 21 bp, Homo sapiens
tcagttctctgcctgtgcttg

SEQ ID NO: 7694428 - DNA, 22 bp, Homo sapiens
tcagttctgaagttctgcctcc

SEQ ID NO: 7694429 - DNA, 22 bp, Homo sapiens
tcagttctgaagttctgcctcc

SEQ ID NO: 7694430 - DNA, 22 bp, Homo sapiens
tcagttctgaagttctgcctcc

SEQ ID NO: 7694431 - DNA, 22 bp, Homo sapiens
tcagttctgaagttctgcctcc

SEQ ID NO: 7694432 - DNA, 22 bp, Homo sapiens
tcagttctgctagaaaaacagt

SEQ ID NO: 7694433 - DNA, 22 bp, Homo sapiens
tcagttctgctagaaaaacagt

SEQ ID NO: 7694434 - DNA, 22 bp, Homo sapiens
tcagttctggctgctgctgtca

SEQ ID NO: 7694435 - DNA, 22 bp, Homo sapiens
tcagttctggctgctgctgtca

SEQ ID NO: 7694436 - DNA, 22 bp, Homo sapiens
tcagttcttagtaatgcagtct

SEQ ID NO: 7694437 - DNA, 22 bp, Homo sapiens
tcagttcttagtaatgcagtct

SEQ ID NO: 7694438 - DNA, 22 bp, Homo sapiens
tcagttcttagtaatgcagtct

SEQ ID NO: 7694439 - DNA, 22 bp, Homo sapiens
tcagttctggctgctgctgtca

SEQ ID NO: 7694440 - DNA, 19 bp, Homo sapiens
tcagttctgctcgctgtgc

SEQ ID NO: 7694441 - DNA, 22 bp, Homo sapiens
tcagttctggctgctgctgtca

SEQ ID NO: 7694442 - DNA, 22 bp, Homo sapiens
tcagttctgctagaaaaacagt

SEQ ID NO: 7694443 - DNA, 19 bp, Homo sapiens
tcagttctgctcgctgtgc

SEQ ID NO: 7694444 - DNA, 22 bp, Homo sapiens
catctttgcaccctcaaaacct

SEQ ID NO: 7694445 - DNA, 22 bp, Homo sapiens
catctttgccatatgatgtaat

SEQ ID NO: 7694446 - DNA, 22 bp, Homo sapiens
catctttgccatatgatgtaat

SEQ ID NO: 7694447 - DNA, 22 bp, Homo sapiens
catctttgcccatccacttcca

SEQ ID NO: 7694448 - DNA, 21 bp, Homo sapiens
tcagttctctgcctgtgcttg

SEQ ID NO: 7694449 - DNA, 22 bp, Homo sapiens
tcagttctaagtgctttacatg

SEQ ID NO: 7694450 - DNA, 22 bp, Homo sapiens
tcagttctctcatgcctgccct

SEQ ID NO: 7694451 - DNA, 22 bp, Homo sapiens
tcagttctctcatgcctgccct

SEQ ID NO: 7694452 - DNA, 22 bp, Homo sapiens
catctttgcaccctcaaaacct

SEQ ID NO: 7694453 - DNA, 22 bp, Homo sapiens
tcagttctaagtgctttacatg

SEQ ID NO: 7694454 - DNA, 22 bp, Homo sapiens
tcagttctaacagtttagaaca

SEQ ID NO: 7694455 - DNA, 22 bp, Homo sapiens
tcagttcttattttcatgaata

SEQ ID NO: 7694456 - DNA, 22 bp, Homo sapiens
tcagttcttattttcatgaata

SEQ ID NO: 7694457 - DNA, 22 bp, Homo sapiens
tcagttcttgggctgctaggac

SEQ ID NO: 7694458 - DNA, 22 bp, Homo sapiens
tcagttcttgggctgctaggac

SEQ ID NO: 7694459 - DNA, 22 bp, Homo sapiens
tcagttcttgggctgctaggac

SEQ ID NO: 7694460 - DNA, 22 bp, Homo sapiens
tcagttcttgggctgctaggac

SEQ ID NO: 7694461 - DNA, 22 bp, Homo sapiens
tcagttctttatttcacagtga

SEQ ID NO: 7694462 - DNA, 22 bp, Homo sapiens
tcagttctttatttcacagtga

SEQ ID NO: 7694463 - DNA, 22 bp, Homo sapiens
tcagttctttatttcacagtga

SEQ ID NO: 7694464 - DNA, 22 bp, Homo sapiens
tcagttctttatttcacagtga

SEQ ID NO: 7694465 - DNA, 21 bp, Homo sapiens
tcagttgccaaagtgatgtca

SEQ ID NO: 7694466 - DNA, 22 bp, Homo sapiens
tcagttgcatattttgtgttct

SEQ ID NO: 7694467 - DNA, 22 bp, Homo sapiens
tcagttgcatattttgtgttct

SEQ ID NO: 7694468 - DNA, 22 bp, Homo sapiens
tcagttgcatgggaagttcaga

SEQ ID NO: 7694469 - DNA, 22 bp, Homo sapiens
tcagttgcatgggaagttcaga

SEQ ID NO: 7694470 - DNA, 22 bp, Homo sapiens
tcagttctttatttcacagtga

SEQ ID NO: 7694471 - DNA, 22 bp, Homo sapiens
tcagttgcacctgcatggtact

SEQ ID NO: 7694472 - DNA, 22 bp, Homo sapiens
tcagttgctatgagaaataaat

SEQ ID NO: 7694473 - DNA, 22 bp, Homo sapiens
tcagttgctgtgtaatgttttc

SEQ ID NO: 7694474 - DNA, 22 bp, Homo sapiens
tcagttgctgtgtaatgttttc

SEQ ID NO: 7694475 - DNA, 22 bp, Homo sapiens
tcagttgctagaagggggaacc

SEQ ID NO: 7694476 - DNA, 22 bp, Homo sapiens
tcagttgctaaatggtgtagtg

SEQ ID NO: 7694477 - DNA, 22 bp, Homo sapiens
tcagttgctagaagggggaacc

SEQ ID NO: 7694478 - DNA, 22 bp, Homo sapiens
tcagttgccagtattttatata

SEQ ID NO: 7694479 - DNA, 22 bp, Homo sapiens
tcagttgccagtattttatata

SEQ ID NO: 7694480 - DNA, 22 bp, Homo sapiens
tcagttgcctccatagtcatcc

SEQ ID NO: 7694481 - DNA, 22 bp, Homo sapiens
tcagttgcctccatagtcatcc

SEQ ID NO: 7694482 - DNA, 22 bp, Homo sapiens
tcagtttaagatgactaacaat

SEQ ID NO: 7694483 - DNA, 22 bp, Homo sapiens
tcagtttaagatgactaacaat

SEQ ID NO: 7694484 - DNA, 20 bp, Homo sapiens
tcagtttaaatcctggcttt

SEQ ID NO: 7694485 - DNA, 22 bp, Homo sapiens
tcagtttaagatgactaacaat

SEQ ID NO: 7694486 - DNA, 22 bp, Homo sapiens
tcagtttaagatgactaacaat

SEQ ID NO: 7694487 - DNA, 22 bp, Homo sapiens
catctttatttatatagacagg

SEQ ID NO: 7694488 - DNA, 22 bp, Homo sapiens
catctttatttatatagacagg

SEQ ID NO: 7694489 - DNA, 22 bp, Homo sapiens
catctttatttatatagacagg

SEQ ID NO: 7694490 - DNA, 22 bp, Homo sapiens
catctttagttattgaatatag

SEQ ID NO: 7694491 - DNA, 22 bp, Homo sapiens
catctttatttatatagacagg

SEQ ID NO: 7694492 - DNA, 22 bp, Homo sapiens
catctttatttatatagacagg

SEQ ID NO: 7694493 - DNA, 22 bp, Homo sapiens
catctttatttatatagacagg

SEQ ID NO: 7694494 - DNA, 22 bp, Homo sapiens
catctttatttatatagacagg

SEQ ID NO: 7694495 - DNA, 22 bp, Homo sapiens
catctttatttatatagacagg

SEQ ID NO: 7694496 - DNA, 22 bp, Homo sapiens
catctttatttatatagacagg

SEQ ID NO: 7694497 - DNA, 22 bp, Homo sapiens
catctttgaactctgtataaac

SEQ ID NO: 7694498 - DNA, 22 bp, Homo sapiens
catctttgagacagcattaccc

SEQ ID NO: 7694499 - DNA, 22 bp, Homo sapiens
catctttgaactctgtataaac

SEQ ID NO: 7694500 - DNA, 22 bp, Homo sapiens
catctttgagacagcattaccc

SEQ ID NO: 7694501 - DNA, 22 bp, Homo sapiens
catctttgagacagcattaccc

SEQ ID NO: 7694502 - DNA, 22 bp, Homo sapiens
catctttgcaccctcaaaacct

SEQ ID NO: 7694503 - DNA, 22 bp, Homo sapiens
catctttgaactctgtataaac

SEQ ID NO: 7694504 - DNA, 22 bp, Homo sapiens
catctttcttagaactttcagt

SEQ ID NO: 7694505 - DNA, 22 bp, Homo sapiens
catctttcttagaactttcagt

SEQ ID NO: 7694506 - DNA, 22 bp, Homo sapiens
catctttcagtttataagtctg

SEQ ID NO: 7694507 - DNA, 22 bp, Homo sapiens
catctttcagtttataagtctg

SEQ ID NO: 7694508 - DNA, 22 bp, Homo sapiens
catctttcagtttataagtctg

SEQ ID NO: 7694509 - DNA, 22 bp, Homo sapiens
catctttatttatatagacagg

SEQ ID NO: 7694510 - DNA, 22 bp, Homo sapiens
catctttaatttgtgacaacta

SEQ ID NO: 7694511 - DNA, 22 bp, Homo sapiens
catctttaatttgtgacaacta

SEQ ID NO: 7694512 - DNA, 22 bp, Homo sapiens
catctttaatttgtgacaacta

SEQ ID NO: 7694513 - DNA, 22 bp, Homo sapiens
catctttaacagaatggatttg

SEQ ID NO: 7694514 - DNA, 22 bp, Homo sapiens
catctttaacaatttacaatgt

SEQ ID NO: 7694515 - DNA, 22 bp, Homo sapiens
catctttaacagaatggatttg

SEQ ID NO: 7694516 - DNA, 22 bp, Homo sapiens
catctttaacagaatggatttg

SEQ ID NO: 7694517 - DNA, 22 bp, Homo sapiens
catctttagggaccattattct

SEQ ID NO: 7694518 - DNA, 22 bp, Homo sapiens
catctttagggaccattattct

SEQ ID NO: 7694519 - DNA, 22 bp, Homo sapiens
catctttagggaccattattct

SEQ ID NO: 7694520 - DNA, 22 bp, Homo sapiens
catctttagggaccattattct

SEQ ID NO: 7694521 - DNA, 22 bp, Homo sapiens
catctttagggaccattattct

SEQ ID NO: 7694522 - DNA, 22 bp, Homo sapiens
catctttagttattgaatatag

SEQ ID NO: 7694523 - DNA, 22 bp, Homo sapiens
catctttagttattgaatatag

SEQ ID NO: 7694524 - DNA, 22 bp, Homo sapiens
catctttagttattgaatatag

SEQ ID NO: 7694525 - DNA, 22 bp, Homo sapiens
catctttagggaccattattct

SEQ ID NO: 7694526 - DNA, 22 bp, Homo sapiens
catctttagtaggttctggaga

SEQ ID NO: 7694527 - DNA, 22 bp, Homo sapiens
catctttagttattgaatatag

SEQ ID NO: 7694528 - DNA, 22 bp, Homo sapiens
catctttagttattgaatatag

SEQ ID NO: 7694529 - DNA, 22 bp, Homo sapiens
catctttagttattgaatatag

SEQ ID NO: 7694530 - DNA, 22 bp, Homo sapiens
tccaggcacagagttggtcagt

SEQ ID NO: 7694531 - DNA, 22 bp, Homo sapiens
tccaggcacagagttggtcagt

SEQ ID NO: 7694532 - DNA, 22 bp, Homo sapiens
tccaggcaagggaggagcatgg

SEQ ID NO: 7694533 - DNA, 22 bp, Homo sapiens
tccaggcaagggaggagcatgg

SEQ ID NO: 7694534 - DNA, 22 bp, Homo sapiens
tccaggcaagggaggagcatgg

SEQ ID NO: 7694535 - DNA, 22 bp, Homo sapiens
tccaggcaagggaggagcatgg

SEQ ID NO: 7694536 - DNA, 22 bp, Homo sapiens
tccaggcaaggataataaacat

SEQ ID NO: 7694537 - DNA, 22 bp, Homo sapiens
tccaggcaaggataataaacat

SEQ ID NO: 7694538 - DNA, 22 bp, Homo sapiens
tccaggcaaagtgctgggctgc

SEQ ID NO: 7694539 - DNA, 22 bp, Homo sapiens
tccaggcaaagtgctgggctgc

SEQ ID NO: 7694540 - DNA, 22 bp, Homo sapiens
tccaggcaaagtgctgggctgc

SEQ ID NO: 7694541 - DNA, 22 bp, Homo sapiens
tccaggcaaagtgctgggctgc

SEQ ID NO: 7694542 - DNA, 22 bp, Homo sapiens
tccaggcaaagtgctgggctgc

SEQ ID NO: 7694543 - DNA, 22 bp, Homo sapiens
tccaggcaaagtgctgggctgc

SEQ ID NO: 7694544 - DNA, 22 bp, Homo sapiens
tccaggcaaagtgctgggctgc

SEQ ID NO: 7694545 - DNA, 22 bp, Homo sapiens
tccaggcaaagtgctgggctgc

SEQ ID NO: 7694546 - DNA, 22 bp, Homo sapiens
tccaggcaaagtgctgggctgc

SEQ ID NO: 7694547 - DNA, 22 bp, Homo sapiens
tccaggcaaagtgctgggctgc

SEQ ID NO: 7694548 - DNA, 22 bp, Homo sapiens
tccaggcaaagggactagcagg

SEQ ID NO: 7694549 - DNA, 22 bp, Homo sapiens
tccaggcaaagggactagcagg

SEQ ID NO: 7694550 - DNA, 22 bp, Homo sapiens
tccaggcaaagccttgtagacg

SEQ ID NO: 7694551 - DNA, 22 bp, Homo sapiens
tccaggcaaagccttgtagacg

SEQ ID NO: 7694552 - DNA, 22 bp, Homo sapiens
tccaggcaaagccttgtagacg

SEQ ID NO: 7694553 - DNA, 22 bp, Homo sapiens
tccaggcaaagccttgtagacg

SEQ ID NO: 7694554 - DNA, 22 bp, Homo sapiens
tccaggcaaaaggaactgcttg

SEQ ID NO: 7694555 - DNA, 22 bp, Homo sapiens
tccaggcaaaaggaactgcttg

SEQ ID NO: 7694556 - DNA, 22 bp, Homo sapiens
tccaggcaaaaggaactgcttg

SEQ ID NO: 7694557 - DNA, 22 bp, Homo sapiens
tccaggcaaaaggaactgcttg

SEQ ID NO: 7694558 - DNA, 22 bp, Homo sapiens
tccaggcaaaaaccaactacag

SEQ ID NO: 7694559 - DNA, 22 bp, Homo sapiens
tccaggcaaaaaccaactacag

SEQ ID NO: 7694560 - DNA, 22 bp, Homo sapiens
tccaggcaaaaaccaactacag

SEQ ID NO: 7694561 - DNA, 19 bp, Homo sapiens
catgtgcatgagcacagga

SEQ ID NO: 7694562 - DNA, 19 bp, Homo sapiens
catgtgcatgagcacagga

SEQ ID NO: 7694563 - DNA, 19 bp, Homo sapiens
catgtgcatgagcacagga

SEQ ID NO: 7694564 - DNA, 19 bp, Homo sapiens
catgtgcatgagcacagga

SEQ ID NO: 7694565 - DNA, 22 bp, Homo sapiens
catgtgcattggggccagggag

SEQ ID NO: 7694566 - DNA, 22 bp, Homo sapiens
catgtgcattggggccagggag

SEQ ID NO: 7694567 - DNA, 22 bp, Homo sapiens
catgtctttgttatgctcacca

SEQ ID NO: 7694568 - DNA, 22 bp, Homo sapiens
catgtctttctcatcacatcta

SEQ ID NO: 7694569 - DNA, 22 bp, Homo sapiens
catgtctttgttatgctcacca

SEQ ID NO: 7694570 - DNA, 22 bp, Homo sapiens
catgtctttgttatgctcacca

SEQ ID NO: 7694571 - DNA, 22 bp, Homo sapiens
catgtctttctcatcacatcta

SEQ ID NO: 7694572 - DNA, 22 bp, Homo sapiens
catgtgaattccaaagctaggt

SEQ ID NO: 7694573 - DNA, 22 bp, Homo sapiens
catgtgaattccaaagctaggt

SEQ ID NO: 7694574 - DNA, 22 bp, Homo sapiens
catgtgaattccaaagctaggt

SEQ ID NO: 7694575 - DNA, 22 bp, Homo sapiens
catgtgaattccaaagctaggt

SEQ ID NO: 7694576 - DNA, 22 bp, Homo sapiens
catgtcttatttatgcttctta

SEQ ID NO: 7694577 - DNA, 22 bp, Homo sapiens
catgtcttatttatgcttctta

SEQ ID NO: 7694578 - DNA, 22 bp, Homo sapiens
catgtcttatgcggaactttca

SEQ ID NO: 7694579 - DNA, 21 bp, Homo sapiens
catgtcttccacactgtagta

SEQ ID NO: 7694580 - DNA, 21 bp, Homo sapiens
catgtcttccacactgtagta

SEQ ID NO: 7694581 - DNA, 22 bp, Homo sapiens
catgtcttggcttaggcacaga

SEQ ID NO: 7694582 - DNA, 22 bp, Homo sapiens
catgtcttgccctgattagtag

SEQ ID NO: 7694583 - DNA, 22 bp, Homo sapiens
catgtcttccttgcacacacac

SEQ ID NO: 7694584 - DNA, 22 bp, Homo sapiens
catgtctttcaaaccacacagt

SEQ ID NO: 7694585 - DNA, 23 bp, Homo sapiens
catgtgcaggaactgtgcttttg

SEQ ID NO: 7694586 - DNA, 23 bp, Homo sapiens
catgtgcaggaactgtgcttttg

SEQ ID NO: 7694587 - DNA, 22 bp, Homo sapiens
catgtgcagggccaggcattgc

SEQ ID NO: 7694588 - DNA, 22 bp, Homo sapiens
catgtgcagggccaggcattgc

SEQ ID NO: 7694589 - DNA, 22 bp, Homo sapiens
catgtgcagggccaggcattgc

SEQ ID NO: 7694590 - DNA, 22 bp, Homo sapiens
catgtgcatccttaatctccct

SEQ ID NO: 7694591 - DNA, 22 bp, Homo sapiens
catgtgcatccttaatctccct

SEQ ID NO: 7694592 - DNA, 22 bp, Homo sapiens
catgtgcatccttaatctccct

SEQ ID NO: 7694593 - DNA, 22 bp, Homo sapiens
catgtgcagtgtaagacatgct

SEQ ID NO: 7694594 - DNA, 22 bp, Homo sapiens
catgtgcagtgtaagacatgct

SEQ ID NO: 7694595 - DNA, 22 bp, Homo sapiens
catgtgcagtgtaagacatgct

SEQ ID NO: 7694596 - DNA, 22 bp, Homo sapiens
catgtgacaggagcagctctaa

SEQ ID NO: 7694597 - DNA, 22 bp, Homo sapiens
catgtgagaaacagtgatgtcg

SEQ ID NO: 7694598 - DNA, 22 bp, Homo sapiens
catgtgaccgctgggtgagcga

SEQ ID NO: 7694599 - DNA, 22 bp, Homo sapiens
catgtgatatgaaaacatcttt

SEQ ID NO: 7694600 - DNA, 22 bp, Homo sapiens
catgtgatatgaaaacatcttt

SEQ ID NO: 7694601 - DNA, 22 bp, Homo sapiens
catgtgattacactaagaaggt

SEQ ID NO: 7694602 - DNA, 19 bp, Homo sapiens
catgtgcacatgtgaatgc

SEQ ID NO: 7694603 - DNA, 19 bp, Homo sapiens
catgtgcacatgtgaatgc

SEQ ID NO: 7694604 - DNA, 22 bp, Homo sapiens
catgtgcagacggtgggctgga

SEQ ID NO: 7694605 - DNA, 19 bp, Homo sapiens
catgtgcacatgtgaatgc

SEQ ID NO: 7694606 - DNA, 22 bp, Homo sapiens
catgtgcagacggtgggctgga

SEQ ID NO: 7694607 - DNA, 22 bp, Homo sapiens
catgtgcagactctgacaggct

SEQ ID NO: 7694608 - DNA, 22 bp, Homo sapiens
catgtgcagactctgacaggct

SEQ ID NO: 7694609 - DNA, 22 bp, Homo sapiens
catgtgcagactctgacaggct

SEQ ID NO: 7694610 - DNA, 22 bp, Homo sapiens
catgtcttaattggagcccaga

SEQ ID NO: 7694611 - DNA, 22 bp, Homo sapiens
catgtctgtgtacacatgcaca

SEQ ID NO: 7694612 - DNA, 22 bp, Homo sapiens
catgtctgggtatatgcatatg

SEQ ID NO: 7694613 - DNA, 22 bp, Homo sapiens
catgtctgggtatatgcatatg

SEQ ID NO: 7694614 - DNA, 23 bp, Homo sapiens
catgtctgctttcatgctacaac

SEQ ID NO: 7694615 - DNA, 22 bp, Homo sapiens
catgtcttatgcggaactttca

SEQ ID NO: 7694616 - DNA, 22 bp, Homo sapiens
catgtcttatatcctgtcttca

SEQ ID NO: 7694617 - DNA, 22 bp, Homo sapiens
catgtcttatatcctgtcttca

SEQ ID NO: 7694618 - DNA, 22 bp, Homo sapiens
catgtcttaggaaagcagagga

SEQ ID NO: 7694619 - DNA, 22 bp, Homo sapiens
catgtcttaattggagcccaga

SEQ ID NO: 7694620 - DNA, 22 bp, Homo sapiens
catgtctgccaatttggaagga

SEQ ID NO: 7694621 - DNA, 23 bp, Homo sapiens
catgtctgctttcatgctacaac

SEQ ID NO: 7694622 - DNA, 18 bp, Homo sapiens
catgtctgcgccacaagg

SEQ ID NO: 7694623 - DNA, 22 bp, Homo sapiens
catgtacatgcctactatcaat

SEQ ID NO: 7694624 - DNA, 22 bp, Homo sapiens
catgtacatgcctactatcaat

SEQ ID NO: 7694625 - DNA, 22 bp, Homo sapiens
catgtacatgcctactatcaat

SEQ ID NO: 7694626 - DNA, 22 bp, Homo sapiens
catgtacatgcctactatcaat

SEQ ID NO: 7694627 - DNA, 22 bp, Homo sapiens
catgtacatgcctactatcaat

SEQ ID NO: 7694628 - DNA, 22 bp, Homo sapiens
catgtacatgcctactatcaat

SEQ ID NO: 7694629 - DNA, 22 bp, Homo sapiens
tccagcccagctcctctcagaa

SEQ ID NO: 7694630 - DNA, 22 bp, Homo sapiens
tccagcccagctcctctcagaa

SEQ ID NO: 7694631 - DNA, 22 bp, Homo sapiens
tccagcccagctcctctcagaa

SEQ ID NO: 7694632 - DNA, 22 bp, Homo sapiens
tccagcccagctcctctcagaa

SEQ ID NO: 7694633 - DNA, 22 bp, Homo sapiens
tccagcccagctcctctcagaa

SEQ ID NO: 7694634 - DNA, 20 bp, Homo sapiens
tccagcccagcagcctgaca

SEQ ID NO: 7694635 - DNA, 20 bp, Homo sapiens
tccagcccagcagcctgaca

SEQ ID NO: 7694636 - DNA, 18 bp, Homo sapiens
tccagcccacattttctg

SEQ ID NO: 7694637 - DNA, 18 bp, Homo sapiens
tccagcccacattttctg

SEQ ID NO: 7694638 - DNA, 18 bp, Homo sapiens
tccagcccacattttctg

SEQ ID NO: 7694639 - DNA, 20 bp, Homo sapiens
tccagcccagcagcctgaca

SEQ ID NO: 7694640 - DNA, 20 bp, Homo sapiens
tccagcccagcagcctgaca

SEQ ID NO: 7694641 - DNA, 20 bp, Homo sapiens
tccagcccagcagcctgaca

SEQ ID NO: 7694642 - DNA, 22 bp, Homo sapiens
tccagccatgactcggacagtg

SEQ ID NO: 7694643 - DNA, 22 bp, Homo sapiens
tccagccatatcttgtagccct

SEQ ID NO: 7694644 - DNA, 21 bp, Homo sapiens
tccagccagtaaatgctcagc

SEQ ID NO: 7694645 - DNA, 21 bp, Homo sapiens
tccagccagtaaatgctcagc

SEQ ID NO: 7694646 - DNA, 22 bp, Homo sapiens
tccagccatgcatgacaatcac

SEQ ID NO: 7694647 - DNA, 22 bp, Homo sapiens
tccagccatgactcggacagtg

SEQ ID NO: 7694648 - DNA, 22 bp, Homo sapiens
tccagccattcattatgacacc

SEQ ID NO: 7694649 - DNA, 22 bp, Homo sapiens
tccagccattcattatgacacc

SEQ ID NO: 7694650 - DNA, 22 bp, Homo sapiens
tccagccattcattatgacacc

SEQ ID NO: 7694651 - DNA, 22 bp, Homo sapiens
tccagccatgcatgacaatcac

SEQ ID NO: 7694652 - DNA, 22 bp, Homo sapiens
tccagcccacacctgaagctgg

SEQ ID NO: 7694653 - DNA, 22 bp, Homo sapiens
tccagccattcattatgacacc

SEQ ID NO: 7694654 - DNA, 22 bp, Homo sapiens
tccagccattcattatgacacc

SEQ ID NO: 7694655 - DNA, 18 bp, Homo sapiens
tccagcccacattttctg

SEQ ID NO: 7694656 - DNA, 18 bp, Homo sapiens
tccagcccacattttctg

SEQ ID NO: 7694657 - DNA, 22 bp, Homo sapiens
tccagcccacacctgaagctgg

SEQ ID NO: 7694658 - DNA, 22 bp, Homo sapiens
tccagcccacacctgaagctgg

SEQ ID NO: 7694659 - DNA, 22 bp, Homo sapiens
tccagcccacacctgaagctgg

SEQ ID NO: 7694660 - DNA, 22 bp, Homo sapiens
tccagccaggatggcccaggga

SEQ ID NO: 7694661 - DNA, 22 bp, Homo sapiens
tccagccaggatggcccaggga

SEQ ID NO: 7694662 - DNA, 22 bp, Homo sapiens
tccagccaggatggcccaggga

SEQ ID NO: 7694663 - DNA, 22 bp, Homo sapiens
tccagccacttgcacagttaaa

SEQ ID NO: 7694664 - DNA, 21 bp, Homo sapiens
tccagccagtaaatgctcagc

SEQ ID NO: 7694665 - DNA, 22 bp, Homo sapiens
tccagccaggatggcccaggga

SEQ ID NO: 7694666 - DNA, 22 bp, Homo sapiens
tccagccaggatggcccaggga

SEQ ID NO: 7694667 - DNA, 22 bp, Homo sapiens
catggctttgttctgttagatg

SEQ ID NO: 7694668 - DNA, 22 bp, Homo sapiens
catggcttttttattctgaatg

SEQ ID NO: 7694669 - DNA, 22 bp, Homo sapiens
catggcttttagccctacatga

SEQ ID NO: 7694670 - DNA, 22 bp, Homo sapiens
catggcttttgcttttgcccat

SEQ ID NO: 7694671 - DNA, 22 bp, Homo sapiens
catggctttttagcatattcaa

SEQ ID NO: 7694672 - DNA, 22 bp, Homo sapiens
catgggagctatctccatcact

SEQ ID NO: 7694673 - DNA, 22 bp, Homo sapiens
tccagccacttgcacagttaaa

SEQ ID NO: 7694674 - DNA, 22 bp, Homo sapiens
catgcaaaggtcaagatcagga

SEQ ID NO: 7694675 - DNA, 22 bp, Homo sapiens
catgcaaaggtcaagatcagga

SEQ ID NO: 7694676 - DNA, 22 bp, Homo sapiens
catgcaaaggtcaagatcagga

SEQ ID NO: 7694677 - DNA, 22 bp, Homo sapiens
catgcaaaggtcaagatcagga

SEQ ID NO: 7694678 - DNA, 22 bp, Homo sapiens
catgcaaagcgttttgaccagc

SEQ ID NO: 7694679 - DNA, 22 bp, Homo sapiens
catgcaaagcgttttgaccagc

SEQ ID NO: 7694680 - DNA, 22 bp, Homo sapiens
catgcaaagcgttttgaccagc

SEQ ID NO: 7694681 - DNA, 22 bp, Homo sapiens
catgcaaagcgttttgaccagc

SEQ ID NO: 7694682 - DNA, 23 bp, Homo sapiens
catgcaaacactattgcatttgg

SEQ ID NO: 7694683 - DNA, 23 bp, Homo sapiens
catgcaaacactattgcatttgg

SEQ ID NO: 7694684 - DNA, 22 bp, Homo sapiens
catgcaatttacatgtgatgcc

SEQ ID NO: 7694685 - DNA, 22 bp, Homo sapiens
catgcaatttttggttctctat

SEQ ID NO: 7694686 - DNA, 22 bp, Homo sapiens
catgcaatttttggttctctat

SEQ ID NO: 7694687 - DNA, 22 bp, Homo sapiens
catgcaagaagatagattaaat

SEQ ID NO: 7694688 - DNA, 22 bp, Homo sapiens
catgcaagacaatctttaaaat

SEQ ID NO: 7694689 - DNA, 22 bp, Homo sapiens
catgcaaatgtgctaatctgaa

SEQ ID NO: 7694690 - DNA, 20 bp, Homo sapiens
catgcaacagattatttccc

SEQ ID NO: 7694691 - DNA, 20 bp, Homo sapiens
catgcaacagattatttccc

SEQ ID NO: 7694692 - DNA, 22 bp, Homo sapiens
catgcaaatgtgctaatctgaa

SEQ ID NO: 7694693 - DNA, 22 bp, Homo sapiens
catgcaaatggtggctaaatgg

SEQ ID NO: 7694694 - DNA, 22 bp, Homo sapiens
catgcaaatgtgctaatctgaa

SEQ ID NO: 7694695 - DNA, 22 bp, Homo sapiens
catgcaaatgtgctaatctgaa

SEQ ID NO: 7694696 - DNA, 22 bp, Homo sapiens
catgcaaatgtgctaatctgaa

SEQ ID NO: 7694697 - DNA, 22 bp, Homo sapiens
catgcaaatggtggctaaatgg

SEQ ID NO: 7694698 - DNA, 22 bp, Homo sapiens
catgcaaatggtggctaaatgg

SEQ ID NO: 7694699 - DNA, 22 bp, Homo sapiens
catgcaaatggtggctaaatgg

SEQ ID NO: 7694700 - DNA, 22 bp, Homo sapiens
catgcaaatggtggctaaatgg

SEQ ID NO: 7694701 - DNA, 22 bp, Homo sapiens
tcatttttagcgcgcaaaagtt

SEQ ID NO: 7694702 - DNA, 22 bp, Homo sapiens
tcatttttagcgcgcaaaagtt

SEQ ID NO: 7694703 - DNA, 22 bp, Homo sapiens
catgatttactaaaatttgttt

SEQ ID NO: 7694704 - DNA, 22 bp, Homo sapiens
catgatttactaaaatttgttt

SEQ ID NO: 7694705 - DNA, 22 bp, Homo sapiens
catgatttactaaaatttgttt

SEQ ID NO: 7694706 - DNA, 22 bp, Homo sapiens
catgattttgtcttgtgttaat

SEQ ID NO: 7694707 - DNA, 22 bp, Homo sapiens
catgattttgtcttgtgttaat

SEQ ID NO: 7694708 - DNA, 22 bp, Homo sapiens
catgattttgtcttgtgttaat

SEQ ID NO: 7694709 - DNA, 22 bp, Homo sapiens
catgcaaaatgtattttattag

SEQ ID NO: 7694710 - DNA, 23 bp, Homo sapiens
catgcaaacactattgcatttgg

SEQ ID NO: 7694711 - DNA, 23 bp, Homo sapiens
catgcaaacactattgcatttgg

SEQ ID NO: 7694712 - DNA, 23 bp, Homo sapiens
catgcaaacactattgcatttgg

SEQ ID NO: 7694713 - DNA, 23 bp, Homo sapiens
catgcaaacactattgcatttgg

SEQ ID NO: 7694714 - DNA, 22 bp, Homo sapiens
catgcaaacacgtaaacattca

SEQ ID NO: 7694715 - DNA, 22 bp, Homo sapiens
catgcaaacacgtaaacattca

SEQ ID NO: 7694716 - DNA, 22 bp, Homo sapiens
catgcaaacacgtaaacattca

SEQ ID NO: 7694717 - DNA, 22 bp, Homo sapiens
catgcaaaatgtattttattag

SEQ ID NO: 7694718 - DNA, 22 bp, Homo sapiens
catgcaaacacgtaaacattca

SEQ ID NO: 7694719 - DNA, 22 bp, Homo sapiens
catgcaaacacgtaaacattca

SEQ ID NO: 7694720 - DNA, 22 bp, Homo sapiens
catgcaaacacgtaaacattca

SEQ ID NO: 7694721 - DNA, 22 bp, Homo sapiens
catgcaaacacgtaaacattca

SEQ ID NO: 7694722 - DNA, 22 bp, Homo sapiens
tcattttcaagtttgaacagga

SEQ ID NO: 7694723 - DNA, 22 bp, Homo sapiens
tcattttcaagtttgaacagga

SEQ ID NO: 7694724 - DNA, 22 bp, Homo sapiens
tcattttcaagtttgaacagga

SEQ ID NO: 7694725 - DNA, 22 bp, Homo sapiens
tcattttcaagtttgaacagga

SEQ ID NO: 7694726 - DNA, 18 bp, Homo sapiens
tcatttgttttgcatgaa

SEQ ID NO: 7694727 - DNA, 22 bp, Homo sapiens
tcattttcacacataaatagca

SEQ ID NO: 7694728 - DNA, 22 bp, Homo sapiens
tcattttcacacataaatagca

SEQ ID NO: 7694729 - DNA, 22 bp, Homo sapiens
tcattttcacacataaatagca

SEQ ID NO: 7694730 - DNA, 22 bp, Homo sapiens
tcattttcacacataaatagca

SEQ ID NO: 7694731 - DNA, 22 bp, Homo sapiens
tcattttcccactgaagctgtc

SEQ ID NO: 7694732 - DNA, 22 bp, Homo sapiens
tcattttcacacataaatagca

SEQ ID NO: 7694733 - DNA, 22 bp, Homo sapiens
tcattttggggtttgtcatctt

SEQ ID NO: 7694734 - DNA, 22 bp, Homo sapiens
tcatttttagcgcgcaaaagtt

SEQ ID NO: 7694735 - DNA, 18 bp, Homo sapiens
tcattttgtctgcctttg

SEQ ID NO: 7694736 - DNA, 22 bp, Homo sapiens
tcatttttagcgcgcaaaagtt

SEQ ID NO: 7694737 - DNA, 22 bp, Homo sapiens
tcatttttagcgcgcaaaagtt

SEQ ID NO: 7694738 - DNA, 22 bp, Homo sapiens
tcattttggggtttgtcatctt

SEQ ID NO: 7694739 - DNA, 22 bp, Homo sapiens
tcattttggggtttgtcatctt

SEQ ID NO: 7694740 - DNA, 22 bp, Homo sapiens
tcattttgcctgccatttgagt

SEQ ID NO: 7694741 - DNA, 22 bp, Homo sapiens
tcattttggccatgatacagac

SEQ ID NO: 7694742 - DNA, 22 bp, Homo sapiens
tcattttggccatgatacagac

SEQ ID NO: 7694743 - DNA, 22 bp, Homo sapiens
tcattttggccatgatacagac

SEQ ID NO: 7694744 - DNA, 22 bp, Homo sapiens
tcattttgcctgccatttgagt

SEQ ID NO: 7694745 - DNA, 22 bp, Homo sapiens
tcattttgcctgccatttgagt

SEQ ID NO: 7694746 - DNA, 22 bp, Homo sapiens
tcattttcccactgaagctgtc

SEQ ID NO: 7694747 - DNA, 22 bp, Homo sapiens
tcattttgcctgccatttgagt

SEQ ID NO: 7694748 - DNA, 22 bp, Homo sapiens
tcattttgcctgccatttgagt

SEQ ID NO: 7694749 - DNA, 22 bp, Homo sapiens
catggcttactttcagggagta

SEQ ID NO: 7694750 - DNA, 22 bp, Homo sapiens
catggcttaccccaggagcagc

SEQ ID NO: 7694751 - DNA, 20 bp, Homo sapiens
catggctgtgagcccacagg

SEQ ID NO: 7694752 - DNA, 22 bp, Homo sapiens
catggcttaccccaggagcagc

SEQ ID NO: 7694753 - DNA, 22 bp, Homo sapiens
catggctggtgcacctctggga

SEQ ID NO: 7694754 - DNA, 20 bp, Homo sapiens
catggctgtgagcccacagg

SEQ ID NO: 7694755 - DNA, 20 bp, Homo sapiens
catggctgtgagcccacagg

SEQ ID NO: 7694756 - DNA, 20 bp, Homo sapiens
catggctgtgagcccacagg

SEQ ID NO: 7694757 - DNA, 22 bp, Homo sapiens
catggcttcgcgcgtccccgct

SEQ ID NO: 7694758 - DNA, 22 bp, Homo sapiens
catggcttcatgagggttttgc

SEQ ID NO: 7694759 - DNA, 22 bp, Homo sapiens
catggcttcgcgcgtccccgct

SEQ ID NO: 7694760 - DNA, 22 bp, Homo sapiens
catggcttcgtcacagagggca

SEQ ID NO: 7694761 - DNA, 22 bp, Homo sapiens
catggcttctaagtgataacgt

SEQ ID NO: 7694762 - DNA, 22 bp, Homo sapiens
catggcttactttcagggagta

SEQ ID NO: 7694763 - DNA, 22 bp, Homo sapiens
catggcttactttcagggagta

SEQ ID NO: 7694764 - DNA, 22 bp, Homo sapiens
catggcttagaagttccagccc

SEQ ID NO: 7694765 - DNA, 22 bp, Homo sapiens
catggcttagaagttccagccc

SEQ ID NO: 7694766 - DNA, 22 bp, Homo sapiens
catggcttcaaagcctttggca

SEQ ID NO: 7694767 - DNA, 22 bp, Homo sapiens
catggcttggagcaggatgaga

SEQ ID NO: 7694768 - DNA, 22 bp, Homo sapiens
catggcttgctagtggcccaag

SEQ ID NO: 7694769 - DNA, 22 bp, Homo sapiens
catggcttgctagtggcccaag

SEQ ID NO: 7694770 - DNA, 22 bp, Homo sapiens
catggcttctgatcaaggaact

SEQ ID NO: 7694771 - DNA, 22 bp, Homo sapiens
catggcttgcaagcataggaga

SEQ ID NO: 7694772 - DNA, 22 bp, Homo sapiens
catggcttgcaagcataggaga

SEQ ID NO: 7694773 - DNA, 22 bp, Homo sapiens
catggctttccagtcctccact

SEQ ID NO: 7694774 - DNA, 22 bp, Homo sapiens
catggcttgtaataaatttata

SEQ ID NO: 7694775 - DNA, 22 bp, Homo sapiens
catggcttgtcttgtcttctga

SEQ ID NO: 7694776 - DNA, 22 bp, Homo sapiens
catggcttgtcttgtcttctga

SEQ ID NO: 7694777 - DNA, 22 bp, Homo sapiens
catggctttccagtcctccact

SEQ ID NO: 7694778 - DNA, 22 bp, Homo sapiens
catggctttccctcaagagcaa

SEQ ID NO: 7694779 - DNA, 22 bp, Homo sapiens
catggctttgttcatataattt

SEQ ID NO: 7694780 - DNA, 19 bp, Homo sapiens
catggctgctgcttgggag

SEQ ID NO: 7694781 - DNA, 22 bp, Homo sapiens
catggctgcgagaagagtgggt

SEQ ID NO: 7694782 - DNA, 19 bp, Homo sapiens
catggctgctgcttgggag

SEQ ID NO: 7694783 - DNA, 22 bp, Homo sapiens
catggctgctggctcggtccct

SEQ ID NO: 7694784 - DNA, 22 bp, Homo sapiens
catggctgctggctcggtccct

SEQ ID NO: 7694785 - DNA, 22 bp, Homo sapiens
catggctggcacacagcaacca

SEQ ID NO: 7694786 - DNA, 19 bp, Homo sapiens
catggctgctgcttgggag

SEQ ID NO: 7694787 - DNA, 19 bp, Homo sapiens
catggctgctgcttgggag

SEQ ID NO: 7694788 - DNA, 19 bp, Homo sapiens
catggctgctgcttgggag

SEQ ID NO: 7694789 - DNA, 22 bp, Homo sapiens
catggctgcgagaagagtgggt

SEQ ID NO: 7694790 - DNA, 22 bp, Homo sapiens
catggctgcgagaagagtgggt

SEQ ID NO: 7694791 - DNA, 22 bp, Homo sapiens
catggctgcgagaagagtgggt

SEQ ID NO: 7694792 - DNA, 22 bp, Homo sapiens
catggctgcgagaagagtgggt

SEQ ID NO: 7694793 - DNA, 22 bp, Homo sapiens
catggctggtgcacctctggga

SEQ ID NO: 7694794 - DNA, 22 bp, Homo sapiens
catggctgggagacggctgagg

SEQ ID NO: 7694795 - DNA, 22 bp, Homo sapiens
catggctgggagacggctgagg

SEQ ID NO: 7694796 - DNA, 22 bp, Homo sapiens
catggctgggagacggctgagg

SEQ ID NO: 7694797 - DNA, 22 bp, Homo sapiens
catggctggtgcacctctggga

SEQ ID NO: 7694798 - DNA, 22 bp, Homo sapiens
catggctggtgcacctctggga

SEQ ID NO: 7694799 - DNA, 22 bp, Homo sapiens
catggctgggagacggctgagg

SEQ ID NO: 7694800 - DNA, 22 bp, Homo sapiens
catggctggtgcacctctggga

SEQ ID NO: 7694801 - DNA, 22 bp, Homo sapiens
catggctgggagacggctgagg

SEQ ID NO: 7694802 - DNA, 22 bp, Homo sapiens
catggctggccagtgggagtgg

SEQ ID NO: 7694803 - DNA, 22 bp, Homo sapiens
catggctggcacacagcaacca

SEQ ID NO: 7694804 - DNA, 22 bp, Homo sapiens
catggctggccagtgggagtgg

SEQ ID NO: 7694805 - DNA, 22 bp, Homo sapiens
catggctggccagtgggagtgg

SEQ ID NO: 7694806 - DNA, 22 bp, Homo sapiens
catggccaggcacgcgcatagc

SEQ ID NO: 7694807 - DNA, 22 bp, Homo sapiens
catggccagccctgaggttcag

SEQ ID NO: 7694808 - DNA, 22 bp, Homo sapiens
catggccaggcacgcgcatagc

SEQ ID NO: 7694809 - DNA, 22 bp, Homo sapiens
catggccaggcacgcgcatagc

SEQ ID NO: 7694810 - DNA, 22 bp, Homo sapiens
catggctgaacactcagtgact

SEQ ID NO: 7694811 - DNA, 22 bp, Homo sapiens
catggctgaacactcagtgact

SEQ ID NO: 7694812 - DNA, 22 bp, Homo sapiens
catggctgaacactcagtgact

SEQ ID NO: 7694813 - DNA, 22 bp, Homo sapiens
catggctgaggcagaggactga

SEQ ID NO: 7694814 - DNA, 22 bp, Homo sapiens
catggctgaggcagaggactga

SEQ ID NO: 7694815 - DNA, 22 bp, Homo sapiens
catggctgaggcagaggactga

SEQ ID NO: 7694816 - DNA, 22 bp, Homo sapiens
catggctgaggcagaggactga

SEQ ID NO: 7694817 - DNA, 22 bp, Homo sapiens
catggctgaggcagaggactga

SEQ ID NO: 7694818 - DNA, 22 bp, Homo sapiens
catggctgcattggaatgggtt

SEQ ID NO: 7694819 - DNA, 22 bp, Homo sapiens
catggctgcattggaatgggtt

SEQ ID NO: 7694820 - DNA, 23 bp, Homo sapiens
catggctgatttcaagctaccac

SEQ ID NO: 7694821 - DNA, 22 bp, Homo sapiens
catggctgaggcagaggactga

SEQ ID NO: 7694822 - DNA, 23 bp, Homo sapiens
catggctgatttcaagctaccac

SEQ ID NO: 7694823 - DNA, 22 bp, Homo sapiens
catggctgcctgtggacactgc

SEQ ID NO: 7694824 - DNA, 22 bp, Homo sapiens
catggctgcctgtggacactgc

SEQ ID NO: 7694825 - DNA, 22 bp, Homo sapiens
catggctgcgagaagagtgggt

SEQ ID NO: 7694826 - DNA, 22 bp, Homo sapiens
catggctgcgagaagagtgggt

SEQ ID NO: 7694827 - DNA, 19 bp, Homo sapiens
catggctgccccatatagc

SEQ ID NO: 7694828 - DNA, 22 bp, Homo sapiens
catggctgcgagaagagtgggt

SEQ ID NO: 7694829 - DNA, 22 bp, Homo sapiens
catggctgcgagaagagtgggt

SEQ ID NO: 7694830 - DNA, 22 bp, Homo sapiens
catgcacacacagttctaatta

SEQ ID NO: 7694831 - DNA, 22 bp, Homo sapiens
catgcacacacagttctaatta

SEQ ID NO: 7694832 - DNA, 22 bp, Homo sapiens
catggccagccctgaggttcag

SEQ ID NO: 7694833 - DNA, 22 bp, Homo sapiens
catggccagccctgaggttcag

SEQ ID NO: 7694834 - DNA, 22 bp, Homo sapiens
catgcacaagggatgatgaaat

SEQ ID NO: 7694835 - DNA, 22 bp, Homo sapiens
catgcacaagggatgatgaaat

SEQ ID NO: 7694836 - DNA, 22 bp, Homo sapiens
catgcacaagggatgatgaaat

SEQ ID NO: 7694837 - DNA, 22 bp, Homo sapiens
catgcacaacatactcaagagg

SEQ ID NO: 7694838 - DNA, 22 bp, Homo sapiens
catgcacaagggatgatgaaat

SEQ ID NO: 7694839 - DNA, 22 bp, Homo sapiens
catgcacaagggatgatgaaat

SEQ ID NO: 7694840 - DNA, 22 bp, Homo sapiens
catgcacaacatactcaagagg

SEQ ID NO: 7694841 - DNA, 22 bp, Homo sapiens
catgcacaacatactcaagagg

SEQ ID NO: 7694842 - DNA, 22 bp, Homo sapiens
catgcacaaaggtaagatgcgt

SEQ ID NO: 7694843 - DNA, 22 bp, Homo sapiens
catgcacaaaggtaagatgcgt

SEQ ID NO: 7694844 - DNA, 22 bp, Homo sapiens
catgcacaaaggtaagatgcgt

SEQ ID NO: 7694845 - DNA, 22 bp, Homo sapiens
catgcacaaaggtaagatgcgt

SEQ ID NO: 7694846 - DNA, 22 bp, Homo sapiens
catgcacaaaggtaagatgcgt

SEQ ID NO: 7694847 - DNA, 22 bp, Homo sapiens
catgcaattttttcttgtcagt

SEQ ID NO: 7694848 - DNA, 22 bp, Homo sapiens
catgcaatcagaatctttaagg

SEQ ID NO: 7694849 - DNA, 22 bp, Homo sapiens
catgcacaaaggtaagatgcgt

SEQ ID NO: 7694850 - DNA, 22 bp, Homo sapiens
catgcacaaaggtaagatgcgt

SEQ ID NO: 7694851 - DNA, 22 bp, Homo sapiens
tcagaagtccccagtcaaggag

SEQ ID NO: 7694852 - DNA, 22 bp, Homo sapiens
tcagaagtcccttgcatcttag

SEQ ID NO: 7694853 - DNA, 22 bp, Homo sapiens
tcagaagtctggactgcttctc

SEQ ID NO: 7694854 - DNA, 22 bp, Homo sapiens
cagtttatatgagggtatcaag

SEQ ID NO: 7694855 - DNA, 22 bp, Homo sapiens
cagtttatatgagggtatcaag

SEQ ID NO: 7694856 - DNA, 22 bp, Homo sapiens
cagtttatatgagggtatcaag

SEQ ID NO: 7694857 - DNA, 22 bp, Homo sapiens
tcagaagtctggactgcttctc

SEQ ID NO: 7694858 - DNA, 22 bp, Homo sapiens
tcagaagtccaattttcgcacc

SEQ ID NO: 7694859 - DNA, 22 bp, Homo sapiens
tcagaagtcccagaattcacat

SEQ ID NO: 7694860 - DNA, 22 bp, Homo sapiens
tcagaagtcccagaattcacat

SEQ ID NO: 7694861 - DNA, 22 bp, Homo sapiens
tcagaagtccccagtcaaggag

SEQ ID NO: 7694862 - DNA, 22 bp, Homo sapiens
tcagaagtccaataccatggga

SEQ ID NO: 7694863 - DNA, 22 bp, Homo sapiens
tcagaagtcacttaggaaaggg

SEQ ID NO: 7694864 - DNA, 22 bp, Homo sapiens
tcagaagtcatgctcagtctgt

SEQ ID NO: 7694865 - DNA, 22 bp, Homo sapiens
tcagaagtcacttaggaaaggg

SEQ ID NO: 7694866 - DNA, 22 bp, Homo sapiens
tcagaagtcatgctcagtctgt

SEQ ID NO: 7694867 - DNA, 22 bp, Homo sapiens
tcagaagtccaataccatggga

SEQ ID NO: 7694868 - DNA, 22 bp, Homo sapiens
tcagaagtattatgctaaagga

SEQ ID NO: 7694869 - DNA, 22 bp, Homo sapiens
tcagaagtcacttaggaaaggg

SEQ ID NO: 7694870 - DNA, 22 bp, Homo sapiens
tcagaagtattatgctaaagga

SEQ ID NO: 7694871 - DNA, 22 bp, Homo sapiens
tcagaagtaggagacattcttg

SEQ ID NO: 7694872 - DNA, 22 bp, Homo sapiens
tcagaagtaggagacattcttg

SEQ ID NO: 7694873 - DNA, 22 bp, Homo sapiens
tcagaaggtacagaagggaggt

SEQ ID NO: 7694874 - DNA, 22 bp, Homo sapiens
tcagaaggtacagaagggaggt

SEQ ID NO: 7694875 - DNA, 22 bp, Homo sapiens
tcagaaggtactgaagacatgg

SEQ ID NO: 7694876 - DNA, 22 bp, Homo sapiens
tcagaaggtactgaagacatgg

SEQ ID NO: 7694877 - DNA, 22 bp, Homo sapiens
tcagaagggaaacacaagtgac

SEQ ID NO: 7694878 - DNA, 20 bp, Homo sapiens
tcagaaggctccagagcaga

SEQ ID NO: 7694879 - DNA, 20 bp, Homo sapiens
tcagaaggctccagagcaga

SEQ ID NO: 7694880 - DNA, 22 bp, Homo sapiens
tcagaaggctttataccagtat

SEQ ID NO: 7694881 - DNA, 22 bp, Homo sapiens
tcagaagggaaacacaagtgac

SEQ ID NO: 7694882 - DNA, 22 bp, Homo sapiens
tcagaaggctttataccagtat

SEQ ID NO: 7694883 - DNA, 22 bp, Homo sapiens
tcagaagggaaacacaagtgac

SEQ ID NO: 7694884 - DNA, 22 bp, Homo sapiens
tcagaagtactgtgctacaata

SEQ ID NO: 7694885 - DNA, 22 bp, Homo sapiens
tcagaagtactgtgctacaata

SEQ ID NO: 7694886 - DNA, 22 bp, Homo sapiens
tcagaagtactgtgctacaata

SEQ ID NO: 7694887 - DNA, 22 bp, Homo sapiens
tcagaaggtttttagcaaagga

SEQ ID NO: 7694888 - DNA, 22 bp, Homo sapiens
tcagaagtaaggttctcccaag

SEQ ID NO: 7694889 - DNA, 23 bp, Homo sapiens
tcagaaggtgccactgacgcttt

SEQ ID NO: 7694890 - DNA, 22 bp, Homo sapiens
tcagaaggtggaggttgcagtg

SEQ ID NO: 7694891 - DNA, 22 bp, Homo sapiens
tcagaaggtggaggttgcagtg

SEQ ID NO: 7694892 - DNA, 22 bp, Homo sapiens
tcagaaggtttttagcaaagga

SEQ ID NO: 7694893 - DNA, 22 bp, Homo sapiens
tcagaaggtttttagcaaagga

SEQ ID NO: 7694894 - DNA, 22 bp, Homo sapiens
cagtttctgagccctgtcattt

SEQ ID NO: 7694895 - DNA, 22 bp, Homo sapiens
cagtttctgaggttccaggttt

SEQ ID NO: 7694896 - DNA, 22 bp, Homo sapiens
cagtttctgagccctgtcattt

SEQ ID NO: 7694897 - DNA, 22 bp, Homo sapiens
cagtttctgagccctgtcattt

SEQ ID NO: 7694898 - DNA, 22 bp, Homo sapiens
cagtttctgagccctgtcattt

SEQ ID NO: 7694899 - DNA, 22 bp, Homo sapiens
cagtttctctcatacatatttg

SEQ ID NO: 7694900 - DNA, 22 bp, Homo sapiens
cagtttctctcatacatatttg

SEQ ID NO: 7694901 - DNA, 22 bp, Homo sapiens
cagtttctctcatacatatttg

SEQ ID NO: 7694902 - DNA, 22 bp, Homo sapiens
cagtttctctcatacatatttg

SEQ ID NO: 7694903 - DNA, 22 bp, Homo sapiens
cagtttctctcatacatatttg

SEQ ID NO: 7694904 - DNA, 22 bp, Homo sapiens
cagtttatatgtcagagctgta

SEQ ID NO: 7694905 - DNA, 22 bp, Homo sapiens
cagtttatatgtcagagctgta

SEQ ID NO: 7694906 - DNA, 22 bp, Homo sapiens
cagtttatatgtcagagctgta

SEQ ID NO: 7694907 - DNA, 22 bp, Homo sapiens
cagtttatatgtcagagctgta

SEQ ID NO: 7694908 - DNA, 22 bp, Homo sapiens
cagtttatatgtcagagctgta

SEQ ID NO: 7694909 - DNA, 22 bp, Homo sapiens
cagtttctgggaggaaaggaag

SEQ ID NO: 7694910 - DNA, 15 bp, Homo sapiens
cagtttctgcttgaa

SEQ ID NO: 7694911 - DNA, 22 bp, Homo sapiens
cagtttctgggcgttcacaggt

SEQ ID NO: 7694912 - DNA, 22 bp, Homo sapiens
cagtttctgggcgttcacaggt

SEQ ID NO: 7694913 - DNA, 22 bp, Homo sapiens
cagtttctgggaggaaaggaag

SEQ ID NO: 7694914 - DNA, 22 bp, Homo sapiens
cagtttctgggcgttcacaggt

SEQ ID NO: 7694915 - DNA, 22 bp, Homo sapiens
cagtttctgaggttccaggttt

SEQ ID NO: 7694916 - DNA, 22 bp, Homo sapiens
cagtttctgccaggatgtgtta

SEQ ID NO: 7694917 - DNA, 15 bp, Homo sapiens
cagtttctgatcatc

SEQ ID NO: 7694918 - DNA, 22 bp, Homo sapiens
cagtttctgccaggatgtgtta

SEQ ID NO: 7694919 - DNA, 22 bp, Homo sapiens
cagtttctgccaggatgtgtta

SEQ ID NO: 7694920 - DNA, 22 bp, Homo sapiens
cagtttctgccaggatgtgtta

SEQ ID NO: 7694921 - DNA, 22 bp, Homo sapiens
cagtttctgggcgttcacaggt

SEQ ID NO: 7694922 - DNA, 22 bp, Homo sapiens
cagtttctgtctgttcttatcc

SEQ ID NO: 7694923 - DNA, 22 bp, Homo sapiens
cagtttctgtctgttcttatcc

SEQ ID NO: 7694924 - DNA, 22 bp, Homo sapiens
cagtttctgggcgttcacaggt

SEQ ID NO: 7694925 - DNA, 22 bp, Homo sapiens
cagtttctgggcgttcacaggt

SEQ ID NO: 7694926 - DNA, 22 bp, Homo sapiens
cagtttctgggcgttcacaggt

SEQ ID NO: 7694927 - DNA, 22 bp, Homo sapiens
cagtttctgggcgttcacaggt

SEQ ID NO: 7694928 - DNA, 22 bp, Homo sapiens
cagtttctgtggtctcttttca

SEQ ID NO: 7694929 - DNA, 22 bp, Homo sapiens
cagtttctgtctgttcttatcc

SEQ ID NO: 7694930 - DNA, 22 bp, Homo sapiens
cagtttctgtggtctcttttca

SEQ ID NO: 7694931 - DNA, 22 bp, Homo sapiens
cagtttctgtggtctcttttca

SEQ ID NO: 7694932 - DNA, 22 bp, Homo sapiens
cagtttctgttttaaatagcag

SEQ ID NO: 7694933 - DNA, 22 bp, Homo sapiens
cagtttctgtggtctcttttca

SEQ ID NO: 7694934 - DNA, 22 bp, Homo sapiens
cagtttctgtggtctcttttca

SEQ ID NO: 7694935 - DNA, 22 bp, Homo sapiens
cagtttcttcaattcagacact

SEQ ID NO: 7694936 - DNA, 22 bp, Homo sapiens
cagtttcttcaattcagacact

SEQ ID NO: 7694937 - DNA, 22 bp, Homo sapiens
cagtttcttcaattcagacact

SEQ ID NO: 7694938 - DNA, 22 bp, Homo sapiens
cagtttcttcaattcagacact

SEQ ID NO: 7694939 - DNA, 22 bp, Homo sapiens
cagtttcttcaattcagacact

SEQ ID NO: 7694940 - DNA, 22 bp, Homo sapiens
cagtttcttcatcagttaagca

SEQ ID NO: 7694941 - DNA, 22 bp, Homo sapiens
cagtttcttcatcagttaagca

SEQ ID NO: 7694942 - DNA, 22 bp, Homo sapiens
cagtttcttcatctgcagaatc

SEQ ID NO: 7694943 - DNA, 22 bp, Homo sapiens
cagtttcttcatctgcagaatc

SEQ ID NO: 7694944 - DNA, 22 bp, Homo sapiens
cagtttcttcatctgcagaatc

SEQ ID NO: 7694945 - DNA, 22 bp, Homo sapiens
cagtttcttcatcagttaagca

SEQ ID NO: 7694946 - DNA, 22 bp, Homo sapiens
cagtttcttcatcagttaagca

SEQ ID NO: 7694947 - DNA, 22 bp, Homo sapiens
cagtttcttctattttgaacta

SEQ ID NO: 7694948 - DNA, 22 bp, Homo sapiens
cagtttcttcctcccccagaga

SEQ ID NO: 7694949 - DNA, 22 bp, Homo sapiens
cagtttcttcctcccccagaga

SEQ ID NO: 7694950 - DNA, 17 bp, Homo sapiens
cagtttcttccccctct

SEQ ID NO: 7694951 - DNA, 22 bp, Homo sapiens
cagtttcttcatctgcagaatc

SEQ ID NO: 7694952 - DNA, 22 bp, Homo sapiens
cagtttctgttttaaatagcag

SEQ ID NO: 7694953 - DNA, 22 bp, Homo sapiens
cagtttctgttttaaatagcag

SEQ ID NO: 7694954 - DNA, 22 bp, Homo sapiens
cagtttctgttttaaatagcag

SEQ ID NO: 7694955 - DNA, 22 bp, Homo sapiens
cagtttctgttttaaatagcag

SEQ ID NO: 7694956 - DNA, 22 bp, Homo sapiens
cagtttctgttttaaatagcag

SEQ ID NO: 7694957 - DNA, 22 bp, Homo sapiens
cagtttcttagtgacacaaatc

SEQ ID NO: 7694958 - DNA, 22 bp, Homo sapiens
cagtttcttaagactgagatct

SEQ ID NO: 7694959 - DNA, 22 bp, Homo sapiens
cagtttcttaagactgagatct

SEQ ID NO: 7694960 - DNA, 22 bp, Homo sapiens
cagtttcttatcttcaaaattg

SEQ ID NO: 7694961 - DNA, 22 bp, Homo sapiens
cagtttcttatcttcaaaattg

SEQ ID NO: 7694962 - DNA, 22 bp, Homo sapiens
cagtttcttatcttcaaaattg

SEQ ID NO: 7694963 - DNA, 22 bp, Homo sapiens
cagtttcttatcttcaaaattg

SEQ ID NO: 7694964 - DNA, 22 bp, Homo sapiens
cagtttcttatcttcaaaattg

SEQ ID NO: 7694965 - DNA, 22 bp, Homo sapiens
cagtttcttatcttcaaaattg

SEQ ID NO: 7694966 - DNA, 22 bp, Homo sapiens
cagtttcttagtgacacaaatc

SEQ ID NO: 7694967 - DNA, 22 bp, Homo sapiens
cagtttcttagtgacacaaatc

SEQ ID NO: 7694968 - DNA, 22 bp, Homo sapiens
cagtttcttagtgacacaaatc

SEQ ID NO: 7694969 - DNA, 22 bp, Homo sapiens
cagtttcttagtgacacaaatc

SEQ ID NO: 7694970 - DNA, 22 bp, Homo sapiens
cagtttcttctattttgaacta

SEQ ID NO: 7694971 - DNA, 22 bp, Homo sapiens
cagtttcttctattttgaacta

SEQ ID NO: 7694972 - DNA, 22 bp, Homo sapiens
cagtttcttggatgccaatttc

SEQ ID NO: 7694973 - DNA, 22 bp, Homo sapiens
cagtttcttctattttgaacta

SEQ ID NO: 7694974 - DNA, 22 bp, Homo sapiens
cagtttcttggatgccaatttc

SEQ ID NO: 7694975 - DNA, 22 bp, Homo sapiens
cagtttcttggatgccaatttc

SEQ ID NO: 7694976 - DNA, 22 bp, Homo sapiens
cagtttctttccattgttacct

SEQ ID NO: 7694977 - DNA, 22 bp, Homo sapiens
cagtttgcataacaagagattc

SEQ ID NO: 7694978 - DNA, 22 bp, Homo sapiens
cagtttctttccattgttacct

SEQ ID NO: 7694979 - DNA, 22 bp, Homo sapiens
cagtttctttccattgttacct

SEQ ID NO: 7694980 - DNA, 22 bp, Homo sapiens
cagtttctttccattgttacct

SEQ ID NO: 7694981 - DNA, 22 bp, Homo sapiens
cagtttggtacatagttcaaaa

SEQ ID NO: 7694982 - DNA, 17 bp, Homo sapiens
cagtttggtggatataa

SEQ ID NO: 7694983 - DNA, 19 bp, Homo sapiens
cagtttgtccagaggggac

SEQ ID NO: 7694984 - DNA, 22 bp, Homo sapiens
cagtttgtatttattactcata

SEQ ID NO: 7694985 - DNA, 19 bp, Homo sapiens
cagtttgtccagaggggac

SEQ ID NO: 7694986 - DNA, 22 bp, Homo sapiens
cagtttggcagcaacatggcga

SEQ ID NO: 7694987 - DNA, 22 bp, Homo sapiens
cagtttgggctctgcctgtggc

SEQ ID NO: 7694988 - DNA, 22 bp, Homo sapiens
cagtttggcagcaacatggcga

SEQ ID NO: 7694989 - DNA, 22 bp, Homo sapiens
cagtttggggtcggagtcaggg

SEQ ID NO: 7694990 - DNA, 22 bp, Homo sapiens
cagtttggggtcggagtcaggg

SEQ ID NO: 7694991 - DNA, 22 bp, Homo sapiens
cagtttggtacttttctagcaa

SEQ ID NO: 7694992 - DNA, 22 bp, Homo sapiens
cagtttggtcatttgtcttgta

SEQ ID NO: 7694993 - DNA, 22 bp, Homo sapiens
tcagcagtggctctcatgcagt

SEQ ID NO: 7694994 - DNA, 22 bp, Homo sapiens
tcagcagtgggtcctgagggtg

SEQ ID NO: 7694995 - DNA, 22 bp, Homo sapiens
tcagcagtgggtcctgagggtg

SEQ ID NO: 7694996 - DNA, 22 bp, Homo sapiens
tcagcagtggctctcatgcagt

SEQ ID NO: 7694997 - DNA, 22 bp, Homo sapiens
tcagcagtggctctcatgcagt

SEQ ID NO: 7694998 - DNA, 22 bp, Homo sapiens
tcagcccaggaggttgagacta

SEQ ID NO: 7694999 - DNA, 22 bp, Homo sapiens
tcagcccaggaatgagccttct

SEQ ID NO: 7695000 - DNA, 22 bp, Homo sapiens
tcagcagtgagaattaatgttg

SEQ ID NO: 7695001 - DNA, 22 bp, Homo sapiens
tcagcagtgcagggtgaggcag

SEQ ID NO: 7695002 - DNA, 22 bp, Homo sapiens
tcagcagtgagaattaatgttg

SEQ ID NO: 7695003 - DNA, 22 bp, Homo sapiens
tcagcagtggctctcatgcagt

SEQ ID NO: 7695004 - DNA, 22 bp, Homo sapiens
tcagcagtggctctcatgcagt

SEQ ID NO: 7695005 - DNA, 22 bp, Homo sapiens
tcagcccagggacagaggcccc

SEQ ID NO: 7695006 - DNA, 22 bp, Homo sapiens
tcagcccagggacagaggcccc

SEQ ID NO: 7695007 - DNA, 20 bp, Homo sapiens
tcagcccagggtgagcatct

SEQ ID NO: 7695008 - DNA, 20 bp, Homo sapiens
tcagcccagggtgagcatct

SEQ ID NO: 7695009 - DNA, 22 bp, Homo sapiens
tcagcccaggtcacgtaatcaa

SEQ ID NO: 7695010 - DNA, 20 bp, Homo sapiens
tcagcccagggtgagcatct

SEQ ID NO: 7695011 - DNA, 20 bp, Homo sapiens
tcagcccagggtgagcatct

SEQ ID NO: 7695012 - DNA, 19 bp, Homo sapiens
tcagcccaggctgggaagc

SEQ ID NO: 7695013 - DNA, 19 bp, Homo sapiens
tcagcccaggctgggaagc

SEQ ID NO: 7695014 - DNA, 22 bp, Homo sapiens
catacatttatacacatctatg

SEQ ID NO: 7695015 - DNA, 22 bp, Homo sapiens
catacatttatacacatctatg

SEQ ID NO: 7695016 - DNA, 22 bp, Homo sapiens
catacatttatacacatctatg

SEQ ID NO: 7695017 - DNA, 22 bp, Homo sapiens
catacatttatacacatctatg

SEQ ID NO: 7695018 - DNA, 22 bp, Homo sapiens
catacattttgcatatttacca

SEQ ID NO: 7695019 - DNA, 22 bp, Homo sapiens
catacatttatacacatctatg

SEQ ID NO: 7695020 - DNA, 22 bp, Homo sapiens
catacattgctcattcagtatc

SEQ ID NO: 7695021 - DNA, 22 bp, Homo sapiens
catacattgctcattcagtatc

SEQ ID NO: 7695022 - DNA, 22 bp, Homo sapiens
catacattgctcattcagtatc

SEQ ID NO: 7695023 - DNA, 22 bp, Homo sapiens
catacattgctcattcagtatc

SEQ ID NO: 7695024 - DNA, 22 bp, Homo sapiens
catacattgctcattcagtatc

SEQ ID NO: 7695025 - DNA, 22 bp, Homo sapiens
catacattgaaggagaaaggaa

SEQ ID NO: 7695026 - DNA, 22 bp, Homo sapiens
catacattgaaggagaaaggaa

SEQ ID NO: 7695027 - DNA, 22 bp, Homo sapiens
catacattgaatttgcacgtgt

SEQ ID NO: 7695028 - DNA, 22 bp, Homo sapiens
catacattgaatttgcacgtgt

SEQ ID NO: 7695029 - DNA, 22 bp, Homo sapiens
catacattgaatttgcacgtgt

SEQ ID NO: 7695030 - DNA, 22 bp, Homo sapiens
catacattgctcattcagtatc

SEQ ID NO: 7695031 - DNA, 22 bp, Homo sapiens
catacattgctcattcagtatc

SEQ ID NO: 7695032 - DNA, 22 bp, Homo sapiens
catacattgctcattcagtatc

SEQ ID NO: 7695033 - DNA, 22 bp, Homo sapiens
tcagctgcataagtcaccttgc

SEQ ID NO: 7695034 - DNA, 22 bp, Homo sapiens
cataatttttttaagtcagaac

SEQ ID NO: 7695035 - DNA, 22 bp, Homo sapiens
cataatttttttaagtcagaac

SEQ ID NO: 7695036 - DNA, 22 bp, Homo sapiens
cataatttttttaagtcagaac

SEQ ID NO: 7695037 - DNA, 22 bp, Homo sapiens
cataatttttttaagtcagaac

SEQ ID NO: 7695038 - DNA, 22 bp, Homo sapiens
catacattacctaacttaatgc

SEQ ID NO: 7695039 - DNA, 22 bp, Homo sapiens
cataatttttttaagtcagaac

SEQ ID NO: 7695040 - DNA, 22 bp, Homo sapiens
tcagctgcagtttcacaagcac

SEQ ID NO: 7695041 - DNA, 22 bp, Homo sapiens
tcagctgcagtttcacaagcac

SEQ ID NO: 7695042 - DNA, 22 bp, Homo sapiens
tcagctgcagtttcacaagcac

SEQ ID NO: 7695043 - DNA, 22 bp, Homo sapiens
tcagctgcataacaaagtatga

SEQ ID NO: 7695044 - DNA, 22 bp, Homo sapiens
tcagctgcataacaaagtatga

SEQ ID NO: 7695045 - DNA, 22 bp, Homo sapiens
tcagctgcataagtcaccttgc

SEQ ID NO: 7695046 - DNA, 22 bp, Homo sapiens
tcagctgcataagtcaccttgc

SEQ ID NO: 7695047 - DNA, 22 bp, Homo sapiens
tcagctgcagcaggcaccattt

SEQ ID NO: 7695048 - DNA, 22 bp, Homo sapiens
tcagctgcagcaggcaccattt

SEQ ID NO: 7695049 - DNA, 22 bp, Homo sapiens
tcagctgcagcaggcaccattt

SEQ ID NO: 7695050 - DNA, 22 bp, Homo sapiens
tcagctgcagcaggcaccattt

SEQ ID NO: 7695051 - DNA, 22 bp, Homo sapiens
tcagctgcagcaggcaccattt

SEQ ID NO: 7695052 - DNA, 22 bp, Homo sapiens
tcagctgcagtttcacaagcac

SEQ ID NO: 7695053 - DNA, 22 bp, Homo sapiens
tcagctgcagtttcacaagcac

SEQ ID NO: 7695054 - DNA, 22 bp, Homo sapiens
tcagctgcagtttcacaagcac

SEQ ID NO: 7695055 - DNA, 22 bp, Homo sapiens
catacctttctcaagcacatgt

SEQ ID NO: 7695056 - DNA, 22 bp, Homo sapiens
cataccctgaagggagttgcca

SEQ ID NO: 7695057 - DNA, 22 bp, Homo sapiens
cataccctgtgccagagaaaac

SEQ ID NO: 7695058 - DNA, 17 bp, Homo sapiens
catacctgagagttata

SEQ ID NO: 7695059 - DNA, 17 bp, Homo sapiens
catacctgagagttata

SEQ ID NO: 7695060 - DNA, 22 bp, Homo sapiens
catacattttgcatatttacca

SEQ ID NO: 7695061 - DNA, 21 bp, Homo sapiens
cataccattctctaagcaaaa

SEQ ID NO: 7695062 - DNA, 22 bp, Homo sapiens
catacccatttgtttcaggagc

SEQ ID NO: 7695063 - DNA, 22 bp, Homo sapiens
cataccctcccctgtgtcacgt

SEQ ID NO: 7695064 - DNA, 22 bp, Homo sapiens
catacattttgcatatttacca

SEQ ID NO: 7695065 - DNA, 22 bp, Homo sapiens
catacattttgcatatttacca

SEQ ID NO: 7695066 - DNA, 22 bp, Homo sapiens
catacattttgcatatttacca

SEQ ID NO: 7695067 - DNA, 22 bp, Homo sapiens
catacattttgcatatttacca

SEQ ID NO: 7695068 - DNA, 22 bp, Homo sapiens
catacattttgcatatttacca

SEQ ID NO: 7695069 - DNA, 22 bp, Homo sapiens
catactgtaagtgcaaaagtgt

SEQ ID NO: 7695070 - DNA, 22 bp, Homo sapiens
catactgtaagtgcaaaagtgt

SEQ ID NO: 7695071 - DNA, 21 bp, Homo sapiens
catactcagtgtataacttct

SEQ ID NO: 7695072 - DNA, 21 bp, Homo sapiens
catactcagtgtataacttct

SEQ ID NO: 7695073 - DNA, 22 bp, Homo sapiens
catactaaactatccagttact

SEQ ID NO: 7695074 - DNA, 22 bp, Homo sapiens
catactattactaggagcagga

SEQ ID NO: 7695075 - DNA, 22 bp, Homo sapiens
catactaaactatccagttact

SEQ ID NO: 7695076 - DNA, 22 bp, Homo sapiens
catactcactgttgtatcttcg

SEQ ID NO: 7695077 - DNA, 22 bp, Homo sapiens
catactgtcagagcctgaaggg

SEQ ID NO: 7695078 - DNA, 22 bp, Homo sapiens
catactgtgaagcttactattt

SEQ ID NO: 7695079 - DNA, 22 bp, Homo sapiens
catacttactgtgtaccaggtg

SEQ ID NO: 7695080 - DNA, 22 bp, Homo sapiens
catactttctttttcacgcata

SEQ ID NO: 7695081 - DNA, 22 bp, Homo sapiens
catacttttgccctgacattct

SEQ ID NO: 7695082 - DNA, 22 bp, Homo sapiens
catacttttgccctgacattct

SEQ ID NO: 7695083 - DNA, 22 bp, Homo sapiens
catacttttgccctgacattct

SEQ ID NO: 7695084 - DNA, 22 bp, Homo sapiens
catactttgggataagagtgga

SEQ ID NO: 7695085 - DNA, 22 bp, Homo sapiens
catactttgggataagagtgga

SEQ ID NO: 7695086 - DNA, 22 bp, Homo sapiens
catactttgggataagagtgga

SEQ ID NO: 7695087 - DNA, 22 bp, Homo sapiens
catactttttagatctgccttc

SEQ ID NO: 7695088 - DNA, 22 bp, Homo sapiens
catacttttgccctgacattct

SEQ ID NO: 7695089 - DNA, 22 bp, Homo sapiens
catactttttagatctgccttc

SEQ ID NO: 7695090 - DNA, 22 bp, Homo sapiens
catactttttagatctgccttc

SEQ ID NO: 7695091 - DNA, 22 bp, Homo sapiens
catactttttagatctgccttc

SEQ ID NO: 7695092 - DNA, 22 bp, Homo sapiens
catagaaaagagtaggtaatgt

SEQ ID NO: 7695093 - DNA, 22 bp, Homo sapiens
catagaaaagagtaggtaatgt

SEQ ID NO: 7695094 - DNA, 22 bp, Homo sapiens
catagaaaagagtaggtaatgt

SEQ ID NO: 7695095 - DNA, 22 bp, Homo sapiens
catagaaaagagtaggtaatgt

SEQ ID NO: 7695096 - DNA, 22 bp, Homo sapiens
catagaaaagagtaggtaatgt

SEQ ID NO: 7695097 - DNA, 22 bp, Homo sapiens
catagaaaagagtaggtaatgt

SEQ ID NO: 7695098 - DNA, 22 bp, Homo sapiens
catagaaaagagtaggtaatgt

SEQ ID NO: 7695099 - DNA, 22 bp, Homo sapiens
tcaggaagtataatcagattca

SEQ ID NO: 7695100 - DNA, 22 bp, Homo sapiens
tcaggaagtataatcagattca

SEQ ID NO: 7695101 - DNA, 22 bp, Homo sapiens
tcagccctagaaagtctaagca

SEQ ID NO: 7695102 - DNA, 22 bp, Homo sapiens
tcagccctacattaggtaagcc

SEQ ID NO: 7695103 - DNA, 22 bp, Homo sapiens
tcagccctacattaggtaagcc

SEQ ID NO: 7695104 - DNA, 22 bp, Homo sapiens
tcagcccatcactcacgtatta

SEQ ID NO: 7695105 - DNA, 22 bp, Homo sapiens
tcagcccatcactcacgtatta

SEQ ID NO: 7695106 - DNA, 22 bp, Homo sapiens
tcagcccatcactcacgtatta

SEQ ID NO: 7695107 - DNA, 19 bp, Homo sapiens
tcagcccatcagactcaca

SEQ ID NO: 7695108 - DNA, 22 bp, Homo sapiens
tcagccccacggggtcagccaa

SEQ ID NO: 7695109 - DNA, 22 bp, Homo sapiens
tcagcccatcactcacgtatta

SEQ ID NO: 7695110 - DNA, 22 bp, Homo sapiens
tcagcccagttttatcatctgt

SEQ ID NO: 7695111 - DNA, 22 bp, Homo sapiens
tcagcccagttttatcatctgt

SEQ ID NO: 7695112 - DNA, 22 bp, Homo sapiens
tcagcccagttttatcatctgt

SEQ ID NO: 7695113 - DNA, 22 bp, Homo sapiens
tcagcccagttaagaacctgtt

SEQ ID NO: 7695114 - DNA, 21 bp, Homo sapiens
tcagcccaggtgtctttgccc

SEQ ID NO: 7695115 - DNA, 21 bp, Homo sapiens
tcagcccaggtgtctttgccc

SEQ ID NO: 7695116 - DNA, 21 bp, Homo sapiens
tcagcccaggtgtctttgccc

SEQ ID NO: 7695117 - DNA, 22 bp, Homo sapiens
tcagccctgaggacagaggcag

SEQ ID NO: 7695118 - DNA, 22 bp, Homo sapiens
tcagccctagcctcagtccagg

SEQ ID NO: 7695119 - DNA, 22 bp, Homo sapiens
tcagccctgaggacagaggcag

SEQ ID NO: 7695120 - DNA, 22 bp, Homo sapiens
tcagccctgaggacagaggcag

SEQ ID NO: 7695121 - DNA, 20 bp, Homo sapiens
tcagccctgagtccaggctg

SEQ ID NO: 7695122 - DNA, 22 bp, Homo sapiens
tcagccctagaaagtctaagca

SEQ ID NO: 7695123 - DNA, 22 bp, Homo sapiens
tcagccctagcctcagtccagg

SEQ ID NO: 7695124 - DNA, 22 bp, Homo sapiens
tcagccctagcctcagtccagg

SEQ ID NO: 7695125 - DNA, 22 bp, Homo sapiens
tcagccctagaaagtctaagca

SEQ ID NO: 7695126 - DNA, 22 bp, Homo sapiens
tcagcccgggttcgcaaacact

SEQ ID NO: 7695127 - DNA, 22 bp, Homo sapiens
tcagccctagaaagtctaagca

SEQ ID NO: 7695128 - DNA, 22 bp, Homo sapiens
tcagccctagaaagtctaagca

SEQ ID NO: 7695129 - DNA, 22 bp, Homo sapiens
tcagccctggcactgtctccca

SEQ ID NO: 7695130 - DNA, 22 bp, Homo sapiens
tcagccctggcactgtctccca

SEQ ID NO: 7695131 - DNA, 22 bp, Homo sapiens
tcagccctggcactgtctccca

SEQ ID NO: 7695132 - DNA, 20 bp, Homo sapiens
tcagccctgagtccaggctg

SEQ ID NO: 7695133 - DNA, 20 bp, Homo sapiens
tcagccctgagtccaggctg

SEQ ID NO: 7695134 - DNA, 22 bp, Homo sapiens
tcagccctgaggacagaggcag

SEQ ID NO: 7695135 - DNA, 20 bp, Homo sapiens
tcagccctgagtccaggctg

SEQ ID NO: 7695136 - DNA, 22 bp, Homo sapiens
tcagccctgggacccagggatg

SEQ ID NO: 7695137 - DNA, 22 bp, Homo sapiens
tcagccctggcactgtctccca

SEQ ID NO: 7695138 - DNA, 22 bp, Homo sapiens
tcagccctgggacccagggatg

SEQ ID NO: 7695139 - DNA, 22 bp, Homo sapiens
tcagccctggcactgtctccca

SEQ ID NO: 7695140 - DNA, 22 bp, Homo sapiens
tcagccctgggacccagggatg

SEQ ID NO: 7695141 - DNA, 22 bp, Homo sapiens
tcagctgagttctagagcactc

SEQ ID NO: 7695142 - DNA, 22 bp, Homo sapiens
tcagctgcactgttctgaccca

SEQ ID NO: 7695143 - DNA, 22 bp, Homo sapiens
tcagctgagttctagagcactc

SEQ ID NO: 7695144 - DNA, 22 bp, Homo sapiens
tcagctgcactgttctgaccca

SEQ ID NO: 7695145 - DNA, 22 bp, Homo sapiens
tcagctgcactgttctgaccca

SEQ ID NO: 7695146 - DNA, 22 bp, Homo sapiens
tcagctgcactgttctgaccca

SEQ ID NO: 7695147 - DNA, 22 bp, Homo sapiens
tcagctgaagtggagaagcaga

SEQ ID NO: 7695148 - DNA, 22 bp, Homo sapiens
tcagctgaagtggagaagcaga

SEQ ID NO: 7695149 - DNA, 22 bp, Homo sapiens
tcagctgagctccagctcatag

SEQ ID NO: 7695150 - DNA, 20 bp, Homo sapiens
tcagctcttagaggtcgctt

SEQ ID NO: 7695151 - DNA, 20 bp, Homo sapiens
tcagctcttagaggtcgctt

SEQ ID NO: 7695152 - DNA, 20 bp, Homo sapiens
tcagctcttagaggtcgctt

SEQ ID NO: 7695153 - DNA, 22 bp, Homo sapiens
tcagctcttccccccagccagg

SEQ ID NO: 7695154 - DNA, 22 bp, Homo sapiens
tcagctcttccccccagccagg

SEQ ID NO: 7695155 - DNA, 22 bp, Homo sapiens
tcagctcttaaccctctggcct

SEQ ID NO: 7695156 - DNA, 22 bp, Homo sapiens
tcagctcttaaccctctggcct

SEQ ID NO: 7695157 - DNA, 22 bp, Homo sapiens
tcagctcttaaccctctggcct

SEQ ID NO: 7695158 - DNA, 22 bp, Homo sapiens
tcagcccttcctggagctttta

SEQ ID NO: 7695159 - DNA, 19 bp, Homo sapiens
tcagctctggggtcagtgg

SEQ ID NO: 7695160 - DNA, 20 bp, Homo sapiens
tcagctctgtgcctgggatg

SEQ ID NO: 7695161 - DNA, 20 bp, Homo sapiens
tcagctctgtgcctgggatg

SEQ ID NO: 7695162 - DNA, 22 bp, Homo sapiens
tcagccctgggcttcctcatgg

SEQ ID NO: 7695163 - DNA, 22 bp, Homo sapiens
tcagccctgggcttcctcatgg

SEQ ID NO: 7695164 - DNA, 22 bp, Homo sapiens
tcagccctgggcttcctcatgg

SEQ ID NO: 7695165 - DNA, 22 bp, Homo sapiens
tcagccctgggcttcctcatgg

SEQ ID NO: 7695166 - DNA, 22 bp, Homo sapiens
tcagccctgggcttcctcatgg

SEQ ID NO: 7695167 - DNA, 22 bp, Homo sapiens
tcagccctgggcttcctcatgg

SEQ ID NO: 7695168 - DNA, 22 bp, Homo sapiens
tcagctctgttttgagtggaac

SEQ ID NO: 7695169 - DNA, 22 bp, Homo sapiens
tcagctcttaaccctctggcct

SEQ ID NO: 7695170 - DNA, 22 bp, Homo sapiens
tcagctctgttttgagtggaac

SEQ ID NO: 7695171 - DNA, 22 bp, Homo sapiens
tcagctctgtgtacagttagca

SEQ ID NO: 7695172 - DNA, 22 bp, Homo sapiens
tcagctctgtgtacagttagca

SEQ ID NO: 7695173 - DNA, 20 bp, Homo sapiens
tcagctctgtgcctgggatg

SEQ ID NO: 7695174 - DNA, 20 bp, Homo sapiens
tcagctctgtgcctgggatg

SEQ ID NO: 7695175 - DNA, 22 bp, Homo sapiens
catcacagtttgtcagaaatca

SEQ ID NO: 7695176 - DNA, 22 bp, Homo sapiens
catcacagtttgtcagaaatca

SEQ ID NO: 7695177 - DNA, 22 bp, Homo sapiens
catcacagtttgtcagaaatca

SEQ ID NO: 7695178 - DNA, 22 bp, Homo sapiens
catcacagtttgtcagaaatca

SEQ ID NO: 7695179 - DNA, 22 bp, Homo sapiens
catcacagtttgtcagaaatca

SEQ ID NO: 7695180 - DNA, 22 bp, Homo sapiens
catcacagtttgtcagaaatca

SEQ ID NO: 7695181 - DNA, 22 bp, Homo sapiens
catcacagtggctgtttattta

SEQ ID NO: 7695182 - DNA, 22 bp, Homo sapiens
catcacaggtcctgatgacatt

SEQ ID NO: 7695183 - DNA, 22 bp, Homo sapiens
catcacaggtcctgatgacatt

SEQ ID NO: 7695184 - DNA, 22 bp, Homo sapiens
catcacaggcattttgagtgtc

SEQ ID NO: 7695185 - DNA, 22 bp, Homo sapiens
catcacaggcattttgagtgtc

SEQ ID NO: 7695186 - DNA, 22 bp, Homo sapiens
catcacagggggctagaagtct

SEQ ID NO: 7695187 - DNA, 22 bp, Homo sapiens
catcacagggggctagaagtct

SEQ ID NO: 7695188 - DNA, 22 bp, Homo sapiens
catcacaggtcctgatgacatt

SEQ ID NO: 7695189 - DNA, 22 bp, Homo sapiens
catcacaggtcctgatgacatt

SEQ ID NO: 7695190 - DNA, 22 bp, Homo sapiens
catcacaggtcctgatgacatt

SEQ ID NO: 7695191 - DNA, 22 bp, Homo sapiens
catcacaggtcctgatgacatt

SEQ ID NO: 7695192 - DNA, 22 bp, Homo sapiens
catcacaggtcctgatgacatt

SEQ ID NO: 7695193 - DNA, 22 bp, Homo sapiens
catcacatctactataagtgat

SEQ ID NO: 7695194 - DNA, 22 bp, Homo sapiens
catcacatctactataagtgat

SEQ ID NO: 7695195 - DNA, 22 bp, Homo sapiens
catcacatcagtgtgaacagtt

SEQ ID NO: 7695196 - DNA, 22 bp, Homo sapiens
catcacatcagtgtgaacagtt

SEQ ID NO: 7695197 - DNA, 22 bp, Homo sapiens
catcacatcagtgtgaacagtt

SEQ ID NO: 7695198 - DNA, 22 bp, Homo sapiens
catcacatgcctatcatgagct

SEQ ID NO: 7695199 - DNA, 22 bp, Homo sapiens
catcacatgcctatcatgagct

SEQ ID NO: 7695200 - DNA, 22 bp, Homo sapiens
catcacatgcctatcatgagct

SEQ ID NO: 7695201 - DNA, 22 bp, Homo sapiens
catcacatgcctatcatgagct

SEQ ID NO: 7695202 - DNA, 22 bp, Homo sapiens
catcacatgcctatcatgagct

SEQ ID NO: 7695203 - DNA, 19 bp, Homo sapiens
catcacatggtctgatgaa

SEQ ID NO: 7695204 - DNA, 19 bp, Homo sapiens
catcacatggtctgatgaa

SEQ ID NO: 7695205 - DNA, 22 bp, Homo sapiens
catcacatgtaggcagcatcac

SEQ ID NO: 7695206 - DNA, 22 bp, Homo sapiens
catcacatgtaggcagcatcac

SEQ ID NO: 7695207 - DNA, 22 bp, Homo sapiens
catcatctggcttttagaaaaa

SEQ ID NO: 7695208 - DNA, 22 bp, Homo sapiens
catcatctctcccccaggcctg

SEQ ID NO: 7695209 - DNA, 22 bp, Homo sapiens
catcacatgtaggcagcatcac

SEQ ID NO: 7695210 - DNA, 21 bp, Homo sapiens
catcacattactcaaagtcct

SEQ ID NO: 7695211 - DNA, 21 bp, Homo sapiens
catcacattactcaaagtcct

SEQ ID NO: 7695212 - DNA, 22 bp, Homo sapiens
catccagggcagccatggcctg

SEQ ID NO: 7695213 - DNA, 22 bp, Homo sapiens
catccaggctggagtacagtgg

SEQ ID NO: 7695214 - DNA, 22 bp, Homo sapiens
catccaggctggagtacagtgg

SEQ ID NO: 7695215 - DNA, 22 bp, Homo sapiens
catccagtggtcagggaagttg

SEQ ID NO: 7695216 - DNA, 22 bp, Homo sapiens
catccatagattgagagatggt

SEQ ID NO: 7695217 - DNA, 22 bp, Homo sapiens
catccatagattgagagatggt

SEQ ID NO: 7695218 - DNA, 22 bp, Homo sapiens
catccagtgggacagagaaacc

SEQ ID NO: 7695219 - DNA, 22 bp, Homo sapiens
catccagggcagccatggcctg

SEQ ID NO: 7695220 - DNA, 22 bp, Homo sapiens
catccagcccacgataaagagg

SEQ ID NO: 7695221 - DNA, 22 bp, Homo sapiens
catccagctcctgggggccacc

SEQ ID NO: 7695222 - DNA, 23 bp, Homo sapiens
catccaggagctgagtctgactg

SEQ ID NO: 7695223 - DNA, 23 bp, Homo sapiens
catccaggagctgagtctgactg

SEQ ID NO: 7695224 - DNA, 23 bp, Homo sapiens
catccaggagctgagtctgactg

SEQ ID NO: 7695225 - DNA, 22 bp, Homo sapiens
catccaggcaccacaaccagct

SEQ ID NO: 7695226 - DNA, 22 bp, Homo sapiens
catccaggctgaagtgcagtgg

SEQ ID NO: 7695227 - DNA, 22 bp, Homo sapiens
catccaggctgaagtgcagtgg

SEQ ID NO: 7695228 - DNA, 22 bp, Homo sapiens
catccaccgcgtgcacctctac

SEQ ID NO: 7695229 - DNA, 22 bp, Homo sapiens
catccactagaatgacagagtt

SEQ ID NO: 7695230 - DNA, 22 bp, Homo sapiens
catccagaccgtgccatgctgc

SEQ ID NO: 7695231 - DNA, 22 bp, Homo sapiens
catccagaccgtgccatgctgc

SEQ ID NO: 7695232 - DNA, 22 bp, Homo sapiens
catccagaccgtgccatgctgc

SEQ ID NO: 7695233 - DNA, 22 bp, Homo sapiens
catccagaccgtgccatgctgc

SEQ ID NO: 7695234 - DNA, 22 bp, Homo sapiens
catccagaccgtgccatgctgc

SEQ ID NO: 7695235 - DNA, 22 bp, Homo sapiens
catccagagtccaaggctgggc

SEQ ID NO: 7695236 - DNA, 22 bp, Homo sapiens
catccactagaatgacagagtt

SEQ ID NO: 7695237 - DNA, 22 bp, Homo sapiens
catccagctcctgggggccacc

SEQ ID NO: 7695238 - DNA, 22 bp, Homo sapiens
catccagagtccaaggctgggc

SEQ ID NO: 7695239 - DNA, 22 bp, Homo sapiens
catccagcccacgataaagagg

SEQ ID NO: 7695240 - DNA, 22 bp, Homo sapiens
catccagagtccaaggctgggc

SEQ ID NO: 7695241 - DNA, 22 bp, Homo sapiens
catccaatgtcctattaagact

SEQ ID NO: 7695242 - DNA, 22 bp, Homo sapiens
catccactagaatgacagagtt

SEQ ID NO: 7695243 - DNA, 22 bp, Homo sapiens
catcatgaagatgagaaagcat

SEQ ID NO: 7695244 - DNA, 22 bp, Homo sapiens
catcatgaagatgagaaagcat

SEQ ID NO: 7695245 - DNA, 22 bp, Homo sapiens
catccaatgtcctattaagact

SEQ ID NO: 7695246 - DNA, 22 bp, Homo sapiens
catcatcttgaatgactgtgat

SEQ ID NO: 7695247 - DNA, 22 bp, Homo sapiens
catcatctgtgctggagagcct

SEQ ID NO: 7695248 - DNA, 22 bp, Homo sapiens
catcatctggcttttagaaaaa

SEQ ID NO: 7695249 - DNA, 22 bp, Homo sapiens
catcatctggcttttagaaaaa

SEQ ID NO: 7695250 - DNA, 22 bp, Homo sapiens
catcatctggcttttagaaaaa

SEQ ID NO: 7695251 - DNA, 22 bp, Homo sapiens
catatggacaagaacatttatg

SEQ ID NO: 7695252 - DNA, 23 bp, Homo sapiens
catatgaattttagaggcagttt

SEQ ID NO: 7695253 - DNA, 22 bp, Homo sapiens
catatgtactgtttgctttcaa

SEQ ID NO: 7695254 - DNA, 22 bp, Homo sapiens
catatgtactgtttgctttcaa

SEQ ID NO: 7695255 - DNA, 22 bp, Homo sapiens
tcagggattgcaaaattcatcc

SEQ ID NO: 7695256 - DNA, 22 bp, Homo sapiens
tcagggattgcaaaattcatcc

SEQ ID NO: 7695257 - DNA, 22 bp, Homo sapiens
catatgtatttctcataattag

SEQ ID NO: 7695258 - DNA, 22 bp, Homo sapiens
catatgtatttctcataattag

SEQ ID NO: 7695259 - DNA, 22 bp, Homo sapiens
tcagggcatggctgcacttggc

SEQ ID NO: 7695260 - DNA, 22 bp, Homo sapiens
tcagggcatggctgcacttggc

SEQ ID NO: 7695261 - DNA, 22 bp, Homo sapiens
tcagggattgcaaaattcatcc

SEQ ID NO: 7695262 - DNA, 20 bp, Homo sapiens
tcagggcatgggacagcccc

SEQ ID NO: 7695263 - DNA, 22 bp, Homo sapiens
tcagggcatggctgcacttggc

SEQ ID NO: 7695264 - DNA, 22 bp, Homo sapiens
tcagggcatggctgcacttggc

SEQ ID NO: 7695265 - DNA, 22 bp, Homo sapiens
tcagggccacgcggaggtgacg

SEQ ID NO: 7695266 - DNA, 22 bp, Homo sapiens
tcagggccacgcggaggtgacg

SEQ ID NO: 7695267 - DNA, 22 bp, Homo sapiens
tcagggccacaacaccagagtc

SEQ ID NO: 7695268 - DNA, 22 bp, Homo sapiens
tcagggccacaacaccagagtc

SEQ ID NO: 7695269 - DNA, 22 bp, Homo sapiens
tcagggcattcaagaggcctgg

SEQ ID NO: 7695270 - DNA, 22 bp, Homo sapiens
tcagggcattcaagaggcctgg

SEQ ID NO: 7695271 - DNA, 22 bp, Homo sapiens
tcagggcattcaagaggcctgg

SEQ ID NO: 7695272 - DNA, 22 bp, Homo sapiens
tcagggcattcaagaggcctgg

SEQ ID NO: 7695273 - DNA, 22 bp, Homo sapiens
tcagggcattcaagaggcctgg

SEQ ID NO: 7695274 - DNA, 20 bp, Homo sapiens
tcagggcatgggacagcccc

SEQ ID NO: 7695275 - DNA, 22 bp, Homo sapiens
tcagggcatgtatgtttcttta

SEQ ID NO: 7695276 - DNA, 20 bp, Homo sapiens
tcagggcatgggacagcccc

SEQ ID NO: 7695277 - DNA, 20 bp, Homo sapiens
tcagggcatgggacagcccc

SEQ ID NO: 7695278 - DNA, 20 bp, Homo sapiens
tcagggcatgggacagcccc

SEQ ID NO: 7695279 - DNA, 20 bp, Homo sapiens
tcagggcatgggacagcccc

SEQ ID NO: 7695280 - DNA, 20 bp, Homo sapiens
tcagggcatgggacagcccc

SEQ ID NO: 7695281 - DNA, 20 bp, Homo sapiens
tcagggcatgggacagcccc

SEQ ID NO: 7695282 - DNA, 20 bp, Homo sapiens
tcagggcatgggacagcccc

SEQ ID NO: 7695283 - DNA, 19 bp, Homo sapiens
tcagggccatgagcgccac

SEQ ID NO: 7695284 - DNA, 19 bp, Homo sapiens
tcagggccatgagcgccac

SEQ ID NO: 7695285 - DNA, 22 bp, Homo sapiens
tcagggcccagagctcaggcaa

SEQ ID NO: 7695286 - DNA, 22 bp, Homo sapiens
tcagggcccagagctcaggcaa

SEQ ID NO: 7695287 - DNA, 22 bp, Homo sapiens
tcagggcccagagctcaggcaa

SEQ ID NO: 7695288 - DNA, 22 bp, Homo sapiens
tcagggccaggactaggatgag

SEQ ID NO: 7695289 - DNA, 22 bp, Homo sapiens
tcagggccacgcggaggtgacg

SEQ ID NO: 7695290 - DNA, 22 bp, Homo sapiens
tcagggccaggactaggatgag

SEQ ID NO: 7695291 - DNA, 22 bp, Homo sapiens
tcagggccatcttttgcctcaa

SEQ ID NO: 7695292 - DNA, 22 bp, Homo sapiens
tcagggccatcttttgcctcaa

SEQ ID NO: 7695293 - DNA, 22 bp, Homo sapiens
tcagggccatcttttgcctcaa

SEQ ID NO: 7695294 - DNA, 22 bp, Homo sapiens
tcagggccatcttttgcctcaa

SEQ ID NO: 7695295 - DNA, 22 bp, Homo sapiens
tcagggccatcttttgcctcaa

SEQ ID NO: 7695296 - DNA, 22 bp, Homo sapiens
catcacagatgttgtgtggagt

SEQ ID NO: 7695297 - DNA, 21 bp, Homo sapiens
catcacaggatgattttttca

SEQ ID NO: 7695298 - DNA, 21 bp, Homo sapiens
catcacaggatgattttttca

SEQ ID NO: 7695299 - DNA, 22 bp, Homo sapiens
catcacaggcattttgagtgtc

SEQ ID NO: 7695300 - DNA, 22 bp, Homo sapiens
catcacagaaataaacatacct

SEQ ID NO: 7695301 - DNA, 22 bp, Homo sapiens
catcacagaaataaacatacct

SEQ ID NO: 7695302 - DNA, 22 bp, Homo sapiens
catcacagaaataaacatacct

SEQ ID NO: 7695303 - DNA, 22 bp, Homo sapiens
catcacagaaataaacatacct

SEQ ID NO: 7695304 - DNA, 22 bp, Homo sapiens
tcagggcccagtctgtgcatct

SEQ ID NO: 7695305 - DNA, 22 bp, Homo sapiens
tcagggcccagtctgtgcatct

SEQ ID NO: 7695306 - DNA, 22 bp, Homo sapiens
tcagggcccagagctcaggcaa

SEQ ID NO: 7695307 - DNA, 22 bp, Homo sapiens
tcagggccctcacttgcatagg

SEQ ID NO: 7695308 - DNA, 22 bp, Homo sapiens
tcagggccctcacttgcatagg

SEQ ID NO: 7695309 - DNA, 22 bp, Homo sapiens
tcagggccctggacaaccctcc

SEQ ID NO: 7695310 - DNA, 22 bp, Homo sapiens
tcagggccctggacaaccctcc

SEQ ID NO: 7695311 - DNA, 22 bp, Homo sapiens
catcacaaatgtaataatgtct

SEQ ID NO: 7695312 - DNA, 22 bp, Homo sapiens
catcacaaatgtaataatgtct

SEQ ID NO: 7695313 - DNA, 22 bp, Homo sapiens
catatattatggactgcagaat

SEQ ID NO: 7695314 - DNA, 22 bp, Homo sapiens
catatattatggactgcagaat

SEQ ID NO: 7695315 - DNA, 22 bp, Homo sapiens
catatattatggactgcagaat

SEQ ID NO: 7695316 - DNA, 22 bp, Homo sapiens
catatattatggactgcagaat

SEQ ID NO: 7695317 - DNA, 22 bp, Homo sapiens
catatatgtgcagaccacttga

SEQ ID NO: 7695318 - DNA, 22 bp, Homo sapiens
catatatgtgcagaccacttga

SEQ ID NO: 7695319 - DNA, 22 bp, Homo sapiens
catatatgtagatgtatgtgaa

SEQ ID NO: 7695320 - DNA, 22 bp, Homo sapiens
catatatgtagatgtatgtgaa

SEQ ID NO: 7695321 - DNA, 22 bp, Homo sapiens
catatattctggttttcactgg

SEQ ID NO: 7695322 - DNA, 22 bp, Homo sapiens
catatattctggttttcactgg

SEQ ID NO: 7695323 - DNA, 22 bp, Homo sapiens
catatattctggttttcactgg

SEQ ID NO: 7695324 - DNA, 22 bp, Homo sapiens
catatattctggttttcactgg

SEQ ID NO: 7695325 - DNA, 22 bp, Homo sapiens
catatattctggttttcactgg

SEQ ID NO: 7695326 - DNA, 22 bp, Homo sapiens
catatattatggactgcagaat

SEQ ID NO: 7695327 - DNA, 22 bp, Homo sapiens
catatattctggttttcactgg

SEQ ID NO: 7695328 - DNA, 22 bp, Homo sapiens
catatattctggttttcactgg

SEQ ID NO: 7695329 - DNA, 22 bp, Homo sapiens
catatattctggttttcactgg

SEQ ID NO: 7695330 - DNA, 22 bp, Homo sapiens
catatattatggactgcagaat

SEQ ID NO: 7695331 - DNA, 22 bp, Homo sapiens
catatacacttccacctctgtg

SEQ ID NO: 7695332 - DNA, 22 bp, Homo sapiens
catatacacttccacctctgtg

SEQ ID NO: 7695333 - DNA, 22 bp, Homo sapiens
catatactgcatacatatgtgt

SEQ ID NO: 7695334 - DNA, 22 bp, Homo sapiens
catatacttttctatagctttc

SEQ ID NO: 7695335 - DNA, 22 bp, Homo sapiens
catatactgcatacatatgtgt

SEQ ID NO: 7695336 - DNA, 20 bp, Homo sapiens
catatatacctagaagtgga

SEQ ID NO: 7695337 - DNA, 20 bp, Homo sapiens
catatatacctagaagtgga

SEQ ID NO: 7695338 - DNA, 20 bp, Homo sapiens
catatatacctagaagtgga

SEQ ID NO: 7695339 - DNA, 20 bp, Homo sapiens
catatatacctagaagtgga

SEQ ID NO: 7695340 - DNA, 20 bp, Homo sapiens
catatatacctagaagtgga

SEQ ID NO: 7695341 - DNA, 20 bp, Homo sapiens
catatatacctagaagtgga

SEQ ID NO: 7695342 - DNA, 20 bp, Homo sapiens
catatatacctagaagtgga

SEQ ID NO: 7695343 - DNA, 22 bp, Homo sapiens
catatcttctgacatgatcagg

SEQ ID NO: 7695344 - DNA, 22 bp, Homo sapiens
catatcttctgacatgatcagg

SEQ ID NO: 7695345 - DNA, 23 bp, Homo sapiens
catatgaaagtagacactttcca

SEQ ID NO: 7695346 - DNA, 23 bp, Homo sapiens
catatgaaagtagacactttcca

SEQ ID NO: 7695347 - DNA, 21 bp, Homo sapiens
catatgaaagaagtatctgac

SEQ ID NO: 7695348 - DNA, 22 bp, Homo sapiens
catatgaaatatgagttgaaca

SEQ ID NO: 7695349 - DNA, 22 bp, Homo sapiens
catatgaagttcaacagagatg

SEQ ID NO: 7695350 - DNA, 22 bp, Homo sapiens
catatgaagttcaacagagatg

SEQ ID NO: 7695351 - DNA, 21 bp, Homo sapiens
catatgaaagaagtatctgac

SEQ ID NO: 7695352 - DNA, 22 bp, Homo sapiens
catatgaagatgtctttttgta

SEQ ID NO: 7695353 - DNA, 23 bp, Homo sapiens
catatgaattttagaggcagttt

SEQ ID NO: 7695354 - DNA, 20 bp, Homo sapiens
catatggaaagatattgttc

SEQ ID NO: 7695355 - DNA, 22 bp, Homo sapiens
catatgaagttcaacagagatg

SEQ ID NO: 7695356 - DNA, 23 bp, Homo sapiens
catatgaattttagaggcagttt

SEQ ID NO: 7695357 - DNA, 22 bp, Homo sapiens
catatcttctgacatgatcagg

SEQ ID NO: 7695358 - DNA, 22 bp, Homo sapiens
catatcttatggttttctaagt

SEQ ID NO: 7695359 - DNA, 22 bp, Homo sapiens
catatcttatggttttctaagt

SEQ ID NO: 7695360 - DNA, 22 bp, Homo sapiens
catatccaatatgactagtgtt

SEQ ID NO: 7695361 - DNA, 22 bp, Homo sapiens
catatccaggtttctttggttt

SEQ ID NO: 7695362 - DNA, 22 bp, Homo sapiens
catatcaaagagaaggatagga

SEQ ID NO: 7695363 - DNA, 22 bp, Homo sapiens
catatcatttgcttataaatct

SEQ ID NO: 7695364 - DNA, 22 bp, Homo sapiens
catatcatttgcttataaatct

SEQ ID NO: 7695365 - DNA, 22 bp, Homo sapiens
catatattctggttttcactgg

SEQ ID NO: 7695366 - DNA, 15 bp, Homo sapiens
catatcactgggaat

SEQ ID NO: 7695367 - DNA, 22 bp, Homo sapiens
catatcaaagagaaggatagga

SEQ ID NO: 7695368 - DNA, 22 bp, Homo sapiens
tcaggaagtggtaaaggatgtt

SEQ ID NO: 7695369 - DNA, 22 bp, Homo sapiens
tcaggaagtgctgaggctgctt

SEQ ID NO: 7695370 - DNA, 22 bp, Homo sapiens
tcaggaagtgctgaggctgctt

SEQ ID NO: 7695371 - DNA, 22 bp, Homo sapiens
tcaggaagtggtaaaggatgtt

SEQ ID NO: 7695372 - DNA, 22 bp, Homo sapiens
tcaggaagtggtaaaggatgtt

SEQ ID NO: 7695373 - DNA, 22 bp, Homo sapiens
tcaggaagtggtaaaggatgtt

SEQ ID NO: 7695374 - DNA, 22 bp, Homo sapiens
tcaggaagtggtaaaggatgtt

SEQ ID NO: 7695375 - DNA, 22 bp, Homo sapiens
tcaggaagtggtaaaggatgtt

SEQ ID NO: 7695376 - DNA, 22 bp, Homo sapiens
tcaggaagttgaggcgtagaga

SEQ ID NO: 7695377 - DNA, 22 bp, Homo sapiens
tcaggaagttgaggcgtagaga

SEQ ID NO: 7695378 - DNA, 22 bp, Homo sapiens
tcaggaagtggtaaaggatgtt

SEQ ID NO: 7695379 - DNA, 22 bp, Homo sapiens
tcaggaagttgaggcgtagaga

SEQ ID NO: 7695380 - DNA, 22 bp, Homo sapiens
tcaggaagttgaggcgtagaga

SEQ ID NO: 7695381 - DNA, 22 bp, Homo sapiens
tcaggaagtggtaaaggatgtt

SEQ ID NO: 7695382 - DNA, 22 bp, Homo sapiens
tcaggaagtggtaaaggatgtt

SEQ ID NO: 7695383 - DNA, 22 bp, Homo sapiens
tcaggaagtggtaaaggatgtt

SEQ ID NO: 7695384 - DNA, 22 bp, Homo sapiens
tcaggaagtggtaaaggatgtt

SEQ ID NO: 7695385 - DNA, 22 bp, Homo sapiens
tcaggaagtgcctaggctggcc

SEQ ID NO: 7695386 - DNA, 22 bp, Homo sapiens
tcaggaagtgcctaggctggcc

SEQ ID NO: 7695387 - DNA, 22 bp, Homo sapiens
tcaggaagtgcctaggctggcc

SEQ ID NO: 7695388 - DNA, 22 bp, Homo sapiens
tcaggaagtgcctaggctggcc

SEQ ID NO: 7695389 - DNA, 22 bp, Homo sapiens
tcaggaagtgcctaggctggcc

SEQ ID NO: 7695390 - DNA, 22 bp, Homo sapiens
tcaggaagtgcctaggctggcc

SEQ ID NO: 7695391 - DNA, 22 bp, Homo sapiens
tcaggaagtgcctaggctggcc

SEQ ID NO: 7695392 - DNA, 22 bp, Homo sapiens
tcaggaagtctcaattagctac

SEQ ID NO: 7695393 - DNA, 22 bp, Homo sapiens
tcaggaagtctcaattagctac

SEQ ID NO: 7695394 - DNA, 22 bp, Homo sapiens
tcaggaagtctcaattagctac

SEQ ID NO: 7695395 - DNA, 22 bp, Homo sapiens
tcaggaagtctcaattagctac

SEQ ID NO: 7695396 - DNA, 22 bp, Homo sapiens
tcaggaagtctcaattagctac

SEQ ID NO: 7695397 - DNA, 22 bp, Homo sapiens
tcaggaagtgctgaggctgctt

SEQ ID NO: 7695398 - DNA, 22 bp, Homo sapiens
tcaggaagtgctgaggctgctt

SEQ ID NO: 7695399 - DNA, 22 bp, Homo sapiens
tcaggaagtgctgaggctgctt

SEQ ID NO: 7695400 - DNA, 22 bp, Homo sapiens
tcaggaagtgctgaggctgctt

SEQ ID NO: 7695401 - DNA, 22 bp, Homo sapiens
tcaggaagtgctgaggctgctt

SEQ ID NO: 7695402 - DNA, 22 bp, Homo sapiens
tcaggaagtgcctaggctggcc

SEQ ID NO: 7695403 - DNA, 22 bp, Homo sapiens
tcaggaagtgcctaggctggcc

SEQ ID NO: 7695404 - DNA, 22 bp, Homo sapiens
tcaggaagtgcctaggctggcc

SEQ ID NO: 7695405 - DNA, 22 bp, Homo sapiens
tcaggaagtgcctaggctggcc

SEQ ID NO: 7695406 - DNA, 22 bp, Homo sapiens
tcaggaagtgcctaggctggcc

SEQ ID NO: 7695407 - DNA, 22 bp, Homo sapiens
catagacagatggtaagaagct

SEQ ID NO: 7695408 - DNA, 22 bp, Homo sapiens
catataaatacaacatgtgtta

SEQ ID NO: 7695409 - DNA, 22 bp, Homo sapiens
catagaatgtaataaagagtag

SEQ ID NO: 7695410 - DNA, 22 bp, Homo sapiens
catagaatggattgacaagatt

SEQ ID NO: 7695411 - DNA, 22 bp, Homo sapiens
catagaatgtaataaagagtag

SEQ ID NO: 7695412 - DNA, 22 bp, Homo sapiens
catagacaaagatcagaagagt

SEQ ID NO: 7695413 - DNA, 22 bp, Homo sapiens
catagacaaagatcagaagagt

SEQ ID NO: 7695414 - DNA, 19 bp, Homo sapiens
tcaggaagttgatgaggtg

SEQ ID NO: 7695415 - DNA, 19 bp, Homo sapiens
tcaggaagttgatgaggtg

SEQ ID NO: 7695416 - DNA, 19 bp, Homo sapiens
tcaggaagttgatgaggtg

SEQ ID NO: 7695417 - DNA, 19 bp, Homo sapiens
tcaggaagttgatgaggtg

SEQ ID NO: 7695418 - DNA, 19 bp, Homo sapiens
tcaggaagttgatgaggtg

SEQ ID NO: 7695419 - DNA, 22 bp, Homo sapiens
tcaggaagttgaggcgtagaga

SEQ ID NO: 7695420 - DNA, 22 bp, Homo sapiens
tcaggaagttgaggcgtagaga

SEQ ID NO: 7695421 - DNA, 22 bp, Homo sapiens
tcaggaagttttgaatcaactg

SEQ ID NO: 7695422 - DNA, 19 bp, Homo sapiens
tcaggaagttgatgaggtg

SEQ ID NO: 7695423 - DNA, 19 bp, Homo sapiens
tcaggaagttgatgaggtg

SEQ ID NO: 7695424 - DNA, 19 bp, Homo sapiens
tcaggaagttgatgaggtg

SEQ ID NO: 7695425 - DNA, 19 bp, Homo sapiens
tcaggaagttgatgaggtg

SEQ ID NO: 7695426 - DNA, 19 bp, Homo sapiens
tcaggaagttgatgaggtg

SEQ ID NO: 7695427 - DNA, 22 bp, Homo sapiens
catatacacttccacctctgtg

SEQ ID NO: 7695428 - DNA, 22 bp, Homo sapiens
catatacacttccacctctgtg

SEQ ID NO: 7695429 - DNA, 22 bp, Homo sapiens
catatacacttccacctctgtg

SEQ ID NO: 7695430 - DNA, 22 bp, Homo sapiens
catatacacttccacctctgtg

SEQ ID NO: 7695431 - DNA, 22 bp, Homo sapiens
catatacacttccacctctgtg

SEQ ID NO: 7695432 - DNA, 22 bp, Homo sapiens
catatacacttccacctctgtg

SEQ ID NO: 7695433 - DNA, 22 bp, Homo sapiens
catatacacttccacctctgtg

SEQ ID NO: 7695434 - DNA, 22 bp, Homo sapiens
catataatgtttgaagatgtgg

SEQ ID NO: 7695435 - DNA, 22 bp, Homo sapiens
catataaatacaacatgtgtta

SEQ ID NO: 7695436 - DNA, 22 bp, Homo sapiens
catataaatacaacatgtgtta

SEQ ID NO: 7695437 - DNA, 22 bp, Homo sapiens
catataaatacaacatgtgtta

SEQ ID NO: 7695438 - DNA, 22 bp, Homo sapiens
catataaatacaacatgtgtta

SEQ ID NO: 7695439 - DNA, 22 bp, Homo sapiens
catataaatacaacatgtgtta

SEQ ID NO: 7695440 - DNA, 22 bp, Homo sapiens
catataaatacaacatgtgtta

SEQ ID NO: 7695441 - DNA, 20 bp, Homo sapiens
tgtgccaaaactgtttgctt

SEQ ID NO: 7695442 - DNA, 22 bp, Homo sapiens
tgtgcattaactccacaagcag

SEQ ID NO: 7695443 - DNA, 22 bp, Homo sapiens
tgtgcatgttgcttgaactcct

SEQ ID NO: 7695444 - DNA, 23 bp, Homo sapiens
tgtgccaagcttagaaagaacct

SEQ ID NO: 7695445 - DNA, 22 bp, Homo sapiens
tgtgccaatctgctgactgtct

SEQ ID NO: 7695446 - DNA, 22 bp, Homo sapiens
tgtgccaagatcaaacttttct

SEQ ID NO: 7695447 - DNA, 22 bp, Homo sapiens
tgtgccaagactatattgtgct

SEQ ID NO: 7695448 - DNA, 22 bp, Homo sapiens
tgtgcatggccagctggatcga

SEQ ID NO: 7695449 - DNA, 22 bp, Homo sapiens
tgtgcatgtctgggcctgtaag

SEQ ID NO: 7695450 - DNA, 16 bp, Homo sapiens
tgtgcatgttctgtgt

SEQ ID NO: 7695451 - DNA, 22 bp, Homo sapiens
tgtgcatgtgtctttatagtag

SEQ ID NO: 7695452 - DNA, 22 bp, Homo sapiens
tgtgcatgcacatatatgttgc

SEQ ID NO: 7695453 - DNA, 22 bp, Homo sapiens
tgtgcatggcatcattgcagcc

SEQ ID NO: 7695454 - DNA, 22 bp, Homo sapiens
tgtgcatgtaccttattctgga

SEQ ID NO: 7695455 - DNA, 20 bp, Homo sapiens
tgtgcatgaactgagggatt

SEQ ID NO: 7695456 - DNA, 22 bp, Homo sapiens
tgtgcatcttgcctggatgttt

SEQ ID NO: 7695457 - DNA, 22 bp, Homo sapiens
tgtgcatcaagagaaaacagtg

SEQ ID NO: 7695458 - DNA, 22 bp, Homo sapiens
tgtgcatcaagagaaaacagtg

SEQ ID NO: 7695459 - DNA, 22 bp, Homo sapiens
tgtgcatcttgcctggatgttt

SEQ ID NO: 7695460 - DNA, 22 bp, Homo sapiens
tgtgcatcttgcctggatgttt

SEQ ID NO: 7695461 - DNA, 22 bp, Homo sapiens
tgtgcatcaaacccatttaaat

SEQ ID NO: 7695462 - DNA, 22 bp, Homo sapiens
tgtgcagttttaagtggtctaa

SEQ ID NO: 7695463 - DNA, 22 bp, Homo sapiens
tgtgcagttttaagtggtctaa

SEQ ID NO: 7695464 - DNA, 17 bp, Homo sapiens
tgtgcatagaataatga

SEQ ID NO: 7695465 - DNA, 22 bp, Homo sapiens
tgtgcatattactacctactcc

SEQ ID NO: 7695466 - DNA, 22 bp, Homo sapiens
tgtgcatcaaacccatttaaat

SEQ ID NO: 7695467 - DNA, 22 bp, Homo sapiens
tgtgccctctctgagccataaa

SEQ ID NO: 7695468 - DNA, 22 bp, Homo sapiens
tgtgccctcctgccaggggctg

SEQ ID NO: 7695469 - DNA, 22 bp, Homo sapiens
tgtgccctcctgccaggggctg

SEQ ID NO: 7695470 - DNA, 22 bp, Homo sapiens
tgtgccctcctgccaggggctg

SEQ ID NO: 7695471 - DNA, 20 bp, Homo sapiens
tgtgccctgcagacttcttt

SEQ ID NO: 7695472 - DNA, 22 bp, Homo sapiens
tgtgccctgcctacatcacctt

SEQ ID NO: 7695473 - DNA, 19 bp, Homo sapiens
tgtgcccttggcaatggga

SEQ ID NO: 7695474 - DNA, 19 bp, Homo sapiens
tgtgcccttggcaatggga

SEQ ID NO: 7695475 - DNA, 22 bp, Homo sapiens
tgtgccctgttaaatgcacagt

SEQ ID NO: 7695476 - DNA, 22 bp, Homo sapiens
tgtgccctgttaaatgcacagt

SEQ ID NO: 7695477 - DNA, 22 bp, Homo sapiens
tgtgccctttcctgctcctcca

SEQ ID NO: 7695478 - DNA, 22 bp, Homo sapiens
tgtgccctttcctgctcctcca

SEQ ID NO: 7695479 - DNA, 22 bp, Homo sapiens
tgtgccctcagaagagtacatc

SEQ ID NO: 7695480 - DNA, 19 bp, Homo sapiens
tgtgccccctccagcctgc

SEQ ID NO: 7695481 - DNA, 19 bp, Homo sapiens
tgtgccccctccagcctgc

SEQ ID NO: 7695482 - DNA, 19 bp, Homo sapiens
tgtgccccctccagcctgc

SEQ ID NO: 7695483 - DNA, 22 bp, Homo sapiens
tgtgccagaaaatatgctgagg

SEQ ID NO: 7695484 - DNA, 22 bp, Homo sapiens
tgtgccacatacacagtacatt

SEQ ID NO: 7695485 - DNA, 22 bp, Homo sapiens
tgtgccaatttgttcaggtaag

SEQ ID NO: 7695486 - DNA, 22 bp, Homo sapiens
tgtgcccttttgacagtgagag

SEQ ID NO: 7695487 - DNA, 22 bp, Homo sapiens
tgtgcccttttgacagtgagag

SEQ ID NO: 7695488 - DNA, 22 bp, Homo sapiens
tgtgcctactgatagagccaag

SEQ ID NO: 7695489 - DNA, 22 bp, Homo sapiens
tgtgcctactgatagagccaag

SEQ ID NO: 7695490 - DNA, 22 bp, Homo sapiens
tgtgcctactgatagagccaag

SEQ ID NO: 7695491 - DNA, 22 bp, Homo sapiens
tgtgccctttcctgctcctcca

SEQ ID NO: 7695492 - DNA, 22 bp, Homo sapiens
tgtgcctcaccctgctcttggc

SEQ ID NO: 7695493 - DNA, 22 bp, Homo sapiens
tgtgcctactgatagagccaag

SEQ ID NO: 7695494 - DNA, 22 bp, Homo sapiens
tgtgcctagttctgtatttaca

SEQ ID NO: 7695495 - DNA, 22 bp, Homo sapiens
tgtgcctcaccctgctcttggc

SEQ ID NO: 7695496 - DNA, 22 bp, Homo sapiens
tgtgcctcatgtatctggatga

SEQ ID NO: 7695497 - DNA, 22 bp, Homo sapiens
tgtgcctcatgtatctggatga

SEQ ID NO: 7695498 - DNA, 19 bp, Homo sapiens
tgtgcctcctcgtctccta

SEQ ID NO: 7695499 - DNA, 22 bp, Homo sapiens
tgtgcctgactaggtgaatcaa

SEQ ID NO: 7695500 - DNA, 22 bp, Homo sapiens
tgtgcctctgcctcatgccctg

SEQ ID NO: 7695501 - DNA, 22 bp, Homo sapiens
tgtgcctctgcctcatgccctg

SEQ ID NO: 7695502 - DNA, 22 bp, Homo sapiens
tgtgcaaagtgtacaaattaat

SEQ ID NO: 7695503 - DNA, 22 bp, Homo sapiens
tgtgcaaattaagtagattttc

SEQ ID NO: 7695504 - DNA, 18 bp, Homo sapiens
tgtgcaatattaaccacc

SEQ ID NO: 7695505 - DNA, 22 bp, Homo sapiens
tgtgcaatcatattttaaaatg

SEQ ID NO: 7695506 - DNA, 22 bp, Homo sapiens
tgtgcaatcatattttaaaatg

SEQ ID NO: 7695507 - DNA, 22 bp, Homo sapiens
tgtgcaatcatattttaaaatg

SEQ ID NO: 7695508 - DNA, 22 bp, Homo sapiens
tgtgcacatatactcatattcc

SEQ ID NO: 7695509 - DNA, 23 bp, Homo sapiens
tgtgcacatctgacgggtgaagg

SEQ ID NO: 7695510 - DNA, 22 bp, Homo sapiens
tgtgcacattctaggactagta

SEQ ID NO: 7695511 - DNA, 22 bp, Homo sapiens
tgtgcacattctaggactagta

SEQ ID NO: 7695512 - DNA, 22 bp, Homo sapiens
tgtgcacattctaggactagta

SEQ ID NO: 7695513 - DNA, 22 bp, Homo sapiens
tgtgcacctcatccaccagacc

SEQ ID NO: 7695514 - DNA, 22 bp, Homo sapiens
tgtgcagaaactgggaaggaag

SEQ ID NO: 7695515 - DNA, 22 bp, Homo sapiens
tgtgcagagaagccactggggg

SEQ ID NO: 7695516 - DNA, 20 bp, Homo sapiens
tgtgcacctgctagggagca

SEQ ID NO: 7695517 - DNA, 22 bp, Homo sapiens
tgtgcacctgagtcgcgcaggg

SEQ ID NO: 7695518 - DNA, 22 bp, Homo sapiens
tgtgcacctgagtcgcgcaggg

SEQ ID NO: 7695519 - DNA, 22 bp, Homo sapiens
tgtgcacctagggcattttcca

SEQ ID NO: 7695520 - DNA, 22 bp, Homo sapiens
tgtgcacctagggcattttcca

SEQ ID NO: 7695521 - DNA, 22 bp, Homo sapiens
tgtgcacattctaggactagta

SEQ ID NO: 7695522 - DNA, 22 bp, Homo sapiens
tgtgcacaggaagctattctct

SEQ ID NO: 7695523 - DNA, 22 bp, Homo sapiens
tgtgcacataaaacagtactag

SEQ ID NO: 7695524 - DNA, 22 bp, Homo sapiens
tgtgcacataaaacagtactag

SEQ ID NO: 7695525 - DNA, 22 bp, Homo sapiens
tgtgcacaatgtgcaggtttgt

SEQ ID NO: 7695526 - DNA, 22 bp, Homo sapiens
tgtgcacataaaacagtactag

SEQ ID NO: 7695527 - DNA, 23 bp, Homo sapiens
tgtgcacatctgacgggtgaagg

SEQ ID NO: 7695528 - DNA, 22 bp, Homo sapiens
tgtgcagagttgaagacaggag

SEQ ID NO: 7695529 - DNA, 22 bp, Homo sapiens
tgtgcagagttgaagacaggag

SEQ ID NO: 7695530 - DNA, 22 bp, Homo sapiens
tgtgcagagcggggaagagcac

SEQ ID NO: 7695531 - DNA, 22 bp, Homo sapiens
tgtgcagagcggggaagagcac

SEQ ID NO: 7695532 - DNA, 22 bp, Homo sapiens
tgtgcagagcccacaggcagct

SEQ ID NO: 7695533 - DNA, 22 bp, Homo sapiens
tgtgcagagcccacaggcagct

SEQ ID NO: 7695534 - DNA, 22 bp, Homo sapiens
tgtgcagagcccacaggcagct

SEQ ID NO: 7695535 - DNA, 22 bp, Homo sapiens
tgtgcagctatctctctacagt

SEQ ID NO: 7695536 - DNA, 23 bp, Homo sapiens
tgtgcagcatttcttgctatagg

SEQ ID NO: 7695537 - DNA, 22 bp, Homo sapiens
tgtgcagctactgaataaatag

SEQ ID NO: 7695538 - DNA, 22 bp, Homo sapiens
tgtgcagctagtcctggacttg

SEQ ID NO: 7695539 - DNA, 22 bp, Homo sapiens
tgtgcagctagtcctggacttg

SEQ ID NO: 7695540 - DNA, 22 bp, Homo sapiens
tgtgcagcaaaatagaatcttt

SEQ ID NO: 7695541 - DNA, 22 bp, Homo sapiens
tgtgcagcagcagctgtggaga

SEQ ID NO: 7695542 - DNA, 22 bp, Homo sapiens
tgtgcagcagcagctgtggaga

SEQ ID NO: 7695543 - DNA, 22 bp, Homo sapiens
tgtgcagcagcagctgtggaga

SEQ ID NO: 7695544 - DNA, 22 bp, Homo sapiens
tgtgcagctttctggctttaag

SEQ ID NO: 7695545 - DNA, 20 bp, Homo sapiens
tgtgcaggagagtgaggctg

SEQ ID NO: 7695546 - DNA, 22 bp, Homo sapiens
tgtgcagctttctggctttaag

SEQ ID NO: 7695547 - DNA, 22 bp, Homo sapiens
tgtgcagctctagagccaagcc

SEQ ID NO: 7695548 - DNA, 22 bp, Homo sapiens
tgtgcagctctagagccaagcc

SEQ ID NO: 7695549 - DNA, 22 bp, Homo sapiens
tgtgcagctctagagccaagcc

SEQ ID NO: 7695550 - DNA, 22 bp, Homo sapiens
tgtgcaggtgcaggaagggggc

SEQ ID NO: 7695551 - DNA, 22 bp, Homo sapiens
tgtgcaggtgcaggaagggggc

SEQ ID NO: 7695552 - DNA, 22 bp, Homo sapiens
tgtgcaggtgcaggaagggggc

SEQ ID NO: 7695553 - DNA, 21 bp, Homo sapiens
tgtgcagtccaatgtgctagc

SEQ ID NO: 7695554 - DNA, 22 bp, Homo sapiens
tgtgcagttcaaacccgtgttg

SEQ ID NO: 7695555 - DNA, 22 bp, Homo sapiens
tgtgcagtggcctcggcacgca

SEQ ID NO: 7695556 - DNA, 22 bp, Homo sapiens
tgtgcagtttctatgttgtcca

SEQ ID NO: 7695557 - DNA, 20 bp, Homo sapiens
tgtgcaggagagtgaggctg

SEQ ID NO: 7695558 - DNA, 20 bp, Homo sapiens
tgtgcaggagagtgaggctg

SEQ ID NO: 7695559 - DNA, 22 bp, Homo sapiens
tgtgcagggaagggcatgctat

SEQ ID NO: 7695560 - DNA, 22 bp, Homo sapiens
tgtgcaggatgcgggggtacca

SEQ ID NO: 7695561 - DNA, 20 bp, Homo sapiens
tgtgcaggagagtgaggctg

SEQ ID NO: 7695562 - DNA, 22 bp, Homo sapiens
tgtgcagggaagggcatgctat

SEQ ID NO: 7695563 - DNA, 22 bp, Homo sapiens
tgtgcagggaagggcatgctat

SEQ ID NO: 7695564 - DNA, 22 bp, Homo sapiens
tgtgcagggaagggcatgctat

SEQ ID NO: 7695565 - DNA, 22 bp, Homo sapiens
tgtgcagggaagggcatgctat

SEQ ID NO: 7695566 - DNA, 22 bp, Homo sapiens
tgtgcagggaagggcatgctat

SEQ ID NO: 7695567 - DNA, 22 bp, Homo sapiens
tgtgcctggcccagtggtgtca

SEQ ID NO: 7695568 - DNA, 22 bp, Homo sapiens
tgtgcctggtccctgagtcgag

SEQ ID NO: 7695569 - DNA, 22 bp, Homo sapiens
tgtgcctggcccagtggtgtca

SEQ ID NO: 7695570 - DNA, 22 bp, Homo sapiens
tgtgcctggcccagtggtgtca

SEQ ID NO: 7695571 - DNA, 22 bp, Homo sapiens
tgtgcctggcattctgggcttc

SEQ ID NO: 7695572 - DNA, 22 bp, Homo sapiens
tgtgcctggcattctgggcttc

SEQ ID NO: 7695573 - DNA, 22 bp, Homo sapiens
tgtgcctggcattctgggcttc

SEQ ID NO: 7695574 - DNA, 22 bp, Homo sapiens
tgtgcctggatctctgtgacaa

SEQ ID NO: 7695575 - DNA, 22 bp, Homo sapiens
tgtgcctggatctctgtgacaa

SEQ ID NO: 7695576 - DNA, 22 bp, Homo sapiens
tgtgcctggatctctgtgacaa

SEQ ID NO: 7695577 - DNA, 22 bp, Homo sapiens
tgtgcctggatctctgtgacaa

SEQ ID NO: 7695578 - DNA, 22 bp, Homo sapiens
tgtgcctggatctctgtgacaa

SEQ ID NO: 7695579 - DNA, 22 bp, Homo sapiens
tgtgcctgatggtcacgtggcc

SEQ ID NO: 7695580 - DNA, 22 bp, Homo sapiens
tgtgcctgatggtcacgtggcc

SEQ ID NO: 7695581 - DNA, 22 bp, Homo sapiens
tgtgcctgatggtcacgtggcc

SEQ ID NO: 7695582 - DNA, 22 bp, Homo sapiens
tgtgcctgctagatggttgtcg

SEQ ID NO: 7695583 - DNA, 22 bp, Homo sapiens
tgtgcctgatggtcacgtggcc

SEQ ID NO: 7695584 - DNA, 22 bp, Homo sapiens
tgtgcctggagtccctgaggag

SEQ ID NO: 7695585 - DNA, 22 bp, Homo sapiens
tgtgcctggagtccctgaggag

SEQ ID NO: 7695586 - DNA, 22 bp, Homo sapiens
tgtgcctgagttggctgagtac

SEQ ID NO: 7695587 - DNA, 22 bp, Homo sapiens
tgtgcctgagttggctgagtac

SEQ ID NO: 7695588 - DNA, 22 bp, Homo sapiens
tgtgcctgagttggctgagtac

SEQ ID NO: 7695589 - DNA, 22 bp, Homo sapiens
tgtgcctgagttggctgagtac

SEQ ID NO: 7695590 - DNA, 22 bp, Homo sapiens
tgtgcctgagtctcggcccacc

SEQ ID NO: 7695591 - DNA, 22 bp, Homo sapiens
tgtgcctgagtctcggcccacc

SEQ ID NO: 7695592 - DNA, 22 bp, Homo sapiens
tgtgccttccctctgctgattt

SEQ ID NO: 7695593 - DNA, 22 bp, Homo sapiens
tgtgccttatgaattctttctg

SEQ ID NO: 7695594 - DNA, 22 bp, Homo sapiens
tgtgcctgttggtgtagacata

SEQ ID NO: 7695595 - DNA, 19 bp, Homo sapiens
tgtgccttatactcacatt

SEQ ID NO: 7695596 - DNA, 22 bp, Homo sapiens
tgtgcctgttggtgtagacata

SEQ ID NO: 7695597 - DNA, 22 bp, Homo sapiens
tgtgcctgttcccactttgcct

SEQ ID NO: 7695598 - DNA, 22 bp, Homo sapiens
tgtgcctgtgacagcgacctgg

SEQ ID NO: 7695599 - DNA, 22 bp, Homo sapiens
tgtgcctgttcccactttgcct

SEQ ID NO: 7695600 - DNA, 22 bp, Homo sapiens
tgtgcctgtcccgcattctggt

SEQ ID NO: 7695601 - DNA, 22 bp, Homo sapiens
tgtgcctgtgacagcgacctgg

SEQ ID NO: 7695602 - DNA, 22 bp, Homo sapiens
tgtgcctgtgacagcgacctgg

SEQ ID NO: 7695603 - DNA, 22 bp, Homo sapiens
tgtgcctgtcaccctcagagag

SEQ ID NO: 7695604 - DNA, 22 bp, Homo sapiens
tgtgcctgtcaccctcagagag

SEQ ID NO: 7695605 - DNA, 22 bp, Homo sapiens
tgtgcctgtcaccctcagagag

SEQ ID NO: 7695606 - DNA, 20 bp, Homo sapiens
tgtgcctggctttgtcctga

SEQ ID NO: 7695607 - DNA, 22 bp, Homo sapiens
tgtgcctgtcccgcattctggt

SEQ ID NO: 7695608 - DNA, 22 bp, Homo sapiens
tgtgcggggaagggctcactca

SEQ ID NO: 7695609 - DNA, 17 bp, Homo sapiens
tgtgcgcttgtgtgagg

SEQ ID NO: 7695610 - DNA, 23 bp, Homo sapiens
tgtgcgtgatgctttgttgaagg

SEQ ID NO: 7695611 - DNA, 22 bp, Homo sapiens
tgtgcgtcctgtgcgcacactg

SEQ ID NO: 7695612 - DNA, 22 bp, Homo sapiens
tgtgcgtgatggaccgggcctg

SEQ ID NO: 7695613 - DNA, 22 bp, Homo sapiens
tgtgcgtggattcctgtactca

SEQ ID NO: 7695614 - DNA, 22 bp, Homo sapiens
tgtgcgtgggcacacacatatg

SEQ ID NO: 7695615 - DNA, 22 bp, Homo sapiens
tgtgccttctcagtcctgctca

SEQ ID NO: 7695616 - DNA, 22 bp, Homo sapiens
tgtgccttccctctgctgattt

SEQ ID NO: 7695617 - DNA, 22 bp, Homo sapiens
tgtgccttctcagtcctgctca

SEQ ID NO: 7695618 - DNA, 22 bp, Homo sapiens
tgtgcgatgggtacatgagagt

SEQ ID NO: 7695619 - DNA, 22 bp, Homo sapiens
tgtgcctttcatcatgcttttg

SEQ ID NO: 7695620 - DNA, 22 bp, Homo sapiens
tgtgcctttcatcatgcttttg

SEQ ID NO: 7695621 - DNA, 22 bp, Homo sapiens
tgtgcgcgtgcagcggagtgtt

SEQ ID NO: 7695622 - DNA, 22 bp, Homo sapiens
tgtgcgctccggcgagtcagcg

SEQ ID NO: 7695623 - DNA, 22 bp, Homo sapiens
tgtggaacaaaatgttgggaga

SEQ ID NO: 7695624 - DNA, 22 bp, Homo sapiens
tgtggaaagtcaagttccagga

SEQ ID NO: 7695625 - DNA, 22 bp, Homo sapiens
tgtggaaagtggtctaagcaca

SEQ ID NO: 7695626 - DNA, 22 bp, Homo sapiens
tgtggaaaagccccacaggact

SEQ ID NO: 7695627 - DNA, 22 bp, Homo sapiens
tgtgctgctctcagtgacagcc

SEQ ID NO: 7695628 - DNA, 22 bp, Homo sapiens
tgtgctgctctcagtgacagcc

SEQ ID NO: 7695629 - DNA, 22 bp, Homo sapiens
tgtgctgctctcagtgacagcc

SEQ ID NO: 7695630 - DNA, 22 bp, Homo sapiens
tgtgctgctgtgaataagacct

SEQ ID NO: 7695631 - DNA, 22 bp, Homo sapiens
tgtgctgctgtgaataagacct

SEQ ID NO: 7695632 - DNA, 22 bp, Homo sapiens
tgtgctggagatcagcttattt

SEQ ID NO: 7695633 - DNA, 23 bp, Homo sapiens
tgtgctggcatctcaggctttgg

SEQ ID NO: 7695634 - DNA, 19 bp, Homo sapiens
tgtggaaaaaggagacatt

SEQ ID NO: 7695635 - DNA, 22 bp, Homo sapiens
tgtggaaaagaataagggagat

SEQ ID NO: 7695636 - DNA, 22 bp, Homo sapiens
tgtgctgagtgatcccattcct

SEQ ID NO: 7695637 - DNA, 22 bp, Homo sapiens
tgtgctgcctctcacagaatta

SEQ ID NO: 7695638 - DNA, 22 bp, Homo sapiens
tgtgctgccagaaactatggaa

SEQ ID NO: 7695639 - DNA, 22 bp, Homo sapiens
tgtgctgctctcagtgacagcc

SEQ ID NO: 7695640 - DNA, 22 bp, Homo sapiens
tgtgctgctctcagtgacagcc

SEQ ID NO: 7695641 - DNA, 22 bp, Homo sapiens
tgtgctgctctcagtgacagcc

SEQ ID NO: 7695642 - DNA, 22 bp, Homo sapiens
tgtgctgacaattcacagagaa

SEQ ID NO: 7695643 - DNA, 22 bp, Homo sapiens
tgtgctgacaattcacagagaa

SEQ ID NO: 7695644 - DNA, 22 bp, Homo sapiens
tgtgctgagcaaatccatctgt

SEQ ID NO: 7695645 - DNA, 22 bp, Homo sapiens
tgtgctctggagttgccttcac

SEQ ID NO: 7695646 - DNA, 22 bp, Homo sapiens
tgtgctcttctgttacttgtag

SEQ ID NO: 7695647 - DNA, 22 bp, Homo sapiens
tgtgctcttgtctgtgactaac

SEQ ID NO: 7695648 - DNA, 22 bp, Homo sapiens
tgtgctgacaagatcagaaggt

SEQ ID NO: 7695649 - DNA, 22 bp, Homo sapiens
tgtgctcttctgttacttgtag

SEQ ID NO: 7695650 - DNA, 22 bp, Homo sapiens
tgtgctcactctaaattaagat

SEQ ID NO: 7695651 - DNA, 22 bp, Homo sapiens
tgtgctagaagaggatggacct

SEQ ID NO: 7695652 - DNA, 22 bp, Homo sapiens
tgtgcgtggttcccggggccat

SEQ ID NO: 7695653 - DNA, 22 bp, Homo sapiens
tgtgctaaggcagtctatcaca

SEQ ID NO: 7695654 - DNA, 22 bp, Homo sapiens
tgtgctaagtattttcttattt

SEQ ID NO: 7695655 - DNA, 22 bp, Homo sapiens
tgtgctccacactcccagtcct

SEQ ID NO: 7695656 - DNA, 22 bp, Homo sapiens
tgtgctccacactcccagtcct

SEQ ID NO: 7695657 - DNA, 22 bp, Homo sapiens
tgtgctcatggtccagcatggt

SEQ ID NO: 7695658 - DNA, 22 bp, Homo sapiens
tgtgctcatggtccagcatggt

SEQ ID NO: 7695659 - DNA, 22 bp, Homo sapiens
tgtgctcatggtccagcatggt

SEQ ID NO: 7695660 - DNA, 22 bp, Homo sapiens
tgtgctcatggtccagcatggt

SEQ ID NO: 7695661 - DNA, 22 bp, Homo sapiens
tgtgctcatggtccagcatggt

SEQ ID NO: 7695662 - DNA, 22 bp, Homo sapiens
tgtgctcagtctttggctggga

SEQ ID NO: 7695663 - DNA, 22 bp, Homo sapiens
tgtgctatttttgcatatgtgt

SEQ ID NO: 7695664 - DNA, 22 bp, Homo sapiens
tgtgctcactctaaattaagat

SEQ ID NO: 7695665 - DNA, 22 bp, Homo sapiens
tgtgctctacctcagtgtcatt

SEQ ID NO: 7695666 - DNA, 22 bp, Homo sapiens
tgtgctctacctcagtgtcatt

SEQ ID NO: 7695667 - DNA, 22 bp, Homo sapiens
tgtgctctgaagagtgcatgtc

SEQ ID NO: 7695668 - DNA, 17 bp, Homo sapiens
tgtgctctctcactcag

SEQ ID NO: 7695669 - DNA, 22 bp, Homo sapiens
tgtgctctgaagagtgcatgtc

SEQ ID NO: 7695670 - DNA, 22 bp, Homo sapiens
tgtgctctacctcagtgtcatt

SEQ ID NO: 7695671 - DNA, 22 bp, Homo sapiens
tgtgctctacctcagtgtcatt

SEQ ID NO: 7695672 - DNA, 23 bp, Homo sapiens
tgtgctcccaaatgtaggtctat

SEQ ID NO: 7695673 - DNA, 22 bp, Homo sapiens
tgtgctccatcatccataatct

SEQ ID NO: 7695674 - DNA, 22 bp, Homo sapiens
tgtgctctgcccctgactgttt

SEQ ID NO: 7695675 - DNA, 22 bp, Homo sapiens
tgtgctctgactttctcctggt

SEQ ID NO: 7695676 - DNA, 22 bp, Homo sapiens
tgtgctctgactttctcctggt

SEQ ID NO: 7695677 - DNA, 22 bp, Homo sapiens
tgtgaagtccagagaagtcagg

SEQ ID NO: 7695678 - DNA, 22 bp, Homo sapiens
tgtgaagtccagagaagtcagg

SEQ ID NO: 7695679 - DNA, 22 bp, Homo sapiens
tgtgaaggtttttatgggatat

SEQ ID NO: 7695680 - DNA, 22 bp, Homo sapiens
tgtgaataatgccgcaataaac

SEQ ID NO: 7695681 - DNA, 23 bp, Homo sapiens
tgtgaaggtgggtccaagggctg

SEQ ID NO: 7695682 - DNA, 22 bp, Homo sapiens
tgtgaaggttaaataatatgat

SEQ ID NO: 7695683 - DNA, 22 bp, Homo sapiens
tgtgaacagtatgtcatttcac

SEQ ID NO: 7695684 - DNA, 22 bp, Homo sapiens
tgtgaacatttctggttatttg

SEQ ID NO: 7695685 - DNA, 22 bp, Homo sapiens
tgtgaacattcagatcaagctc

SEQ ID NO: 7695686 - DNA, 22 bp, Homo sapiens
tgtgaacattcagatcaagctc

SEQ ID NO: 7695687 - DNA, 22 bp, Homo sapiens
tgtgaacatttctggttatttg

SEQ ID NO: 7695688 - DNA, 22 bp, Homo sapiens
tgtgaatagtgccgcaataaac

SEQ ID NO: 7695689 - DNA, 22 bp, Homo sapiens
tgtgaatagattgaagctttgg

SEQ ID NO: 7695690 - DNA, 22 bp, Homo sapiens
tgtgaatagtcagcattttgtt

SEQ ID NO: 7695691 - DNA, 22 bp, Homo sapiens
tgtgaatagattgaagctttgg

SEQ ID NO: 7695692 - DNA, 22 bp, Homo sapiens
tgtgaataccttgaattcatca

SEQ ID NO: 7695693 - DNA, 22 bp, Homo sapiens
tgtgaataccttgaattcatca

SEQ ID NO: 7695694 - DNA, 22 bp, Homo sapiens
tgtgaataccttgaattcatca

SEQ ID NO: 7695695 - DNA, 22 bp, Homo sapiens
tgtgaataccttgaattcatca

SEQ ID NO: 7695696 - DNA, 22 bp, Homo sapiens
tgtgaataccttgaattcatca

SEQ ID NO: 7695697 - DNA, 22 bp, Homo sapiens
tgtgaatacattggtagaagca

SEQ ID NO: 7695698 - DNA, 22 bp, Homo sapiens
tgtgaatatttccttctttgga

SEQ ID NO: 7695699 - DNA, 22 bp, Homo sapiens
tgtgaatgaagaatgctaacct

SEQ ID NO: 7695700 - DNA, 22 bp, Homo sapiens
tgtgaatggacaattaaatcta

SEQ ID NO: 7695701 - DNA, 22 bp, Homo sapiens
tgtgaatggacaattaaatcta

SEQ ID NO: 7695702 - DNA, 22 bp, Homo sapiens
tgtgaatggacaattaaatcta

SEQ ID NO: 7695703 - DNA, 22 bp, Homo sapiens
tgtgaatggacaattaaatcta

SEQ ID NO: 7695704 - DNA, 22 bp, Homo sapiens
tgtgaatatttccttctttgga

SEQ ID NO: 7695705 - DNA, 22 bp, Homo sapiens
tgtgaatatttccttctttgga

SEQ ID NO: 7695706 - DNA, 22 bp, Homo sapiens
tgtgaatatacttaatgccact

SEQ ID NO: 7695707 - DNA, 22 bp, Homo sapiens
tgtgaatatacttaatgccact

SEQ ID NO: 7695708 - DNA, 22 bp, Homo sapiens
tgtgaatatccatttgtttcag

SEQ ID NO: 7695709 - DNA, 22 bp, Homo sapiens
tgtgaatggacaattaaatcta

SEQ ID NO: 7695710 - DNA, 22 bp, Homo sapiens
tgtgaatggcagttggatagca

SEQ ID NO: 7695711 - DNA, 22 bp, Homo sapiens
tgtgaatggacaattaaatcta

SEQ ID NO: 7695712 - DNA, 22 bp, Homo sapiens
tgtgaatggacaattaaatcta

SEQ ID NO: 7695713 - DNA, 22 bp, Homo sapiens
tgtgaatggacaattaaatcta

SEQ ID NO: 7695714 - DNA, 23 bp, Homo sapiens
tgtgaattgaggacatcaaaagc

SEQ ID NO: 7695715 - DNA, 22 bp, Homo sapiens
tgtgacagccagtaaagtaagc

SEQ ID NO: 7695716 - DNA, 22 bp, Homo sapiens
tgtgacagccagtaaagtaagc

SEQ ID NO: 7695717 - DNA, 22 bp, Homo sapiens
tgtgacagcacggttcaactgc

SEQ ID NO: 7695718 - DNA, 22 bp, Homo sapiens
tgtgacagcacggttcaactgc

SEQ ID NO: 7695719 - DNA, 22 bp, Homo sapiens
tgtgacagatctttaaataatg

SEQ ID NO: 7695720 - DNA, 22 bp, Homo sapiens
tgtgacagatctttaaataatg

SEQ ID NO: 7695721 - DNA, 22 bp, Homo sapiens
tgtgacagcaataactacttaa

SEQ ID NO: 7695722 - DNA, 22 bp, Homo sapiens
tgtgacagatctctatacatga

SEQ ID NO: 7695723 - DNA, 22 bp, Homo sapiens
tgtgacagatctctatacatga

SEQ ID NO: 7695724 - DNA, 22 bp, Homo sapiens
tgtgacagatctctatacatga

SEQ ID NO: 7695725 - DNA, 22 bp, Homo sapiens
tgtgacagatctttaaataatg

SEQ ID NO: 7695726 - DNA, 22 bp, Homo sapiens
tgtgacagatctttaaataatg

SEQ ID NO: 7695727 - DNA, 22 bp, Homo sapiens
tgtgacagaaagtggatgggac

SEQ ID NO: 7695728 - DNA, 22 bp, Homo sapiens
tgtgacagaaagtggatgggac

SEQ ID NO: 7695729 - DNA, 22 bp, Homo sapiens
tgtgacagaaagtggatgggac

SEQ ID NO: 7695730 - DNA, 22 bp, Homo sapiens
tgtgacagaattggtctgttct

SEQ ID NO: 7695731 - DNA, 22 bp, Homo sapiens
tgtgacagaattggtctgttct

SEQ ID NO: 7695732 - DNA, 22 bp, Homo sapiens
tgtgacagaattggtctgttct

SEQ ID NO: 7695733 - DNA, 22 bp, Homo sapiens
tgtgacagaattggtctgttct

SEQ ID NO: 7695734 - DNA, 21 bp, Homo sapiens
tgtgacagaggcggtgcctac

SEQ ID NO: 7695735 - DNA, 21 bp, Homo sapiens
tgtgacagaggcggtgcctac

SEQ ID NO: 7695736 - DNA, 23 bp, Homo sapiens
tgtgaattgaggacatcaaaagc

SEQ ID NO: 7695737 - DNA, 23 bp, Homo sapiens
tgtgaattgaggacatcaaaagc

SEQ ID NO: 7695738 - DNA, 20 bp, Homo sapiens
tgtgacaaaggcatatttta

SEQ ID NO: 7695739 - DNA, 20 bp, Homo sapiens
tgtgacaaaggcatatttta

SEQ ID NO: 7695740 - DNA, 22 bp, Homo sapiens
tgtgacaagcattgtatattgg

SEQ ID NO: 7695741 - DNA, 22 bp, Homo sapiens
tgtgacataaaaacagcaatca

SEQ ID NO: 7695742 - DNA, 22 bp, Homo sapiens
tgtgacagttagtttggtgtta

SEQ ID NO: 7695743 - DNA, 22 bp, Homo sapiens
tgtgacagttagtttggtgtta

SEQ ID NO: 7695744 - DNA, 22 bp, Homo sapiens
tgtgacatcgctgtgtctgttt

SEQ ID NO: 7695745 - DNA, 22 bp, Homo sapiens
tgtgacagtgccagcttcatag

SEQ ID NO: 7695746 - DNA, 23 bp, Homo sapiens
tgtgacagtgacaatactgactt

SEQ ID NO: 7695747 - DNA, 23 bp, Homo sapiens
tgtgacagtgacaatactgactt

SEQ ID NO: 7695748 - DNA, 22 bp, Homo sapiens
tgtgacagtgccagcttcatag

SEQ ID NO: 7695749 - DNA, 22 bp, Homo sapiens
tgtgacagtgccagcttcatag

SEQ ID NO: 7695750 - DNA, 22 bp, Homo sapiens
tgtgacagtgccagcttcatag

SEQ ID NO: 7695751 - DNA, 22 bp, Homo sapiens
tgtgacagtcgttaggagctca

SEQ ID NO: 7695752 - DNA, 22 bp, Homo sapiens
tgtgacagtaacttgggatgga

SEQ ID NO: 7695753 - DNA, 23 bp, Homo sapiens
tgtgacagtgacaatactgactt

SEQ ID NO: 7695754 - DNA, 23 bp, Homo sapiens
tgtgacagggtcattgaaaaggg

SEQ ID NO: 7695755 - DNA, 23 bp, Homo sapiens
tgtgacagggtcattgaaaaggg

SEQ ID NO: 7695756 - DNA, 22 bp, Homo sapiens
tgtgacaggaactatgtggatg

SEQ ID NO: 7695757 - DNA, 22 bp, Homo sapiens
tgtgacaggaactatgtggatg

SEQ ID NO: 7695758 - DNA, 22 bp, Homo sapiens
tgtgacagccagtaaagtaagc

SEQ ID NO: 7695759 - DNA, 22 bp, Homo sapiens
tgtgacaggaactatgtggatg

SEQ ID NO: 7695760 - DNA, 22 bp, Homo sapiens
tgtgacaggaactatgtggatg

SEQ ID NO: 7695761 - DNA, 23 bp, Homo sapiens
tgtgacagggtcattgaaaaggg

SEQ ID NO: 7695762 - DNA, 22 bp, Homo sapiens
tgtgacagtaacttgggatgga

SEQ ID NO: 7695763 - DNA, 22 bp, Homo sapiens
tgtgacagtaacttgggatgga

SEQ ID NO: 7695764 - DNA, 22 bp, Homo sapiens
tgtgacagtcgttaggagctca

SEQ ID NO: 7695765 - DNA, 22 bp, Homo sapiens
tgtgacagtcgttaggagctca

SEQ ID NO: 7695766 - DNA, 23 bp, Homo sapiens
tgtgacagggtcattgaaaaggg

SEQ ID NO: 7695767 - DNA, 23 bp, Homo sapiens
tgtgacagggtcattgaaaaggg

SEQ ID NO: 7695768 - DNA, 23 bp, Homo sapiens
tgtgacagggtcattgaaaaggg

SEQ ID NO: 7695769 - DNA, 22 bp, Homo sapiens
tgtgaaattacttaaaggaaat

SEQ ID NO: 7695770 - DNA, 22 bp, Homo sapiens
tgtgaaatgtgtgtataattaa

SEQ ID NO: 7695771 - DNA, 22 bp, Homo sapiens
tgtgaaatgtgtgtataattaa

SEQ ID NO: 7695772 - DNA, 22 bp, Homo sapiens
tgtgaaattcttgaaatgcaca

SEQ ID NO: 7695773 - DNA, 22 bp, Homo sapiens
tgtgaaattcttgaaatgcaca

SEQ ID NO: 7695774 - DNA, 22 bp, Homo sapiens
tgtgaaattcttgaaatgcaca

SEQ ID NO: 7695775 - DNA, 22 bp, Homo sapiens
tgtgaaattgagaaactttcac

SEQ ID NO: 7695776 - DNA, 22 bp, Homo sapiens
tgtgaaattgaatgcccattgc

SEQ ID NO: 7695777 - DNA, 22 bp, Homo sapiens
tgtgaaattgagaaactttcac

SEQ ID NO: 7695778 - DNA, 23 bp, Homo sapiens
tgtgaaatttgaggtcagtgctt

SEQ ID NO: 7695779 - DNA, 22 bp, Homo sapiens
tgtgaaatgagtatatttgaat

SEQ ID NO: 7695780 - DNA, 22 bp, Homo sapiens
tgtgaaatgaagataattcttg

SEQ ID NO: 7695781 - DNA, 22 bp, Homo sapiens
tgtgaaatgaagataattcttg

SEQ ID NO: 7695782 - DNA, 22 bp, Homo sapiens
tgtgaaatgagtatatttgaat

SEQ ID NO: 7695783 - DNA, 22 bp, Homo sapiens
tgtgaaatgctattgtgacaaa

SEQ ID NO: 7695784 - DNA, 22 bp, Homo sapiens
tgtgaaatgagtatatttgaat

SEQ ID NO: 7695785 - DNA, 22 bp, Homo sapiens
tgtgaaatgctattgtgacaaa

SEQ ID NO: 7695786 - DNA, 22 bp, Homo sapiens
tgtgaaatgctattgtgacaaa

SEQ ID NO: 7695787 - DNA, 22 bp, Homo sapiens
tgtgaaatgctatttccatgag

SEQ ID NO: 7695788 - DNA, 22 bp, Homo sapiens
tgtgaaatgtgtgtataattaa

SEQ ID NO: 7695789 - DNA, 22 bp, Homo sapiens
tgtgaaatgtggatgttaatag

SEQ ID NO: 7695790 - DNA, 22 bp, Homo sapiens
tgtgaaatgtggatgttaatag

SEQ ID NO: 7695791 - DNA, 22 bp, Homo sapiens
tgtgaaatcacaggctatttag

SEQ ID NO: 7695792 - DNA, 22 bp, Homo sapiens
tgtgaaatcacaggctatttag

SEQ ID NO: 7695793 - DNA, 22 bp, Homo sapiens
tgtgaaatctgaactcaaagat

SEQ ID NO: 7695794 - DNA, 22 bp, Homo sapiens
tgtgaaatctgaactcaaagat

SEQ ID NO: 7695795 - DNA, 22 bp, Homo sapiens
tgtgaaatctgatgaattgacc

SEQ ID NO: 7695796 - DNA, 22 bp, Homo sapiens
tgtgaaatctgatgaattgacc

SEQ ID NO: 7695797 - DNA, 22 bp, Homo sapiens
tgtgaaatatttatatactcaa

SEQ ID NO: 7695798 - DNA, 22 bp, Homo sapiens
tgtgaaatcaattagctgcaga

SEQ ID NO: 7695799 - DNA, 22 bp, Homo sapiens
tgtgaaagtcaaattaattgaa

SEQ ID NO: 7695800 - DNA, 22 bp, Homo sapiens
tgtgaaatattggcaatttcat

SEQ ID NO: 7695801 - DNA, 21 bp, Homo sapiens
tgtgaaatagctatgctacat

SEQ ID NO: 7695802 - DNA, 22 bp, Homo sapiens
tgtgaaatattggcaatttcat

SEQ ID NO: 7695803 - DNA, 22 bp, Homo sapiens
tgtgaaagagtcttatagtttc

SEQ ID NO: 7695804 - DNA, 22 bp, Homo sapiens
tgtgaaagagtcttatagtttc

SEQ ID NO: 7695805 - DNA, 22 bp, Homo sapiens
tgtgaaacggagtcagggaagg

SEQ ID NO: 7695806 - DNA, 22 bp, Homo sapiens
tgtgaaagagtcttatagtttc

SEQ ID NO: 7695807 - DNA, 22 bp, Homo sapiens
tgtgaaagagtcttatagtttc

SEQ ID NO: 7695808 - DNA, 22 bp, Homo sapiens
tgtgaaagatactaggcagagg

SEQ ID NO: 7695809 - DNA, 22 bp, Homo sapiens
tgtgaaagcaagtctagttctc

SEQ ID NO: 7695810 - DNA, 22 bp, Homo sapiens
tgtgaaaggagccatagacagt

SEQ ID NO: 7695811 - DNA, 22 bp, Homo sapiens
tgtgaaaggagccatagacagt

SEQ ID NO: 7695812 - DNA, 22 bp, Homo sapiens
tgtgaaaggagccatagacagt

SEQ ID NO: 7695813 - DNA, 19 bp, Homo sapiens
tgtgaaagctagtgttctt

SEQ ID NO: 7695814 - DNA, 22 bp, Homo sapiens
tgtgaaaggggtcacagggaaa

SEQ ID NO: 7695815 - DNA, 22 bp, Homo sapiens
tgtgaaagtcaaattaattgaa

SEQ ID NO: 7695816 - DNA, 21 bp, Homo sapiens
tgtgaaatagctatgctacat

SEQ ID NO: 7695817 - DNA, 22 bp, Homo sapiens
tgtgagtgacagttcccttggt

SEQ ID NO: 7695818 - DNA, 22 bp, Homo sapiens
tgtgagttcttagaaagtcagt

SEQ ID NO: 7695819 - DNA, 22 bp, Homo sapiens
tgtgagttattttcaggagttt

SEQ ID NO: 7695820 - DNA, 22 bp, Homo sapiens
tgtgataacttttacattttcg

SEQ ID NO: 7695821 - DNA, 22 bp, Homo sapiens
tgtgagttcttattgctcatct

SEQ ID NO: 7695822 - DNA, 22 bp, Homo sapiens
tgtgagttgctcttttgctact

SEQ ID NO: 7695823 - DNA, 22 bp, Homo sapiens
tgtgagttgctcttttgctact

SEQ ID NO: 7695824 - DNA, 22 bp, Homo sapiens
tgtgagttcttattgctcatct

SEQ ID NO: 7695825 - DNA, 22 bp, Homo sapiens
tgtgagcactgtgatgctgttc

SEQ ID NO: 7695826 - DNA, 22 bp, Homo sapiens
tgtgagcagagacatgaaaagc

SEQ ID NO: 7695827 - DNA, 22 bp, Homo sapiens
tgtgagcactgtgatgctgttc

SEQ ID NO: 7695828 - DNA, 22 bp, Homo sapiens
tgtgagcactgtgatgctgttc

SEQ ID NO: 7695829 - DNA, 22 bp, Homo sapiens
tgtgagcactgtgatgctgttc

SEQ ID NO: 7695830 - DNA, 22 bp, Homo sapiens
tgtgagcactggctgggaaagt

SEQ ID NO: 7695831 - DNA, 22 bp, Homo sapiens
tgtgagtgaatgggtctgaagt

SEQ ID NO: 7695832 - DNA, 22 bp, Homo sapiens
tgtgagtctaggtcagggtgtt

SEQ ID NO: 7695833 - DNA, 21 bp, Homo sapiens
tgtgagtccatctgagcagaa

SEQ ID NO: 7695834 - DNA, 22 bp, Homo sapiens
tgtgagcactatggctaggctc

SEQ ID NO: 7695835 - DNA, 22 bp, Homo sapiens
tgtgagattttatttgatatgc

SEQ ID NO: 7695836 - DNA, 22 bp, Homo sapiens
tgtgagcaagattcagagattc

SEQ ID NO: 7695837 - DNA, 22 bp, Homo sapiens
tgtgagcaagattcagagattc

SEQ ID NO: 7695838 - DNA, 22 bp, Homo sapiens
tgtgagagctgcttcagccagg

SEQ ID NO: 7695839 - DNA, 22 bp, Homo sapiens
tgtgagagctgcttcagccagg

SEQ ID NO: 7695840 - DNA, 22 bp, Homo sapiens
tgtgagaggagaaatgcattaa

SEQ ID NO: 7695841 - DNA, 19 bp, Homo sapiens
tgtgagaggctagctgccc

SEQ ID NO: 7695842 - DNA, 20 bp, Homo sapiens
tgtgagagggtggcttgccc

SEQ ID NO: 7695843 - DNA, 19 bp, Homo sapiens
tgtgagaggctagctgccc

SEQ ID NO: 7695844 - DNA, 22 bp, Homo sapiens
tgtgagaggagaaatgcattaa

SEQ ID NO: 7695845 - DNA, 22 bp, Homo sapiens
tgtgagagttgagatattttgc

SEQ ID NO: 7695846 - DNA, 22 bp, Homo sapiens
tgtgagagttgagatattttgc

SEQ ID NO: 7695847 - DNA, 22 bp, Homo sapiens
tgtgagagtataatctctctgt

SEQ ID NO: 7695848 - DNA, 22 bp, Homo sapiens
tgtgatactggtttatatcatt

SEQ ID NO: 7695849 - DNA, 21 bp, Homo sapiens
tgtgataatactatatgctct

SEQ ID NO: 7695850 - DNA, 19 bp, Homo sapiens
tgtgataagcagaattcca

SEQ ID NO: 7695851 - DNA, 19 bp, Homo sapiens
tgtgataagcagaattcca

SEQ ID NO: 7695852 - DNA, 22 bp, Homo sapiens
tgtgataagttaaattaaacct

SEQ ID NO: 7695853 - DNA, 22 bp, Homo sapiens
tgtgatcacatctgggctgaag

SEQ ID NO: 7695854 - DNA, 22 bp, Homo sapiens
tgtgatatttgagtattgtcaa

SEQ ID NO: 7695855 - DNA, 22 bp, Homo sapiens
tgtgatatttgagtattgtcaa

SEQ ID NO: 7695856 - DNA, 22 bp, Homo sapiens
tgtgagtgacagttcccttggt

SEQ ID NO: 7695857 - DNA, 22 bp, Homo sapiens
tgtgatgctggagtgcgaatat

SEQ ID NO: 7695858 - DNA, 22 bp, Homo sapiens
tgtgatcttagacaactcactg

SEQ ID NO: 7695859 - DNA, 22 bp, Homo sapiens
tgtgatgaagagtccaagaaca

SEQ ID NO: 7695860 - DNA, 22 bp, Homo sapiens
tgtgatgcatagtttttattgc

SEQ ID NO: 7695861 - DNA, 22 bp, Homo sapiens
tgtgatctgccttggatctgca

SEQ ID NO: 7695862 - DNA, 22 bp, Homo sapiens
tgtgatggttcactgggcatga

SEQ ID NO: 7695863 - DNA, 22 bp, Homo sapiens
tgtgatggttcactgggcatga

SEQ ID NO: 7695864 - DNA, 22 bp, Homo sapiens
tgtgatgtcagtggtatcaaag

SEQ ID NO: 7695865 - DNA, 22 bp, Homo sapiens
tgtgattttcgttatggcttgg

SEQ ID NO: 7695866 - DNA, 18 bp, Homo sapiens
tgtgatttggctggaaat

SEQ ID NO: 7695867 - DNA, 22 bp, Homo sapiens
tgtgattttcaaggtgactcaa

SEQ ID NO: 7695868 - DNA, 22 bp, Homo sapiens
tgtgcaaaataataaatcactg

SEQ ID NO: 7695869 - DNA, 22 bp, Homo sapiens
tgtgcaaaataataaatcactg

SEQ ID NO: 7695870 - DNA, 22 bp, Homo sapiens
tgtgcaaagtgtacaaattaat

SEQ ID NO: 7695871 - DNA, 22 bp, Homo sapiens
tgtgatttcatctgaggccagg

SEQ ID NO: 7695872 - DNA, 22 bp, Homo sapiens
tgtgatttcactggtgacatgt

SEQ ID NO: 7695873 - DNA, 22 bp, Homo sapiens
tgtgatttcatctgaggccagg

SEQ ID NO: 7695874 - DNA, 22 bp, Homo sapiens
tgtgatttccagccattaaaaa

SEQ ID NO: 7695875 - DNA, 22 bp, Homo sapiens
tgtgattatattgtagtacatt

SEQ ID NO: 7695876 - DNA, 22 bp, Homo sapiens
tgtgattagctgaatacactgg

SEQ ID NO: 7695877 - DNA, 22 bp, Homo sapiens
tgtgattactgaatagaaaata

SEQ ID NO: 7695878 - DNA, 22 bp, Homo sapiens
tgtgattctcagaagagggaag

SEQ ID NO: 7695879 - DNA, 22 bp, Homo sapiens
tgtgattgtagtatacatatta

SEQ ID NO: 7695880 - DNA, 22 bp, Homo sapiens
tgtgatttatgcatggggaagt

SEQ ID NO: 7695881 - DNA, 22 bp, Homo sapiens
tgtgatttattgaaaagagctt

SEQ ID NO: 7695882 - DNA, 22 bp, Homo sapiens
tgtgatttattgaaaagagctt

SEQ ID NO: 7695883 - DNA, 21 bp, Homo sapiens
tgtgacctccctctatctttc

SEQ ID NO: 7695884 - DNA, 22 bp, Homo sapiens
tgtgaccttatttagaaatacc

SEQ ID NO: 7695885 - DNA, 22 bp, Homo sapiens
tgtgaccttatttagaaatacc

SEQ ID NO: 7695886 - DNA, 22 bp, Homo sapiens
tgtgaccttatttagaaatacc

SEQ ID NO: 7695887 - DNA, 22 bp, Homo sapiens
tgtgacgttgttctggattccc

SEQ ID NO: 7695888 - DNA, 20 bp, Homo sapiens
tgtgacgacatcaaaatatt

SEQ ID NO: 7695889 - DNA, 22 bp, Homo sapiens
tgtgaccataatttgtaaataa

SEQ ID NO: 7695890 - DNA, 22 bp, Homo sapiens
tgtgacctcatcttaactggaa

SEQ ID NO: 7695891 - DNA, 22 bp, Homo sapiens
tgtgacctcatcttaactggaa

SEQ ID NO: 7695892 - DNA, 22 bp, Homo sapiens
tgtgacatgtgtcatcttttct

SEQ ID NO: 7695893 - DNA, 17 bp, Homo sapiens
tgtgacattgggacatt

SEQ ID NO: 7695894 - DNA, 22 bp, Homo sapiens
tgtgacatgtgtcatcttttct

SEQ ID NO: 7695895 - DNA, 22 bp, Homo sapiens
tgtgacatcgctgtgtctgttt

SEQ ID NO: 7695896 - DNA, 22 bp, Homo sapiens
tgtgacatgcaggaggtgctca

SEQ ID NO: 7695897 - DNA, 22 bp, Homo sapiens
tgtgaccactagcacagctgcc

SEQ ID NO: 7695898 - DNA, 22 bp, Homo sapiens
tgtgaccactagcacagctgcc

SEQ ID NO: 7695899 - DNA, 17 bp, Homo sapiens
tgtgacattgggacatt

SEQ ID NO: 7695900 - DNA, 22 bp, Homo sapiens
tgtgaccatttgccacaatggt

SEQ ID NO: 7695901 - DNA, 22 bp, Homo sapiens
tgtgaccataatttgtaaataa

SEQ ID NO: 7695902 - DNA, 22 bp, Homo sapiens
tgtgactggagtccagcccact

SEQ ID NO: 7695903 - DNA, 22 bp, Homo sapiens
tgtgactggagtccagcccact

SEQ ID NO: 7695904 - DNA, 22 bp, Homo sapiens
tgtgactggagtccagcccact

SEQ ID NO: 7695905 - DNA, 22 bp, Homo sapiens
tgtgactggagtccagcccact

SEQ ID NO: 7695906 - DNA, 22 bp, Homo sapiens
tgtgactgaggctccaagctag

SEQ ID NO: 7695907 - DNA, 22 bp, Homo sapiens
tgtgactgagctgcagagtgtc

SEQ ID NO: 7695908 - DNA, 22 bp, Homo sapiens
tgtgactggcttatttcactta

SEQ ID NO: 7695909 - DNA, 22 bp, Homo sapiens
tgtgactggttgggaagaggct

SEQ ID NO: 7695910 - DNA, 22 bp, Homo sapiens
tgtgactgagctgcagagtgtc

SEQ ID NO: 7695911 - DNA, 22 bp, Homo sapiens
tgtgactgagctgcagagtgtc

SEQ ID NO: 7695912 - DNA, 22 bp, Homo sapiens
tgtgactgagctgcagagtgtc

SEQ ID NO: 7695913 - DNA, 22 bp, Homo sapiens
tgtgactaggcctgagctcttg

SEQ ID NO: 7695914 - DNA, 22 bp, Homo sapiens
tgtgactaggcctgagctcttg

SEQ ID NO: 7695915 - DNA, 22 bp, Homo sapiens
tgtgactatcattctaaacatc

SEQ ID NO: 7695916 - DNA, 22 bp, Homo sapiens
tgtgactgaagtgtctagacct

SEQ ID NO: 7695917 - DNA, 22 bp, Homo sapiens
tgtgagagctccatcctcatga

SEQ ID NO: 7695918 - DNA, 22 bp, Homo sapiens
tgtgagagcagaagacacatag

SEQ ID NO: 7695919 - DNA, 22 bp, Homo sapiens
tgtgagagcagaagacacatag

SEQ ID NO: 7695920 - DNA, 22 bp, Homo sapiens
tgtgagagcagaagacacatag

SEQ ID NO: 7695921 - DNA, 22 bp, Homo sapiens
tgtgagagagtgcatttgcata

SEQ ID NO: 7695922 - DNA, 22 bp, Homo sapiens
tgtgagagagtgcatttgcata

SEQ ID NO: 7695923 - DNA, 22 bp, Homo sapiens
tgtgagagaagtgtgtgctccc

SEQ ID NO: 7695924 - DNA, 22 bp, Homo sapiens
tgtgagagagtgcatttgcata

SEQ ID NO: 7695925 - DNA, 22 bp, Homo sapiens
tgtgagacacactgctgcttca

SEQ ID NO: 7695926 - DNA, 22 bp, Homo sapiens
tgtgagacaggatttagagcag

SEQ ID NO: 7695927 - DNA, 22 bp, Homo sapiens
tgtgagaagggtgaggctttta

SEQ ID NO: 7695928 - DNA, 22 bp, Homo sapiens
tgtgagaagggcatgcagggag

SEQ ID NO: 7695929 - DNA, 22 bp, Homo sapiens
tgtgagaagggtgaggctttta

SEQ ID NO: 7695930 - DNA, 22 bp, Homo sapiens
tgtgagaagggtgaggctttta

SEQ ID NO: 7695931 - DNA, 22 bp, Homo sapiens
tgtgagaattcctgatcacagg

SEQ ID NO: 7695932 - DNA, 22 bp, Homo sapiens
tgtgactgtggtgagatttaag

SEQ ID NO: 7695933 - DNA, 22 bp, Homo sapiens
tgtgacttaatccttgggtggg

SEQ ID NO: 7695934 - DNA, 22 bp, Homo sapiens
tgtgactgtggacttttgtggg

SEQ ID NO: 7695935 - DNA, 22 bp, Homo sapiens
tgtgactggttgtcccgctttc

SEQ ID NO: 7695936 - DNA, 22 bp, Homo sapiens
tgtgactggttgtcccgctttc

SEQ ID NO: 7695937 - DNA, 21 bp, Homo sapiens
tgtgagaagagtactgaggtc

SEQ ID NO: 7695938 - DNA, 22 bp, Homo sapiens
tgtgacttctttttgagttcaa

SEQ ID NO: 7695939 - DNA, 22 bp, Homo sapiens
tgtgacttataacatagaattt

SEQ ID NO: 7695940 - DNA, 22 bp, Homo sapiens
tgtgacttataacatagaattt

SEQ ID NO: 7695941 - DNA, 22 bp, Homo sapiens
tgtgacttataacatagaattt

SEQ ID NO: 7695942 - DNA, 22 bp, Homo sapiens
tgtgacttgatgtttgcaccag

SEQ ID NO: 7695943 - DNA, 22 bp, Homo sapiens
tgtctctcctgatgatctggtg

SEQ ID NO: 7695944 - DNA, 20 bp, Homo sapiens
tgtctctcggttttgtgact

SEQ ID NO: 7695945 - DNA, 18 bp, Homo sapiens
tgtctctcctttctgtgt

SEQ ID NO: 7695946 - DNA, 18 bp, Homo sapiens
tgtctctcctttctgtgt

SEQ ID NO: 7695947 - DNA, 18 bp, Homo sapiens
tgtctctcctttctgtgt

SEQ ID NO: 7695948 - DNA, 22 bp, Homo sapiens
tgtctctcctgatgatctggtg

SEQ ID NO: 7695949 - DNA, 18 bp, Homo sapiens
tgtctctcctttctgtgt

SEQ ID NO: 7695950 - DNA, 22 bp, Homo sapiens
tgtctccttgcttttccctgta

SEQ ID NO: 7695951 - DNA, 21 bp, Homo sapiens
tgtctcctgttggcacatggc

SEQ ID NO: 7695952 - DNA, 22 bp, Homo sapiens
tgtctctagggcaatgtgaact

SEQ ID NO: 7695953 - DNA, 22 bp, Homo sapiens
tgtctccttgcttttccctgta

SEQ ID NO: 7695954 - DNA, 22 bp, Homo sapiens
tgtctctcatttagttttgcac

SEQ ID NO: 7695955 - DNA, 22 bp, Homo sapiens
tgtctctagggcaatgtgaact

SEQ ID NO: 7695956 - DNA, 20 bp, Homo sapiens
tgtctctcagtgtcagtgca

SEQ ID NO: 7695957 - DNA, 22 bp, Homo sapiens
tgtctcctgggtcccttccacc

SEQ ID NO: 7695958 - DNA, 22 bp, Homo sapiens
tgtctcctgggtcccttccacc

SEQ ID NO: 7695959 - DNA, 21 bp, Homo sapiens
tgtctcctgttggcacatggc

SEQ ID NO: 7695960 - DNA, 21 bp, Homo sapiens
tgtctcctgttggcacatggc

SEQ ID NO: 7695961 - DNA, 21 bp, Homo sapiens
tgtctcctgttggcacatggc

SEQ ID NO: 7695962 - DNA, 21 bp, Homo sapiens
tgtctcctgttggcacatggc

SEQ ID NO: 7695963 - DNA, 22 bp, Homo sapiens
tgtctcctctgtcctgtcagga

SEQ ID NO: 7695964 - DNA, 22 bp, Homo sapiens
tgtctcctctgtcctgtcagga

SEQ ID NO: 7695965 - DNA, 22 bp, Homo sapiens
tgtctcctctgtcctgtcagga

SEQ ID NO: 7695966 - DNA, 22 bp, Homo sapiens
tgtctcctgagagctggacaga

SEQ ID NO: 7695967 - DNA, 22 bp, Homo sapiens
tgtctcctgagagctggacaga

SEQ ID NO: 7695968 - DNA, 22 bp, Homo sapiens
tgtctcctgggccctggccctg

SEQ ID NO: 7695969 - DNA, 22 bp, Homo sapiens
tgtctcctactgcctgtggatc

SEQ ID NO: 7695970 - DNA, 22 bp, Homo sapiens
tgtctcctactgcctgtggatc

SEQ ID NO: 7695971 - DNA, 22 bp, Homo sapiens
tgtctcctactgcctgtggatc

SEQ ID NO: 7695972 - DNA, 22 bp, Homo sapiens
tgtctcctactgcctgtggatc

SEQ ID NO: 7695973 - DNA, 22 bp, Homo sapiens
tgtctcctaatgtctgtttcct

SEQ ID NO: 7695974 - DNA, 23 bp, Homo sapiens
tgtctccatctcattacttgggg

SEQ ID NO: 7695975 - DNA, 23 bp, Homo sapiens
tgtctccatctcattacttgggg

SEQ ID NO: 7695976 - DNA, 23 bp, Homo sapiens
tgtctccatctcattacttgggg

SEQ ID NO: 7695977 - DNA, 22 bp, Homo sapiens
tgtctccatggtgaagcagggt

SEQ ID NO: 7695978 - DNA, 23 bp, Homo sapiens
tgtctccatctcattacttgggg

SEQ ID NO: 7695979 - DNA, 22 bp, Homo sapiens
tgtctccattttcaagtagcag

SEQ ID NO: 7695980 - DNA, 22 bp, Homo sapiens
tgtctcccaggtgtgcccagtg

SEQ ID NO: 7695981 - DNA, 22 bp, Homo sapiens
tgtctcccaggtgtgcccagtg

SEQ ID NO: 7695982 - DNA, 22 bp, Homo sapiens
tgtctcccaggtgtgcccagtg

SEQ ID NO: 7695983 - DNA, 22 bp, Homo sapiens
tgtctcccaggtgtgcccagtg

SEQ ID NO: 7695984 - DNA, 22 bp, Homo sapiens
tgtctcccaggtgtgcccagtg

SEQ ID NO: 7695985 - DNA, 22 bp, Homo sapiens
tgtctccattttcaagtagcag

SEQ ID NO: 7695986 - DNA, 22 bp, Homo sapiens
tgtctccatgtgatagtggcct

SEQ ID NO: 7695987 - DNA, 22 bp, Homo sapiens
tgtctccatgtgatagtggcct

SEQ ID NO: 7695988 - DNA, 22 bp, Homo sapiens
tgtctcctcaactcatgctcga

SEQ ID NO: 7695989 - DNA, 19 bp, Homo sapiens
tgtctcctcatgcaagtgt

SEQ ID NO: 7695990 - DNA, 22 bp, Homo sapiens
tgtctcctcatactgtcatatt

SEQ ID NO: 7695991 - DNA, 22 bp, Homo sapiens
tgtctcctcatactgtcatatt

SEQ ID NO: 7695992 - DNA, 19 bp, Homo sapiens
tgtctcctccccgccgtct

SEQ ID NO: 7695993 - DNA, 22 bp, Homo sapiens
tgtctcctatttcctgctaagg

SEQ ID NO: 7695994 - DNA, 22 bp, Homo sapiens
tgtctcctatttcctgctaagg

SEQ ID NO: 7695995 - DNA, 22 bp, Homo sapiens
tgtctcctatttcctgctaagg

SEQ ID NO: 7695996 - DNA, 22 bp, Homo sapiens
tgtctcctatttcctgctaagg

SEQ ID NO: 7695997 - DNA, 22 bp, Homo sapiens
tgtctcctcaactcatgctcga

SEQ ID NO: 7695998 - DNA, 22 bp, Homo sapiens
tgtctcctcaactcatgctcga

SEQ ID NO: 7695999 - DNA, 22 bp, Homo sapiens
tgtctcctcaactcatgctcga

SEQ ID NO: 7696000 - DNA, 22 bp, Homo sapiens
tgtctacttgggctctacagca

SEQ ID NO: 7696001 - DNA, 22 bp, Homo sapiens
tgtctacttgggctctacagca

SEQ ID NO: 7696002 - DNA, 22 bp, Homo sapiens
tgtctagacaagaagtattgcc

SEQ ID NO: 7696003 - DNA, 22 bp, Homo sapiens
tgtctagaaatgctgagtctca

SEQ ID NO: 7696004 - DNA, 19 bp, Homo sapiens
tgtctacataatagattga

SEQ ID NO: 7696005 - DNA, 22 bp, Homo sapiens
tgtctactgctgacactaacag

SEQ ID NO: 7696006 - DNA, 21 bp, Homo sapiens
tgtctagacctcatcctacag

SEQ ID NO: 7696007 - DNA, 22 bp, Homo sapiens
tgtctagacattagcttcagct

SEQ ID NO: 7696008 - DNA, 22 bp, Homo sapiens
tgtctagacattagcttcagct

SEQ ID NO: 7696009 - DNA, 22 bp, Homo sapiens
tgtctagaggccaacaggaaag

SEQ ID NO: 7696010 - DNA, 22 bp, Homo sapiens
tgtctagaggccaacaggaaag

SEQ ID NO: 7696011 - DNA, 19 bp, Homo sapiens
tgtctagctgcacagctga

SEQ ID NO: 7696012 - DNA, 15 bp, Homo sapiens
tgtctagattgttgt

SEQ ID NO: 7696013 - DNA, 19 bp, Homo sapiens
tgtctagctgcacagctga

SEQ ID NO: 7696014 - DNA, 22 bp, Homo sapiens
tgtctaagggaagatgcaatgt

SEQ ID NO: 7696015 - DNA, 22 bp, Homo sapiens
tgtctaagagtgcaatgcatga

SEQ ID NO: 7696016 - DNA, 22 bp, Homo sapiens
tgtctaatggcaatttcatgtg

SEQ ID NO: 7696017 - DNA, 22 bp, Homo sapiens
tgtctaatgaattaattaatta

SEQ ID NO: 7696018 - DNA, 22 bp, Homo sapiens
tgtctacagaatgttaatattt

SEQ ID NO: 7696019 - DNA, 22 bp, Homo sapiens
tgtctacaaacgtgtacacatt

SEQ ID NO: 7696020 - DNA, 22 bp, Homo sapiens
tgtctacaaacgtgtacacatt

SEQ ID NO: 7696021 - DNA, 22 bp, Homo sapiens
tgtctaaatgcaatggatttcc

SEQ ID NO: 7696022 - DNA, 22 bp, Homo sapiens
tgtctaaatgcaatggatttcc

SEQ ID NO: 7696023 - DNA, 22 bp, Homo sapiens
tgtctaaacttgttttatctca

SEQ ID NO: 7696024 - DNA, 22 bp, Homo sapiens
tgtctaaacttgttttatctca

SEQ ID NO: 7696025 - DNA, 22 bp, Homo sapiens
tgtctaaatgaaaagagatgcc

SEQ ID NO: 7696026 - DNA, 22 bp, Homo sapiens
tgtctaaacttgttttatctca

SEQ ID NO: 7696027 - DNA, 22 bp, Homo sapiens
tgtctaaacttgttttatctca

SEQ ID NO: 7696028 - DNA, 22 bp, Homo sapiens
tgtcgggcatgcattctgagaa

SEQ ID NO: 7696029 - DNA, 23 bp, Homo sapiens
tgtcctttttgaggcctcctcct

SEQ ID NO: 7696030 - DNA, 22 bp, Homo sapiens
tgtcgagttactgagctccagc

SEQ ID NO: 7696031 - DNA, 22 bp, Homo sapiens
tgtcgcagctgaaaatctcaat

SEQ ID NO: 7696032 - DNA, 22 bp, Homo sapiens
tgtctccatagagtagcttgat

SEQ ID NO: 7696033 - DNA, 22 bp, Homo sapiens
tgtctccatagaagagactgca

SEQ ID NO: 7696034 - DNA, 22 bp, Homo sapiens
tgtctccatagaagagactgca

SEQ ID NO: 7696035 - DNA, 22 bp, Homo sapiens
tgtctccaggggcaggccagcc

SEQ ID NO: 7696036 - DNA, 22 bp, Homo sapiens
tgtctccatagaagagactgca

SEQ ID NO: 7696037 - DNA, 22 bp, Homo sapiens
tgtctccatagaagagactgca

SEQ ID NO: 7696038 - DNA, 22 bp, Homo sapiens
tgtctccaggggcaggccagcc

SEQ ID NO: 7696039 - DNA, 22 bp, Homo sapiens
tgtctccaggggcaggccagcc

SEQ ID NO: 7696040 - DNA, 20 bp, Homo sapiens
tgtctccagggctgagtgga

SEQ ID NO: 7696041 - DNA, 20 bp, Homo sapiens
tgtctccagggctgagtgga

SEQ ID NO: 7696042 - DNA, 20 bp, Homo sapiens
tgtctccagggctgagtgga

SEQ ID NO: 7696043 - DNA, 22 bp, Homo sapiens
tgtctccagaaagcaccaggag

SEQ ID NO: 7696044 - DNA, 22 bp, Homo sapiens
tgtctccagaaagcaccaggag

SEQ ID NO: 7696045 - DNA, 22 bp, Homo sapiens
tgtctccagaaagcaccaggag

SEQ ID NO: 7696046 - DNA, 22 bp, Homo sapiens
tgtctccaccatcatcttacca

SEQ ID NO: 7696047 - DNA, 22 bp, Homo sapiens
tgtctccacaggtgtcagctca

SEQ ID NO: 7696048 - DNA, 22 bp, Homo sapiens
tgtctccacaggtgtcagctca

SEQ ID NO: 7696049 - DNA, 22 bp, Homo sapiens
tgtctccacaggtgtcagctca

SEQ ID NO: 7696050 - DNA, 22 bp, Homo sapiens
tgtctagttttagcttttggag

SEQ ID NO: 7696051 - DNA, 20 bp, Homo sapiens
tgtctagttgtgcaagggga

SEQ ID NO: 7696052 - DNA, 22 bp, Homo sapiens
tgtctatacctgatacagagtt

SEQ ID NO: 7696053 - DNA, 22 bp, Homo sapiens
tgtctatagaatcatgcagttt

SEQ ID NO: 7696054 - DNA, 22 bp, Homo sapiens
tgtctatagaatcatgcagttt

SEQ ID NO: 7696055 - DNA, 22 bp, Homo sapiens
tgtctaggttgcggttttatgt

SEQ ID NO: 7696056 - DNA, 22 bp, Homo sapiens
tgtctaggtctaggttggcaat

SEQ ID NO: 7696057 - DNA, 22 bp, Homo sapiens
tgtctaggtctaggttggcaat

SEQ ID NO: 7696058 - DNA, 22 bp, Homo sapiens
tgtctagggtctgccccaccag

SEQ ID NO: 7696059 - DNA, 22 bp, Homo sapiens
tgtctaggtctaggttggcaat

SEQ ID NO: 7696060 - DNA, 22 bp, Homo sapiens
tgtctagggcgagaatgtgtag

SEQ ID NO: 7696061 - DNA, 18 bp, Homo sapiens
tgtctaggtacgatggat

SEQ ID NO: 7696062 - DNA, 22 bp, Homo sapiens
tgtctccaactcactgtatact

SEQ ID NO: 7696063 - DNA, 22 bp, Homo sapiens
tgtctccaactcactgtatact

SEQ ID NO: 7696064 - DNA, 22 bp, Homo sapiens
tgtctccaaaacaatctcagat

SEQ ID NO: 7696065 - DNA, 22 bp, Homo sapiens
tgtctccaactcactgtatact

SEQ ID NO: 7696066 - DNA, 22 bp, Homo sapiens
tgtctccaaaacaatctcagat

SEQ ID NO: 7696067 - DNA, 22 bp, Homo sapiens
tgtctccaaaacaatctcagat

SEQ ID NO: 7696068 - DNA, 22 bp, Homo sapiens
tgtctccaaaacaatctcagat

SEQ ID NO: 7696069 - DNA, 22 bp, Homo sapiens
tgtctctttgggttcctcttgg

SEQ ID NO: 7696070 - DNA, 22 bp, Homo sapiens
tgtctctttggcctcccatatg

SEQ ID NO: 7696071 - DNA, 22 bp, Homo sapiens
tgtctctttgggttcctcttgg

SEQ ID NO: 7696072 - DNA, 22 bp, Homo sapiens
tgtctcttttcaagctaccctt

SEQ ID NO: 7696073 - DNA, 22 bp, Homo sapiens
tgtctcttttcaagctaccctt

SEQ ID NO: 7696074 - DNA, 22 bp, Homo sapiens
tgtctgaaagaggacgagctgg

SEQ ID NO: 7696075 - DNA, 22 bp, Homo sapiens
tgtctgaaagaggacgagctgg

SEQ ID NO: 7696076 - DNA, 22 bp, Homo sapiens
tgtctgaaacttggtcctatgc

SEQ ID NO: 7696077 - DNA, 20 bp, Homo sapiens
tgtctgaaaaggaagctatc

SEQ ID NO: 7696078 - DNA, 22 bp, Homo sapiens
tgtctctttggcctcccatatg

SEQ ID NO: 7696079 - DNA, 22 bp, Homo sapiens
tgtctctttggcctcccatatg

SEQ ID NO: 7696080 - DNA, 22 bp, Homo sapiens
tgtctcttggctctatcactta

SEQ ID NO: 7696081 - DNA, 22 bp, Homo sapiens
tgtctcttggtgtccagaggag

SEQ ID NO: 7696082 - DNA, 22 bp, Homo sapiens
tgtctcttggtgtccagaggag

SEQ ID NO: 7696083 - DNA, 22 bp, Homo sapiens
tgtctcttgttaatgattacta

SEQ ID NO: 7696084 - DNA, 22 bp, Homo sapiens
tgtctcttggctctatcactta

SEQ ID NO: 7696085 - DNA, 22 bp, Homo sapiens
tgtctctggcccatgagcagag

SEQ ID NO: 7696086 - DNA, 22 bp, Homo sapiens
tgtctctggcccatgagcagag

SEQ ID NO: 7696087 - DNA, 22 bp, Homo sapiens
tgtctctgctttccttgcaggg

SEQ ID NO: 7696088 - DNA, 22 bp, Homo sapiens
tgtctctgctttccttgcaggg

SEQ ID NO: 7696089 - DNA, 22 bp, Homo sapiens
tgtctctgctgcaccttctggg

SEQ ID NO: 7696090 - DNA, 22 bp, Homo sapiens
tgtctctgctgcaccttctggg

SEQ ID NO: 7696091 - DNA, 22 bp, Homo sapiens
tgtctctgctttccttgcaggg

SEQ ID NO: 7696092 - DNA, 22 bp, Homo sapiens
tgtctctgctttccttgcaggg

SEQ ID NO: 7696093 - DNA, 22 bp, Homo sapiens
tgtctctgctttccttgcaggg

SEQ ID NO: 7696094 - DNA, 18 bp, Homo sapiens
tgtctctgaattccagtg

SEQ ID NO: 7696095 - DNA, 18 bp, Homo sapiens
tgtctctgaattccagtg

SEQ ID NO: 7696096 - DNA, 18 bp, Homo sapiens
tgtctctgaattccagtg

SEQ ID NO: 7696097 - DNA, 22 bp, Homo sapiens
tgtctctgaagccccctccttt

SEQ ID NO: 7696098 - DNA, 22 bp, Homo sapiens
tgtctctgaactgggttttctt

SEQ ID NO: 7696099 - DNA, 22 bp, Homo sapiens
tgtctctgaacagcttactaaa

SEQ ID NO: 7696100 - DNA, 22 bp, Homo sapiens
tgtctctgaaatatgtggctcc

SEQ ID NO: 7696101 - DNA, 22 bp, Homo sapiens
tgtctctgaaatatgtggctcc

SEQ ID NO: 7696102 - DNA, 22 bp, Homo sapiens
tgtctctgaaatatgtggctcc

SEQ ID NO: 7696103 - DNA, 22 bp, Homo sapiens
tgtctctgaaatatgtggctcc

SEQ ID NO: 7696104 - DNA, 19 bp, Homo sapiens
tgtctctgaaagatgagct

SEQ ID NO: 7696105 - DNA, 22 bp, Homo sapiens
tgtctctctagctcttggtttg

SEQ ID NO: 7696106 - DNA, 22 bp, Homo sapiens
tgtctctctgcccccattgctc

SEQ ID NO: 7696107 - DNA, 22 bp, Homo sapiens
tgtctctctgcccccattgctc

SEQ ID NO: 7696108 - DNA, 22 bp, Homo sapiens
tgtctctgaggtgagggtcagc

SEQ ID NO: 7696109 - DNA, 22 bp, Homo sapiens
tgtctctgagatgactcccacc

SEQ ID NO: 7696110 - DNA, 22 bp, Homo sapiens
tgtctctgaggtgagggtcagc

SEQ ID NO: 7696111 - DNA, 22 bp, Homo sapiens
tgtctctgaggtgagggtcagc

SEQ ID NO: 7696112 - DNA, 22 bp, Homo sapiens
tgtctctgagatgactcccacc

SEQ ID NO: 7696113 - DNA, 18 bp, Homo sapiens
tgtctctgaattccagtg

SEQ ID NO: 7696114 - DNA, 22 bp, Homo sapiens
tgtctctgataagtagttcagt

SEQ ID NO: 7696115 - DNA, 22 bp, Homo sapiens
tgtctctgccagctagcagaat

SEQ ID NO: 7696116 - DNA, 22 bp, Homo sapiens
tgtctctgctgcaccttctggg

SEQ ID NO: 7696117 - DNA, 22 bp, Homo sapiens
tgtctctgataagtagttcagt

SEQ ID NO: 7696118 - DNA, 22 bp, Homo sapiens
tgtctctgataagtagttcagt

SEQ ID NO: 7696119 - DNA, 22 bp, Homo sapiens
tgtctctgaggtgagggtcagc

SEQ ID NO: 7696120 - DNA, 22 bp, Homo sapiens
tgtctctgataagtagttcagt

SEQ ID NO: 7696121 - DNA, 22 bp, Homo sapiens
tgtctctgccagctagcagaat

SEQ ID NO: 7696122 - DNA, 22 bp, Homo sapiens
tgtctctgataagtagttcagt

SEQ ID NO: 7696123 - DNA, 22 bp, Homo sapiens
tgtctgccaaagcttcctcctg

SEQ ID NO: 7696124 - DNA, 22 bp, Homo sapiens
tgtctgccaccccatcaagctc

SEQ ID NO: 7696125 - DNA, 22 bp, Homo sapiens
tgtctgccaccccatcaagctc

SEQ ID NO: 7696126 - DNA, 22 bp, Homo sapiens
tgtctgccattagcccagtcca

SEQ ID NO: 7696127 - DNA, 22 bp, Homo sapiens
tgtctgcagtgccacagtggga

SEQ ID NO: 7696128 - DNA, 22 bp, Homo sapiens
tgtctgccaaagcttcctcctg

SEQ ID NO: 7696129 - DNA, 22 bp, Homo sapiens
tgtctgcagaagatggcatggg

SEQ ID NO: 7696130 - DNA, 22 bp, Homo sapiens
tgtctgcagaagatggcatggg

SEQ ID NO: 7696131 - DNA, 21 bp, Homo sapiens
tgtctgatgtattttttgcct

SEQ ID NO: 7696132 - DNA, 22 bp, Homo sapiens
tgtctgcaaagtccagcacagg

SEQ ID NO: 7696133 - DNA, 22 bp, Homo sapiens
tgtctgagtggtgcaaggctga

SEQ ID NO: 7696134 - DNA, 22 bp, Homo sapiens
tgtctgagtggtgcaaggctga

SEQ ID NO: 7696135 - DNA, 22 bp, Homo sapiens
tgtctgatggggattgctcttc

SEQ ID NO: 7696136 - DNA, 22 bp, Homo sapiens
tgtctgatgatagtgtctctcc

SEQ ID NO: 7696137 - DNA, 22 bp, Homo sapiens
tgtctgatgatagtgtctctcc

SEQ ID NO: 7696138 - DNA, 22 bp, Homo sapiens
tgtctgccctcaacccagaggc

SEQ ID NO: 7696139 - DNA, 21 bp, Homo sapiens
tgtctgcccctgtttaccaga

SEQ ID NO: 7696140 - DNA, 22 bp, Homo sapiens
tgtctgcccattcatgggcaca

SEQ ID NO: 7696141 - DNA, 22 bp, Homo sapiens
tgtctgccattagcccagtcca

SEQ ID NO: 7696142 - DNA, 22 bp, Homo sapiens
tgtctgccctcaacccagaggc

SEQ ID NO: 7696143 - DNA, 22 bp, Homo sapiens
tgtctgccctcaacccagaggc

SEQ ID NO: 7696144 - DNA, 22 bp, Homo sapiens
tgtctgcctgcgggccggcaca

SEQ ID NO: 7696145 - DNA, 22 bp, Homo sapiens
tgtctgcctgcgggccggcaca

SEQ ID NO: 7696146 - DNA, 22 bp, Homo sapiens
tgtctgcctgcgggccggcaca

SEQ ID NO: 7696147 - DNA, 22 bp, Homo sapiens
tgtctgctaaattactattaca

SEQ ID NO: 7696148 - DNA, 22 bp, Homo sapiens
tgtctgcctgtctctgtgcaaa

SEQ ID NO: 7696149 - DNA, 21 bp, Homo sapiens
tgtctgcctgcttcttcactc

SEQ ID NO: 7696150 - DNA, 21 bp, Homo sapiens
tgtctgcctgcttcttcactc

SEQ ID NO: 7696151 - DNA, 20 bp, Homo sapiens
tgtctgctcataataaaccc

SEQ ID NO: 7696152 - DNA, 21 bp, Homo sapiens
tgtctgctgaaggctggtcac

SEQ ID NO: 7696153 - DNA, 20 bp, Homo sapiens
tgtctgctgagctgctgccc

SEQ ID NO: 7696154 - DNA, 22 bp, Homo sapiens
tgtctgctagctggtggcaatt

SEQ ID NO: 7696155 - DNA, 22 bp, Homo sapiens
tgtctgctaaattactattaca

SEQ ID NO: 7696156 - DNA, 21 bp, Homo sapiens
tgtctgctaagctcagcttcc

SEQ ID NO: 7696157 - DNA, 22 bp, Homo sapiens
tgtctgagctggggcagacaga

SEQ ID NO: 7696158 - DNA, 22 bp, Homo sapiens
tgtctgagcacctgtgctgaac

SEQ ID NO: 7696159 - DNA, 18 bp, Homo sapiens
tgtctgagagctgggcgc

SEQ ID NO: 7696160 - DNA, 22 bp, Homo sapiens
tgtctgaattttggaatcaagt

SEQ ID NO: 7696161 - DNA, 22 bp, Homo sapiens
tgtctgactttattaattcaca

SEQ ID NO: 7696162 - DNA, 22 bp, Homo sapiens
tgtctgaggaagtcagcccttt

SEQ ID NO: 7696163 - DNA, 22 bp, Homo sapiens
tgtctgagtgcatatgtgctgg

SEQ ID NO: 7696164 - DNA, 22 bp, Homo sapiens
tgtctgagtcatgcagagatat

SEQ ID NO: 7696165 - DNA, 22 bp, Homo sapiens
tgtctgaaggcctgacctacat

SEQ ID NO: 7696166 - DNA, 22 bp, Homo sapiens
tgtctgaaggcaggtggagaac

SEQ ID NO: 7696167 - DNA, 22 bp, Homo sapiens
tgtctgaatcgcttcctagagg

SEQ ID NO: 7696168 - DNA, 22 bp, Homo sapiens
tgtctgaatctcggtttcctca

SEQ ID NO: 7696169 - DNA, 22 bp, Homo sapiens
tgtctgaattcaagaaattcaa

SEQ ID NO: 7696170 - DNA, 22 bp, Homo sapiens
tgtctgaattccacatcgttct

SEQ ID NO: 7696171 - DNA, 22 bp, Homo sapiens
tgtctgaacaaactctgcctcc

SEQ ID NO: 7696172 - DNA, 22 bp, Homo sapiens
tgtctgaacgaagtaggtccac

SEQ ID NO: 7696173 - DNA, 22 bp, Homo sapiens
tgtctgaactgcactgaaagac

SEQ ID NO: 7696174 - DNA, 22 bp, Homo sapiens
tgtctgaagcagccagtgctgt

SEQ ID NO: 7696175 - DNA, 22 bp, Homo sapiens
tgtcttcgctacaatgaaaagg

SEQ ID NO: 7696176 - DNA, 22 bp, Homo sapiens
tgtcttcctcttggcttgagct

SEQ ID NO: 7696177 - DNA, 22 bp, Homo sapiens
tgtcttccatggttttgacact

SEQ ID NO: 7696178 - DNA, 22 bp, Homo sapiens
tgtcttcattctgtatgtccag

SEQ ID NO: 7696179 - DNA, 20 bp, Homo sapiens
tgtcttccagcaggtgttta

SEQ ID NO: 7696180 - DNA, 22 bp, Homo sapiens
tgtcttcattccccatgaagtc

SEQ ID NO: 7696181 - DNA, 22 bp, Homo sapiens
tgtcttcattccccatgaagtc

SEQ ID NO: 7696182 - DNA, 20 bp, Homo sapiens
tgtcttcattatggtgccct

SEQ ID NO: 7696183 - DNA, 22 bp, Homo sapiens
tgtcttcattccccatgaagtc

SEQ ID NO: 7696184 - DNA, 22 bp, Homo sapiens
tgtcttcattccccatgaagtc

SEQ ID NO: 7696185 - DNA, 22 bp, Homo sapiens
tgtcttcattccccatgaagtc

SEQ ID NO: 7696186 - DNA, 22 bp, Homo sapiens
tgtcttcatggcggaacaactt

SEQ ID NO: 7696187 - DNA, 22 bp, Homo sapiens
tgtcttcatctccatgcacaga

SEQ ID NO: 7696188 - DNA, 22 bp, Homo sapiens
tgtcttcatctccatgcacaga

SEQ ID NO: 7696189 - DNA, 22 bp, Homo sapiens
tgtcttcatgcctgaaagaaga

SEQ ID NO: 7696190 - DNA, 22 bp, Homo sapiens
tgtcttcatgcctgaaagaaga

SEQ ID NO: 7696191 - DNA, 22 bp, Homo sapiens
tgtcttcatggcggaacaactt

SEQ ID NO: 7696192 - DNA, 22 bp, Homo sapiens
tgtcttcatggcggaacaactt

SEQ ID NO: 7696193 - DNA, 22 bp, Homo sapiens
tgtcttcatctccatgcacaga

SEQ ID NO: 7696194 - DNA, 22 bp, Homo sapiens
tgtcttcatctccatgcacaga

SEQ ID NO: 7696195 - DNA, 22 bp, Homo sapiens
tgtcttcatctccatgcacaga

SEQ ID NO: 7696196 - DNA, 22 bp, Homo sapiens
tgtcttcatctcagacacagtt

SEQ ID NO: 7696197 - DNA, 22 bp, Homo sapiens
tgtcttcatctcagacacagtt

SEQ ID NO: 7696198 - DNA, 22 bp, Homo sapiens
tgtcttcatctcagacacagtt

SEQ ID NO: 7696199 - DNA, 21 bp, Homo sapiens
tgtcttcatatgagatggtgt

SEQ ID NO: 7696200 - DNA, 21 bp, Homo sapiens
tgtcttcatatgagatggtgt

SEQ ID NO: 7696201 - DNA, 21 bp, Homo sapiens
tgtcttcatatgagatggtgt

SEQ ID NO: 7696202 - DNA, 22 bp, Homo sapiens
tgtcttcatctcagacacagtt

SEQ ID NO: 7696203 - DNA, 22 bp, Homo sapiens
tgtcttcatctcagacacagtt

SEQ ID NO: 7696204 - DNA, 22 bp, Homo sapiens
tgtcttcagtaaaatacactat

SEQ ID NO: 7696205 - DNA, 22 bp, Homo sapiens
tgtcttcagtaaaatacactat

SEQ ID NO: 7696206 - DNA, 22 bp, Homo sapiens
tgtcttcagtaaaatacactat

SEQ ID NO: 7696207 - DNA, 22 bp, Homo sapiens
tgtcttcagtaaaatacactat

SEQ ID NO: 7696208 - DNA, 22 bp, Homo sapiens
tgtcttcagtaaaatacactat

SEQ ID NO: 7696209 - DNA, 22 bp, Homo sapiens
tgtcttcagtaaaatacactat

SEQ ID NO: 7696210 - DNA, 22 bp, Homo sapiens
tgtcttcaggagtaaatatcat

SEQ ID NO: 7696211 - DNA, 22 bp, Homo sapiens
tgtcttcaggagtaaatatcat

SEQ ID NO: 7696212 - DNA, 22 bp, Homo sapiens
tgtcttctaccttgacagcatt

SEQ ID NO: 7696213 - DNA, 22 bp, Homo sapiens
tgtcttcgctacaatgaaaagg

SEQ ID NO: 7696214 - DNA, 22 bp, Homo sapiens
tgtcttctaccttgacagcatt

SEQ ID NO: 7696215 - DNA, 22 bp, Homo sapiens
tgtcttctaccttgacagcatt

SEQ ID NO: 7696216 - DNA, 17 bp, Homo sapiens
tgtcttctgaagagagc

SEQ ID NO: 7696217 - DNA, 17 bp, Homo sapiens
tgtcttctgaagagagc

SEQ ID NO: 7696218 - DNA, 22 bp, Homo sapiens
tgtcttctaccttgacagcatt

SEQ ID NO: 7696219 - DNA, 17 bp, Homo sapiens
tgtcttctgaagagagc

SEQ ID NO: 7696220 - DNA, 22 bp, Homo sapiens
tgtcttctgtattcaagtctat

SEQ ID NO: 7696221 - DNA, 22 bp, Homo sapiens
tgtcttcttcataaggagagtg

SEQ ID NO: 7696222 - DNA, 22 bp, Homo sapiens
tgtcttcttcataaggagagtg

SEQ ID NO: 7696223 - DNA, 22 bp, Homo sapiens
tgtcttgactttagagccagga

SEQ ID NO: 7696224 - DNA, 22 bp, Homo sapiens
tgtctttaaaattaaacacatc

SEQ ID NO: 7696225 - DNA, 22 bp, Homo sapiens
tgtctttaaaattaaacacatc

SEQ ID NO: 7696226 - DNA, 22 bp, Homo sapiens
tgtctttaaaattaaacacatc

SEQ ID NO: 7696227 - DNA, 22 bp, Homo sapiens
tgtctttaaaattaaacacatc

SEQ ID NO: 7696228 - DNA, 22 bp, Homo sapiens
tgtctttaaaattaaacacatc

SEQ ID NO: 7696229 - DNA, 22 bp, Homo sapiens
tgtctttaattctacatatctc

SEQ ID NO: 7696230 - DNA, 22 bp, Homo sapiens
tgtctttaattctacatatctc

SEQ ID NO: 7696231 - DNA, 22 bp, Homo sapiens
tgtctttaattctacatatctc

SEQ ID NO: 7696232 - DNA, 19 bp, Homo sapiens
tgtctttaactggaaccac

SEQ ID NO: 7696233 - DNA, 19 bp, Homo sapiens
tgtctttaactggaaccac

SEQ ID NO: 7696234 - DNA, 22 bp, Homo sapiens
tgtctttaagcaaacagtgttt

SEQ ID NO: 7696235 - DNA, 22 bp, Homo sapiens
tgtctttaagcaaacagtgttt

SEQ ID NO: 7696236 - DNA, 22 bp, Homo sapiens
tgtctttaagcaaacagtgttt

SEQ ID NO: 7696237 - DNA, 22 bp, Homo sapiens
tgtcttgtctgtgagggcattg

SEQ ID NO: 7696238 - DNA, 22 bp, Homo sapiens
tgtcttgtctgtgagggcattg

SEQ ID NO: 7696239 - DNA, 22 bp, Homo sapiens
tgtcttggctctggagggggat

SEQ ID NO: 7696240 - DNA, 23 bp, Homo sapiens
tgtcttggtttcttcaccctagt

SEQ ID NO: 7696241 - DNA, 22 bp, Homo sapiens
tgtcttgattagaatgatgggc

SEQ ID NO: 7696242 - DNA, 22 bp, Homo sapiens
tgtcttgattgaagagatagaa

SEQ ID NO: 7696243 - DNA, 22 bp, Homo sapiens
tgtcttgattgaagagatagaa

SEQ ID NO: 7696244 - DNA, 22 bp, Homo sapiens
tgtcttggatgaggattaacag

SEQ ID NO: 7696245 - DNA, 22 bp, Homo sapiens
tgtcttggccactaggagtgcc

SEQ ID NO: 7696246 - DNA, 22 bp, Homo sapiens
tgtcttggccactaggagtgcc

SEQ ID NO: 7696247 - DNA, 22 bp, Homo sapiens
tgtgaaaagcgtgtgttctagg

SEQ ID NO: 7696248 - DNA, 22 bp, Homo sapiens
tgtgaaaagcgtgtgttctagg

SEQ ID NO: 7696249 - DNA, 22 bp, Homo sapiens
tgtgaaaagcgtgtgttctagg

SEQ ID NO: 7696250 - DNA, 22 bp, Homo sapiens
tgtgaaaagcgtgtgttctagg

SEQ ID NO: 7696251 - DNA, 22 bp, Homo sapiens
tgtgaaaagcaggctactttct

SEQ ID NO: 7696252 - DNA, 22 bp, Homo sapiens
tgtgaaaagcaggctactttct

SEQ ID NO: 7696253 - DNA, 22 bp, Homo sapiens
tgtgaaaagcaggctactttct

SEQ ID NO: 7696254 - DNA, 22 bp, Homo sapiens
tgtgaaaagcaggctactttct

SEQ ID NO: 7696255 - DNA, 22 bp, Homo sapiens
tgtgaaaagggctttgtacaaa

SEQ ID NO: 7696256 - DNA, 22 bp, Homo sapiens
tgtgaaaagggctttgtacaaa

SEQ ID NO: 7696257 - DNA, 22 bp, Homo sapiens
tgtgaaaagcgtgtgttctagg

SEQ ID NO: 7696258 - DNA, 22 bp, Homo sapiens
tgtgaaaagggctttgtacaaa

SEQ ID NO: 7696259 - DNA, 22 bp, Homo sapiens
tgtgaaaagggctttgtacaaa

SEQ ID NO: 7696260 - DNA, 22 bp, Homo sapiens
tgtgaaaagggctttgtacaaa

SEQ ID NO: 7696261 - DNA, 22 bp, Homo sapiens
tgtgaaaagggctttgtacaaa

SEQ ID NO: 7696262 - DNA, 22 bp, Homo sapiens
tgtgaaacggagtcagggaagg

SEQ ID NO: 7696263 - DNA, 22 bp, Homo sapiens
tgtcttttggagcatctttctt

SEQ ID NO: 7696264 - DNA, 22 bp, Homo sapiens
tgtcttttggagcatctttctt

SEQ ID NO: 7696265 - DNA, 22 bp, Homo sapiens
tgtcttttggagcatctttctt

SEQ ID NO: 7696266 - DNA, 22 bp, Homo sapiens
tgtcttttggagcatctttctt

SEQ ID NO: 7696267 - DNA, 22 bp, Homo sapiens
tgtctttttacctgtgatgagt

SEQ ID NO: 7696268 - DNA, 22 bp, Homo sapiens
tgtctttttacctgtgatgagt

SEQ ID NO: 7696269 - DNA, 22 bp, Homo sapiens
tgtcttttggagcatctttctt

SEQ ID NO: 7696270 - DNA, 22 bp, Homo sapiens
tgtcttttggagcatctttctt

SEQ ID NO: 7696271 - DNA, 22 bp, Homo sapiens
tgtgaaaaaagttctagaagga

SEQ ID NO: 7696272 - DNA, 22 bp, Homo sapiens
tgtgaaaaaagttctagaagga

SEQ ID NO: 7696273 - DNA, 22 bp, Homo sapiens
tgtgaaaaaagttctagaagga

SEQ ID NO: 7696274 - DNA, 22 bp, Homo sapiens
tgtgaaaaaagttctagaagga

SEQ ID NO: 7696275 - DNA, 22 bp, Homo sapiens
tgtctttttactatgttcaatc

SEQ ID NO: 7696276 - DNA, 22 bp, Homo sapiens
tgtcttttgccaaagatcagtt

SEQ ID NO: 7696277 - DNA, 22 bp, Homo sapiens
tgtcttttctactgtaagcata

SEQ ID NO: 7696278 - DNA, 22 bp, Homo sapiens
tgtcttttctactgtaagcata

SEQ ID NO: 7696279 - DNA, 22 bp, Homo sapiens
tgtcttttctactgtaagcata

SEQ ID NO: 7696280 - DNA, 22 bp, Homo sapiens
tgtcttttctactgtaagcata

SEQ ID NO: 7696281 - DNA, 22 bp, Homo sapiens
tgtcttttgccaaagatcagtt

SEQ ID NO: 7696282 - DNA, 22 bp, Homo sapiens
tgtcttttgccaaagatcagtt

SEQ ID NO: 7696283 - DNA, 22 bp, Homo sapiens
tgtcttttgccaaagatcagtt

SEQ ID NO: 7696284 - DNA, 22 bp, Homo sapiens
tgtcttttgccaaagatcagtt

SEQ ID NO: 7696285 - DNA, 22 bp, Homo sapiens
tgtcttttataactgacatata

SEQ ID NO: 7696286 - DNA, 22 bp, Homo sapiens
tgtcttttataactgacatata

SEQ ID NO: 7696287 - DNA, 22 bp, Homo sapiens
tgtcttttagtttgtgagatct

SEQ ID NO: 7696288 - DNA, 22 bp, Homo sapiens
tgtcttttagtttgtgagatct

SEQ ID NO: 7696289 - DNA, 22 bp, Homo sapiens
tgtcttttacctaatgagctgg

SEQ ID NO: 7696290 - DNA, 22 bp, Homo sapiens
tgtcttttataactgacatata

SEQ ID NO: 7696291 - DNA, 22 bp, Homo sapiens
tgtcttttacctaatgagctgg

SEQ ID NO: 7696292 - DNA, 22 bp, Homo sapiens
tgtcttttacctaatgagctgg

SEQ ID NO: 7696293 - DNA, 22 bp, Homo sapiens
tgtcttttacctaatgagctgg

SEQ ID NO: 7696294 - DNA, 22 bp, Homo sapiens
tgtctttgttattgtggacagg

SEQ ID NO: 7696295 - DNA, 22 bp, Homo sapiens
tgtctttgtgtacaggatcgcc

SEQ ID NO: 7696296 - DNA, 23 bp, Homo sapiens
tgtctttgttaggactgtgttta

SEQ ID NO: 7696297 - DNA, 22 bp, Homo sapiens
tgtctttgtgtacaggatcgcc

SEQ ID NO: 7696298 - DNA, 23 bp, Homo sapiens
tgtctttgttaggactgtgttta

SEQ ID NO: 7696299 - DNA, 22 bp, Homo sapiens
tgtctttgttattgtggacagg

SEQ ID NO: 7696300 - DNA, 23 bp, Homo sapiens
tgtctttgttaggactgtgttta

SEQ ID NO: 7696301 - DNA, 22 bp, Homo sapiens
tgtctttacttaataaatatac

SEQ ID NO: 7696302 - DNA, 22 bp, Homo sapiens
tgtctttacttaataaatatac

SEQ ID NO: 7696303 - DNA, 22 bp, Homo sapiens
tgtctttaattctacatatctc

SEQ ID NO: 7696304 - DNA, 22 bp, Homo sapiens
tgtctttacttaataaatatac

SEQ ID NO: 7696305 - DNA, 22 bp, Homo sapiens
tgtctttaattctacatatctc

SEQ ID NO: 7696306 - DNA, 22 bp, Homo sapiens
tgtctttaattctacatatctc

SEQ ID NO: 7696307 - DNA, 22 bp, Homo sapiens
tgtctttacttaataaatatac

SEQ ID NO: 7696308 - DNA, 19 bp, Homo sapiens
tgtctttggtctgagtttc

SEQ ID NO: 7696309 - DNA, 19 bp, Homo sapiens
tgtctttggtctgagtttc

SEQ ID NO: 7696310 - DNA, 22 bp, Homo sapiens
tgtcttcaggagtaaatatcat

SEQ ID NO: 7696311 - DNA, 22 bp, Homo sapiens
tgtcttcaggagtaaatatcat

SEQ ID NO: 7696312 - DNA, 22 bp, Homo sapiens
tgtcttcagcagtcatctgggg

SEQ ID NO: 7696313 - DNA, 22 bp, Homo sapiens
tgtcttcagcaaatgcctttct

SEQ ID NO: 7696314 - DNA, 22 bp, Homo sapiens
tgtcttcagataggcattcttc

SEQ ID NO: 7696315 - DNA, 22 bp, Homo sapiens
tgtcttcactcaagtctcttgg

SEQ ID NO: 7696316 - DNA, 22 bp, Homo sapiens
tgtcttcaaatattgaaatcct

SEQ ID NO: 7696317 - DNA, 22 bp, Homo sapiens
tgtcttcacaaagcagaaggga

SEQ ID NO: 7696318 - DNA, 22 bp, Homo sapiens
tgtcttcacaaagcagaaggga

SEQ ID NO: 7696319 - DNA, 22 bp, Homo sapiens
tgtcttcacatgataagccatt

SEQ ID NO: 7696320 - DNA, 22 bp, Homo sapiens
tgtcttcactcaagtctcttgg

SEQ ID NO: 7696321 - DNA, 22 bp, Homo sapiens
tgtcttcagaattaagagtatg

SEQ ID NO: 7696322 - DNA, 22 bp, Homo sapiens
tgtcttcagaattaagagtatg

SEQ ID NO: 7696323 - DNA, 22 bp, Homo sapiens
tgtcttcagataggcattcttc

SEQ ID NO: 7696324 - DNA, 22 bp, Homo sapiens
tgtcttcaaatattgaaatcct

SEQ ID NO: 7696325 - DNA, 22 bp, Homo sapiens
tgtcttattttgaagtgttcac

SEQ ID NO: 7696326 - DNA, 22 bp, Homo sapiens
tgtcttcaaatattgaaatcct

SEQ ID NO: 7696327 - DNA, 22 bp, Homo sapiens
tgtcttattttaaaagggaagt

SEQ ID NO: 7696328 - DNA, 22 bp, Homo sapiens
tgtcttattccttctgttcagc

SEQ ID NO: 7696329 - DNA, 22 bp, Homo sapiens
tgtcttattccttctgttcagc

SEQ ID NO: 7696330 - DNA, 22 bp, Homo sapiens
tgtcttattgcctttgtaattt

SEQ ID NO: 7696331 - DNA, 22 bp, Homo sapiens
tgtcttattgcctttgtaattt

SEQ ID NO: 7696332 - DNA, 22 bp, Homo sapiens
tgtcttattaagaccagtgact

SEQ ID NO: 7696333 - DNA, 22 bp, Homo sapiens
tgtcttatgtagatactgagaa

SEQ ID NO: 7696334 - DNA, 20 bp, Homo sapiens
tgtcttattccagtgtttac

SEQ ID NO: 7696335 - DNA, 22 bp, Homo sapiens
tgtcttattccttctgttcagc

SEQ ID NO: 7696336 - DNA, 17 bp, Homo sapiens
tgtcttatctgtcctgt

SEQ ID NO: 7696337 - DNA, 17 bp, Homo sapiens
tgtcttatctgtcctgt

SEQ ID NO: 7696338 - DNA, 22 bp, Homo sapiens
tgtcttatgctgcatagactat

SEQ ID NO: 7696339 - DNA, 22 bp, Homo sapiens
tgtcttatgctgcatagactat

SEQ ID NO: 7696340 - DNA, 22 bp, Homo sapiens
tgtcttatgtagatactgagaa

SEQ ID NO: 7696341 - DNA, 22 bp, Homo sapiens
tgtcttatgtagatactgagaa

SEQ ID NO: 7696342 - DNA, 22 bp, Homo sapiens
tgtcttatgtagatactgagaa

SEQ ID NO: 7696343 - DNA, 22 bp, Homo sapiens
tgtcttatgctgcatagactat

SEQ ID NO: 7696344 - DNA, 22 bp, Homo sapiens
tgtcttatgctgcatagactat

SEQ ID NO: 7696345 - DNA, 22 bp, Homo sapiens
tgtcttatggcatgtccactgg

SEQ ID NO: 7696346 - DNA, 22 bp, Homo sapiens
tgtctgtggcaattgtgggtaa

SEQ ID NO: 7696347 - DNA, 22 bp, Homo sapiens
tgtctgtggcaattgtgggtaa

SEQ ID NO: 7696348 - DNA, 22 bp, Homo sapiens
tgtctgtggcaattgtgggtaa

SEQ ID NO: 7696349 - DNA, 20 bp, Homo sapiens
tgtctgtgccacggcactcc

SEQ ID NO: 7696350 - DNA, 22 bp, Homo sapiens
tgtctgtgcccaaggctcccgg

SEQ ID NO: 7696351 - DNA, 22 bp, Homo sapiens
tgtctgtgacctctttggagcc

SEQ ID NO: 7696352 - DNA, 22 bp, Homo sapiens
tgtctgtgggcaacgcctccca

SEQ ID NO: 7696353 - DNA, 22 bp, Homo sapiens
tgtctgtggcaattgtgggtaa

SEQ ID NO: 7696354 - DNA, 22 bp, Homo sapiens
tgtctgtggcaattgtgggtaa

SEQ ID NO: 7696355 - DNA, 22 bp, Homo sapiens
tgtctgtggcaattgtgggtaa

SEQ ID NO: 7696356 - DNA, 22 bp, Homo sapiens
tgtctgtgtccaaatttcctct

SEQ ID NO: 7696357 - DNA, 22 bp, Homo sapiens
tgtctgtgggcaacgcctccca

SEQ ID NO: 7696358 - DNA, 22 bp, Homo sapiens
tgtctgtgtccaaatttcctct

SEQ ID NO: 7696359 - DNA, 22 bp, Homo sapiens
tgtctgtgtgagcaaatgactt

SEQ ID NO: 7696360 - DNA, 22 bp, Homo sapiens
tgtctgttattggtgtataaga

SEQ ID NO: 7696361 - DNA, 22 bp, Homo sapiens
tgtcttaagtagattacagcct

SEQ ID NO: 7696362 - DNA, 22 bp, Homo sapiens
tgtcttaagtagattacagcct

SEQ ID NO: 7696363 - DNA, 22 bp, Homo sapiens
tgtcttaacataaaaggaaatc

SEQ ID NO: 7696364 - DNA, 22 bp, Homo sapiens
tgtcttaagaaattgcatttgt

SEQ ID NO: 7696365 - DNA, 22 bp, Homo sapiens
tgtcttaagaaattgcatttgt

SEQ ID NO: 7696366 - DNA, 22 bp, Homo sapiens
tgtcttaagaaattgcatttgt

SEQ ID NO: 7696367 - DNA, 22 bp, Homo sapiens
tgtcttaaacttgtgggacttc

SEQ ID NO: 7696368 - DNA, 22 bp, Homo sapiens
tgtcttaacataaaaggaaatc

SEQ ID NO: 7696369 - DNA, 22 bp, Homo sapiens
tgtcttaacataaaaggaaatc

SEQ ID NO: 7696370 - DNA, 22 bp, Homo sapiens
tgtcttaaacttgtgggacttc

SEQ ID NO: 7696371 - DNA, 22 bp, Homo sapiens
tgtctgttattggtgtataaga

SEQ ID NO: 7696372 - DNA, 22 bp, Homo sapiens
tgtcttaatagtatccaggttc

SEQ ID NO: 7696373 - DNA, 22 bp, Homo sapiens
tgtcttaatagtatccaggttc

SEQ ID NO: 7696374 - DNA, 22 bp, Homo sapiens
tgtcttaatatgtgcattctgt

SEQ ID NO: 7696375 - DNA, 19 bp, Homo sapiens
tgtcttaattaactcagag

SEQ ID NO: 7696376 - DNA, 19 bp, Homo sapiens
tgtcttaattaactcagag

SEQ ID NO: 7696377 - DNA, 19 bp, Homo sapiens
tgtcttaattaactcagag

SEQ ID NO: 7696378 - DNA, 22 bp, Homo sapiens
tgtcttaatttggatgatgttt

SEQ ID NO: 7696379 - DNA, 22 bp, Homo sapiens
tgtcttaatttggatgatgttt

SEQ ID NO: 7696380 - DNA, 22 bp, Homo sapiens
tgtcttaatttccctttgtcat

SEQ ID NO: 7696381 - DNA, 22 bp, Homo sapiens
tgtcttaatttccctttgtcat

SEQ ID NO: 7696382 - DNA, 22 bp, Homo sapiens
tgtcttaatttggatgatgttt

SEQ ID NO: 7696383 - DNA, 22 bp, Homo sapiens
tgtctgggatgttggcagccac

SEQ ID NO: 7696384 - DNA, 22 bp, Homo sapiens
tgtctgggatgttggcagccac

SEQ ID NO: 7696385 - DNA, 22 bp, Homo sapiens
tgtctggggaactgtgcatcca

SEQ ID NO: 7696386 - DNA, 22 bp, Homo sapiens
tgtctggggaactgtgcatcca

SEQ ID NO: 7696387 - DNA, 22 bp, Homo sapiens
tgtctggggaactgtgcatcca

SEQ ID NO: 7696388 - DNA, 22 bp, Homo sapiens
tgtctgtgacagacctttgcta

SEQ ID NO: 7696389 - DNA, 22 bp, Homo sapiens
tgtctgggatgtaattcctgcc

SEQ ID NO: 7696390 - DNA, 22 bp, Homo sapiens
tgtctgggatgtaattcctgcc

SEQ ID NO: 7696391 - DNA, 22 bp, Homo sapiens
tgtctgggatgttggcagccac

SEQ ID NO: 7696392 - DNA, 22 bp, Homo sapiens
tgtctgggagggacagggctac

SEQ ID NO: 7696393 - DNA, 22 bp, Homo sapiens
tgtctgggagggacagggctac

SEQ ID NO: 7696394 - DNA, 22 bp, Homo sapiens
tgtctgggatgtaattcctgcc

SEQ ID NO: 7696395 - DNA, 22 bp, Homo sapiens
tgtctgtgatttaggccagggc

SEQ ID NO: 7696396 - DNA, 22 bp, Homo sapiens
tgtctgtgacctctttggagcc

SEQ ID NO: 7696397 - DNA, 22 bp, Homo sapiens
tgtctgtgacctcttaggcaag

SEQ ID NO: 7696398 - DNA, 22 bp, Homo sapiens
tgtctgtgacctcttaggcaag

SEQ ID NO: 7696399 - DNA, 22 bp, Homo sapiens
tgtctggatgtctggagcatcg

SEQ ID NO: 7696400 - DNA, 22 bp, Homo sapiens
tgtctggatgtctggagcatcg

SEQ ID NO: 7696401 - DNA, 22 bp, Homo sapiens
tgtctggcctcaaaagccattt

SEQ ID NO: 7696402 - DNA, 22 bp, Homo sapiens
tgtctggcatagttgctccctg

SEQ ID NO: 7696403 - DNA, 22 bp, Homo sapiens
tgtctggcatagttgctccctg

SEQ ID NO: 7696404 - DNA, 22 bp, Homo sapiens
tgtctgggagactgatcacccg

SEQ ID NO: 7696405 - DNA, 22 bp, Homo sapiens
tgtctgggagggacagggctac

SEQ ID NO: 7696406 - DNA, 23 bp, Homo sapiens
tgtctggctcatggtgggtctca

SEQ ID NO: 7696407 - DNA, 22 bp, Homo sapiens
tgtctgggagggacagggctac

SEQ ID NO: 7696408 - DNA, 22 bp, Homo sapiens
tgtctgggagggacagggctac

SEQ ID NO: 7696409 - DNA, 22 bp, Homo sapiens
tgtctgggagggacagggctac

SEQ ID NO: 7696410 - DNA, 22 bp, Homo sapiens
tgtctgggagggacagggctac

SEQ ID NO: 7696411 - DNA, 22 bp, Homo sapiens
tgtctggatggtggagattgag

SEQ ID NO: 7696412 - DNA, 22 bp, Homo sapiens
tgtctggaggtcaggtcctggg

SEQ ID NO: 7696413 - DNA, 22 bp, Homo sapiens
tgtctggaggtcaggtcctggg

SEQ ID NO: 7696414 - DNA, 23 bp, Homo sapiens
tgtctggagcctgagcaggtgct

SEQ ID NO: 7696415 - DNA, 23 bp, Homo sapiens
tgtctggagagggcttgctctcc

SEQ ID NO: 7696416 - DNA, 23 bp, Homo sapiens
tgtctggagcctgagcaggtgct

SEQ ID NO: 7696417 - DNA, 22 bp, Homo sapiens
tgtctggacattgacaatcatg

SEQ ID NO: 7696418 - DNA, 22 bp, Homo sapiens
tgtctggacagagattctcaat

SEQ ID NO: 7696419 - DNA, 22 bp, Homo sapiens
tgtctggaagtaccagggaagc

SEQ ID NO: 7696420 - DNA, 18 bp, Homo sapiens
tgtctgcttctccaactc

SEQ ID NO: 7696421 - DNA, 19 bp, Homo sapiens
tgtctgctgatgactctat

SEQ ID NO: 7696422 - DNA, 19 bp, Homo sapiens
tgtctgctgatgactctat

SEQ ID NO: 7696423 - DNA, 19 bp, Homo sapiens
tgtctggaagagctgcagg

SEQ ID NO: 7696424 - DNA, 19 bp, Homo sapiens
tgtctggaagagctgcagg

SEQ ID NO: 7696425 - DNA, 18 bp, Homo sapiens
tgtctgcttctccaactc

SEQ ID NO: 7696426 - DNA, 22 bp, Homo sapiens
tgttttagctgacacatggagc

SEQ ID NO: 7696427 - DNA, 22 bp, Homo sapiens
tgttttaatctcccattgctct

SEQ ID NO: 7696428 - DNA, 22 bp, Homo sapiens
tgttttaatctcccattgctct

SEQ ID NO: 7696429 - DNA, 22 bp, Homo sapiens
tgttttaatctcccattgctct

SEQ ID NO: 7696430 - DNA, 22 bp, Homo sapiens
tgttttaatctcccattgctct

SEQ ID NO: 7696431 - DNA, 22 bp, Homo sapiens
tgttttaatctcccattgctct

SEQ ID NO: 7696432 - DNA, 22 bp, Homo sapiens
tgttttaagggtcaactgtcac

SEQ ID NO: 7696433 - DNA, 22 bp, Homo sapiens
tgttttaagggtcaactgtcac

SEQ ID NO: 7696434 - DNA, 22 bp, Homo sapiens
tgttttaagggtcaactgtcac

SEQ ID NO: 7696435 - DNA, 22 bp, Homo sapiens
tgttttaagggtcaactgtcac

SEQ ID NO: 7696436 - DNA, 22 bp, Homo sapiens
tgttttaagggtcaactgtcac

SEQ ID NO: 7696437 - DNA, 22 bp, Homo sapiens
tgttttaagggtcaactgtcac

SEQ ID NO: 7696438 - DNA, 22 bp, Homo sapiens
tgttttaatctcccattgctct

SEQ ID NO: 7696439 - DNA, 22 bp, Homo sapiens
tgttttaatctcccattgctct

SEQ ID NO: 7696440 - DNA, 22 bp, Homo sapiens
tgttttaatctcccattgctct

SEQ ID NO: 7696441 - DNA, 22 bp, Homo sapiens
tgttttaatctcccattgctct

SEQ ID NO: 7696442 - DNA, 22 bp, Homo sapiens
tgttttaagggtcaactgtcac

SEQ ID NO: 7696443 - DNA, 22 bp, Homo sapiens
tgttttaagagcgcactttata

SEQ ID NO: 7696444 - DNA, 22 bp, Homo sapiens
tgttttaagagcgcactttata

SEQ ID NO: 7696445 - DNA, 22 bp, Homo sapiens
tgttttaagagcgcactttata

SEQ ID NO: 7696446 - DNA, 22 bp, Homo sapiens
tgttttaagggtcaactgtcac

SEQ ID NO: 7696447 - DNA, 22 bp, Homo sapiens
tgttttaagggtcaactgtcac

SEQ ID NO: 7696448 - DNA, 22 bp, Homo sapiens
tgttttaagctctagaagggga

SEQ ID NO: 7696449 - DNA, 22 bp, Homo sapiens
tgttttaaagccattgcctttc

SEQ ID NO: 7696450 - DNA, 23 bp, Homo sapiens
tgtttgtttctatgagagatagc

SEQ ID NO: 7696451 - DNA, 23 bp, Homo sapiens
tgtttgtttctatgagagatagc

SEQ ID NO: 7696452 - DNA, 22 bp, Homo sapiens
tgttttaagagcgcactttata

SEQ ID NO: 7696453 - DNA, 22 bp, Homo sapiens
tgttttaagagcgcactttata

SEQ ID NO: 7696454 - DNA, 22 bp, Homo sapiens
tgttttaagagcgcactttata

SEQ ID NO: 7696455 - DNA, 22 bp, Homo sapiens
tgttttaagagcgcactttata

SEQ ID NO: 7696456 - DNA, 22 bp, Homo sapiens
tgttttatataagcagagcggt

SEQ ID NO: 7696457 - DNA, 22 bp, Homo sapiens
tgttttatataagcagagcggt

SEQ ID NO: 7696458 - DNA, 22 bp, Homo sapiens
tgttttagttctgtcttgcatg

SEQ ID NO: 7696459 - DNA, 22 bp, Homo sapiens
tgttttatataagcagagcggt

SEQ ID NO: 7696460 - DNA, 22 bp, Homo sapiens
tgttttagttctgtcttgcatg

SEQ ID NO: 7696461 - DNA, 22 bp, Homo sapiens
tgttttatataagcagagcggt

SEQ ID NO: 7696462 - DNA, 22 bp, Homo sapiens
tgttttatcaagatggcatgtc

SEQ ID NO: 7696463 - DNA, 22 bp, Homo sapiens
tgttttatcaagatggcatgtc

SEQ ID NO: 7696464 - DNA, 22 bp, Homo sapiens
tgttttatcaagatggcatgtc

SEQ ID NO: 7696465 - DNA, 22 bp, Homo sapiens
tgttttatataagcagagcggt

SEQ ID NO: 7696466 - DNA, 22 bp, Homo sapiens
tgttttatcaagatggcatgtc

SEQ ID NO: 7696467 - DNA, 22 bp, Homo sapiens
tgttttatgagccatataacct

SEQ ID NO: 7696468 - DNA, 22 bp, Homo sapiens
tgttttatgagccatataacct

SEQ ID NO: 7696469 - DNA, 22 bp, Homo sapiens
tgttttatgagccatataacct

SEQ ID NO: 7696470 - DNA, 22 bp, Homo sapiens
tgttttatgagccatataacct

SEQ ID NO: 7696471 - DNA, 22 bp, Homo sapiens
tgttttatgagccatataacct

SEQ ID NO: 7696472 - DNA, 22 bp, Homo sapiens
tgttttatgagccatataacct

SEQ ID NO: 7696473 - DNA, 22 bp, Homo sapiens
tgttttatgagccatataacct

SEQ ID NO: 7696474 - DNA, 22 bp, Homo sapiens
tgttttatgagccatataacct

SEQ ID NO: 7696475 - DNA, 22 bp, Homo sapiens
tgttttatgagccatataacct

SEQ ID NO: 7696476 - DNA, 22 bp, Homo sapiens
tgttttatgagccatataacct

SEQ ID NO: 7696477 - DNA, 22 bp, Homo sapiens
tgttttatcaagatggcatgtc

SEQ ID NO: 7696478 - DNA, 22 bp, Homo sapiens
tgttttatcaagatggcatgtc

SEQ ID NO: 7696479 - DNA, 22 bp, Homo sapiens
tgtttttccatgtgcagaacaa

SEQ ID NO: 7696480 - DNA, 22 bp, Homo sapiens
tgtttttgtctccttgtctgct

SEQ ID NO: 7696481 - DNA, 22 bp, Homo sapiens
tgtttttgtctccttgtctgct

SEQ ID NO: 7696482 - DNA, 22 bp, Homo sapiens
tgtttttccatgtgcagaacaa

SEQ ID NO: 7696483 - DNA, 22 bp, Homo sapiens
tgtttttccatgtgcagaacaa

SEQ ID NO: 7696484 - DNA, 22 bp, Homo sapiens
tgtttttccatgtgcagaacaa

SEQ ID NO: 7696485 - DNA, 22 bp, Homo sapiens
tgttttcaagtcaaggccaaat

SEQ ID NO: 7696486 - DNA, 22 bp, Homo sapiens
tgttttatttctccaagaggga

SEQ ID NO: 7696487 - DNA, 22 bp, Homo sapiens
tgttttatttctccaagaggga

SEQ ID NO: 7696488 - DNA, 22 bp, Homo sapiens
tgttttatgagccatataacct

SEQ ID NO: 7696489 - DNA, 22 bp, Homo sapiens
tgttttatgagccatataacct

SEQ ID NO: 7696490 - DNA, 22 bp, Homo sapiens
tgttttatgagccatataacct

SEQ ID NO: 7696491 - DNA, 22 bp, Homo sapiens
tgttttatgagccatataacct

SEQ ID NO: 7696492 - DNA, 22 bp, Homo sapiens
tgttttatttctccaagaggga

SEQ ID NO: 7696493 - DNA, 22 bp, Homo sapiens
tgttttatttctccaagaggga

SEQ ID NO: 7696494 - DNA, 22 bp, Homo sapiens
tgttttatttctccaagaggga

SEQ ID NO: 7696495 - DNA, 22 bp, Homo sapiens
tgttttatttctccaagaggga

SEQ ID NO: 7696496 - DNA, 22 bp, Homo sapiens
tgttttatgagccatataacct

SEQ ID NO: 7696497 - DNA, 22 bp, Homo sapiens
tgtttgtgctgcctggtgggca

SEQ ID NO: 7696498 - DNA, 22 bp, Homo sapiens
tgtttgtgctgcctggtgggca

SEQ ID NO: 7696499 - DNA, 22 bp, Homo sapiens
tgtttgtggaatattctttaag

SEQ ID NO: 7696500 - DNA, 20 bp, Homo sapiens
tgtttgtgccagctttgtca

SEQ ID NO: 7696501 - DNA, 20 bp, Homo sapiens
tgtttgtgccagctttgtca

SEQ ID NO: 7696502 - DNA, 20 bp, Homo sapiens
tgtttgtgccagctttgtca

SEQ ID NO: 7696503 - DNA, 22 bp, Homo sapiens
tgtttgtgctgcctggtgggca

SEQ ID NO: 7696504 - DNA, 22 bp, Homo sapiens
tgtttgtatctctctctgtggc

SEQ ID NO: 7696505 - DNA, 20 bp, Homo sapiens
tgtttgtgtggggccttggc

SEQ ID NO: 7696506 - DNA, 22 bp, Homo sapiens
tgtttgtggttataataagtat

SEQ ID NO: 7696507 - DNA, 22 bp, Homo sapiens
tgtttgtggaatattctttaag

SEQ ID NO: 7696508 - DNA, 20 bp, Homo sapiens
tgtttgtgtggggccttggc

SEQ ID NO: 7696509 - DNA, 20 bp, Homo sapiens
tgtttgtgtggggccttggc

SEQ ID NO: 7696510 - DNA, 20 bp, Homo sapiens
tgtttgtgtggggccttggc

SEQ ID NO: 7696511 - DNA, 20 bp, Homo sapiens
tgtttgtgtggggccttggc

SEQ ID NO: 7696512 - DNA, 22 bp, Homo sapiens
tgtttgttccctctctttcctg

SEQ ID NO: 7696513 - DNA, 22 bp, Homo sapiens
tgtttgtagagacagctgatgc

SEQ ID NO: 7696514 - DNA, 22 bp, Homo sapiens
tgtttgtagagacagctgatgc

SEQ ID NO: 7696515 - DNA, 22 bp, Homo sapiens
tgtttgtactcaaagccatgag

SEQ ID NO: 7696516 - DNA, 22 bp, Homo sapiens
tgtttgtactcaaagccatgag

SEQ ID NO: 7696517 - DNA, 22 bp, Homo sapiens
tgtttgtagagacagctgatgc

SEQ ID NO: 7696518 - DNA, 22 bp, Homo sapiens
tgtttgtagagacagctgatgc

SEQ ID NO: 7696519 - DNA, 22 bp, Homo sapiens
tgtttgtatggacctgttctat

SEQ ID NO: 7696520 - DNA, 22 bp, Homo sapiens
tgtttgtatggacctgttctat

SEQ ID NO: 7696521 - DNA, 22 bp, Homo sapiens
tgtttgtatctctctctgtggc

SEQ ID NO: 7696522 - DNA, 22 bp, Homo sapiens
tgtttgtcatcattgtgagaga

SEQ ID NO: 7696523 - DNA, 22 bp, Homo sapiens
tgtttgtcatcattgtgagaga

SEQ ID NO: 7696524 - DNA, 22 bp, Homo sapiens
tgtttgtccccatccctcagca

SEQ ID NO: 7696525 - DNA, 22 bp, Homo sapiens
tgtttgtatggacctgttctat

SEQ ID NO: 7696526 - DNA, 20 bp, Homo sapiens
tgtttgtgccagctttgtca

SEQ ID NO: 7696527 - DNA, 22 bp, Homo sapiens
tgtttgcttacttgtatgctgc

SEQ ID NO: 7696528 - DNA, 22 bp, Homo sapiens
tgtttgcttacttgtatgctgc

SEQ ID NO: 7696529 - DNA, 22 bp, Homo sapiens
tgtttggaaacactggcagaaa

SEQ ID NO: 7696530 - DNA, 22 bp, Homo sapiens
tgtttggaaacactggcagaaa

SEQ ID NO: 7696531 - DNA, 22 bp, Homo sapiens
tgtttggagaaaggctgtgaac

SEQ ID NO: 7696532 - DNA, 22 bp, Homo sapiens
tgtttggtcatgaatgtcagtg

SEQ ID NO: 7696533 - DNA, 22 bp, Homo sapiens
tgtttggtcatgaatgtcagtg

SEQ ID NO: 7696534 - DNA, 22 bp, Homo sapiens
tgtttggtcatgaatgtcagtg

SEQ ID NO: 7696535 - DNA, 17 bp, Homo sapiens
tgtttggttgattggtg

SEQ ID NO: 7696536 - DNA, 22 bp, Homo sapiens
tgtttgtaaagcagagccagta

SEQ ID NO: 7696537 - DNA, 22 bp, Homo sapiens
tgtttgtaaagcagagccagta

SEQ ID NO: 7696538 - DNA, 22 bp, Homo sapiens
tgtttgtacagtgcccacttct

SEQ ID NO: 7696539 - DNA, 22 bp, Homo sapiens
tgtttgtacagtgcccacttct

SEQ ID NO: 7696540 - DNA, 22 bp, Homo sapiens
tgtttcaactgttaagatatgc

SEQ ID NO: 7696541 - DNA, 22 bp, Homo sapiens
tgtttgcattgttaattcagtc

SEQ ID NO: 7696542 - DNA, 22 bp, Homo sapiens
tgtttgcattaattagaaggta

SEQ ID NO: 7696543 - DNA, 22 bp, Homo sapiens
tgtttcaactgttaagatatgc

SEQ ID NO: 7696544 - DNA, 22 bp, Homo sapiens
tgtttcaactgttaagatatgc

SEQ ID NO: 7696545 - DNA, 22 bp, Homo sapiens
tgtttcaaattacttgaggatt

SEQ ID NO: 7696546 - DNA, 22 bp, Homo sapiens
tgtttcaaagaaagaaaatata

SEQ ID NO: 7696547 - DNA, 22 bp, Homo sapiens
tgtttcaaagaaagaaaatata

SEQ ID NO: 7696548 - DNA, 22 bp, Homo sapiens
tgtttcaaagaaagaaaatata

SEQ ID NO: 7696549 - DNA, 22 bp, Homo sapiens
tgtttcaaaggttatacagtca

SEQ ID NO: 7696550 - DNA, 22 bp, Homo sapiens
tgtttcaaagaaagaaaatata

SEQ ID NO: 7696551 - DNA, 22 bp, Homo sapiens
tgtttcaaaggttatacagtca

SEQ ID NO: 7696552 - DNA, 22 bp, Homo sapiens
tgtttcaaaggttatacagtca

SEQ ID NO: 7696553 - DNA, 22 bp, Homo sapiens
tgtttcaaaggttatacagtca

SEQ ID NO: 7696554 - DNA, 22 bp, Homo sapiens
tgtttgctctgactatcttgcg

SEQ ID NO: 7696555 - DNA, 22 bp, Homo sapiens
tgtttgctctgactatcttgcg

SEQ ID NO: 7696556 - DNA, 22 bp, Homo sapiens
tgtttgctctgactatcttgcg

SEQ ID NO: 7696557 - DNA, 22 bp, Homo sapiens
tgtttgctatatcctacttcat

SEQ ID NO: 7696558 - DNA, 22 bp, Homo sapiens
tgtttgctctgactatcttgcg

SEQ ID NO: 7696559 - DNA, 22 bp, Homo sapiens
tgtttgctagggttggtattta

SEQ ID NO: 7696560 - DNA, 22 bp, Homo sapiens
tgtttgctatatcctacttcat

SEQ ID NO: 7696561 - DNA, 22 bp, Homo sapiens
tgtttgcattgttaattcagtc

SEQ ID NO: 7696562 - DNA, 22 bp, Homo sapiens
tgtttgctagggttggtattta

SEQ ID NO: 7696563 - DNA, 22 bp, Homo sapiens
tgtttgctagggttggtattta

SEQ ID NO: 7696564 - DNA, 22 bp, Homo sapiens
tgtttcaaaataacaagagggt

SEQ ID NO: 7696565 - DNA, 22 bp, Homo sapiens
tgtttcaaaataacaagagggt

SEQ ID NO: 7696566 - DNA, 22 bp, Homo sapiens
tgtttcaaaacagtgataattt

SEQ ID NO: 7696567 - DNA, 22 bp, Homo sapiens
tgtttcaaaacagtgataattt

SEQ ID NO: 7696568 - DNA, 18 bp, Homo sapiens
tgtttatttttctcttac

SEQ ID NO: 7696569 - DNA, 18 bp, Homo sapiens
tgtttatttttctcttac

SEQ ID NO: 7696570 - DNA, 22 bp, Homo sapiens
tgtttattttcaggatggattg

SEQ ID NO: 7696571 - DNA, 18 bp, Homo sapiens
tgtttatttttctcttac

SEQ ID NO: 7696572 - DNA, 18 bp, Homo sapiens
tgtttatttttctcttac

SEQ ID NO: 7696573 - DNA, 18 bp, Homo sapiens
tgtttatttttctcttac

SEQ ID NO: 7696574 - DNA, 18 bp, Homo sapiens
tgtttatttttctcttac

SEQ ID NO: 7696575 - DNA, 18 bp, Homo sapiens
tgtttatttttctcttac

SEQ ID NO: 7696576 - DNA, 18 bp, Homo sapiens
tgtttatttttctcttac

SEQ ID NO: 7696577 - DNA, 22 bp, Homo sapiens
ttaaaaaccatcttcctttcct

SEQ ID NO: 7696578 - DNA, 22 bp, Homo sapiens
ttaaaaaccatcttcctttcct

SEQ ID NO: 7696579 - DNA, 22 bp, Homo sapiens
ttaaaaaccatcttcctttcct

SEQ ID NO: 7696580 - DNA, 22 bp, Homo sapiens
ttaaaaaccatcttcctttcct

SEQ ID NO: 7696581 - DNA, 22 bp, Homo sapiens
ttaaaaaccatcttcctttcct

SEQ ID NO: 7696582 - DNA, 22 bp, Homo sapiens
ttaaaaaccatcttcctttcct

SEQ ID NO: 7696583 - DNA, 22 bp, Homo sapiens
tgtttttttatatacctgaagt

SEQ ID NO: 7696584 - DNA, 22 bp, Homo sapiens
tgtttttttatatacctgaagt

SEQ ID NO: 7696585 - DNA, 22 bp, Homo sapiens
tgtttttttatatacctgaagt

SEQ ID NO: 7696586 - DNA, 22 bp, Homo sapiens
tgtttttttatatacctgaagt

SEQ ID NO: 7696587 - DNA, 22 bp, Homo sapiens
tgtttttttatatacctgaagt

SEQ ID NO: 7696588 - DNA, 17 bp, Homo sapiens
tgttttttccctgttct

SEQ ID NO: 7696589 - DNA, 17 bp, Homo sapiens
tgttttttccctgttct

SEQ ID NO: 7696590 - DNA, 17 bp, Homo sapiens
tgttttttccctgttct

SEQ ID NO: 7696591 - DNA, 17 bp, Homo sapiens
tgttttttccctgttct

SEQ ID NO: 7696592 - DNA, 17 bp, Homo sapiens
tgttttttccctgttct

SEQ ID NO: 7696593 - DNA, 17 bp, Homo sapiens
tgttttttccctgttct

SEQ ID NO: 7696594 - DNA, 22 bp, Homo sapiens
tgttttttccttatgcaatctg

SEQ ID NO: 7696595 - DNA, 22 bp, Homo sapiens
tgttttttccttatgcaatctg

SEQ ID NO: 7696596 - DNA, 22 bp, Homo sapiens
tgttttttccttatgcaatctg

SEQ ID NO: 7696597 - DNA, 22 bp, Homo sapiens
tgttttttccttatgcaatctg

SEQ ID NO: 7696598 - DNA, 22 bp, Homo sapiens
tgttttttccttatgcaatctg

SEQ ID NO: 7696599 - DNA, 22 bp, Homo sapiens
ttaaaaatatgtagggcccgat

SEQ ID NO: 7696600 - DNA, 22 bp, Homo sapiens
ttaaaacagcgtgaatctggca

SEQ ID NO: 7696601 - DNA, 22 bp, Homo sapiens
ttaaaacagcgtgaatctggca

SEQ ID NO: 7696602 - DNA, 20 bp, Homo sapiens
ttaaaaagagtcacaggaga

SEQ ID NO: 7696603 - DNA, 22 bp, Homo sapiens
ttaaaaatatgtagggcccgat

SEQ ID NO: 7696604 - DNA, 22 bp, Homo sapiens
ttaaaaatatgtagggcccgat

SEQ ID NO: 7696605 - DNA, 20 bp, Homo sapiens
ttaaaaagagtcacaggaga

SEQ ID NO: 7696606 - DNA, 20 bp, Homo sapiens
ttaaaaagagtcacaggaga

SEQ ID NO: 7696607 - DNA, 20 bp, Homo sapiens
ttaaaaagagtcacaggaga

SEQ ID NO: 7696608 - DNA, 20 bp, Homo sapiens
ttaaaaagagtcacaggaga

SEQ ID NO: 7696609 - DNA, 20 bp, Homo sapiens
ttaaaaagagtcacaggaga

SEQ ID NO: 7696610 - DNA, 20 bp, Homo sapiens
ttaaaaagagtcacaggaga

SEQ ID NO: 7696611 - DNA, 22 bp, Homo sapiens
ttaaaaaccatcttcctttcct

SEQ ID NO: 7696612 - DNA, 22 bp, Homo sapiens
ttaaaaaccatcttcctttcct

SEQ ID NO: 7696613 - DNA, 20 bp, Homo sapiens
ttaaaaagagtcacaggaga

SEQ ID NO: 7696614 - DNA, 20 bp, Homo sapiens
ttaaaaagagtcacaggaga

SEQ ID NO: 7696615 - DNA, 22 bp, Homo sapiens
ttaaaaaccatcttcctttcct

SEQ ID NO: 7696616 - DNA, 22 bp, Homo sapiens
ttaaaacagcgtgaatctggca

SEQ ID NO: 7696617 - DNA, 22 bp, Homo sapiens
ttaaaacagcgtgaatctggca

SEQ ID NO: 7696618 - DNA, 22 bp, Homo sapiens
ttaaaacagcgtgaatctggca

SEQ ID NO: 7696619 - DNA, 22 bp, Homo sapiens
ttaaaaatatgtagggcccgat

SEQ ID NO: 7696620 - DNA, 22 bp, Homo sapiens
ttaaaacagcgtgaatctggca

SEQ ID NO: 7696621 - DNA, 22 bp, Homo sapiens
ttaaaacagcgtgaatctggca

SEQ ID NO: 7696622 - DNA, 22 bp, Homo sapiens
ttaaaactgcaaatcctactga

SEQ ID NO: 7696623 - DNA, 22 bp, Homo sapiens
ttaaaacgtaaatgtccccagc

SEQ ID NO: 7696624 - DNA, 22 bp, Homo sapiens
ttaaaacagcgtgaatctggca

SEQ ID NO: 7696625 - DNA, 22 bp, Homo sapiens
ttaaaaccatcagctgtaagat

SEQ ID NO: 7696626 - DNA, 22 bp, Homo sapiens
ttaaaacagcgtgaatctggca

SEQ ID NO: 7696627 - DNA, 22 bp, Homo sapiens
ttaaaaccatcagctgtaagat

SEQ ID NO: 7696628 - DNA, 22 bp, Homo sapiens
ttaaaagaatcctgttatcctc

SEQ ID NO: 7696629 - DNA, 22 bp, Homo sapiens
ttaaaagaatcctgttatcctc

SEQ ID NO: 7696630 - DNA, 22 bp, Homo sapiens
ttaaaactgcaaatcctactga

SEQ ID NO: 7696631 - DNA, 22 bp, Homo sapiens
ttaaaagacctgttgaggttag

SEQ ID NO: 7696632 - DNA, 22 bp, Homo sapiens
ttaaaagaatcctgttatcctc

SEQ ID NO: 7696633 - DNA, 22 bp, Homo sapiens
ttaaaagaatcctgttatcctc

SEQ ID NO: 7696634 - DNA, 22 bp, Homo sapiens
ttaaaatgcagattctgattca

SEQ ID NO: 7696635 - DNA, 22 bp, Homo sapiens
ttaaaatgcagattctgattca

SEQ ID NO: 7696636 - DNA, 22 bp, Homo sapiens
ttaaaatgcagattctgattca

SEQ ID NO: 7696637 - DNA, 22 bp, Homo sapiens
ttaaaatgcagattctgattca

SEQ ID NO: 7696638 - DNA, 22 bp, Homo sapiens
ttaaaatgcagattctgattca

SEQ ID NO: 7696639 - DNA, 22 bp, Homo sapiens
ttaaaatgcagattatgactca

SEQ ID NO: 7696640 - DNA, 22 bp, Homo sapiens
ttaaaatgcagattctgattca

SEQ ID NO: 7696641 - DNA, 22 bp, Homo sapiens
ttaaaatgcagattctgattca

SEQ ID NO: 7696642 - DNA, 22 bp, Homo sapiens
ttaaaagagacttcctttgttt

SEQ ID NO: 7696643 - DNA, 22 bp, Homo sapiens
ttaaaagagacttcctttgttt

SEQ ID NO: 7696644 - DNA, 22 bp, Homo sapiens
ttaaaagacctgttgaggttag

SEQ ID NO: 7696645 - DNA, 22 bp, Homo sapiens
ttaaaagagcagcccagcatat

SEQ ID NO: 7696646 - DNA, 22 bp, Homo sapiens
ttaaaagagcagcccagcatat

SEQ ID NO: 7696647 - DNA, 22 bp, Homo sapiens
ttaaaagagacttcctttgttt

SEQ ID NO: 7696648 - DNA, 22 bp, Homo sapiens
ttaaaagagacttcctttgttt

SEQ ID NO: 7696649 - DNA, 22 bp, Homo sapiens
ttaaaatttccccaccatgtat

SEQ ID NO: 7696650 - DNA, 22 bp, Homo sapiens
ttaaaatttccccaccatgtat

SEQ ID NO: 7696651 - DNA, 22 bp, Homo sapiens
ttaaaatttccccaccatgtat

SEQ ID NO: 7696652 - DNA, 22 bp, Homo sapiens
ttaaaatttccccaccatgtat

SEQ ID NO: 7696653 - DNA, 22 bp, Homo sapiens
ttaaaatttccccaccatgtat

SEQ ID NO: 7696654 - DNA, 22 bp, Homo sapiens
ttaaaatttccccaccatgtat

SEQ ID NO: 7696655 - DNA, 22 bp, Homo sapiens
ttaaacacactgagatttatgt

SEQ ID NO: 7696656 - DNA, 22 bp, Homo sapiens
ttaaacacactgagatttatgt

SEQ ID NO: 7696657 - DNA, 22 bp, Homo sapiens
ttaaacacactgagatttatgt

SEQ ID NO: 7696658 - DNA, 22 bp, Homo sapiens
ttaaacacctgtctagtgtagc

SEQ ID NO: 7696659 - DNA, 22 bp, Homo sapiens
ttaaacaccacagcagtcccta

SEQ ID NO: 7696660 - DNA, 22 bp, Homo sapiens
ttaaacaccaagtgcaaaccac

SEQ ID NO: 7696661 - DNA, 22 bp, Homo sapiens
ttaaacaccaagtgcaaaccac

SEQ ID NO: 7696662 - DNA, 22 bp, Homo sapiens
ttaaacacactgagatttatgt

SEQ ID NO: 7696663 - DNA, 22 bp, Homo sapiens
ttaaacactggagctgggtgtt

SEQ ID NO: 7696664 - DNA, 23 bp, Homo sapiens
ttaaacactagttcgagtagcat

SEQ ID NO: 7696665 - DNA, 22 bp, Homo sapiens
ttaaacacctgtctagtgtagc

SEQ ID NO: 7696666 - DNA, 22 bp, Homo sapiens
ttaaacacctgtctagtgtagc

SEQ ID NO: 7696667 - DNA, 22 bp, Homo sapiens
ttaaacacctgtctagtgtagc

SEQ ID NO: 7696668 - DNA, 22 bp, Homo sapiens
ttaaaatttccccaccatgtat

SEQ ID NO: 7696669 - DNA, 22 bp, Homo sapiens
ttaaaatttccccaccatgtat

SEQ ID NO: 7696670 - DNA, 22 bp, Homo sapiens
ttaaaatttccccaccatgtat

SEQ ID NO: 7696671 - DNA, 22 bp, Homo sapiens
ttaaaatttccccaccatgtat

SEQ ID NO: 7696672 - DNA, 22 bp, Homo sapiens
ttaaaatttccccaccatgtat

SEQ ID NO: 7696673 - DNA, 22 bp, Homo sapiens
ttaaaattatggcccatttgga

SEQ ID NO: 7696674 - DNA, 22 bp, Homo sapiens
ttaaaattatggcccatttgga

SEQ ID NO: 7696675 - DNA, 22 bp, Homo sapiens
ttaaaattatggcccatttgga

SEQ ID NO: 7696676 - DNA, 22 bp, Homo sapiens
ttaaaattatggcccatttgga

SEQ ID NO: 7696677 - DNA, 22 bp, Homo sapiens
ttaaaattatggcccatttgga

SEQ ID NO: 7696678 - DNA, 22 bp, Homo sapiens
ttaaaattatggcccatttgga

SEQ ID NO: 7696679 - DNA, 22 bp, Homo sapiens
ttaaaattatggcccatttgga

SEQ ID NO: 7696680 - DNA, 23 bp, Homo sapiens
ttaaaatgtggtctctccctagt

SEQ ID NO: 7696681 - DNA, 23 bp, Homo sapiens
ttaaaatgtggtctctccctagt

SEQ ID NO: 7696682 - DNA, 23 bp, Homo sapiens
ttaaaatgtggtctctccctagt

SEQ ID NO: 7696683 - DNA, 23 bp, Homo sapiens
ttaaaatgtggtctctccctagt

SEQ ID NO: 7696684 - DNA, 22 bp, Homo sapiens
ttaaaatgtacaggggaaagtg

SEQ ID NO: 7696685 - DNA, 22 bp, Homo sapiens
ttaaaatgtacaggggaaagtg

SEQ ID NO: 7696686 - DNA, 22 bp, Homo sapiens
ttaaacaggtttttgaatggcc

SEQ ID NO: 7696687 - DNA, 22 bp, Homo sapiens
ttaaacagagtctgaaatgtaa

SEQ ID NO: 7696688 - DNA, 22 bp, Homo sapiens
ttaaacaggtttttgaatggcc

SEQ ID NO: 7696689 - DNA, 22 bp, Homo sapiens
ttaaacagagtctgaaatgtaa

SEQ ID NO: 7696690 - DNA, 22 bp, Homo sapiens
ttaaacagaggtagcagactgg

SEQ ID NO: 7696691 - DNA, 22 bp, Homo sapiens
ttaaacagagtctgaaatgtaa

SEQ ID NO: 7696692 - DNA, 22 bp, Homo sapiens
ttaaacagagtctgaaatgtaa

SEQ ID NO: 7696693 - DNA, 22 bp, Homo sapiens
ttaaacatttatggaggcagca

SEQ ID NO: 7696694 - DNA, 22 bp, Homo sapiens
ttaaacatttatggaggcagca

SEQ ID NO: 7696695 - DNA, 22 bp, Homo sapiens
ttaaacagtgtttcatgtgggg

SEQ ID NO: 7696696 - DNA, 22 bp, Homo sapiens
ttaaacagtcccagaggctgac

SEQ ID NO: 7696697 - DNA, 22 bp, Homo sapiens
ttaaacagtcccagaggctgac

SEQ ID NO: 7696698 - DNA, 22 bp, Homo sapiens
ttaaacagtatatctgagcaag

SEQ ID NO: 7696699 - DNA, 22 bp, Homo sapiens
ttaaacactgggggttaatgca

SEQ ID NO: 7696700 - DNA, 22 bp, Homo sapiens
ttaaacagacagtaaatgaaac

SEQ ID NO: 7696701 - DNA, 22 bp, Homo sapiens
ttaaacagacagtaaatgaaac

SEQ ID NO: 7696702 - DNA, 22 bp, Homo sapiens
ttaaacactgggggttaatgca

SEQ ID NO: 7696703 - DNA, 22 bp, Homo sapiens
ttaaacagacagtaaatgaaac

SEQ ID NO: 7696704 - DNA, 22 bp, Homo sapiens
ttaaacagacagtaaatgaaac

SEQ ID NO: 7696705 - DNA, 22 bp, Homo sapiens
ttaaacagacagtaaatgaaac

SEQ ID NO: 7696706 - DNA, 22 bp, Homo sapiens
ttaaacagacagtaaatgaaac

SEQ ID NO: 7696707 - DNA, 22 bp, Homo sapiens
ttaaacagacagtaaatgaaac

SEQ ID NO: 7696708 - DNA, 22 bp, Homo sapiens
ttaaacagaggtagcagactgg

SEQ ID NO: 7696709 - DNA, 22 bp, Homo sapiens
ttaaaccatagtttaacataag

SEQ ID NO: 7696710 - DNA, 22 bp, Homo sapiens
ttaaaccatagtttaacataag

SEQ ID NO: 7696711 - DNA, 17 bp, Homo sapiens
ttaaaccataaagaagg

SEQ ID NO: 7696712 - DNA, 17 bp, Homo sapiens
ttaaaccataaagaagg

SEQ ID NO: 7696713 - DNA, 17 bp, Homo sapiens
ttaaaccataaagaagg

SEQ ID NO: 7696714 - DNA, 22 bp, Homo sapiens
ttaaaccatagtttaacataag

SEQ ID NO: 7696715 - DNA, 22 bp, Homo sapiens
ttaaaccatagtttaacataag

SEQ ID NO: 7696716 - DNA, 22 bp, Homo sapiens
ttaaaccatagtttaacataag

SEQ ID NO: 7696717 - DNA, 22 bp, Homo sapiens
ttaaaccatagtttaacataag

SEQ ID NO: 7696718 - DNA, 22 bp, Homo sapiens
ttaaaccactttgttgcaagta

SEQ ID NO: 7696719 - DNA, 22 bp, Homo sapiens
ttaaaccactgagtggagacta

SEQ ID NO: 7696720 - DNA, 22 bp, Homo sapiens
ttaaaccacaaggcaagttttg

SEQ ID NO: 7696721 - DNA, 22 bp, Homo sapiens
ttaaaccacaaggcaagttttg

SEQ ID NO: 7696722 - DNA, 22 bp, Homo sapiens
ttaaaccaccagaagccattat

SEQ ID NO: 7696723 - DNA, 22 bp, Homo sapiens
ttaaacatttatggaggcagca

SEQ ID NO: 7696724 - DNA, 22 bp, Homo sapiens
ttaaacatttatggaggcagca

SEQ ID NO: 7696725 - DNA, 22 bp, Homo sapiens
ttaaacatttttgatgatcgat

SEQ ID NO: 7696726 - DNA, 22 bp, Homo sapiens
ttaaacatttttgatgatcgat

SEQ ID NO: 7696727 - DNA, 22 bp, Homo sapiens
ttaaacatttttgatgatcgat

SEQ ID NO: 7696728 - DNA, 22 bp, Homo sapiens
ttaaacatttttgatgatcgat

SEQ ID NO: 7696729 - DNA, 22 bp, Homo sapiens
tgttctttcagttagacacagt

SEQ ID NO: 7696730 - DNA, 22 bp, Homo sapiens
tgttctttcagttagacacagt

SEQ ID NO: 7696731 - DNA, 22 bp, Homo sapiens
tgttctttcagttagacacagt

SEQ ID NO: 7696732 - DNA, 22 bp, Homo sapiens
tgttctttagcagaccatgttg

SEQ ID NO: 7696733 - DNA, 22 bp, Homo sapiens
tgttctttagcagaccatgttg

SEQ ID NO: 7696734 - DNA, 22 bp, Homo sapiens
tgttcttgggaatcttacagtt

SEQ ID NO: 7696735 - DNA, 22 bp, Homo sapiens
tgttctttcagttagacacagt

SEQ ID NO: 7696736 - DNA, 22 bp, Homo sapiens
tgttctttagcagaccatgttg

SEQ ID NO: 7696737 - DNA, 22 bp, Homo sapiens
tgttcttgagcctttagaccta

SEQ ID NO: 7696738 - DNA, 22 bp, Homo sapiens
tgttcttgagcctttagaccta

SEQ ID NO: 7696739 - DNA, 22 bp, Homo sapiens
tgttcttctagattgcctttta

SEQ ID NO: 7696740 - DNA, 22 bp, Homo sapiens
tgttcttatggctatttctccc

SEQ ID NO: 7696741 - DNA, 22 bp, Homo sapiens
tgttcttatggctatttctccc

SEQ ID NO: 7696742 - DNA, 22 bp, Homo sapiens
tgttcttgggaatcttacagtt

SEQ ID NO: 7696743 - DNA, 22 bp, Homo sapiens
tgttcttgggaatcttacagtt

SEQ ID NO: 7696744 - DNA, 22 bp, Homo sapiens
tgttcttgagcctttagaccta

SEQ ID NO: 7696745 - DNA, 22 bp, Homo sapiens
tgttcttgagcctttagaccta

SEQ ID NO: 7696746 - DNA, 22 bp, Homo sapiens
tgttcttgagcctttagaccta

SEQ ID NO: 7696747 - DNA, 22 bp, Homo sapiens
tgttctttgccagtgatttaat

SEQ ID NO: 7696748 - DNA, 22 bp, Homo sapiens
tgttctttgccagtgatttaat

SEQ ID NO: 7696749 - DNA, 22 bp, Homo sapiens
tgttctttgccagtgatttaat

SEQ ID NO: 7696750 - DNA, 22 bp, Homo sapiens
tgttctttgccagtgatttaat

SEQ ID NO: 7696751 - DNA, 22 bp, Homo sapiens
tgttctttgctgttgatgtaga

SEQ ID NO: 7696752 - DNA, 22 bp, Homo sapiens
tgttctttgctgttgatgtaga

SEQ ID NO: 7696753 - DNA, 22 bp, Homo sapiens
tgttctttggcttcacagctct

SEQ ID NO: 7696754 - DNA, 22 bp, Homo sapiens
tgttctttggcttcacagctct

SEQ ID NO: 7696755 - DNA, 22 bp, Homo sapiens
tgttctttggcttcctttccgt

SEQ ID NO: 7696756 - DNA, 22 bp, Homo sapiens
tgttcttttctctaaactgata

SEQ ID NO: 7696757 - DNA, 22 bp, Homo sapiens
tgttcttttctctaaactgata

SEQ ID NO: 7696758 - DNA, 22 bp, Homo sapiens
tgttctttggcttcacagctct

SEQ ID NO: 7696759 - DNA, 22 bp, Homo sapiens
tgttctttggcttcacagctct

SEQ ID NO: 7696760 - DNA, 22 bp, Homo sapiens
tgttctttgctgttgatgtaga

SEQ ID NO: 7696761 - DNA, 22 bp, Homo sapiens
tgttctttggcttcacagctct

SEQ ID NO: 7696762 - DNA, 22 bp, Homo sapiens
tgttagaatattgtaatattcg

SEQ ID NO: 7696763 - DNA, 22 bp, Homo sapiens
tgttagagctaagataacatct

SEQ ID NO: 7696764 - DNA, 22 bp, Homo sapiens
tgttagcaaggataattatgat

SEQ ID NO: 7696765 - DNA, 22 bp, Homo sapiens
tgttagatacacgaaaaaactt

SEQ ID NO: 7696766 - DNA, 22 bp, Homo sapiens
tgttagatattcattaatagga

SEQ ID NO: 7696767 - DNA, 22 bp, Homo sapiens
tgttagatattcattaatagga

SEQ ID NO: 7696768 - DNA, 22 bp, Homo sapiens
tgttagcaaggataattatgat

SEQ ID NO: 7696769 - DNA, 22 bp, Homo sapiens
tgttagcagagcagctgacaga

SEQ ID NO: 7696770 - DNA, 22 bp, Homo sapiens
tgttaggactccccagaagctg

SEQ ID NO: 7696771 - DNA, 18 bp, Homo sapiens
tgttaggaagggcacaca

SEQ ID NO: 7696772 - DNA, 22 bp, Homo sapiens
tgttagcatagctcagaaggag

SEQ ID NO: 7696773 - DNA, 22 bp, Homo sapiens
tgttagtattggcaaatttgtt

SEQ ID NO: 7696774 - DNA, 22 bp, Homo sapiens
tgttagggacacttggagagga

SEQ ID NO: 7696775 - DNA, 22 bp, Homo sapiens
tgttaggagaaaggaagatatt

SEQ ID NO: 7696776 - DNA, 22 bp, Homo sapiens
tgttaggagaaaggaagatatt

SEQ ID NO: 7696777 - DNA, 18 bp, Homo sapiens
tgttaggaagggcacaca

SEQ ID NO: 7696778 - DNA, 22 bp, Homo sapiens
tgttaggactccccagaagctg

SEQ ID NO: 7696779 - DNA, 22 bp, Homo sapiens
tgttcttagcatgcaaaatatg

SEQ ID NO: 7696780 - DNA, 22 bp, Homo sapiens
tgttcttaggtatttgacagtc

SEQ ID NO: 7696781 - DNA, 22 bp, Homo sapiens
tgttcttaggtatttgacagtc

SEQ ID NO: 7696782 - DNA, 22 bp, Homo sapiens
tgttcttaggtatttgacagtc

SEQ ID NO: 7696783 - DNA, 22 bp, Homo sapiens
tgttcttatgatgaagcactga

SEQ ID NO: 7696784 - DNA, 22 bp, Homo sapiens
tgttcttatgaattcaagacac

SEQ ID NO: 7696785 - DNA, 22 bp, Homo sapiens
tgttcttatgaattcaagacac

SEQ ID NO: 7696786 - DNA, 22 bp, Homo sapiens
tgttcttatgatgaagcactga

SEQ ID NO: 7696787 - DNA, 22 bp, Homo sapiens
tgttcttagcaggagcatctat

SEQ ID NO: 7696788 - DNA, 22 bp, Homo sapiens
tgttcttagcatgcaaaatatg

SEQ ID NO: 7696789 - DNA, 22 bp, Homo sapiens
tgttcttagcatgcaaaatatg

SEQ ID NO: 7696790 - DNA, 22 bp, Homo sapiens
tgttcttagcatgcaaaatatg

SEQ ID NO: 7696791 - DNA, 22 bp, Homo sapiens
tgttcttacggaacttatcttt

SEQ ID NO: 7696792 - DNA, 22 bp, Homo sapiens
tgttcttagcaggagcatctat

SEQ ID NO: 7696793 - DNA, 22 bp, Homo sapiens
tgttcttagcaggagcatctat

SEQ ID NO: 7696794 - DNA, 19 bp, Homo sapiens
tgttcttaaactgatggca

SEQ ID NO: 7696795 - DNA, 19 bp, Homo sapiens
tgttcttaaactgatggca

SEQ ID NO: 7696796 - DNA, 22 bp, Homo sapiens
tgttcttaacttttgtgtatat

SEQ ID NO: 7696797 - DNA, 22 bp, Homo sapiens
tgttcttaacttttgtgtatat

SEQ ID NO: 7696798 - DNA, 22 bp, Homo sapiens
tgttagttgttcatgttaagag

SEQ ID NO: 7696799 - DNA, 22 bp, Homo sapiens
tgttagttgttcatgttaagag

SEQ ID NO: 7696800 - DNA, 17 bp, Homo sapiens
tgttctgttggaaagca

SEQ ID NO: 7696801 - DNA, 22 bp, Homo sapiens
tgttcttacggaacttatcttt

SEQ ID NO: 7696802 - DNA, 22 bp, Homo sapiens
tgttcttacggaacttatcttt

SEQ ID NO: 7696803 - DNA, 22 bp, Homo sapiens
tgttcttacggaacttatcttt

SEQ ID NO: 7696804 - DNA, 22 bp, Homo sapiens
tgttcttaacttttgtgtatat

SEQ ID NO: 7696805 - DNA, 22 bp, Homo sapiens
tgttcttaagactggaagttac

SEQ ID NO: 7696806 - DNA, 22 bp, Homo sapiens
tgttcttaagactggaagttac

SEQ ID NO: 7696807 - DNA, 22 bp, Homo sapiens
tgttcttaacttttgtgtatat

SEQ ID NO: 7696808 - DNA, 22 bp, Homo sapiens
tgttaaattgattcacctttct

SEQ ID NO: 7696809 - DNA, 22 bp, Homo sapiens
tgttaaattgattcacctttct

SEQ ID NO: 7696810 - DNA, 22 bp, Homo sapiens
tgttaaattgattcacctttct

SEQ ID NO: 7696811 - DNA, 22 bp, Homo sapiens
tgttaaattgattcacctttct

SEQ ID NO: 7696812 - DNA, 22 bp, Homo sapiens
tgttaaatgttttgctagtgtc

SEQ ID NO: 7696813 - DNA, 22 bp, Homo sapiens
tgttaaatgttcctttactgga

SEQ ID NO: 7696814 - DNA, 22 bp, Homo sapiens
tgttaaatgttttgctagtgtc

SEQ ID NO: 7696815 - DNA, 22 bp, Homo sapiens
tgttaaatgttcctttactgga

SEQ ID NO: 7696816 - DNA, 22 bp, Homo sapiens
tgttaaatgttcctttactgga

SEQ ID NO: 7696817 - DNA, 22 bp, Homo sapiens
tgttaacatactgctttctaat

SEQ ID NO: 7696818 - DNA, 22 bp, Homo sapiens
tgttaacatcttggactcgtga

SEQ ID NO: 7696819 - DNA, 22 bp, Homo sapiens
tgttaacatactgctttctaat

SEQ ID NO: 7696820 - DNA, 22 bp, Homo sapiens
tgttaacagaggtcattttggg

SEQ ID NO: 7696821 - DNA, 22 bp, Homo sapiens
tgttaacagccagatttggtga

SEQ ID NO: 7696822 - DNA, 22 bp, Homo sapiens
tgttaacaataagtccaggcat

SEQ ID NO: 7696823 - DNA, 22 bp, Homo sapiens
tgttaacaataagtccaggcat

SEQ ID NO: 7696824 - DNA, 22 bp, Homo sapiens
tgttaacacaattctggagaga

SEQ ID NO: 7696825 - DNA, 22 bp, Homo sapiens
tgttaaatgagattggaatttg

SEQ ID NO: 7696826 - DNA, 22 bp, Homo sapiens
tgttaaatgagattggaatttg

SEQ ID NO: 7696827 - DNA, 22 bp, Homo sapiens
tgttaaatgagattggaatttg

SEQ ID NO: 7696828 - DNA, 22 bp, Homo sapiens
tgttaaatgagattggaatttg

SEQ ID NO: 7696829 - DNA, 18 bp, Homo sapiens
tgttaaatgaagatttgc

SEQ ID NO: 7696830 - DNA, 18 bp, Homo sapiens
tgttaaatgaagatttgc

SEQ ID NO: 7696831 - DNA, 18 bp, Homo sapiens
tgttaaatgaagatttgc

SEQ ID NO: 7696832 - DNA, 18 bp, Homo sapiens
tgttaaatgaagatttgc

SEQ ID NO: 7696833 - DNA, 22 bp, Homo sapiens
tgttaaatgtattatgtgttct

SEQ ID NO: 7696834 - DNA, 22 bp, Homo sapiens
tgttaaatgttcctttactgga

SEQ ID NO: 7696835 - DNA, 22 bp, Homo sapiens
tgttaaatgttcctttactgga

SEQ ID NO: 7696836 - DNA, 22 bp, Homo sapiens
tgttaaatgttcctttactgga

SEQ ID NO: 7696837 - DNA, 22 bp, Homo sapiens
tgttaaatgttcctttactgga

SEQ ID NO: 7696838 - DNA, 22 bp, Homo sapiens
tgttaaatgctcagctcgggga

SEQ ID NO: 7696839 - DNA, 22 bp, Homo sapiens
tgttaaatgtattatgtgttct

SEQ ID NO: 7696840 - DNA, 22 bp, Homo sapiens
tgttaaatgtattatgtgttct

SEQ ID NO: 7696841 - DNA, 22 bp, Homo sapiens
tgttaaatgtattatgtgttct

SEQ ID NO: 7696842 - DNA, 22 bp, Homo sapiens
tgttaaatgtattatgtgttct

SEQ ID NO: 7696843 - DNA, 22 bp, Homo sapiens
tgttacttcttatttcttacat

SEQ ID NO: 7696844 - DNA, 22 bp, Homo sapiens
tgttacttcttatttcttacat

SEQ ID NO: 7696845 - DNA, 22 bp, Homo sapiens
tgttacttatctcacgtgatgc

SEQ ID NO: 7696846 - DNA, 22 bp, Homo sapiens
tgttacttatctcacgtgatgc

SEQ ID NO: 7696847 - DNA, 22 bp, Homo sapiens
tgttacttcttggtaaaggaga

SEQ ID NO: 7696848 - DNA, 22 bp, Homo sapiens
tgttacttcttggtaaaggaga

SEQ ID NO: 7696849 - DNA, 22 bp, Homo sapiens
tgttacttcttatttcttacat

SEQ ID NO: 7696850 - DNA, 22 bp, Homo sapiens
tgttacttcttggtaaaggaga

SEQ ID NO: 7696851 - DNA, 22 bp, Homo sapiens
tgttagaaattattagtaatat

SEQ ID NO: 7696852 - DNA, 22 bp, Homo sapiens
tgttagaaattattagtaatat

SEQ ID NO: 7696853 - DNA, 22 bp, Homo sapiens
tgttacttggtgtctctggctg

SEQ ID NO: 7696854 - DNA, 22 bp, Homo sapiens
tgttactttgattggtattcta

SEQ ID NO: 7696855 - DNA, 22 bp, Homo sapiens
tgttagaaaggctattggacca

SEQ ID NO: 7696856 - DNA, 22 bp, Homo sapiens
tgttagaaattattagtaatat

SEQ ID NO: 7696857 - DNA, 22 bp, Homo sapiens
tgttactgatttgatatacagt

SEQ ID NO: 7696858 - DNA, 22 bp, Homo sapiens
tgttactgtctcatcattggat

SEQ ID NO: 7696859 - DNA, 22 bp, Homo sapiens
tgttactgtggttaccagaagc

SEQ ID NO: 7696860 - DNA, 22 bp, Homo sapiens
tgttactgtggttaccagaagc

SEQ ID NO: 7696861 - DNA, 18 bp, Homo sapiens
tgttactgagttatgttc

SEQ ID NO: 7696862 - DNA, 22 bp, Homo sapiens
tgttactgatttgatatacagt

SEQ ID NO: 7696863 - DNA, 22 bp, Homo sapiens
tgttactgatttgatatacagt

SEQ ID NO: 7696864 - DNA, 22 bp, Homo sapiens
tgttactctggggttgtggtga

SEQ ID NO: 7696865 - DNA, 22 bp, Homo sapiens
tgttactccttccctactcatg

SEQ ID NO: 7696866 - DNA, 22 bp, Homo sapiens
tgttaaggagacacatgaaaaa

SEQ ID NO: 7696867 - DNA, 22 bp, Homo sapiens
tgttaaggagacacatgaaaaa

SEQ ID NO: 7696868 - DNA, 22 bp, Homo sapiens
tgttaagaagaggcagtactta

SEQ ID NO: 7696869 - DNA, 22 bp, Homo sapiens
tgttaagaagaggcagtactta

SEQ ID NO: 7696870 - DNA, 22 bp, Homo sapiens
tgttaagcaagcaatggagggt

SEQ ID NO: 7696871 - DNA, 22 bp, Homo sapiens
tgttaacttgcaagctgaagaa

SEQ ID NO: 7696872 - DNA, 22 bp, Homo sapiens
tgttaagaagaggcagtactta

SEQ ID NO: 7696873 - DNA, 22 bp, Homo sapiens
tgttaacatgtgtattgtatga

SEQ ID NO: 7696874 - DNA, 22 bp, Homo sapiens
tgttaacatgtgtattgtatga

SEQ ID NO: 7696875 - DNA, 22 bp, Homo sapiens
tgttacattggagttgtttaga

SEQ ID NO: 7696876 - DNA, 22 bp, Homo sapiens
tgttacattggagttgtttaga

SEQ ID NO: 7696877 - DNA, 22 bp, Homo sapiens
tgttacattggagttgtttaga

SEQ ID NO: 7696878 - DNA, 22 bp, Homo sapiens
tgttacatcgttggctaggaga

SEQ ID NO: 7696879 - DNA, 22 bp, Homo sapiens
tgttacagtggctttttaaaca

SEQ ID NO: 7696880 - DNA, 22 bp, Homo sapiens
tgttacatcgttggctaggaga

SEQ ID NO: 7696881 - DNA, 22 bp, Homo sapiens
tgttacagtggctttttaaaca

SEQ ID NO: 7696882 - DNA, 22 bp, Homo sapiens
tgttacagtggctttttaaaca

SEQ ID NO: 7696883 - DNA, 22 bp, Homo sapiens
tgttacagtggctttttaaaca

SEQ ID NO: 7696884 - DNA, 22 bp, Homo sapiens
tgttacagtggctttttaaaca

SEQ ID NO: 7696885 - DNA, 22 bp, Homo sapiens
tgttaccaggcagtattgctta

SEQ ID NO: 7696886 - DNA, 22 bp, Homo sapiens
tgttaccaaggctgcttctagt

SEQ ID NO: 7696887 - DNA, 22 bp, Homo sapiens
tgttaccataggtcagaacgtt

SEQ ID NO: 7696888 - DNA, 22 bp, Homo sapiens
tgttactattagtttgagcata

SEQ ID NO: 7696889 - DNA, 22 bp, Homo sapiens
tgttaccaaaatcttgtatatc

SEQ ID NO: 7696890 - DNA, 22 bp, Homo sapiens
tgttacatttctctttcttgga

SEQ ID NO: 7696891 - DNA, 22 bp, Homo sapiens
tgttacatttctctttcttgga

SEQ ID NO: 7696892 - DNA, 22 bp, Homo sapiens
tgtttatgcatcgttaatacca

SEQ ID NO: 7696893 - DNA, 22 bp, Homo sapiens
tgtttatagggtctgtcacttg

SEQ ID NO: 7696894 - DNA, 22 bp, Homo sapiens
tgtttatagggtctgtcacttg

SEQ ID NO: 7696895 - DNA, 21 bp, Homo sapiens
tgtttatggaaaagagacaaa

SEQ ID NO: 7696896 - DNA, 21 bp, Homo sapiens
tgtttatggaaaagagacaaa

SEQ ID NO: 7696897 - DNA, 22 bp, Homo sapiens
tgtttatgcatcgttaatacca

SEQ ID NO: 7696898 - DNA, 22 bp, Homo sapiens
tgtttatagggtctgtcacttg

SEQ ID NO: 7696899 - DNA, 22 bp, Homo sapiens
tgtttatagatggccacaatga

SEQ ID NO: 7696900 - DNA, 22 bp, Homo sapiens
tgtttatagggtctgtcacttg

SEQ ID NO: 7696901 - DNA, 22 bp, Homo sapiens
tgtttatagatggccacaatga

SEQ ID NO: 7696902 - DNA, 22 bp, Homo sapiens
tgtttatagatggccacaatga

SEQ ID NO: 7696903 - DNA, 22 bp, Homo sapiens
tgtttataccttggtataacca

SEQ ID NO: 7696904 - DNA, 22 bp, Homo sapiens
tgtttactcctgatatattttt

SEQ ID NO: 7696905 - DNA, 22 bp, Homo sapiens
tgtttactgcattctatttgct

SEQ ID NO: 7696906 - DNA, 22 bp, Homo sapiens
tgtttactgcattctatttgct

SEQ ID NO: 7696907 - DNA, 22 bp, Homo sapiens
tgtttactggaccagggagggg

SEQ ID NO: 7696908 - DNA, 22 bp, Homo sapiens
tgtttataccttggtataacca

SEQ ID NO: 7696909 - DNA, 22 bp, Homo sapiens
tgtttattcatggctaatgaaa

SEQ ID NO: 7696910 - DNA, 22 bp, Homo sapiens
tgtttattcatggctaatgaaa

SEQ ID NO: 7696911 - DNA, 22 bp, Homo sapiens
tgtttattcatggctaatgaaa

SEQ ID NO: 7696912 - DNA, 22 bp, Homo sapiens
tgtttattcatggctaatgaaa

SEQ ID NO: 7696913 - DNA, 22 bp, Homo sapiens
tgtttattcatggctaatgaaa

SEQ ID NO: 7696914 - DNA, 22 bp, Homo sapiens
tgtttattcatggctaatgaaa

SEQ ID NO: 7696915 - DNA, 22 bp, Homo sapiens
tgtttattacagttcttggaat

SEQ ID NO: 7696916 - DNA, 22 bp, Homo sapiens
tgtttattacagttcttggaat

SEQ ID NO: 7696917 - DNA, 22 bp, Homo sapiens
tgtttattacagttcttggaat

SEQ ID NO: 7696918 - DNA, 22 bp, Homo sapiens
tgtttattacagttcttggaat

SEQ ID NO: 7696919 - DNA, 22 bp, Homo sapiens
tgtttatgtgtgtgcatatata

SEQ ID NO: 7696920 - DNA, 22 bp, Homo sapiens
tgtttattacagttcttggaat

SEQ ID NO: 7696921 - DNA, 22 bp, Homo sapiens
tgtttattgagtgcctactata

SEQ ID NO: 7696922 - DNA, 22 bp, Homo sapiens
tgtttattgagtgcctactata

SEQ ID NO: 7696923 - DNA, 22 bp, Homo sapiens
tgtttattgagtgcctactata

SEQ ID NO: 7696924 - DNA, 22 bp, Homo sapiens
tgtttattgagtgcctactata

SEQ ID NO: 7696925 - DNA, 22 bp, Homo sapiens
tgtttattgagtgcctactata

SEQ ID NO: 7696926 - DNA, 22 bp, Homo sapiens
tgtttattgagtgcctactata

SEQ ID NO: 7696927 - DNA, 18 bp, Homo sapiens
tgtttattctcctgacag

SEQ ID NO: 7696928 - DNA, 18 bp, Homo sapiens
tgtttattctcctgacag

SEQ ID NO: 7696929 - DNA, 18 bp, Homo sapiens
tgtttattctcctgacag

SEQ ID NO: 7696930 - DNA, 18 bp, Homo sapiens
tgtttattctcctgacag

SEQ ID NO: 7696931 - DNA, 18 bp, Homo sapiens
tgtttattctcctgacag

SEQ ID NO: 7696932 - DNA, 18 bp, Homo sapiens
tgtttattctcctgacag

SEQ ID NO: 7696933 - DNA, 22 bp, Homo sapiens
tgtttattgctgcaattgtgcc

SEQ ID NO: 7696934 - DNA, 22 bp, Homo sapiens
tgtttattgctgcaattgtgcc

SEQ ID NO: 7696935 - DNA, 22 bp, Homo sapiens
tgtttattgctgcaattgtgcc

SEQ ID NO: 7696936 - DNA, 22 bp, Homo sapiens
tgtttattgctgcaattgtgcc

SEQ ID NO: 7696937 - DNA, 22 bp, Homo sapiens
tgtttattgcagtgctgggctg

SEQ ID NO: 7696938 - DNA, 22 bp, Homo sapiens
tgtttattgcagtgctgggctg

SEQ ID NO: 7696939 - DNA, 22 bp, Homo sapiens
tgtttattgcagtgctgggctg

SEQ ID NO: 7696940 - DNA, 22 bp, Homo sapiens
tgtttattttcaggatggattg

SEQ ID NO: 7696941 - DNA, 22 bp, Homo sapiens
tgtttattttcaggatggattg

SEQ ID NO: 7696942 - DNA, 22 bp, Homo sapiens
tgtttattttcaggatggattg

SEQ ID NO: 7696943 - DNA, 22 bp, Homo sapiens
tgtttattttcaggatggattg

SEQ ID NO: 7696944 - DNA, 22 bp, Homo sapiens
tgtttattgctgcaattgtgcc

SEQ ID NO: 7696945 - DNA, 22 bp, Homo sapiens
tgtttattgctgcaattgtgcc

SEQ ID NO: 7696946 - DNA, 23 bp, Homo sapiens
tgttgaagtaactgttacataga

SEQ ID NO: 7696947 - DNA, 22 bp, Homo sapiens
tgttgaatcagaagtcctggct

SEQ ID NO: 7696948 - DNA, 20 bp, Homo sapiens
tgttgaattcatggtgactt

SEQ ID NO: 7696949 - DNA, 19 bp, Homo sapiens
tgttgacattctgagttga

SEQ ID NO: 7696950 - DNA, 18 bp, Homo sapiens
tgttgaaacttcaggtaa

SEQ ID NO: 7696951 - DNA, 22 bp, Homo sapiens
tgttcttttctctaaactgata

SEQ ID NO: 7696952 - DNA, 22 bp, Homo sapiens
tgttcttttctctaaactgata

SEQ ID NO: 7696953 - DNA, 22 bp, Homo sapiens
tgttcttttctctaaactgata

SEQ ID NO: 7696954 - DNA, 22 bp, Homo sapiens
tgttcttttctctaaactgata

SEQ ID NO: 7696955 - DNA, 22 bp, Homo sapiens
tgttgagacacagacacaagcc

SEQ ID NO: 7696956 - DNA, 22 bp, Homo sapiens
tgttgagactgagggagtcagc

SEQ ID NO: 7696957 - DNA, 22 bp, Homo sapiens
tgttgactggtaactttaaaca

SEQ ID NO: 7696958 - DNA, 22 bp, Homo sapiens
tgttgacttgaaccaaagtgtt

SEQ ID NO: 7696959 - DNA, 22 bp, Homo sapiens
tgttgagtatatacctacaagt

SEQ ID NO: 7696960 - DNA, 22 bp, Homo sapiens
tgttgagtatatacctacaagt

SEQ ID NO: 7696961 - DNA, 22 bp, Homo sapiens
tgttgagtatatacctacaagt

SEQ ID NO: 7696962 - DNA, 22 bp, Homo sapiens
tgttgagtatatacctacaagt

SEQ ID NO: 7696963 - DNA, 22 bp, Homo sapiens
tgttggggtcaggagctagcct

SEQ ID NO: 7696964 - DNA, 22 bp, Homo sapiens
tgttggggtcaggagctagcct

SEQ ID NO: 7696965 - DNA, 22 bp, Homo sapiens
tgttgggatcgaatggtggaac

SEQ ID NO: 7696966 - DNA, 22 bp, Homo sapiens
tgttgggatcgaatggtggaac

SEQ ID NO: 7696967 - DNA, 20 bp, Homo sapiens
tgttgggatgaagttaacct

SEQ ID NO: 7696968 - DNA, 22 bp, Homo sapiens
tgttgggaagctctgccagggg

SEQ ID NO: 7696969 - DNA, 22 bp, Homo sapiens
tgttgggaagctctgccagggg

SEQ ID NO: 7696970 - DNA, 22 bp, Homo sapiens
tgttgggaagctctgccagggg

SEQ ID NO: 7696971 - DNA, 22 bp, Homo sapiens
tgttgattagtgtttagactta

SEQ ID NO: 7696972 - DNA, 22 bp, Homo sapiens
tgttgggaattgtgagtaatgg

SEQ ID NO: 7696973 - DNA, 22 bp, Homo sapiens
tgttgggaagctctgccagggg

SEQ ID NO: 7696974 - DNA, 22 bp, Homo sapiens
tgttgggaagctctgccagggg

SEQ ID NO: 7696975 - DNA, 22 bp, Homo sapiens
tgttgggaagctctgccagggg

SEQ ID NO: 7696976 - DNA, 22 bp, Homo sapiens
tgttgtaaaatttgagatgtca

SEQ ID NO: 7696977 - DNA, 22 bp, Homo sapiens
tgttggtttaaaatgctgattt

SEQ ID NO: 7696978 - DNA, 22 bp, Homo sapiens
tgttgtaatcattttatgaaaa

SEQ ID NO: 7696979 - DNA, 22 bp, Homo sapiens
tgttgtacagatatatttgggt

SEQ ID NO: 7696980 - DNA, 22 bp, Homo sapiens
tgttgtactcaacagatgaatt

SEQ ID NO: 7696981 - DNA, 22 bp, Homo sapiens
tgttgtactcaacagatgaatt

SEQ ID NO: 7696982 - DNA, 22 bp, Homo sapiens
tgttggtaggatttgcttcagc

SEQ ID NO: 7696983 - DNA, 22 bp, Homo sapiens
tgttggtgaacttccacttgct

SEQ ID NO: 7696984 - DNA, 22 bp, Homo sapiens
tgttgtaaaatttgagatgtca

SEQ ID NO: 7696985 - DNA, 23 bp, Homo sapiens
tgttggtggcggtaattttgtcc

SEQ ID NO: 7696986 - DNA, 18 bp, Homo sapiens
tgttggtgttcactcact

SEQ ID NO: 7696987 - DNA, 22 bp, Homo sapiens
tgtttaaccatctgcttttatg

SEQ ID NO: 7696988 - DNA, 22 bp, Homo sapiens
tgtttaaccaccattctattct

SEQ ID NO: 7696989 - DNA, 22 bp, Homo sapiens
tgtttaactagttttcacactt

SEQ ID NO: 7696990 - DNA, 22 bp, Homo sapiens
tgtttaagatccgtcagtcact

SEQ ID NO: 7696991 - DNA, 22 bp, Homo sapiens
tgtttaagcctgtggtgtcatc

SEQ ID NO: 7696992 - DNA, 15 bp, Homo sapiens
tgtttaagccacatt

SEQ ID NO: 7696993 - DNA, 22 bp, Homo sapiens
tgtttaaatagaacatactgca

SEQ ID NO: 7696994 - DNA, 22 bp, Homo sapiens
tgtttaagctgatgaggtatcg

SEQ ID NO: 7696995 - DNA, 22 bp, Homo sapiens
tgtttaagctgatgaggtatcg

SEQ ID NO: 7696996 - DNA, 21 bp, Homo sapiens
tgtttactccctgcaagcacg

SEQ ID NO: 7696997 - DNA, 21 bp, Homo sapiens
tgtttactccctgcaagcacg

SEQ ID NO: 7696998 - DNA, 21 bp, Homo sapiens
tgtttactccctgcaagcacg

SEQ ID NO: 7696999 - DNA, 22 bp, Homo sapiens
tgtttactgcattctatttgct

SEQ ID NO: 7697000 - DNA, 20 bp, Homo sapiens
tgtttactctagagggtaga

SEQ ID NO: 7697001 - DNA, 22 bp, Homo sapiens
tgtttactcctgatatattttt

SEQ ID NO: 7697002 - DNA, 22 bp, Homo sapiens
tgttgttcagtctttgctggct

SEQ ID NO: 7697003 - DNA, 22 bp, Homo sapiens
tgttgttcagtctttgctggct

SEQ ID NO: 7697004 - DNA, 22 bp, Homo sapiens
tgttgtttctactaataggcca

SEQ ID NO: 7697005 - DNA, 22 bp, Homo sapiens
tgttgttacattcctgtgtccc

SEQ ID NO: 7697006 - DNA, 21 bp, Homo sapiens
tgttgttttatggctatgaat

SEQ ID NO: 7697007 - DNA, 21 bp, Homo sapiens
tgttgttttatggctatgaat

SEQ ID NO: 7697008 - DNA, 21 bp, Homo sapiens
tgttgttttatggctatgaat

SEQ ID NO: 7697009 - DNA, 23 bp, Homo sapiens
tgttgtgactggatgctttgtcc

SEQ ID NO: 7697010 - DNA, 19 bp, Homo sapiens
tgttgtctaccatgaagtc

SEQ ID NO: 7697011 - DNA, 22 bp, Homo sapiens
tgttgtagcttgacagcagcca

SEQ ID NO: 7697012 - DNA, 22 bp, Homo sapiens
tgtttaaatagaacatactgca

SEQ ID NO: 7697013 - DNA, 22 bp, Homo sapiens
tgtttaaatagaacatactgca

SEQ ID NO: 7697014 - DNA, 22 bp, Homo sapiens
tgtttaaatagaacatactgca

SEQ ID NO: 7697015 - DNA, 22 bp, Homo sapiens
tgtttaaatagaacatactgca

SEQ ID NO: 7697016 - DNA, 22 bp, Homo sapiens
tgtttaaatagaacatactgca

SEQ ID NO: 7697017 - DNA, 22 bp, Homo sapiens
tgtttaaatagaacatactgca

SEQ ID NO: 7697018 - DNA, 22 bp, Homo sapiens
tgtttaaatagaacatactgca

SEQ ID NO: 7697019 - DNA, 22 bp, Homo sapiens
tgtttaaatagaacatactgca

SEQ ID NO: 7697020 - DNA, 22 bp, Homo sapiens
tgtttaaatagaacatactgca

SEQ ID NO: 7697021 - DNA, 22 bp, Homo sapiens
tgtttaaatagaacatactgca

SEQ ID NO: 7697022 - DNA, 22 bp, Homo sapiens
tgtgtgtgtgcgcgcacgcata

SEQ ID NO: 7697023 - DNA, 22 bp, Homo sapiens
tgtgtgtgtgcgcgcacgcata

SEQ ID NO: 7697024 - DNA, 22 bp, Homo sapiens
tgtgtgtgtgcgcgcacgcata

SEQ ID NO: 7697025 - DNA, 22 bp, Homo sapiens
tgtgtgtgtcctcatttgcaga

SEQ ID NO: 7697026 - DNA, 22 bp, Homo sapiens
tgtgtgtgtcctcatttgcaga

SEQ ID NO: 7697027 - DNA, 22 bp, Homo sapiens
tgtgtgtgttcctcctcagcta

SEQ ID NO: 7697028 - DNA, 22 bp, Homo sapiens
tgtgtgtgttcctcctcagcta

SEQ ID NO: 7697029 - DNA, 22 bp, Homo sapiens
tgtgtgtgttcctcctcagcta

SEQ ID NO: 7697030 - DNA, 22 bp, Homo sapiens
tgtgtgtgttcctcctcagcta

SEQ ID NO: 7697031 - DNA, 22 bp, Homo sapiens
tgtgtgtgtgcgcgcacgcata

SEQ ID NO: 7697032 - DNA, 22 bp, Homo sapiens
tgtgtgtgtgcgcgcacgcata

SEQ ID NO: 7697033 - DNA, 22 bp, Homo sapiens
tgtgtgtgtgcgcgcacgcata

SEQ ID NO: 7697034 - DNA, 20 bp, Homo sapiens
tgtgtgtgtacttctaaata

SEQ ID NO: 7697035 - DNA, 20 bp, Homo sapiens
tgtgtgtgtacttctaaata

SEQ ID NO: 7697036 - DNA, 20 bp, Homo sapiens
tgtgtgtgtacttctaaata

SEQ ID NO: 7697037 - DNA, 20 bp, Homo sapiens
tgtgtgtgtacttctaaata

SEQ ID NO: 7697038 - DNA, 22 bp, Homo sapiens
tgtgtgtgtaaaagcatttata

SEQ ID NO: 7697039 - DNA, 22 bp, Homo sapiens
tgtgtgtgtaaaagcatttata

SEQ ID NO: 7697040 - DNA, 23 bp, Homo sapiens
tgtgtgtgtattctacgcaaggt

SEQ ID NO: 7697041 - DNA, 23 bp, Homo sapiens
tgtgtgtgtattctacgcaaggt

SEQ ID NO: 7697042 - DNA, 22 bp, Homo sapiens
tgtgtgtgtcctcatttgcaga

SEQ ID NO: 7697043 - DNA, 22 bp, Homo sapiens
tgtgtgtgtcctcatttgcaga

SEQ ID NO: 7697044 - DNA, 23 bp, Homo sapiens
tgtgtgtgtattctacgcaaggt

SEQ ID NO: 7697045 - DNA, 23 bp, Homo sapiens
tgtgtgtgtattctacgcaaggt

SEQ ID NO: 7697046 - DNA, 21 bp, Homo sapiens
tgtgtgtgcaggcacacacac

SEQ ID NO: 7697047 - DNA, 21 bp, Homo sapiens
tgtgtgtgcaggcacacacac

SEQ ID NO: 7697048 - DNA, 21 bp, Homo sapiens
tgtgtgtgcaggcacacacac

SEQ ID NO: 7697049 - DNA, 21 bp, Homo sapiens
tgtgtgtgcaggcacacacac

SEQ ID NO: 7697050 - DNA, 21 bp, Homo sapiens
tgtgtgtgcaggcacacacac

SEQ ID NO: 7697051 - DNA, 22 bp, Homo sapiens
tgtgtgtgcaggagagcaggtg

SEQ ID NO: 7697052 - DNA, 22 bp, Homo sapiens
tgtgtgtgcaggagagcaggtg

SEQ ID NO: 7697053 - DNA, 22 bp, Homo sapiens
tgtgtgtgcaggagagcaggtg

SEQ ID NO: 7697054 - DNA, 22 bp, Homo sapiens
tgtgtgtgcaggagagcaggtg

SEQ ID NO: 7697055 - DNA, 22 bp, Homo sapiens
tgtgtgtgcaggagagcaggtg

SEQ ID NO: 7697056 - DNA, 22 bp, Homo sapiens
tgtgtgtgcaggagagcaggtg

SEQ ID NO: 7697057 - DNA, 22 bp, Homo sapiens
tgtgtgtgcacgtgcgcgcgag

SEQ ID NO: 7697058 - DNA, 22 bp, Homo sapiens
tgtgtgtgcacgtgcgcgcgag

SEQ ID NO: 7697059 - DNA, 22 bp, Homo sapiens
tgtgtgtgcacgtgcgcgcgag

SEQ ID NO: 7697060 - DNA, 22 bp, Homo sapiens
tgtgtgtggggaggcagcagat

SEQ ID NO: 7697061 - DNA, 22 bp, Homo sapiens
tgtgtgtggggaggcagcagat

SEQ ID NO: 7697062 - DNA, 22 bp, Homo sapiens
tgtgtgtggggaggcagcagat

SEQ ID NO: 7697063 - DNA, 22 bp, Homo sapiens
tgtgtgtgggcggaacggcccc

SEQ ID NO: 7697064 - DNA, 22 bp, Homo sapiens
tgtgtgtgggcggaacggcccc

SEQ ID NO: 7697065 - DNA, 22 bp, Homo sapiens
tgtgtgtgggcggaacggcccc

SEQ ID NO: 7697066 - DNA, 22 bp, Homo sapiens
tgtgtgtgggcggaacggcccc

SEQ ID NO: 7697067 - DNA, 22 bp, Homo sapiens
tgtgtgtggggaggcagcagat

SEQ ID NO: 7697068 - DNA, 22 bp, Homo sapiens
tgtgtgtgtaaaagcatttata

SEQ ID NO: 7697069 - DNA, 22 bp, Homo sapiens
tgtgtgtgtaaaagcatttata

SEQ ID NO: 7697070 - DNA, 22 bp, Homo sapiens
tgtgtgtgtaaaagcatttata

SEQ ID NO: 7697071 - DNA, 22 bp, Homo sapiens
tgtgtgtgtttctgctcataca

SEQ ID NO: 7697072 - DNA, 22 bp, Homo sapiens
tgtgtgtgtttctgctcataca

SEQ ID NO: 7697073 - DNA, 22 bp, Homo sapiens
tgtgtgtgtttctgctcataca

SEQ ID NO: 7697074 - DNA, 22 bp, Homo sapiens
tgtgtgtgtttctgctcataca

SEQ ID NO: 7697075 - DNA, 22 bp, Homo sapiens
tgtgtgtgtttataaatctaaa

SEQ ID NO: 7697076 - DNA, 22 bp, Homo sapiens
tgtgtgtgtttataaatctaaa

SEQ ID NO: 7697077 - DNA, 22 bp, Homo sapiens
tgtgtgtgtttataaatctaaa

SEQ ID NO: 7697078 - DNA, 22 bp, Homo sapiens
tgtgtgtgtttataaatctaaa

SEQ ID NO: 7697079 - DNA, 22 bp, Homo sapiens
tgtgtgtgtttacagtttctca

SEQ ID NO: 7697080 - DNA, 22 bp, Homo sapiens
tgtgtgtgtttacagtttctca

SEQ ID NO: 7697081 - DNA, 22 bp, Homo sapiens
tgtgtgtgtttacagtttctca

SEQ ID NO: 7697082 - DNA, 22 bp, Homo sapiens
tgtgtgtgtttacagtttctca

SEQ ID NO: 7697083 - DNA, 22 bp, Homo sapiens
tgtgtgtgtttacagtttctca

SEQ ID NO: 7697084 - DNA, 22 bp, Homo sapiens
tgtgtgtgttcctcctcagcta

SEQ ID NO: 7697085 - DNA, 22 bp, Homo sapiens
tgtgtgttattttcagccatta

SEQ ID NO: 7697086 - DNA, 22 bp, Homo sapiens
tgtgtgttggctggagagggct

SEQ ID NO: 7697087 - DNA, 19 bp, Homo sapiens
tgtgtgtttatatatgtat

SEQ ID NO: 7697088 - DNA, 22 bp, Homo sapiens
tgtgtgttagtctcaaagccgt

SEQ ID NO: 7697089 - DNA, 22 bp, Homo sapiens
tgtgtgtgtttctgctcataca

SEQ ID NO: 7697090 - DNA, 19 bp, Homo sapiens
tgtgtgtttatatatgtat

SEQ ID NO: 7697091 - DNA, 19 bp, Homo sapiens
tgtgtgtttatatatgtat

SEQ ID NO: 7697092 - DNA, 19 bp, Homo sapiens
tgtgtgtttatatatgtat

SEQ ID NO: 7697093 - DNA, 22 bp, Homo sapiens
tgtgttaacactgcatgataat

SEQ ID NO: 7697094 - DNA, 19 bp, Homo sapiens
tgtgttaacaggaattggt

SEQ ID NO: 7697095 - DNA, 21 bp, Homo sapiens
tgtgttaaaggctgaggtccc

SEQ ID NO: 7697096 - DNA, 22 bp, Homo sapiens
tgtgttaacactgcatgataat

SEQ ID NO: 7697097 - DNA, 22 bp, Homo sapiens
tgtgttaaggtgcatctagtgc

SEQ ID NO: 7697098 - DNA, 22 bp, Homo sapiens
tgtgttaaggtgcatctagtgc

SEQ ID NO: 7697099 - DNA, 22 bp, Homo sapiens
tgtgttaaggtgcatctagtgc

SEQ ID NO: 7697100 - DNA, 22 bp, Homo sapiens
tgtgttaagtatttgatacact

SEQ ID NO: 7697101 - DNA, 22 bp, Homo sapiens
tgtgttaagtatttgatacact

SEQ ID NO: 7697102 - DNA, 22 bp, Homo sapiens
tgtgttaagtatttgatacact

SEQ ID NO: 7697103 - DNA, 22 bp, Homo sapiens
tgttaaaaattcagctctagat

SEQ ID NO: 7697104 - DNA, 22 bp, Homo sapiens
tgttaaaaattcagctctagat

SEQ ID NO: 7697105 - DNA, 22 bp, Homo sapiens
tgttaaaaattcagctctagat

SEQ ID NO: 7697106 - DNA, 22 bp, Homo sapiens
tgtgttaagtatttgatacact

SEQ ID NO: 7697107 - DNA, 22 bp, Homo sapiens
tgtgttaattccacaaacattc

SEQ ID NO: 7697108 - DNA, 22 bp, Homo sapiens
tgtgttaattccacaaacattc

SEQ ID NO: 7697109 - DNA, 22 bp, Homo sapiens
tgttaaaaatgcagattcctat

SEQ ID NO: 7697110 - DNA, 22 bp, Homo sapiens
tgttaaacagatattgcccaca

SEQ ID NO: 7697111 - DNA, 22 bp, Homo sapiens
tgttaaaaccacaggtgaggac

SEQ ID NO: 7697112 - DNA, 22 bp, Homo sapiens
tgttaaaaccacaggtgaggac

SEQ ID NO: 7697113 - DNA, 22 bp, Homo sapiens
tgttaaaaccacaggtgaggac

SEQ ID NO: 7697114 - DNA, 22 bp, Homo sapiens
tgttaaaaattcagctctagat

SEQ ID NO: 7697115 - DNA, 22 bp, Homo sapiens
tgttaaaaattcagctctagat

SEQ ID NO: 7697116 - DNA, 22 bp, Homo sapiens
tgttaaactcgtaggttaggct

SEQ ID NO: 7697117 - DNA, 22 bp, Homo sapiens
tgttaaacctagtacaggtcct

SEQ ID NO: 7697118 - DNA, 22 bp, Homo sapiens
tgttaaacctagtacaggtcct

SEQ ID NO: 7697119 - DNA, 22 bp, Homo sapiens
tgttaaaccagttttgcatcat

SEQ ID NO: 7697120 - DNA, 22 bp, Homo sapiens
tgttaaacctagtacaggtcct

SEQ ID NO: 7697121 - DNA, 22 bp, Homo sapiens
tgttaaagtggataagctgaat

SEQ ID NO: 7697122 - DNA, 18 bp, Homo sapiens
tgttaaatgaagatttgc

SEQ ID NO: 7697123 - DNA, 22 bp, Homo sapiens
tgttaaagttatatgccgtcct

SEQ ID NO: 7697124 - DNA, 22 bp, Homo sapiens
tgtgtgcctgagccgtgcctgg

SEQ ID NO: 7697125 - DNA, 22 bp, Homo sapiens
tgtgtgcctgagccgtgcctgg

SEQ ID NO: 7697126 - DNA, 22 bp, Homo sapiens
tgtgtgctaatgtatgctctaa

SEQ ID NO: 7697127 - DNA, 22 bp, Homo sapiens
tgtgtgcctgagccgtgcctgg

SEQ ID NO: 7697128 - DNA, 20 bp, Homo sapiens
tgtgtgctaggactacagtg

SEQ ID NO: 7697129 - DNA, 22 bp, Homo sapiens
tgtgtgctaatgtatgctctaa

SEQ ID NO: 7697130 - DNA, 22 bp, Homo sapiens
tgtgtgctaatgtatgctctaa

SEQ ID NO: 7697131 - DNA, 22 bp, Homo sapiens
tgtgtgctaatgtatgctctaa

SEQ ID NO: 7697132 - DNA, 22 bp, Homo sapiens
tgtgtgccagcctacgaggagc

SEQ ID NO: 7697133 - DNA, 22 bp, Homo sapiens
tgtgtgccccagatgagtagct

SEQ ID NO: 7697134 - DNA, 22 bp, Homo sapiens
tgtgtgccagggcatgcacagg

SEQ ID NO: 7697135 - DNA, 22 bp, Homo sapiens
tgtgtgccagcctacgaggagc

SEQ ID NO: 7697136 - DNA, 22 bp, Homo sapiens
tgtgtgccccagatgagtagct

SEQ ID NO: 7697137 - DNA, 22 bp, Homo sapiens
tgtgtgcctgagccgtgcctgg

SEQ ID NO: 7697138 - DNA, 22 bp, Homo sapiens
tgtgtgcattcacatgcatgcc

SEQ ID NO: 7697139 - DNA, 22 bp, Homo sapiens
tgtgtgcattcacatgcatgcc

SEQ ID NO: 7697140 - DNA, 19 bp, Homo sapiens
tgtgtgcatgcgcacgtgt

SEQ ID NO: 7697141 - DNA, 22 bp, Homo sapiens
tgtgtgcattcacatgcatgcc

SEQ ID NO: 7697142 - DNA, 19 bp, Homo sapiens
tgtgtgcatgcgcacgtgt

SEQ ID NO: 7697143 - DNA, 22 bp, Homo sapiens
tgtgtcagaggtagagatggca

SEQ ID NO: 7697144 - DNA, 22 bp, Homo sapiens
tgtgtcagaggtagagatggca

SEQ ID NO: 7697145 - DNA, 22 bp, Homo sapiens
tgtgtgcattagcattctaggg

SEQ ID NO: 7697146 - DNA, 22 bp, Homo sapiens
tgtgtgcatgttaatgagaaaa

SEQ ID NO: 7697147 - DNA, 22 bp, Homo sapiens
tgtgtgcatgcttggggcagca

SEQ ID NO: 7697148 - DNA, 22 bp, Homo sapiens
tgtgtgcatgttaatgagaaaa

SEQ ID NO: 7697149 - DNA, 22 bp, Homo sapiens
tgtgtattaccattttacagct

SEQ ID NO: 7697150 - DNA, 22 bp, Homo sapiens
tgtgtattcagcaagcgaaaca

SEQ ID NO: 7697151 - DNA, 22 bp, Homo sapiens
tgtgtattaccattttacagct

SEQ ID NO: 7697152 - DNA, 22 bp, Homo sapiens
tgtgtattcagcaagcgaaaca

SEQ ID NO: 7697153 - DNA, 22 bp, Homo sapiens
tgtgtattctgaggtaggtata

SEQ ID NO: 7697154 - DNA, 22 bp, Homo sapiens
tgtgtatttctggaacagacta

SEQ ID NO: 7697155 - DNA, 22 bp, Homo sapiens
tgtgtatttctggaacagacta

SEQ ID NO: 7697156 - DNA, 22 bp, Homo sapiens
tgtgtcaaagtcaggtgtcact

SEQ ID NO: 7697157 - DNA, 22 bp, Homo sapiens
tgtgtagaaagatctccaagat

SEQ ID NO: 7697158 - DNA, 22 bp, Homo sapiens
tgtgtagaaagatctccaagat

SEQ ID NO: 7697159 - DNA, 22 bp, Homo sapiens
tgtgtacttgaaagggcaggtc

SEQ ID NO: 7697160 - DNA, 22 bp, Homo sapiens
tgtgtacttttgtttctaagcc

SEQ ID NO: 7697161 - DNA, 20 bp, Homo sapiens
tgtgtagcaggtgctgtgcc

SEQ ID NO: 7697162 - DNA, 22 bp, Homo sapiens
tgtgtagaggtaagtaacactt

SEQ ID NO: 7697163 - DNA, 20 bp, Homo sapiens
tgtgtagcaggtgctgtgcc

SEQ ID NO: 7697164 - DNA, 22 bp, Homo sapiens
tgtgtagctcatattagtgtta

SEQ ID NO: 7697165 - DNA, 22 bp, Homo sapiens
tgtgtagctttcttctgtgggg

SEQ ID NO: 7697166 - DNA, 22 bp, Homo sapiens
tgtgtcaacaacagccttggat

SEQ ID NO: 7697167 - DNA, 22 bp, Homo sapiens
tgtgtcaaagtgtggagtattt

SEQ ID NO: 7697168 - DNA, 22 bp, Homo sapiens
tgtgtcaaattgttttacacag

SEQ ID NO: 7697169 - DNA, 22 bp, Homo sapiens
tgtgtcaacctgtggccgggtg

SEQ ID NO: 7697170 - DNA, 22 bp, Homo sapiens
tgtgtcaagacatttagtcatt

SEQ ID NO: 7697171 - DNA, 21 bp, Homo sapiens
tgtgtcactaactagaggcta

SEQ ID NO: 7697172 - DNA, 22 bp, Homo sapiens
tgtgtcaattttcattcctact

SEQ ID NO: 7697173 - DNA, 22 bp, Homo sapiens
tgtgtcaatttatgtcattcat

SEQ ID NO: 7697174 - DNA, 22 bp, Homo sapiens
tgtgtcaattttcattcctact

SEQ ID NO: 7697175 - DNA, 22 bp, Homo sapiens
tgtgtcaagacatttagtcatt

SEQ ID NO: 7697176 - DNA, 22 bp, Homo sapiens
tgtgtcaagacatttagtcatt

SEQ ID NO: 7697177 - DNA, 22 bp, Homo sapiens
tgtgtcaaggcatcagcccagc

SEQ ID NO: 7697178 - DNA, 22 bp, Homo sapiens
tgtgtcaagtggaatttcaggg

SEQ ID NO: 7697179 - DNA, 22 bp, Homo sapiens
tgtgtcaagtggaatttcaggg

SEQ ID NO: 7697180 - DNA, 22 bp, Homo sapiens
tgtgtcaagtggaatttcaggg

SEQ ID NO: 7697181 - DNA, 22 bp, Homo sapiens
tgtgtcaatttatgtcattcat

SEQ ID NO: 7697182 - DNA, 22 bp, Homo sapiens
tgtgtcagaaatcagtgcctcg

SEQ ID NO: 7697183 - DNA, 22 bp, Homo sapiens
tgtgtcactgttcctccagcta

SEQ ID NO: 7697184 - DNA, 22 bp, Homo sapiens
tgtgtcagaaggcaatggggat

SEQ ID NO: 7697185 - DNA, 22 bp, Homo sapiens
tgtgtcagaagtacttttggaa

SEQ ID NO: 7697186 - DNA, 22 bp, Homo sapiens
tgtgtgggagcacgggctgttg

SEQ ID NO: 7697187 - DNA, 22 bp, Homo sapiens
tgtgtgggagcacgggctgttg

SEQ ID NO: 7697188 - DNA, 22 bp, Homo sapiens
tgtgtgggagcacgggctgttg

SEQ ID NO: 7697189 - DNA, 22 bp, Homo sapiens
tgtgtggcgttgcgtggctagg

SEQ ID NO: 7697190 - DNA, 22 bp, Homo sapiens
tgtgtggcgttgcgtggctagg

SEQ ID NO: 7697191 - DNA, 22 bp, Homo sapiens
tgtgtggcaagctgtatgctag

SEQ ID NO: 7697192 - DNA, 22 bp, Homo sapiens
tgtgtggattcatctcaaagag

SEQ ID NO: 7697193 - DNA, 22 bp, Homo sapiens
tgtgtggcaagctgtatgctag

SEQ ID NO: 7697194 - DNA, 21 bp, Homo sapiens
tgtgtgggcatatctgctgca

SEQ ID NO: 7697195 - DNA, 21 bp, Homo sapiens
tgtgtgggcatatctgctgca

SEQ ID NO: 7697196 - DNA, 21 bp, Homo sapiens
tgtgtgggcatatctgctgca

SEQ ID NO: 7697197 - DNA, 22 bp, Homo sapiens
tgtgtgggagcacgggctgttg

SEQ ID NO: 7697198 - DNA, 21 bp, Homo sapiens
tgtgtgggcatatctgctgca

SEQ ID NO: 7697199 - DNA, 22 bp, Homo sapiens
tgtgtgggagcacgggctgttg

SEQ ID NO: 7697200 - DNA, 22 bp, Homo sapiens
tgtgtgggagcacgggctgttg

SEQ ID NO: 7697201 - DNA, 22 bp, Homo sapiens
tgtgtgggagcacgggctgttg

SEQ ID NO: 7697202 - DNA, 22 bp, Homo sapiens
tgtgtggatgcagcgtgggtct

SEQ ID NO: 7697203 - DNA, 22 bp, Homo sapiens
tgtgtggatgcagcgtgggtct

SEQ ID NO: 7697204 - DNA, 22 bp, Homo sapiens
tgtgtgcttatagtctagtagt

SEQ ID NO: 7697205 - DNA, 22 bp, Homo sapiens
tgtgtggattcatctcaaagag

SEQ ID NO: 7697206 - DNA, 22 bp, Homo sapiens
tgtgtggattcatctcaaagag

SEQ ID NO: 7697207 - DNA, 22 bp, Homo sapiens
tgtgtggattcatctcaaagag

SEQ ID NO: 7697208 - DNA, 22 bp, Homo sapiens
tgtgtggattcatctcaaagag

SEQ ID NO: 7697209 - DNA, 22 bp, Homo sapiens
tgtgtgctctaatgcctagtac

SEQ ID NO: 7697210 - DNA, 22 bp, Homo sapiens
tgtgtgctctaatgcctagtac

SEQ ID NO: 7697211 - DNA, 22 bp, Homo sapiens
tgtgtgctcgatggccctgcag

SEQ ID NO: 7697212 - DNA, 20 bp, Homo sapiens
tgtgtgctaggactacagtg

SEQ ID NO: 7697213 - DNA, 22 bp, Homo sapiens
tgtgtgctcgatggccctgcag

SEQ ID NO: 7697214 - DNA, 19 bp, Homo sapiens
tgtgtgctgactgccagag

SEQ ID NO: 7697215 - DNA, 19 bp, Homo sapiens
tgtgtgctgactgccagag

SEQ ID NO: 7697216 - DNA, 19 bp, Homo sapiens
tgtgtgctgactgccagag

SEQ ID NO: 7697217 - DNA, 22 bp, Homo sapiens
tgtgtgcttaagggctgaacct

SEQ ID NO: 7697218 - DNA, 19 bp, Homo sapiens
tgtgtgctgactgccagag

SEQ ID NO: 7697219 - DNA, 19 bp, Homo sapiens
tgtgtgctgactgccagag

SEQ ID NO: 7697220 - DNA, 22 bp, Homo sapiens
tgtgtgtgacaacctagttcag

SEQ ID NO: 7697221 - DNA, 22 bp, Homo sapiens
tgtgtgtgaaccattgagggct

SEQ ID NO: 7697222 - DNA, 22 bp, Homo sapiens
tgtgtgtgaaccattgagggct

SEQ ID NO: 7697223 - DNA, 22 bp, Homo sapiens
tgtgtgtgactcatactagaac

SEQ ID NO: 7697224 - DNA, 22 bp, Homo sapiens
tgtgtgtgactcatactagaac

SEQ ID NO: 7697225 - DNA, 22 bp, Homo sapiens
tgtgtgtgacaacctagttcag

SEQ ID NO: 7697226 - DNA, 22 bp, Homo sapiens
tgtgtgtgacaacctagttcag

SEQ ID NO: 7697227 - DNA, 22 bp, Homo sapiens
tgtgtgtctttgcctcctctca

SEQ ID NO: 7697228 - DNA, 22 bp, Homo sapiens
tgtgtgtgaaccattgagggct

SEQ ID NO: 7697229 - DNA, 22 bp, Homo sapiens
tgtgtgtgaaccattgagggct

SEQ ID NO: 7697230 - DNA, 21 bp, Homo sapiens
tgtgtgggcatatctgctgca

SEQ ID NO: 7697231 - DNA, 22 bp, Homo sapiens
tgtgtgtctttgcctcctctca

SEQ ID NO: 7697232 - DNA, 22 bp, Homo sapiens
tgtgtgtgaaccattgagggct

SEQ ID NO: 7697233 - DNA, 22 bp, Homo sapiens
tgtgtgtgaaccattgagggct

SEQ ID NO: 7697234 - DNA, 22 bp, Homo sapiens
tgtgtgtgaaccattgagggct

SEQ ID NO: 7697235 - DNA, 22 bp, Homo sapiens
tgtgtgtgactcatactagaac

SEQ ID NO: 7697236 - DNA, 22 bp, Homo sapiens
tgtgtgtgagtcctggctttcc

SEQ ID NO: 7697237 - DNA, 22 bp, Homo sapiens
tgtgtgtgagtcctggctttcc

SEQ ID NO: 7697238 - DNA, 22 bp, Homo sapiens
tgtgtgtgagtcctggctttcc

SEQ ID NO: 7697239 - DNA, 22 bp, Homo sapiens
tgtgtgtgagtcctggctttcc

SEQ ID NO: 7697240 - DNA, 22 bp, Homo sapiens
tgtgtgtgcacatgcatataca

SEQ ID NO: 7697241 - DNA, 22 bp, Homo sapiens
tgtgtgtgcacatgcatataca

SEQ ID NO: 7697242 - DNA, 22 bp, Homo sapiens
tgtgtgtgcacatgcatataca

SEQ ID NO: 7697243 - DNA, 22 bp, Homo sapiens
tgtgtgtgcacatgcatataca

SEQ ID NO: 7697244 - DNA, 22 bp, Homo sapiens
tgtgtgtgcacatgcatataca

SEQ ID NO: 7697245 - DNA, 22 bp, Homo sapiens
tgtgtgtgagtcctggctttcc

SEQ ID NO: 7697246 - DNA, 22 bp, Homo sapiens
tgtgtgtgagtcctggctttcc

SEQ ID NO: 7697247 - DNA, 22 bp, Homo sapiens
tgtgggaggaacacagccagaa

SEQ ID NO: 7697248 - DNA, 22 bp, Homo sapiens
tgtgggaggaacacagccagaa

SEQ ID NO: 7697249 - DNA, 22 bp, Homo sapiens
tgtgggaggaacacagccagaa

SEQ ID NO: 7697250 - DNA, 22 bp, Homo sapiens
tgtgggaggaacacagccagaa

SEQ ID NO: 7697251 - DNA, 22 bp, Homo sapiens
tgtgggaggaacacagccagaa

SEQ ID NO: 7697252 - DNA, 22 bp, Homo sapiens
tgtgggaggaattagaatggga

SEQ ID NO: 7697253 - DNA, 22 bp, Homo sapiens
tgtgggaggaattagaatggga

SEQ ID NO: 7697254 - DNA, 22 bp, Homo sapiens
tgtgggaggaattagaatggga

SEQ ID NO: 7697255 - DNA, 22 bp, Homo sapiens
tgtgggagaaggaagcaagctg

SEQ ID NO: 7697256 - DNA, 22 bp, Homo sapiens
tgtgggaggaacacagccagaa

SEQ ID NO: 7697257 - DNA, 22 bp, Homo sapiens
tgtgggaggaacacagccagaa

SEQ ID NO: 7697258 - DNA, 22 bp, Homo sapiens
tgtgggaggaacacagccagaa

SEQ ID NO: 7697259 - DNA, 22 bp, Homo sapiens
tgtgggagaaggaagcaagctg

SEQ ID NO: 7697260 - DNA, 22 bp, Homo sapiens
tgtgggagaaggaagcaagctg

SEQ ID NO: 7697261 - DNA, 22 bp, Homo sapiens
tgtgggagaaggaagcaagctg

SEQ ID NO: 7697262 - DNA, 22 bp, Homo sapiens
tgtgggagaaggaagcaagctg

SEQ ID NO: 7697263 - DNA, 23 bp, Homo sapiens
tgtgggaatgttggagaggaaac

SEQ ID NO: 7697264 - DNA, 23 bp, Homo sapiens
tgtgggaatgttggagaggaaac

SEQ ID NO: 7697265 - DNA, 22 bp, Homo sapiens
tgtgggagaaggaagcaagctg

SEQ ID NO: 7697266 - DNA, 22 bp, Homo sapiens
tgtgggagaaggaagcaagctg

SEQ ID NO: 7697267 - DNA, 22 bp, Homo sapiens
tgtgggacctcagagggtcccc

SEQ ID NO: 7697268 - DNA, 22 bp, Homo sapiens
tgtgggagaaggaagcaagctg

SEQ ID NO: 7697269 - DNA, 22 bp, Homo sapiens
tgtgggagaaggaagcaagctg

SEQ ID NO: 7697270 - DNA, 22 bp, Homo sapiens
tgtgggaatgctgatgggatct

SEQ ID NO: 7697271 - DNA, 22 bp, Homo sapiens
tgtgggaatgacgaggaagagg

SEQ ID NO: 7697272 - DNA, 23 bp, Homo sapiens
tgtgggaatgttggagaggaaac

SEQ ID NO: 7697273 - DNA, 23 bp, Homo sapiens
tgtgggaatgttggagaggaaac

SEQ ID NO: 7697274 - DNA, 23 bp, Homo sapiens
tgtgggaatgttggagaggaaac

SEQ ID NO: 7697275 - DNA, 22 bp, Homo sapiens
tgtgggaatgacgaggaagagg

SEQ ID NO: 7697276 - DNA, 22 bp, Homo sapiens
tgtgggaatgacgaggaagagg

SEQ ID NO: 7697277 - DNA, 22 bp, Homo sapiens
tgtgggaatgacgaggaagagg

SEQ ID NO: 7697278 - DNA, 22 bp, Homo sapiens
tgtgggaatcagccaggggggc

SEQ ID NO: 7697279 - DNA, 22 bp, Homo sapiens
tgtgggaatcagccaggggggc

SEQ ID NO: 7697280 - DNA, 21 bp, Homo sapiens
tgtggctgcctctggccctgg

SEQ ID NO: 7697281 - DNA, 21 bp, Homo sapiens
tgtggctgcctctggccctgg

SEQ ID NO: 7697282 - DNA, 22 bp, Homo sapiens
tgtggctgccaccctgaagccg

SEQ ID NO: 7697283 - DNA, 22 bp, Homo sapiens
tgtgggaaatgggagtggaaga

SEQ ID NO: 7697284 - DNA, 22 bp, Homo sapiens
tgtggctgccaccctgaagccg

SEQ ID NO: 7697285 - DNA, 22 bp, Homo sapiens
tgtgggaaatgggagtggaaga

SEQ ID NO: 7697286 - DNA, 22 bp, Homo sapiens
tgtgggaagagcagtggcagca

SEQ ID NO: 7697287 - DNA, 22 bp, Homo sapiens
tgtgggaagagcagtggcagca

SEQ ID NO: 7697288 - DNA, 22 bp, Homo sapiens
tgtgggaagagcagtggcagca

SEQ ID NO: 7697289 - DNA, 22 bp, Homo sapiens
tgtgggaatcagccaggggggc

SEQ ID NO: 7697290 - DNA, 22 bp, Homo sapiens
tgtgggaatcagccaggggggc

SEQ ID NO: 7697291 - DNA, 22 bp, Homo sapiens
tgtgggaagtttggagggaaag

SEQ ID NO: 7697292 - DNA, 22 bp, Homo sapiens
tgtgggaagtttggagggaaag

SEQ ID NO: 7697293 - DNA, 22 bp, Homo sapiens
tgtgggaagtttggagggaaag

SEQ ID NO: 7697294 - DNA, 22 bp, Homo sapiens
tgtgggaagatgttgcaggaga

SEQ ID NO: 7697295 - DNA, 22 bp, Homo sapiens
tgtgggaagatgttgcaggaga

SEQ ID NO: 7697296 - DNA, 22 bp, Homo sapiens
tgtgggaagatgttgcaggaga

SEQ ID NO: 7697297 - DNA, 22 bp, Homo sapiens
tgtgggaagatgttgcaggaga

SEQ ID NO: 7697298 - DNA, 22 bp, Homo sapiens
tgtgggaagatgttgcaggaga

SEQ ID NO: 7697299 - DNA, 22 bp, Homo sapiens
tgtggctgcaaaggaaggctgc

SEQ ID NO: 7697300 - DNA, 22 bp, Homo sapiens
tgtggctgcagacactggagcc

SEQ ID NO: 7697301 - DNA, 22 bp, Homo sapiens
tgtggctgcaaaggaaggctgc

SEQ ID NO: 7697302 - DNA, 22 bp, Homo sapiens
tgtggctgccaccctgaagccg

SEQ ID NO: 7697303 - DNA, 22 bp, Homo sapiens
tgtggctgccaccctgaagccg

SEQ ID NO: 7697304 - DNA, 22 bp, Homo sapiens
tgtggctgccaccctgaagccg

SEQ ID NO: 7697305 - DNA, 22 bp, Homo sapiens
tgtggctgcaggcgatggagga

SEQ ID NO: 7697306 - DNA, 22 bp, Homo sapiens
tgtggctgcaggcgatggagga

SEQ ID NO: 7697307 - DNA, 22 bp, Homo sapiens
tgtggctgcaggcgatggagga

SEQ ID NO: 7697308 - DNA, 22 bp, Homo sapiens
tgtggctgcaggcgatggagga

SEQ ID NO: 7697309 - DNA, 22 bp, Homo sapiens
tgtggctgcagacactggagcc

SEQ ID NO: 7697310 - DNA, 22 bp, Homo sapiens
tgtggaagggacactggactgg

SEQ ID NO: 7697311 - DNA, 22 bp, Homo sapiens
tgtggaagggacactggactgg

SEQ ID NO: 7697312 - DNA, 22 bp, Homo sapiens
tgtggaagggacactggactgg

SEQ ID NO: 7697313 - DNA, 22 bp, Homo sapiens
tgtggaagccggtgggaagcag

SEQ ID NO: 7697314 - DNA, 22 bp, Homo sapiens
tgtggaagaacttcttgcttgg

SEQ ID NO: 7697315 - DNA, 22 bp, Homo sapiens
tgtggaagcctgggccccaggg

SEQ ID NO: 7697316 - DNA, 22 bp, Homo sapiens
tgtggaagtgccaatgacaaat

SEQ ID NO: 7697317 - DNA, 22 bp, Homo sapiens
tgtggaagtgccaatgacaaat

SEQ ID NO: 7697318 - DNA, 22 bp, Homo sapiens
tgtggaagaacttcttgcttgg

SEQ ID NO: 7697319 - DNA, 22 bp, Homo sapiens
tgtggaagaacttcttgcttgg

SEQ ID NO: 7697320 - DNA, 22 bp, Homo sapiens
tgtggaagaacactggccaggc

SEQ ID NO: 7697321 - DNA, 22 bp, Homo sapiens
tgtggaagaacactggccaggc

SEQ ID NO: 7697322 - DNA, 22 bp, Homo sapiens
tgtggaagaaacaagacacttt

SEQ ID NO: 7697323 - DNA, 22 bp, Homo sapiens
tgtggaagaaacaagacacttt

SEQ ID NO: 7697324 - DNA, 22 bp, Homo sapiens
tgtggaagaaacaagacacttt

SEQ ID NO: 7697325 - DNA, 22 bp, Homo sapiens
tgtggaactagtattgtcttaa

SEQ ID NO: 7697326 - DNA, 23 bp, Homo sapiens
tgtggaacgccataggagcacga

SEQ ID NO: 7697327 - DNA, 22 bp, Homo sapiens
tgtggaacacctagaatgggta

SEQ ID NO: 7697328 - DNA, 22 bp, Homo sapiens
tgtggaacaaaatgttgggaga

SEQ ID NO: 7697329 - DNA, 22 bp, Homo sapiens
tgtggaacacctagaatgggta

SEQ ID NO: 7697330 - DNA, 22 bp, Homo sapiens
tgtggcgagaacattggaccat

SEQ ID NO: 7697331 - DNA, 22 bp, Homo sapiens
tgtggctcaggcggcttctcct

SEQ ID NO: 7697332 - DNA, 22 bp, Homo sapiens
tgtggccttgcagcctggaggt

SEQ ID NO: 7697333 - DNA, 22 bp, Homo sapiens
tgtggccttgcagcctggaggt

SEQ ID NO: 7697334 - DNA, 22 bp, Homo sapiens
tgtggcctttcaaggatggaat

SEQ ID NO: 7697335 - DNA, 17 bp, Homo sapiens
tgtggccttctgagctt

SEQ ID NO: 7697336 - DNA, 22 bp, Homo sapiens
tgtggccttgcagcctggaggt

SEQ ID NO: 7697337 - DNA, 22 bp, Homo sapiens
tgtggacaccactgggactgga

SEQ ID NO: 7697338 - DNA, 22 bp, Homo sapiens
tgtggacaagatgccaattgat

SEQ ID NO: 7697339 - DNA, 22 bp, Homo sapiens
tgtggaatgtcctcagcatcct

SEQ ID NO: 7697340 - DNA, 22 bp, Homo sapiens
tgtggaatgctcctaagtgaat

SEQ ID NO: 7697341 - DNA, 22 bp, Homo sapiens
tgtggaatgggagtgagaagac

SEQ ID NO: 7697342 - DNA, 22 bp, Homo sapiens
tgtggaatgggagtgagaagac

SEQ ID NO: 7697343 - DNA, 22 bp, Homo sapiens
tgtggaatgctcctaagtgaat

SEQ ID NO: 7697344 - DNA, 22 bp, Homo sapiens
tgtggctccactccacattaat

SEQ ID NO: 7697345 - DNA, 22 bp, Homo sapiens
tgtggctccactccacattaat

SEQ ID NO: 7697346 - DNA, 22 bp, Homo sapiens
tgtggctcggccagctgctgaa

SEQ ID NO: 7697347 - DNA, 22 bp, Homo sapiens
tgtggctcggccagctgctgaa

SEQ ID NO: 7697348 - DNA, 22 bp, Homo sapiens
tgtggctcggccagctgctgaa

SEQ ID NO: 7697349 - DNA, 22 bp, Homo sapiens
tgtggctctcatgcactcccag

SEQ ID NO: 7697350 - DNA, 22 bp, Homo sapiens
tgtggctctcatgcactcccag

SEQ ID NO: 7697351 - DNA, 22 bp, Homo sapiens
tgtggctctcatgcactcccag

SEQ ID NO: 7697352 - DNA, 22 bp, Homo sapiens
tgtggctcggccagctgctgaa

SEQ ID NO: 7697353 - DNA, 22 bp, Homo sapiens
tgtggctctcagatcctccaat

SEQ ID NO: 7697354 - DNA, 22 bp, Homo sapiens
tgtggctctcagatcctccaat

SEQ ID NO: 7697355 - DNA, 22 bp, Homo sapiens
tgtggctctcagatcctccaat

SEQ ID NO: 7697356 - DNA, 22 bp, Homo sapiens
tgtggctctcctcctgctgccc

SEQ ID NO: 7697357 - DNA, 22 bp, Homo sapiens
tgtggctctcctcctgctgccc

SEQ ID NO: 7697358 - DNA, 22 bp, Homo sapiens
tgtggctctcctcctgctgccc

SEQ ID NO: 7697359 - DNA, 22 bp, Homo sapiens
tgtggctctgccccctggtaag

SEQ ID NO: 7697360 - DNA, 22 bp, Homo sapiens
tgtggctctgcctggcagtatt

SEQ ID NO: 7697361 - DNA, 22 bp, Homo sapiens
tgtggctctgcctggcagtatt

SEQ ID NO: 7697362 - DNA, 21 bp, Homo sapiens
tgtggctgacaccctttggga

SEQ ID NO: 7697363 - DNA, 22 bp, Homo sapiens
tgtggctgactcctggtcccca

SEQ ID NO: 7697364 - DNA, 23 bp, Homo sapiens
tgtggctgagaaattgacaactt

SEQ ID NO: 7697365 - DNA, 21 bp, Homo sapiens
tgtggctgacaccctttggga

SEQ ID NO: 7697366 - DNA, 22 bp, Homo sapiens
tgtggctgactcctggtcccca

SEQ ID NO: 7697367 - DNA, 22 bp, Homo sapiens
tgtggctgcaaaggaaggctgc

SEQ ID NO: 7697368 - DNA, 22 bp, Homo sapiens
tgtggctgcaaaggaaggctgc

SEQ ID NO: 7697369 - DNA, 22 bp, Homo sapiens
tgtggctgatcaaagcgctcag

SEQ ID NO: 7697370 - DNA, 22 bp, Homo sapiens
tgtggctgatcaaagcgctcag

SEQ ID NO: 7697371 - DNA, 22 bp, Homo sapiens
tgtggctgatcaaagcgctcag

SEQ ID NO: 7697372 - DNA, 19 bp, Homo sapiens
tgtggctgagcactcctta

SEQ ID NO: 7697373 - DNA, 19 bp, Homo sapiens
tgtggctgagcactcctta

SEQ ID NO: 7697374 - DNA, 19 bp, Homo sapiens
tgtggctgagcactcctta

SEQ ID NO: 7697375 - DNA, 19 bp, Homo sapiens
tgtggctgagcactcctta

SEQ ID NO: 7697376 - DNA, 20 bp, Homo sapiens
tgtgggcccttggctggcaa

SEQ ID NO: 7697377 - DNA, 20 bp, Homo sapiens
tgtgggcccttggctggcaa

SEQ ID NO: 7697378 - DNA, 20 bp, Homo sapiens
tgtgggcccttggctggcaa

SEQ ID NO: 7697379 - DNA, 22 bp, Homo sapiens
tgtgggcctcagcaggactcca

SEQ ID NO: 7697380 - DNA, 22 bp, Homo sapiens
tgtgggcctgggaaggtgacac

SEQ ID NO: 7697381 - DNA, 22 bp, Homo sapiens
tgtgggcctgggaaggtgacac

SEQ ID NO: 7697382 - DNA, 22 bp, Homo sapiens
tgtgggcctcagcaggactcca

SEQ ID NO: 7697383 - DNA, 22 bp, Homo sapiens
tgtgggccctaggcaccttgtc

SEQ ID NO: 7697384 - DNA, 22 bp, Homo sapiens
tgtgggccctaggcaccttgtc

SEQ ID NO: 7697385 - DNA, 22 bp, Homo sapiens
tgtgggcccagattctgaggct

SEQ ID NO: 7697386 - DNA, 22 bp, Homo sapiens
tgtgggcccagattctgaggct

SEQ ID NO: 7697387 - DNA, 22 bp, Homo sapiens
tgtgggcaggcccgggtctgag

SEQ ID NO: 7697388 - DNA, 22 bp, Homo sapiens
tgtgggcaggcccgggtctgag

SEQ ID NO: 7697389 - DNA, 22 bp, Homo sapiens
tgtgggccaggaggcctcagtg

SEQ ID NO: 7697390 - DNA, 22 bp, Homo sapiens
tgtgggccaggaggcctcagtg

SEQ ID NO: 7697391 - DNA, 22 bp, Homo sapiens
tgtgggccaggaggcctcagtg

SEQ ID NO: 7697392 - DNA, 22 bp, Homo sapiens
tgtgggcaggagcacaagtcag

SEQ ID NO: 7697393 - DNA, 22 bp, Homo sapiens
tgtgggcaggcccgggtctgag

SEQ ID NO: 7697394 - DNA, 22 bp, Homo sapiens
tgtgggcaggcccgggtctgag

SEQ ID NO: 7697395 - DNA, 23 bp, Homo sapiens
tgtgggcgcattgtaagggtagc

SEQ ID NO: 7697396 - DNA, 23 bp, Homo sapiens
tgtgggcgcattgtaagggtagc

SEQ ID NO: 7697397 - DNA, 23 bp, Homo sapiens
tgtgggcgcattgtaagggtagc

SEQ ID NO: 7697398 - DNA, 20 bp, Homo sapiens
tgtgggccttcggcgtgctc

SEQ ID NO: 7697399 - DNA, 20 bp, Homo sapiens
tgtgggccttcggcgtgctc

SEQ ID NO: 7697400 - DNA, 20 bp, Homo sapiens
tgtgggcctgtgaagcggcg

SEQ ID NO: 7697401 - DNA, 20 bp, Homo sapiens
tgtgggcctgtgaagcggcg

SEQ ID NO: 7697402 - DNA, 22 bp, Homo sapiens
tgtgggcctgggaaggtgacac

SEQ ID NO: 7697403 - DNA, 22 bp, Homo sapiens
tgtgggctgtactgagggcagg

SEQ ID NO: 7697404 - DNA, 22 bp, Homo sapiens
tgtgggctgtactgagggcagg

SEQ ID NO: 7697405 - DNA, 22 bp, Homo sapiens
tgtgggctctaatggcagcaga

SEQ ID NO: 7697406 - DNA, 22 bp, Homo sapiens
tgtgggctctaatggcagcaga

SEQ ID NO: 7697407 - DNA, 19 bp, Homo sapiens
tgtgggcaagggatggcag

SEQ ID NO: 7697408 - DNA, 19 bp, Homo sapiens
tgtgggcaagggatggcag

SEQ ID NO: 7697409 - DNA, 19 bp, Homo sapiens
tgtgggcaagggatggcag

SEQ ID NO: 7697410 - DNA, 22 bp, Homo sapiens
tgtgggattcatttggatcagc

SEQ ID NO: 7697411 - DNA, 19 bp, Homo sapiens
tgtgggcaagggatggcag

SEQ ID NO: 7697412 - DNA, 22 bp, Homo sapiens
tgtgggattcatttggatcagc

SEQ ID NO: 7697413 - DNA, 22 bp, Homo sapiens
tgtgggatggttttgccagaat

SEQ ID NO: 7697414 - DNA, 22 bp, Homo sapiens
tgtgggaggtctggaaggctcc

SEQ ID NO: 7697415 - DNA, 22 bp, Homo sapiens
tgtgggcaaagggtagctgggt

SEQ ID NO: 7697416 - DNA, 22 bp, Homo sapiens
tgtgggcaaagggtagctgggt

SEQ ID NO: 7697417 - DNA, 22 bp, Homo sapiens
tgtgggcagatacacagacacg

SEQ ID NO: 7697418 - DNA, 22 bp, Homo sapiens
tgtgggcagctggagctgttca

SEQ ID NO: 7697419 - DNA, 22 bp, Homo sapiens
tgtgggcagctggagctgttca

SEQ ID NO: 7697420 - DNA, 22 bp, Homo sapiens
tgtgggcactaatgacatgcag

SEQ ID NO: 7697421 - DNA, 22 bp, Homo sapiens
tgtgggcagatacacagacacg

SEQ ID NO: 7697422 - DNA, 22 bp, Homo sapiens
tgtgggcactaatgacatgcag

SEQ ID NO: 7697423 - DNA, 19 bp, Homo sapiens
tgtgggcaagggatggcag

SEQ ID NO: 7697424 - DNA, 19 bp, Homo sapiens
tgtgggcaagggatggcag

SEQ ID NO: 7697425 - DNA, 22 bp, Homo sapiens
tgtgggcactaatgacatgcag

SEQ ID NO: 7697426 - DNA, 22 bp, Homo sapiens
tgtgggaggtctggaaggctcc

SEQ ID NO: 7697427 - DNA, 22 bp, Homo sapiens
tgtgggaggtctggaaggctcc

SEQ ID NO: 7697428 - DNA, 22 bp, Homo sapiens
tgtgggaggattcagaattggg

SEQ ID NO: 7697429 - DNA, 22 bp, Homo sapiens
tgtgggaggtctggaaggctcc

SEQ ID NO: 7697430 - DNA, 22 bp, Homo sapiens
tgtgggaggtctggaaggctcc

SEQ ID NO: 7697431 - DNA, 22 bp, Homo sapiens
tgtgggaggtctggaaggctcc

SEQ ID NO: 7697432 - DNA, 22 bp, Homo sapiens
tgtgggaggtctggaaggctcc

SEQ ID NO: 7697433 - DNA, 22 bp, Homo sapiens
tgtgggaggattcagaattggg

SEQ ID NO: 7697434 - DNA, 22 bp, Homo sapiens
tgtgggaggattcagaattggg

SEQ ID NO: 7697435 - DNA, 22 bp, Homo sapiens
tgtgggaggattcagaattggg

SEQ ID NO: 7697436 - DNA, 22 bp, Homo sapiens
tgtgggaggattcagaattggg

SEQ ID NO: 7697437 - DNA, 22 bp, Homo sapiens
tgtgggaggaattagaatggga

SEQ ID NO: 7697438 - DNA, 22 bp, Homo sapiens
tgtgggaggaattagaatggga

SEQ ID NO: 7697439 - DNA, 22 bp, Homo sapiens
tgtgggaggaattagaatggga

SEQ ID NO: 7697440 - DNA, 22 bp, Homo sapiens
tgtgggaggaattagaatggga

SEQ ID NO: 7697441 - DNA, 22 bp, Homo sapiens
tgtgtactcaattgagccattt

SEQ ID NO: 7697442 - DNA, 22 bp, Homo sapiens
tgtgtactcaattgagccattt

SEQ ID NO: 7697443 - DNA, 22 bp, Homo sapiens
tgtgtacatgtatcaactatcg

SEQ ID NO: 7697444 - DNA, 22 bp, Homo sapiens
tgtgtacatgtatcaactatcg

SEQ ID NO: 7697445 - DNA, 22 bp, Homo sapiens
tgtgtacattgccttttaaagg

SEQ ID NO: 7697446 - DNA, 22 bp, Homo sapiens
tgtgtacattgccttttaaagg

SEQ ID NO: 7697447 - DNA, 22 bp, Homo sapiens
tgtgtacatctcttctcacatt

SEQ ID NO: 7697448 - DNA, 22 bp, Homo sapiens
tgtgtacatctcttctcacatt

SEQ ID NO: 7697449 - DNA, 22 bp, Homo sapiens
tgtgtacatatctatcctagat

SEQ ID NO: 7697450 - DNA, 22 bp, Homo sapiens
tgtgtacatatctatcctagat

SEQ ID NO: 7697451 - DNA, 22 bp, Homo sapiens
tgtgtacatatctatcctagat

SEQ ID NO: 7697452 - DNA, 22 bp, Homo sapiens
tgtgtacatatacacaaataca

SEQ ID NO: 7697453 - DNA, 22 bp, Homo sapiens
tgtgtacatatacacaaataca

SEQ ID NO: 7697454 - DNA, 22 bp, Homo sapiens
tgtgtacatatacacaaataca

SEQ ID NO: 7697455 - DNA, 23 bp, Homo sapiens
tgtgtacatacatatgtacacac

SEQ ID NO: 7697456 - DNA, 23 bp, Homo sapiens
tgtgtacatacatatgtacacac

SEQ ID NO: 7697457 - DNA, 23 bp, Homo sapiens
tgtgtacatacatatgtacacac

SEQ ID NO: 7697458 - DNA, 23 bp, Homo sapiens
tgtgtacatacatatgtacacac

SEQ ID NO: 7697459 - DNA, 22 bp, Homo sapiens
tgtgtacaggccttgctagact

SEQ ID NO: 7697460 - DNA, 22 bp, Homo sapiens
tgtgtacaggacagaaaggagg

SEQ ID NO: 7697461 - DNA, 22 bp, Homo sapiens
tgtgtacaggccttgctagact

SEQ ID NO: 7697462 - DNA, 22 bp, Homo sapiens
tgtgtacaggacagaaaggagg

SEQ ID NO: 7697463 - DNA, 22 bp, Homo sapiens
tgtgtacaggaactgatcagat

SEQ ID NO: 7697464 - DNA, 22 bp, Homo sapiens
tgtgtacagcatggtccagcag

SEQ ID NO: 7697465 - DNA, 22 bp, Homo sapiens
tgtgtacaggaactgatcagat

SEQ ID NO: 7697466 - DNA, 22 bp, Homo sapiens
tgtgtacacgagaggttatata

SEQ ID NO: 7697467 - DNA, 22 bp, Homo sapiens
tgtgtacagcaggatttctcaa

SEQ ID NO: 7697468 - DNA, 22 bp, Homo sapiens
tgtgtacagcaggatttctcaa

SEQ ID NO: 7697469 - DNA, 22 bp, Homo sapiens
tgtgtacagcaggatttctcaa

SEQ ID NO: 7697470 - DNA, 22 bp, Homo sapiens
tgtgtacagcatggtccagcag

SEQ ID NO: 7697471 - DNA, 22 bp, Homo sapiens
tgtgtacacagatagtaatggc

SEQ ID NO: 7697472 - DNA, 22 bp, Homo sapiens
tgtgtacacatgacaggcaccc

SEQ ID NO: 7697473 - DNA, 22 bp, Homo sapiens
tgtgtacacaatgattgcagag

SEQ ID NO: 7697474 - DNA, 22 bp, Homo sapiens
tgtgtacacacagatatataca

SEQ ID NO: 7697475 - DNA, 22 bp, Homo sapiens
tgtgtacacacagatatataca

SEQ ID NO: 7697476 - DNA, 22 bp, Homo sapiens
tgtgtacacacagatatataca

SEQ ID NO: 7697477 - DNA, 22 bp, Homo sapiens
tgtggggacctggctgccaccc

SEQ ID NO: 7697478 - DNA, 22 bp, Homo sapiens
tgtggggacccatgccatgggc

SEQ ID NO: 7697479 - DNA, 22 bp, Homo sapiens
tgtggggacccatgccatgggc

SEQ ID NO: 7697480 - DNA, 22 bp, Homo sapiens
tgtggggactgagtggaggctt

SEQ ID NO: 7697481 - DNA, 22 bp, Homo sapiens
tgtggggacctggctgccaccc

SEQ ID NO: 7697482 - DNA, 22 bp, Homo sapiens
tgtggggacctggctgccaccc

SEQ ID NO: 7697483 - DNA, 22 bp, Homo sapiens
tgtggggactgagtggaggctt

SEQ ID NO: 7697484 - DNA, 22 bp, Homo sapiens
tgtggggactgagtggaggctt

SEQ ID NO: 7697485 - DNA, 22 bp, Homo sapiens
tgtggggactgagtggaggctt

SEQ ID NO: 7697486 - DNA, 22 bp, Homo sapiens
tgtggggactgagtggaggctt

SEQ ID NO: 7697487 - DNA, 22 bp, Homo sapiens
tgtggggacccatgccatgggc

SEQ ID NO: 7697488 - DNA, 22 bp, Homo sapiens
tgtggggaagagtatgacttgg

SEQ ID NO: 7697489 - DNA, 22 bp, Homo sapiens
tgtggggacccatgccatgggc

SEQ ID NO: 7697490 - DNA, 22 bp, Homo sapiens
tgtggggacccatgccatgggc

SEQ ID NO: 7697491 - DNA, 20 bp, Homo sapiens
tgtgggctttgaaatgtgtg

SEQ ID NO: 7697492 - DNA, 22 bp, Homo sapiens
tgtggggaagagtatgacttgg

SEQ ID NO: 7697493 - DNA, 22 bp, Homo sapiens
tgtgtacacaagtatatataca

SEQ ID NO: 7697494 - DNA, 22 bp, Homo sapiens
tgtgtacacaagtatatataca

SEQ ID NO: 7697495 - DNA, 22 bp, Homo sapiens
tgtgtacacaagtatatataca

SEQ ID NO: 7697496 - DNA, 22 bp, Homo sapiens
tgtgtacaagagtgtttactgt

SEQ ID NO: 7697497 - DNA, 23 bp, Homo sapiens
tgtgtacacaatagatgaggttt

SEQ ID NO: 7697498 - DNA, 23 bp, Homo sapiens
tgtgtacacaatagatgaggttt

SEQ ID NO: 7697499 - DNA, 23 bp, Homo sapiens
tgtgtacacaatagatgaggttt

SEQ ID NO: 7697500 - DNA, 22 bp, Homo sapiens
tgtgtacacaatgattgcagag

SEQ ID NO: 7697501 - DNA, 22 bp, Homo sapiens
tgtgtacacaatgattgcagag

SEQ ID NO: 7697502 - DNA, 22 bp, Homo sapiens
tgtgtacacaatgattgcagag

SEQ ID NO: 7697503 - DNA, 22 bp, Homo sapiens
tgtggggactgagtggaggctt

SEQ ID NO: 7697504 - DNA, 22 bp, Homo sapiens
tgtggggactgagtggaggctt

SEQ ID NO: 7697505 - DNA, 22 bp, Homo sapiens
tgtggggactgagtggaggctt

SEQ ID NO: 7697506 - DNA, 22 bp, Homo sapiens
tgtggggactgagtggaggctt

SEQ ID NO: 7697507 - DNA, 22 bp, Homo sapiens
tgtgtacaaactaacaacatat

SEQ ID NO: 7697508 - DNA, 22 bp, Homo sapiens
tgtgtacaagcctgagtacaga

SEQ ID NO: 7697509 - DNA, 22 bp, Homo sapiens
tgtgtacaagagtgtttactgt

SEQ ID NO: 7697510 - DNA, 22 bp, Homo sapiens
tgtgtacaagcctgagtacaga

SEQ ID NO: 7697511 - DNA, 22 bp, Homo sapiens
tgtgtacaagcctgagtacaga

SEQ ID NO: 7697512 - DNA, 22 bp, Homo sapiens
ttagtgataggactttaaagcc

SEQ ID NO: 7697513 - DNA, 22 bp, Homo sapiens
ttagtgaaagtaatacaaagta

SEQ ID NO: 7697514 - DNA, 22 bp, Homo sapiens
ttagtgatcaaaatcaaaattg

SEQ ID NO: 7697515 - DNA, 22 bp, Homo sapiens
ttagtgatgactagacttttgt

SEQ ID NO: 7697516 - DNA, 22 bp, Homo sapiens
ttagtgcaaacctcagagacac

SEQ ID NO: 7697517 - DNA, 22 bp, Homo sapiens
ttagtgcagctgagccccatgg

SEQ ID NO: 7697518 - DNA, 22 bp, Homo sapiens
ttagtctccagcttagggtttg

SEQ ID NO: 7697519 - DNA, 22 bp, Homo sapiens
ttagtcacttcttccttcatca

SEQ ID NO: 7697520 - DNA, 22 bp, Homo sapiens
ttagtcttcttccttatatgtt

SEQ ID NO: 7697521 - DNA, 22 bp, Homo sapiens
ttagtctctttgcattgccata

SEQ ID NO: 7697522 - DNA, 22 bp, Homo sapiens
ttagtcttctcatagtaaaact

SEQ ID NO: 7697523 - DNA, 22 bp, Homo sapiens
ttagtcttctcatagtaaaact

SEQ ID NO: 7697524 - DNA, 22 bp, Homo sapiens
ttagtattaggatcatatttga

SEQ ID NO: 7697525 - DNA, 18 bp, Homo sapiens
ttagtataactgcctgtg

SEQ ID NO: 7697526 - DNA, 22 bp, Homo sapiens
ttagtagtgatgttatttcaag

SEQ ID NO: 7697527 - DNA, 22 bp, Homo sapiens
ttagtaggagagcttgttcatt

SEQ ID NO: 7697528 - DNA, 22 bp, Homo sapiens
ttagtagtaagagtcatatgta

SEQ ID NO: 7697529 - DNA, 22 bp, Homo sapiens
ttagtcaaatcattctgtttct

SEQ ID NO: 7697530 - DNA, 22 bp, Homo sapiens
ttagtatctagctggaaccagg

SEQ ID NO: 7697531 - DNA, 22 bp, Homo sapiens
ttagtattaggatcatatttga

SEQ ID NO: 7697532 - DNA, 22 bp, Homo sapiens
ttagtcaatagtgaatatagag

SEQ ID NO: 7697533 - DNA, 22 bp, Homo sapiens
ttagtcaatagtgaatatagag

SEQ ID NO: 7697534 - DNA, 22 bp, Homo sapiens
ttagtcaatagtgaatatagag

SEQ ID NO: 7697535 - DNA, 22 bp, Homo sapiens
ttagtcaatagtgaatatagag

SEQ ID NO: 7697536 - DNA, 22 bp, Homo sapiens
ttatctgtctatcaagactagc

SEQ ID NO: 7697537 - DNA, 20 bp, Homo sapiens
ttatctgtcaatctgtctca

SEQ ID NO: 7697538 - DNA, 22 bp, Homo sapiens
ttatctgtctatcaagactagc

SEQ ID NO: 7697539 - DNA, 22 bp, Homo sapiens
ttatctgtctatcaagactagc

SEQ ID NO: 7697540 - DNA, 22 bp, Homo sapiens
ttatctgtgacagccttgtatg

SEQ ID NO: 7697541 - DNA, 22 bp, Homo sapiens
ttatctgtgatcctaaatgtct

SEQ ID NO: 7697542 - DNA, 19 bp, Homo sapiens
ttatctgtgttgcagtggt

SEQ ID NO: 7697543 - DNA, 22 bp, Homo sapiens
ttatctgttgttttagtacaat

SEQ ID NO: 7697544 - DNA, 22 bp, Homo sapiens
ttatctgttgttttagtacaat

SEQ ID NO: 7697545 - DNA, 22 bp, Homo sapiens
ttatctgtgatcctaaatgtct

SEQ ID NO: 7697546 - DNA, 22 bp, Homo sapiens
ttatctgtgatcctaaatgtct

SEQ ID NO: 7697547 - DNA, 19 bp, Homo sapiens
ttatctgtgttgcagtggt

SEQ ID NO: 7697548 - DNA, 22 bp, Homo sapiens
ttatctgtttaacaaagtatct

SEQ ID NO: 7697549 - DNA, 22 bp, Homo sapiens
ttatcttagaggtgattgtatt

SEQ ID NO: 7697550 - DNA, 22 bp, Homo sapiens
ttatctgtttaacaaagtatct

SEQ ID NO: 7697551 - DNA, 22 bp, Homo sapiens
ttatctgttttctgtgcgtttc

SEQ ID NO: 7697552 - DNA, 22 bp, Homo sapiens
ttatatgtttctgtttggaggc

SEQ ID NO: 7697553 - DNA, 22 bp, Homo sapiens
ttatatgtttctgtttggaggc

SEQ ID NO: 7697554 - DNA, 22 bp, Homo sapiens
ttatatgtatgcttataaacca

SEQ ID NO: 7697555 - DNA, 22 bp, Homo sapiens
ttatatgtatgcttataaacca

SEQ ID NO: 7697556 - DNA, 22 bp, Homo sapiens
ttatatgtatgcttataaacca

SEQ ID NO: 7697557 - DNA, 22 bp, Homo sapiens
ttagtgctcacgtgttagaaag

SEQ ID NO: 7697558 - DNA, 22 bp, Homo sapiens
ttagtgctaaatactcccacag

SEQ ID NO: 7697559 - DNA, 22 bp, Homo sapiens
ttatatgtatgcttataaacca

SEQ ID NO: 7697560 - DNA, 22 bp, Homo sapiens
ttatatgtatgcttataaacca

SEQ ID NO: 7697561 - DNA, 22 bp, Homo sapiens
ttatatgtatgcttataaacca

SEQ ID NO: 7697562 - DNA, 22 bp, Homo sapiens
ttatatgtatgcttataaacca

SEQ ID NO: 7697563 - DNA, 22 bp, Homo sapiens
ttatattagttagacttgctgt

SEQ ID NO: 7697564 - DNA, 22 bp, Homo sapiens
ttatattagttagacttgctgt

SEQ ID NO: 7697565 - DNA, 22 bp, Homo sapiens
ttatattagttagacttgctgt

SEQ ID NO: 7697566 - DNA, 22 bp, Homo sapiens
ttatatgtttctgtttggaggc

SEQ ID NO: 7697567 - DNA, 22 bp, Homo sapiens
ttatatgtttctgtttggaggc

SEQ ID NO: 7697568 - DNA, 18 bp, Homo sapiens
ttatctgctgcaaagggt

SEQ ID NO: 7697569 - DNA, 22 bp, Homo sapiens
ttatctgaaacttttgggacca

SEQ ID NO: 7697570 - DNA, 22 bp, Homo sapiens
ttatctgaaaacctcaaaatat

SEQ ID NO: 7697571 - DNA, 22 bp, Homo sapiens
ttatatgtttctgtttggaggc

SEQ ID NO: 7697572 - DNA, 18 bp, Homo sapiens
ttatctctggcatgtgcc

SEQ ID NO: 7697573 - DNA, 22 bp, Homo sapiens
ttatctgaaaacctcaaaatat

SEQ ID NO: 7697574 - DNA, 22 bp, Homo sapiens
ttatgaacaatttctaggaatg

SEQ ID NO: 7697575 - DNA, 22 bp, Homo sapiens
ttatgaacaatttctaggaatg

SEQ ID NO: 7697576 - DNA, 22 bp, Homo sapiens
ttatgaaagacatttctgttgg

SEQ ID NO: 7697577 - DNA, 22 bp, Homo sapiens
ttatgaacagtatccaaaatgt

SEQ ID NO: 7697578 - DNA, 22 bp, Homo sapiens
ttatgaacagtatccaaaatgt

SEQ ID NO: 7697579 - DNA, 22 bp, Homo sapiens
ttatgaaagacatttctgttgg

SEQ ID NO: 7697580 - DNA, 22 bp, Homo sapiens
ttatgaaagacatttctgttgg

SEQ ID NO: 7697581 - DNA, 22 bp, Homo sapiens
ttatgaaagacatttctgttgg

SEQ ID NO: 7697582 - DNA, 22 bp, Homo sapiens
ttatgaaagacatttctgttgg

SEQ ID NO: 7697583 - DNA, 22 bp, Homo sapiens
ttatgaaagacatttctgttgg

SEQ ID NO: 7697584 - DNA, 22 bp, Homo sapiens
ttatgaaagacatttctgttgg

SEQ ID NO: 7697585 - DNA, 22 bp, Homo sapiens
ttatgacaggaaaatcacagaa

SEQ ID NO: 7697586 - DNA, 19 bp, Homo sapiens
ttatgaatagcttcatcca

SEQ ID NO: 7697587 - DNA, 19 bp, Homo sapiens
ttatgaatagcttcatcca

SEQ ID NO: 7697588 - DNA, 22 bp, Homo sapiens
ttatgaagttcctgttacagtg

SEQ ID NO: 7697589 - DNA, 22 bp, Homo sapiens
ttatgaagttcctgttacagtg

SEQ ID NO: 7697590 - DNA, 22 bp, Homo sapiens
ttatgaaaacaatcagtaggca

SEQ ID NO: 7697591 - DNA, 22 bp, Homo sapiens
ttatgaaaacaatcagtaggca

SEQ ID NO: 7697592 - DNA, 22 bp, Homo sapiens
ttatcttgtagagatattttcg

SEQ ID NO: 7697593 - DNA, 22 bp, Homo sapiens
ttatcttgtagagatattttcg

SEQ ID NO: 7697594 - DNA, 22 bp, Homo sapiens
ttatcttggtgttttagtaatt

SEQ ID NO: 7697595 - DNA, 22 bp, Homo sapiens
ttatgaaaacaatcagtaggca

SEQ ID NO: 7697596 - DNA, 22 bp, Homo sapiens
ttatgaaagacatttctgttgg

SEQ ID NO: 7697597 - DNA, 22 bp, Homo sapiens
ttatgaaagacatttctgttgg

SEQ ID NO: 7697598 - DNA, 22 bp, Homo sapiens
ttatgaaaacaatcagtaggca

SEQ ID NO: 7697599 - DNA, 22 bp, Homo sapiens
ttatgaaaacaatcagtaggca

SEQ ID NO: 7697600 - DNA, 22 bp, Homo sapiens
ttatcttggtgttttagtaatt

SEQ ID NO: 7697601 - DNA, 22 bp, Homo sapiens
ttatcttggcaattctaaggta

SEQ ID NO: 7697602 - DNA, 22 bp, Homo sapiens
ttatcttggtgttttagtaatt

SEQ ID NO: 7697603 - DNA, 22 bp, Homo sapiens
ttatcttggtgttttagtaatt

SEQ ID NO: 7697604 - DNA, 22 bp, Homo sapiens
ttatcttgggtaactttgtgca

SEQ ID NO: 7697605 - DNA, 22 bp, Homo sapiens
ttatcttgggtaactttgtgca

SEQ ID NO: 7697606 - DNA, 22 bp, Homo sapiens
ttatcttggcaattctaaggta

SEQ ID NO: 7697607 - DNA, 17 bp, Homo sapiens
ttatcttgctgtttcta

SEQ ID NO: 7697608 - DNA, 17 bp, Homo sapiens
ttatcttgctgtttcta

SEQ ID NO: 7697609 - DNA, 22 bp, Homo sapiens
ttatcttagaggtgattgtatt

SEQ ID NO: 7697610 - DNA, 22 bp, Homo sapiens
ttattattccccaagtcattat

SEQ ID NO: 7697611 - DNA, 22 bp, Homo sapiens
ttattattccccaagtcattat

SEQ ID NO: 7697612 - DNA, 22 bp, Homo sapiens
ttattatgtggatgaaagatgt

SEQ ID NO: 7697613 - DNA, 22 bp, Homo sapiens
ttattattccccaagtcattat

SEQ ID NO: 7697614 - DNA, 22 bp, Homo sapiens
ttattattccccaagtcattat

SEQ ID NO: 7697615 - DNA, 22 bp, Homo sapiens
ttattattccccaagtcattat

SEQ ID NO: 7697616 - DNA, 22 bp, Homo sapiens
ttattattgattcgctctcaaa

SEQ ID NO: 7697617 - DNA, 22 bp, Homo sapiens
ttattattgattcgctctcaaa

SEQ ID NO: 7697618 - DNA, 22 bp, Homo sapiens
ttattattgattcgctctcaaa

SEQ ID NO: 7697619 - DNA, 22 bp, Homo sapiens
ttattattgattcgctctcaaa

SEQ ID NO: 7697620 - DNA, 22 bp, Homo sapiens
ttatgcaaagaaatagactaat

SEQ ID NO: 7697621 - DNA, 22 bp, Homo sapiens
ttatgcaaagaaatagactaat

SEQ ID NO: 7697622 - DNA, 22 bp, Homo sapiens
ttatgcaacaggtgagcagaca

SEQ ID NO: 7697623 - DNA, 22 bp, Homo sapiens
ttatgatttgccacagattggt

SEQ ID NO: 7697624 - DNA, 22 bp, Homo sapiens
ttatgatttgccacagattggt

SEQ ID NO: 7697625 - DNA, 18 bp, Homo sapiens
ttatgcaaaactgttttc

SEQ ID NO: 7697626 - DNA, 18 bp, Homo sapiens
ttatgcaaaactgttttc

SEQ ID NO: 7697627 - DNA, 22 bp, Homo sapiens
ttatgagactgttttacacact

SEQ ID NO: 7697628 - DNA, 22 bp, Homo sapiens
ttatgacatatgagtacaagta

SEQ ID NO: 7697629 - DNA, 22 bp, Homo sapiens
ttatgatttagaaagattcact

SEQ ID NO: 7697630 - DNA, 22 bp, Homo sapiens
ttatgagatatttatactgctg

SEQ ID NO: 7697631 - DNA, 22 bp, Homo sapiens
ttatgagactgttttacacact

SEQ ID NO: 7697632 - DNA, 22 bp, Homo sapiens
ttatgatttgccacagattggt

SEQ ID NO: 7697633 - DNA, 22 bp, Homo sapiens
ttatgatttgccacagattggt

SEQ ID NO: 7697634 - DNA, 22 bp, Homo sapiens
ttatgatttgccacagattggt

SEQ ID NO: 7697635 - DNA, 22 bp, Homo sapiens
ttatgatttgccacagattggt

SEQ ID NO: 7697636 - DNA, 22 bp, Homo sapiens
ttatgatttagaaagattcact

SEQ ID NO: 7697637 - DNA, 22 bp, Homo sapiens
ttatgatttagaaagattcact

SEQ ID NO: 7697638 - DNA, 22 bp, Homo sapiens
ttattccatagaagtcaaggaa

SEQ ID NO: 7697639 - DNA, 22 bp, Homo sapiens
ttattccagtgggtggtttctc

SEQ ID NO: 7697640 - DNA, 22 bp, Homo sapiens
ttattccagtgggtggtttctc

SEQ ID NO: 7697641 - DNA, 22 bp, Homo sapiens
ttattccagtgggtggtttctc

SEQ ID NO: 7697642 - DNA, 22 bp, Homo sapiens
ttattccagtgggtggtttctc

SEQ ID NO: 7697643 - DNA, 22 bp, Homo sapiens
ttattccagtaatctctgtaat

SEQ ID NO: 7697644 - DNA, 22 bp, Homo sapiens
ttattccagtaatctctgtaat

SEQ ID NO: 7697645 - DNA, 22 bp, Homo sapiens
ttattccagtaatctctgtaat

SEQ ID NO: 7697646 - DNA, 22 bp, Homo sapiens
ttattccagtaatctctgtaat

SEQ ID NO: 7697647 - DNA, 22 bp, Homo sapiens
ttattccaggtacttggtttct

SEQ ID NO: 7697648 - DNA, 22 bp, Homo sapiens
ttattccaggtacttggtttct

SEQ ID NO: 7697649 - DNA, 22 bp, Homo sapiens
ttattccaggtacttggtttct

SEQ ID NO: 7697650 - DNA, 22 bp, Homo sapiens
ttattccaggcacagaaggagg

SEQ ID NO: 7697651 - DNA, 22 bp, Homo sapiens
ttattccaggcacagaaggagg

SEQ ID NO: 7697652 - DNA, 22 bp, Homo sapiens
ttattccagctaagagtcctgg

SEQ ID NO: 7697653 - DNA, 22 bp, Homo sapiens
ttattccagctaagagtcctgg

SEQ ID NO: 7697654 - DNA, 22 bp, Homo sapiens
ttattccacctccattttccta

SEQ ID NO: 7697655 - DNA, 22 bp, Homo sapiens
ttattccagctaagagtcctgg

SEQ ID NO: 7697656 - DNA, 22 bp, Homo sapiens
ttattccattgtcttttgactt

SEQ ID NO: 7697657 - DNA, 22 bp, Homo sapiens
ttattccattgtcttttgactt

SEQ ID NO: 7697658 - DNA, 22 bp, Homo sapiens
ttattccattgtcttttgactt

SEQ ID NO: 7697659 - DNA, 22 bp, Homo sapiens
ttattccattgtcttttgactt

SEQ ID NO: 7697660 - DNA, 22 bp, Homo sapiens
ttattccattgtcttttgactt

SEQ ID NO: 7697661 - DNA, 22 bp, Homo sapiens
ttattccattcagttcaacaag

SEQ ID NO: 7697662 - DNA, 22 bp, Homo sapiens
ttattccattcagttcaacaag

SEQ ID NO: 7697663 - DNA, 22 bp, Homo sapiens
ttattccattcagttcaacaag

SEQ ID NO: 7697664 - DNA, 22 bp, Homo sapiens
ttattccattcagttcaacaag

SEQ ID NO: 7697665 - DNA, 22 bp, Homo sapiens
ttattccattatttcacttagg

SEQ ID NO: 7697666 - DNA, 22 bp, Homo sapiens
ttattccattatttcacttagg

SEQ ID NO: 7697667 - DNA, 22 bp, Homo sapiens
ttattccatagaagtcaaggaa

SEQ ID NO: 7697668 - DNA, 22 bp, Homo sapiens
ttattccattatttcacttagg

SEQ ID NO: 7697669 - DNA, 22 bp, Homo sapiens
ttattccattatttcacttagg

SEQ ID NO: 7697670 - DNA, 22 bp, Homo sapiens
ttattccatagaagtcaaggaa

SEQ ID NO: 7697671 - DNA, 22 bp, Homo sapiens
ttattccatagaagtcaaggaa

SEQ ID NO: 7697672 - DNA, 22 bp, Homo sapiens
ttattctgactaatgtataact

SEQ ID NO: 7697673 - DNA, 22 bp, Homo sapiens
ttattctgactaatgtataact

SEQ ID NO: 7697674 - DNA, 22 bp, Homo sapiens
ttattctgaactagactctcat

SEQ ID NO: 7697675 - DNA, 22 bp, Homo sapiens
ttattctgagagttgaagtaat

SEQ ID NO: 7697676 - DNA, 22 bp, Homo sapiens
ttattcctgccttaggtggctg

SEQ ID NO: 7697677 - DNA, 22 bp, Homo sapiens
ttattcctgccttaggtggctg

SEQ ID NO: 7697678 - DNA, 22 bp, Homo sapiens
ttattctcatctccctacttag

SEQ ID NO: 7697679 - DNA, 22 bp, Homo sapiens
ttattcccaggctgtctggttg

SEQ ID NO: 7697680 - DNA, 21 bp, Homo sapiens
ttattctgagatgagattctt

SEQ ID NO: 7697681 - DNA, 22 bp, Homo sapiens
ttattctgagagttgaagtaat

SEQ ID NO: 7697682 - DNA, 22 bp, Homo sapiens
ttattctgagagttgaagtaat

SEQ ID NO: 7697683 - DNA, 22 bp, Homo sapiens
ttattctgagagttgaagtaat

SEQ ID NO: 7697684 - DNA, 22 bp, Homo sapiens
ttattctgcacttttaaaatat

SEQ ID NO: 7697685 - DNA, 22 bp, Homo sapiens
ttattctgcacttttaaaatat

SEQ ID NO: 7697686 - DNA, 22 bp, Homo sapiens
ttattctgccaggagcgtcagt

SEQ ID NO: 7697687 - DNA, 22 bp, Homo sapiens
ttattcatcagtgcattaattt

SEQ ID NO: 7697688 - DNA, 22 bp, Homo sapiens
ttattcatcagtgcattaattt

SEQ ID NO: 7697689 - DNA, 22 bp, Homo sapiens
ttattcatcagtgcattaattt

SEQ ID NO: 7697690 - DNA, 22 bp, Homo sapiens
ttattcatcagtgcattaattt

SEQ ID NO: 7697691 - DNA, 22 bp, Homo sapiens
ttattcatcagtgcattaattt

SEQ ID NO: 7697692 - DNA, 22 bp, Homo sapiens
ttattcatcagtgcattaattt

SEQ ID NO: 7697693 - DNA, 22 bp, Homo sapiens
ttattcatcagtgcattaattt

SEQ ID NO: 7697694 - DNA, 22 bp, Homo sapiens
ttattcatcagtgcattaattt

SEQ ID NO: 7697695 - DNA, 22 bp, Homo sapiens
ttattccaaatcatggttgcat

SEQ ID NO: 7697696 - DNA, 22 bp, Homo sapiens
ttattccaaatcatggttgcat

SEQ ID NO: 7697697 - DNA, 22 bp, Homo sapiens
ttattcattaacagggaccaaa

SEQ ID NO: 7697698 - DNA, 22 bp, Homo sapiens
ttattcattaacagggaccaaa

SEQ ID NO: 7697699 - DNA, 22 bp, Homo sapiens
ttattccaagataggatagcat

SEQ ID NO: 7697700 - DNA, 22 bp, Homo sapiens
ttattccaagataggatagcat

SEQ ID NO: 7697701 - DNA, 22 bp, Homo sapiens
ttattccaaatcatggttgcat

SEQ ID NO: 7697702 - DNA, 22 bp, Homo sapiens
ttattccaaatcatggttgcat

SEQ ID NO: 7697703 - DNA, 22 bp, Homo sapiens
ttattccaaatcatggttgcat

SEQ ID NO: 7697704 - DNA, 22 bp, Homo sapiens
ttattccaatttctcctacaaa

SEQ ID NO: 7697705 - DNA, 22 bp, Homo sapiens
ttattccaatttctcctacaaa

SEQ ID NO: 7697706 - DNA, 22 bp, Homo sapiens
ttattccaatttctcctacaaa

SEQ ID NO: 7697707 - DNA, 22 bp, Homo sapiens
ttattccaatttctcctacaaa

SEQ ID NO: 7697708 - DNA, 22 bp, Homo sapiens
ttattccaatttctcctacaaa

SEQ ID NO: 7697709 - DNA, 22 bp, Homo sapiens
ttattccacctccattttccta

SEQ ID NO: 7697710 - DNA, 22 bp, Homo sapiens
ttattccacctccattttccta

SEQ ID NO: 7697711 - DNA, 22 bp, Homo sapiens
ttattccacagctcagaatttt

SEQ ID NO: 7697712 - DNA, 22 bp, Homo sapiens
ttattccacctccattttccta

SEQ ID NO: 7697713 - DNA, 22 bp, Homo sapiens
ttattccacctccattttccta

SEQ ID NO: 7697714 - DNA, 22 bp, Homo sapiens
ttattccacagctcagaatttt

SEQ ID NO: 7697715 - DNA, 22 bp, Homo sapiens
ttattccacagctcagaatttt

SEQ ID NO: 7697716 - DNA, 22 bp, Homo sapiens
ttattccacagctcagaatttt

SEQ ID NO: 7697717 - DNA, 22 bp, Homo sapiens
ttattccacagctcagaatttt

SEQ ID NO: 7697718 - DNA, 22 bp, Homo sapiens
ttattcagggataacatccagg

SEQ ID NO: 7697719 - DNA, 22 bp, Homo sapiens
ttattcagggataacatccagg

SEQ ID NO: 7697720 - DNA, 22 bp, Homo sapiens
ttattcagggataacatccagg

SEQ ID NO: 7697721 - DNA, 22 bp, Homo sapiens
ttattattggtgagttaaggaa

SEQ ID NO: 7697722 - DNA, 22 bp, Homo sapiens
ttattcaggaggtgctcgaagg

SEQ ID NO: 7697723 - DNA, 22 bp, Homo sapiens
ttattcaggaggtgctcgaagg

SEQ ID NO: 7697724 - DNA, 22 bp, Homo sapiens
ttattcaggctctctttggcta

SEQ ID NO: 7697725 - DNA, 22 bp, Homo sapiens
ttattcaggctctctttggcta

SEQ ID NO: 7697726 - DNA, 22 bp, Homo sapiens
ttattattgattcgctctcaaa

SEQ ID NO: 7697727 - DNA, 22 bp, Homo sapiens
ttattattggtgagttaaggaa

SEQ ID NO: 7697728 - DNA, 22 bp, Homo sapiens
ttattcagtttgtgtagaggtg

SEQ ID NO: 7697729 - DNA, 22 bp, Homo sapiens
ttattcagtttgtgtagaggtg

SEQ ID NO: 7697730 - DNA, 22 bp, Homo sapiens
ttattcagtttgtgtagaggtg

SEQ ID NO: 7697731 - DNA, 22 bp, Homo sapiens
ttattcagtgcctttgaaagaa

SEQ ID NO: 7697732 - DNA, 22 bp, Homo sapiens
ttattcagttcccttcactctc

SEQ ID NO: 7697733 - DNA, 22 bp, Homo sapiens
ttattcagttcccttcactctc

SEQ ID NO: 7697734 - DNA, 22 bp, Homo sapiens
ttattcagtgcatatattaaaa

SEQ ID NO: 7697735 - DNA, 22 bp, Homo sapiens
ttattcagtgcctttgaaagaa

SEQ ID NO: 7697736 - DNA, 22 bp, Homo sapiens
ttattcagtgcctttgaaagaa

SEQ ID NO: 7697737 - DNA, 22 bp, Homo sapiens
ttattcaggtcatggactgtca

SEQ ID NO: 7697738 - DNA, 22 bp, Homo sapiens
ttattcaggtcatggactgtca

SEQ ID NO: 7697739 - DNA, 22 bp, Homo sapiens
ttattcagtgcatatattaaaa

SEQ ID NO: 7697740 - DNA, 22 bp, Homo sapiens
ttattcagtgcatatattaaaa

SEQ ID NO: 7697741 - DNA, 22 bp, Homo sapiens
ttattcagtctgtctagggagt

SEQ ID NO: 7697742 - DNA, 22 bp, Homo sapiens
ttattcagtctgtctagggagt

SEQ ID NO: 7697743 - DNA, 22 bp, Homo sapiens
ttattcagtgcatatattaaaa

SEQ ID NO: 7697744 - DNA, 22 bp, Homo sapiens
ttatttccctgagggttgcagg

SEQ ID NO: 7697745 - DNA, 22 bp, Homo sapiens
ttatttcctaaatctctttgtt

SEQ ID NO: 7697746 - DNA, 22 bp, Homo sapiens
ttatttccctgagggttgcagg

SEQ ID NO: 7697747 - DNA, 22 bp, Homo sapiens
ttatttcctaaatctctttgtt

SEQ ID NO: 7697748 - DNA, 22 bp, Homo sapiens
ttatttccagtccagaaattta

SEQ ID NO: 7697749 - DNA, 22 bp, Homo sapiens
ttatttccacaatgtggtaggg

SEQ ID NO: 7697750 - DNA, 20 bp, Homo sapiens
ttatttccagtccaggtcct

SEQ ID NO: 7697751 - DNA, 20 bp, Homo sapiens
ttatttccagtccaggtcct

SEQ ID NO: 7697752 - DNA, 22 bp, Homo sapiens
ttatttcattgatttctaagac

SEQ ID NO: 7697753 - DNA, 22 bp, Homo sapiens
ttatttcattgatttctaagac

SEQ ID NO: 7697754 - DNA, 22 bp, Homo sapiens
ttatttccaaactggatatacc

SEQ ID NO: 7697755 - DNA, 22 bp, Homo sapiens
ttatttccacaatgtggtaggg

SEQ ID NO: 7697756 - DNA, 22 bp, Homo sapiens
ttattcttggatctgagtctct

SEQ ID NO: 7697757 - DNA, 22 bp, Homo sapiens
ttattcttggatctgagtctct

SEQ ID NO: 7697758 - DNA, 22 bp, Homo sapiens
ttattcttggatctgagtctct

SEQ ID NO: 7697759 - DNA, 22 bp, Homo sapiens
ttattcttggatctgagtctct

SEQ ID NO: 7697760 - DNA, 22 bp, Homo sapiens
ttattcttggatctgagtctct

SEQ ID NO: 7697761 - DNA, 22 bp, Homo sapiens
ttattctttaaacatatatgtt

SEQ ID NO: 7697762 - DNA, 22 bp, Homo sapiens
ttattcttggatctgagtctct

SEQ ID NO: 7697763 - DNA, 22 bp, Homo sapiens
ttattcttggatctgagtctct

SEQ ID NO: 7697764 - DNA, 22 bp, Homo sapiens
ttatttatggcactgttggtgg

SEQ ID NO: 7697765 - DNA, 22 bp, Homo sapiens
ttatttatgttaacagtcgaga

SEQ ID NO: 7697766 - DNA, 22 bp, Homo sapiens
ttatttatgttaacagtcgaga

SEQ ID NO: 7697767 - DNA, 22 bp, Homo sapiens
ttatttatgttaacagtcgaga

SEQ ID NO: 7697768 - DNA, 22 bp, Homo sapiens
ttatttatggccctcacctgat

SEQ ID NO: 7697769 - DNA, 22 bp, Homo sapiens
ttatttatggccctcacctgat

SEQ ID NO: 7697770 - DNA, 22 bp, Homo sapiens
ttatttatggccctcacctgat

SEQ ID NO: 7697771 - DNA, 22 bp, Homo sapiens
ttatttatggccctcacctgat

SEQ ID NO: 7697772 - DNA, 22 bp, Homo sapiens
ttatttatggccctcacctgat

SEQ ID NO: 7697773 - DNA, 19 bp, Homo sapiens
ttattctgtcagagcacac

SEQ ID NO: 7697774 - DNA, 22 bp, Homo sapiens
ttattctgtcaaacttatacat

SEQ ID NO: 7697775 - DNA, 22 bp, Homo sapiens
ttattctgtcaaacttatacat

SEQ ID NO: 7697776 - DNA, 22 bp, Homo sapiens
ttattctgtcaaacttatacat

SEQ ID NO: 7697777 - DNA, 22 bp, Homo sapiens
ttattctgttgcttttacagta

SEQ ID NO: 7697778 - DNA, 22 bp, Homo sapiens
ttattctgttgcttttacagta

SEQ ID NO: 7697779 - DNA, 22 bp, Homo sapiens
ttattctgtctttggtctcaat

SEQ ID NO: 7697780 - DNA, 22 bp, Homo sapiens
ttattctgtgaacatggttaat

SEQ ID NO: 7697781 - DNA, 22 bp, Homo sapiens
ttattctgtgaacatggttaat

SEQ ID NO: 7697782 - DNA, 22 bp, Homo sapiens
ttattctggaggaagcaaatgg

SEQ ID NO: 7697783 - DNA, 17 bp, Homo sapiens
ttattctggcatatgtg

SEQ ID NO: 7697784 - DNA, 22 bp, Homo sapiens
ttattctgtagaacctagtaca

SEQ ID NO: 7697785 - DNA, 22 bp, Homo sapiens
ttattctgtatttcaggtatgt

SEQ ID NO: 7697786 - DNA, 22 bp, Homo sapiens
ttattctgtcaaacttatacat

SEQ ID NO: 7697787 - DNA, 22 bp, Homo sapiens
ttattcttcttctcttgccagg

SEQ ID NO: 7697788 - DNA, 22 bp, Homo sapiens
ttattcttggatctgagtctct

SEQ ID NO: 7697789 - DNA, 18 bp, Homo sapiens
ttattcttccaggccacc

SEQ ID NO: 7697790 - DNA, 19 bp, Homo sapiens
ttattcttaaagtagctta

SEQ ID NO: 7697791 - DNA, 19 bp, Homo sapiens
ttattcttaaagtagctta

SEQ ID NO: 7697792 - DNA, 19 bp, Homo sapiens
ttattcttaaagtagctta

SEQ ID NO: 7697793 - DNA, 19 bp, Homo sapiens
ttattcttaaagtagctta

SEQ ID NO: 7697794 - DNA, 22 bp, Homo sapiens
ttattctgtttgccgaccagta

SEQ ID NO: 7697795 - DNA, 22 bp, Homo sapiens
ttattctgttgttcagggttgg

SEQ ID NO: 7697796 - DNA, 22 bp, Homo sapiens
ttattctgttgcttttacagta

SEQ ID NO: 7697797 - DNA, 22 bp, Homo sapiens
ttattctgttgcttttacagta

SEQ ID NO: 7697798 - DNA, 22 bp, Homo sapiens
ttattctgttggccctctcatc

SEQ ID NO: 7697799 - DNA, 19 bp, Homo sapiens
ttaggtattattgctttcc

SEQ ID NO: 7697800 - DNA, 22 bp, Homo sapiens
ttaggtaagtaggatcaaaaaa

SEQ ID NO: 7697801 - DNA, 22 bp, Homo sapiens
ttaggtaaggatggtgacagta

SEQ ID NO: 7697802 - DNA, 22 bp, Homo sapiens
ttaggtaagtaggatcaaaaaa

SEQ ID NO: 7697803 - DNA, 22 bp, Homo sapiens
ttagggttacaccagcctcctg

SEQ ID NO: 7697804 - DNA, 22 bp, Homo sapiens
ttaggtaaggatggtgacagta

SEQ ID NO: 7697805 - DNA, 22 bp, Homo sapiens
ttagtaaataaagtctactttc

SEQ ID NO: 7697806 - DNA, 22 bp, Homo sapiens
ttagtaaataaagtctactttc

SEQ ID NO: 7697807 - DNA, 22 bp, Homo sapiens
ttagtaaataaagtctactttc

SEQ ID NO: 7697808 - DNA, 22 bp, Homo sapiens
ttaggttggtgcaaaagtaatt

SEQ ID NO: 7697809 - DNA, 22 bp, Homo sapiens
ttaggtttaagtgactggaatc

SEQ ID NO: 7697810 - DNA, 22 bp, Homo sapiens
ttaggtattttgttatgtcagc

SEQ ID NO: 7697811 - DNA, 22 bp, Homo sapiens
ttaggtaagtaggatcaaaaaa

SEQ ID NO: 7697812 - DNA, 19 bp, Homo sapiens
ttaggtattattgctttcc

SEQ ID NO: 7697813 - DNA, 21 bp, Homo sapiens
ttaggtctgagaactgagaga

SEQ ID NO: 7697814 - DNA, 22 bp, Homo sapiens
ttaggtcacatcggtgaccaaa

SEQ ID NO: 7697815 - DNA, 22 bp, Homo sapiens
ttaggtcattccctgagcagat

SEQ ID NO: 7697816 - DNA, 22 bp, Homo sapiens
ttagtacattgattcattatgt

SEQ ID NO: 7697817 - DNA, 22 bp, Homo sapiens
ttagtagaagacagataacaaa

SEQ ID NO: 7697818 - DNA, 22 bp, Homo sapiens
ttagtagattgtgatcagtact

SEQ ID NO: 7697819 - DNA, 22 bp, Homo sapiens
ttagtagagatttggtgcgtgg

SEQ ID NO: 7697820 - DNA, 22 bp, Homo sapiens
ttagtagagagtcatgttttta

SEQ ID NO: 7697821 - DNA, 22 bp, Homo sapiens
ttagtagagagtcatgttttta

SEQ ID NO: 7697822 - DNA, 22 bp, Homo sapiens
ttagtagaatgttatagcaatt

SEQ ID NO: 7697823 - DNA, 22 bp, Homo sapiens
ttagtacagaatcaaaagcaat

SEQ ID NO: 7697824 - DNA, 22 bp, Homo sapiens
ttagtacattgattcattatgt

SEQ ID NO: 7697825 - DNA, 22 bp, Homo sapiens
ttagtacaagagattaattact

SEQ ID NO: 7697826 - DNA, 22 bp, Homo sapiens
ttagtacaagagattaattact

SEQ ID NO: 7697827 - DNA, 22 bp, Homo sapiens
ttagtaattagaaagtaattct

SEQ ID NO: 7697828 - DNA, 22 bp, Homo sapiens
ttagtaattagaaagtaattct

SEQ ID NO: 7697829 - DNA, 22 bp, Homo sapiens
ttagtaaataaagtctactttc

SEQ ID NO: 7697830 - DNA, 22 bp, Homo sapiens
ttagtaatgtgttaatatgaat

SEQ ID NO: 7697831 - DNA, 22 bp, Homo sapiens
ttagggaaggacagtgaagaaa

SEQ ID NO: 7697832 - DNA, 22 bp, Homo sapiens
ttagggaagtgttattctcagg

SEQ ID NO: 7697833 - DNA, 22 bp, Homo sapiens
ttagggaaatatttatatactt

SEQ ID NO: 7697834 - DNA, 22 bp, Homo sapiens
ttagggaaatatttatatactt

SEQ ID NO: 7697835 - DNA, 22 bp, Homo sapiens
ttagggaagtgttattctcagg

SEQ ID NO: 7697836 - DNA, 22 bp, Homo sapiens
ttagggagctcagtcctcagat

SEQ ID NO: 7697837 - DNA, 22 bp, Homo sapiens
ttagggagaaatgcttccctca

SEQ ID NO: 7697838 - DNA, 22 bp, Homo sapiens
ttagggcaggcatgagagaact

SEQ ID NO: 7697839 - DNA, 22 bp, Homo sapiens
ttagggttacaccagcctcctg

SEQ ID NO: 7697840 - DNA, 22 bp, Homo sapiens
ttagggttacaccagcctcctg

SEQ ID NO: 7697841 - DNA, 22 bp, Homo sapiens
ttagggttacaccagcctcctg

SEQ ID NO: 7697842 - DNA, 22 bp, Homo sapiens
ttaggaaattccacctgtattc

SEQ ID NO: 7697843 - DNA, 22 bp, Homo sapiens
ttagccaaacaggtgaaattga

SEQ ID NO: 7697844 - DNA, 22 bp, Homo sapiens
ttaggaaattatggtttcagat

SEQ ID NO: 7697845 - DNA, 22 bp, Homo sapiens
ttagcatttctggaatcacaag

SEQ ID NO: 7697846 - DNA, 22 bp, Homo sapiens
ttagcatttcagtacacatgtt

SEQ ID NO: 7697847 - DNA, 22 bp, Homo sapiens
ttagcatttcagtacacatgtt

SEQ ID NO: 7697848 - DNA, 22 bp, Homo sapiens
ttagcatttcatttcaagagga

SEQ ID NO: 7697849 - DNA, 22 bp, Homo sapiens
ttaggaagaatatatttagagc

SEQ ID NO: 7697850 - DNA, 22 bp, Homo sapiens
ttaggaagaaggaggcagtatt

SEQ ID NO: 7697851 - DNA, 22 bp, Homo sapiens
ttaggaaattccacctgtattc

SEQ ID NO: 7697852 - DNA, 22 bp, Homo sapiens
ttaggaagagctttcaatcact

SEQ ID NO: 7697853 - DNA, 22 bp, Homo sapiens
ttaggaagcacacagtaaatat

SEQ ID NO: 7697854 - DNA, 22 bp, Homo sapiens
ttagatttacaagcactgttta

SEQ ID NO: 7697855 - DNA, 22 bp, Homo sapiens
ttagatttacaagcactgttta

SEQ ID NO: 7697856 - DNA, 22 bp, Homo sapiens
ttagatttatatgtgagaatgg

SEQ ID NO: 7697857 - DNA, 22 bp, Homo sapiens
ttagatttatatgtgagaatgg

SEQ ID NO: 7697858 - DNA, 22 bp, Homo sapiens
ttagatttacaagcactgttta

SEQ ID NO: 7697859 - DNA, 22 bp, Homo sapiens
ttagatttatatgtgagaatgg

SEQ ID NO: 7697860 - DNA, 22 bp, Homo sapiens
ttagatttatatgtgagaatgg

SEQ ID NO: 7697861 - DNA, 22 bp, Homo sapiens
ttagatttatatgtgagaatgg

SEQ ID NO: 7697862 - DNA, 22 bp, Homo sapiens
ttagatgttcactctatccccc

SEQ ID NO: 7697863 - DNA, 22 bp, Homo sapiens
ttagatgtttatatacagattt

SEQ ID NO: 7697864 - DNA, 22 bp, Homo sapiens
ttagatgtgtatatacatgtca

SEQ ID NO: 7697865 - DNA, 22 bp, Homo sapiens
ttagatgtgtatatacatgtca

SEQ ID NO: 7697866 - DNA, 22 bp, Homo sapiens
ttagatgtgcaggacttttatc

SEQ ID NO: 7697867 - DNA, 22 bp, Homo sapiens
ttagatgtggacttatgttatt

SEQ ID NO: 7697868 - DNA, 22 bp, Homo sapiens
ttagatgtggacttatgttatt

SEQ ID NO: 7697869 - DNA, 22 bp, Homo sapiens
ttagatgtgcaggacttttatc

SEQ ID NO: 7697870 - DNA, 22 bp, Homo sapiens
ttagatcattttgaactaattt

SEQ ID NO: 7697871 - DNA, 22 bp, Homo sapiens
ttagatcttaggcaaatgtgtt

SEQ ID NO: 7697872 - DNA, 17 bp, Homo sapiens
ttagcaaaatagcactt

SEQ ID NO: 7697873 - DNA, 17 bp, Homo sapiens
ttagcaaaatagcactt

SEQ ID NO: 7697874 - DNA, 22 bp, Homo sapiens
ttagcaaacaaatgaaatggtt

SEQ ID NO: 7697875 - DNA, 22 bp, Homo sapiens
ttagcaaacaaatgaaatggtt

SEQ ID NO: 7697876 - DNA, 22 bp, Homo sapiens
ttagcaaacaaatgaaatggtt

SEQ ID NO: 7697877 - DNA, 22 bp, Homo sapiens
ttagcaaacatcttcgtgtgag

SEQ ID NO: 7697878 - DNA, 22 bp, Homo sapiens
ttagcaaacccttgctggtgag

SEQ ID NO: 7697879 - DNA, 22 bp, Homo sapiens
ttagcaaacctggactacagat

SEQ ID NO: 7697880 - DNA, 22 bp, Homo sapiens
ttagcaaacctggactacagat

SEQ ID NO: 7697881 - DNA, 22 bp, Homo sapiens
ttagcaaacctggactacagat

SEQ ID NO: 7697882 - DNA, 22 bp, Homo sapiens
ttagcaaacctggactacagat

SEQ ID NO: 7697883 - DNA, 17 bp, Homo sapiens
ttagcaaaatagcactt

SEQ ID NO: 7697884 - DNA, 17 bp, Homo sapiens
ttagcaaaatagcactt

SEQ ID NO: 7697885 - DNA, 22 bp, Homo sapiens
ttagcaaaaatatctcatatta

SEQ ID NO: 7697886 - DNA, 22 bp, Homo sapiens
ttagcaaaaatatctcatatta

SEQ ID NO: 7697887 - DNA, 22 bp, Homo sapiens
ttagcaaaaatatctcatatta

SEQ ID NO: 7697888 - DNA, 22 bp, Homo sapiens
ttagcaaaaatatctcatatta

SEQ ID NO: 7697889 - DNA, 22 bp, Homo sapiens
ttagcaaaaatatctcatatta

SEQ ID NO: 7697890 - DNA, 22 bp, Homo sapiens
ttagatttgtagtgagttcaga

SEQ ID NO: 7697891 - DNA, 22 bp, Homo sapiens
ttagattttaagaagggaggta

SEQ ID NO: 7697892 - DNA, 22 bp, Homo sapiens
ttagatttatatgtgagaatgg

SEQ ID NO: 7697893 - DNA, 22 bp, Homo sapiens
ttagcagatttcatgtacattt

SEQ ID NO: 7697894 - DNA, 22 bp, Homo sapiens
ttagcagcaatggcatcaacta

SEQ ID NO: 7697895 - DNA, 22 bp, Homo sapiens
ttagcagcaatggcatcaacta

SEQ ID NO: 7697896 - DNA, 22 bp, Homo sapiens
ttagcagcaatggcatcaacta

SEQ ID NO: 7697897 - DNA, 22 bp, Homo sapiens
ttagcagcatccctggcctgta

SEQ ID NO: 7697898 - DNA, 22 bp, Homo sapiens
ttagcaaacctggactacagat

SEQ ID NO: 7697899 - DNA, 22 bp, Homo sapiens
ttagcaaacctggactacagat

SEQ ID NO: 7697900 - DNA, 22 bp, Homo sapiens
ttagcactttgattcatgcaga

SEQ ID NO: 7697901 - DNA, 22 bp, Homo sapiens
ttagcactgtctggttatcttg

SEQ ID NO: 7697902 - DNA, 22 bp, Homo sapiens
ttagcactgtctggttatcttg

SEQ ID NO: 7697903 - DNA, 22 bp, Homo sapiens
ttagcagctaagtcatgctgca

SEQ ID NO: 7697904 - DNA, 22 bp, Homo sapiens
ttagcagctaaactgacagacc

SEQ ID NO: 7697905 - DNA, 22 bp, Homo sapiens
ttagcagctaagtcatgctgca

SEQ ID NO: 7697906 - DNA, 22 bp, Homo sapiens
ttagcagcatccctggcctgta

SEQ ID NO: 7697907 - DNA, 22 bp, Homo sapiens
ttagcagcggtcagttttgaag

SEQ ID NO: 7697908 - DNA, 22 bp, Homo sapiens
ttagcagcggtcagttttgaag

SEQ ID NO: 7697909 - DNA, 22 bp, Homo sapiens
ttagcagctaaactgacagacc

SEQ ID NO: 7697910 - DNA, 22 bp, Homo sapiens
ttagcattctctgtgtgcataa

SEQ ID NO: 7697911 - DNA, 22 bp, Homo sapiens
ttagcatagccattgaaatatg

SEQ ID NO: 7697912 - DNA, 22 bp, Homo sapiens
ttagcagcttagactgcctggg

SEQ ID NO: 7697913 - DNA, 22 bp, Homo sapiens
ttagcagcttttaaatggttct

SEQ ID NO: 7697914 - DNA, 22 bp, Homo sapiens
ttagcagcttagactgcctggg

SEQ ID NO: 7697915 - DNA, 22 bp, Homo sapiens
ttagcagcttttaaatggttct

SEQ ID NO: 7697916 - DNA, 22 bp, Homo sapiens
ttagcagttcattgattatcgt

SEQ ID NO: 7697917 - DNA, 22 bp, Homo sapiens
ttagcaggtttctggctcttgg

SEQ ID NO: 7697918 - DNA, 22 bp, Homo sapiens
ttagaaatgtcacagatctgat

SEQ ID NO: 7697919 - DNA, 22 bp, Homo sapiens
ttagaaatgtcacagatctgat

SEQ ID NO: 7697920 - DNA, 22 bp, Homo sapiens
ttagaaatgtcacagatctgat

SEQ ID NO: 7697921 - DNA, 22 bp, Homo sapiens
ttagaaatgtcacagatctgat

SEQ ID NO: 7697922 - DNA, 22 bp, Homo sapiens
ttagaaatgtcacagatctgat

SEQ ID NO: 7697923 - DNA, 22 bp, Homo sapiens
ttagaaatgtcacagatctgat

SEQ ID NO: 7697924 - DNA, 22 bp, Homo sapiens
ttagaaatgtcacagatctgat

SEQ ID NO: 7697925 - DNA, 22 bp, Homo sapiens
ttagaacaaagccaccaggtga

SEQ ID NO: 7697926 - DNA, 22 bp, Homo sapiens
ttagaaatgtcacagatctgat

SEQ ID NO: 7697927 - DNA, 22 bp, Homo sapiens
ttagaacaccattctatattac

SEQ ID NO: 7697928 - DNA, 22 bp, Homo sapiens
ttagaacaccattctatattac

SEQ ID NO: 7697929 - DNA, 21 bp, Homo sapiens
ttagaacaatatttggtatag

SEQ ID NO: 7697930 - DNA, 21 bp, Homo sapiens
ttagaacaatatttggtatag

SEQ ID NO: 7697931 - DNA, 22 bp, Homo sapiens
ttagaaatctgctgccatgcaa

SEQ ID NO: 7697932 - DNA, 22 bp, Homo sapiens
ttagaaatctgctgccatgcaa

SEQ ID NO: 7697933 - DNA, 22 bp, Homo sapiens
ttagaaatgatttcacctcttt

SEQ ID NO: 7697934 - DNA, 22 bp, Homo sapiens
ttagaaatgatttcacctcttt

SEQ ID NO: 7697935 - DNA, 22 bp, Homo sapiens
ttagaaatgcacccaagaccta

SEQ ID NO: 7697936 - DNA, 22 bp, Homo sapiens
ttagaaatgcacccaagaccta

SEQ ID NO: 7697937 - DNA, 22 bp, Homo sapiens
ttagaaatgcacccaagaccta

SEQ ID NO: 7697938 - DNA, 22 bp, Homo sapiens
ttagaaatgcacccaagaccta

SEQ ID NO: 7697939 - DNA, 22 bp, Homo sapiens
ttagaaatgatttcacctcttt

SEQ ID NO: 7697940 - DNA, 22 bp, Homo sapiens
ttagaaatgatttcacctcttt

SEQ ID NO: 7697941 - DNA, 22 bp, Homo sapiens
ttagaaatcacctctgaagatc

SEQ ID NO: 7697942 - DNA, 22 bp, Homo sapiens
ttagaaatcacctctgaagatc

SEQ ID NO: 7697943 - DNA, 22 bp, Homo sapiens
ttagaaatctgctgccatgcaa

SEQ ID NO: 7697944 - DNA, 22 bp, Homo sapiens
ttagaaatctgctgccatgcaa

SEQ ID NO: 7697945 - DNA, 22 bp, Homo sapiens
ttagaaatcacctctgaagatc

SEQ ID NO: 7697946 - DNA, 22 bp, Homo sapiens
ttagaaatcacctctgaagatc

SEQ ID NO: 7697947 - DNA, 22 bp, Homo sapiens
ttagaaatcacctctgaagatc

SEQ ID NO: 7697948 - DNA, 22 bp, Homo sapiens
ttagaaatcacctctgaagatc

SEQ ID NO: 7697949 - DNA, 22 bp, Homo sapiens
ttagaaatcacctctgaagatc

SEQ ID NO: 7697950 - DNA, 22 bp, Homo sapiens
ttagaaatcacctctgaagatc

SEQ ID NO: 7697951 - DNA, 22 bp, Homo sapiens
ttagaaatcacctctgaagatc

SEQ ID NO: 7697952 - DNA, 22 bp, Homo sapiens
ttagaaatacaagtgaggttga

SEQ ID NO: 7697953 - DNA, 22 bp, Homo sapiens
ttagaaatacaagtgaggttga

SEQ ID NO: 7697954 - DNA, 22 bp, Homo sapiens
ttagaaatacaagtgaggttga

SEQ ID NO: 7697955 - DNA, 22 bp, Homo sapiens
ttagaaatatggtgctgccgcc

SEQ ID NO: 7697956 - DNA, 22 bp, Homo sapiens
ttagaaatatggtgctgccgcc

SEQ ID NO: 7697957 - DNA, 22 bp, Homo sapiens
ttagaaatacaagtgaggttga

SEQ ID NO: 7697958 - DNA, 22 bp, Homo sapiens
ttagaaaggttttgctctgaaa

SEQ ID NO: 7697959 - DNA, 22 bp, Homo sapiens
ttagaaaggttttgctctgaaa

SEQ ID NO: 7697960 - DNA, 22 bp, Homo sapiens
ttagaaatacaagtgaggttga

SEQ ID NO: 7697961 - DNA, 22 bp, Homo sapiens
ttagaaatacaagtgaggttga

SEQ ID NO: 7697962 - DNA, 22 bp, Homo sapiens
ttagaaaggttttgctctgaaa

SEQ ID NO: 7697963 - DNA, 22 bp, Homo sapiens
ttagaaagggtgtctgaatctg

SEQ ID NO: 7697964 - DNA, 22 bp, Homo sapiens
ttagaaaggggtgaatcaatgg

SEQ ID NO: 7697965 - DNA, 22 bp, Homo sapiens
ttagaaaggttttgctctgaaa

SEQ ID NO: 7697966 - DNA, 22 bp, Homo sapiens
ttagaaagggtgtctgaatctg

SEQ ID NO: 7697967 - DNA, 22 bp, Homo sapiens
ttagaaaggggtgaatcaatgg

SEQ ID NO: 7697968 - DNA, 22 bp, Homo sapiens
ttagaaaggggtgaatcaatgg

SEQ ID NO: 7697969 - DNA, 22 bp, Homo sapiens
ttagaaaggggtgaatcaatgg

SEQ ID NO: 7697970 - DNA, 22 bp, Homo sapiens
ttacattttgcacagatgtccc

SEQ ID NO: 7697971 - DNA, 22 bp, Homo sapiens
ttacattttgcacagatgtccc

SEQ ID NO: 7697972 - DNA, 22 bp, Homo sapiens
ttacattttgcacagatgtccc

SEQ ID NO: 7697973 - DNA, 22 bp, Homo sapiens
ttacattttggggtaaggataa

SEQ ID NO: 7697974 - DNA, 22 bp, Homo sapiens
ttacattttggggtaaggataa

SEQ ID NO: 7697975 - DNA, 22 bp, Homo sapiens
ttacattttggggtaaggataa

SEQ ID NO: 7697976 - DNA, 22 bp, Homo sapiens
ttacattttggggtaaggataa

SEQ ID NO: 7697977 - DNA, 22 bp, Homo sapiens
ttacattttggggtaaggataa

SEQ ID NO: 7697978 - DNA, 22 bp, Homo sapiens
ttagaaaggagcttatttcttt

SEQ ID NO: 7697979 - DNA, 22 bp, Homo sapiens
ttagaaaggagcttatttcttt

SEQ ID NO: 7697980 - DNA, 22 bp, Homo sapiens
ttagaaaggagcttatttcttt

SEQ ID NO: 7697981 - DNA, 22 bp, Homo sapiens
ttagaaaggagcttatttcttt

SEQ ID NO: 7697982 - DNA, 22 bp, Homo sapiens
ttacattttggggtaaggataa

SEQ ID NO: 7697983 - DNA, 22 bp, Homo sapiens
ttagaaaggaatcttcatttca

SEQ ID NO: 7697984 - DNA, 22 bp, Homo sapiens
ttagaaaggaatcttcatttca

SEQ ID NO: 7697985 - DNA, 22 bp, Homo sapiens
ttagaacatagcaacagaatta

SEQ ID NO: 7697986 - DNA, 21 bp, Homo sapiens
ttagaacatcaacagcaccta

SEQ ID NO: 7697987 - DNA, 22 bp, Homo sapiens
ttagaacatagcaacagaatta

SEQ ID NO: 7697988 - DNA, 22 bp, Homo sapiens
ttagaacatagcaacagaatta

SEQ ID NO: 7697989 - DNA, 22 bp, Homo sapiens
ttagaacatagcaacagaatta

SEQ ID NO: 7697990 - DNA, 22 bp, Homo sapiens
ttagaacagtagaagaaagggt

SEQ ID NO: 7697991 - DNA, 22 bp, Homo sapiens
ttagaacactgagaaagtgatg

SEQ ID NO: 7697992 - DNA, 22 bp, Homo sapiens
ttagaacagtagaagaaagggt

SEQ ID NO: 7697993 - DNA, 22 bp, Homo sapiens
ttagaacactgagaaagtgatg

SEQ ID NO: 7697994 - DNA, 22 bp, Homo sapiens
ttagaacactgagaaagtgatg

SEQ ID NO: 7697995 - DNA, 22 bp, Homo sapiens
ttagaacactgagaaagtgatg

SEQ ID NO: 7697996 - DNA, 22 bp, Homo sapiens
ttagaacatctctcttctgcca

SEQ ID NO: 7697997 - DNA, 22 bp, Homo sapiens
ttagaaccactgaagactcaca

SEQ ID NO: 7697998 - DNA, 22 bp, Homo sapiens
ttagaacatttttagaccaata

SEQ ID NO: 7697999 - DNA, 22 bp, Homo sapiens
ttagaacatttttagaccaata

SEQ ID NO: 7698000 - DNA, 22 bp, Homo sapiens
ttagaaccagggttacgattct

SEQ ID NO: 7698001 - DNA, 22 bp, Homo sapiens
ttagaaccaggaactctaatat

SEQ ID NO: 7698002 - DNA, 22 bp, Homo sapiens
ttagaaccagcatttgtcctgg

SEQ ID NO: 7698003 - DNA, 22 bp, Homo sapiens
ttagaaccataatgaatcaatg

SEQ ID NO: 7698004 - DNA, 22 bp, Homo sapiens
ttagaaccataatgaatcaatg

SEQ ID NO: 7698005 - DNA, 22 bp, Homo sapiens
ttagatatgtttttgctaatgc

SEQ ID NO: 7698006 - DNA, 22 bp, Homo sapiens
ttagatatgtttttgctaatgc

SEQ ID NO: 7698007 - DNA, 18 bp, Homo sapiens
ttagatactagtgtgcta

SEQ ID NO: 7698008 - DNA, 18 bp, Homo sapiens
ttagatactagtgtgcta

SEQ ID NO: 7698009 - DNA, 22 bp, Homo sapiens
ttagatacctttgtgttgtaga

SEQ ID NO: 7698010 - DNA, 22 bp, Homo sapiens
ttagatacgcaggcagttttaa

SEQ ID NO: 7698011 - DNA, 22 bp, Homo sapiens
ttagatacccaagtggatctgt

SEQ ID NO: 7698012 - DNA, 22 bp, Homo sapiens
ttagatacattctcatttgttt

SEQ ID NO: 7698013 - DNA, 22 bp, Homo sapiens
ttagatcttaggcaaatgtgtt

SEQ ID NO: 7698014 - DNA, 22 bp, Homo sapiens
ttagatcatagtgtatatactg

SEQ ID NO: 7698015 - DNA, 22 bp, Homo sapiens
ttagatcatatttaccacagta

SEQ ID NO: 7698016 - DNA, 19 bp, Homo sapiens
ttagatcattaccatgagg

SEQ ID NO: 7698017 - DNA, 22 bp, Homo sapiens
ttagatcaatactaaagaagtt

SEQ ID NO: 7698018 - DNA, 22 bp, Homo sapiens
ttagataaattgcaacttgatt

SEQ ID NO: 7698019 - DNA, 22 bp, Homo sapiens
ttagataacagtagaatatcaa

SEQ ID NO: 7698020 - DNA, 22 bp, Homo sapiens
ttagataacagtagaatatcaa

SEQ ID NO: 7698021 - DNA, 22 bp, Homo sapiens
ttagaagcactaattactcaca

SEQ ID NO: 7698022 - DNA, 22 bp, Homo sapiens
ttagaagcaggctgtgtcccca

SEQ ID NO: 7698023 - DNA, 22 bp, Homo sapiens
ttagataaattgcaacttgatt

SEQ ID NO: 7698024 - DNA, 22 bp, Homo sapiens
ttagataacagtagaatatcaa

SEQ ID NO: 7698025 - DNA, 22 bp, Homo sapiens
ttagataacagtagaatatcaa

SEQ ID NO: 7698026 - DNA, 22 bp, Homo sapiens
ttagataatgttattgtaattt

SEQ ID NO: 7698027 - DNA, 22 bp, Homo sapiens
ttagataatgttattgtaattt

SEQ ID NO: 7698028 - DNA, 22 bp, Homo sapiens
ttagataatgttattgtaattt

SEQ ID NO: 7698029 - DNA, 22 bp, Homo sapiens
ttagataatgtagagatatgag

SEQ ID NO: 7698030 - DNA, 22 bp, Homo sapiens
ttagataatgtagagatatgag

SEQ ID NO: 7698031 - DNA, 22 bp, Homo sapiens
ttagataatgttattgtaattt

SEQ ID NO: 7698032 - DNA, 22 bp, Homo sapiens
ttagataatgttattgtaattt

SEQ ID NO: 7698033 - DNA, 22 bp, Homo sapiens
ttagataatgtagagatatgag

SEQ ID NO: 7698034 - DNA, 22 bp, Homo sapiens
ttagataacagtagaatatcaa

SEQ ID NO: 7698035 - DNA, 22 bp, Homo sapiens
ttagataatgtagagatatgag

SEQ ID NO: 7698036 - DNA, 22 bp, Homo sapiens
ttagataatgtagagatatgag

SEQ ID NO: 7698037 - DNA, 22 bp, Homo sapiens
ttagataatgtagagatatgag

SEQ ID NO: 7698038 - DNA, 22 bp, Homo sapiens
ttagataatgtagagatatgag

SEQ ID NO: 7698039 - DNA, 22 bp, Homo sapiens
ttacagatggatctagcaaaat

SEQ ID NO: 7698040 - DNA, 22 bp, Homo sapiens
ttacagatacatttcttttgtt

SEQ ID NO: 7698041 - DNA, 22 bp, Homo sapiens
ttacagatggatctagcaaaat

SEQ ID NO: 7698042 - DNA, 22 bp, Homo sapiens
ttacagatggatctagcaaaat

SEQ ID NO: 7698043 - DNA, 22 bp, Homo sapiens
ttacagatcatcaaggtataat

SEQ ID NO: 7698044 - DNA, 22 bp, Homo sapiens
ttacagatcatcaaggtataat

SEQ ID NO: 7698045 - DNA, 22 bp, Homo sapiens
ttacagatcatcaaggtataat

SEQ ID NO: 7698046 - DNA, 22 bp, Homo sapiens
ttacagatcatcaaggtataat

SEQ ID NO: 7698047 - DNA, 22 bp, Homo sapiens
ttacagatggatctagcaaaat

SEQ ID NO: 7698048 - DNA, 22 bp, Homo sapiens
ttacagatggatctagcaaaat

SEQ ID NO: 7698049 - DNA, 22 bp, Homo sapiens
ttacagatggcagtttcttgag

SEQ ID NO: 7698050 - DNA, 22 bp, Homo sapiens
ttacagatgtaggaactgaagt

SEQ ID NO: 7698051 - DNA, 22 bp, Homo sapiens
ttacagatgtaggaactgaagt

SEQ ID NO: 7698052 - DNA, 22 bp, Homo sapiens
ttacagatgtaggaactgaagt

SEQ ID NO: 7698053 - DNA, 22 bp, Homo sapiens
ttacagatggggttgcaataaa

SEQ ID NO: 7698054 - DNA, 22 bp, Homo sapiens
ttacagatggggttgcaataaa

SEQ ID NO: 7698055 - DNA, 22 bp, Homo sapiens
ttacagatggggttgcaataaa

SEQ ID NO: 7698056 - DNA, 22 bp, Homo sapiens
ttacagatggggttgcaataaa

SEQ ID NO: 7698057 - DNA, 22 bp, Homo sapiens
ttacagatgtaggaactgaagt

SEQ ID NO: 7698058 - DNA, 19 bp, Homo sapiens
ttacagatgtggaaattga

SEQ ID NO: 7698059 - DNA, 22 bp, Homo sapiens
ttacagatgtttcaggaatact

SEQ ID NO: 7698060 - DNA, 22 bp, Homo sapiens
ttacagatgtttcaggaatact

SEQ ID NO: 7698061 - DNA, 22 bp, Homo sapiens
ttacagatgtttcaggaatact

SEQ ID NO: 7698062 - DNA, 22 bp, Homo sapiens
ttacagatgtttcaggaatact

SEQ ID NO: 7698063 - DNA, 22 bp, Homo sapiens
ttacagattaaaatgctgaggt

SEQ ID NO: 7698064 - DNA, 22 bp, Homo sapiens
ttacagattaaaatgctgaggt

SEQ ID NO: 7698065 - DNA, 22 bp, Homo sapiens
ttacagattaaaatgctgaggt

SEQ ID NO: 7698066 - DNA, 22 bp, Homo sapiens
ttacagattcaagctctttgaa

SEQ ID NO: 7698067 - DNA, 21 bp, Homo sapiens
ttacagcaatgttagcaggaa

SEQ ID NO: 7698068 - DNA, 22 bp, Homo sapiens
ttacagcacagtgcttttactg

SEQ ID NO: 7698069 - DNA, 21 bp, Homo sapiens
ttacagcaatgttagcaggaa

SEQ ID NO: 7698070 - DNA, 22 bp, Homo sapiens
ttacagcacagtgcttttactg

SEQ ID NO: 7698071 - DNA, 22 bp, Homo sapiens
ttacagcacagtgcttttactg

SEQ ID NO: 7698072 - DNA, 22 bp, Homo sapiens
ttacagcacagtgcttttactg

SEQ ID NO: 7698073 - DNA, 17 bp, Homo sapiens
ttacagcagcaatagag

SEQ ID NO: 7698074 - DNA, 18 bp, Homo sapiens
ttacagcagcaacaggaa

SEQ ID NO: 7698075 - DNA, 22 bp, Homo sapiens
ttacatgaggttaattaagcat

SEQ ID NO: 7698076 - DNA, 22 bp, Homo sapiens
ttacatgatgatttcataaaca

SEQ ID NO: 7698077 - DNA, 22 bp, Homo sapiens
ttacatgatgatttcataaaca

SEQ ID NO: 7698078 - DNA, 22 bp, Homo sapiens
ttacatgatgatttcataaaca

SEQ ID NO: 7698079 - DNA, 22 bp, Homo sapiens
ttacatgatgatttcataaaca

SEQ ID NO: 7698080 - DNA, 22 bp, Homo sapiens
ttacatgatgatttcataaaca

SEQ ID NO: 7698081 - DNA, 22 bp, Homo sapiens
ttacatggtaaacactctttta

SEQ ID NO: 7698082 - DNA, 22 bp, Homo sapiens
ttacatgggcttgtgagtcctt

SEQ ID NO: 7698083 - DNA, 22 bp, Homo sapiens
ttacatgggccatttagacatg

SEQ ID NO: 7698084 - DNA, 22 bp, Homo sapiens
ttacatgggccatttagacatg

SEQ ID NO: 7698085 - DNA, 22 bp, Homo sapiens
ttacatgcatatatgtgtgtgt

SEQ ID NO: 7698086 - DNA, 22 bp, Homo sapiens
ttacatgcaggtcagactgcat

SEQ ID NO: 7698087 - DNA, 22 bp, Homo sapiens
ttacatgcaggtcagactgcat

SEQ ID NO: 7698088 - DNA, 22 bp, Homo sapiens
ttacatgcatatatgtgtgtgt

SEQ ID NO: 7698089 - DNA, 22 bp, Homo sapiens
ttacatggatgtaaaaaagtta

SEQ ID NO: 7698090 - DNA, 22 bp, Homo sapiens
ttacatgcttagagatgcatgc

SEQ ID NO: 7698091 - DNA, 22 bp, Homo sapiens
ttacatgcttagagatgcatgc

SEQ ID NO: 7698092 - DNA, 22 bp, Homo sapiens
ttacatgctctgtgtgtctccg

SEQ ID NO: 7698093 - DNA, 22 bp, Homo sapiens
ttacatgctctgtgtgtctccg

SEQ ID NO: 7698094 - DNA, 22 bp, Homo sapiens
ttacatgactgcccttgtcagg

SEQ ID NO: 7698095 - DNA, 22 bp, Homo sapiens
ttacatgactcaatagaagggc

SEQ ID NO: 7698096 - DNA, 19 bp, Homo sapiens
ttacatgacatatgaagga

SEQ ID NO: 7698097 - DNA, 19 bp, Homo sapiens
ttacatgacatatgaagga

SEQ ID NO: 7698098 - DNA, 23 bp, Homo sapiens
ttacagctaactgctgttattag

SEQ ID NO: 7698099 - DNA, 23 bp, Homo sapiens
ttacagctaactgctgttattag

SEQ ID NO: 7698100 - DNA, 22 bp, Homo sapiens
ttacagctagccaattatttag

SEQ ID NO: 7698101 - DNA, 22 bp, Homo sapiens
ttacagctagccaattatttag

SEQ ID NO: 7698102 - DNA, 19 bp, Homo sapiens
ttacatgacatatgaagga

SEQ ID NO: 7698103 - DNA, 19 bp, Homo sapiens
ttacatgacatatgaagga

SEQ ID NO: 7698104 - DNA, 22 bp, Homo sapiens
ttacagcagcagggacagacta

SEQ ID NO: 7698105 - DNA, 22 bp, Homo sapiens
ttacagcagcagggacagacta

SEQ ID NO: 7698106 - DNA, 22 bp, Homo sapiens
ttacagcagtgggaaggagtca

SEQ ID NO: 7698107 - DNA, 22 bp, Homo sapiens
ttacagcagtgggaaggagtca

SEQ ID NO: 7698108 - DNA, 22 bp, Homo sapiens
ttacagcagcagggacagacta

SEQ ID NO: 7698109 - DNA, 22 bp, Homo sapiens
ttacagcatttaatgagatctg

SEQ ID NO: 7698110 - DNA, 22 bp, Homo sapiens
ttacagcatttaatgagatctg

SEQ ID NO: 7698111 - DNA, 22 bp, Homo sapiens
ttacagcatttaatgagatctg

SEQ ID NO: 7698112 - DNA, 22 bp, Homo sapiens
ttacagcagtgggaaggagtca

SEQ ID NO: 7698113 - DNA, 22 bp, Homo sapiens
ttacagcagtgggaaggagtca

SEQ ID NO: 7698114 - DNA, 22 bp, Homo sapiens
ttacagcagtgggaaggagtca

SEQ ID NO: 7698115 - DNA, 22 bp, Homo sapiens
ttacagcagtgggaaggagtca

SEQ ID NO: 7698116 - DNA, 22 bp, Homo sapiens
ttacattttgcacagatgtccc

SEQ ID NO: 7698117 - DNA, 22 bp, Homo sapiens
ttacattttgcacagatgtccc

SEQ ID NO: 7698118 - DNA, 22 bp, Homo sapiens
ttacattttgcacagatgtccc

SEQ ID NO: 7698119 - DNA, 22 bp, Homo sapiens
ttacattttgcacagatgtccc

SEQ ID NO: 7698120 - DNA, 22 bp, Homo sapiens
ttacattttagttaacctgtga

SEQ ID NO: 7698121 - DNA, 22 bp, Homo sapiens
ttacatttggctatgtcctcta

SEQ ID NO: 7698122 - DNA, 22 bp, Homo sapiens
ttacattttagttaacctgtga

SEQ ID NO: 7698123 - DNA, 22 bp, Homo sapiens
ttacattttagttaacctgtga

SEQ ID NO: 7698124 - DNA, 22 bp, Homo sapiens
ttacattttagttaacctgtga

SEQ ID NO: 7698125 - DNA, 22 bp, Homo sapiens
ttacattttagttaacctgtga

SEQ ID NO: 7698126 - DNA, 22 bp, Homo sapiens
ttacatttggctatgtcctcta

SEQ ID NO: 7698127 - DNA, 22 bp, Homo sapiens
ttacatttggctatgtcctcta

SEQ ID NO: 7698128 - DNA, 22 bp, Homo sapiens
ttacatttggctatgtcctcta

SEQ ID NO: 7698129 - DNA, 22 bp, Homo sapiens
ttacatttggctatgtcctcta

SEQ ID NO: 7698130 - DNA, 22 bp, Homo sapiens
ttacatttggctatgtcctcta

SEQ ID NO: 7698131 - DNA, 22 bp, Homo sapiens
ttacatttcccccttggaggct

SEQ ID NO: 7698132 - DNA, 22 bp, Homo sapiens
ttacattcttatctcagttatt

SEQ ID NO: 7698133 - DNA, 22 bp, Homo sapiens
ttacatttcccccttggaggct

SEQ ID NO: 7698134 - DNA, 22 bp, Homo sapiens
ttacattcaaggaactcattct

SEQ ID NO: 7698135 - DNA, 22 bp, Homo sapiens
ttacattcaatttctagaggta

SEQ ID NO: 7698136 - DNA, 22 bp, Homo sapiens
ttacattaggtcaagctgccaa

SEQ ID NO: 7698137 - DNA, 22 bp, Homo sapiens
ttacattaggtcaagctgccaa

SEQ ID NO: 7698138 - DNA, 22 bp, Homo sapiens
ttacattaggtcaagctgccaa

SEQ ID NO: 7698139 - DNA, 22 bp, Homo sapiens
ttacattcagaaagatttgagt

SEQ ID NO: 7698140 - DNA, 21 bp, Homo sapiens
ttacattcagaggagtggaag

SEQ ID NO: 7698141 - DNA, 22 bp, Homo sapiens
ttacattcccagtgtgcagcat

SEQ ID NO: 7698142 - DNA, 22 bp, Homo sapiens
ttacattcattgaagtgattca

SEQ ID NO: 7698143 - DNA, 22 bp, Homo sapiens
ttacattcttatctcagttatt

SEQ ID NO: 7698144 - DNA, 22 bp, Homo sapiens
ttacattcttggaatcttgttt

SEQ ID NO: 7698145 - DNA, 22 bp, Homo sapiens
ttacattcttggaatcttgttt

SEQ ID NO: 7698146 - DNA, 21 bp, Homo sapiens
ttacatggtttatcatatgga

SEQ ID NO: 7698147 - DNA, 21 bp, Homo sapiens
ttacatggtttatcatatgga

SEQ ID NO: 7698148 - DNA, 21 bp, Homo sapiens
ttacatggtttatcatatgga

SEQ ID NO: 7698149 - DNA, 22 bp, Homo sapiens
ttacatggttgttggaaatgct

SEQ ID NO: 7698150 - DNA, 22 bp, Homo sapiens
ttacatgtaatctaaaataatt

SEQ ID NO: 7698151 - DNA, 22 bp, Homo sapiens
ttacatgtaatctaaaataatt

SEQ ID NO: 7698152 - DNA, 22 bp, Homo sapiens
ttacatgtacaaacaattctta

SEQ ID NO: 7698153 - DNA, 22 bp, Homo sapiens
ttacatgtaatctaaaataatt

SEQ ID NO: 7698154 - DNA, 22 bp, Homo sapiens
ttacatgtaatctaaaataatt

SEQ ID NO: 7698155 - DNA, 22 bp, Homo sapiens
ttacatgtactggtttgactta

SEQ ID NO: 7698156 - DNA, 22 bp, Homo sapiens
ttacatgtactggtttgactta

SEQ ID NO: 7698157 - DNA, 22 bp, Homo sapiens
ttacatgtactggtttgactta

SEQ ID NO: 7698158 - DNA, 22 bp, Homo sapiens
ttacatgtactggtttgactta

SEQ ID NO: 7698159 - DNA, 22 bp, Homo sapiens
ttacatgtacaaacaattctta

SEQ ID NO: 7698160 - DNA, 22 bp, Homo sapiens
ttacatgtactggtttgactta

SEQ ID NO: 7698161 - DNA, 22 bp, Homo sapiens
ttacatgtggtgtgaagaagag

SEQ ID NO: 7698162 - DNA, 22 bp, Homo sapiens
ttacatgtggtgtgaagaagag

SEQ ID NO: 7698163 - DNA, 22 bp, Homo sapiens
ttacatgtggagtctgattgca

SEQ ID NO: 7698164 - DNA, 22 bp, Homo sapiens
ttacatgtattttggaaaaagt

SEQ ID NO: 7698165 - DNA, 22 bp, Homo sapiens
ttacatgtggagtctgattgca

SEQ ID NO: 7698166 - DNA, 22 bp, Homo sapiens
ttacatgtggagtctgattgca

SEQ ID NO: 7698167 - DNA, 23 bp, Homo sapiens
ttacatgtgtgcacacattctgg

SEQ ID NO: 7698168 - DNA, 23 bp, Homo sapiens
ttacatgtgtgcacacattctgg

SEQ ID NO: 7698169 - DNA, 23 bp, Homo sapiens
ttacatgtgtgcacacattctgg

SEQ ID NO: 7698170 - DNA, 22 bp, Homo sapiens
ttacatgttctcatacacagag

SEQ ID NO: 7698171 - DNA, 22 bp, Homo sapiens
ttacatgttctcatacacagag

SEQ ID NO: 7698172 - DNA, 22 bp, Homo sapiens
ttacatgttagaaaaggctgtt

SEQ ID NO: 7698173 - DNA, 22 bp, Homo sapiens
ttacatgttctcatacacagag

SEQ ID NO: 7698174 - DNA, 22 bp, Homo sapiens
ttacatgttctcatacacagag

SEQ ID NO: 7698175 - DNA, 22 bp, Homo sapiens
ttacatgtttacggatacactt

SEQ ID NO: 7698176 - DNA, 22 bp, Homo sapiens
ttacatgtttacggatacactt

SEQ ID NO: 7698177 - DNA, 22 bp, Homo sapiens
ttacatgtttatgggggtacat

SEQ ID NO: 7698178 - DNA, 22 bp, Homo sapiens
ttacattagacccactttcatg

SEQ ID NO: 7698179 - DNA, 22 bp, Homo sapiens
ttacattagacccactttcatg

SEQ ID NO: 7698180 - DNA, 22 bp, Homo sapiens
ttacattagacccactttcatg

SEQ ID NO: 7698181 - DNA, 22 bp, Homo sapiens
ttacatgtttatgtggtacatg

SEQ ID NO: 7698182 - DNA, 22 bp, Homo sapiens
ttacatgtttatgggggtacat

SEQ ID NO: 7698183 - DNA, 22 bp, Homo sapiens
ttacatgtttatgggggtacat

SEQ ID NO: 7698184 - DNA, 22 bp, Homo sapiens
ttacaattgagtctattgtatg

SEQ ID NO: 7698185 - DNA, 22 bp, Homo sapiens
ttacaattgagtctattgtatg

SEQ ID NO: 7698186 - DNA, 22 bp, Homo sapiens
ttacaattgagtctattgtatg

SEQ ID NO: 7698187 - DNA, 22 bp, Homo sapiens
ttacaattgagtctattgtatg

SEQ ID NO: 7698188 - DNA, 22 bp, Homo sapiens
ttacaattgagtctattgtatg

SEQ ID NO: 7698189 - DNA, 22 bp, Homo sapiens
ttacaattgagtctattgtatg

SEQ ID NO: 7698190 - DNA, 22 bp, Homo sapiens
ttacaattgagtctattgtatg

SEQ ID NO: 7698191 - DNA, 22 bp, Homo sapiens
ttacaattgagtctattgtatg

SEQ ID NO: 7698192 - DNA, 22 bp, Homo sapiens
ttacaattgagtctattgtatg

SEQ ID NO: 7698193 - DNA, 19 bp, Homo sapiens
ttacaatggtgattaggtt

SEQ ID NO: 7698194 - DNA, 22 bp, Homo sapiens
ttacaattacttgatctcagct

SEQ ID NO: 7698195 - DNA, 22 bp, Homo sapiens
ttacaattgagtctattgtatg

SEQ ID NO: 7698196 - DNA, 22 bp, Homo sapiens
ttacaattgagtctattgtatg

SEQ ID NO: 7698197 - DNA, 22 bp, Homo sapiens
ttacaattacttgatctcagct

SEQ ID NO: 7698198 - DNA, 22 bp, Homo sapiens
ttacaattacttgatctcagct

SEQ ID NO: 7698199 - DNA, 22 bp, Homo sapiens
ttacaatgggtatacttccatt

SEQ ID NO: 7698200 - DNA, 22 bp, Homo sapiens
ttacaatgggtatacttccatt

SEQ ID NO: 7698201 - DNA, 22 bp, Homo sapiens
ttacaatgtaaggcatggttct

SEQ ID NO: 7698202 - DNA, 22 bp, Homo sapiens
ttacaatgtaaggcatggttct

SEQ ID NO: 7698203 - DNA, 22 bp, Homo sapiens
ttacaatgtaaggcatggttct

SEQ ID NO: 7698204 - DNA, 19 bp, Homo sapiens
ttacaatggtgattaggtt

SEQ ID NO: 7698205 - DNA, 22 bp, Homo sapiens
ttacaagtactgaatatgattt

SEQ ID NO: 7698206 - DNA, 22 bp, Homo sapiens
ttacaagtactgaatatgattt

SEQ ID NO: 7698207 - DNA, 22 bp, Homo sapiens
ttacaagtactgaatatgattt

SEQ ID NO: 7698208 - DNA, 22 bp, Homo sapiens
ttacaagtactgaatatgattt

SEQ ID NO: 7698209 - DNA, 22 bp, Homo sapiens
ttacaatgatgggattcagcca

SEQ ID NO: 7698210 - DNA, 22 bp, Homo sapiens
ttacaatgatgggattcagcca

SEQ ID NO: 7698211 - DNA, 22 bp, Homo sapiens
ttacaatgatgggattcagcca

SEQ ID NO: 7698212 - DNA, 22 bp, Homo sapiens
ttacaagtactgaatatgattt

SEQ ID NO: 7698213 - DNA, 22 bp, Homo sapiens
ttacaatgggtatacttccatt

SEQ ID NO: 7698214 - DNA, 22 bp, Homo sapiens
ttacaatgggagcccttggact

SEQ ID NO: 7698215 - DNA, 22 bp, Homo sapiens
ttacaatgggagcccttggact

SEQ ID NO: 7698216 - DNA, 22 bp, Homo sapiens
ttacaatgggagcccttggact

SEQ ID NO: 7698217 - DNA, 22 bp, Homo sapiens
ttacaatgcactcacctttaga

SEQ ID NO: 7698218 - DNA, 22 bp, Homo sapiens
ttacaatgcactcacctttaga

SEQ ID NO: 7698219 - DNA, 22 bp, Homo sapiens
ttacaatgcactcacctttaga

SEQ ID NO: 7698220 - DNA, 21 bp, Homo sapiens
ttacaatgcattttctttggc

SEQ ID NO: 7698221 - DNA, 21 bp, Homo sapiens
ttacaatgcattttctttggc

SEQ ID NO: 7698222 - DNA, 22 bp, Homo sapiens
ttacaagctaattgtttcagct

SEQ ID NO: 7698223 - DNA, 23 bp, Homo sapiens
ttacaaggaagtgcacagatggg

SEQ ID NO: 7698224 - DNA, 22 bp, Homo sapiens
ttacaaggaggatagcatttcc

SEQ ID NO: 7698225 - DNA, 22 bp, Homo sapiens
ttacaagggtcagtgtgtttgt

SEQ ID NO: 7698226 - DNA, 22 bp, Homo sapiens
ttacaagggtttctggggccca

SEQ ID NO: 7698227 - DNA, 22 bp, Homo sapiens
ttacaagggtcagtgtgtttgt

SEQ ID NO: 7698228 - DNA, 22 bp, Homo sapiens
ttacaaggaggatagcatttcc

SEQ ID NO: 7698229 - DNA, 22 bp, Homo sapiens
ttacaagatatgtgagaactag

SEQ ID NO: 7698230 - DNA, 22 bp, Homo sapiens
ttacaagatatgtgagaactag

SEQ ID NO: 7698231 - DNA, 22 bp, Homo sapiens
ttacaagatatgtgagaactag

SEQ ID NO: 7698232 - DNA, 22 bp, Homo sapiens
ttacaagataacggagaaagca

SEQ ID NO: 7698233 - DNA, 22 bp, Homo sapiens
ttacaagataacggagaaagca

SEQ ID NO: 7698234 - DNA, 22 bp, Homo sapiens
ttacaagataacctgatgctgt

SEQ ID NO: 7698235 - DNA, 22 bp, Homo sapiens
ttacaagataacctgatgctgt

SEQ ID NO: 7698236 - DNA, 22 bp, Homo sapiens
ttacaagataacggagaaagca

SEQ ID NO: 7698237 - DNA, 22 bp, Homo sapiens
ttacaagataacggagaaagca

SEQ ID NO: 7698238 - DNA, 22 bp, Homo sapiens
ttacaagataacggagaaagca

SEQ ID NO: 7698239 - DNA, 22 bp, Homo sapiens
ttacaagataacctgatgctgt

SEQ ID NO: 7698240 - DNA, 22 bp, Homo sapiens
ttacaagataacctgatgctgt

SEQ ID NO: 7698241 - DNA, 22 bp, Homo sapiens
ttacaagataacctgatgctgt

SEQ ID NO: 7698242 - DNA, 22 bp, Homo sapiens
ttacaagacagtgtggtaaata

SEQ ID NO: 7698243 - DNA, 22 bp, Homo sapiens
ttacaagacagtgtggtaaata

SEQ ID NO: 7698244 - DNA, 22 bp, Homo sapiens
ttacaagacagtgtggtaaata

SEQ ID NO: 7698245 - DNA, 22 bp, Homo sapiens
ttacaagacagtgtggtaaata

SEQ ID NO: 7698246 - DNA, 22 bp, Homo sapiens
ttacaagacagtgtggtaaata

SEQ ID NO: 7698247 - DNA, 22 bp, Homo sapiens
ttacaagacactgctgacacag

SEQ ID NO: 7698248 - DNA, 22 bp, Homo sapiens
ttacaagacactgctgacacag

SEQ ID NO: 7698249 - DNA, 22 bp, Homo sapiens
ttacaagacactgctgacacag

SEQ ID NO: 7698250 - DNA, 22 bp, Homo sapiens
ttacaagatgggaaagggaagt

SEQ ID NO: 7698251 - DNA, 22 bp, Homo sapiens
ttacaagatgggaaagggaagt

SEQ ID NO: 7698252 - DNA, 22 bp, Homo sapiens
ttacaagatgggaaagggaagt

SEQ ID NO: 7698253 - DNA, 22 bp, Homo sapiens
ttacaagatctttgaaggcaag

SEQ ID NO: 7698254 - DNA, 22 bp, Homo sapiens
ttacaagatctttgaaggcaag

SEQ ID NO: 7698255 - DNA, 22 bp, Homo sapiens
ttacaagatctttgaaggcaag

SEQ ID NO: 7698256 - DNA, 22 bp, Homo sapiens
ttacaagatctttgaaggcaag

SEQ ID NO: 7698257 - DNA, 22 bp, Homo sapiens
ttacaagatctttgaaggcaag

SEQ ID NO: 7698258 - DNA, 22 bp, Homo sapiens
ttacaagatatgtgagaactag

SEQ ID NO: 7698259 - DNA, 22 bp, Homo sapiens
ttacaagatatgtgagaactag

SEQ ID NO: 7698260 - DNA, 22 bp, Homo sapiens
ttacaagatatgtgagaactag

SEQ ID NO: 7698261 - DNA, 22 bp, Homo sapiens
ttacaagatatgtgagaactag

SEQ ID NO: 7698262 - DNA, 22 bp, Homo sapiens
ttacaagattaattattggagt

SEQ ID NO: 7698263 - DNA, 22 bp, Homo sapiens
ttacaagatgggaaagggaagt

SEQ ID NO: 7698264 - DNA, 22 bp, Homo sapiens
ttacaagattaattattggagt

SEQ ID NO: 7698265 - DNA, 22 bp, Homo sapiens
ttacaagattgatttgcttggc

SEQ ID NO: 7698266 - DNA, 22 bp, Homo sapiens
ttacaagattgatttgcttggc

SEQ ID NO: 7698267 - DNA, 22 bp, Homo sapiens
ttacagagtggtctggctatgt

SEQ ID NO: 7698268 - DNA, 22 bp, Homo sapiens
ttacagagtggtctggctatgt

SEQ ID NO: 7698269 - DNA, 22 bp, Homo sapiens
ttacagagtagtgcagaactca

SEQ ID NO: 7698270 - DNA, 22 bp, Homo sapiens
ttacagagtagtgcagaactca

SEQ ID NO: 7698271 - DNA, 22 bp, Homo sapiens
ttacagagtagggaattgaagt

SEQ ID NO: 7698272 - DNA, 22 bp, Homo sapiens
ttacagagtagggaattgaagt

SEQ ID NO: 7698273 - DNA, 22 bp, Homo sapiens
ttacagatacatttcttttgtt

SEQ ID NO: 7698274 - DNA, 22 bp, Homo sapiens
ttacagagttcgcacctggtgg

SEQ ID NO: 7698275 - DNA, 22 bp, Homo sapiens
ttacagatactttgtaggcaag

SEQ ID NO: 7698276 - DNA, 22 bp, Homo sapiens
ttacagatacatttcttttgtt

SEQ ID NO: 7698277 - DNA, 22 bp, Homo sapiens
ttacagatactttgtaggcaag

SEQ ID NO: 7698278 - DNA, 22 bp, Homo sapiens
ttacagatactttgtaggcaag

SEQ ID NO: 7698279 - DNA, 22 bp, Homo sapiens
ttacagatactttgtaggcaag

SEQ ID NO: 7698280 - DNA, 22 bp, Homo sapiens
ttacagagataaactgtaagtg

SEQ ID NO: 7698281 - DNA, 22 bp, Homo sapiens
ttacagagcctcattttagaga

SEQ ID NO: 7698282 - DNA, 22 bp, Homo sapiens
ttacagagctcatttctaaggg

SEQ ID NO: 7698283 - DNA, 22 bp, Homo sapiens
ttacagagcctcattttagaga

SEQ ID NO: 7698284 - DNA, 22 bp, Homo sapiens
ttacagagaggtgattgtgaag

SEQ ID NO: 7698285 - DNA, 22 bp, Homo sapiens
ttacagacaaactgtgttaagt

SEQ ID NO: 7698286 - DNA, 22 bp, Homo sapiens
ttacagacaaactgtgttaagt

SEQ ID NO: 7698287 - DNA, 22 bp, Homo sapiens
ttacagagaggtgattgtgaag

SEQ ID NO: 7698288 - DNA, 22 bp, Homo sapiens
ttacagagggcttctctgaact

SEQ ID NO: 7698289 - DNA, 22 bp, Homo sapiens
ttacagaggtatgtatgtctct

SEQ ID NO: 7698290 - DNA, 17 bp, Homo sapiens
ttacagaggtaattaag

SEQ ID NO: 7698291 - DNA, 22 bp, Homo sapiens
ttacagaggcttccagggccca

SEQ ID NO: 7698292 - DNA, 22 bp, Homo sapiens
ttacagagctgggtggagagag

SEQ ID NO: 7698293 - DNA, 22 bp, Homo sapiens
ttacagagctgggtggagagag

SEQ ID NO: 7698294 - DNA, 22 bp, Homo sapiens
ttacagagctcatttctaaggg

SEQ ID NO: 7698295 - DNA, 22 bp, Homo sapiens
ttacagagctcatttctaaggg

SEQ ID NO: 7698296 - DNA, 22 bp, Homo sapiens
ttacacaaaaataagatatggc

SEQ ID NO: 7698297 - DNA, 22 bp, Homo sapiens
ttacacaaaaataagatatggc

SEQ ID NO: 7698298 - DNA, 22 bp, Homo sapiens
ttacacaaaaataagatatggc

SEQ ID NO: 7698299 - DNA, 22 bp, Homo sapiens
ttacacaaaaataagatatggc

SEQ ID NO: 7698300 - DNA, 22 bp, Homo sapiens
ttacacaaaaataagatatggc

SEQ ID NO: 7698301 - DNA, 22 bp, Homo sapiens
ttacacaaaaataagatatggc

SEQ ID NO: 7698302 - DNA, 22 bp, Homo sapiens
ttacacaaaaataagatatggc

SEQ ID NO: 7698303 - DNA, 22 bp, Homo sapiens
ttacacaaacacattccagata

SEQ ID NO: 7698304 - DNA, 22 bp, Homo sapiens
ttacacaaacacattccagata

SEQ ID NO: 7698305 - DNA, 22 bp, Homo sapiens
ttacacaaacacattccagata

SEQ ID NO: 7698306 - DNA, 22 bp, Homo sapiens
ttacacaaaagcaagtgtgtgt

SEQ ID NO: 7698307 - DNA, 22 bp, Homo sapiens
ttacacaaaagcaagtgtgtgt

SEQ ID NO: 7698308 - DNA, 22 bp, Homo sapiens
ttacagaaaagggctttaagag

SEQ ID NO: 7698309 - DNA, 22 bp, Homo sapiens
ttacagaaaagggctttaagag

SEQ ID NO: 7698310 - DNA, 22 bp, Homo sapiens
ttacagaaaagggctttaagag

SEQ ID NO: 7698311 - DNA, 22 bp, Homo sapiens
ttacagaaaagggctttaagag

SEQ ID NO: 7698312 - DNA, 22 bp, Homo sapiens
ttacacttttgacaaacctgag

SEQ ID NO: 7698313 - DNA, 22 bp, Homo sapiens
ttacacttttgacaaacctgag

SEQ ID NO: 7698314 - DNA, 22 bp, Homo sapiens
ttacacttttgacaaacctgag

SEQ ID NO: 7698315 - DNA, 21 bp, Homo sapiens
ttacagaatccatgggaagtc

SEQ ID NO: 7698316 - DNA, 22 bp, Homo sapiens
ttacagaatctactcgtggtga

SEQ ID NO: 7698317 - DNA, 22 bp, Homo sapiens
ttacagaaaaggggttgtcctt

SEQ ID NO: 7698318 - DNA, 22 bp, Homo sapiens
ttacagaaaatgtgttttaact

SEQ ID NO: 7698319 - DNA, 22 bp, Homo sapiens
ttacagaaaatgtgttttaact

SEQ ID NO: 7698320 - DNA, 22 bp, Homo sapiens
ttacagaaaatgtgttttaact

SEQ ID NO: 7698321 - DNA, 22 bp, Homo sapiens
ttacagaaaatgtgttttaact

SEQ ID NO: 7698322 - DNA, 22 bp, Homo sapiens
ttacagaaaaggggttgtcctt

SEQ ID NO: 7698323 - DNA, 22 bp, Homo sapiens
ttacagaaaaggggttgtcctt

SEQ ID NO: 7698324 - DNA, 22 bp, Homo sapiens
ttacagaaaaggggttgtcctt

SEQ ID NO: 7698325 - DNA, 22 bp, Homo sapiens
ttacagaaaagggctttaagag

SEQ ID NO: 7698326 - DNA, 22 bp, Homo sapiens
ttacagaaaagggctttaagag

SEQ ID NO: 7698327 - DNA, 22 bp, Homo sapiens
ttacagaaaagggctttaagag

SEQ ID NO: 7698328 - DNA, 22 bp, Homo sapiens
ttacagaatgttcttccaacag

SEQ ID NO: 7698329 - DNA, 22 bp, Homo sapiens
ttacagaatgttcttccaacag

SEQ ID NO: 7698330 - DNA, 22 bp, Homo sapiens
ttacagaatgttcttccaacag

SEQ ID NO: 7698331 - DNA, 22 bp, Homo sapiens
ttacagaatgttcttccaacag

SEQ ID NO: 7698332 - DNA, 22 bp, Homo sapiens
ttacagaatgttcttccaacag

SEQ ID NO: 7698333 - DNA, 22 bp, Homo sapiens
ttacagaatgttcttccaacag

SEQ ID NO: 7698334 - DNA, 22 bp, Homo sapiens
ttacagaatgtgccatttggtc

SEQ ID NO: 7698335 - DNA, 22 bp, Homo sapiens
ttacagaatgtgccatttggtc

SEQ ID NO: 7698336 - DNA, 22 bp, Homo sapiens
ttacagaatgtgccatttggtc

SEQ ID NO: 7698337 - DNA, 22 bp, Homo sapiens
ttacagaatgtgccatttggtc

SEQ ID NO: 7698338 - DNA, 22 bp, Homo sapiens
ttacagaatctactcgtggtga

SEQ ID NO: 7698339 - DNA, 22 bp, Homo sapiens
ttacagaatctactcgtggtga

SEQ ID NO: 7698340 - DNA, 22 bp, Homo sapiens
ttacagaatgtgccatttggtc

SEQ ID NO: 7698341 - DNA, 22 bp, Homo sapiens
ttacagaatgtgccatttggtc

SEQ ID NO: 7698342 - DNA, 21 bp, Homo sapiens
ttacaaagctacagatgttgc

SEQ ID NO: 7698343 - DNA, 22 bp, Homo sapiens
ttacaaagagtgccagagtgtg

SEQ ID NO: 7698344 - DNA, 21 bp, Homo sapiens
ttacaaagctacagatgttgc

SEQ ID NO: 7698345 - DNA, 22 bp, Homo sapiens
ttacaaaggtagttttgtctat

SEQ ID NO: 7698346 - DNA, 22 bp, Homo sapiens
ttacaaaggtagttttgtctat

SEQ ID NO: 7698347 - DNA, 21 bp, Homo sapiens
ttacaaagctacagatgttgc

SEQ ID NO: 7698348 - DNA, 22 bp, Homo sapiens
ttacaaaggtagttttgtctat

SEQ ID NO: 7698349 - DNA, 22 bp, Homo sapiens
ttacaaaggtagttttgtctat

SEQ ID NO: 7698350 - DNA, 22 bp, Homo sapiens
ttacaaagtgctgcaccatttt

SEQ ID NO: 7698351 - DNA, 22 bp, Homo sapiens
ttacaaagtgctgcaccatttt

SEQ ID NO: 7698352 - DNA, 22 bp, Homo sapiens
ttacaaagtgctgcaccatttt

SEQ ID NO: 7698353 - DNA, 22 bp, Homo sapiens
ttacaaagtgctgcaccatttt

SEQ ID NO: 7698354 - DNA, 22 bp, Homo sapiens
ttacaaagtgctgcaccatttt

SEQ ID NO: 7698355 - DNA, 22 bp, Homo sapiens
ttacaaaggtagttttgtctat

SEQ ID NO: 7698356 - DNA, 22 bp, Homo sapiens
ttacaaagtgctgcaccatttt

SEQ ID NO: 7698357 - DNA, 22 bp, Homo sapiens
ttacaaagtgttatgataaaca

SEQ ID NO: 7698358 - DNA, 22 bp, Homo sapiens
ttacaaagtgttatgataaaca

SEQ ID NO: 7698359 - DNA, 22 bp, Homo sapiens
ttacaaagtgttatgataaaca

SEQ ID NO: 7698360 - DNA, 22 bp, Homo sapiens
ttacaaagtgttatgataaaca

SEQ ID NO: 7698361 - DNA, 22 bp, Homo sapiens
ttacaaagtgttatgataaaca

SEQ ID NO: 7698362 - DNA, 22 bp, Homo sapiens
ttacaaagtgttatgataaaca

SEQ ID NO: 7698363 - DNA, 22 bp, Homo sapiens
ttacaaagtgttatgataaaca

SEQ ID NO: 7698364 - DNA, 22 bp, Homo sapiens
ttacaaagtgttatgataaaca

SEQ ID NO: 7698365 - DNA, 22 bp, Homo sapiens
ttacaaagttctgagttcaaac

SEQ ID NO: 7698366 - DNA, 22 bp, Homo sapiens
ttacaaagttctgagttcaaac

SEQ ID NO: 7698367 - DNA, 22 bp, Homo sapiens
ttacaaagttctgagttcaaac

SEQ ID NO: 7698368 - DNA, 22 bp, Homo sapiens
ttacaaagttctgagttcaaac

SEQ ID NO: 7698369 - DNA, 22 bp, Homo sapiens
ttacaaagttctgagttcaaac

SEQ ID NO: 7698370 - DNA, 22 bp, Homo sapiens
ttacaaagttctgagttcaaac

SEQ ID NO: 7698371 - DNA, 22 bp, Homo sapiens
ttacaaagttctgagttcaaac

SEQ ID NO: 7698372 - DNA, 22 bp, Homo sapiens
ttacaaagttctgagttcaaac

SEQ ID NO: 7698373 - DNA, 22 bp, Homo sapiens
ttacaaagttctgagttcaaac

SEQ ID NO: 7698374 - DNA, 22 bp, Homo sapiens
ttacaaagttctgagttcaaac

SEQ ID NO: 7698375 - DNA, 22 bp, Homo sapiens
ttacaaagtttaaggtggcact

SEQ ID NO: 7698376 - DNA, 22 bp, Homo sapiens
ttacaaagtttaaggtggcact

SEQ ID NO: 7698377 - DNA, 22 bp, Homo sapiens
ttacaaagtttaaggtggcact

SEQ ID NO: 7698378 - DNA, 22 bp, Homo sapiens
ttacaaagagaagttgtagaat

SEQ ID NO: 7698379 - DNA, 22 bp, Homo sapiens
ttacaaagagaagttgtagaat

SEQ ID NO: 7698380 - DNA, 22 bp, Homo sapiens
ttacaaagagaagttgtagaat

SEQ ID NO: 7698381 - DNA, 20 bp, Homo sapiens
ttacaaagaggcatcgcttt

SEQ ID NO: 7698382 - DNA, 20 bp, Homo sapiens
ttacaaagaggcatcgcttt

SEQ ID NO: 7698383 - DNA, 20 bp, Homo sapiens
ttacaaagaggcatcgcttt

SEQ ID NO: 7698384 - DNA, 22 bp, Homo sapiens
ttaattaattagttaagcatgt

SEQ ID NO: 7698385 - DNA, 22 bp, Homo sapiens
ttaattaattagttaagcatgt

SEQ ID NO: 7698386 - DNA, 22 bp, Homo sapiens
ttaattaattagttaagcatgt

SEQ ID NO: 7698387 - DNA, 22 bp, Homo sapiens
ttacaaagaaaattaggcattt

SEQ ID NO: 7698388 - DNA, 22 bp, Homo sapiens
ttaattaattagttaagcatgt

SEQ ID NO: 7698389 - DNA, 22 bp, Homo sapiens
ttaattaattagttaagcatgt

SEQ ID NO: 7698390 - DNA, 22 bp, Homo sapiens
ttaattaagagatactgcagta

SEQ ID NO: 7698391 - DNA, 22 bp, Homo sapiens
ttaattaagagatactgcagta

SEQ ID NO: 7698392 - DNA, 22 bp, Homo sapiens
ttaattaactagccaaccacta

SEQ ID NO: 7698393 - DNA, 22 bp, Homo sapiens
ttaattaactagccaaccacta

SEQ ID NO: 7698394 - DNA, 22 bp, Homo sapiens
ttaattaactagccaaccacta

SEQ ID NO: 7698395 - DNA, 22 bp, Homo sapiens
ttaattaaattcatgagcattg

SEQ ID NO: 7698396 - DNA, 22 bp, Homo sapiens
ttaattaaattcatgagcattg

SEQ ID NO: 7698397 - DNA, 22 bp, Homo sapiens
ttaattaaattcatgagcattg

SEQ ID NO: 7698398 - DNA, 22 bp, Homo sapiens
ttaattaaattcatgagcattg

SEQ ID NO: 7698399 - DNA, 22 bp, Homo sapiens
ttaattaaattcatgagcattg

SEQ ID NO: 7698400 - DNA, 22 bp, Homo sapiens
ttaattaaattcatgagcattg

SEQ ID NO: 7698401 - DNA, 22 bp, Homo sapiens
ttaatgttttaagttatagaga

SEQ ID NO: 7698402 - DNA, 22 bp, Homo sapiens
ttaatgttttaagttatagaga

SEQ ID NO: 7698403 - DNA, 22 bp, Homo sapiens
ttaatgttttaagttatagaga

SEQ ID NO: 7698404 - DNA, 22 bp, Homo sapiens
ttaatgttttaagttatagaga

SEQ ID NO: 7698405 - DNA, 22 bp, Homo sapiens
ttaatgttttaagttatagaga

SEQ ID NO: 7698406 - DNA, 22 bp, Homo sapiens
ttaatgttttaagttatagaga

SEQ ID NO: 7698407 - DNA, 22 bp, Homo sapiens
ttaatgttttaagttatagaga

SEQ ID NO: 7698408 - DNA, 22 bp, Homo sapiens
ttacaacaaaggcacgtgcatg

SEQ ID NO: 7698409 - DNA, 22 bp, Homo sapiens
ttacaacaaaggcacgtgcatg

SEQ ID NO: 7698410 - DNA, 22 bp, Homo sapiens
ttacaacaaaggcacgtgcatg

SEQ ID NO: 7698411 - DNA, 17 bp, Homo sapiens
ttacaacaattcatgag

SEQ ID NO: 7698412 - DNA, 17 bp, Homo sapiens
ttacaacaattcatgag

SEQ ID NO: 7698413 - DNA, 17 bp, Homo sapiens
ttacaacaattcatgag

SEQ ID NO: 7698414 - DNA, 17 bp, Homo sapiens
ttacaacaattcatgag

SEQ ID NO: 7698415 - DNA, 17 bp, Homo sapiens
ttacaacaattcatgag

SEQ ID NO: 7698416 - DNA, 22 bp, Homo sapiens
ttacaacaccaggcagtatcct

SEQ ID NO: 7698417 - DNA, 22 bp, Homo sapiens
ttacaacaccaggcagtatcct

SEQ ID NO: 7698418 - DNA, 22 bp, Homo sapiens
ttacaacaccaggcagtatcct

SEQ ID NO: 7698419 - DNA, 17 bp, Homo sapiens
ttacaacaattcatgag

SEQ ID NO: 7698420 - DNA, 17 bp, Homo sapiens
ttacaacaattcatgag

SEQ ID NO: 7698421 - DNA, 17 bp, Homo sapiens
ttacaacaattcatgag

SEQ ID NO: 7698422 - DNA, 22 bp, Homo sapiens
ttacaacagacacatattctaa

SEQ ID NO: 7698423 - DNA, 22 bp, Homo sapiens
ttacaacagacacatattctaa

SEQ ID NO: 7698424 - DNA, 23 bp, Homo sapiens
ttacaacagtgtccatatttgta

SEQ ID NO: 7698425 - DNA, 23 bp, Homo sapiens
ttacaacagtgtccatatttgta

SEQ ID NO: 7698426 - DNA, 22 bp, Homo sapiens
ttacaacagcgatttacctgtc

SEQ ID NO: 7698427 - DNA, 22 bp, Homo sapiens
ttacaacagcgatttacctgtc

SEQ ID NO: 7698428 - DNA, 22 bp, Homo sapiens
ttacaacagcgatttacctgtc

SEQ ID NO: 7698429 - DNA, 22 bp, Homo sapiens
ttacaacagcgatttacctgtc

SEQ ID NO: 7698430 - DNA, 22 bp, Homo sapiens
ttacaacagacacatattctaa

SEQ ID NO: 7698431 - DNA, 22 bp, Homo sapiens
ttacaacagacacatattctaa

SEQ ID NO: 7698432 - DNA, 22 bp, Homo sapiens
ttacaacagacacatattctaa

SEQ ID NO: 7698433 - DNA, 22 bp, Homo sapiens
ttacaacagacacatattctaa

SEQ ID NO: 7698434 - DNA, 22 bp, Homo sapiens
ttacaacagacacatattctaa

SEQ ID NO: 7698435 - DNA, 22 bp, Homo sapiens
ttacaacagacacatattctaa

SEQ ID NO: 7698436 - DNA, 22 bp, Homo sapiens
ttacaacactacttatccttga

SEQ ID NO: 7698437 - DNA, 22 bp, Homo sapiens
ttacaacactacttatccttga

SEQ ID NO: 7698438 - DNA, 22 bp, Homo sapiens
ttacaacactacttatccttga

SEQ ID NO: 7698439 - DNA, 22 bp, Homo sapiens
ttacaacagacacatattctaa

SEQ ID NO: 7698440 - DNA, 22 bp, Homo sapiens
ttacaacactacttatccttga

SEQ ID NO: 7698441 - DNA, 22 bp, Homo sapiens
ttacaacatatttagcttgatt

SEQ ID NO: 7698442 - DNA, 22 bp, Homo sapiens
ttacaacatatttagcttgatt

SEQ ID NO: 7698443 - DNA, 22 bp, Homo sapiens
ttacaacatatttagcttgatt

SEQ ID NO: 7698444 - DNA, 22 bp, Homo sapiens
ttacaacatatgataggagtct

SEQ ID NO: 7698445 - DNA, 22 bp, Homo sapiens
ttacaacatatgataggagtct

SEQ ID NO: 7698446 - DNA, 23 bp, Homo sapiens
ttacaacagtgtccatatttgta

SEQ ID NO: 7698447 - DNA, 23 bp, Homo sapiens
ttacaacagtgtccatatttgta

SEQ ID NO: 7698448 - DNA, 21 bp, Homo sapiens
ttacaacatttgtgttctatg

SEQ ID NO: 7698449 - DNA, 23 bp, Homo sapiens
ttacaactatttgccatgttgtt

SEQ ID NO: 7698450 - DNA, 17 bp, Homo sapiens
ttacaacgtcatctctg

SEQ ID NO: 7698451 - DNA, 21 bp, Homo sapiens
ttacaacatttgtgttctatg

SEQ ID NO: 7698452 - DNA, 21 bp, Homo sapiens
ttacaacatttgtgttctatg

SEQ ID NO: 7698453 - DNA, 21 bp, Homo sapiens
ttacaacatttgtgttctatg

SEQ ID NO: 7698454 - DNA, 21 bp, Homo sapiens
ttacaacatttgtgttctatg

SEQ ID NO: 7698455 - DNA, 22 bp, Homo sapiens
ttacaacttgcagaggatgttg

SEQ ID NO: 7698456 - DNA, 22 bp, Homo sapiens
ttacaactttcctgtgtcaaat

SEQ ID NO: 7698457 - DNA, 22 bp, Homo sapiens
ttacaactttcctgtgtcaaat

SEQ ID NO: 7698458 - DNA, 22 bp, Homo sapiens
ttacaactggtgaattttatgg

SEQ ID NO: 7698459 - DNA, 22 bp, Homo sapiens
ttacaacttgcagaggatgttg

SEQ ID NO: 7698460 - DNA, 22 bp, Homo sapiens
ttacaagacacagtgctgaagg

SEQ ID NO: 7698461 - DNA, 22 bp, Homo sapiens
ttacaagacacagtgctgaagg

SEQ ID NO: 7698462 - DNA, 22 bp, Homo sapiens
ttacaactttcctgtgtcaaat

SEQ ID NO: 7698463 - DNA, 22 bp, Homo sapiens
ttacaagacacagtgctgaagg

SEQ ID NO: 7698464 - DNA, 22 bp, Homo sapiens
ttacaagacacagtgctgaagg

SEQ ID NO: 7698465 - DNA, 22 bp, Homo sapiens
ttacaagacacagtgctgaagg

SEQ ID NO: 7698466 - DNA, 22 bp, Homo sapiens
ttacaagacacagtgctgaagg

SEQ ID NO: 7698467 - DNA, 22 bp, Homo sapiens
ttacaactctgtcagtatagct

SEQ ID NO: 7698468 - DNA, 22 bp, Homo sapiens
ttacaactctgaactacagagg

SEQ ID NO: 7698469 - DNA, 23 bp, Homo sapiens
ttacaactatttgccatgttgtt

SEQ ID NO: 7698470 - DNA, 22 bp, Homo sapiens
ttacaactctagagaaaagaaa

SEQ ID NO: 7698471 - DNA, 22 bp, Homo sapiens
ttacaactggtgaattttatgg

SEQ ID NO: 7698472 - DNA, 22 bp, Homo sapiens
ttacaactgaagctaatgtgct

SEQ ID NO: 7698473 - DNA, 22 bp, Homo sapiens
ttacaactgaagctaatgtgct

SEQ ID NO: 7698474 - DNA, 22 bp, Homo sapiens
ttacaactgaagctaatgtgct

SEQ ID NO: 7698475 - DNA, 22 bp, Homo sapiens
ttacaactgaagctaatgtgct

SEQ ID NO: 7698476 - DNA, 22 bp, Homo sapiens
ttacaactgaagctaatgtgct

SEQ ID NO: 7698477 - DNA, 22 bp, Homo sapiens
ttacaactgaagctaatgtgct

SEQ ID NO: 7698478 - DNA, 22 bp, Homo sapiens
ttaaagatgcagctttagagaa

SEQ ID NO: 7698479 - DNA, 22 bp, Homo sapiens
ttaaagatgcagctttagagaa

SEQ ID NO: 7698480 - DNA, 22 bp, Homo sapiens
ttaaagatgcagctttagagaa

SEQ ID NO: 7698481 - DNA, 22 bp, Homo sapiens
ttaaagatgcagctttagagaa

SEQ ID NO: 7698482 - DNA, 22 bp, Homo sapiens
ttaaagattctgaggctgatta

SEQ ID NO: 7698483 - DNA, 22 bp, Homo sapiens
ttaaagattctgaggctgatta

SEQ ID NO: 7698484 - DNA, 22 bp, Homo sapiens
ttaaagagtttattacttgtaa

SEQ ID NO: 7698485 - DNA, 22 bp, Homo sapiens
ttaaagagtctactgcacatcc

SEQ ID NO: 7698486 - DNA, 22 bp, Homo sapiens
ttaaagagtttattacttgtaa

SEQ ID NO: 7698487 - DNA, 22 bp, Homo sapiens
ttaaagagtttattacttgtaa

SEQ ID NO: 7698488 - DNA, 22 bp, Homo sapiens
ttaaagagtttattacttgtaa

SEQ ID NO: 7698489 - DNA, 22 bp, Homo sapiens
ttaaagcaaccatcaatttgga

SEQ ID NO: 7698490 - DNA, 22 bp, Homo sapiens
ttaaagcaacctcagccctctt

SEQ ID NO: 7698491 - DNA, 22 bp, Homo sapiens
ttaaagcaaccatcaatttgga

SEQ ID NO: 7698492 - DNA, 22 bp, Homo sapiens
ttaaagcaaaaactaggatgga

SEQ ID NO: 7698493 - DNA, 22 bp, Homo sapiens
ttaaagcagtttgtatacatgg

SEQ ID NO: 7698494 - DNA, 22 bp, Homo sapiens
ttaataaagtatgaattggaaa

SEQ ID NO: 7698495 - DNA, 22 bp, Homo sapiens
ttaataaagtatgaattggaaa

SEQ ID NO: 7698496 - DNA, 22 bp, Homo sapiens
ttaaagcagtttgtatacatgg

SEQ ID NO: 7698497 - DNA, 22 bp, Homo sapiens
ttaataaagtatgaattggaaa

SEQ ID NO: 7698498 - DNA, 22 bp, Homo sapiens
ttaataaagtatgaattggaaa

SEQ ID NO: 7698499 - DNA, 22 bp, Homo sapiens
ttaataaagtatgaattggaaa

SEQ ID NO: 7698500 - DNA, 22 bp, Homo sapiens
ttaataaagtatgaattggaaa

SEQ ID NO: 7698501 - DNA, 22 bp, Homo sapiens
ttaataaagtatgaattggaaa

SEQ ID NO: 7698502 - DNA, 22 bp, Homo sapiens
ttaaagcagtttgtatacatgg

SEQ ID NO: 7698503 - DNA, 22 bp, Homo sapiens
ttaaagcagtttgtatacatgg

SEQ ID NO: 7698504 - DNA, 22 bp, Homo sapiens
ttaaagcaggcatcattcctca

SEQ ID NO: 7698505 - DNA, 22 bp, Homo sapiens
ttaaagcagtttgtatacatgg

SEQ ID NO: 7698506 - DNA, 22 bp, Homo sapiens
ttaaagcaggcatcattcctca

SEQ ID NO: 7698507 - DNA, 22 bp, Homo sapiens
ttaaagagggaaagacttcaga

SEQ ID NO: 7698508 - DNA, 22 bp, Homo sapiens
ttaaagaggtagttaggtttaa

SEQ ID NO: 7698509 - DNA, 22 bp, Homo sapiens
ttaaagaggtagttaggtttaa

SEQ ID NO: 7698510 - DNA, 22 bp, Homo sapiens
ttaaagagggaaagacttcaga

SEQ ID NO: 7698511 - DNA, 22 bp, Homo sapiens
ttaaagagtaatcataggtcaa

SEQ ID NO: 7698512 - DNA, 22 bp, Homo sapiens
ttaaagagtctactgcacatcc

SEQ ID NO: 7698513 - DNA, 22 bp, Homo sapiens
ttaaagaggtagttaggtttaa

SEQ ID NO: 7698514 - DNA, 22 bp, Homo sapiens
ttaaagagtctactgcacatcc

SEQ ID NO: 7698515 - DNA, 22 bp, Homo sapiens
ttaaagagtctactgcacatcc

SEQ ID NO: 7698516 - DNA, 22 bp, Homo sapiens
ttaaagaggcaggttaaataat

SEQ ID NO: 7698517 - DNA, 22 bp, Homo sapiens
ttaaagaggcaggttaaataat

SEQ ID NO: 7698518 - DNA, 22 bp, Homo sapiens
ttaaagaggcaggttaaataat

SEQ ID NO: 7698519 - DNA, 22 bp, Homo sapiens
ttaaagaggcaggttaaataat

SEQ ID NO: 7698520 - DNA, 22 bp, Homo sapiens
ttaaagaggcaggttaaataat

SEQ ID NO: 7698521 - DNA, 22 bp, Homo sapiens
ttaaagaggcatgggaatgtat

SEQ ID NO: 7698522 - DNA, 22 bp, Homo sapiens
ttaaagaggcatgggaatgtat

SEQ ID NO: 7698523 - DNA, 22 bp, Homo sapiens
ttaaagaggcatgggaatgtat

SEQ ID NO: 7698524 - DNA, 22 bp, Homo sapiens
ttaaagagaaagtgtttgtctt

SEQ ID NO: 7698525 - DNA, 22 bp, Homo sapiens
ttaaagagaactcaatgaatga

SEQ ID NO: 7698526 - DNA, 22 bp, Homo sapiens
ttaaagagaactcaatgaatga

SEQ ID NO: 7698527 - DNA, 22 bp, Homo sapiens
ttaaagagaactcaatgaatga

SEQ ID NO: 7698528 - DNA, 22 bp, Homo sapiens
ttaaagagaactcaatgaatga

SEQ ID NO: 7698529 - DNA, 22 bp, Homo sapiens
ttaaagagaaagtgtttgtctt

SEQ ID NO: 7698530 - DNA, 22 bp, Homo sapiens
ttaaagagaaagtgtttgtctt

SEQ ID NO: 7698531 - DNA, 22 bp, Homo sapiens
ttaaagaatagtgcccctattg

SEQ ID NO: 7698532 - DNA, 22 bp, Homo sapiens
ttaaagacatcacagattacac

SEQ ID NO: 7698533 - DNA, 22 bp, Homo sapiens
ttaaagacatcacagattacac

SEQ ID NO: 7698534 - DNA, 22 bp, Homo sapiens
ttaaagaatagtgcccctattg

SEQ ID NO: 7698535 - DNA, 22 bp, Homo sapiens
ttaaagaatagtgcccctattg

SEQ ID NO: 7698536 - DNA, 22 bp, Homo sapiens
ttaaagaatagtgcccctattg

SEQ ID NO: 7698537 - DNA, 23 bp, Homo sapiens
ttaaacttcagtgcagaacactc

SEQ ID NO: 7698538 - DNA, 22 bp, Homo sapiens
ttaaactgggttagactgaatt

SEQ ID NO: 7698539 - DNA, 23 bp, Homo sapiens
ttaaacttcagtgcagaacactc

SEQ ID NO: 7698540 - DNA, 22 bp, Homo sapiens
ttaaactgcttgaattgggttt

SEQ ID NO: 7698541 - DNA, 22 bp, Homo sapiens
ttaaactgcagactcagtgttc

SEQ ID NO: 7698542 - DNA, 22 bp, Homo sapiens
ttaaaccatagtttaacataag

SEQ ID NO: 7698543 - DNA, 22 bp, Homo sapiens
ttaaaccatagtttaacataag

SEQ ID NO: 7698544 - DNA, 22 bp, Homo sapiens
ttaaactgcagactcagtgttc

SEQ ID NO: 7698545 - DNA, 22 bp, Homo sapiens
ttaaactgcagactcagtgttc

SEQ ID NO: 7698546 - DNA, 22 bp, Homo sapiens
ttaataaagtatgaattggaaa

SEQ ID NO: 7698547 - DNA, 22 bp, Homo sapiens
ttaataaagtatgaattggaaa

SEQ ID NO: 7698548 - DNA, 22 bp, Homo sapiens
ttaataaagtatgaattggaaa

SEQ ID NO: 7698549 - DNA, 22 bp, Homo sapiens
ttaataaagtatgaattggaaa

SEQ ID NO: 7698550 - DNA, 22 bp, Homo sapiens
ttaataaagtatgaattggaaa

SEQ ID NO: 7698551 - DNA, 22 bp, Homo sapiens
ttaataaagtatgaattggaaa

SEQ ID NO: 7698552 - DNA, 22 bp, Homo sapiens
ttaataaagtatgaattggaaa

SEQ ID NO: 7698553 - DNA, 22 bp, Homo sapiens
ttaataataatgagcccatttt

SEQ ID NO: 7698554 - DNA, 22 bp, Homo sapiens
ttaatacaactgttgtcactgg

SEQ ID NO: 7698555 - DNA, 22 bp, Homo sapiens
ttaatacaactgttgtcactgg

SEQ ID NO: 7698556 - DNA, 22 bp, Homo sapiens
ttaatacaactgttgtcactgg

SEQ ID NO: 7698557 - DNA, 22 bp, Homo sapiens
ttaataataatgagcccatttt

SEQ ID NO: 7698558 - DNA, 22 bp, Homo sapiens
ttaataataatgagcccatttt

SEQ ID NO: 7698559 - DNA, 22 bp, Homo sapiens
ttaataataatgagcccatttt

SEQ ID NO: 7698560 - DNA, 22 bp, Homo sapiens
ttaataataatgagcccatttt

SEQ ID NO: 7698561 - DNA, 22 bp, Homo sapiens
ttaataacattgtgtatcaccc

SEQ ID NO: 7698562 - DNA, 22 bp, Homo sapiens
ttaataacattgtgtatcaccc

SEQ ID NO: 7698563 - DNA, 22 bp, Homo sapiens
ttaataacattgtgtatcaccc

SEQ ID NO: 7698564 - DNA, 22 bp, Homo sapiens
ttaataagtagtagttattgtt

SEQ ID NO: 7698565 - DNA, 22 bp, Homo sapiens
ttaatacaagcatatgcacaca

SEQ ID NO: 7698566 - DNA, 22 bp, Homo sapiens
ttaatacaagcatatgcacaca

SEQ ID NO: 7698567 - DNA, 22 bp, Homo sapiens
ttaatacaagcatatgcacaca

SEQ ID NO: 7698568 - DNA, 22 bp, Homo sapiens
ttaatacaagcatatgcacaca

SEQ ID NO: 7698569 - DNA, 22 bp, Homo sapiens
ttaatacactatatgatcacat

SEQ ID NO: 7698570 - DNA, 22 bp, Homo sapiens
ttaatacactatatgatcacat

SEQ ID NO: 7698571 - DNA, 22 bp, Homo sapiens
ttaatacactatatgatcacat

SEQ ID NO: 7698572 - DNA, 22 bp, Homo sapiens
ttaatacaagcatatgcacaca

SEQ ID NO: 7698573 - DNA, 22 bp, Homo sapiens
ttaatacaagcatatgcacaca

SEQ ID NO: 7698574 - DNA, 22 bp, Homo sapiens
ttaatacaagcatatgcacaca

SEQ ID NO: 7698575 - DNA, 22 bp, Homo sapiens
ttaatacaagcatatgcacaca

SEQ ID NO: 7698576 - DNA, 22 bp, Homo sapiens
ttaatacaagcatatgcacaca

SEQ ID NO: 7698577 - DNA, 22 bp, Homo sapiens
ttaatacaactgttgtcactgg

SEQ ID NO: 7698578 - DNA, 22 bp, Homo sapiens
ttaatacaactgttgtcactgg

SEQ ID NO: 7698579 - DNA, 22 bp, Homo sapiens
ttaatacaactgttgtcactgg

SEQ ID NO: 7698580 - DNA, 22 bp, Homo sapiens
ttaatacaactgttgtcactgg

SEQ ID NO: 7698581 - DNA, 22 bp, Homo sapiens
ttaatacaactgttgtcactgg

SEQ ID NO: 7698582 - DNA, 22 bp, Homo sapiens
ttaatacaactgttgtcactgg

SEQ ID NO: 7698583 - DNA, 22 bp, Homo sapiens
ttaatacaactgttgtcactgg

SEQ ID NO: 7698584 - DNA, 22 bp, Homo sapiens
ttaatacaactgttgtcactgg

SEQ ID NO: 7698585 - DNA, 22 bp, Homo sapiens
ttaatacaactgttgtcactgg

SEQ ID NO: 7698586 - DNA, 22 bp, Homo sapiens
ttaatacaagcatatgcacaca

SEQ ID NO: 7698587 - DNA, 22 bp, Homo sapiens
ttaatacaagcatatgcacaca

SEQ ID NO: 7698588 - DNA, 22 bp, Homo sapiens
ttaatacaagcatatgcacaca

SEQ ID NO: 7698589 - DNA, 22 bp, Homo sapiens
ttaatacaagcatatgcacaca

SEQ ID NO: 7698590 - DNA, 22 bp, Homo sapiens
ttaatacaagcatatgcacaca

SEQ ID NO: 7698591 - DNA, 22 bp, Homo sapiens
ttaatgtcaacatttctgaaga

SEQ ID NO: 7698592 - DNA, 22 bp, Homo sapiens
ttaatgtcaacatttctgaaga

SEQ ID NO: 7698593 - DNA, 22 bp, Homo sapiens
ttaatgtcactgttttctgggc

SEQ ID NO: 7698594 - DNA, 22 bp, Homo sapiens
ttaatggccccattttatgtct

SEQ ID NO: 7698595 - DNA, 22 bp, Homo sapiens
ttaatggcatgttgcaaaattt

SEQ ID NO: 7698596 - DNA, 22 bp, Homo sapiens
ttaatggccccattttatgtct

SEQ ID NO: 7698597 - DNA, 22 bp, Homo sapiens
ttaatgtatggggttgagatga

SEQ ID NO: 7698598 - DNA, 22 bp, Homo sapiens
ttaatggattggaggtttcaat

SEQ ID NO: 7698599 - DNA, 22 bp, Homo sapiens
ttaatggcagggcagaatatta

SEQ ID NO: 7698600 - DNA, 22 bp, Homo sapiens
ttaatggcagggcagaatatta

SEQ ID NO: 7698601 - DNA, 22 bp, Homo sapiens
ttaatggcagggcagaatatta

SEQ ID NO: 7698602 - DNA, 22 bp, Homo sapiens
ttaatgcttgtctagatcttct

SEQ ID NO: 7698603 - DNA, 22 bp, Homo sapiens
ttaatgcttacagtgtcctgcg

SEQ ID NO: 7698604 - DNA, 22 bp, Homo sapiens
ttaatggactaggcagttgtaa

SEQ ID NO: 7698605 - DNA, 22 bp, Homo sapiens
ttaatggaacagcatgcataga

SEQ ID NO: 7698606 - DNA, 22 bp, Homo sapiens
ttaatggaaatatgtttatacc

SEQ ID NO: 7698607 - DNA, 22 bp, Homo sapiens
ttaatgcttgtctagatcttct

SEQ ID NO: 7698608 - DNA, 21 bp, Homo sapiens
ttaatgctatgcagaaaatct

SEQ ID NO: 7698609 - DNA, 21 bp, Homo sapiens
ttaatgctatgcagaaaatct

SEQ ID NO: 7698610 - DNA, 22 bp, Homo sapiens
ttaatacatttcagactgttat

SEQ ID NO: 7698611 - DNA, 22 bp, Homo sapiens
ttaatacatttcagactgttat

SEQ ID NO: 7698612 - DNA, 22 bp, Homo sapiens
ttaatacatttcagactgttat

SEQ ID NO: 7698613 - DNA, 22 bp, Homo sapiens
ttaatacagaagcaagacactg

SEQ ID NO: 7698614 - DNA, 22 bp, Homo sapiens
ttaatacagaagcaagacactg

SEQ ID NO: 7698615 - DNA, 22 bp, Homo sapiens
ttaatacagaagcaagacactg

SEQ ID NO: 7698616 - DNA, 22 bp, Homo sapiens
ttaatacagaagcaagacactg

SEQ ID NO: 7698617 - DNA, 22 bp, Homo sapiens
ttaatacagaagcaagacactg

SEQ ID NO: 7698618 - DNA, 22 bp, Homo sapiens
ttaatacagaagcaagacactg

SEQ ID NO: 7698619 - DNA, 22 bp, Homo sapiens
ttaatacagaagcaagacactg

SEQ ID NO: 7698620 - DNA, 22 bp, Homo sapiens
ttaatacactatatgatcacat

SEQ ID NO: 7698621 - DNA, 22 bp, Homo sapiens
ttaatacactatatgatcacat

SEQ ID NO: 7698622 - DNA, 22 bp, Homo sapiens
ttaatacactatatgatcacat

SEQ ID NO: 7698623 - DNA, 22 bp, Homo sapiens
ttaatacactatatgatcacat

SEQ ID NO: 7698624 - DNA, 22 bp, Homo sapiens
ttaatacatttcagactgttat

SEQ ID NO: 7698625 - DNA, 22 bp, Homo sapiens
ttaatacagtctccagaagtaa

SEQ ID NO: 7698626 - DNA, 22 bp, Homo sapiens
ttaatacagtctccagaagtaa

SEQ ID NO: 7698627 - DNA, 22 bp, Homo sapiens
ttaatacagtctccagaagtaa

SEQ ID NO: 7698628 - DNA, 22 bp, Homo sapiens
ttaatacagtctccagaagtaa

SEQ ID NO: 7698629 - DNA, 22 bp, Homo sapiens
ttaatacagtctccagaagtaa

SEQ ID NO: 7698630 - DNA, 22 bp, Homo sapiens
ttaatacagtctccagaagtaa

SEQ ID NO: 7698631 - DNA, 22 bp, Homo sapiens
ttaatacagaagcaagacactg

SEQ ID NO: 7698632 - DNA, 22 bp, Homo sapiens
ttaatacagtctccagaagtaa

SEQ ID NO: 7698633 - DNA, 22 bp, Homo sapiens
ttaatacagtctccagaagtaa

SEQ ID NO: 7698634 - DNA, 22 bp, Homo sapiens
ttaatacagtctccagaagtaa

SEQ ID NO: 7698635 - DNA, 22 bp, Homo sapiens
ttaatacagtctccagaagtaa

SEQ ID NO: 7698636 - DNA, 22 bp, Homo sapiens
ttaatacagtctccagaagtaa

SEQ ID NO: 7698637 - DNA, 22 bp, Homo sapiens
ttatttggaaatatggcttctg

SEQ ID NO: 7698638 - DNA, 22 bp, Homo sapiens
ttatttggatttagcttatcaa

SEQ ID NO: 7698639 - DNA, 22 bp, Homo sapiens
ttatttggaaatatggcttctg

SEQ ID NO: 7698640 - DNA, 22 bp, Homo sapiens
ttatttggaaatatggcttctg

SEQ ID NO: 7698641 - DNA, 22 bp, Homo sapiens
ttatttggaaatatggcttctg

SEQ ID NO: 7698642 - DNA, 23 bp, Homo sapiens
ttatttggattttagtggaaaga

SEQ ID NO: 7698643 - DNA, 23 bp, Homo sapiens
ttatttggattttagtggaaaga

SEQ ID NO: 7698644 - DNA, 22 bp, Homo sapiens
ttatttggcaatgcttcaccat

SEQ ID NO: 7698645 - DNA, 22 bp, Homo sapiens
ttatttggatttagcttatcaa

SEQ ID NO: 7698646 - DNA, 22 bp, Homo sapiens
ttatttgcccatgtttagcaga

SEQ ID NO: 7698647 - DNA, 22 bp, Homo sapiens
ttatttgcccatgtttagcaga

SEQ ID NO: 7698648 - DNA, 20 bp, Homo sapiens
ttatttgctctttatctgca

SEQ ID NO: 7698649 - DNA, 22 bp, Homo sapiens
ttatttgctgatttcagtttca

SEQ ID NO: 7698650 - DNA, 22 bp, Homo sapiens
ttatttgcccatgtttagcaga

SEQ ID NO: 7698651 - DNA, 22 bp, Homo sapiens
ttatttgattagtaaacctgta

SEQ ID NO: 7698652 - DNA, 22 bp, Homo sapiens
ttatttgattagtaaacctgta

SEQ ID NO: 7698653 - DNA, 22 bp, Homo sapiens
ttatttgccagaatttctcttg

SEQ ID NO: 7698654 - DNA, 22 bp, Homo sapiens
ttatttgccagaatttctcttg

SEQ ID NO: 7698655 - DNA, 22 bp, Homo sapiens
ttatttggttgctgacttggaa

SEQ ID NO: 7698656 - DNA, 22 bp, Homo sapiens
ttatttggttgctgacttggaa

SEQ ID NO: 7698657 - DNA, 22 bp, Homo sapiens
ttatttggttgctgacttggaa

SEQ ID NO: 7698658 - DNA, 22 bp, Homo sapiens
ttatttgtaaaggtccatagta

SEQ ID NO: 7698659 - DNA, 22 bp, Homo sapiens
ttatttgtaaaggtccatagta

SEQ ID NO: 7698660 - DNA, 22 bp, Homo sapiens
ttatttgtaaaggtccatagta

SEQ ID NO: 7698661 - DNA, 22 bp, Homo sapiens
ttatttgggtttgagtgtggca

SEQ ID NO: 7698662 - DNA, 22 bp, Homo sapiens
ttatttggcaatgcttcaccat

SEQ ID NO: 7698663 - DNA, 22 bp, Homo sapiens
ttatttggttattgtaattggg

SEQ ID NO: 7698664 - DNA, 22 bp, Homo sapiens
ttatttggttgctgacttggaa

SEQ ID NO: 7698665 - DNA, 22 bp, Homo sapiens
ttatttgtgaatcatttatcta

SEQ ID NO: 7698666 - DNA, 22 bp, Homo sapiens
ttatttgtgaatcatttatcta

SEQ ID NO: 7698667 - DNA, 22 bp, Homo sapiens
ttatttgtgaatcatttatcta

SEQ ID NO: 7698668 - DNA, 22 bp, Homo sapiens
ttatttgtgaatcatttatcta

SEQ ID NO: 7698669 - DNA, 22 bp, Homo sapiens
ttatttgtggcatatgagacga

SEQ ID NO: 7698670 - DNA, 22 bp, Homo sapiens
ttatttgtgaatcatttatcta

SEQ ID NO: 7698671 - DNA, 22 bp, Homo sapiens
ttatttgtgaatcatttatcta

SEQ ID NO: 7698672 - DNA, 22 bp, Homo sapiens
ttatttcttgtctatgtagcca

SEQ ID NO: 7698673 - DNA, 20 bp, Homo sapiens
ttatttctcattctcctact

SEQ ID NO: 7698674 - DNA, 22 bp, Homo sapiens
ttatttcttgtctatgtagcca

SEQ ID NO: 7698675 - DNA, 22 bp, Homo sapiens
ttatttcttgtctatgtagcca

SEQ ID NO: 7698676 - DNA, 22 bp, Homo sapiens
ttatttcttgtctatgtagcca

SEQ ID NO: 7698677 - DNA, 22 bp, Homo sapiens
ttatttcttgtctatgtagcca

SEQ ID NO: 7698678 - DNA, 22 bp, Homo sapiens
ttatttcttgtctatgtagcca

SEQ ID NO: 7698679 - DNA, 22 bp, Homo sapiens
ttatttgaatgatggcacaatt

SEQ ID NO: 7698680 - DNA, 22 bp, Homo sapiens
ttatttgaatgatggcacaatt

SEQ ID NO: 7698681 - DNA, 22 bp, Homo sapiens
ttatttgaatgatggcacaatt

SEQ ID NO: 7698682 - DNA, 22 bp, Homo sapiens
ttatttgaatctggctagagaa

SEQ ID NO: 7698683 - DNA, 22 bp, Homo sapiens
ttatttgaatctggctagagaa

SEQ ID NO: 7698684 - DNA, 22 bp, Homo sapiens
ttatttcttgtctatgtagcca

SEQ ID NO: 7698685 - DNA, 22 bp, Homo sapiens
ttatttgaaaagaaggttacgt

SEQ ID NO: 7698686 - DNA, 22 bp, Homo sapiens
ttatttgacttcttgctatgct

SEQ ID NO: 7698687 - DNA, 22 bp, Homo sapiens
ttatttgacttcttgctatgct

SEQ ID NO: 7698688 - DNA, 22 bp, Homo sapiens
ttatttgacttcttgctatgct

SEQ ID NO: 7698689 - DNA, 20 bp, Homo sapiens
ttatttctcattctcctact

SEQ ID NO: 7698690 - DNA, 20 bp, Homo sapiens
ttatttctcattctcctact

SEQ ID NO: 7698691 - DNA, 22 bp, Homo sapiens
ttatttctactattttgcctga

SEQ ID NO: 7698692 - DNA, 22 bp, Homo sapiens
ttatttctactattttgcctga

SEQ ID NO: 7698693 - DNA, 22 bp, Homo sapiens
ttatttctactattttgcctga

SEQ ID NO: 7698694 - DNA, 22 bp, Homo sapiens
ttatttctactattttgcctga

SEQ ID NO: 7698695 - DNA, 22 bp, Homo sapiens
ttatttcctagggaatttgcct

SEQ ID NO: 7698696 - DNA, 22 bp, Homo sapiens
ttatttcctctctaatagggta

SEQ ID NO: 7698697 - DNA, 22 bp, Homo sapiens
ttatttcctagggaatttgcct

SEQ ID NO: 7698698 - DNA, 22 bp, Homo sapiens
ttatttcctgacacagctgatt

SEQ ID NO: 7698699 - DNA, 22 bp, Homo sapiens
ttatttcctctctaatagggta

SEQ ID NO: 7698700 - DNA, 22 bp, Homo sapiens
ttatttcctgacacagctgatt

SEQ ID NO: 7698701 - DNA, 22 bp, Homo sapiens
ttatttcctgacacagctgatt

SEQ ID NO: 7698702 - DNA, 22 bp, Homo sapiens
ttatttcctgacacagctgatt

SEQ ID NO: 7698703 - DNA, 22 bp, Homo sapiens
ttatttcctgacacagctgatt

SEQ ID NO: 7698704 - DNA, 22 bp, Homo sapiens
ttcacatttcataccacagctt

SEQ ID NO: 7698705 - DNA, 20 bp, Homo sapiens
ttcacatttctgtagtgatt

SEQ ID NO: 7698706 - DNA, 22 bp, Homo sapiens
ttcacatttctctgctgtttga

SEQ ID NO: 7698707 - DNA, 22 bp, Homo sapiens
ttcacatttctctgctgtttga

SEQ ID NO: 7698708 - DNA, 22 bp, Homo sapiens
ttcacatttctctgctgtttga

SEQ ID NO: 7698709 - DNA, 22 bp, Homo sapiens
ttcacatttctctgctgtttga

SEQ ID NO: 7698710 - DNA, 22 bp, Homo sapiens
ttcacatttgaaaggaaagata

SEQ ID NO: 7698711 - DNA, 20 bp, Homo sapiens
ttcacatttctgtagtgatt

SEQ ID NO: 7698712 - DNA, 22 bp, Homo sapiens
ttcacatttgaaaggaaagata

SEQ ID NO: 7698713 - DNA, 22 bp, Homo sapiens
ttcacatttgaaaggaaagata

SEQ ID NO: 7698714 - DNA, 22 bp, Homo sapiens
ttcacatttgcccttatgtgtg

SEQ ID NO: 7698715 - DNA, 22 bp, Homo sapiens
ttcacatttgcccttatgtgtg

SEQ ID NO: 7698716 - DNA, 22 bp, Homo sapiens
ttcacatttgcccttatgtgtg

SEQ ID NO: 7698717 - DNA, 22 bp, Homo sapiens
ttcacatttgcccttatgtgtg

SEQ ID NO: 7698718 - DNA, 22 bp, Homo sapiens
ttcacatttgcccttatgtgtg

SEQ ID NO: 7698719 - DNA, 19 bp, Homo sapiens
ttcacattttgctctgagg

SEQ ID NO: 7698720 - DNA, 19 bp, Homo sapiens
ttcacattttgctctgagg

SEQ ID NO: 7698721 - DNA, 19 bp, Homo sapiens
ttcacattttgctctgagg

SEQ ID NO: 7698722 - DNA, 19 bp, Homo sapiens
ttcacatttttgtggcact

SEQ ID NO: 7698723 - DNA, 19 bp, Homo sapiens
ttcacatttttgtggcact

SEQ ID NO: 7698724 - DNA, 22 bp, Homo sapiens
ttcaccatcattaacttcatgt

SEQ ID NO: 7698725 - DNA, 19 bp, Homo sapiens
ttcaccatctcaccaaacc

SEQ ID NO: 7698726 - DNA, 19 bp, Homo sapiens
ttcaccatctcaccaaacc

SEQ ID NO: 7698727 - DNA, 19 bp, Homo sapiens
ttcaccatctcaccaaacc

SEQ ID NO: 7698728 - DNA, 22 bp, Homo sapiens
ttcaccatgggatgacaacagt

SEQ ID NO: 7698729 - DNA, 19 bp, Homo sapiens
ttcaccatgggactggagc

SEQ ID NO: 7698730 - DNA, 22 bp, Homo sapiens
ttcaccatgggatgacaacagt

SEQ ID NO: 7698731 - DNA, 22 bp, Homo sapiens
ttcaccagaggttagaatattt

SEQ ID NO: 7698732 - DNA, 22 bp, Homo sapiens
ttcaccactttgcaccaggcct

SEQ ID NO: 7698733 - DNA, 22 bp, Homo sapiens
ttcaccacagtctcatctacgc

SEQ ID NO: 7698734 - DNA, 22 bp, Homo sapiens
ttcaccagattttgtatagtca

SEQ ID NO: 7698735 - DNA, 22 bp, Homo sapiens
ttcaccagacctgtgagcttcc

SEQ ID NO: 7698736 - DNA, 22 bp, Homo sapiens
ttcaccataatgcaaagtggga

SEQ ID NO: 7698737 - DNA, 22 bp, Homo sapiens
ttcaccataatgcaaagtggga

SEQ ID NO: 7698738 - DNA, 22 bp, Homo sapiens
ttcaccaggtgtacagttagtt

SEQ ID NO: 7698739 - DNA, 18 bp, Homo sapiens
ttcaccagtgtgatgggt

SEQ ID NO: 7698740 - DNA, 22 bp, Homo sapiens
ttcacatttactggtttgtccg

SEQ ID NO: 7698741 - DNA, 22 bp, Homo sapiens
ttcacatttcataccacagctt

SEQ ID NO: 7698742 - DNA, 22 bp, Homo sapiens
ttcacatttcataccacagctt

SEQ ID NO: 7698743 - DNA, 22 bp, Homo sapiens
ttcacatttactggtttgtccg

SEQ ID NO: 7698744 - DNA, 22 bp, Homo sapiens
ttcacattgttttaatgtgaat

SEQ ID NO: 7698745 - DNA, 22 bp, Homo sapiens
ttcacattgtggttcatgtgaa

SEQ ID NO: 7698746 - DNA, 22 bp, Homo sapiens
ttcacattgtggttcatgtgaa

SEQ ID NO: 7698747 - DNA, 22 bp, Homo sapiens
ttcacattgtggttcatgtgaa

SEQ ID NO: 7698748 - DNA, 22 bp, Homo sapiens
ttcacattgttttaatgtgaat

SEQ ID NO: 7698749 - DNA, 22 bp, Homo sapiens
ttcacattgttttaatgtgaat

SEQ ID NO: 7698750 - DNA, 22 bp, Homo sapiens
ttcacattgtggttcatgtgaa

SEQ ID NO: 7698751 - DNA, 22 bp, Homo sapiens
ttcacattgttttaatgtgaat

SEQ ID NO: 7698752 - DNA, 22 bp, Homo sapiens
ttcacattgttttaatgtgaat

SEQ ID NO: 7698753 - DNA, 22 bp, Homo sapiens
ttcacattgttttaatgtgaat

SEQ ID NO: 7698754 - DNA, 22 bp, Homo sapiens
ttcacattgttttaatgtgaat

SEQ ID NO: 7698755 - DNA, 22 bp, Homo sapiens
ttcacattggtgatatgtttct

SEQ ID NO: 7698756 - DNA, 19 bp, Homo sapiens
ttcacattggaagaagtag

SEQ ID NO: 7698757 - DNA, 22 bp, Homo sapiens
ttcacattggtgatatgtttct

SEQ ID NO: 7698758 - DNA, 22 bp, Homo sapiens
ttcacattggtgatatgtttct

SEQ ID NO: 7698759 - DNA, 22 bp, Homo sapiens
ttcacattggtgatatgtttct

SEQ ID NO: 7698760 - DNA, 22 bp, Homo sapiens
ttcacattggtgatatgtttct

SEQ ID NO: 7698761 - DNA, 22 bp, Homo sapiens
ttcacattggttcttgatagct

SEQ ID NO: 7698762 - DNA, 22 bp, Homo sapiens
ttcacattggttcttgatagct

SEQ ID NO: 7698763 - DNA, 22 bp, Homo sapiens
ttcacattggttcttgatagct

SEQ ID NO: 7698764 - DNA, 22 bp, Homo sapiens
ttcacattggttcttgatagct

SEQ ID NO: 7698765 - DNA, 22 bp, Homo sapiens
ttcacattggttcttgatagct

SEQ ID NO: 7698766 - DNA, 22 bp, Homo sapiens
ttcacattgtgcagattatggt

SEQ ID NO: 7698767 - DNA, 22 bp, Homo sapiens
ttcacattgtgcagattatggt

SEQ ID NO: 7698768 - DNA, 22 bp, Homo sapiens
ttcacattgtgcagattatggt

SEQ ID NO: 7698769 - DNA, 22 bp, Homo sapiens
ttcagcagttcctattagatgt

SEQ ID NO: 7698770 - DNA, 22 bp, Homo sapiens
ttcagcagtttctgagaagcaa

SEQ ID NO: 7698771 - DNA, 22 bp, Homo sapiens
ttcagcagtttctgagaagcaa

SEQ ID NO: 7698772 - DNA, 22 bp, Homo sapiens
ttcagcagttcctattagatgt

SEQ ID NO: 7698773 - DNA, 17 bp, Homo sapiens
ttcagcagtgtttctcc

SEQ ID NO: 7698774 - DNA, 17 bp, Homo sapiens
ttcagcagtgtttctcc

SEQ ID NO: 7698775 - DNA, 17 bp, Homo sapiens
ttcagcagtgtttctcc

SEQ ID NO: 7698776 - DNA, 19 bp, Homo sapiens
ttcagcagtgtctgctctt

SEQ ID NO: 7698777 - DNA, 19 bp, Homo sapiens
ttcagcagtgtctgctctt

SEQ ID NO: 7698778 - DNA, 19 bp, Homo sapiens
ttcagcagtgtctgctctt

SEQ ID NO: 7698779 - DNA, 22 bp, Homo sapiens
ttcagcagtgcagacacccagt

SEQ ID NO: 7698780 - DNA, 22 bp, Homo sapiens
ttcagcagtgcagacacccagt

SEQ ID NO: 7698781 - DNA, 22 bp, Homo sapiens
ttcagcagtgcagacacccagt

SEQ ID NO: 7698782 - DNA, 22 bp, Homo sapiens
ttcagcagtcgtccaggaaaag

SEQ ID NO: 7698783 - DNA, 21 bp, Homo sapiens
ttcagcagtcctctagagata

SEQ ID NO: 7698784 - DNA, 22 bp, Homo sapiens
ttcagcagtcgtccaggaaaag

SEQ ID NO: 7698785 - DNA, 22 bp, Homo sapiens
ttcagcagtcgtccaggaaaag

SEQ ID NO: 7698786 - DNA, 21 bp, Homo sapiens
ttcagcagcatgttgtctgtt

SEQ ID NO: 7698787 - DNA, 22 bp, Homo sapiens
ttcagcagcttttagtacattg

SEQ ID NO: 7698788 - DNA, 22 bp, Homo sapiens
ttcagcaggcggtagctgccac

SEQ ID NO: 7698789 - DNA, 22 bp, Homo sapiens
ttcagcagcttttagtacattg

SEQ ID NO: 7698790 - DNA, 22 bp, Homo sapiens
ttcagcagcttttagtacattg

SEQ ID NO: 7698791 - DNA, 22 bp, Homo sapiens
ttcagcagcttttagtacattg

SEQ ID NO: 7698792 - DNA, 22 bp, Homo sapiens
ttcactgctacatccaggtgcc

SEQ ID NO: 7698793 - DNA, 22 bp, Homo sapiens
ttcactggtcctttataggaac

SEQ ID NO: 7698794 - DNA, 22 bp, Homo sapiens
ttcactggggagatgtggcaga

SEQ ID NO: 7698795 - DNA, 22 bp, Homo sapiens
ttcactggtcctttataggaac

SEQ ID NO: 7698796 - DNA, 22 bp, Homo sapiens
ttcagcaggtggtgagttctgc

SEQ ID NO: 7698797 - DNA, 21 bp, Homo sapiens
ttcagcagtcctctagagata

SEQ ID NO: 7698798 - DNA, 21 bp, Homo sapiens
ttcagcagtcctctagagata

SEQ ID NO: 7698799 - DNA, 21 bp, Homo sapiens
ttcagcagtcctctagagata

SEQ ID NO: 7698800 - DNA, 21 bp, Homo sapiens
ttcagcagtcctctagagata

SEQ ID NO: 7698801 - DNA, 19 bp, Homo sapiens
ttcagcaggctgaagcttc

SEQ ID NO: 7698802 - DNA, 19 bp, Homo sapiens
ttcagcaggctgaagcttc

SEQ ID NO: 7698803 - DNA, 19 bp, Homo sapiens
ttcagcaggctgaagcttc

SEQ ID NO: 7698804 - DNA, 22 bp, Homo sapiens
ttcagcaggtggtgagttctgc

SEQ ID NO: 7698805 - DNA, 22 bp, Homo sapiens
ttcagcaggtggtgagttctgc

SEQ ID NO: 7698806 - DNA, 22 bp, Homo sapiens
ttcactataaagtttcaacttt

SEQ ID NO: 7698807 - DNA, 22 bp, Homo sapiens
ttcactatgcttggaaacttct

SEQ ID NO: 7698808 - DNA, 19 bp, Homo sapiens
ttcactaattgtaagattt

SEQ ID NO: 7698809 - DNA, 18 bp, Homo sapiens
ttcacctgtcctggcagg

SEQ ID NO: 7698810 - DNA, 22 bp, Homo sapiens
ttcacgaccatcagagcttaga

SEQ ID NO: 7698811 - DNA, 22 bp, Homo sapiens
ttcacgttgttgaagaaaatac

SEQ ID NO: 7698812 - DNA, 22 bp, Homo sapiens
ttcacgttgttgaagaaaatac

SEQ ID NO: 7698813 - DNA, 22 bp, Homo sapiens
ttcactaattcagtgtttgcgg

SEQ ID NO: 7698814 - DNA, 19 bp, Homo sapiens
ttcactaattgtaagattt

SEQ ID NO: 7698815 - DNA, 22 bp, Homo sapiens
ttcactgaagtttcttccatgt

SEQ ID NO: 7698816 - DNA, 22 bp, Homo sapiens
ttcactgaattaaaaagagtat

SEQ ID NO: 7698817 - DNA, 22 bp, Homo sapiens
ttcactgaattaaaaagagtat

SEQ ID NO: 7698818 - DNA, 22 bp, Homo sapiens
ttcactgaattaaaaagagtat

SEQ ID NO: 7698819 - DNA, 22 bp, Homo sapiens
ttcactgaagtttcttccatgt

SEQ ID NO: 7698820 - DNA, 22 bp, Homo sapiens
ttcactgaagtttcttccatgt

SEQ ID NO: 7698821 - DNA, 22 bp, Homo sapiens
ttcactgagagacatgaaggtc

SEQ ID NO: 7698822 - DNA, 22 bp, Homo sapiens
ttcactgcaacctccgcctccc

SEQ ID NO: 7698823 - DNA, 22 bp, Homo sapiens
ttcactgcagcccatgaaggga

SEQ ID NO: 7698824 - DNA, 22 bp, Homo sapiens
ttcactgcagcccatgaaggga

SEQ ID NO: 7698825 - DNA, 22 bp, Homo sapiens
ttcaccctggaccagaaattgg

SEQ ID NO: 7698826 - DNA, 22 bp, Homo sapiens
ttcaccctggaccagaaattgg

SEQ ID NO: 7698827 - DNA, 22 bp, Homo sapiens
ttcaccctggaccagaaattgg

SEQ ID NO: 7698828 - DNA, 22 bp, Homo sapiens
ttcaccccaaattcccagtgga

SEQ ID NO: 7698829 - DNA, 22 bp, Homo sapiens
ttcaccctgagccccacctctg

SEQ ID NO: 7698830 - DNA, 22 bp, Homo sapiens
ttcaccctggaccagaaattgg

SEQ ID NO: 7698831 - DNA, 22 bp, Homo sapiens
ttcaccctggaccagaaattgg

SEQ ID NO: 7698832 - DNA, 22 bp, Homo sapiens
ttcaccctggaccagaaattgg

SEQ ID NO: 7698833 - DNA, 22 bp, Homo sapiens
ttcacctggcacatgtgagcct

SEQ ID NO: 7698834 - DNA, 22 bp, Homo sapiens
ttcaccctggaccagaaattgg

SEQ ID NO: 7698835 - DNA, 22 bp, Homo sapiens
ttcaccattacatacaaagatg

SEQ ID NO: 7698836 - DNA, 22 bp, Homo sapiens
ttcaccattacatacaaagatg

SEQ ID NO: 7698837 - DNA, 22 bp, Homo sapiens
ttcaccatgttggccaggctgg

SEQ ID NO: 7698838 - DNA, 22 bp, Homo sapiens
ttcaccattacatacaaagatg

SEQ ID NO: 7698839 - DNA, 22 bp, Homo sapiens
ttcaccatgtaaaccatgtggc

SEQ ID NO: 7698840 - DNA, 22 bp, Homo sapiens
ttcaccatgtaaaccatgtggc

SEQ ID NO: 7698841 - DNA, 22 bp, Homo sapiens
ttcacccactagagaactcagg

SEQ ID NO: 7698842 - DNA, 22 bp, Homo sapiens
ttcaccatttcccactaaacca

SEQ ID NO: 7698843 - DNA, 22 bp, Homo sapiens
ttcaccatttcccactaaacca

SEQ ID NO: 7698844 - DNA, 22 bp, Homo sapiens
ttcacccaatataactagagga

SEQ ID NO: 7698845 - DNA, 22 bp, Homo sapiens
ttcacccaatataactagagga

SEQ ID NO: 7698846 - DNA, 22 bp, Homo sapiens
ttcagcctgttcatgctgttgc

SEQ ID NO: 7698847 - DNA, 21 bp, Homo sapiens
ttcagccctgtttgaggctac

SEQ ID NO: 7698848 - DNA, 22 bp, Homo sapiens
ttcagcctgtctgcagacccct

SEQ ID NO: 7698849 - DNA, 22 bp, Homo sapiens
ttcagcctgtctgcagacccct

SEQ ID NO: 7698850 - DNA, 22 bp, Homo sapiens
ttcagcccccaaagcctcattc

SEQ ID NO: 7698851 - DNA, 21 bp, Homo sapiens
ttcagccctgtttgaggctac

SEQ ID NO: 7698852 - DNA, 22 bp, Homo sapiens
ttcagcccacgccaccttcttg

SEQ ID NO: 7698853 - DNA, 22 bp, Homo sapiens
ttcagcccaggagttggaggct

SEQ ID NO: 7698854 - DNA, 22 bp, Homo sapiens
ttcagcccaggagttggaggct

SEQ ID NO: 7698855 - DNA, 22 bp, Homo sapiens
ttcagcccaggcatagggcaaa

SEQ ID NO: 7698856 - DNA, 22 bp, Homo sapiens
ttcagcatgggtgtgataaatg

SEQ ID NO: 7698857 - DNA, 22 bp, Homo sapiens
ttcagcatgaaaggatttgagt

SEQ ID NO: 7698858 - DNA, 23 bp, Homo sapiens
ttcagcatgaagagtgaaggctg

SEQ ID NO: 7698859 - DNA, 22 bp, Homo sapiens
ttcagcattggtatgaaaaccc

SEQ ID NO: 7698860 - DNA, 22 bp, Homo sapiens
ttcagcattggtatgaaaaccc

SEQ ID NO: 7698861 - DNA, 22 bp, Homo sapiens
ttcagcattggtatgaaaaccc

SEQ ID NO: 7698862 - DNA, 22 bp, Homo sapiens
ttcagcatttctgttgttggct

SEQ ID NO: 7698863 - DNA, 22 bp, Homo sapiens
ttcagccagtcatcagtcttgt

SEQ ID NO: 7698864 - DNA, 22 bp, Homo sapiens
ttcagctctgctagctctgtgc

SEQ ID NO: 7698865 - DNA, 23 bp, Homo sapiens
ttcagctctgtgtatcctgcctc

SEQ ID NO: 7698866 - DNA, 23 bp, Homo sapiens
ttcagctctgtgtatcctgcctc

SEQ ID NO: 7698867 - DNA, 22 bp, Homo sapiens
ttcagcttcatttgtctttatg

SEQ ID NO: 7698868 - DNA, 22 bp, Homo sapiens
ttcagcttcatttgtctttatg

SEQ ID NO: 7698869 - DNA, 21 bp, Homo sapiens
ttcagcttatgtgtcacttgc

SEQ ID NO: 7698870 - DNA, 21 bp, Homo sapiens
ttcagcttatgtgtcacttgc

SEQ ID NO: 7698871 - DNA, 22 bp, Homo sapiens
ttcagctcagtctgtgcagcag

SEQ ID NO: 7698872 - DNA, 22 bp, Homo sapiens
ttcagctccttatttctgagca

SEQ ID NO: 7698873 - DNA, 22 bp, Homo sapiens
ttcagctcctttcttccaccag

SEQ ID NO: 7698874 - DNA, 22 bp, Homo sapiens
ttcagctcctttcttccaccag

SEQ ID NO: 7698875 - DNA, 21 bp, Homo sapiens
ttcagctcggtctggcatgat

SEQ ID NO: 7698876 - DNA, 22 bp, Homo sapiens
ttcagctctagtaagcagacac

SEQ ID NO: 7698877 - DNA, 22 bp, Homo sapiens
ttcagctctagtaagcagacac

SEQ ID NO: 7698878 - DNA, 22 bp, Homo sapiens
ttcagctctagtaagcagacac

SEQ ID NO: 7698879 - DNA, 21 bp, Homo sapiens
ttcagctctgcttcagggaat

SEQ ID NO: 7698880 - DNA, 22 bp, Homo sapiens
ttcagctctgctagctctgtgc

SEQ ID NO: 7698881 - DNA, 22 bp, Homo sapiens
ttcagctcagcactgacaagat

SEQ ID NO: 7698882 - DNA, 22 bp, Homo sapiens
ttcagctcagtctgtgcagcag

SEQ ID NO: 7698883 - DNA, 22 bp, Homo sapiens
ttcagctcagcactgacaagat

SEQ ID NO: 7698884 - DNA, 22 bp, Homo sapiens
ttcagcgatattattcatgagc

SEQ ID NO: 7698885 - DNA, 22 bp, Homo sapiens
ttcagcctgttcatgctgttgc

SEQ ID NO: 7698886 - DNA, 22 bp, Homo sapiens
ttcaggaagcctttcttggtct

SEQ ID NO: 7698887 - DNA, 22 bp, Homo sapiens
ttcaggaaggtcctatagcaga

SEQ ID NO: 7698888 - DNA, 20 bp, Homo sapiens
ttcaggaataagatagcagc

SEQ ID NO: 7698889 - DNA, 20 bp, Homo sapiens
ttcaggaataagatagcagc

SEQ ID NO: 7698890 - DNA, 22 bp, Homo sapiens
ttcaggaagtgctgcctggtgt

SEQ ID NO: 7698891 - DNA, 22 bp, Homo sapiens
ttcaggaataattatcatatga

SEQ ID NO: 7698892 - DNA, 20 bp, Homo sapiens
ttcaggaataagatagcagc

SEQ ID NO: 7698893 - DNA, 22 bp, Homo sapiens
ttcaggaataattatcatatga

SEQ ID NO: 7698894 - DNA, 22 bp, Homo sapiens
ttcaggaataattatcatatga

SEQ ID NO: 7698895 - DNA, 22 bp, Homo sapiens
ttcaggaaattggagtccttct

SEQ ID NO: 7698896 - DNA, 22 bp, Homo sapiens
ttcaggaaggtcctatagcaga

SEQ ID NO: 7698897 - DNA, 22 bp, Homo sapiens
ttcaggaagcctttcttggtct

SEQ ID NO: 7698898 - DNA, 22 bp, Homo sapiens
ttcaggaaatttgtgtcacagg

SEQ ID NO: 7698899 - DNA, 22 bp, Homo sapiens
ttcaggaagcctttcttggtct

SEQ ID NO: 7698900 - DNA, 22 bp, Homo sapiens
ttcagcttgctgactgcggcag

SEQ ID NO: 7698901 - DNA, 22 bp, Homo sapiens
ttcagcttgctgactgcggcag

SEQ ID NO: 7698902 - DNA, 22 bp, Homo sapiens
ttcagcttgcttagtctccttc

SEQ ID NO: 7698903 - DNA, 22 bp, Homo sapiens
ttcagcttgcttagtctccttc

SEQ ID NO: 7698904 - DNA, 22 bp, Homo sapiens
ttcagcttgctgactgcggcag

SEQ ID NO: 7698905 - DNA, 22 bp, Homo sapiens
ttcagcttgctgactgcggcag

SEQ ID NO: 7698906 - DNA, 22 bp, Homo sapiens
ttcagcttgctgactgcggcag

SEQ ID NO: 7698907 - DNA, 22 bp, Homo sapiens
ttcagcttgctgactgcggcag

SEQ ID NO: 7698908 - DNA, 22 bp, Homo sapiens
ttcagcttgaatctggctttga

SEQ ID NO: 7698909 - DNA, 22 bp, Homo sapiens
ttcagcttgaatctggctttga

SEQ ID NO: 7698910 - DNA, 22 bp, Homo sapiens
ttcagcttgaatctggctttga

SEQ ID NO: 7698911 - DNA, 23 bp, Homo sapiens
ttcaggaaatgaatacagacaca

SEQ ID NO: 7698912 - DNA, 23 bp, Homo sapiens
ttcaggaaatgaatacagacaca

SEQ ID NO: 7698913 - DNA, 22 bp, Homo sapiens
ttcagctttgaggttgattttc

SEQ ID NO: 7698914 - DNA, 23 bp, Homo sapiens
ttcaggaaatgaatacagacaca

SEQ ID NO: 7698915 - DNA, 23 bp, Homo sapiens
ttcaggaaatgaatacagacaca

SEQ ID NO: 7698916 - DNA, 23 bp, Homo sapiens
ttcaggaaatgaatacagacaca

SEQ ID NO: 7698917 - DNA, 23 bp, Homo sapiens
ttcaggaaatgaatacagacaca

SEQ ID NO: 7698918 - DNA, 22 bp, Homo sapiens
ttcagcttggctgtaggtttta

SEQ ID NO: 7698919 - DNA, 22 bp, Homo sapiens
ttcagcttggctgtaggtttta

SEQ ID NO: 7698920 - DNA, 22 bp, Homo sapiens
ttcagctttgaggttgattttc

SEQ ID NO: 7698921 - DNA, 22 bp, Homo sapiens
ttcagcttggagagaattttta

SEQ ID NO: 7698922 - DNA, 22 bp, Homo sapiens
ttcagcttggagagaattttta

SEQ ID NO: 7698923 - DNA, 22 bp, Homo sapiens
ttcagcttgcttagtctccttc

SEQ ID NO: 7698924 - DNA, 22 bp, Homo sapiens
ttcagcttggagagaattttta

SEQ ID NO: 7698925 - DNA, 22 bp, Homo sapiens
ttccagctaactcacatccctt

SEQ ID NO: 7698926 - DNA, 22 bp, Homo sapiens
ttccagctaactcacatccctt

SEQ ID NO: 7698927 - DNA, 22 bp, Homo sapiens
ttccagcctttatccatccaga

SEQ ID NO: 7698928 - DNA, 22 bp, Homo sapiens
ttccagctaactcacatccctt

SEQ ID NO: 7698929 - DNA, 22 bp, Homo sapiens
ttccagctaactcacatccctt

SEQ ID NO: 7698930 - DNA, 22 bp, Homo sapiens
ttccagctaactcacatccctt

SEQ ID NO: 7698931 - DNA, 22 bp, Homo sapiens
ttccagctaactcacatccctt

SEQ ID NO: 7698932 - DNA, 22 bp, Homo sapiens
ttccagccactttatactgcta

SEQ ID NO: 7698933 - DNA, 22 bp, Homo sapiens
ttccagccagatttgctgggtt

SEQ ID NO: 7698934 - DNA, 22 bp, Homo sapiens
ttccagccagatttgctgggtt

SEQ ID NO: 7698935 - DNA, 22 bp, Homo sapiens
ttccagccagatttgctgggtt

SEQ ID NO: 7698936 - DNA, 22 bp, Homo sapiens
ttccagccatggtttccctatg

SEQ ID NO: 7698937 - DNA, 22 bp, Homo sapiens
ttccagcccgcgacttgttcag

SEQ ID NO: 7698938 - DNA, 20 bp, Homo sapiens
ttccagccgccacttccgcc

SEQ ID NO: 7698939 - DNA, 22 bp, Homo sapiens
ttccagcctttatccatccaga

SEQ ID NO: 7698940 - DNA, 22 bp, Homo sapiens
ttccagcacagaagtatacatt

SEQ ID NO: 7698941 - DNA, 22 bp, Homo sapiens
ttccagcacagaagtatacatt

SEQ ID NO: 7698942 - DNA, 22 bp, Homo sapiens
ttccagatgtttaagttctgct

SEQ ID NO: 7698943 - DNA, 22 bp, Homo sapiens
ttccagatttctacacaagacc

SEQ ID NO: 7698944 - DNA, 22 bp, Homo sapiens
ttccagatttctacacaagacc

SEQ ID NO: 7698945 - DNA, 22 bp, Homo sapiens
ttccagagttgggggagtggtt

SEQ ID NO: 7698946 - DNA, 22 bp, Homo sapiens
ttccagatatttttatgtggaa

SEQ ID NO: 7698947 - DNA, 22 bp, Homo sapiens
ttccagatgtttaagttctgct

SEQ ID NO: 7698948 - DNA, 22 bp, Homo sapiens
ttccagatgtttaagttctgct

SEQ ID NO: 7698949 - DNA, 17 bp, Homo sapiens
ttccagcatgttactaa

SEQ ID NO: 7698950 - DNA, 17 bp, Homo sapiens
ttccagcatgttactaa

SEQ ID NO: 7698951 - DNA, 22 bp, Homo sapiens
ttccagcagggtacttgtaatt

SEQ ID NO: 7698952 - DNA, 22 bp, Homo sapiens
ttccagcagcgtgggagaagta

SEQ ID NO: 7698953 - DNA, 22 bp, Homo sapiens
ttccagcagcgtgggagaagta

SEQ ID NO: 7698954 - DNA, 22 bp, Homo sapiens
ttccagcaggcagacaggagat

SEQ ID NO: 7698955 - DNA, 22 bp, Homo sapiens
ttccagcagggtacttgtaatt

SEQ ID NO: 7698956 - DNA, 22 bp, Homo sapiens
ttccagcagggtacttgtaatt

SEQ ID NO: 7698957 - DNA, 22 bp, Homo sapiens
ttccagagtctggttccatggt

SEQ ID NO: 7698958 - DNA, 23 bp, Homo sapiens
ttccagagtcttcgacggtaggc

SEQ ID NO: 7698959 - DNA, 23 bp, Homo sapiens
ttccagagtcttcgacggtaggc

SEQ ID NO: 7698960 - DNA, 22 bp, Homo sapiens
ttccagagtgactgtgccactt

SEQ ID NO: 7698961 - DNA, 22 bp, Homo sapiens
ttccagagtgactgtgccactt

SEQ ID NO: 7698962 - DNA, 22 bp, Homo sapiens
ttccagagtctggttccatggt

SEQ ID NO: 7698963 - DNA, 22 bp, Homo sapiens
ttccagagtctggttccatggt

SEQ ID NO: 7698964 - DNA, 22 bp, Homo sapiens
ttccagagtgactgtgccactt

SEQ ID NO: 7698965 - DNA, 22 bp, Homo sapiens
ttccagagtgactgtgccactt

SEQ ID NO: 7698966 - DNA, 22 bp, Homo sapiens
ttccagagttgggggagtggtt

SEQ ID NO: 7698967 - DNA, 22 bp, Homo sapiens
ttccagaggttctcagccctgt

SEQ ID NO: 7698968 - DNA, 22 bp, Homo sapiens
ttccagagtattggtagctata

SEQ ID NO: 7698969 - DNA, 22 bp, Homo sapiens
ttccagaggttctcagccctgt

SEQ ID NO: 7698970 - DNA, 22 bp, Homo sapiens
ttccagagtcagccactgggag

SEQ ID NO: 7698971 - DNA, 22 bp, Homo sapiens
ttccagagtattggtagctata

SEQ ID NO: 7698972 - DNA, 23 bp, Homo sapiens
ttccagagtccacatctgccacc

SEQ ID NO: 7698973 - DNA, 22 bp, Homo sapiens
ttccagagtccatgttggctca

SEQ ID NO: 7698974 - DNA, 22 bp, Homo sapiens
ttccagagtccatgttggctca

SEQ ID NO: 7698975 - DNA, 22 bp, Homo sapiens
ttccagagtccatgttggctca

SEQ ID NO: 7698976 - DNA, 23 bp, Homo sapiens
ttccagagtccacatctgccacc

SEQ ID NO: 7698977 - DNA, 22 bp, Homo sapiens
ttccagaggcttgaggaaaatt

SEQ ID NO: 7698978 - DNA, 22 bp, Homo sapiens
ttccagaggggaggtggcagcc

SEQ ID NO: 7698979 - DNA, 22 bp, Homo sapiens
ttccagaggggaggtggcagcc

SEQ ID NO: 7698980 - DNA, 22 bp, Homo sapiens
ttccagaggggaggtggcagcc

SEQ ID NO: 7698981 - DNA, 22 bp, Homo sapiens
ttccagaggtagcaatgacttg

SEQ ID NO: 7698982 - DNA, 22 bp, Homo sapiens
ttccagaggtagcaatgacttg

SEQ ID NO: 7698983 - DNA, 22 bp, Homo sapiens
ttccagaggttctcagccctgt

SEQ ID NO: 7698984 - DNA, 22 bp, Homo sapiens
ttccagaggttctcagccctgt

SEQ ID NO: 7698985 - DNA, 22 bp, Homo sapiens
ttccagaggttctcagccctgt

SEQ ID NO: 7698986 - DNA, 22 bp, Homo sapiens
ttccagaggttctcagccctgt

SEQ ID NO: 7698987 - DNA, 22 bp, Homo sapiens
ttccagaggcttcagggaagaa

SEQ ID NO: 7698988 - DNA, 22 bp, Homo sapiens
ttccagaggcttcagggaagaa

SEQ ID NO: 7698989 - DNA, 22 bp, Homo sapiens
ttccagaggcttcagggaagaa

SEQ ID NO: 7698990 - DNA, 22 bp, Homo sapiens
ttccagaggcttcagggaagaa

SEQ ID NO: 7698991 - DNA, 22 bp, Homo sapiens
ttccagaggcttcagggaagaa

SEQ ID NO: 7698992 - DNA, 22 bp, Homo sapiens
ttccagaggcttcagggaagaa

SEQ ID NO: 7698993 - DNA, 22 bp, Homo sapiens
ttccagaggcttgaggaaaatt

SEQ ID NO: 7698994 - DNA, 22 bp, Homo sapiens
ttccagaggcttcagggaagaa

SEQ ID NO: 7698995 - DNA, 22 bp, Homo sapiens
ttccagaggcttgaggaaaatt

SEQ ID NO: 7698996 - DNA, 22 bp, Homo sapiens
ttccagaggcttgaggaaaatt

SEQ ID NO: 7698997 - DNA, 22 bp, Homo sapiens
ttccagaggcttgaggaaaatt

SEQ ID NO: 7698998 - DNA, 22 bp, Homo sapiens
ttccagaggcttcagggaagaa

SEQ ID NO: 7698999 - DNA, 22 bp, Homo sapiens
ttccagctcttgaaggtgggat

SEQ ID NO: 7699000 - DNA, 22 bp, Homo sapiens
ttccagctaactcacatccctt

SEQ ID NO: 7699001 - DNA, 22 bp, Homo sapiens
ttccagctaactcacatccctt

SEQ ID NO: 7699002 - DNA, 22 bp, Homo sapiens
ttccagcttagagcatcatgtt

SEQ ID NO: 7699003 - DNA, 22 bp, Homo sapiens
ttccagcttagagcatcatgtt

SEQ ID NO: 7699004 - DNA, 22 bp, Homo sapiens
ttccagcttgacttctacttaa

SEQ ID NO: 7699005 - DNA, 22 bp, Homo sapiens
ttccaggaaaacagttggaagt

SEQ ID NO: 7699006 - DNA, 23 bp, Homo sapiens
ttcattcaaaaggaaaagtcatg

SEQ ID NO: 7699007 - DNA, 22 bp, Homo sapiens
ttcattcaaggggttcctgatt

SEQ ID NO: 7699008 - DNA, 22 bp, Homo sapiens
ttcattcacccaggaaacatct

SEQ ID NO: 7699009 - DNA, 22 bp, Homo sapiens
ttcattcaaggggttcctgatt

SEQ ID NO: 7699010 - DNA, 22 bp, Homo sapiens
ttcattcacccaggaaacatct

SEQ ID NO: 7699011 - DNA, 22 bp, Homo sapiens
ttcattcaggtgtatttatggg

SEQ ID NO: 7699012 - DNA, 22 bp, Homo sapiens
ttcattcaggtgtatttatggg

SEQ ID NO: 7699013 - DNA, 22 bp, Homo sapiens
ttcattcagcacatatttattg

SEQ ID NO: 7699014 - DNA, 22 bp, Homo sapiens
ttcattcagcacatatttattg

SEQ ID NO: 7699015 - DNA, 20 bp, Homo sapiens
ttcattcacgtagctgttga

SEQ ID NO: 7699016 - DNA, 20 bp, Homo sapiens
ttcattcacgtagctgttga

SEQ ID NO: 7699017 - DNA, 22 bp, Homo sapiens
ttcattcagtgagactaggacg

SEQ ID NO: 7699018 - DNA, 22 bp, Homo sapiens
ttcattcatcacatgcagctgg

SEQ ID NO: 7699019 - DNA, 22 bp, Homo sapiens
ttcattcatcacatgcagctgg

SEQ ID NO: 7699020 - DNA, 22 bp, Homo sapiens
ttcattcatcacatgcagctgg

SEQ ID NO: 7699021 - DNA, 22 bp, Homo sapiens
ttcattcatctctaaaatgcct

SEQ ID NO: 7699022 - DNA, 22 bp, Homo sapiens
ttcattcatctctaaaatgcct

SEQ ID NO: 7699023 - DNA, 21 bp, Homo sapiens
ttcattcatggcataatatag

SEQ ID NO: 7699024 - DNA, 21 bp, Homo sapiens
ttcattcatggcataatatag

SEQ ID NO: 7699025 - DNA, 22 bp, Homo sapiens
ttcattcatggtcttctgagat

SEQ ID NO: 7699026 - DNA, 21 bp, Homo sapiens
ttcattcatggcataatatag

SEQ ID NO: 7699027 - DNA, 21 bp, Homo sapiens
ttcaggacaggaaaaacaggg

SEQ ID NO: 7699028 - DNA, 22 bp, Homo sapiens
ttcatgtttgcctatttgactt

SEQ ID NO: 7699029 - DNA, 22 bp, Homo sapiens
ttcatgtttgcctatttgactt

SEQ ID NO: 7699030 - DNA, 22 bp, Homo sapiens
ttcatgtttgcctatttgactt

SEQ ID NO: 7699031 - DNA, 22 bp, Homo sapiens
ttcaggaatcaaccaagtcatt

SEQ ID NO: 7699032 - DNA, 22 bp, Homo sapiens
ttcaggaatcaaccaagtcatt

SEQ ID NO: 7699033 - DNA, 22 bp, Homo sapiens
ttcaggaataattatcatatga

SEQ ID NO: 7699034 - DNA, 22 bp, Homo sapiens
ttcaggaatataggcattgaca

SEQ ID NO: 7699035 - DNA, 22 bp, Homo sapiens
ttcaggaatataggcattgaca

SEQ ID NO: 7699036 - DNA, 22 bp, Homo sapiens
ttcaggaatcaaccaagtcatt

SEQ ID NO: 7699037 - DNA, 22 bp, Homo sapiens
ttcaggaatcaaccaagtcatt

SEQ ID NO: 7699038 - DNA, 22 bp, Homo sapiens
ttcaggaatcaaccaagtcatt

SEQ ID NO: 7699039 - DNA, 22 bp, Homo sapiens
ttcatgtttgcctatttgactt

SEQ ID NO: 7699040 - DNA, 22 bp, Homo sapiens
ttcatgtttgcctatttgactt

SEQ ID NO: 7699041 - DNA, 19 bp, Homo sapiens
ttcatgtttgtagatggtg

SEQ ID NO: 7699042 - DNA, 19 bp, Homo sapiens
ttcatgtttgtagatggtg

SEQ ID NO: 7699043 - DNA, 19 bp, Homo sapiens
ttcatgtttgtagatggtg

SEQ ID NO: 7699044 - DNA, 22 bp, Homo sapiens
ttcatgtttgtaggactgaggc

SEQ ID NO: 7699045 - DNA, 22 bp, Homo sapiens
ttcatgtttgtaggactgaggc

SEQ ID NO: 7699046 - DNA, 22 bp, Homo sapiens
ttcatgtttgtaggactgaggc

SEQ ID NO: 7699047 - DNA, 22 bp, Homo sapiens
ttcatgtttgtaggactgaggc

SEQ ID NO: 7699048 - DNA, 22 bp, Homo sapiens
ttcatgtttgtaggactgaggc

SEQ ID NO: 7699049 - DNA, 22 bp, Homo sapiens
ttcatgttttattcagtaatta

SEQ ID NO: 7699050 - DNA, 22 bp, Homo sapiens
ttcatgttttattcagtaatta

SEQ ID NO: 7699051 - DNA, 22 bp, Homo sapiens
ttcatgttttattcagtaatta

SEQ ID NO: 7699052 - DNA, 22 bp, Homo sapiens
ttcatgttttattcagtaatta

SEQ ID NO: 7699053 - DNA, 22 bp, Homo sapiens
ttcatgttttgagccattctga

SEQ ID NO: 7699054 - DNA, 22 bp, Homo sapiens
ttcatgttttgagccattctga

SEQ ID NO: 7699055 - DNA, 22 bp, Homo sapiens
ttcattaagtataaaatgtggt

SEQ ID NO: 7699056 - DNA, 22 bp, Homo sapiens
ttcattaagtataaaatgtggt

SEQ ID NO: 7699057 - DNA, 22 bp, Homo sapiens
ttcattaagtataaaatgtggt

SEQ ID NO: 7699058 - DNA, 22 bp, Homo sapiens
ttcattaagtataaaatgtggt

SEQ ID NO: 7699059 - DNA, 17 bp, Homo sapiens
ttcattaataaaagcaa

SEQ ID NO: 7699060 - DNA, 17 bp, Homo sapiens
ttcattaataaaagcaa

SEQ ID NO: 7699061 - DNA, 17 bp, Homo sapiens
ttcattaataaaagcaa

SEQ ID NO: 7699062 - DNA, 17 bp, Homo sapiens
ttcattaataaaagcaa

SEQ ID NO: 7699063 - DNA, 22 bp, Homo sapiens
ttcattaattcattcagtgact

SEQ ID NO: 7699064 - DNA, 22 bp, Homo sapiens
ttcattaattcattcagtgact

SEQ ID NO: 7699065 - DNA, 22 bp, Homo sapiens
ttcattacattcaaaaggcatt

SEQ ID NO: 7699066 - DNA, 22 bp, Homo sapiens
ttcattactgaattctcactac

SEQ ID NO: 7699067 - DNA, 23 bp, Homo sapiens
ttcattcaaaaggaaaagtcatg

SEQ ID NO: 7699068 - DNA, 23 bp, Homo sapiens
ttcattcaaaaggaaaagtcatg

SEQ ID NO: 7699069 - DNA, 22 bp, Homo sapiens
ttcattagttctgaagatgtct

SEQ ID NO: 7699070 - DNA, 22 bp, Homo sapiens
ttcattagttctgaagatgtct

SEQ ID NO: 7699071 - DNA, 22 bp, Homo sapiens
ttcattagaaaagtaaaaatgc

SEQ ID NO: 7699072 - DNA, 22 bp, Homo sapiens
ttcattactgcggtagtcacac

SEQ ID NO: 7699073 - DNA, 22 bp, Homo sapiens
ttcattactgaattctcactac

SEQ ID NO: 7699074 - DNA, 22 bp, Homo sapiens
ttcattactgcggtagtcacac

SEQ ID NO: 7699075 - DNA, 22 bp, Homo sapiens
ttcattgaaatacagtcttgac

SEQ ID NO: 7699076 - DNA, 22 bp, Homo sapiens
ttcattcttttacatgtgaata

SEQ ID NO: 7699077 - DNA, 22 bp, Homo sapiens
ttcattgaaccactttattctt

SEQ ID NO: 7699078 - DNA, 22 bp, Homo sapiens
ttcattgaaattaagcccaact

SEQ ID NO: 7699079 - DNA, 22 bp, Homo sapiens
ttcattgaaccactttattctt

SEQ ID NO: 7699080 - DNA, 22 bp, Homo sapiens
ttcattgaaatgtttctagctg

SEQ ID NO: 7699081 - DNA, 22 bp, Homo sapiens
ttcattgaaatacagtcttgac

SEQ ID NO: 7699082 - DNA, 19 bp, Homo sapiens
ttcattctttctacttacc

SEQ ID NO: 7699083 - DNA, 19 bp, Homo sapiens
ttcattctttctacttacc

SEQ ID NO: 7699084 - DNA, 22 bp, Homo sapiens
ttcattcttttacatgtgaata

SEQ ID NO: 7699085 - DNA, 22 bp, Homo sapiens
ttcattcttttacatgtgaata

SEQ ID NO: 7699086 - DNA, 22 bp, Homo sapiens
ttcattcttgtctttgtatagt

SEQ ID NO: 7699087 - DNA, 20 bp, Homo sapiens
ttcattcattccacaacttc

SEQ ID NO: 7699088 - DNA, 20 bp, Homo sapiens
ttcattcattccacaacttc

SEQ ID NO: 7699089 - DNA, 22 bp, Homo sapiens
ttcattcttgtctttgtatagt

SEQ ID NO: 7699090 - DNA, 22 bp, Homo sapiens
ttcattcttgtctttgtatagt

SEQ ID NO: 7699091 - DNA, 22 bp, Homo sapiens
ttcattcattcatgaatgttaa

SEQ ID NO: 7699092 - DNA, 22 bp, Homo sapiens
ttcattcattacgtgccaggca

SEQ ID NO: 7699093 - DNA, 22 bp, Homo sapiens
ttcattcatgtattgtctatgg

SEQ ID NO: 7699094 - DNA, 22 bp, Homo sapiens
ttcattcatgtattgtctatgg

SEQ ID NO: 7699095 - DNA, 22 bp, Homo sapiens
ttcattcatggtcttctgagat

SEQ ID NO: 7699096 - DNA, 22 bp, Homo sapiens
ttcattgagttactgcctgggc

SEQ ID NO: 7699097 - DNA, 22 bp, Homo sapiens
ttcattgagtggtttattctaa

SEQ ID NO: 7699098 - DNA, 22 bp, Homo sapiens
ttcattgagtggtttattctaa

SEQ ID NO: 7699099 - DNA, 22 bp, Homo sapiens
ttcattgatagttttatgtatg

SEQ ID NO: 7699100 - DNA, 22 bp, Homo sapiens
ttcattgatgtggtttaatgta

SEQ ID NO: 7699101 - DNA, 23 bp, Homo sapiens
ttcattgattgcaaggagattgg

SEQ ID NO: 7699102 - DNA, 22 bp, Homo sapiens
ttcattgattccaggctcttct

SEQ ID NO: 7699103 - DNA, 22 bp, Homo sapiens
ttcattgagctgtacacttagg

SEQ ID NO: 7699104 - DNA, 22 bp, Homo sapiens
ttcattgagctgtacacttagg

SEQ ID NO: 7699105 - DNA, 23 bp, Homo sapiens
ttcattgagctgttcttgaggat

SEQ ID NO: 7699106 - DNA, 22 bp, Homo sapiens
ttcattgagtataggggtatac

SEQ ID NO: 7699107 - DNA, 22 bp, Homo sapiens
ttcattgaaggagggacttgct

SEQ ID NO: 7699108 - DNA, 22 bp, Homo sapiens
ttcattgactggttcgttaagt

SEQ ID NO: 7699109 - DNA, 22 bp, Homo sapiens
ttcattgaagcacaagtgatct

SEQ ID NO: 7699110 - DNA, 22 bp, Homo sapiens
ttcattgaagcacaagtgatct

SEQ ID NO: 7699111 - DNA, 21 bp, Homo sapiens
ttcattgaactatttgtggag

SEQ ID NO: 7699112 - DNA, 22 bp, Homo sapiens
ttccagaggcctgggcacactc

SEQ ID NO: 7699113 - DNA, 22 bp, Homo sapiens
ttccagaggctctaggggagaa

SEQ ID NO: 7699114 - DNA, 22 bp, Homo sapiens
ttccagaggctctaggggagaa

SEQ ID NO: 7699115 - DNA, 22 bp, Homo sapiens
ttccagaggctctaggggagaa

SEQ ID NO: 7699116 - DNA, 22 bp, Homo sapiens
ttccagaggctctaggggagaa

SEQ ID NO: 7699117 - DNA, 22 bp, Homo sapiens
ttccagaggagtgattcagagg

SEQ ID NO: 7699118 - DNA, 22 bp, Homo sapiens
ttccagaggatctcaggtattt

SEQ ID NO: 7699119 - DNA, 22 bp, Homo sapiens
ttccagaggatctcaggtattt

SEQ ID NO: 7699120 - DNA, 22 bp, Homo sapiens
ttccagaggcctgggcacactc

SEQ ID NO: 7699121 - DNA, 22 bp, Homo sapiens
ttccagaggagtgattcagagg

SEQ ID NO: 7699122 - DNA, 22 bp, Homo sapiens
ttccagaggagtgattcagagg

SEQ ID NO: 7699123 - DNA, 22 bp, Homo sapiens
ttccagaggagtgattcagagg

SEQ ID NO: 7699124 - DNA, 22 bp, Homo sapiens
ttcattgatttaacaaacaagt

SEQ ID NO: 7699125 - DNA, 22 bp, Homo sapiens
ttcattgatttaacaaacaagt

SEQ ID NO: 7699126 - DNA, 22 bp, Homo sapiens
ttcattgatttaacaaacaagt

SEQ ID NO: 7699127 - DNA, 22 bp, Homo sapiens
ttccagaggaaagaaaatgact

SEQ ID NO: 7699128 - DNA, 22 bp, Homo sapiens
ttccagaggaaagaaaatgact

SEQ ID NO: 7699129 - DNA, 22 bp, Homo sapiens
ttccagaggaaagaaaatgact

SEQ ID NO: 7699130 - DNA, 23 bp, Homo sapiens
ttccagaggaagaagtcatgact

SEQ ID NO: 7699131 - DNA, 23 bp, Homo sapiens
ttccagaggaagaagtcatgact

SEQ ID NO: 7699132 - DNA, 23 bp, Homo sapiens
ttccagaggaagaagtcatgact

SEQ ID NO: 7699133 - DNA, 23 bp, Homo sapiens
ttccagaggaagaagtcatgact

SEQ ID NO: 7699134 - DNA, 23 bp, Homo sapiens
ttccagaggaagaagtcatgact

SEQ ID NO: 7699135 - DNA, 21 bp, Homo sapiens
tgtatgcacgcacatgcacac

SEQ ID NO: 7699136 - DNA, 21 bp, Homo sapiens
tgtatgcacgcacatgcacac

SEQ ID NO: 7699137 - DNA, 22 bp, Homo sapiens
tgtatgcagcaaaacaattagt

SEQ ID NO: 7699138 - DNA, 22 bp, Homo sapiens
tgtatgcagcaaaacaattagt

SEQ ID NO: 7699139 - DNA, 22 bp, Homo sapiens
tgtatgcagcaaaacaattagt

SEQ ID NO: 7699140 - DNA, 22 bp, Homo sapiens
tgtatgcagggcttgtatgcag

SEQ ID NO: 7699141 - DNA, 22 bp, Homo sapiens
tgtatgcagggcttgtatgcag

SEQ ID NO: 7699142 - DNA, 22 bp, Homo sapiens
tgtatgcacatatataggtaca

SEQ ID NO: 7699143 - DNA, 22 bp, Homo sapiens
tgtatgcacatggataagtatg

SEQ ID NO: 7699144 - DNA, 22 bp, Homo sapiens
tgtatgcacatggataagtatg

SEQ ID NO: 7699145 - DNA, 22 bp, Homo sapiens
tgtatgcaccattgtattacct

SEQ ID NO: 7699146 - DNA, 22 bp, Homo sapiens
tgtatgcaccattgtattacct

SEQ ID NO: 7699147 - DNA, 22 bp, Homo sapiens
tgtatgcacatatataggtaca

SEQ ID NO: 7699148 - DNA, 22 bp, Homo sapiens
tgtatgcaccattgtattacct

SEQ ID NO: 7699149 - DNA, 22 bp, Homo sapiens
tgtatgcaccattgtattacct

SEQ ID NO: 7699150 - DNA, 17 bp, Homo sapiens
tgtatgcataaaattta

SEQ ID NO: 7699151 - DNA, 22 bp, Homo sapiens
tgtatgcataaaattatttaca

SEQ ID NO: 7699152 - DNA, 22 bp, Homo sapiens
tgtatgcatctttgataaatag

SEQ ID NO: 7699153 - DNA, 22 bp, Homo sapiens
tgtatgcctttttctgttgtaa

SEQ ID NO: 7699154 - DNA, 17 bp, Homo sapiens
tgtatgcatatgctttt

SEQ ID NO: 7699155 - DNA, 22 bp, Homo sapiens
tgtatgcatctttgataaatag

SEQ ID NO: 7699156 - DNA, 22 bp, Homo sapiens
tgtatgcatctttgataaatag

SEQ ID NO: 7699157 - DNA, 22 bp, Homo sapiens
tgtatgcttgtgtataatataa

SEQ ID NO: 7699158 - DNA, 22 bp, Homo sapiens
tgtatgcttgagtgtgtatact

SEQ ID NO: 7699159 - DNA, 22 bp, Homo sapiens
tgtatgtatacactgatcatca

SEQ ID NO: 7699160 - DNA, 22 bp, Homo sapiens
tgtattctctcaatatttcata

SEQ ID NO: 7699161 - DNA, 22 bp, Homo sapiens
tgtatgtatacacatagatacg

SEQ ID NO: 7699162 - DNA, 22 bp, Homo sapiens
tgtatgtaaagtttgtaataga

SEQ ID NO: 7699163 - DNA, 22 bp, Homo sapiens
tgtatgtatacacatagatacg

SEQ ID NO: 7699164 - DNA, 22 bp, Homo sapiens
tgtatgtaaagtttgtaataga

SEQ ID NO: 7699165 - DNA, 22 bp, Homo sapiens
tgtattctctcaatatttcata

SEQ ID NO: 7699166 - DNA, 22 bp, Homo sapiens
tgtattctctcaatatttcata

SEQ ID NO: 7699167 - DNA, 22 bp, Homo sapiens
tgtattcttagttttaatcaga

SEQ ID NO: 7699168 - DNA, 22 bp, Homo sapiens
tgtatgctttccaaaaatgctg

SEQ ID NO: 7699169 - DNA, 22 bp, Homo sapiens
tgtatgctttccttctttctgg

SEQ ID NO: 7699170 - DNA, 22 bp, Homo sapiens
tgtatgtaaagaaggatatttt

SEQ ID NO: 7699171 - DNA, 22 bp, Homo sapiens
tgtatgtaaaggtcttcatgtt

SEQ ID NO: 7699172 - DNA, 22 bp, Homo sapiens
tgtatgtaaagtttgtaataga

SEQ ID NO: 7699173 - DNA, 20 bp, Homo sapiens
tgtatttaatgaaggctttt

SEQ ID NO: 7699174 - DNA, 20 bp, Homo sapiens
tgtatttaatgaaggctttt

SEQ ID NO: 7699175 - DNA, 22 bp, Homo sapiens
tgtatttaagctttacctaaaa

SEQ ID NO: 7699176 - DNA, 22 bp, Homo sapiens
tgtatttaagctttacctaaaa

SEQ ID NO: 7699177 - DNA, 22 bp, Homo sapiens
tgtatttaagctttacctaaaa

SEQ ID NO: 7699178 - DNA, 20 bp, Homo sapiens
tgtattgttattgggacaga

SEQ ID NO: 7699179 - DNA, 22 bp, Homo sapiens
tgtattgttataatttgtatgt

SEQ ID NO: 7699180 - DNA, 22 bp, Homo sapiens
tgtattgttataatttgtatgt

SEQ ID NO: 7699181 - DNA, 22 bp, Homo sapiens
tgtattgttataatttgtatgt

SEQ ID NO: 7699182 - DNA, 22 bp, Homo sapiens
tgtattgtaagtggttatatgc

SEQ ID NO: 7699183 - DNA, 22 bp, Homo sapiens
tgtattgtaagtggttatatgc

SEQ ID NO: 7699184 - DNA, 22 bp, Homo sapiens
tgtattgtaagtggttatatgc

SEQ ID NO: 7699185 - DNA, 22 bp, Homo sapiens
tgtattgaggattcatttttgt

SEQ ID NO: 7699186 - DNA, 20 bp, Homo sapiens
tgtattctttgctctccact

SEQ ID NO: 7699187 - DNA, 22 bp, Homo sapiens
tgtattgaattgtgttatatct

SEQ ID NO: 7699188 - DNA, 22 bp, Homo sapiens
tgtattgaattgtgttatatct

SEQ ID NO: 7699189 - DNA, 20 bp, Homo sapiens
tgtatttaatgaaggctttt

SEQ ID NO: 7699190 - DNA, 20 bp, Homo sapiens
tgtatttaatgaaggctttt

SEQ ID NO: 7699191 - DNA, 22 bp, Homo sapiens
tgtatttaattgtatcatcaca

SEQ ID NO: 7699192 - DNA, 22 bp, Homo sapiens
tgtatttaattgtatcatcaca

SEQ ID NO: 7699193 - DNA, 22 bp, Homo sapiens
tgtatttaattgtatcatcaca

SEQ ID NO: 7699194 - DNA, 22 bp, Homo sapiens
tgtatttaattgtatcatcaca

SEQ ID NO: 7699195 - DNA, 22 bp, Homo sapiens
tgtatttaattgtatcatcaca

SEQ ID NO: 7699196 - DNA, 22 bp, Homo sapiens
tgtatttaattgtatcatcaca

SEQ ID NO: 7699197 - DNA, 22 bp, Homo sapiens
tgtatttaattgtatcatcaca

SEQ ID NO: 7699198 - DNA, 22 bp, Homo sapiens
tgtatttaattgtatcatcaca

SEQ ID NO: 7699199 - DNA, 22 bp, Homo sapiens
tgtatttaattgtatcatcaca

SEQ ID NO: 7699200 - DNA, 22 bp, Homo sapiens
tgtatttatattagaatggttg

SEQ ID NO: 7699201 - DNA, 22 bp, Homo sapiens
tgtatttagtccagtctctcat

SEQ ID NO: 7699202 - DNA, 22 bp, Homo sapiens
tgtatttatattagaatggttg

SEQ ID NO: 7699203 - DNA, 22 bp, Homo sapiens
tgtatttatattagaatggttg

SEQ ID NO: 7699204 - DNA, 22 bp, Homo sapiens
tgtattttctgaggagcattag

SEQ ID NO: 7699205 - DNA, 22 bp, Homo sapiens
tgtattttcttctggaagctta

SEQ ID NO: 7699206 - DNA, 22 bp, Homo sapiens
tgtattttcttctggaagctta

SEQ ID NO: 7699207 - DNA, 22 bp, Homo sapiens
tgtattttgagtccaatctcct

SEQ ID NO: 7699208 - DNA, 22 bp, Homo sapiens
tgtattttgagtccaatctcct

SEQ ID NO: 7699209 - DNA, 22 bp, Homo sapiens
tgtattttgagtccaatctcct

SEQ ID NO: 7699210 - DNA, 22 bp, Homo sapiens
tgtattttgagtccaatctcct

SEQ ID NO: 7699211 - DNA, 22 bp, Homo sapiens
tgtattttcttctggaagctta

SEQ ID NO: 7699212 - DNA, 22 bp, Homo sapiens
tgtattttcttctggaagctta

SEQ ID NO: 7699213 - DNA, 22 bp, Homo sapiens
tgtattttgtgaggatcactct

SEQ ID NO: 7699214 - DNA, 22 bp, Homo sapiens
tgtattttgtgaggatcactct

SEQ ID NO: 7699215 - DNA, 22 bp, Homo sapiens
tgtattttgtgaggatcactct

SEQ ID NO: 7699216 - DNA, 22 bp, Homo sapiens
tgtattttgagtccaatctcct

SEQ ID NO: 7699217 - DNA, 22 bp, Homo sapiens
tgtattttgtgaggatcactct

SEQ ID NO: 7699218 - DNA, 22 bp, Homo sapiens
tgtattttgtgaggatcactct

SEQ ID NO: 7699219 - DNA, 22 bp, Homo sapiens
tgtattttcagagtggcatttc

SEQ ID NO: 7699220 - DNA, 22 bp, Homo sapiens
tgtattttcagagtggcatttc

SEQ ID NO: 7699221 - DNA, 22 bp, Homo sapiens
tgtattttcagagtggcatttc

SEQ ID NO: 7699222 - DNA, 22 bp, Homo sapiens
tgtattttcagagtggcatttc

SEQ ID NO: 7699223 - DNA, 22 bp, Homo sapiens
tgtattttcagagtggcatttc

SEQ ID NO: 7699224 - DNA, 22 bp, Homo sapiens
tgtattttctgaagataatcaa

SEQ ID NO: 7699225 - DNA, 22 bp, Homo sapiens
tgtattttctgaagataatcaa

SEQ ID NO: 7699226 - DNA, 22 bp, Homo sapiens
tgtattttctgaagataatcaa

SEQ ID NO: 7699227 - DNA, 22 bp, Homo sapiens
tgtattttcagagtggcatttc

SEQ ID NO: 7699228 - DNA, 22 bp, Homo sapiens
tgtattttctgaggagcattag

SEQ ID NO: 7699229 - DNA, 22 bp, Homo sapiens
tgtattttctgaggagcattag

SEQ ID NO: 7699230 - DNA, 22 bp, Homo sapiens
tgtattttctgaggagcattag

SEQ ID NO: 7699231 - DNA, 22 bp, Homo sapiens
tgtattttctgaggagcattag

SEQ ID NO: 7699232 - DNA, 22 bp, Homo sapiens
tgtattttctgaggagcattag

SEQ ID NO: 7699233 - DNA, 22 bp, Homo sapiens
tgtattttctgaggagcattag

SEQ ID NO: 7699234 - DNA, 22 bp, Homo sapiens
tgtattttctgaggagcattag

SEQ ID NO: 7699235 - DNA, 22 bp, Homo sapiens
tgtattttctgaagataatcaa

SEQ ID NO: 7699236 - DNA, 22 bp, Homo sapiens
tgtattttctgaagataatcaa

SEQ ID NO: 7699237 - DNA, 22 bp, Homo sapiens
tgtattttctgaagataatcaa

SEQ ID NO: 7699238 - DNA, 17 bp, Homo sapiens
tgtatttatcatgtcag

SEQ ID NO: 7699239 - DNA, 17 bp, Homo sapiens
tgtatttatcatgtcag

SEQ ID NO: 7699240 - DNA, 17 bp, Homo sapiens
tgtatttatcatgtcag

SEQ ID NO: 7699241 - DNA, 17 bp, Homo sapiens
tgtatttatcatgtcag

SEQ ID NO: 7699242 - DNA, 22 bp, Homo sapiens
tgtatttattcaggatgtaact

SEQ ID NO: 7699243 - DNA, 17 bp, Homo sapiens
tgtatttatcatgtcag

SEQ ID NO: 7699244 - DNA, 22 bp, Homo sapiens
tgtatttattcaggatgtaact

SEQ ID NO: 7699245 - DNA, 17 bp, Homo sapiens
tgtatttatcatgtcag

SEQ ID NO: 7699246 - DNA, 22 bp, Homo sapiens
tgtatttattcaggatgtaact

SEQ ID NO: 7699247 - DNA, 22 bp, Homo sapiens
tgtatttattcaggatgtaact

SEQ ID NO: 7699248 - DNA, 22 bp, Homo sapiens
tgtatttattcaggatgtaact

SEQ ID NO: 7699249 - DNA, 22 bp, Homo sapiens
tgtatttattcaggatgtaact

SEQ ID NO: 7699250 - DNA, 22 bp, Homo sapiens
tgtatttattcttctggtgttt

SEQ ID NO: 7699251 - DNA, 20 bp, Homo sapiens
tgtatttcatgcattcctgg

SEQ ID NO: 7699252 - DNA, 22 bp, Homo sapiens
tgtatttcctggtttagatcaa

SEQ ID NO: 7699253 - DNA, 22 bp, Homo sapiens
tgtatttctgctttctctagta

SEQ ID NO: 7699254 - DNA, 22 bp, Homo sapiens
tgtatttcctggtttagatcaa

SEQ ID NO: 7699255 - DNA, 22 bp, Homo sapiens
tgtatttcctggtttagatcaa

SEQ ID NO: 7699256 - DNA, 22 bp, Homo sapiens
tgtatttcgctaggtactccct

SEQ ID NO: 7699257 - DNA, 18 bp, Homo sapiens
tgtatttctaacagctaa

SEQ ID NO: 7699258 - DNA, 18 bp, Homo sapiens
tgtatttctaacagctaa

SEQ ID NO: 7699259 - DNA, 22 bp, Homo sapiens
tgtatttgggtcacaagatggg

SEQ ID NO: 7699260 - DNA, 22 bp, Homo sapiens
tgtatttgttgttaaatggaga

SEQ ID NO: 7699261 - DNA, 22 bp, Homo sapiens
tgtcacaaaaatcagtaattgc

SEQ ID NO: 7699262 - DNA, 22 bp, Homo sapiens
tgtcacaaaaatcagtaattgc

SEQ ID NO: 7699263 - DNA, 22 bp, Homo sapiens
tgtcaattaaagtttgtaggtg

SEQ ID NO: 7699264 - DNA, 22 bp, Homo sapiens
tgtcaattatcaaggttcattt

SEQ ID NO: 7699265 - DNA, 22 bp, Homo sapiens
tgtcacaaacatacattataga

SEQ ID NO: 7699266 - DNA, 22 bp, Homo sapiens
tgtcacaaacatacattataga

SEQ ID NO: 7699267 - DNA, 22 bp, Homo sapiens
tgtcacaaaaatcagtaattgc

SEQ ID NO: 7699268 - DNA, 22 bp, Homo sapiens
tgtcacaaacatacattataga

SEQ ID NO: 7699269 - DNA, 22 bp, Homo sapiens
tgtcaattatgtgacacatctt

SEQ ID NO: 7699270 - DNA, 22 bp, Homo sapiens
tgtcacaaaaatcagtaattgc

SEQ ID NO: 7699271 - DNA, 22 bp, Homo sapiens
tgtcaatgaagatatgaataat

SEQ ID NO: 7699272 - DNA, 22 bp, Homo sapiens
tgtcaatgtgtacaggagctca

SEQ ID NO: 7699273 - DNA, 22 bp, Homo sapiens
tgtcaatatgtaataactgaat

SEQ ID NO: 7699274 - DNA, 22 bp, Homo sapiens
tgtcaaagtatcagtctctggc

SEQ ID NO: 7699275 - DNA, 22 bp, Homo sapiens
tgtcaaagggtaagctggataa

SEQ ID NO: 7699276 - DNA, 22 bp, Homo sapiens
tgtcaaagcctgaatcacatag

SEQ ID NO: 7699277 - DNA, 22 bp, Homo sapiens
tgtcacactgaccacatctgta

SEQ ID NO: 7699278 - DNA, 22 bp, Homo sapiens
tgtcacactgaccacatctgta

SEQ ID NO: 7699279 - DNA, 22 bp, Homo sapiens
tgtcacactgaccacatctgta

SEQ ID NO: 7699280 - DNA, 22 bp, Homo sapiens
tgtcacacctcgtttagcattc

SEQ ID NO: 7699281 - DNA, 22 bp, Homo sapiens
tgtcacacctcgtttagcattc

SEQ ID NO: 7699282 - DNA, 22 bp, Homo sapiens
tgtcacagagcgtgcaacagaa

SEQ ID NO: 7699283 - DNA, 22 bp, Homo sapiens
tgtcacagagcgtgcaacagaa

SEQ ID NO: 7699284 - DNA, 22 bp, Homo sapiens
tgtcacagagcaactatttctt

SEQ ID NO: 7699285 - DNA, 22 bp, Homo sapiens
tgtcacagagcaactatttctt

SEQ ID NO: 7699286 - DNA, 22 bp, Homo sapiens
tgtcacaacagaggaactgaat

SEQ ID NO: 7699287 - DNA, 22 bp, Homo sapiens
tgtcacaagtaactggcaatgc

SEQ ID NO: 7699288 - DNA, 22 bp, Homo sapiens
tgtcacaaggccatgaaaagaa

SEQ ID NO: 7699289 - DNA, 22 bp, Homo sapiens
tgtcacaaggccatgaaaagaa

SEQ ID NO: 7699290 - DNA, 22 bp, Homo sapiens
tgtcacaaggccatgaaaagaa

SEQ ID NO: 7699291 - DNA, 22 bp, Homo sapiens
tgtcacacctcgtttagcattc

SEQ ID NO: 7699292 - DNA, 22 bp, Homo sapiens
tgtcacaatatcccaatctgcc

SEQ ID NO: 7699293 - DNA, 22 bp, Homo sapiens
tgtcacaatatcccaatctgcc

SEQ ID NO: 7699294 - DNA, 22 bp, Homo sapiens
tgtcacaagtaactggcaatgc

SEQ ID NO: 7699295 - DNA, 22 bp, Homo sapiens
tgtcacaagtaactggcaatgc

SEQ ID NO: 7699296 - DNA, 22 bp, Homo sapiens
tgtatttttagacctttagacc

SEQ ID NO: 7699297 - DNA, 22 bp, Homo sapiens
tgtatttttaggaatgcgctat

SEQ ID NO: 7699298 - DNA, 22 bp, Homo sapiens
tgtatttttaggaatgcgctat

SEQ ID NO: 7699299 - DNA, 22 bp, Homo sapiens
tgtatttttagacctttagacc

SEQ ID NO: 7699300 - DNA, 22 bp, Homo sapiens
tgtatttttaggaatgcgctat

SEQ ID NO: 7699301 - DNA, 22 bp, Homo sapiens
tgtatttttaggaatgcgctat

SEQ ID NO: 7699302 - DNA, 22 bp, Homo sapiens
tgtcaaaaagctgggacaagca

SEQ ID NO: 7699303 - DNA, 22 bp, Homo sapiens
tgtatttttaggaatgcgctat

SEQ ID NO: 7699304 - DNA, 22 bp, Homo sapiens
tgtcaaaaataagagagattgt

SEQ ID NO: 7699305 - DNA, 22 bp, Homo sapiens
tgtcaaaaagctgggacaagca

SEQ ID NO: 7699306 - DNA, 22 bp, Homo sapiens
tgtatttttagacctttagacc

SEQ ID NO: 7699307 - DNA, 22 bp, Homo sapiens
tgtattttgtgaggatcactct

SEQ ID NO: 7699308 - DNA, 22 bp, Homo sapiens
tgtatttttagacctttagacc

SEQ ID NO: 7699309 - DNA, 22 bp, Homo sapiens
tgtatttttagacctttagacc

SEQ ID NO: 7699310 - DNA, 22 bp, Homo sapiens
tgtatttttagacctttagacc

SEQ ID NO: 7699311 - DNA, 22 bp, Homo sapiens
tgtatttttagacctttagacc

SEQ ID NO: 7699312 - DNA, 22 bp, Homo sapiens
tgtatttttagacctttagacc

SEQ ID NO: 7699313 - DNA, 22 bp, Homo sapiens
tgtatttttagacctttagacc

SEQ ID NO: 7699314 - DNA, 22 bp, Homo sapiens
tgtatttttagacctttagacc

SEQ ID NO: 7699315 - DNA, 22 bp, Homo sapiens
tgtatttttagacctttagacc

SEQ ID NO: 7699316 - DNA, 22 bp, Homo sapiens
tgtatttttagacctttagacc

SEQ ID NO: 7699317 - DNA, 22 bp, Homo sapiens
tgtatttttagacctttagacc

SEQ ID NO: 7699318 - DNA, 22 bp, Homo sapiens
tgtcaaaaataagagagattgt

SEQ ID NO: 7699319 - DNA, 22 bp, Homo sapiens
tgtcaaaaataagagagattgt

SEQ ID NO: 7699320 - DNA, 22 bp, Homo sapiens
tgtcaaaaccttggaggcaagg

SEQ ID NO: 7699321 - DNA, 22 bp, Homo sapiens
tgtcaaaaccagcaattttgtt

SEQ ID NO: 7699322 - DNA, 22 bp, Homo sapiens
tgtcaaaaccagcaattttgtt

SEQ ID NO: 7699323 - DNA, 22 bp, Homo sapiens
tgtcaaaatgactttactacag

SEQ ID NO: 7699324 - DNA, 22 bp, Homo sapiens
tgtcaaaatgactttactacag

SEQ ID NO: 7699325 - DNA, 22 bp, Homo sapiens
tgtcaaagacagaaggaaatgg

SEQ ID NO: 7699326 - DNA, 22 bp, Homo sapiens
tgtcaaactgtgacttctaatg

SEQ ID NO: 7699327 - DNA, 22 bp, Homo sapiens
tgtcaaagcaaggattaaatgt

SEQ ID NO: 7699328 - DNA, 21 bp, Homo sapiens
tgtcacattgtccctgctgct

SEQ ID NO: 7699329 - DNA, 23 bp, Homo sapiens
tgtcacatttagttggcattgtt

SEQ ID NO: 7699330 - DNA, 21 bp, Homo sapiens
tgtcacattgtccctgctgct

SEQ ID NO: 7699331 - DNA, 22 bp, Homo sapiens
tgtcacattgaatatgatttat

SEQ ID NO: 7699332 - DNA, 22 bp, Homo sapiens
tgtcacattctgatgtgaggtg

SEQ ID NO: 7699333 - DNA, 22 bp, Homo sapiens
tgtcacattgaatatgatttat

SEQ ID NO: 7699334 - DNA, 22 bp, Homo sapiens
tgtcacattatatgtgaggata

SEQ ID NO: 7699335 - DNA, 22 bp, Homo sapiens
tgtcacattctgatgtgaggtg

SEQ ID NO: 7699336 - DNA, 22 bp, Homo sapiens
tgtcacatgacacaaatatcta

SEQ ID NO: 7699337 - DNA, 22 bp, Homo sapiens
tgtcacatgacacaaatatcta

SEQ ID NO: 7699338 - DNA, 22 bp, Homo sapiens
tgtcacatgacacaaatatcta

SEQ ID NO: 7699339 - DNA, 22 bp, Homo sapiens
tgtcacatgtgtggcatttttc

SEQ ID NO: 7699340 - DNA, 21 bp, Homo sapiens
tgtcacatgtggatggtattt

SEQ ID NO: 7699341 - DNA, 21 bp, Homo sapiens
tgtcacatgtggatggtattt

SEQ ID NO: 7699342 - DNA, 22 bp, Homo sapiens
tgtcacatgtttaatgtggact

SEQ ID NO: 7699343 - DNA, 22 bp, Homo sapiens
tgtcacatgtttaatgtggact

SEQ ID NO: 7699344 - DNA, 22 bp, Homo sapiens
tgtcacattatatgtgaggata

SEQ ID NO: 7699345 - DNA, 22 bp, Homo sapiens
tgtcacattatatgtgaggata

SEQ ID NO: 7699346 - DNA, 22 bp, Homo sapiens
tgtcacatgtttaatgtggact

SEQ ID NO: 7699347 - DNA, 22 bp, Homo sapiens
tgtcacctctttggctgcagct

SEQ ID NO: 7699348 - DNA, 22 bp, Homo sapiens
tgtcaccatgcgaggctaattt

SEQ ID NO: 7699349 - DNA, 22 bp, Homo sapiens
tgtcaccatgccagcttctgcc

SEQ ID NO: 7699350 - DNA, 22 bp, Homo sapiens
tgtcaccatgccagcttctgcc

SEQ ID NO: 7699351 - DNA, 22 bp, Homo sapiens
tgtcaccatgccagcttctgcc

SEQ ID NO: 7699352 - DNA, 22 bp, Homo sapiens
tgtcaccactggctgaaacacc

SEQ ID NO: 7699353 - DNA, 22 bp, Homo sapiens
tgtcaccaccggaagaaactgc

SEQ ID NO: 7699354 - DNA, 22 bp, Homo sapiens
tgtcaccaccggaagaaactgc

SEQ ID NO: 7699355 - DNA, 22 bp, Homo sapiens
tgtcaccaccggaagaaactgc

SEQ ID NO: 7699356 - DNA, 22 bp, Homo sapiens
tgtcaccaagttgatgaatgca

SEQ ID NO: 7699357 - DNA, 22 bp, Homo sapiens
tgtcaccacatttgtcaatatc

SEQ ID NO: 7699358 - DNA, 22 bp, Homo sapiens
tgtcacataatttatctgtagg

SEQ ID NO: 7699359 - DNA, 22 bp, Homo sapiens
tgtcacataatttatctgtagg

SEQ ID NO: 7699360 - DNA, 22 bp, Homo sapiens
tgtcacataggcaaaatgtttt

SEQ ID NO: 7699361 - DNA, 22 bp, Homo sapiens
tgtcacataatttatctgtagg

SEQ ID NO: 7699362 - DNA, 22 bp, Homo sapiens
tgtcacatatataatgttcaat

SEQ ID NO: 7699363 - DNA, 22 bp, Homo sapiens
tgtcacatatataatgttcaat

SEQ ID NO: 7699364 - DNA, 22 bp, Homo sapiens
tgtcacatgaagccaacatagc

SEQ ID NO: 7699365 - DNA, 22 bp, Homo sapiens
tgtcacatgacacaaatatcta

SEQ ID NO: 7699366 - DNA, 22 bp, Homo sapiens
tgtcacatgaagccaacatagc

SEQ ID NO: 7699367 - DNA, 22 bp, Homo sapiens
tgtcacatgaagccaacatagc

SEQ ID NO: 7699368 - DNA, 22 bp, Homo sapiens
tgtcacatgaaacttgctcatc

SEQ ID NO: 7699369 - DNA, 22 bp, Homo sapiens
tgtcacatgaaacttgctcatc

SEQ ID NO: 7699370 - DNA, 22 bp, Homo sapiens
tgtcacatgaagccaacatagc

SEQ ID NO: 7699371 - DNA, 22 bp, Homo sapiens
tgtcacatcaggggtgttgaca

SEQ ID NO: 7699372 - DNA, 22 bp, Homo sapiens
tgtcacatcaggtggtggctgt

SEQ ID NO: 7699373 - DNA, 22 bp, Homo sapiens
tgtcacatcaggggtgttgaca

SEQ ID NO: 7699374 - DNA, 22 bp, Homo sapiens
tgtcacatgaaacttgctcatc

SEQ ID NO: 7699375 - DNA, 22 bp, Homo sapiens
tgtcacatgaaacttgctcatc

SEQ ID NO: 7699376 - DNA, 22 bp, Homo sapiens
tgtcacatccattttgcaagta

SEQ ID NO: 7699377 - DNA, 22 bp, Homo sapiens
tgtcacatccattttgcaagta

SEQ ID NO: 7699378 - DNA, 22 bp, Homo sapiens
tgtcacagggataccatggggc

SEQ ID NO: 7699379 - DNA, 21 bp, Homo sapiens
tgtcacagattctcagcttgc

SEQ ID NO: 7699380 - DNA, 22 bp, Homo sapiens
tgtcacagggataccatggggc

SEQ ID NO: 7699381 - DNA, 21 bp, Homo sapiens
tgtcacagattctcagcttgc

SEQ ID NO: 7699382 - DNA, 21 bp, Homo sapiens
tgtcacagattctcagcttgc

SEQ ID NO: 7699383 - DNA, 21 bp, Homo sapiens
tgtcacagattctcagcttgc

SEQ ID NO: 7699384 - DNA, 22 bp, Homo sapiens
tgtcacagatcgtttttgagct

SEQ ID NO: 7699385 - DNA, 22 bp, Homo sapiens
tgtcacagatcgtttttgagct

SEQ ID NO: 7699386 - DNA, 22 bp, Homo sapiens
tgtcacagagcgtgcaacagaa

SEQ ID NO: 7699387 - DNA, 22 bp, Homo sapiens
tgtcacagagcgtgcaacagaa

SEQ ID NO: 7699388 - DNA, 22 bp, Homo sapiens
tgtcacagagcgtgcaacagaa

SEQ ID NO: 7699389 - DNA, 22 bp, Homo sapiens
tgtcacagagcgtgcaacagaa

SEQ ID NO: 7699390 - DNA, 22 bp, Homo sapiens
tgtcacagagcgtgcaacagaa

SEQ ID NO: 7699391 - DNA, 22 bp, Homo sapiens
tgtcacagtgcacagctaagaa

SEQ ID NO: 7699392 - DNA, 22 bp, Homo sapiens
tgtcacagtgcacagctaagaa

SEQ ID NO: 7699393 - DNA, 22 bp, Homo sapiens
tgtcacagtgcacagctaagaa

SEQ ID NO: 7699394 - DNA, 22 bp, Homo sapiens
tgtcacagtctcgtgagcatct

SEQ ID NO: 7699395 - DNA, 22 bp, Homo sapiens
tgtcacagtttgtactttatag

SEQ ID NO: 7699396 - DNA, 22 bp, Homo sapiens
tgtcacagtgcacagctaagaa

SEQ ID NO: 7699397 - DNA, 22 bp, Homo sapiens
tgtcacagtttgtactttatag

SEQ ID NO: 7699398 - DNA, 22 bp, Homo sapiens
tgtcacagtctcgtgagcatct

SEQ ID NO: 7699399 - DNA, 22 bp, Homo sapiens
tgtcacagtctcgtgagcatct

SEQ ID NO: 7699400 - DNA, 22 bp, Homo sapiens
tgtcacagggataccatggggc

SEQ ID NO: 7699401 - DNA, 22 bp, Homo sapiens
tgtcacagtctcgtgagcatct

SEQ ID NO: 7699402 - DNA, 22 bp, Homo sapiens
tgtcacagtctcgtgagcatct

SEQ ID NO: 7699403 - DNA, 22 bp, Homo sapiens
tgtagaaactacacatgcaaca

SEQ ID NO: 7699404 - DNA, 22 bp, Homo sapiens
tgtagaaactacacatgcaaca

SEQ ID NO: 7699405 - DNA, 22 bp, Homo sapiens
tgtagaaagaatatgtttcata

SEQ ID NO: 7699406 - DNA, 22 bp, Homo sapiens
tgtagaaactacacatgcaaca

SEQ ID NO: 7699407 - DNA, 22 bp, Homo sapiens
tgtagaaaattggagcattcat

SEQ ID NO: 7699408 - DNA, 22 bp, Homo sapiens
tgtagaaaattggagcattcat

SEQ ID NO: 7699409 - DNA, 18 bp, Homo sapiens
tgtagaaaagataggaat

SEQ ID NO: 7699410 - DNA, 18 bp, Homo sapiens
tgtagaaaagataggaat

SEQ ID NO: 7699411 - DNA, 18 bp, Homo sapiens
tgtagaaaagataggaat

SEQ ID NO: 7699412 - DNA, 22 bp, Homo sapiens
tgtacttgcttattagaaatct

SEQ ID NO: 7699413 - DNA, 22 bp, Homo sapiens
tgtacttgcttattagaaatct

SEQ ID NO: 7699414 - DNA, 22 bp, Homo sapiens
tgtagaaaattggagcattcat

SEQ ID NO: 7699415 - DNA, 22 bp, Homo sapiens
tgtagaaaattggagcattcat

SEQ ID NO: 7699416 - DNA, 22 bp, Homo sapiens
tgtagaaaattggagcattcat

SEQ ID NO: 7699417 - DNA, 22 bp, Homo sapiens
tgtactgtattcatctttaact

SEQ ID NO: 7699418 - DNA, 22 bp, Homo sapiens
tgtactgtatgccaggcactat

SEQ ID NO: 7699419 - DNA, 20 bp, Homo sapiens
tgtactgcttgataaatggt

SEQ ID NO: 7699420 - DNA, 22 bp, Homo sapiens
tgtactcagctcagatctcagg

SEQ ID NO: 7699421 - DNA, 22 bp, Homo sapiens
tgtactaggggtgtggaaggta

SEQ ID NO: 7699422 - DNA, 22 bp, Homo sapiens
tgtactattaagaggcctaaat

SEQ ID NO: 7699423 - DNA, 19 bp, Homo sapiens
tgtacgtgtgggtgtttaa

SEQ ID NO: 7699424 - DNA, 22 bp, Homo sapiens
tgtacgctcacatctgaccata

SEQ ID NO: 7699425 - DNA, 22 bp, Homo sapiens
tgtacgctcacgtcctcagtcc

SEQ ID NO: 7699426 - DNA, 22 bp, Homo sapiens
tgtactaatgcatttaactaac

SEQ ID NO: 7699427 - DNA, 22 bp, Homo sapiens
tgtactacatgattattgacca

SEQ ID NO: 7699428 - DNA, 22 bp, Homo sapiens
tgtacttgaacttgactgtaga

SEQ ID NO: 7699429 - DNA, 22 bp, Homo sapiens
tgtacttgaacttgactgtaga

SEQ ID NO: 7699430 - DNA, 22 bp, Homo sapiens
tgtacttgcttattagaaatct

SEQ ID NO: 7699431 - DNA, 22 bp, Homo sapiens
tgtacttgaacttgactgtaga

SEQ ID NO: 7699432 - DNA, 22 bp, Homo sapiens
tgtacttgaacttgactgtaga

SEQ ID NO: 7699433 - DNA, 22 bp, Homo sapiens
tgtacttgaacttgactgtaga

SEQ ID NO: 7699434 - DNA, 22 bp, Homo sapiens
tgtacttattttatgtcagcac

SEQ ID NO: 7699435 - DNA, 22 bp, Homo sapiens
tgtactgtattcatctttaact

SEQ ID NO: 7699436 - DNA, 22 bp, Homo sapiens
tgtacttatgagatcctagtcg

SEQ ID NO: 7699437 - DNA, 22 bp, Homo sapiens
tgtacttatgagatcctagtcg

SEQ ID NO: 7699438 - DNA, 22 bp, Homo sapiens
tgtagaaattagtaagatcaac

SEQ ID NO: 7699439 - DNA, 22 bp, Homo sapiens
tgtagaaattagtaagatcaac

SEQ ID NO: 7699440 - DNA, 22 bp, Homo sapiens
tgtagaaagctcttctgaaatc

SEQ ID NO: 7699441 - DNA, 22 bp, Homo sapiens
tgtagaaagctcttctgaaatc

SEQ ID NO: 7699442 - DNA, 22 bp, Homo sapiens
tgtagaaagctcttctgaaatc

SEQ ID NO: 7699443 - DNA, 22 bp, Homo sapiens
tgtagaaagaatatgtttcata

SEQ ID NO: 7699444 - DNA, 22 bp, Homo sapiens
tgtagaaagaatatgtttcata

SEQ ID NO: 7699445 - DNA, 22 bp, Homo sapiens
tgtagaaagaatatgtttcata

SEQ ID NO: 7699446 - DNA, 22 bp, Homo sapiens
tgtagaaagaatatgtttcata

SEQ ID NO: 7699447 - DNA, 22 bp, Homo sapiens
tgtagaaagaatatgtttcata

SEQ ID NO: 7699448 - DNA, 22 bp, Homo sapiens
tgtagaaattagtaagatcaac

SEQ ID NO: 7699449 - DNA, 22 bp, Homo sapiens
tgtagaaattagtaagatcaac

SEQ ID NO: 7699450 - DNA, 22 bp, Homo sapiens
tgtagaaattagtaagatcaac

SEQ ID NO: 7699451 - DNA, 22 bp, Homo sapiens
tgtagaaattagtaagatcaac

SEQ ID NO: 7699452 - DNA, 22 bp, Homo sapiens
tgtagaagtttatgaacacatt

SEQ ID NO: 7699453 - DNA, 22 bp, Homo sapiens
tgtagaagttcttcaggagaat

SEQ ID NO: 7699454 - DNA, 18 bp, Homo sapiens
tgtagacagggcatggaa

SEQ ID NO: 7699455 - DNA, 18 bp, Homo sapiens
tgtagagccaggtttgcc

SEQ ID NO: 7699456 - DNA, 22 bp, Homo sapiens
tgtagactttctttgtgttagt

SEQ ID NO: 7699457 - DNA, 22 bp, Homo sapiens
tgtagacagtgggatctctggg

SEQ ID NO: 7699458 - DNA, 22 bp, Homo sapiens
tgtagaaggctatagactagga

SEQ ID NO: 7699459 - DNA, 22 bp, Homo sapiens
tgtagaagctagcctggagcca

SEQ ID NO: 7699460 - DNA, 22 bp, Homo sapiens
tgtagaagttcttcaggagaat

SEQ ID NO: 7699461 - DNA, 22 bp, Homo sapiens
tgtagaagttcttcaggagaat

SEQ ID NO: 7699462 - DNA, 22 bp, Homo sapiens
tgtagaagtaggagtcatctca

SEQ ID NO: 7699463 - DNA, 22 bp, Homo sapiens
tgtagcaagagcaatccattgt

SEQ ID NO: 7699464 - DNA, 22 bp, Homo sapiens
tgtagattttggagtctacaag

SEQ ID NO: 7699465 - DNA, 22 bp, Homo sapiens
tgtagcaagagcaatccattgt

SEQ ID NO: 7699466 - DNA, 22 bp, Homo sapiens
tgtagcacaaacacagtccagg

SEQ ID NO: 7699467 - DNA, 22 bp, Homo sapiens
tgtagcacagagctttgacact

SEQ ID NO: 7699468 - DNA, 22 bp, Homo sapiens
tgtagcacactcataatctttc

SEQ ID NO: 7699469 - DNA, 22 bp, Homo sapiens
tgtagcacaagatagatacttc

SEQ ID NO: 7699470 - DNA, 22 bp, Homo sapiens
tgtagcacaagatagatacttc

SEQ ID NO: 7699471 - DNA, 22 bp, Homo sapiens
tgtagcagtgtctaccacatta

SEQ ID NO: 7699472 - DNA, 22 bp, Homo sapiens
tgtagcagagtatctctgtttt

SEQ ID NO: 7699473 - DNA, 22 bp, Homo sapiens
tgtagcagtctgggggaattac

SEQ ID NO: 7699474 - DNA, 22 bp, Homo sapiens
tgtagcagtgtctaccacatta

SEQ ID NO: 7699475 - DNA, 19 bp, Homo sapiens
tgtagcagtttaaaacaac

SEQ ID NO: 7699476 - DNA, 19 bp, Homo sapiens
tgtagcagtttaaaacaac

SEQ ID NO: 7699477 - DNA, 22 bp, Homo sapiens
tgtagcactatgcactacacat

SEQ ID NO: 7699478 - DNA, 22 bp, Homo sapiens
tgtagatatagaaaaagactga

SEQ ID NO: 7699479 - DNA, 22 bp, Homo sapiens
tgtagatgagtcagggtgcatg

SEQ ID NO: 7699480 - DNA, 22 bp, Homo sapiens
tgtagatattaattattccttt

SEQ ID NO: 7699481 - DNA, 22 bp, Homo sapiens
tgtagatgagtcagggtgcacc

SEQ ID NO: 7699482 - DNA, 22 bp, Homo sapiens
tgtagactttctttgtgttagt

SEQ ID NO: 7699483 - DNA, 22 bp, Homo sapiens
tgtagaggaggaaactgaggct

SEQ ID NO: 7699484 - DNA, 22 bp, Homo sapiens
tgtagaggaaagatgaaggccg

SEQ ID NO: 7699485 - DNA, 22 bp, Homo sapiens
tgtagaggaggaaactgaggct

SEQ ID NO: 7699486 - DNA, 22 bp, Homo sapiens
tgtagataagtaaaagcccagt

SEQ ID NO: 7699487 - DNA, 22 bp, Homo sapiens
tgtagatacacacatatagtgg

SEQ ID NO: 7699488 - DNA, 22 bp, Homo sapiens
tgtagatacacacatatagtgg

SEQ ID NO: 7699489 - DNA, 22 bp, Homo sapiens
tgtagatacacacatatagtgg

SEQ ID NO: 7699490 - DNA, 22 bp, Homo sapiens
tgtagccagaagtcatagggtg

SEQ ID NO: 7699491 - DNA, 22 bp, Homo sapiens
tgtagcctttatgtgagaagga

SEQ ID NO: 7699492 - DNA, 22 bp, Homo sapiens
tgtagctctccagccagcaagg

SEQ ID NO: 7699493 - DNA, 23 bp, Homo sapiens
tgtagcatctcttatttctcagc

SEQ ID NO: 7699494 - DNA, 22 bp, Homo sapiens
tgtagcatgtaaattggttatt

SEQ ID NO: 7699495 - DNA, 22 bp, Homo sapiens
tgtagcagtttttcattatcca

SEQ ID NO: 7699496 - DNA, 19 bp, Homo sapiens
tgtagcagtttaaaacaac

SEQ ID NO: 7699497 - DNA, 18 bp, Homo sapiens
tgtagctggaggccaggc

SEQ ID NO: 7699498 - DNA, 22 bp, Homo sapiens
tgtagctctccagccagcaagg

SEQ ID NO: 7699499 - DNA, 22 bp, Homo sapiens
tgtagctctccagccagcaagg

SEQ ID NO: 7699500 - DNA, 18 bp, Homo sapiens
tgtagctggaggccaggc

SEQ ID NO: 7699501 - DNA, 22 bp, Homo sapiens
tgtagcagtgtctaccacatta

SEQ ID NO: 7699502 - DNA, 18 bp, Homo sapiens
tgtagctggaggccaggc

SEQ ID NO: 7699503 - DNA, 17 bp, Homo sapiens
tgtagcttctccttctc

SEQ ID NO: 7699504 - DNA, 20 bp, Homo sapiens
tgtaggaaggaccctgtctg

SEQ ID NO: 7699505 - DNA, 22 bp, Homo sapiens
tgtaggaatggattctagaagg

SEQ ID NO: 7699506 - DNA, 22 bp, Homo sapiens
tgtaggaatggattctagaagg

SEQ ID NO: 7699507 - DNA, 22 bp, Homo sapiens
tgtaggaactcacagatattct

SEQ ID NO: 7699508 - DNA, 22 bp, Homo sapiens
tgtaggaaagttgtgagtctgg

SEQ ID NO: 7699509 - DNA, 17 bp, Homo sapiens
tgtagcttctccttctc

SEQ ID NO: 7699510 - DNA, 17 bp, Homo sapiens
tgtagcttctccttctc

SEQ ID NO: 7699511 - DNA, 23 bp, Homo sapiens
tgtagctttatacaagatctgtt

SEQ ID NO: 7699512 - DNA, 17 bp, Homo sapiens
tgtagcttctccttctc

SEQ ID NO: 7699513 - DNA, 17 bp, Homo sapiens
tgtagcttctccttctc

SEQ ID NO: 7699514 - DNA, 22 bp, Homo sapiens
tgtaggaaaaacaatgatctgc

SEQ ID NO: 7699515 - DNA, 22 bp, Homo sapiens
tgtaggaaaaacaatgatctgc

SEQ ID NO: 7699516 - DNA, 22 bp, Homo sapiens
tgtatacatttggtgcatattt

SEQ ID NO: 7699517 - DNA, 22 bp, Homo sapiens
tgtatacatttggtgcatattt

SEQ ID NO: 7699518 - DNA, 22 bp, Homo sapiens
tgtatacatttaactagataga

SEQ ID NO: 7699519 - DNA, 22 bp, Homo sapiens
tgtatacatttaactagataga

SEQ ID NO: 7699520 - DNA, 22 bp, Homo sapiens
tgtatacatttaactagataga

SEQ ID NO: 7699521 - DNA, 22 bp, Homo sapiens
tgtatacatttggtgcatattt

SEQ ID NO: 7699522 - DNA, 22 bp, Homo sapiens
tgtatagagttggaagatgact

SEQ ID NO: 7699523 - DNA, 22 bp, Homo sapiens
tgtatagagttggaagatgact

SEQ ID NO: 7699524 - DNA, 22 bp, Homo sapiens
tgtatataagcatttacttgtt

SEQ ID NO: 7699525 - DNA, 22 bp, Homo sapiens
tgtatagatgaggaagctgtta

SEQ ID NO: 7699526 - DNA, 22 bp, Homo sapiens
tgtatagatgaggaagctgtta

SEQ ID NO: 7699527 - DNA, 22 bp, Homo sapiens
tgtatataagcatttacttgtt

SEQ ID NO: 7699528 - DNA, 22 bp, Homo sapiens
tgtatataagcatttacttgtt

SEQ ID NO: 7699529 - DNA, 22 bp, Homo sapiens
tgtatatacatacacacatgaa

SEQ ID NO: 7699530 - DNA, 22 bp, Homo sapiens
tgtatatacatacacacatgaa

SEQ ID NO: 7699531 - DNA, 22 bp, Homo sapiens
tgtatacatttaactagataga

SEQ ID NO: 7699532 - DNA, 22 bp, Homo sapiens
tgtatacatttaactagataga

SEQ ID NO: 7699533 - DNA, 22 bp, Homo sapiens
tgtatacatttaactagataga

SEQ ID NO: 7699534 - DNA, 22 bp, Homo sapiens
tgtatacatgtctgtgtgcaca

SEQ ID NO: 7699535 - DNA, 22 bp, Homo sapiens
tgtatacatgtctgtgtgcaca

SEQ ID NO: 7699536 - DNA, 22 bp, Homo sapiens
tgtatacatgtgttcatgcatg

SEQ ID NO: 7699537 - DNA, 22 bp, Homo sapiens
tgtatacatgtgttcatgcatg

SEQ ID NO: 7699538 - DNA, 22 bp, Homo sapiens
tgtatacatgtgtgttcacgca

SEQ ID NO: 7699539 - DNA, 22 bp, Homo sapiens
tgtatacatgtgttcatgcatg

SEQ ID NO: 7699540 - DNA, 22 bp, Homo sapiens
tgtatacaggcataagagatac

SEQ ID NO: 7699541 - DNA, 22 bp, Homo sapiens
tgtatacaggcataagagatac

SEQ ID NO: 7699542 - DNA, 22 bp, Homo sapiens
tgtatacaggcataagagatac

SEQ ID NO: 7699543 - DNA, 22 bp, Homo sapiens
tgtatacaggattactcatagc

SEQ ID NO: 7699544 - DNA, 22 bp, Homo sapiens
tgtatacaggattactcatagc

SEQ ID NO: 7699545 - DNA, 22 bp, Homo sapiens
tgtatacatacatatgtgtgtg

SEQ ID NO: 7699546 - DNA, 22 bp, Homo sapiens
tgtatacatgtctgtgtgcaca

SEQ ID NO: 7699547 - DNA, 22 bp, Homo sapiens
tgtatacaggcataagagatac

SEQ ID NO: 7699548 - DNA, 22 bp, Homo sapiens
tgtatacaggcataagagatac

SEQ ID NO: 7699549 - DNA, 22 bp, Homo sapiens
tgtatacactatgctatatggt

SEQ ID NO: 7699550 - DNA, 22 bp, Homo sapiens
tgtatacactatgctatatggt

SEQ ID NO: 7699551 - DNA, 22 bp, Homo sapiens
tgtatacactatgctatatggt

SEQ ID NO: 7699552 - DNA, 22 bp, Homo sapiens
tgtatacaggattactcatagc

SEQ ID NO: 7699553 - DNA, 22 bp, Homo sapiens
tgtatacaggattactcatagc

SEQ ID NO: 7699554 - DNA, 22 bp, Homo sapiens
tgtatacaggattactcatagc

SEQ ID NO: 7699555 - DNA, 21 bp, Homo sapiens
tgtatacacgtgttgaaaaca

SEQ ID NO: 7699556 - DNA, 21 bp, Homo sapiens
tgtatacacgtgttgaaaaca

SEQ ID NO: 7699557 - DNA, 21 bp, Homo sapiens
tgtatacacgtgttgaaaaca

SEQ ID NO: 7699558 - DNA, 22 bp, Homo sapiens
tgtatacacgtaccttttcttt

SEQ ID NO: 7699559 - DNA, 22 bp, Homo sapiens
tgtatacaattcacacttccca

SEQ ID NO: 7699560 - DNA, 21 bp, Homo sapiens
tgtatacacacatatatgtac

SEQ ID NO: 7699561 - DNA, 22 bp, Homo sapiens
tgtatacaagtcgtgtaaactt

SEQ ID NO: 7699562 - DNA, 22 bp, Homo sapiens
tgtatacaagtcgtgtaaactt

SEQ ID NO: 7699563 - DNA, 21 bp, Homo sapiens
tgtatacacacatatatgtac

SEQ ID NO: 7699564 - DNA, 21 bp, Homo sapiens
tgtatacacacatatatgtac

SEQ ID NO: 7699565 - DNA, 21 bp, Homo sapiens
tgtatacacacatatatgtac

SEQ ID NO: 7699566 - DNA, 23 bp, Homo sapiens
tgtatacaccctgtgcatctggg

SEQ ID NO: 7699567 - DNA, 21 bp, Homo sapiens
tgtatacacacatatatgtac

SEQ ID NO: 7699568 - DNA, 23 bp, Homo sapiens
tgtatacaccctgtgcatctggg

SEQ ID NO: 7699569 - DNA, 22 bp, Homo sapiens
tgtataaatttaaattcctgct

SEQ ID NO: 7699570 - DNA, 22 bp, Homo sapiens
tgtataaatttaaattcctgct

SEQ ID NO: 7699571 - DNA, 22 bp, Homo sapiens
tgtataaacttaagcaggaacc

SEQ ID NO: 7699572 - DNA, 22 bp, Homo sapiens
tgtataaacttaagcaggaacc

SEQ ID NO: 7699573 - DNA, 22 bp, Homo sapiens
tgtataaacttaagcaggaacc

SEQ ID NO: 7699574 - DNA, 22 bp, Homo sapiens
tgtataaacttaagcaggaacc

SEQ ID NO: 7699575 - DNA, 22 bp, Homo sapiens
tgtataaacttaagcaggaacc

SEQ ID NO: 7699576 - DNA, 21 bp, Homo sapiens
tgtataacaactatgcaatgt

SEQ ID NO: 7699577 - DNA, 21 bp, Homo sapiens
tgtataacaactatgcaatgt

SEQ ID NO: 7699578 - DNA, 22 bp, Homo sapiens
tgtataaatttaaattcctgct

SEQ ID NO: 7699579 - DNA, 22 bp, Homo sapiens
tgtatacaagtcgtgtaaactt

SEQ ID NO: 7699580 - DNA, 22 bp, Homo sapiens
tgtatacaagtcgtgtaaactt

SEQ ID NO: 7699581 - DNA, 22 bp, Homo sapiens
tgtatacaagtcgtgtaaactt

SEQ ID NO: 7699582 - DNA, 22 bp, Homo sapiens
tgtataagtgtgtagagtaaga

SEQ ID NO: 7699583 - DNA, 22 bp, Homo sapiens
tgtataagcctagtgaaatttc

SEQ ID NO: 7699584 - DNA, 22 bp, Homo sapiens
tgtataacttgtggttatgaat

SEQ ID NO: 7699585 - DNA, 22 bp, Homo sapiens
tgtataacttgtggttatgaat

SEQ ID NO: 7699586 - DNA, 19 bp, Homo sapiens
tgtataagaatgtatctgt

SEQ ID NO: 7699587 - DNA, 22 bp, Homo sapiens
tgtataacacgcagttgagagg

SEQ ID NO: 7699588 - DNA, 17 bp, Homo sapiens
tgtataacctctggctt

SEQ ID NO: 7699589 - DNA, 22 bp, Homo sapiens
tgtataactcttgttggagttt

SEQ ID NO: 7699590 - DNA, 22 bp, Homo sapiens
tgtatgaagccagaatctgttt

SEQ ID NO: 7699591 - DNA, 22 bp, Homo sapiens
tgtatgaagacttcttctgtgt

SEQ ID NO: 7699592 - DNA, 22 bp, Homo sapiens
tgtatgaatatgtattttcata

SEQ ID NO: 7699593 - DNA, 22 bp, Homo sapiens
tgtatgaatctcatttgtttaa

SEQ ID NO: 7699594 - DNA, 22 bp, Homo sapiens
tgtatgaggcatacatcaggca

SEQ ID NO: 7699595 - DNA, 22 bp, Homo sapiens
tgtatgaatgggaaaaggaaac

SEQ ID NO: 7699596 - DNA, 22 bp, Homo sapiens
tgtatgacagaaacaccgaaat

SEQ ID NO: 7699597 - DNA, 22 bp, Homo sapiens
tgtatgcaataataactatgtg

SEQ ID NO: 7699598 - DNA, 22 bp, Homo sapiens
tgtatgcaaatttattagcaca

SEQ ID NO: 7699599 - DNA, 22 bp, Homo sapiens
tgtatgcaaatttattagcaca

SEQ ID NO: 7699600 - DNA, 22 bp, Homo sapiens
tgtatgcaaatttattagcaca

SEQ ID NO: 7699601 - DNA, 22 bp, Homo sapiens
tgtatgaacctttaatatagtg

SEQ ID NO: 7699602 - DNA, 22 bp, Homo sapiens
tgtatgaacctttaatatagtg

SEQ ID NO: 7699603 - DNA, 22 bp, Homo sapiens
tgtatctttctgtacttttatg

SEQ ID NO: 7699604 - DNA, 22 bp, Homo sapiens
tgtatgaaaaggaatagattga

SEQ ID NO: 7699605 - DNA, 22 bp, Homo sapiens
tgtatcttcagtttgtctttcc

SEQ ID NO: 7699606 - DNA, 22 bp, Homo sapiens
tgtatcttcagtttgtctttcc

SEQ ID NO: 7699607 - DNA, 22 bp, Homo sapiens
tgtatcttcagtttgtctttcc

SEQ ID NO: 7699608 - DNA, 22 bp, Homo sapiens
tgtatcttagtgtgaaaatatt

SEQ ID NO: 7699609 - DNA, 22 bp, Homo sapiens
tgtatctgtttagcacccagcc

SEQ ID NO: 7699610 - DNA, 22 bp, Homo sapiens
tgtatcttagtgtgaaaatatt

SEQ ID NO: 7699611 - DNA, 22 bp, Homo sapiens
tgtatcagatcaaatactggct

SEQ ID NO: 7699612 - DNA, 22 bp, Homo sapiens
tgtatctgacagtggagcggag

SEQ ID NO: 7699613 - DNA, 22 bp, Homo sapiens
tgtatctgtaatcccagatcaa

SEQ ID NO: 7699614 - DNA, 22 bp, Homo sapiens
tgtatccatggtggtcaatgac

SEQ ID NO: 7699615 - DNA, 22 bp, Homo sapiens
tgtatcccctgcaggttgctat

SEQ ID NO: 7699616 - DNA, 22 bp, Homo sapiens
tgtatatacatacacacatgaa

SEQ ID NO: 7699617 - DNA, 22 bp, Homo sapiens
tgtatatatttctttcattcta

SEQ ID NO: 7699618 - DNA, 22 bp, Homo sapiens
tgtatatgagtctgagtgtaca

SEQ ID NO: 7699619 - DNA, 22 bp, Homo sapiens
tgtatatatttctttcattcta

SEQ ID NO: 7699620 - DNA, 22 bp, Homo sapiens
tgtatatgtttgtatgtacaca

SEQ ID NO: 7699621 - DNA, 22 bp, Homo sapiens
tgtatatgtgtattttatgaca

SEQ ID NO: 7699622 - DNA, 22 bp, Homo sapiens
tgtatattctgcctaaaagctt

SEQ ID NO: 7699623 - DNA, 22 bp, Homo sapiens
tgtatatgtgtattttatgaca

SEQ ID NO: 7699624 - DNA, 22 bp, Homo sapiens
tgtatatgtgcacatgtgcttc

SEQ ID NO: 7699625 - DNA, 22 bp, Homo sapiens
tgtatatgtgatgtacatgtac

SEQ ID NO: 7699626 - DNA, 22 bp, Homo sapiens
tgtatatgtgatgtacatgtac

SEQ ID NO: 7699627 - DNA, 22 bp, Homo sapiens
tgtatcaagggtttatgtaagc

SEQ ID NO: 7699628 - DNA, 22 bp, Homo sapiens
tgtatcaagggtttatgtaagc

SEQ ID NO: 7699629 - DNA, 22 bp, Homo sapiens
tgtatcaagggtttatgtaagc

SEQ ID NO: 7699630 - DNA, 22 bp, Homo sapiens
tgtatcaagatcagcagctgtt

SEQ ID NO: 7699631 - DNA, 22 bp, Homo sapiens
tgtatcaaaccaaattaattct

SEQ ID NO: 7699632 - DNA, 22 bp, Homo sapiens
tgtatcaaaccaaattaattct

SEQ ID NO: 7699633 - DNA, 20 bp, Homo sapiens
tgtatattttctggtgtaaa

SEQ ID NO: 7699634 - DNA, 20 bp, Homo sapiens
tgtatattttctggtgtaaa

SEQ ID NO: 7699635 - DNA, 20 bp, Homo sapiens
tgtatattttctggtgtaaa

SEQ ID NO: 7699636 - DNA, 22 bp, Homo sapiens
tgtatattgttctgtctcttca

SEQ ID NO: 7699637 - DNA, 22 bp, Homo sapiens
tgtatattgttctgtctcttca

SEQ ID NO: 7699638 - DNA, 22 bp, Homo sapiens
tgtatattgcctgagtctttcc

SEQ ID NO: 7699639 - DNA, 22 bp, Homo sapiens
tgtatattctgcctaaaagctt

SEQ ID NO: 7699640 - DNA, 22 bp, Homo sapiens
tgtatattgcctgagtctttcc

SEQ ID NO: 7699641 - DNA, 22 bp, Homo sapiens
tgtatattctgcctaaaagctt

SEQ ID NO: 7699642 - DNA, 22 bp, Homo sapiens
tgtatattctgcctaaaagctt

SEQ ID NO: 7699643 - DNA, 22 bp, Homo sapiens
tgtccttttggctgtctatggt

SEQ ID NO: 7699644 - DNA, 22 bp, Homo sapiens
tgtccttttctttagtgcagct

SEQ ID NO: 7699645 - DNA, 22 bp, Homo sapiens
tgtccttttggctgtctatggt

SEQ ID NO: 7699646 - DNA, 22 bp, Homo sapiens
tgtcctttttcttaggaaatat

SEQ ID NO: 7699647 - DNA, 22 bp, Homo sapiens
tgtccttttggctgtctatggt

SEQ ID NO: 7699648 - DNA, 22 bp, Homo sapiens
tgtcctttttcttaggaaatat

SEQ ID NO: 7699649 - DNA, 22 bp, Homo sapiens
tgtcctttttcttaggaaatat

SEQ ID NO: 7699650 - DNA, 22 bp, Homo sapiens
tgtccttttctttagtgcagct

SEQ ID NO: 7699651 - DNA, 22 bp, Homo sapiens
tgtccttttccccaaattcact

SEQ ID NO: 7699652 - DNA, 22 bp, Homo sapiens
tgtccttttccccaaattcact

SEQ ID NO: 7699653 - DNA, 22 bp, Homo sapiens
tgtccttttccccaaattcact

SEQ ID NO: 7699654 - DNA, 22 bp, Homo sapiens
tgtccttttccccaaattcact

SEQ ID NO: 7699655 - DNA, 22 bp, Homo sapiens
tgtccttttccccaaattcact

SEQ ID NO: 7699656 - DNA, 22 bp, Homo sapiens
tgtcctttgggagggcacagct

SEQ ID NO: 7699657 - DNA, 22 bp, Homo sapiens
tgtcctttgggagggcacagct

SEQ ID NO: 7699658 - DNA, 22 bp, Homo sapiens
tgtcctttgtgtatctatagta

SEQ ID NO: 7699659 - DNA, 22 bp, Homo sapiens
tgtcctttgttccctgtctctg

SEQ ID NO: 7699660 - DNA, 22 bp, Homo sapiens
tgtcctttgtgtatctatagta

SEQ ID NO: 7699661 - DNA, 22 bp, Homo sapiens
tgtcctttgtgtatctatagta

SEQ ID NO: 7699662 - DNA, 22 bp, Homo sapiens
tgtcctttactgattgcttctg

SEQ ID NO: 7699663 - DNA, 22 bp, Homo sapiens
tgtcctttatgaaatggtgttt

SEQ ID NO: 7699664 - DNA, 22 bp, Homo sapiens
tgtcctttatgaaatggtgttt

SEQ ID NO: 7699665 - DNA, 22 bp, Homo sapiens
tgtccttgttcctaatgtaaaa

SEQ ID NO: 7699666 - DNA, 22 bp, Homo sapiens
tgtccttgttcctaatgtaaaa

SEQ ID NO: 7699667 - DNA, 22 bp, Homo sapiens
tgtccttgttcctaatgtaaaa

SEQ ID NO: 7699668 - DNA, 22 bp, Homo sapiens
tgtcctttactgattgcttctg

SEQ ID NO: 7699669 - DNA, 22 bp, Homo sapiens
tgtccttataagaaaaggaaat

SEQ ID NO: 7699670 - DNA, 22 bp, Homo sapiens
tgtccttgatgaatatgaaatt

SEQ ID NO: 7699671 - DNA, 22 bp, Homo sapiens
tgtccttgatgaatatgaaatt

SEQ ID NO: 7699672 - DNA, 22 bp, Homo sapiens
tgtccttgtgacattctggctt

SEQ ID NO: 7699673 - DNA, 22 bp, Homo sapiens
tgtccttgatgaatatgaaatt

SEQ ID NO: 7699674 - DNA, 21 bp, Homo sapiens
tgtccttaatgcaatgtcctt

SEQ ID NO: 7699675 - DNA, 22 bp, Homo sapiens
tgtcctgggtggatgcttcatt

SEQ ID NO: 7699676 - DNA, 22 bp, Homo sapiens
tgtcctgggtccctgctagaag

SEQ ID NO: 7699677 - DNA, 22 bp, Homo sapiens
tgtcctgggtccctgctagaag

SEQ ID NO: 7699678 - DNA, 22 bp, Homo sapiens
tgtcctgggtccctgctagaag

SEQ ID NO: 7699679 - DNA, 22 bp, Homo sapiens
tgtcctgggtccctgctagaag

SEQ ID NO: 7699680 - DNA, 22 bp, Homo sapiens
tgtcctgggtccctgctagaag

SEQ ID NO: 7699681 - DNA, 22 bp, Homo sapiens
tgtcctgggtccctgctagaag

SEQ ID NO: 7699682 - DNA, 22 bp, Homo sapiens
tgtcctgggtggatgcttcatt

SEQ ID NO: 7699683 - DNA, 21 bp, Homo sapiens
tgtcctggtcactgctctccc

SEQ ID NO: 7699684 - DNA, 21 bp, Homo sapiens
tgtcctggtcactgctctccc

SEQ ID NO: 7699685 - DNA, 21 bp, Homo sapiens
tgtcctggtcactgctctccc

SEQ ID NO: 7699686 - DNA, 22 bp, Homo sapiens
tgtcctggtgctccaggtggct

SEQ ID NO: 7699687 - DNA, 22 bp, Homo sapiens
tgtcctggtgctccaggtggct

SEQ ID NO: 7699688 - DNA, 22 bp, Homo sapiens
tgtcctggtgctccaggtggct

SEQ ID NO: 7699689 - DNA, 22 bp, Homo sapiens
tgtcctggtgctccaggtggct

SEQ ID NO: 7699690 - DNA, 22 bp, Homo sapiens
tgtcctggtgcttcttgggatt

SEQ ID NO: 7699691 - DNA, 22 bp, Homo sapiens
tgtcctggtgcttcttgggatt

SEQ ID NO: 7699692 - DNA, 22 bp, Homo sapiens
tgtcctggtgctccaggtggct

SEQ ID NO: 7699693 - DNA, 22 bp, Homo sapiens
tgtcctgtaggaggcagaacaa

SEQ ID NO: 7699694 - DNA, 22 bp, Homo sapiens
tgtcctgtaggtttatttgtgt

SEQ ID NO: 7699695 - DNA, 22 bp, Homo sapiens
tgtcctggtgcttcttgggatt

SEQ ID NO: 7699696 - DNA, 22 bp, Homo sapiens
tgtcctggtgcttcttgggatt

SEQ ID NO: 7699697 - DNA, 22 bp, Homo sapiens
tgtcctgtctctttcctaattg

SEQ ID NO: 7699698 - DNA, 22 bp, Homo sapiens
tgtcctgtgtagaatgtttata

SEQ ID NO: 7699699 - DNA, 22 bp, Homo sapiens
tgtcctgtgccaccttcctgag

SEQ ID NO: 7699700 - DNA, 22 bp, Homo sapiens
tgtcctcacaggaatgaacttt

SEQ ID NO: 7699701 - DNA, 22 bp, Homo sapiens
tgtcctcacaggaatgaacttt

SEQ ID NO: 7699702 - DNA, 19 bp, Homo sapiens
tgtcctcacagagcataac

SEQ ID NO: 7699703 - DNA, 22 bp, Homo sapiens
tgtcctatttctctgtgcatga

SEQ ID NO: 7699704 - DNA, 22 bp, Homo sapiens
tgtcctatttctctgtgcatga

SEQ ID NO: 7699705 - DNA, 22 bp, Homo sapiens
tgtcctagagtacattccactg

SEQ ID NO: 7699706 - DNA, 22 bp, Homo sapiens
tgtcctagatccagctgtgctg

SEQ ID NO: 7699707 - DNA, 22 bp, Homo sapiens
tgtcctagagacatcagatgtt

SEQ ID NO: 7699708 - DNA, 22 bp, Homo sapiens
tgtccctggtggaggctggcag

SEQ ID NO: 7699709 - DNA, 22 bp, Homo sapiens
tgtcctagagacatcagatgtt

SEQ ID NO: 7699710 - DNA, 22 bp, Homo sapiens
tgtcctggccaaggccttgctt

SEQ ID NO: 7699711 - DNA, 22 bp, Homo sapiens
tgtcctggccaaggccttgctt

SEQ ID NO: 7699712 - DNA, 22 bp, Homo sapiens
tgtcctcaggacctggcacagt

SEQ ID NO: 7699713 - DNA, 22 bp, Homo sapiens
tgtcctggcctccagaaagtcg

SEQ ID NO: 7699714 - DNA, 22 bp, Homo sapiens
tgtcctggcctccagaaagtcg

SEQ ID NO: 7699715 - DNA, 22 bp, Homo sapiens
tgtcctggcctccagaaagtcg

SEQ ID NO: 7699716 - DNA, 22 bp, Homo sapiens
tgtcctgggaaatcccttaggc

SEQ ID NO: 7699717 - DNA, 22 bp, Homo sapiens
tgtcctgggaaatcccttaggc

SEQ ID NO: 7699718 - DNA, 22 bp, Homo sapiens
tgtcctgggaaatcccttaggc

SEQ ID NO: 7699719 - DNA, 22 bp, Homo sapiens
tgtcctcagatatgtctactct

SEQ ID NO: 7699720 - DNA, 22 bp, Homo sapiens
tgtcctcagatatgtctactct

SEQ ID NO: 7699721 - DNA, 19 bp, Homo sapiens
tgtcctcacagagcataac

SEQ ID NO: 7699722 - DNA, 22 bp, Homo sapiens
tgtcctggggacaagaggccct

SEQ ID NO: 7699723 - DNA, 22 bp, Homo sapiens
tgtcctggggacaagaggccct

SEQ ID NO: 7699724 - DNA, 22 bp, Homo sapiens
tgtcctggggacaagaggccct

SEQ ID NO: 7699725 - DNA, 22 bp, Homo sapiens
tgtcctggggacaagaggccct

SEQ ID NO: 7699726 - DNA, 22 bp, Homo sapiens
tgtcctggggacaagaggccct

SEQ ID NO: 7699727 - DNA, 22 bp, Homo sapiens
tgtcctggggacaagaggccct

SEQ ID NO: 7699728 - DNA, 22 bp, Homo sapiens
tgtcctggggcgacttggggcc

SEQ ID NO: 7699729 - DNA, 22 bp, Homo sapiens
tgtcctggggcgacttggggcc

SEQ ID NO: 7699730 - DNA, 22 bp, Homo sapiens
tgtcctggggcgacttggggcc

SEQ ID NO: 7699731 - DNA, 22 bp, Homo sapiens
tgtcctgggtcaaccaggtcga

SEQ ID NO: 7699732 - DNA, 22 bp, Homo sapiens
tgtcctgggtcaaatcctggtc

SEQ ID NO: 7699733 - DNA, 22 bp, Homo sapiens
tgtcctgggtcaaatcctggtc

SEQ ID NO: 7699734 - DNA, 22 bp, Homo sapiens
tgtcctgggtcaaccaggtcga

SEQ ID NO: 7699735 - DNA, 22 bp, Homo sapiens
tgtcctgggtcaaccaggtcga

SEQ ID NO: 7699736 - DNA, 22 bp, Homo sapiens
tgtcctgggtcaaccaggtcga

SEQ ID NO: 7699737 - DNA, 22 bp, Homo sapiens
tgtcctgggtcaaatcctggtc

SEQ ID NO: 7699738 - DNA, 22 bp, Homo sapiens
tgtcctggggcgacttggggcc

SEQ ID NO: 7699739 - DNA, 22 bp, Homo sapiens
tgtcctgggaatgggatgcagt

SEQ ID NO: 7699740 - DNA, 22 bp, Homo sapiens
tgtcctgggaatgggatgcagt

SEQ ID NO: 7699741 - DNA, 22 bp, Homo sapiens
tgtcctgggaatgggatgcagt

SEQ ID NO: 7699742 - DNA, 22 bp, Homo sapiens
tgtcctgggaatgggatgcagt

SEQ ID NO: 7699743 - DNA, 22 bp, Homo sapiens
tgtcctgggaactcacagtcca

SEQ ID NO: 7699744 - DNA, 22 bp, Homo sapiens
tgtcctgggaactcacagtcca

SEQ ID NO: 7699745 - DNA, 22 bp, Homo sapiens
tgtcctgggaactcacagtcca

SEQ ID NO: 7699746 - DNA, 22 bp, Homo sapiens
tgtcctgggccggcgactggtc

SEQ ID NO: 7699747 - DNA, 22 bp, Homo sapiens
tgtcctgggccggcgactggtc

SEQ ID NO: 7699748 - DNA, 22 bp, Homo sapiens
tgtcctgggaggcggggtccag

SEQ ID NO: 7699749 - DNA, 22 bp, Homo sapiens
tgtcctgggccggcgactggtc

SEQ ID NO: 7699750 - DNA, 22 bp, Homo sapiens
tgtcctgggccggcgactggtc

SEQ ID NO: 7699751 - DNA, 22 bp, Homo sapiens
tgtcctgggccggcgactggtc

SEQ ID NO: 7699752 - DNA, 22 bp, Homo sapiens
tgtcctgggaggcggggtccag

SEQ ID NO: 7699753 - DNA, 22 bp, Homo sapiens
tgtcctgggaatgggatgcagt

SEQ ID NO: 7699754 - DNA, 22 bp, Homo sapiens
tgtcctgggaatgggatgcagt

SEQ ID NO: 7699755 - DNA, 22 bp, Homo sapiens
tgtcctgggaatgggatgcagt

SEQ ID NO: 7699756 - DNA, 22 bp, Homo sapiens
tgtcccagggaaggcccagcac

SEQ ID NO: 7699757 - DNA, 22 bp, Homo sapiens
tgtcccaggctgaagtacagtg

SEQ ID NO: 7699758 - DNA, 22 bp, Homo sapiens
tgtcccaggctgaagtacagtg

SEQ ID NO: 7699759 - DNA, 22 bp, Homo sapiens
tgtcccagggaaggcccagcac

SEQ ID NO: 7699760 - DNA, 22 bp, Homo sapiens
tgtcccaggtcctagatgacca

SEQ ID NO: 7699761 - DNA, 22 bp, Homo sapiens
tgtcccaggtcctagatgacca

SEQ ID NO: 7699762 - DNA, 22 bp, Homo sapiens
tgtcccagggaaggcccagcac

SEQ ID NO: 7699763 - DNA, 22 bp, Homo sapiens
tgtcccagctgtctctgttttt

SEQ ID NO: 7699764 - DNA, 22 bp, Homo sapiens
tgtcccagcactttgggagtct

SEQ ID NO: 7699765 - DNA, 22 bp, Homo sapiens
tgtcccagcagctgggttctct

SEQ ID NO: 7699766 - DNA, 22 bp, Homo sapiens
tgtcccagctgtctctgttttt

SEQ ID NO: 7699767 - DNA, 22 bp, Homo sapiens
tgtcccaggcctcatgttgcca

SEQ ID NO: 7699768 - DNA, 22 bp, Homo sapiens
tgtcccaggctgaagtacagtg

SEQ ID NO: 7699769 - DNA, 22 bp, Homo sapiens
tgtcccaggcctcatgttgcca

SEQ ID NO: 7699770 - DNA, 17 bp, Homo sapiens
tgtcccaggctcaacgc

SEQ ID NO: 7699771 - DNA, 17 bp, Homo sapiens
tgtcccaggctcaacgc

SEQ ID NO: 7699772 - DNA, 22 bp, Homo sapiens
tgtcccagtcaaggctgtcatc

SEQ ID NO: 7699773 - DNA, 22 bp, Homo sapiens
tgtcccagtcaaggctgtcatc

SEQ ID NO: 7699774 - DNA, 22 bp, Homo sapiens
tgtcccagtcaaggctgtcatc

SEQ ID NO: 7699775 - DNA, 22 bp, Homo sapiens
tgtcccaggtcctagatgacca

SEQ ID NO: 7699776 - DNA, 22 bp, Homo sapiens
tgtcccagttcccagggttgct

SEQ ID NO: 7699777 - DNA, 22 bp, Homo sapiens
tgtcccagttgggtattgaatt

SEQ ID NO: 7699778 - DNA, 22 bp, Homo sapiens
tgtcccagttttgcaggttaga

SEQ ID NO: 7699779 - DNA, 22 bp, Homo sapiens
tgtcccagtttatctgggactg

SEQ ID NO: 7699780 - DNA, 22 bp, Homo sapiens
tgtcccagcagctgggttctct

SEQ ID NO: 7699781 - DNA, 22 bp, Homo sapiens
tgtccaggtggcctctgctgct

SEQ ID NO: 7699782 - DNA, 22 bp, Homo sapiens
tgtccaggtgtgtctaaagaga

SEQ ID NO: 7699783 - DNA, 22 bp, Homo sapiens
tgtcccagcactttgggagtct

SEQ ID NO: 7699784 - DNA, 22 bp, Homo sapiens
tgtccaggtgtgtctaaagaga

SEQ ID NO: 7699785 - DNA, 22 bp, Homo sapiens
tgtccaggtggcctctgctgct

SEQ ID NO: 7699786 - DNA, 22 bp, Homo sapiens
tgtccaggtggcctctgctgct

SEQ ID NO: 7699787 - DNA, 22 bp, Homo sapiens
tgtccaggtggcctctgctgct

SEQ ID NO: 7699788 - DNA, 22 bp, Homo sapiens
tgtccaggtggcctctgctgct

SEQ ID NO: 7699789 - DNA, 22 bp, Homo sapiens
tgtccaggtggcctctgctgct

SEQ ID NO: 7699790 - DNA, 22 bp, Homo sapiens
tgtccaggtcagcagcagggac

SEQ ID NO: 7699791 - DNA, 22 bp, Homo sapiens
tgtccagggggcttacctggag

SEQ ID NO: 7699792 - DNA, 22 bp, Homo sapiens
tgtccaggtcagcagcagggac

SEQ ID NO: 7699793 - DNA, 22 bp, Homo sapiens
tgtccaggtcagcagcagggac

SEQ ID NO: 7699794 - DNA, 22 bp, Homo sapiens
tgtccaggtcagcagcagggac

SEQ ID NO: 7699795 - DNA, 22 bp, Homo sapiens
tgtccaggtcagcagcagggac

SEQ ID NO: 7699796 - DNA, 22 bp, Homo sapiens
tgtccaggcggccttgcctgtt

SEQ ID NO: 7699797 - DNA, 22 bp, Homo sapiens
tgtccaggcggccttgcctgtt

SEQ ID NO: 7699798 - DNA, 22 bp, Homo sapiens
tgtccaggctaaagtgcagtgg

SEQ ID NO: 7699799 - DNA, 22 bp, Homo sapiens
tgtccaggctaaagtgcagtgg

SEQ ID NO: 7699800 - DNA, 22 bp, Homo sapiens
tgtccaggctcccttggtgctg

SEQ ID NO: 7699801 - DNA, 22 bp, Homo sapiens
tgtccagggatggggtcaggga

SEQ ID NO: 7699802 - DNA, 22 bp, Homo sapiens
tgtccagggatggggtcaggga

SEQ ID NO: 7699803 - DNA, 20 bp, Homo sapiens
tgtccaggggatcgttggcc

SEQ ID NO: 7699804 - DNA, 22 bp, Homo sapiens
tgtccagggatggggtcaggga

SEQ ID NO: 7699805 - DNA, 22 bp, Homo sapiens
tgtccagggatggggtcaggga

SEQ ID NO: 7699806 - DNA, 22 bp, Homo sapiens
tgtccaggctcccttggtgctg

SEQ ID NO: 7699807 - DNA, 22 bp, Homo sapiens
tgtccaggctggagtgcagtgg

SEQ ID NO: 7699808 - DNA, 22 bp, Homo sapiens
tgtccaggctggagtgcagtgg

SEQ ID NO: 7699809 - DNA, 22 bp, Homo sapiens
tgtccctggagcttctgtcccc

SEQ ID NO: 7699810 - DNA, 22 bp, Homo sapiens
tgtccctggactccaggagcca

SEQ ID NO: 7699811 - DNA, 22 bp, Homo sapiens
tgtccctggactccaggagcca

SEQ ID NO: 7699812 - DNA, 22 bp, Homo sapiens
tgtccctgctgtacttagagca

SEQ ID NO: 7699813 - DNA, 22 bp, Homo sapiens
tgtccctgctgtacttagagca

SEQ ID NO: 7699814 - DNA, 22 bp, Homo sapiens
tgtccctggaactatggctcca

SEQ ID NO: 7699815 - DNA, 22 bp, Homo sapiens
tgtccctggaactatggctcca

SEQ ID NO: 7699816 - DNA, 22 bp, Homo sapiens
tgtccctggagcttctgtcccc

SEQ ID NO: 7699817 - DNA, 22 bp, Homo sapiens
tgtccctggagcttctgtcccc

SEQ ID NO: 7699818 - DNA, 19 bp, Homo sapiens
tgtccctggtcaccagact

SEQ ID NO: 7699819 - DNA, 19 bp, Homo sapiens
tgtccctggtcaccagact

SEQ ID NO: 7699820 - DNA, 22 bp, Homo sapiens
tgtccctggtggaggctggcag

SEQ ID NO: 7699821 - DNA, 19 bp, Homo sapiens
tgtccctggtcaccagact

SEQ ID NO: 7699822 - DNA, 19 bp, Homo sapiens
tgtccctggtcaccagact

SEQ ID NO: 7699823 - DNA, 22 bp, Homo sapiens
tgtccctttgtgttctgaaact

SEQ ID NO: 7699824 - DNA, 19 bp, Homo sapiens
tgtccgtggccttctggat

SEQ ID NO: 7699825 - DNA, 20 bp, Homo sapiens
tgtcctaatagacaagcaga

SEQ ID NO: 7699826 - DNA, 18 bp, Homo sapiens
tgtccctgcaaataacat

SEQ ID NO: 7699827 - DNA, 18 bp, Homo sapiens
tgtccctgcaaataacat

SEQ ID NO: 7699828 - DNA, 18 bp, Homo sapiens
tgtccctgcaaataacat

SEQ ID NO: 7699829 - DNA, 18 bp, Homo sapiens
tgtccctgcaaataacat

SEQ ID NO: 7699830 - DNA, 18 bp, Homo sapiens
tgtccctgcaaataacat

SEQ ID NO: 7699831 - DNA, 22 bp, Homo sapiens
tgtccctgctgtacttagagca

SEQ ID NO: 7699832 - DNA, 22 bp, Homo sapiens
tgtccctgcctgcccactctgt

SEQ ID NO: 7699833 - DNA, 22 bp, Homo sapiens
tgtccctgcctgcccactctgt

SEQ ID NO: 7699834 - DNA, 22 bp, Homo sapiens
tgtccctctgaggcttccctgg

SEQ ID NO: 7699835 - DNA, 22 bp, Homo sapiens
tgtccctctgaggcttccctgg

SEQ ID NO: 7699836 - DNA, 18 bp, Homo sapiens
tgtccctgcaaataacat

SEQ ID NO: 7699837 - DNA, 22 bp, Homo sapiens
tgtccctgatccactggacccc

SEQ ID NO: 7699838 - DNA, 22 bp, Homo sapiens
tgtccctgatccactggacccc

SEQ ID NO: 7699839 - DNA, 22 bp, Homo sapiens
tgtcccctttctttccttcgta

SEQ ID NO: 7699840 - DNA, 22 bp, Homo sapiens
tgtcccctttacctccgcagcc

SEQ ID NO: 7699841 - DNA, 22 bp, Homo sapiens
tgtcccctttctttccttcgta

SEQ ID NO: 7699842 - DNA, 22 bp, Homo sapiens
tgtcccctttacctccgcagcc

SEQ ID NO: 7699843 - DNA, 22 bp, Homo sapiens
tgtcccctttacctccgcagcc

SEQ ID NO: 7699844 - DNA, 22 bp, Homo sapiens
tgtcccctttacctccgcagcc

SEQ ID NO: 7699845 - DNA, 22 bp, Homo sapiens
tgtcccctttacctccgcagcc

SEQ ID NO: 7699846 - DNA, 22 bp, Homo sapiens
tgtccctcattgacgctgtgcc

SEQ ID NO: 7699847 - DNA, 22 bp, Homo sapiens
tgtcccctttctttccttcgta

SEQ ID NO: 7699848 - DNA, 22 bp, Homo sapiens
tgtccctaaagaaacagacatt

SEQ ID NO: 7699849 - DNA, 22 bp, Homo sapiens
tgtcccctgcccagggatggga

SEQ ID NO: 7699850 - DNA, 22 bp, Homo sapiens
tgtcccctgcccagggatggga

SEQ ID NO: 7699851 - DNA, 20 bp, Homo sapiens
tgtcccctagatcccagctc

SEQ ID NO: 7699852 - DNA, 20 bp, Homo sapiens
tgtcccctagatcccagctc

SEQ ID NO: 7699853 - DNA, 20 bp, Homo sapiens
tgtcccctagatcccagctc

SEQ ID NO: 7699854 - DNA, 20 bp, Homo sapiens
tgtcccctagatcccagctc

SEQ ID NO: 7699855 - DNA, 20 bp, Homo sapiens
tgtcccctagatcccagctc

SEQ ID NO: 7699856 - DNA, 22 bp, Homo sapiens
tgtccccattctaagaggtggc

SEQ ID NO: 7699857 - DNA, 20 bp, Homo sapiens
tgtcccctagatcccagctc

SEQ ID NO: 7699858 - DNA, 20 bp, Homo sapiens
tgtcccctagatcccagctc

SEQ ID NO: 7699859 - DNA, 22 bp, Homo sapiens
tgtccccagagcctgttcctgc

SEQ ID NO: 7699860 - DNA, 22 bp, Homo sapiens
tgtccccacctaaatcttatct

SEQ ID NO: 7699861 - DNA, 22 bp, Homo sapiens
tgtccccagagcctgttcctgc

SEQ ID NO: 7699862 - DNA, 20 bp, Homo sapiens
tgtccccacccaaatctcat

SEQ ID NO: 7699863 - DNA, 22 bp, Homo sapiens
tgtccccacccaaatctcatct

SEQ ID NO: 7699864 - DNA, 22 bp, Homo sapiens
tgtccccaggtcctctgccgtc

SEQ ID NO: 7699865 - DNA, 22 bp, Homo sapiens
tgtccccagagcctgttcctgc

SEQ ID NO: 7699866 - DNA, 22 bp, Homo sapiens
tgtccccagcactcactctcca

SEQ ID NO: 7699867 - DNA, 20 bp, Homo sapiens
tgtccccaccaaaatttcat

SEQ ID NO: 7699868 - DNA, 22 bp, Homo sapiens
tgtccccaaggttcagcccaca

SEQ ID NO: 7699869 - DNA, 22 bp, Homo sapiens
tgtcccatggataccaggctat

SEQ ID NO: 7699870 - DNA, 22 bp, Homo sapiens
tgtcccatggacacaacttctt

SEQ ID NO: 7699871 - DNA, 22 bp, Homo sapiens
tgtcagttctggttggctccca

SEQ ID NO: 7699872 - DNA, 22 bp, Homo sapiens
tgtcagtttagttgaagaaaga

SEQ ID NO: 7699873 - DNA, 18 bp, Homo sapiens
tgtcagtttccctttctt

SEQ ID NO: 7699874 - DNA, 22 bp, Homo sapiens
tgtcagtttagttgaagaaaga

SEQ ID NO: 7699875 - DNA, 22 bp, Homo sapiens
tgtcagtttcctgtgccctgct

SEQ ID NO: 7699876 - DNA, 22 bp, Homo sapiens
tgtcagtttggctctaaagttt

SEQ ID NO: 7699877 - DNA, 22 bp, Homo sapiens
tgtcagtttggctctaaagttt

SEQ ID NO: 7699878 - DNA, 22 bp, Homo sapiens
tgtcagtttggctctaaagttt

SEQ ID NO: 7699879 - DNA, 21 bp, Homo sapiens
tgtcagttcatgtataggcca

SEQ ID NO: 7699880 - DNA, 22 bp, Homo sapiens
tgtcagttctcacttacataaa

SEQ ID NO: 7699881 - DNA, 22 bp, Homo sapiens
tgtcagttcatcagttggctaa

SEQ ID NO: 7699882 - DNA, 22 bp, Homo sapiens
tgtcagttcatcagttggctaa

SEQ ID NO: 7699883 - DNA, 22 bp, Homo sapiens
tgtcagttctcacttacataaa

SEQ ID NO: 7699884 - DNA, 22 bp, Homo sapiens
tgtcagttctctgcattgtctc

SEQ ID NO: 7699885 - DNA, 22 bp, Homo sapiens
tgtcagttctcacttacataaa

SEQ ID NO: 7699886 - DNA, 22 bp, Homo sapiens
tgtcagtttagttgaagaaaga

SEQ ID NO: 7699887 - DNA, 22 bp, Homo sapiens
tgtcagttcaattatagtaatt

SEQ ID NO: 7699888 - DNA, 22 bp, Homo sapiens
tgtcagttcaattatagtaatt

SEQ ID NO: 7699889 - DNA, 21 bp, Homo sapiens
tgtcagttataatcaccacag

SEQ ID NO: 7699890 - DNA, 22 bp, Homo sapiens
tgtcagttcagtgattacaaaa

SEQ ID NO: 7699891 - DNA, 22 bp, Homo sapiens
tgtcagttcagtgattacaaaa

SEQ ID NO: 7699892 - DNA, 22 bp, Homo sapiens
tgtcagttcagtgattacaaaa

SEQ ID NO: 7699893 - DNA, 22 bp, Homo sapiens
tgtcagttaaatgaggtacaag

SEQ ID NO: 7699894 - DNA, 22 bp, Homo sapiens
tgtcagttacctagcacaagaa

SEQ ID NO: 7699895 - DNA, 22 bp, Homo sapiens
tgtcagttacctagcacaagaa

SEQ ID NO: 7699896 - DNA, 22 bp, Homo sapiens
tgtcagttacctagcacaagaa

SEQ ID NO: 7699897 - DNA, 22 bp, Homo sapiens
tgtcataagtgtttgcacccag

SEQ ID NO: 7699898 - DNA, 22 bp, Homo sapiens
tgtcataagtgtttgcacccag

SEQ ID NO: 7699899 - DNA, 18 bp, Homo sapiens
tgtcataatatatcacct

SEQ ID NO: 7699900 - DNA, 22 bp, Homo sapiens
tgtcataatcagttttgcatgt

SEQ ID NO: 7699901 - DNA, 22 bp, Homo sapiens
tgtcataatcagttttgcatgt

SEQ ID NO: 7699902 - DNA, 22 bp, Homo sapiens
tgtcataacttagtgacaaatc

SEQ ID NO: 7699903 - DNA, 22 bp, Homo sapiens
tgtcataagattaactttttgt

SEQ ID NO: 7699904 - DNA, 22 bp, Homo sapiens
tgtcataaaacacaagctgttg

SEQ ID NO: 7699905 - DNA, 22 bp, Homo sapiens
tgtcagtttggctctaaagttt

SEQ ID NO: 7699906 - DNA, 22 bp, Homo sapiens
tgtcataaaacacaagctgttg

SEQ ID NO: 7699907 - DNA, 18 bp, Homo sapiens
tgtcagtttccctttctt

SEQ ID NO: 7699908 - DNA, 22 bp, Homo sapiens
tgtcataaaacacaagctgttg

SEQ ID NO: 7699909 - DNA, 22 bp, Homo sapiens
tgtcataaaacacaagctgttg

SEQ ID NO: 7699910 - DNA, 22 bp, Homo sapiens
tgtcatagtgtggtagcagtgg

SEQ ID NO: 7699911 - DNA, 22 bp, Homo sapiens
tgtcatagtgtggtagcagtgg

SEQ ID NO: 7699912 - DNA, 23 bp, Homo sapiens
tgtcatacattctatgggtttgg

SEQ ID NO: 7699913 - DNA, 22 bp, Homo sapiens
tgtcatagtgtggtagcagtgg

SEQ ID NO: 7699914 - DNA, 22 bp, Homo sapiens
tgtcataatgctgctagaaatt

SEQ ID NO: 7699915 - DNA, 22 bp, Homo sapiens
tgtcataatgctgctagaaatt

SEQ ID NO: 7699916 - DNA, 22 bp, Homo sapiens
tgtcagtagattattacaataa

SEQ ID NO: 7699917 - DNA, 22 bp, Homo sapiens
tgtcagtgagttgggtcctgag

SEQ ID NO: 7699918 - DNA, 22 bp, Homo sapiens
tgtcagtgagttgggtcctgag

SEQ ID NO: 7699919 - DNA, 19 bp, Homo sapiens
tgtcagtgatacatgcttt

SEQ ID NO: 7699920 - DNA, 20 bp, Homo sapiens
tgtcagtgcctgaggcacag

SEQ ID NO: 7699921 - DNA, 22 bp, Homo sapiens
tgtcagtgcacagatggttgat

SEQ ID NO: 7699922 - DNA, 22 bp, Homo sapiens
tgtcagtgccaactttgctggt

SEQ ID NO: 7699923 - DNA, 22 bp, Homo sapiens
tgtcagtgccaactttgctggt

SEQ ID NO: 7699924 - DNA, 22 bp, Homo sapiens
tgtcagtgctatagtgggaata

SEQ ID NO: 7699925 - DNA, 22 bp, Homo sapiens
tgtcagtggacctggagaggcc

SEQ ID NO: 7699926 - DNA, 22 bp, Homo sapiens
tgtcagtggtaaggttgggagt

SEQ ID NO: 7699927 - DNA, 22 bp, Homo sapiens
tgtcagtggtcatagtagaaaa

SEQ ID NO: 7699928 - DNA, 22 bp, Homo sapiens
tgtcagtggtagacccagaggt

SEQ ID NO: 7699929 - DNA, 22 bp, Homo sapiens
tgtcagtggtcatagtagaaaa

SEQ ID NO: 7699930 - DNA, 22 bp, Homo sapiens
tgtcagtggtagacccagaggt

SEQ ID NO: 7699931 - DNA, 22 bp, Homo sapiens
tgtcagtgtctatgaagaattt

SEQ ID NO: 7699932 - DNA, 22 bp, Homo sapiens
tgtcagtgtctatgaagaattt

SEQ ID NO: 7699933 - DNA, 22 bp, Homo sapiens
tgtcagtgtctgaggttttata

SEQ ID NO: 7699934 - DNA, 18 bp, Homo sapiens
tgtcagtaaagtgacaga

SEQ ID NO: 7699935 - DNA, 18 bp, Homo sapiens
tgtcagtaaagtgacaga

SEQ ID NO: 7699936 - DNA, 22 bp, Homo sapiens
tgtcaggtcagacttggttttt

SEQ ID NO: 7699937 - DNA, 22 bp, Homo sapiens
tgtcaggttggttttcagagaa

SEQ ID NO: 7699938 - DNA, 19 bp, Homo sapiens
tgtcaggggtgtgctgtgc

SEQ ID NO: 7699939 - DNA, 19 bp, Homo sapiens
tgtcaggggtgtgctgtgc

SEQ ID NO: 7699940 - DNA, 22 bp, Homo sapiens
tgtcagggctggacacagctgc

SEQ ID NO: 7699941 - DNA, 19 bp, Homo sapiens
tgtcaggggtgtgctgtgc

SEQ ID NO: 7699942 - DNA, 22 bp, Homo sapiens
tgtcagggatttccaactcccc

SEQ ID NO: 7699943 - DNA, 22 bp, Homo sapiens
tgtcagggcatgcggtccagcc

SEQ ID NO: 7699944 - DNA, 22 bp, Homo sapiens
tgtcagggcatgcggtccagcc

SEQ ID NO: 7699945 - DNA, 22 bp, Homo sapiens
tgtcaggcaaaggaaggtattt

SEQ ID NO: 7699946 - DNA, 22 bp, Homo sapiens
tgtcagggatttaaagacacaa

SEQ ID NO: 7699947 - DNA, 22 bp, Homo sapiens
tgtcagggatttaaagacacaa

SEQ ID NO: 7699948 - DNA, 22 bp, Homo sapiens
tgtcagaactctattgatgtcc

SEQ ID NO: 7699949 - DNA, 22 bp, Homo sapiens
tgtcaggagggtccagagaaaa

SEQ ID NO: 7699950 - DNA, 21 bp, Homo sapiens
tgtcagaaataagcatgtgat

SEQ ID NO: 7699951 - DNA, 21 bp, Homo sapiens
tgtcagaaataagcatgtgat

SEQ ID NO: 7699952 - DNA, 22 bp, Homo sapiens
tgtcactttttataggtgttga

SEQ ID NO: 7699953 - DNA, 22 bp, Homo sapiens
tgtcactttggggagagttttg

SEQ ID NO: 7699954 - DNA, 22 bp, Homo sapiens
tgtcactttggggagagttttg

SEQ ID NO: 7699955 - DNA, 22 bp, Homo sapiens
tgtcactttggccaagccattg

SEQ ID NO: 7699956 - DNA, 22 bp, Homo sapiens
tgtcactttggccaagccattg

SEQ ID NO: 7699957 - DNA, 22 bp, Homo sapiens
tgtcactttgccttctggactt

SEQ ID NO: 7699958 - DNA, 22 bp, Homo sapiens
tgtcacttcagttttgaaacaa

SEQ ID NO: 7699959 - DNA, 22 bp, Homo sapiens
tgtcacttcaggaatgcaggga

SEQ ID NO: 7699960 - DNA, 21 bp, Homo sapiens
tgtcactttaagctagctcta

SEQ ID NO: 7699961 - DNA, 21 bp, Homo sapiens
tgtcactttaagctagctcta

SEQ ID NO: 7699962 - DNA, 22 bp, Homo sapiens
tgtcacttggagaagctgatcc

SEQ ID NO: 7699963 - DNA, 22 bp, Homo sapiens
tgtcacctttacccttttatag

SEQ ID NO: 7699964 - DNA, 22 bp, Homo sapiens
tgtcactacatcataaatatat

SEQ ID NO: 7699965 - DNA, 22 bp, Homo sapiens
tgtcactcaagttccaatttac

SEQ ID NO: 7699966 - DNA, 22 bp, Homo sapiens
tgtcaccttgatgatggcctag

SEQ ID NO: 7699967 - DNA, 19 bp, Homo sapiens
tgtcaccttctgtcagttt

SEQ ID NO: 7699968 - DNA, 22 bp, Homo sapiens
tgtcactgtgctctgttcattt

SEQ ID NO: 7699969 - DNA, 22 bp, Homo sapiens
tgtcactgtgctctgttcattt

SEQ ID NO: 7699970 - DNA, 22 bp, Homo sapiens
tgtcactgttacatgaactctt

SEQ ID NO: 7699971 - DNA, 22 bp, Homo sapiens
tgtcactgtgctctgttcattt

SEQ ID NO: 7699972 - DNA, 18 bp, Homo sapiens
tgtcactggataatggtc

SEQ ID NO: 7699973 - DNA, 18 bp, Homo sapiens
tgtcactctggagcccag

SEQ ID NO: 7699974 - DNA, 23 bp, Homo sapiens
tgtcactataagagggcttgccc

SEQ ID NO: 7699975 - DNA, 22 bp, Homo sapiens
tgtcatatgtaatatgttcatt

SEQ ID NO: 7699976 - DNA, 22 bp, Homo sapiens
tgtcatatgttgatgaaagaga

SEQ ID NO: 7699977 - DNA, 22 bp, Homo sapiens
tgtcatatgttgatgaaagaga

SEQ ID NO: 7699978 - DNA, 22 bp, Homo sapiens
tgtcatatgtaatatgttcatt

SEQ ID NO: 7699979 - DNA, 22 bp, Homo sapiens
tgtcatatagaatgttctatga

SEQ ID NO: 7699980 - DNA, 22 bp, Homo sapiens
tgtcatatagatattagacagg

SEQ ID NO: 7699981 - DNA, 22 bp, Homo sapiens
tgtcatatctattaaatgtcta

SEQ ID NO: 7699982 - DNA, 22 bp, Homo sapiens
tgtcatctcactgatatagatg

SEQ ID NO: 7699983 - DNA, 22 bp, Homo sapiens
tgtcatcatttgagagaagaaa

SEQ ID NO: 7699984 - DNA, 22 bp, Homo sapiens
tgtcatcatttgagagaagaaa

SEQ ID NO: 7699985 - DNA, 22 bp, Homo sapiens
tgtcatcagggtgcaagagtta

SEQ ID NO: 7699986 - DNA, 22 bp, Homo sapiens
tgtcatcagcatataagacagt

SEQ ID NO: 7699987 - DNA, 22 bp, Homo sapiens
tgtcatcagcatataagacagt

SEQ ID NO: 7699988 - DNA, 22 bp, Homo sapiens
tgtcatcagcatataagacagt

SEQ ID NO: 7699989 - DNA, 22 bp, Homo sapiens
tgtcatcaactcacagagccaa

SEQ ID NO: 7699990 - DNA, 22 bp, Homo sapiens
tgtcatctttttaaagaagaga

SEQ ID NO: 7699991 - DNA, 22 bp, Homo sapiens
tgtcatgaccatgataactaag

SEQ ID NO: 7699992 - DNA, 22 bp, Homo sapiens
tgtcatcttcatcataagtaaa

SEQ ID NO: 7699993 - DNA, 22 bp, Homo sapiens
tgtcatcttaaatcattcccac

SEQ ID NO: 7699994 - DNA, 22 bp, Homo sapiens
tgtcatgatgtgcacaccacag

SEQ ID NO: 7699995 - DNA, 22 bp, Homo sapiens
tgtcattccttcaatgtagata

SEQ ID NO: 7699996 - DNA, 22 bp, Homo sapiens
tgtcatgatgtgcacaccacag

SEQ ID NO: 7699997 - DNA, 22 bp, Homo sapiens
tgtcatgagtctcctccatctt

SEQ ID NO: 7699998 - DNA, 22 bp, Homo sapiens
tgtcatgagttatttcatagga

SEQ ID NO: 7699999 - DNA, 22 bp, Homo sapiens
tgtcatctgcgggtggcactgc

SEQ ID NO: 7700000 - DNA, 22 bp, Homo sapiens
tgtcatctgcgggtggcactgc

SEQ ID NO: 7700001 - DNA, 22 bp, Homo sapiens
tgtcatctcactgatatagatg

SEQ ID NO: 7700002 - DNA, 23 bp, Homo sapiens
tgtcatctccagactcccagtgc

SEQ ID NO: 7700003 - DNA, 22 bp, Homo sapiens
tgtcatctgcgggtggcactgc

SEQ ID NO: 7700004 - DNA, 18 bp, Homo sapiens
tgtcatctgtttaaaacc

SEQ ID NO: 7700005 - DNA, 18 bp, Homo sapiens
tgtcatctgtttaaaacc

SEQ ID NO: 7700006 - DNA, 22 bp, Homo sapiens
tgtcatttatgcttcttcagtg

SEQ ID NO: 7700007 - DNA, 22 bp, Homo sapiens
tgtcatttatgcttcttcagtg

SEQ ID NO: 7700008 - DNA, 22 bp, Homo sapiens
tgtcatttattctcttattcta

SEQ ID NO: 7700009 - DNA, 22 bp, Homo sapiens
tgtcatttatgcttcttcagtg

SEQ ID NO: 7700010 - DNA, 22 bp, Homo sapiens
tgtcatttatcttatagtaatc

SEQ ID NO: 7700011 - DNA, 22 bp, Homo sapiens
tgtcatttagtcctctgtgtgt

SEQ ID NO: 7700012 - DNA, 22 bp, Homo sapiens
tgtcatttatcttatagtaatc

SEQ ID NO: 7700013 - DNA, 22 bp, Homo sapiens
tgtcatttatcttatagtaatc

SEQ ID NO: 7700014 - DNA, 20 bp, Homo sapiens
tgtcatttatttatcaaatg

SEQ ID NO: 7700015 - DNA, 20 bp, Homo sapiens
tgtcatttatttatcaaatg

SEQ ID NO: 7700016 - DNA, 22 bp, Homo sapiens
tgtcatttattctcttattcta

SEQ ID NO: 7700017 - DNA, 22 bp, Homo sapiens
tgtcatttattctcttattcta

SEQ ID NO: 7700018 - DNA, 22 bp, Homo sapiens
tgtcatttatgcttcttcagtg

SEQ ID NO: 7700019 - DNA, 22 bp, Homo sapiens
tgtcatttattctcttattcta

SEQ ID NO: 7700020 - DNA, 20 bp, Homo sapiens
tgtcatttatttatcaaatg

SEQ ID NO: 7700021 - DNA, 22 bp, Homo sapiens
tgtcatttattttgctgtctgt

SEQ ID NO: 7700022 - DNA, 20 bp, Homo sapiens
tgtcatttatttatcaaatg

SEQ ID NO: 7700023 - DNA, 22 bp, Homo sapiens
tgtcatttactccataccctca

SEQ ID NO: 7700024 - DNA, 22 bp, Homo sapiens
tgtcatttaatagatatgatgg

SEQ ID NO: 7700025 - DNA, 22 bp, Homo sapiens
tgtcatttagtcctctgtgtgt

SEQ ID NO: 7700026 - DNA, 22 bp, Homo sapiens
tgtcatttagtcctctgtgtgt

SEQ ID NO: 7700027 - DNA, 22 bp, Homo sapiens
tgtcatttagtcctctgtgtgt

SEQ ID NO: 7700028 - DNA, 22 bp, Homo sapiens
tgtcatttaatagatatgatgg

SEQ ID NO: 7700029 - DNA, 22 bp, Homo sapiens
tgtcatttaatagatatgatgg

SEQ ID NO: 7700030 - DNA, 20 bp, Homo sapiens
tgtcattgtttctaggacct

SEQ ID NO: 7700031 - DNA, 22 bp, Homo sapiens
tgtcatttaatagatatgatgg

SEQ ID NO: 7700032 - DNA, 20 bp, Homo sapiens
tgtcattcttctttcacagg

SEQ ID NO: 7700033 - DNA, 20 bp, Homo sapiens
tgtcattggcgtggttggct

SEQ ID NO: 7700034 - DNA, 22 bp, Homo sapiens
tgtcattggtacaaattgattg

SEQ ID NO: 7700035 - DNA, 22 bp, Homo sapiens
tgtcatttaaagctttccagat

SEQ ID NO: 7700036 - DNA, 22 bp, Homo sapiens
tgtcatttaaagctttccagat

SEQ ID NO: 7700037 - DNA, 22 bp, Homo sapiens
tgtcatttaaagctttccagat

SEQ ID NO: 7700038 - DNA, 23 bp, Homo sapiens
tgtcattgtgactacagaaccag

SEQ ID NO: 7700039 - DNA, 22 bp, Homo sapiens
tgtcattggtgatctgatgcct

SEQ ID NO: 7700040 - DNA, 22 bp, Homo sapiens
tgtcatttggtgccaggaaaga

SEQ ID NO: 7700041 - DNA, 22 bp, Homo sapiens
tgtcattttaatcacctttcca

SEQ ID NO: 7700042 - DNA, 22 bp, Homo sapiens
tgtcattttaatcacctttcca

SEQ ID NO: 7700043 - DNA, 22 bp, Homo sapiens
tgtcattttagtgcatcactca

SEQ ID NO: 7700044 - DNA, 22 bp, Homo sapiens
tgtcatttcctgaatgctgagt

SEQ ID NO: 7700045 - DNA, 22 bp, Homo sapiens
tgtcatttggactttggtatta

SEQ ID NO: 7700046 - DNA, 22 bp, Homo sapiens
tgtcatttggactttggtatta

SEQ ID NO: 7700047 - DNA, 22 bp, Homo sapiens
tgtcatttcacaatatcactca

SEQ ID NO: 7700048 - DNA, 22 bp, Homo sapiens
tgtcatttcacaatatcactca

SEQ ID NO: 7700049 - DNA, 22 bp, Homo sapiens
tgtcatttcctgaatgctgagt

SEQ ID NO: 7700050 - DNA, 22 bp, Homo sapiens
tgtcatttcctgaatgctgagt

SEQ ID NO: 7700051 - DNA, 22 bp, Homo sapiens
tgtcatttcctgaatgctgagt

SEQ ID NO: 7700052 - DNA, 22 bp, Homo sapiens
tgtcatttattttgctgtctgt

SEQ ID NO: 7700053 - DNA, 22 bp, Homo sapiens
tgtcatttcacaatatcactca

SEQ ID NO: 7700054 - DNA, 22 bp, Homo sapiens
tgtcatttcacaatatcactca

SEQ ID NO: 7700055 - DNA, 22 bp, Homo sapiens
tgtcattttagtgcatcactca

SEQ ID NO: 7700056 - DNA, 22 bp, Homo sapiens
tgtcatttggactttggtatta

SEQ ID NO: 7700057 - DNA, 22 bp, Homo sapiens
tgtcattttcagcttatgcttc

SEQ ID NO: 7700058 - DNA, 22 bp, Homo sapiens
tgtcattttatgtatgtggtct

SEQ ID NO: 7700059 - DNA, 22 bp, Homo sapiens
tgtcattttcagcttatgcttc

SEQ ID NO: 7700060 - DNA, 22 bp, Homo sapiens
tgtcattttcagcttatgcttc

SEQ ID NO: 7700061 - DNA, 22 bp, Homo sapiens
tgtcattttcagcttatgcttc

SEQ ID NO: 7700062 - DNA, 22 bp, Homo sapiens
tgtcattttctaatctgttgtc

SEQ ID NO: 7700063 - DNA, 22 bp, Homo sapiens
tgtcattttctaatctgttgtc

SEQ ID NO: 7700064 - DNA, 22 bp, Homo sapiens
tgtcattttctaatctgttgtc

SEQ ID NO: 7700065 - DNA, 22 bp, Homo sapiens
tgtcattttctaatctgttgtc

SEQ ID NO: 7700066 - DNA, 22 bp, Homo sapiens
tgtcattttcatcctaaggagc

SEQ ID NO: 7700067 - DNA, 22 bp, Homo sapiens
tgtcattttcatcctaaggagc

SEQ ID NO: 7700068 - DNA, 22 bp, Homo sapiens
tgtcattttcatcctaaggagc

SEQ ID NO: 7700069 - DNA, 22 bp, Homo sapiens
tgtcattttctaatctgttgtc

SEQ ID NO: 7700070 - DNA, 22 bp, Homo sapiens
tgtccaagaacagactgccagg

SEQ ID NO: 7700071 - DNA, 22 bp, Homo sapiens
tgtccaagaacagactgccagg

SEQ ID NO: 7700072 - DNA, 22 bp, Homo sapiens
tgtccaatgccctttccacatg

SEQ ID NO: 7700073 - DNA, 22 bp, Homo sapiens
tgtccaatgccctttccacatg

SEQ ID NO: 7700074 - DNA, 21 bp, Homo sapiens
tgtccaaggtatgcactgggg

SEQ ID NO: 7700075 - DNA, 21 bp, Homo sapiens
tgtccaaggtatgcactgggg

SEQ ID NO: 7700076 - DNA, 22 bp, Homo sapiens
tgtcattttgtctcactgctat

SEQ ID NO: 7700077 - DNA, 22 bp, Homo sapiens
tgtcattttctggttagttaat

SEQ ID NO: 7700078 - DNA, 22 bp, Homo sapiens
tgtcattttctaatctgttgtc

SEQ ID NO: 7700079 - DNA, 22 bp, Homo sapiens
tgtcattttctggttagttaat

SEQ ID NO: 7700080 - DNA, 22 bp, Homo sapiens
tgtccacatcactcacttgtca

SEQ ID NO: 7700081 - DNA, 22 bp, Homo sapiens
tgtccacatcactcacttgtca

SEQ ID NO: 7700082 - DNA, 22 bp, Homo sapiens
tgtccacatcactcacttgtca

SEQ ID NO: 7700083 - DNA, 22 bp, Homo sapiens
tgtccaatgccctttccacatg

SEQ ID NO: 7700084 - DNA, 22 bp, Homo sapiens
tgtccaccggtcctgtgatggg

SEQ ID NO: 7700085 - DNA, 22 bp, Homo sapiens
tgtccaccgttcagcaccagag

SEQ ID NO: 7700086 - DNA, 22 bp, Homo sapiens
tgtccaccgttcagcaccagag

SEQ ID NO: 7700087 - DNA, 22 bp, Homo sapiens
tgtccaccgttcagcaccagag

SEQ ID NO: 7700088 - DNA, 22 bp, Homo sapiens
tgtccactttgtcagtgtcata

SEQ ID NO: 7700089 - DNA, 22 bp, Homo sapiens
tgtccactttgtcagtgtcata

SEQ ID NO: 7700090 - DNA, 22 bp, Homo sapiens
tgtccagaatgtgtggaaattc

SEQ ID NO: 7700091 - DNA, 22 bp, Homo sapiens
tgtccagatcaatgcccacatg

SEQ ID NO: 7700092 - DNA, 22 bp, Homo sapiens
tgtccagcacagccaggcttac

SEQ ID NO: 7700093 - DNA, 22 bp, Homo sapiens
tgtccagatcaatgcccacatg

SEQ ID NO: 7700094 - DNA, 22 bp, Homo sapiens
tgtccagagtcacagagctcaa

SEQ ID NO: 7700095 - DNA, 22 bp, Homo sapiens
tgtccagagtcacagagctcaa

SEQ ID NO: 7700096 - DNA, 22 bp, Homo sapiens
tgtccagcacagccaggcttac

SEQ ID NO: 7700097 - DNA, 22 bp, Homo sapiens
tgtccagcggcctggctgctga

SEQ ID NO: 7700098 - DNA, 22 bp, Homo sapiens
tgtccagcggcctggctgctga

SEQ ID NO: 7700099 - DNA, 22 bp, Homo sapiens
tgtccagcggcctggctgctga

SEQ ID NO: 7700100 - DNA, 22 bp, Homo sapiens
tgtccagctcgagacactatct

SEQ ID NO: 7700101 - DNA, 22 bp, Homo sapiens
tgtccaggaccctattctcact

SEQ ID NO: 7700102 - DNA, 22 bp, Homo sapiens
tgtccaggaccctattctcact

SEQ ID NO: 7700103 - DNA, 22 bp, Homo sapiens
tgtccaggaattgaccctgcaa

SEQ ID NO: 7700104 - DNA, 22 bp, Homo sapiens
tgtccagctgaaggcagcctca

SEQ ID NO: 7700105 - DNA, 22 bp, Homo sapiens
tgtccagctgaaggcagcctca

SEQ ID NO: 7700106 - DNA, 22 bp, Homo sapiens
tgtccaggaattgaccctgcaa

SEQ ID NO: 7700107 - DNA, 22 bp, Homo sapiens
tgtccaggaccctattctcact

SEQ ID NO: 7700108 - DNA, 22 bp, Homo sapiens
tgtccaggaccctattctcact

SEQ ID NO: 7700109 - DNA, 22 bp, Homo sapiens
tgtccaggcactgggactctag

SEQ ID NO: 7700110 - DNA, 23 bp, Homo sapiens
tggtctcacttggtaagatgaag

SEQ ID NO: 7700111 - DNA, 23 bp, Homo sapiens
tggtctcacttggtaagatgaag

SEQ ID NO: 7700112 - DNA, 22 bp, Homo sapiens
tggtctaaatatggctctaaat

SEQ ID NO: 7700113 - DNA, 19 bp, Homo sapiens
tggtctaaatgtgtgcccc

SEQ ID NO: 7700114 - DNA, 22 bp, Homo sapiens
tggtctaagagcctaactgctg

SEQ ID NO: 7700115 - DNA, 23 bp, Homo sapiens
tggtctcacttggtaagatgaag

SEQ ID NO: 7700116 - DNA, 22 bp, Homo sapiens
tggtcgaccagttggaaagtaa

SEQ ID NO: 7700117 - DNA, 22 bp, Homo sapiens
tggtcgaccagttggaaagtaa

SEQ ID NO: 7700118 - DNA, 22 bp, Homo sapiens
tggtcgggagcgagcagctatt

SEQ ID NO: 7700119 - DNA, 22 bp, Homo sapiens
tggtcgaccagttggaaagtaa

SEQ ID NO: 7700120 - DNA, 22 bp, Homo sapiens
tggtcctttaagtctttctctg

SEQ ID NO: 7700121 - DNA, 22 bp, Homo sapiens
tggtccttgtaggcatttgagc

SEQ ID NO: 7700122 - DNA, 22 bp, Homo sapiens
tggtccttgtaggcatttgagc

SEQ ID NO: 7700123 - DNA, 22 bp, Homo sapiens
tggtctctgagccttcctgtgg

SEQ ID NO: 7700124 - DNA, 22 bp, Homo sapiens
tggtctctgcaggccaggctca

SEQ ID NO: 7700125 - DNA, 22 bp, Homo sapiens
tggtctctgcaggccaggctca

SEQ ID NO: 7700126 - DNA, 22 bp, Homo sapiens
tggtctctgagccttcctgtgg

SEQ ID NO: 7700127 - DNA, 22 bp, Homo sapiens
tggtctctgagccttcctgtgg

SEQ ID NO: 7700128 - DNA, 22 bp, Homo sapiens
tggtctctgactctgaagaccc

SEQ ID NO: 7700129 - DNA, 22 bp, Homo sapiens
tggtctctctcctgcaacaact

SEQ ID NO: 7700130 - DNA, 22 bp, Homo sapiens
tggtctctctcctgcaacaact

SEQ ID NO: 7700131 - DNA, 22 bp, Homo sapiens
tggtctctctcctgcaacaact

SEQ ID NO: 7700132 - DNA, 22 bp, Homo sapiens
tggtctcccagagcagggacgc

SEQ ID NO: 7700133 - DNA, 22 bp, Homo sapiens
tggtctctacggaggaaagctg

SEQ ID NO: 7700134 - DNA, 22 bp, Homo sapiens
tggtctctacggaggaaagctg

SEQ ID NO: 7700135 - DNA, 22 bp, Homo sapiens
tggtctctccatgccctccacc

SEQ ID NO: 7700136 - DNA, 22 bp, Homo sapiens
tggtctctacggaggaaagctg

SEQ ID NO: 7700137 - DNA, 22 bp, Homo sapiens
tggtctctccatgccctccacc

SEQ ID NO: 7700138 - DNA, 22 bp, Homo sapiens
tggtctcccagagcagggacgc

SEQ ID NO: 7700139 - DNA, 22 bp, Homo sapiens
tggtctcccagagcagggacgc

SEQ ID NO: 7700140 - DNA, 22 bp, Homo sapiens
tggtctcaggagagtctcttca

SEQ ID NO: 7700141 - DNA, 22 bp, Homo sapiens
tggtctcaggagagtctcttca

SEQ ID NO: 7700142 - DNA, 23 bp, Homo sapiens
tggtctcagcctgtgagagctga

SEQ ID NO: 7700143 - DNA, 23 bp, Homo sapiens
tggtctcagcctgtgagagctga

SEQ ID NO: 7700144 - DNA, 22 bp, Homo sapiens
tggtcctgtgttcttcctgcct

SEQ ID NO: 7700145 - DNA, 22 bp, Homo sapiens
tggtcctgtgttcttcctgcct

SEQ ID NO: 7700146 - DNA, 22 bp, Homo sapiens
tggtcctgtgttcttcctgcct

SEQ ID NO: 7700147 - DNA, 22 bp, Homo sapiens
tggtcctgtctcaaggagcctt

SEQ ID NO: 7700148 - DNA, 22 bp, Homo sapiens
tggtcctgtctcaaggagcctt

SEQ ID NO: 7700149 - DNA, 22 bp, Homo sapiens
tggtcctgtctcaaggagcctt

SEQ ID NO: 7700150 - DNA, 22 bp, Homo sapiens
tggtccttctctgcctgcagtg

SEQ ID NO: 7700151 - DNA, 22 bp, Homo sapiens
tggtcctgtgttcttcctgcct

SEQ ID NO: 7700152 - DNA, 22 bp, Homo sapiens
tggtccttcgtggtgcagttct

SEQ ID NO: 7700153 - DNA, 22 bp, Homo sapiens
tggtccttcacagccacactct

SEQ ID NO: 7700154 - DNA, 22 bp, Homo sapiens
tggtccttcacagccacactct

SEQ ID NO: 7700155 - DNA, 22 bp, Homo sapiens
tggtcctgtagctctctaagtt

SEQ ID NO: 7700156 - DNA, 20 bp, Homo sapiens
tggtcctgtcccacccactc

SEQ ID NO: 7700157 - DNA, 22 bp, Homo sapiens
tggtcctgtagctctctaagtt

SEQ ID NO: 7700158 - DNA, 22 bp, Homo sapiens
tggtcctgtagctctctaagtt

SEQ ID NO: 7700159 - DNA, 22 bp, Homo sapiens
tggtcctgtagctctctaagtt

SEQ ID NO: 7700160 - DNA, 22 bp, Homo sapiens
tggtcctggtagcggtgtgctt

SEQ ID NO: 7700161 - DNA, 22 bp, Homo sapiens
tggtcctggggtgcaggctgac

SEQ ID NO: 7700162 - DNA, 22 bp, Homo sapiens
tggtcctggggtgcaggctgac

SEQ ID NO: 7700163 - DNA, 22 bp, Homo sapiens
tggtcctggggtgcaggctgac

SEQ ID NO: 7700164 - DNA, 22 bp, Homo sapiens
tggtcctggggtgcaggctgac

SEQ ID NO: 7700165 - DNA, 22 bp, Homo sapiens
tggtcctggggtgcaggctgac

SEQ ID NO: 7700166 - DNA, 22 bp, Homo sapiens
tggtcctggggatctgcagtga

SEQ ID NO: 7700167 - DNA, 23 bp, Homo sapiens
tggtcctggttgaggtgggcccc

SEQ ID NO: 7700168 - DNA, 23 bp, Homo sapiens
tggtcctggttgaggtgggcccc

SEQ ID NO: 7700169 - DNA, 22 bp, Homo sapiens
tggtcctggtcatctgggctgg

SEQ ID NO: 7700170 - DNA, 22 bp, Homo sapiens
tggtcctggtcatctgggctgg

SEQ ID NO: 7700171 - DNA, 22 bp, Homo sapiens
tggtcctggtgcaagtgcattt

SEQ ID NO: 7700172 - DNA, 22 bp, Homo sapiens
tggtcctggtgcaagtgcattt

SEQ ID NO: 7700173 - DNA, 22 bp, Homo sapiens
tggtcctggtgcaagtgcattt

SEQ ID NO: 7700174 - DNA, 22 bp, Homo sapiens
tggtcctggtgcaagtgcattt

SEQ ID NO: 7700175 - DNA, 22 bp, Homo sapiens
tggtcctggtgcaagtgcattt

SEQ ID NO: 7700176 - DNA, 22 bp, Homo sapiens
tggtcctggtagcggtgtgctt

SEQ ID NO: 7700177 - DNA, 22 bp, Homo sapiens
tggtcctggtcatctgggctgg

SEQ ID NO: 7700178 - DNA, 22 bp, Homo sapiens
tggtcctggtcatctgggctgg

SEQ ID NO: 7700179 - DNA, 22 bp, Homo sapiens
tggtcctggtcatctgggctgg

SEQ ID NO: 7700180 - DNA, 22 bp, Homo sapiens
tggtgagctctttagactggga

SEQ ID NO: 7700181 - DNA, 22 bp, Homo sapiens
tggtgagctctggcagtctgtg

SEQ ID NO: 7700182 - DNA, 22 bp, Homo sapiens
tggtgagctctggcagtctgtg

SEQ ID NO: 7700183 - DNA, 22 bp, Homo sapiens
tggtgagctctggcagtctgtg

SEQ ID NO: 7700184 - DNA, 22 bp, Homo sapiens
tggtgagctctttagactggga

SEQ ID NO: 7700185 - DNA, 22 bp, Homo sapiens
tggtgagctctttagactggga

SEQ ID NO: 7700186 - DNA, 22 bp, Homo sapiens
tggtgagatgtatggagggttg

SEQ ID NO: 7700187 - DNA, 22 bp, Homo sapiens
tggtgagatgcagcaacagaca

SEQ ID NO: 7700188 - DNA, 22 bp, Homo sapiens
tggtgagcgatgctgcatgttc

SEQ ID NO: 7700189 - DNA, 22 bp, Homo sapiens
tggtgaggccaaagccatgaca

SEQ ID NO: 7700190 - DNA, 22 bp, Homo sapiens
tggtgaggccaaagccatgaca

SEQ ID NO: 7700191 - DNA, 22 bp, Homo sapiens
tggtgaggccaaagccatgaca

SEQ ID NO: 7700192 - DNA, 22 bp, Homo sapiens
tggtgaggccaaagccatgaca

SEQ ID NO: 7700193 - DNA, 22 bp, Homo sapiens
tggtgaggaagacctgctcctg

SEQ ID NO: 7700194 - DNA, 22 bp, Homo sapiens
tggtgaggaagacctgctcctg

SEQ ID NO: 7700195 - DNA, 22 bp, Homo sapiens
tggtgaggaagacctgctcctg

SEQ ID NO: 7700196 - DNA, 22 bp, Homo sapiens
tggtgaggaagacctgctcctg

SEQ ID NO: 7700197 - DNA, 22 bp, Homo sapiens
tggtgaggaagacctgctcctg

SEQ ID NO: 7700198 - DNA, 22 bp, Homo sapiens
tggtgaggccaaagccatgaca

SEQ ID NO: 7700199 - DNA, 22 bp, Homo sapiens
tggtgaggccaaagccatgaca

SEQ ID NO: 7700200 - DNA, 22 bp, Homo sapiens
tggtgaggccaaagccatgaca

SEQ ID NO: 7700201 - DNA, 22 bp, Homo sapiens
tggtgaggccaaagccatgaca

SEQ ID NO: 7700202 - DNA, 22 bp, Homo sapiens
tggtgaggtcatagagaactgt

SEQ ID NO: 7700203 - DNA, 22 bp, Homo sapiens
tggtgaggtcatagagaactgt

SEQ ID NO: 7700204 - DNA, 22 bp, Homo sapiens
tggtgaggtcatagagaactgt

SEQ ID NO: 7700205 - DNA, 22 bp, Homo sapiens
tggtgaggtcatagagaactgt

SEQ ID NO: 7700206 - DNA, 22 bp, Homo sapiens
tggtgatcagtcaactgtcttc

SEQ ID NO: 7700207 - DNA, 22 bp, Homo sapiens
tggtgatcagtcaactgtcttc

SEQ ID NO: 7700208 - DNA, 22 bp, Homo sapiens
tggtgcaaaactaattgcggtt

SEQ ID NO: 7700209 - DNA, 22 bp, Homo sapiens
tggtgcaaaactaattgcggtt

SEQ ID NO: 7700210 - DNA, 22 bp, Homo sapiens
tggtgcaagtctctgaggaggg

SEQ ID NO: 7700211 - DNA, 22 bp, Homo sapiens
tggtgcaaaactaattgcggtt

SEQ ID NO: 7700212 - DNA, 22 bp, Homo sapiens
tggtgcagatagtggtgtagta

SEQ ID NO: 7700213 - DNA, 22 bp, Homo sapiens
tggtgcagatagtggtgtagta

SEQ ID NO: 7700214 - DNA, 22 bp, Homo sapiens
tggtgcagagagggatctaggg

SEQ ID NO: 7700215 - DNA, 22 bp, Homo sapiens
tggtgcagagagggatctaggg

SEQ ID NO: 7700216 - DNA, 22 bp, Homo sapiens
tggtgcagagagggatctaggg

SEQ ID NO: 7700217 - DNA, 22 bp, Homo sapiens
tggtgcagagagggatctaggg

SEQ ID NO: 7700218 - DNA, 22 bp, Homo sapiens
tggtgcagacaggagccccgct

SEQ ID NO: 7700219 - DNA, 22 bp, Homo sapiens
tggtgcaatattatgaaaggta

SEQ ID NO: 7700220 - DNA, 22 bp, Homo sapiens
tggtgcaatgttgaaagggagt

SEQ ID NO: 7700221 - DNA, 22 bp, Homo sapiens
tggtgagaccttgttccttatg

SEQ ID NO: 7700222 - DNA, 22 bp, Homo sapiens
tggtgagacaggatcaacccct

SEQ ID NO: 7700223 - DNA, 20 bp, Homo sapiens
tggtgagagcacctgatggg

SEQ ID NO: 7700224 - DNA, 22 bp, Homo sapiens
tggtgagaccttgttccttatg

SEQ ID NO: 7700225 - DNA, 22 bp, Homo sapiens
tggtgagagctgaccgtgcgag

SEQ ID NO: 7700226 - DNA, 22 bp, Homo sapiens
tggtgagagcagaccttctttt

SEQ ID NO: 7700227 - DNA, 22 bp, Homo sapiens
tggtgagataactttcggcaag

SEQ ID NO: 7700228 - DNA, 22 bp, Homo sapiens
tggtgacctgcagagaaaattt

SEQ ID NO: 7700229 - DNA, 22 bp, Homo sapiens
tggtgactgggactggatatga

SEQ ID NO: 7700230 - DNA, 22 bp, Homo sapiens
tggtgagaattggttggattta

SEQ ID NO: 7700231 - DNA, 22 bp, Homo sapiens
tggtgacagcatggaagaagtg

SEQ ID NO: 7700232 - DNA, 22 bp, Homo sapiens
tggtgacagcatggaagaagtg

SEQ ID NO: 7700233 - DNA, 22 bp, Homo sapiens
tggtgaccaatgctatggccag

SEQ ID NO: 7700234 - DNA, 21 bp, Homo sapiens
tggtgacccctgtctgttccc

SEQ ID NO: 7700235 - DNA, 22 bp, Homo sapiens
tggtgacagcatggaagaagtg

SEQ ID NO: 7700236 - DNA, 22 bp, Homo sapiens
tggtgacagcatggaagaagtg

SEQ ID NO: 7700237 - DNA, 22 bp, Homo sapiens
tggtgacaccccatctctaaag

SEQ ID NO: 7700238 - DNA, 19 bp, Homo sapiens
tggtctctgtctctttgca

SEQ ID NO: 7700239 - DNA, 19 bp, Homo sapiens
tggtctctgtctctttgca

SEQ ID NO: 7700240 - DNA, 19 bp, Homo sapiens
tggtctctgtctctttgca

SEQ ID NO: 7700241 - DNA, 22 bp, Homo sapiens
tggtctctgtaggctaccccat

SEQ ID NO: 7700242 - DNA, 22 bp, Homo sapiens
tggtctctgtaggctaccccat

SEQ ID NO: 7700243 - DNA, 22 bp, Homo sapiens
tggtctctgtaggctaccccat

SEQ ID NO: 7700244 - DNA, 22 bp, Homo sapiens
tggtctctgctgcagcttctca

SEQ ID NO: 7700245 - DNA, 22 bp, Homo sapiens
tggtctctgctgcagcttctca

SEQ ID NO: 7700246 - DNA, 22 bp, Homo sapiens
tggtctctgcaggccaggctca

SEQ ID NO: 7700247 - DNA, 22 bp, Homo sapiens
tggtctctgctgcagcttctca

SEQ ID NO: 7700248 - DNA, 22 bp, Homo sapiens
tggtgacacgaagtttgctatc

SEQ ID NO: 7700249 - DNA, 22 bp, Homo sapiens
tggtgacaccccatctctaaag

SEQ ID NO: 7700250 - DNA, 22 bp, Homo sapiens
tggtctctgtgctcgggcatgg

SEQ ID NO: 7700251 - DNA, 22 bp, Homo sapiens
tggtcctgggcacagtatatgc

SEQ ID NO: 7700252 - DNA, 22 bp, Homo sapiens
tggtcctggccttgaccccagg

SEQ ID NO: 7700253 - DNA, 22 bp, Homo sapiens
tggtcctggggatctgcagtga

SEQ ID NO: 7700254 - DNA, 22 bp, Homo sapiens
tggtcctggggatctgcagtga

SEQ ID NO: 7700255 - DNA, 22 bp, Homo sapiens
tggtcctggggatctgcagtga

SEQ ID NO: 7700256 - DNA, 22 bp, Homo sapiens
tggtcctggccttgaccccagg

SEQ ID NO: 7700257 - DNA, 22 bp, Homo sapiens
tggtcctggagagtgttccata

SEQ ID NO: 7700258 - DNA, 22 bp, Homo sapiens
tggtcctggagagtgttccata

SEQ ID NO: 7700259 - DNA, 22 bp, Homo sapiens
tggtcctggagagtgttccata

SEQ ID NO: 7700260 - DNA, 22 bp, Homo sapiens
tggtcctggagagtgttccata

SEQ ID NO: 7700261 - DNA, 22 bp, Homo sapiens
tggtcctggagagtgttccata

SEQ ID NO: 7700262 - DNA, 22 bp, Homo sapiens
tggtcctggaaggtcctgaggg

SEQ ID NO: 7700263 - DNA, 22 bp, Homo sapiens
tggtcctggaaggtcctgaggg

SEQ ID NO: 7700264 - DNA, 22 bp, Homo sapiens
tggtcctgccccgtgcacagag

SEQ ID NO: 7700265 - DNA, 22 bp, Homo sapiens
tggtcctgctacaggggattag

SEQ ID NO: 7700266 - DNA, 22 bp, Homo sapiens
tggtcctggaaggtcctgaggg

SEQ ID NO: 7700267 - DNA, 22 bp, Homo sapiens
tggtcctggaaggtcctgaggg

SEQ ID NO: 7700268 - DNA, 22 bp, Homo sapiens
tggtcctgcttgctgcttaaga

SEQ ID NO: 7700269 - DNA, 22 bp, Homo sapiens
tggtcctggaaggtcctgaggg

SEQ ID NO: 7700270 - DNA, 22 bp, Homo sapiens
tggtcctggaaggtcctgaggg

SEQ ID NO: 7700271 - DNA, 22 bp, Homo sapiens
tggtcctggaaggtcctgaggg

SEQ ID NO: 7700272 - DNA, 22 bp, Homo sapiens
tggtcctgcccacgcccatctg

SEQ ID NO: 7700273 - DNA, 22 bp, Homo sapiens
tggtcctgcccacgcccatctg

SEQ ID NO: 7700274 - DNA, 22 bp, Homo sapiens
tggtcctgcccacgcccatctg

SEQ ID NO: 7700275 - DNA, 23 bp, Homo sapiens
tggtcctgccaacggtgcccctc

SEQ ID NO: 7700276 - DNA, 23 bp, Homo sapiens
tggtcctgccaacggtgcccctc

SEQ ID NO: 7700277 - DNA, 23 bp, Homo sapiens
tggtcctgccaacggtgcccctc

SEQ ID NO: 7700278 - DNA, 22 bp, Homo sapiens
tggtcctgcagtaatagacatc

SEQ ID NO: 7700279 - DNA, 22 bp, Homo sapiens
tggtcctgccccgtgcacagag

SEQ ID NO: 7700280 - DNA, 22 bp, Homo sapiens
tggtcctgccccgtgcacagag

SEQ ID NO: 7700281 - DNA, 22 bp, Homo sapiens
tggtcctgccccgtgcacagag

SEQ ID NO: 7700282 - DNA, 22 bp, Homo sapiens
tggtcctgccccgtgcacagag

SEQ ID NO: 7700283 - DNA, 22 bp, Homo sapiens
tggtcctgagaatcctgtcctc

SEQ ID NO: 7700284 - DNA, 22 bp, Homo sapiens
tggtcctgagaatcctgtcctc

SEQ ID NO: 7700285 - DNA, 22 bp, Homo sapiens
tggtcctcaggttctctgtgcg

SEQ ID NO: 7700286 - DNA, 22 bp, Homo sapiens
tggtcctgagaatcctgtcctc

SEQ ID NO: 7700287 - DNA, 22 bp, Homo sapiens
tggtcctgagaatcctgtcctc

SEQ ID NO: 7700288 - DNA, 22 bp, Homo sapiens
tggtcctgagaatcctgtcctc

SEQ ID NO: 7700289 - DNA, 22 bp, Homo sapiens
tggtcctgagcaccagcctgac

SEQ ID NO: 7700290 - DNA, 22 bp, Homo sapiens
tggtcctgagcaccagcctgac

SEQ ID NO: 7700291 - DNA, 22 bp, Homo sapiens
tggtcctgagcaccagcctgac

SEQ ID NO: 7700292 - DNA, 22 bp, Homo sapiens
tggtcctgagcaccagcctgac

SEQ ID NO: 7700293 - DNA, 22 bp, Homo sapiens
tggtcctgagcaccagcctgac

SEQ ID NO: 7700294 - DNA, 22 bp, Homo sapiens
tggtcctgaggcttgtttccac

SEQ ID NO: 7700295 - DNA, 22 bp, Homo sapiens
tggtcctgatcaccgctgggca

SEQ ID NO: 7700296 - DNA, 22 bp, Homo sapiens
tggtcctgatcaccgctgggca

SEQ ID NO: 7700297 - DNA, 22 bp, Homo sapiens
tggtcctgatcaccgctgggca

SEQ ID NO: 7700298 - DNA, 22 bp, Homo sapiens
tggtcctgaggcttgtttccac

SEQ ID NO: 7700299 - DNA, 22 bp, Homo sapiens
tggtcctgatcaccgctgggca

SEQ ID NO: 7700300 - DNA, 22 bp, Homo sapiens
tggtcctcaggttctctgtgcg

SEQ ID NO: 7700301 - DNA, 22 bp, Homo sapiens
tggtcctcaggttctctgtgcg

SEQ ID NO: 7700302 - DNA, 20 bp, Homo sapiens
tggtcctcacatgccatctt

SEQ ID NO: 7700303 - DNA, 17 bp, Homo sapiens
tggtccaggtggagcca

SEQ ID NO: 7700304 - DNA, 22 bp, Homo sapiens
tggtccagggtgtagtacagag

SEQ ID NO: 7700305 - DNA, 17 bp, Homo sapiens
tggtccaggtggagcca

SEQ ID NO: 7700306 - DNA, 17 bp, Homo sapiens
tggtccaggtggagcca

SEQ ID NO: 7700307 - DNA, 20 bp, Homo sapiens
tggtcctcacatgccatctt

SEQ ID NO: 7700308 - DNA, 22 bp, Homo sapiens
tggtccagggtgtagtacagag

SEQ ID NO: 7700309 - DNA, 17 bp, Homo sapiens
tggtccaggtggagcca

SEQ ID NO: 7700310 - DNA, 22 bp, Homo sapiens
tggtccagggtgtagtacagag

SEQ ID NO: 7700311 - DNA, 22 bp, Homo sapiens
tggtccagggtgtagtacagag

SEQ ID NO: 7700312 - DNA, 22 bp, Homo sapiens
tggtccagggtgtagtacagag

SEQ ID NO: 7700313 - DNA, 22 bp, Homo sapiens
tggtccagggtgtagtacagag

SEQ ID NO: 7700314 - DNA, 22 bp, Homo sapiens
tggtccaggcacccttctagag

SEQ ID NO: 7700315 - DNA, 22 bp, Homo sapiens
tggtccaggcacccttctagag

SEQ ID NO: 7700316 - DNA, 19 bp, Homo sapiens
tggtccagcttcttctcct

SEQ ID NO: 7700317 - DNA, 22 bp, Homo sapiens
tggtccagcttgattctcttct

SEQ ID NO: 7700318 - DNA, 22 bp, Homo sapiens
tggtccagcttgattctcttct

SEQ ID NO: 7700319 - DNA, 20 bp, Homo sapiens
tggtccaggacctggtgtcc

SEQ ID NO: 7700320 - DNA, 20 bp, Homo sapiens
tggtccaggacctggtgtcc

SEQ ID NO: 7700321 - DNA, 22 bp, Homo sapiens
tggtcagaaggaagggctccta

SEQ ID NO: 7700322 - DNA, 22 bp, Homo sapiens
tggtcagaactcagcgtgcttg

SEQ ID NO: 7700323 - DNA, 22 bp, Homo sapiens
tggtcacttttgccagtggatg

SEQ ID NO: 7700324 - DNA, 22 bp, Homo sapiens
tggtcacctatagaggagatgt

SEQ ID NO: 7700325 - DNA, 18 bp, Homo sapiens
tggtcactgtggatagtg

SEQ ID NO: 7700326 - DNA, 22 bp, Homo sapiens
tggtcactatatttaaatatct

SEQ ID NO: 7700327 - DNA, 22 bp, Homo sapiens
tggtcacccactgggactgcgg

SEQ ID NO: 7700328 - DNA, 19 bp, Homo sapiens
tggtcagcattaggatttg

SEQ ID NO: 7700329 - DNA, 19 bp, Homo sapiens
tggtcagcattaggatttg

SEQ ID NO: 7700330 - DNA, 19 bp, Homo sapiens
tggtcagatttcagaagtc

SEQ ID NO: 7700331 - DNA, 19 bp, Homo sapiens
tggtcagatttcagaagtc

SEQ ID NO: 7700332 - DNA, 22 bp, Homo sapiens
tggtcagatgctgagtggatct

SEQ ID NO: 7700333 - DNA, 22 bp, Homo sapiens
tggtcagacaaaggagaatgtt

SEQ ID NO: 7700334 - DNA, 22 bp, Homo sapiens
tggtcagaactcagcgtgcttg

SEQ ID NO: 7700335 - DNA, 22 bp, Homo sapiens
tggtcaggctgctctgcggcgt

SEQ ID NO: 7700336 - DNA, 22 bp, Homo sapiens
tggtcaggattctcagcccttc

SEQ ID NO: 7700337 - DNA, 22 bp, Homo sapiens
tggtcaggattctcagcccttc

SEQ ID NO: 7700338 - DNA, 22 bp, Homo sapiens
tggtcagcttcagagtgttcca

SEQ ID NO: 7700339 - DNA, 22 bp, Homo sapiens
tggtcaggattctcagcccttc

SEQ ID NO: 7700340 - DNA, 22 bp, Homo sapiens
tggtcagcgtttgtcagagcag

SEQ ID NO: 7700341 - DNA, 22 bp, Homo sapiens
tggtcagcgtttgtcagagcag

SEQ ID NO: 7700342 - DNA, 22 bp, Homo sapiens
tggtcagcttcagagtgttcca

SEQ ID NO: 7700343 - DNA, 22 bp, Homo sapiens
tggtcagcgtttgtcagagcag

SEQ ID NO: 7700344 - DNA, 22 bp, Homo sapiens
tggtcaggctgctctgcggcgt

SEQ ID NO: 7700345 - DNA, 22 bp, Homo sapiens
tggtcaggctgctctgcggcgt

SEQ ID NO: 7700346 - DNA, 22 bp, Homo sapiens
tggtcaggggcttctgagctgt

SEQ ID NO: 7700347 - DNA, 22 bp, Homo sapiens
tggtcaggggcttctgagctgt

SEQ ID NO: 7700348 - DNA, 22 bp, Homo sapiens
tggtcaggggcttctgagctgt

SEQ ID NO: 7700349 - DNA, 22 bp, Homo sapiens
tggtcaggggcttctgagctgt

SEQ ID NO: 7700350 - DNA, 22 bp, Homo sapiens
tggtcagttgtgactagaacac

SEQ ID NO: 7700351 - DNA, 22 bp, Homo sapiens
tggtcatgtagtagagacagct

SEQ ID NO: 7700352 - DNA, 22 bp, Homo sapiens
tggtcatgtagtagagacagct

SEQ ID NO: 7700353 - DNA, 22 bp, Homo sapiens
tggtcagtacctggtcaccata

SEQ ID NO: 7700354 - DNA, 22 bp, Homo sapiens
tggtcaggtacctctggctgtc

SEQ ID NO: 7700355 - DNA, 22 bp, Homo sapiens
tggtcaggtacctctggctgtc

SEQ ID NO: 7700356 - DNA, 22 bp, Homo sapiens
tggtcaggtacctctggctgtc

SEQ ID NO: 7700357 - DNA, 22 bp, Homo sapiens
tggtcagttgatcaggcagcag

SEQ ID NO: 7700358 - DNA, 21 bp, Homo sapiens
tggtcagtatttcagttacat

SEQ ID NO: 7700359 - DNA, 22 bp, Homo sapiens
tggtccagaagatattcaacca

SEQ ID NO: 7700360 - DNA, 22 bp, Homo sapiens
tggtccacagggagtccgtgct

SEQ ID NO: 7700361 - DNA, 22 bp, Homo sapiens
tggtccagactttgacctctca

SEQ ID NO: 7700362 - DNA, 22 bp, Homo sapiens
tggtccagacatttctgaggta

SEQ ID NO: 7700363 - DNA, 22 bp, Homo sapiens
tggtccagaagatattcaacca

SEQ ID NO: 7700364 - DNA, 22 bp, Homo sapiens
tggtccagactttgacctctca

SEQ ID NO: 7700365 - DNA, 22 bp, Homo sapiens
tggtccagactttgacctctca

SEQ ID NO: 7700366 - DNA, 22 bp, Homo sapiens
tggtccagatgccttggcttta

SEQ ID NO: 7700367 - DNA, 22 bp, Homo sapiens
tggtccagatgccttggcttta

SEQ ID NO: 7700368 - DNA, 19 bp, Homo sapiens
tggtccagcttcttctcct

SEQ ID NO: 7700369 - DNA, 22 bp, Homo sapiens
tggtgccaccctccttcagctg

SEQ ID NO: 7700370 - DNA, 22 bp, Homo sapiens
tggtgccaccctccttcagctg

SEQ ID NO: 7700371 - DNA, 22 bp, Homo sapiens
tggtgccaagtggtttttggct

SEQ ID NO: 7700372 - DNA, 22 bp, Homo sapiens
tggtgccaagcatgaggactct

SEQ ID NO: 7700373 - DNA, 23 bp, Homo sapiens
tggtgccacagctgaagtcaggt

SEQ ID NO: 7700374 - DNA, 22 bp, Homo sapiens
tggtgccatcatagctcactgc

SEQ ID NO: 7700375 - DNA, 22 bp, Homo sapiens
tggtgccacttcttaggctggt

SEQ ID NO: 7700376 - DNA, 22 bp, Homo sapiens
tggtgcccactccagacaccta

SEQ ID NO: 7700377 - DNA, 22 bp, Homo sapiens
tggtgccattagccctgctgtt

SEQ ID NO: 7700378 - DNA, 22 bp, Homo sapiens
tggtgccattagccctgctgtt

SEQ ID NO: 7700379 - DNA, 22 bp, Homo sapiens
tggtgcccttgtgggtgagatg

SEQ ID NO: 7700380 - DNA, 22 bp, Homo sapiens
tggtgcccttgacagagccagc

SEQ ID NO: 7700381 - DNA, 22 bp, Homo sapiens
tggtgcccttgacagagccagc

SEQ ID NO: 7700382 - DNA, 22 bp, Homo sapiens
tggtgcccttgacagagccagc

SEQ ID NO: 7700383 - DNA, 22 bp, Homo sapiens
tggtgcccattctggtcccatg

SEQ ID NO: 7700384 - DNA, 22 bp, Homo sapiens
tggtgcccactctggacccagc

SEQ ID NO: 7700385 - DNA, 22 bp, Homo sapiens
tggtgcccactctggacccagc

SEQ ID NO: 7700386 - DNA, 22 bp, Homo sapiens
tggtgcccattctggtcccatg

SEQ ID NO: 7700387 - DNA, 22 bp, Homo sapiens
tggtgcccatgtatcccttcac

SEQ ID NO: 7700388 - DNA, 22 bp, Homo sapiens
tggtgcagtccaaagggagcag

SEQ ID NO: 7700389 - DNA, 22 bp, Homo sapiens
tggtgcagtccaaagggagcag

SEQ ID NO: 7700390 - DNA, 22 bp, Homo sapiens
tggtgcagtcattggcccaggg

SEQ ID NO: 7700391 - DNA, 22 bp, Homo sapiens
tggtgcagtcattggcccaggg

SEQ ID NO: 7700392 - DNA, 22 bp, Homo sapiens
tggtgcagtccaaagggagcag

SEQ ID NO: 7700393 - DNA, 22 bp, Homo sapiens
tggtgcagtccaaagggagcag

SEQ ID NO: 7700394 - DNA, 22 bp, Homo sapiens
tggtgcagtccaaagggagcag

SEQ ID NO: 7700395 - DNA, 22 bp, Homo sapiens
tggtgcagtccaaagggagcag

SEQ ID NO: 7700396 - DNA, 22 bp, Homo sapiens
tggtgcagtccaaagggagcag

SEQ ID NO: 7700397 - DNA, 22 bp, Homo sapiens
tggtgccaagcatgaggactct

SEQ ID NO: 7700398 - DNA, 22 bp, Homo sapiens
tggtgccaagcatgaggactct

SEQ ID NO: 7700399 - DNA, 22 bp, Homo sapiens
tggtgcagttcccagggccggg

SEQ ID NO: 7700400 - DNA, 22 bp, Homo sapiens
tggtgcagtccaaagggagcag

SEQ ID NO: 7700401 - DNA, 22 bp, Homo sapiens
tggtgcagttcccagggccggg

SEQ ID NO: 7700402 - DNA, 22 bp, Homo sapiens
tggtgcagttcccagggccggg

SEQ ID NO: 7700403 - DNA, 22 bp, Homo sapiens
tggtgcagttcccagggccggg

SEQ ID NO: 7700404 - DNA, 22 bp, Homo sapiens
tggtgcagatgcaggtcactgg

SEQ ID NO: 7700405 - DNA, 22 bp, Homo sapiens
tggtgcaggagttggcagggac

SEQ ID NO: 7700406 - DNA, 22 bp, Homo sapiens
tggtgcaggagttggcagggac

SEQ ID NO: 7700407 - DNA, 22 bp, Homo sapiens
tggtgcaggagttggcagggac

SEQ ID NO: 7700408 - DNA, 22 bp, Homo sapiens
tggtgcaggagttggcagggac

SEQ ID NO: 7700409 - DNA, 22 bp, Homo sapiens
tggtgcagatagtggtgtagta

SEQ ID NO: 7700410 - DNA, 22 bp, Homo sapiens
tggtgcagatagtggtgtagta

SEQ ID NO: 7700411 - DNA, 22 bp, Homo sapiens
tggtgcagatagtggtgtagta

SEQ ID NO: 7700412 - DNA, 22 bp, Homo sapiens
tggtgcagatgcaggtcactgg

SEQ ID NO: 7700413 - DNA, 22 bp, Homo sapiens
tggtgcaggtgttgatgcagga

SEQ ID NO: 7700414 - DNA, 22 bp, Homo sapiens
tggtgcaggtgttgatgcagga

SEQ ID NO: 7700415 - DNA, 22 bp, Homo sapiens
tggtgcaggtgttgatgcagga

SEQ ID NO: 7700416 - DNA, 22 bp, Homo sapiens
tggtgcaggccaagctgcgagc

SEQ ID NO: 7700417 - DNA, 22 bp, Homo sapiens
tggtgcaggccaagctgcgagc

SEQ ID NO: 7700418 - DNA, 22 bp, Homo sapiens
tggtgcaggagttggcagggac

SEQ ID NO: 7700419 - DNA, 22 bp, Homo sapiens
tggtgcaggccaagctgcgagc

SEQ ID NO: 7700420 - DNA, 22 bp, Homo sapiens
tggtgcaggagttggcagggac

SEQ ID NO: 7700421 - DNA, 22 bp, Homo sapiens
tggtgcaggagttggcagggac

SEQ ID NO: 7700422 - DNA, 22 bp, Homo sapiens
tggtgcagtagagctgtctggg

SEQ ID NO: 7700423 - DNA, 22 bp, Homo sapiens
tggtgcagtagagctgtctggg

SEQ ID NO: 7700424 - DNA, 22 bp, Homo sapiens
tggtgcagtagagctgtctggg

SEQ ID NO: 7700425 - DNA, 22 bp, Homo sapiens
tggtgcagtcattggcccaggg

SEQ ID NO: 7700426 - DNA, 22 bp, Homo sapiens
tggtgcagtcattggcccaggg

SEQ ID NO: 7700427 - DNA, 22 bp, Homo sapiens
tggtgcagtcattggcccaggg

SEQ ID NO: 7700428 - DNA, 22 bp, Homo sapiens
tggtgcagtcattggcccaggg

SEQ ID NO: 7700429 - DNA, 22 bp, Homo sapiens
tggtgcagtcattggcccaggg

SEQ ID NO: 7700430 - DNA, 22 bp, Homo sapiens
tggtgcagtcattggcccaggg

SEQ ID NO: 7700431 - DNA, 22 bp, Homo sapiens
tggtgcagtagaaggccgactt

SEQ ID NO: 7700432 - DNA, 22 bp, Homo sapiens
tggtgcagtagagctgtctggg

SEQ ID NO: 7700433 - DNA, 22 bp, Homo sapiens
tggtgcagtagagctgtctggg

SEQ ID NO: 7700434 - DNA, 22 bp, Homo sapiens
tggtgcagtagagctgtctggg

SEQ ID NO: 7700435 - DNA, 22 bp, Homo sapiens
tggtgcaggtgttgatgcagga

SEQ ID NO: 7700436 - DNA, 22 bp, Homo sapiens
tggtgcagtagaaggccgactt

SEQ ID NO: 7700437 - DNA, 22 bp, Homo sapiens
tggtgcaggtgttgatgcagga

SEQ ID NO: 7700438 - DNA, 22 bp, Homo sapiens
tggtgcaggtgttgatgcagga

SEQ ID NO: 7700439 - DNA, 19 bp, Homo sapiens
tggtggaggtgcacctgac

SEQ ID NO: 7700440 - DNA, 19 bp, Homo sapiens
tggtggaggtgcacctgac

SEQ ID NO: 7700441 - DNA, 19 bp, Homo sapiens
tggtggaggtgcacctgac

SEQ ID NO: 7700442 - DNA, 19 bp, Homo sapiens
tggtggaggtgcacctgac

SEQ ID NO: 7700443 - DNA, 19 bp, Homo sapiens
tggtggaggtgcacctgac

SEQ ID NO: 7700444 - DNA, 19 bp, Homo sapiens
tggtggaggtgcacctgac

SEQ ID NO: 7700445 - DNA, 22 bp, Homo sapiens
tggtggaggtgcatttcggagc

SEQ ID NO: 7700446 - DNA, 19 bp, Homo sapiens
tggtggaggtgcacctgac

SEQ ID NO: 7700447 - DNA, 21 bp, Homo sapiens
tggtggagtgtgctgagcatg

SEQ ID NO: 7700448 - DNA, 21 bp, Homo sapiens
tggtggagtgtgctgagcatg

SEQ ID NO: 7700449 - DNA, 21 bp, Homo sapiens
tggtggagtgtgctgagcatg

SEQ ID NO: 7700450 - DNA, 21 bp, Homo sapiens
tggtggagtgtgctgagcatg

SEQ ID NO: 7700451 - DNA, 21 bp, Homo sapiens
tggtggagtgtgctgagcatg

SEQ ID NO: 7700452 - DNA, 21 bp, Homo sapiens
tggtggagtgtgctgagcatg

SEQ ID NO: 7700453 - DNA, 21 bp, Homo sapiens
tggtggagtgtgctgagcatg

SEQ ID NO: 7700454 - DNA, 21 bp, Homo sapiens
tggtggagtgtgctgagcatg

SEQ ID NO: 7700455 - DNA, 21 bp, Homo sapiens
tggtggagtgtgctgagcatg

SEQ ID NO: 7700456 - DNA, 22 bp, Homo sapiens
tggtggagtttctctttcaaac

SEQ ID NO: 7700457 - DNA, 22 bp, Homo sapiens
tggtggcaaaagaggcaaagtg

SEQ ID NO: 7700458 - DNA, 22 bp, Homo sapiens
tggtggcaaagtacaaagtgac

SEQ ID NO: 7700459 - DNA, 22 bp, Homo sapiens
tggtggcaaagtacaaagtgac

SEQ ID NO: 7700460 - DNA, 22 bp, Homo sapiens
tggtggcaaatcaggacacttc

SEQ ID NO: 7700461 - DNA, 22 bp, Homo sapiens
tggtggcaaatcaggacacttc

SEQ ID NO: 7700462 - DNA, 22 bp, Homo sapiens
tggtggcaaatcaggacacttc

SEQ ID NO: 7700463 - DNA, 22 bp, Homo sapiens
tggtggcaacattgctggagtg

SEQ ID NO: 7700464 - DNA, 22 bp, Homo sapiens
tggtggcaacattgctggagtg

SEQ ID NO: 7700465 - DNA, 22 bp, Homo sapiens
tggtggcaacattgctggagtg

SEQ ID NO: 7700466 - DNA, 22 bp, Homo sapiens
tggtggcaacattgctggagtg

SEQ ID NO: 7700467 - DNA, 22 bp, Homo sapiens
tggtggcaacattgctggagtg

SEQ ID NO: 7700468 - DNA, 22 bp, Homo sapiens
tggtggcaacattgctggagtg

SEQ ID NO: 7700469 - DNA, 22 bp, Homo sapiens
tggtggcaacattgctggagtg

SEQ ID NO: 7700470 - DNA, 22 bp, Homo sapiens
tggtggacaccgcagccatgaa

SEQ ID NO: 7700471 - DNA, 22 bp, Homo sapiens
tggtggacaccgcagccatgaa

SEQ ID NO: 7700472 - DNA, 22 bp, Homo sapiens
tggtggaattgtaaaatagtgt

SEQ ID NO: 7700473 - DNA, 22 bp, Homo sapiens
tggtgccgcaggctggccttcg

SEQ ID NO: 7700474 - DNA, 23 bp, Homo sapiens
tggtgcctcagaagcagtgggct

SEQ ID NO: 7700475 - DNA, 23 bp, Homo sapiens
tggtgcctcagaagcagtgggct

SEQ ID NO: 7700476 - DNA, 22 bp, Homo sapiens
tggtgcctccagctgcttctcc

SEQ ID NO: 7700477 - DNA, 21 bp, Homo sapiens
tggtgccttcagctgtctttt

SEQ ID NO: 7700478 - DNA, 21 bp, Homo sapiens
tggtgccttcagctgtctttt

SEQ ID NO: 7700479 - DNA, 22 bp, Homo sapiens
tggtgcctccagctgcttctcc

SEQ ID NO: 7700480 - DNA, 22 bp, Homo sapiens
tggtggacaccgcagccatgaa

SEQ ID NO: 7700481 - DNA, 22 bp, Homo sapiens
tggtggacctggcattgaacct

SEQ ID NO: 7700482 - DNA, 21 bp, Homo sapiens
tggtggaccagtgctgggaga

SEQ ID NO: 7700483 - DNA, 20 bp, Homo sapiens
tggtggactttggcatggct

SEQ ID NO: 7700484 - DNA, 20 bp, Homo sapiens
tggtggactttggcatggct

SEQ ID NO: 7700485 - DNA, 20 bp, Homo sapiens
tggtggactttggcatggct

SEQ ID NO: 7700486 - DNA, 22 bp, Homo sapiens
tggtggagacctcgctaacccc

SEQ ID NO: 7700487 - DNA, 22 bp, Homo sapiens
tggtggagagacagtgtattgg

SEQ ID NO: 7700488 - DNA, 20 bp, Homo sapiens
tggtggactttggcatggct

SEQ ID NO: 7700489 - DNA, 22 bp, Homo sapiens
tggtggacaccgcagccatgaa

SEQ ID NO: 7700490 - DNA, 22 bp, Homo sapiens
tggtggagcctaggctaagtct

SEQ ID NO: 7700491 - DNA, 22 bp, Homo sapiens
tggtggagcctaggctaagtct

SEQ ID NO: 7700492 - DNA, 22 bp, Homo sapiens
tggtggagcctaggctaagtct

SEQ ID NO: 7700493 - DNA, 22 bp, Homo sapiens
tggtggagggaactatttccag

SEQ ID NO: 7700494 - DNA, 19 bp, Homo sapiens
tggtggaggccccatgttc

SEQ ID NO: 7700495 - DNA, 22 bp, Homo sapiens
tggtggagggaactatttccag

SEQ ID NO: 7700496 - DNA, 19 bp, Homo sapiens
tggtggaggccccatgttc

SEQ ID NO: 7700497 - DNA, 22 bp, Homo sapiens
tggtggagctgtggccacgacc

SEQ ID NO: 7700498 - DNA, 22 bp, Homo sapiens
tggtggagctgtggccacgacc

SEQ ID NO: 7700499 - DNA, 22 bp, Homo sapiens
tggtggagctgtggccacgacc

SEQ ID NO: 7700500 - DNA, 19 bp, Homo sapiens
tggtggcaatgtcagctaa

SEQ ID NO: 7700501 - DNA, 19 bp, Homo sapiens
tggtggcaatgtcagctaa

SEQ ID NO: 7700502 - DNA, 19 bp, Homo sapiens
tggtggcaatgtcagctaa

SEQ ID NO: 7700503 - DNA, 22 bp, Homo sapiens
tggtggcaaggtgataagtggg

SEQ ID NO: 7700504 - DNA, 22 bp, Homo sapiens
tggtggcaacattgctggagtg

SEQ ID NO: 7700505 - DNA, 22 bp, Homo sapiens
tggtggcaatgtcctggagaag

SEQ ID NO: 7700506 - DNA, 22 bp, Homo sapiens
tggtggcaatgtcctggagaag

SEQ ID NO: 7700507 - DNA, 22 bp, Homo sapiens
tggtggcaatgtcctggagaag

SEQ ID NO: 7700508 - DNA, 22 bp, Homo sapiens
tggtggcaattcaaagacagca

SEQ ID NO: 7700509 - DNA, 22 bp, Homo sapiens
tggtggcacaagggagagaatc

SEQ ID NO: 7700510 - DNA, 22 bp, Homo sapiens
tggtggcaatgtcctggagaag

SEQ ID NO: 7700511 - DNA, 22 bp, Homo sapiens
tggtggcaatgtcctggagaag

SEQ ID NO: 7700512 - DNA, 22 bp, Homo sapiens
tggtggcaatgtcctggagaag

SEQ ID NO: 7700513 - DNA, 22 bp, Homo sapiens
tggtggcaatgtcctggagaag

SEQ ID NO: 7700514 - DNA, 22 bp, Homo sapiens
tggtggcaattcaaagacagca

SEQ ID NO: 7700515 - DNA, 23 bp, Homo sapiens
tggtggcagaagtagcagatgac

SEQ ID NO: 7700516 - DNA, 23 bp, Homo sapiens
tggtggcagaagtagcagatgac

SEQ ID NO: 7700517 - DNA, 22 bp, Homo sapiens
tggtggcactgacatcagacac

SEQ ID NO: 7700518 - DNA, 23 bp, Homo sapiens
tggtggcagaagtagcagatgac

SEQ ID NO: 7700519 - DNA, 23 bp, Homo sapiens
tggtggcagaagtagcagatgac

SEQ ID NO: 7700520 - DNA, 22 bp, Homo sapiens
tggtggcacaagggagagaatc

SEQ ID NO: 7700521 - DNA, 22 bp, Homo sapiens
tggtggcacaagggagagaatc

SEQ ID NO: 7700522 - DNA, 22 bp, Homo sapiens
tggtggcacaagggagagaatc

SEQ ID NO: 7700523 - DNA, 22 bp, Homo sapiens
tggtggcagagcaagagctgga

SEQ ID NO: 7700524 - DNA, 22 bp, Homo sapiens
tggtggcagagcaagagctgga

SEQ ID NO: 7700525 - DNA, 23 bp, Homo sapiens
tggtggcagaagtagcagatgac

SEQ ID NO: 7700526 - DNA, 23 bp, Homo sapiens
tggtggcagaagtagcagatgac

SEQ ID NO: 7700527 - DNA, 23 bp, Homo sapiens
tggtggcagaagtagcagatgac

SEQ ID NO: 7700528 - DNA, 22 bp, Homo sapiens
tggtggcagagcaagagctgga

SEQ ID NO: 7700529 - DNA, 22 bp, Homo sapiens
tggtggcagagcaagagctgga

SEQ ID NO: 7700530 - DNA, 22 bp, Homo sapiens
tggtggcagagcaagagctgga

SEQ ID NO: 7700531 - DNA, 22 bp, Homo sapiens
tggtggcagagcaagagctgga

SEQ ID NO: 7700532 - DNA, 22 bp, Homo sapiens
tggtggcagctgagtgtcaggt

SEQ ID NO: 7700533 - DNA, 22 bp, Homo sapiens
tggtggcagctgagtgtcaggt

SEQ ID NO: 7700534 - DNA, 22 bp, Homo sapiens
tggtggcagctgagtgtcaggt

SEQ ID NO: 7700535 - DNA, 22 bp, Homo sapiens
tggtggcagcaggagggcccct

SEQ ID NO: 7700536 - DNA, 22 bp, Homo sapiens
tggtggcagcaggagggcccct

SEQ ID NO: 7700537 - DNA, 22 bp, Homo sapiens
tggtggcagctgagtgtcaggt

SEQ ID NO: 7700538 - DNA, 22 bp, Homo sapiens
tggtggcagtctcctggctgtg

SEQ ID NO: 7700539 - DNA, 22 bp, Homo sapiens
tggtggcagtgagaaggagagg

SEQ ID NO: 7700540 - DNA, 22 bp, Homo sapiens
tggtggcagtgagaaggagagg

SEQ ID NO: 7700541 - DNA, 22 bp, Homo sapiens
tggtggcagtgagaaggagagg

SEQ ID NO: 7700542 - DNA, 22 bp, Homo sapiens
tggtggcagctgggacagaggt

SEQ ID NO: 7700543 - DNA, 22 bp, Homo sapiens
tggtggcagctgggacagaggt

SEQ ID NO: 7700544 - DNA, 22 bp, Homo sapiens
tggtggcagctgggacagaggt

SEQ ID NO: 7700545 - DNA, 22 bp, Homo sapiens
tggtggcagctgggacagaggt

SEQ ID NO: 7700546 - DNA, 22 bp, Homo sapiens
tggtggcagctgggacagaggt

SEQ ID NO: 7700547 - DNA, 22 bp, Homo sapiens
tggtggcatcactcagcctccc

SEQ ID NO: 7700548 - DNA, 22 bp, Homo sapiens
tggtggcatcagtgaagtacac

SEQ ID NO: 7700549 - DNA, 22 bp, Homo sapiens
tggtggcatcagtgaagtacac

SEQ ID NO: 7700550 - DNA, 22 bp, Homo sapiens
tggtggcatcagtgaagtacac

SEQ ID NO: 7700551 - DNA, 22 bp, Homo sapiens
tggtggcatcactcagcctccc

SEQ ID NO: 7700552 - DNA, 22 bp, Homo sapiens
tggtggcatcactcagcctccc

SEQ ID NO: 7700553 - DNA, 22 bp, Homo sapiens
tggtggcatcaattgacttctc

SEQ ID NO: 7700554 - DNA, 22 bp, Homo sapiens
tggtggcagtgagaaggagagg

SEQ ID NO: 7700555 - DNA, 22 bp, Homo sapiens
tggtggcatcaattgacttctc

SEQ ID NO: 7700556 - DNA, 22 bp, Homo sapiens
tggtggcatgatagtgtgaatg

SEQ ID NO: 7700557 - DNA, 22 bp, Homo sapiens
tggtggccaattcacagggctc

SEQ ID NO: 7700558 - DNA, 22 bp, Homo sapiens
tggtggcatgatagtgtgaatg

SEQ ID NO: 7700559 - DNA, 22 bp, Homo sapiens
tggtggccacgtgggcgcgagc

SEQ ID NO: 7700560 - DNA, 20 bp, Homo sapiens
tggtggccagtgctgcaggc

SEQ ID NO: 7700561 - DNA, 20 bp, Homo sapiens
tggtggccagtgctgcaggc

SEQ ID NO: 7700562 - DNA, 20 bp, Homo sapiens
tggtggccagtgctgcaggc

SEQ ID NO: 7700563 - DNA, 20 bp, Homo sapiens
tggtggccagtgctgcaggc

SEQ ID NO: 7700564 - DNA, 22 bp, Homo sapiens
tggtggccacgtgggcgcgagc

SEQ ID NO: 7700565 - DNA, 22 bp, Homo sapiens
tggtggccacgtgggcgcgagc

SEQ ID NO: 7700566 - DNA, 22 bp, Homo sapiens
tggtggccaattcacagggctc

SEQ ID NO: 7700567 - DNA, 22 bp, Homo sapiens
tggtgggcacagtgcccaggct

SEQ ID NO: 7700568 - DNA, 22 bp, Homo sapiens
tggtgggcacagtgcccaggct

SEQ ID NO: 7700569 - DNA, 22 bp, Homo sapiens
tggtgggcacagtgcccaggct

SEQ ID NO: 7700570 - DNA, 22 bp, Homo sapiens
tggtgggagtgagggcatgcca

SEQ ID NO: 7700571 - DNA, 22 bp, Homo sapiens
tggtgggagtgagggcatgcca

SEQ ID NO: 7700572 - DNA, 22 bp, Homo sapiens
tggtgggagtgagggcatgcca

SEQ ID NO: 7700573 - DNA, 22 bp, Homo sapiens
tggtgggagtgagggcatgcca

SEQ ID NO: 7700574 - DNA, 22 bp, Homo sapiens
tggtgggagtgacgttgccttc

SEQ ID NO: 7700575 - DNA, 22 bp, Homo sapiens
tggtgggagtgagggcatgcca

SEQ ID NO: 7700576 - DNA, 22 bp, Homo sapiens
tggtgggagtgagggcatgcca

SEQ ID NO: 7700577 - DNA, 22 bp, Homo sapiens
tggtgggagtgacgttgccttc

SEQ ID NO: 7700578 - DNA, 22 bp, Homo sapiens
tggtgggagtgacgttgccttc

SEQ ID NO: 7700579 - DNA, 22 bp, Homo sapiens
tggtgggagtgagggcatgcca

SEQ ID NO: 7700580 - DNA, 22 bp, Homo sapiens
tggtgggagtccgctgtgctgc

SEQ ID NO: 7700581 - DNA, 22 bp, Homo sapiens
tggtgggagtccgctgtgctgc

SEQ ID NO: 7700582 - DNA, 20 bp, Homo sapiens
tggtggccagtgctgcaggc

SEQ ID NO: 7700583 - DNA, 20 bp, Homo sapiens
tggtggccagtgctgcaggc

SEQ ID NO: 7700584 - DNA, 16 bp, Homo sapiens
tggtggccatagttat

SEQ ID NO: 7700585 - DNA, 22 bp, Homo sapiens
tggtgggcacagtgcccaggct

SEQ ID NO: 7700586 - DNA, 22 bp, Homo sapiens
tggtgggcacagtgcccaggct

SEQ ID NO: 7700587 - DNA, 22 bp, Homo sapiens
tggtgggcacagtgcccaggct

SEQ ID NO: 7700588 - DNA, 23 bp, Homo sapiens
tggtgggccctgcttgctcactg

SEQ ID NO: 7700589 - DNA, 22 bp, Homo sapiens
tggtgggctgagtctcatcgga

SEQ ID NO: 7700590 - DNA, 22 bp, Homo sapiens
tggtgggctgagtctcatcgga

SEQ ID NO: 7700591 - DNA, 23 bp, Homo sapiens
tggtgggccctgcttgctcactg

SEQ ID NO: 7700592 - DNA, 16 bp, Homo sapiens
tggtggggaggacagc

SEQ ID NO: 7700593 - DNA, 16 bp, Homo sapiens
tggtggggaggacagc

SEQ ID NO: 7700594 - DNA, 22 bp, Homo sapiens
tggtgggctgagtctcatcgga

SEQ ID NO: 7700595 - DNA, 16 bp, Homo sapiens
tggtggggaggacagc

SEQ ID NO: 7700596 - DNA, 16 bp, Homo sapiens
tggtggggaggacagc

SEQ ID NO: 7700597 - DNA, 16 bp, Homo sapiens
tggtggggaggacagc

SEQ ID NO: 7700598 - DNA, 16 bp, Homo sapiens
tggtggggaggacagc

SEQ ID NO: 7700599 - DNA, 16 bp, Homo sapiens
tggtggggaggacagc

SEQ ID NO: 7700600 - DNA, 16 bp, Homo sapiens
tggtggggaggacagc

SEQ ID NO: 7700601 - DNA, 16 bp, Homo sapiens
tggtggggaggacagc

SEQ ID NO: 7700602 - DNA, 22 bp, Homo sapiens
tggtggggctttccttctgctt

SEQ ID NO: 7700603 - DNA, 22 bp, Homo sapiens
tggtggggctttccttctgctt

SEQ ID NO: 7700604 - DNA, 22 bp, Homo sapiens
tggtggggctttccttctgctt

SEQ ID NO: 7700605 - DNA, 22 bp, Homo sapiens
tggtggggctttccttctgctt

SEQ ID NO: 7700606 - DNA, 22 bp, Homo sapiens
tggtggggccagacttcagctc

SEQ ID NO: 7700607 - DNA, 22 bp, Homo sapiens
tggtggggccagacttcagctc

SEQ ID NO: 7700608 - DNA, 22 bp, Homo sapiens
tggtggggccagacttcagctc

SEQ ID NO: 7700609 - DNA, 22 bp, Homo sapiens
tggtggggattccctccctggc

SEQ ID NO: 7700610 - DNA, 16 bp, Homo sapiens
tggtggggaggacagc

SEQ ID NO: 7700611 - DNA, 22 bp, Homo sapiens
tggtggggattccctccctggc

SEQ ID NO: 7700612 - DNA, 22 bp, Homo sapiens
tggtggggattccctccctggc

SEQ ID NO: 7700613 - DNA, 22 bp, Homo sapiens
tggtggggattccctccctggc

SEQ ID NO: 7700614 - DNA, 22 bp, Homo sapiens
tggtggggattccctccctggc

SEQ ID NO: 7700615 - DNA, 22 bp, Homo sapiens
tggtggggattccctccctggc

SEQ ID NO: 7700616 - DNA, 22 bp, Homo sapiens
tggtggggccagacttcagctc

SEQ ID NO: 7700617 - DNA, 22 bp, Homo sapiens
tggtggggccagacttcagctc

SEQ ID NO: 7700618 - DNA, 22 bp, Homo sapiens
tggtggggccagacttcagctc

SEQ ID NO: 7700619 - DNA, 22 bp, Homo sapiens
tggtggggattccctccctggc

SEQ ID NO: 7700620 - DNA, 22 bp, Homo sapiens
tggtgggggaggctgtctagca

SEQ ID NO: 7700621 - DNA, 22 bp, Homo sapiens
tggtggggctttccttctgctt

SEQ ID NO: 7700622 - DNA, 22 bp, Homo sapiens
tggtggggctttccttctgctt

SEQ ID NO: 7700623 - DNA, 22 bp, Homo sapiens
tggtgggggaggctgtctagca

SEQ ID NO: 7700624 - DNA, 22 bp, Homo sapiens
tggtgggggaggctgtctagca

SEQ ID NO: 7700625 - DNA, 22 bp, Homo sapiens
tggtgggggaggctgtctagca

SEQ ID NO: 7700626 - DNA, 22 bp, Homo sapiens
tggtgggggaggctgtctagca

SEQ ID NO: 7700627 - DNA, 22 bp, Homo sapiens
tggtggggtcatcgtcagatgc

SEQ ID NO: 7700628 - DNA, 22 bp, Homo sapiens
tggtggggtcatcgtcagatgc

SEQ ID NO: 7700629 - DNA, 22 bp, Homo sapiens
tggtggggtcatcgtcagatgc

SEQ ID NO: 7700630 - DNA, 22 bp, Homo sapiens
tggtggggtcatcgtcagatgc

SEQ ID NO: 7700631 - DNA, 22 bp, Homo sapiens
tggtggggtcatcgtcagatgc

SEQ ID NO: 7700632 - DNA, 22 bp, Homo sapiens
tggtggggtcatcgtcagatgc

SEQ ID NO: 7700633 - DNA, 22 bp, Homo sapiens
tggtgggggaggctgtctagca

SEQ ID NO: 7700634 - DNA, 22 bp, Homo sapiens
tggtgggggaggctgtctagca

SEQ ID NO: 7700635 - DNA, 22 bp, Homo sapiens
tggtgggggaggctgtctagca

SEQ ID NO: 7700636 - DNA, 22 bp, Homo sapiens
tggtgggggaggctgtctagca

SEQ ID NO: 7700637 - DNA, 22 bp, Homo sapiens
tggtgggggaggctgtctagca

SEQ ID NO: 7700638 - DNA, 23 bp, Homo sapiens
tgtaacttcttaaattcttcact

SEQ ID NO: 7700639 - DNA, 23 bp, Homo sapiens
tgtaacttcttaaattcttcact

SEQ ID NO: 7700640 - DNA, 23 bp, Homo sapiens
tgtaacttcttaaattcttcact

SEQ ID NO: 7700641 - DNA, 22 bp, Homo sapiens
tgtaactgtggtctagggactg

SEQ ID NO: 7700642 - DNA, 23 bp, Homo sapiens
tgtaacttgatggaatgagctat

SEQ ID NO: 7700643 - DNA, 22 bp, Homo sapiens
tgtaactgcttagaaggtttta

SEQ ID NO: 7700644 - DNA, 22 bp, Homo sapiens
tgtaactggacaagatattcat

SEQ ID NO: 7700645 - DNA, 22 bp, Homo sapiens
tgtaactggttataatttttga

SEQ ID NO: 7700646 - DNA, 22 bp, Homo sapiens
tgtaactgtggtctagggactg

SEQ ID NO: 7700647 - DNA, 22 bp, Homo sapiens
tgtaactataaaattaattgct

SEQ ID NO: 7700648 - DNA, 22 bp, Homo sapiens
tgtaactgccatgtagcctgtc

SEQ ID NO: 7700649 - DNA, 22 bp, Homo sapiens
tgtaagaaaagtaaatagtgac

SEQ ID NO: 7700650 - DNA, 22 bp, Homo sapiens
tgtaagaaaagtaaatagtgac

SEQ ID NO: 7700651 - DNA, 22 bp, Homo sapiens
tgtaagaaaagtaaatagtgac

SEQ ID NO: 7700652 - DNA, 22 bp, Homo sapiens
tgtaagaacaactgtcaaatgt

SEQ ID NO: 7700653 - DNA, 22 bp, Homo sapiens
tgtaagaacaactgtcaaatgt

SEQ ID NO: 7700654 - DNA, 22 bp, Homo sapiens
tgtaagaaaacctgtacaaaga

SEQ ID NO: 7700655 - DNA, 22 bp, Homo sapiens
tgtaagaaaacctgtacaaaga

SEQ ID NO: 7700656 - DNA, 22 bp, Homo sapiens
tgtaagaaaacctgtacaaaga

SEQ ID NO: 7700657 - DNA, 22 bp, Homo sapiens
tgtaagaaaagtaaatagtgac

SEQ ID NO: 7700658 - DNA, 22 bp, Homo sapiens
tgtaagaaaacctgtacaaaga

SEQ ID NO: 7700659 - DNA, 22 bp, Homo sapiens
tgtaagatattcagcttattga

SEQ ID NO: 7700660 - DNA, 22 bp, Homo sapiens
tgtaagatgctgggatagatga

SEQ ID NO: 7700661 - DNA, 22 bp, Homo sapiens
tgtaagatattcagcttattga

SEQ ID NO: 7700662 - DNA, 22 bp, Homo sapiens
tgtaagatatgagtacatgtaa

SEQ ID NO: 7700663 - DNA, 22 bp, Homo sapiens
tgtaagatatgagtacatgtaa

SEQ ID NO: 7700664 - DNA, 22 bp, Homo sapiens
tgtaagatatgagtacatgtaa

SEQ ID NO: 7700665 - DNA, 22 bp, Homo sapiens
tgtaagatttgctatgtgttgt

SEQ ID NO: 7700666 - DNA, 22 bp, Homo sapiens
tgtaagatgctgggatagatga

SEQ ID NO: 7700667 - DNA, 22 bp, Homo sapiens
tgtaagacatatcttagtgatg

SEQ ID NO: 7700668 - DNA, 22 bp, Homo sapiens
tgtaagaatcagtctttaatgt

SEQ ID NO: 7700669 - DNA, 22 bp, Homo sapiens
tgtaagaatcagtctttaatgt

SEQ ID NO: 7700670 - DNA, 22 bp, Homo sapiens
tgtaagaataatgatttctaag

SEQ ID NO: 7700671 - DNA, 22 bp, Homo sapiens
tgtaagaataatgatttctaag

SEQ ID NO: 7700672 - DNA, 22 bp, Homo sapiens
tgtaagaataatgatttctaag

SEQ ID NO: 7700673 - DNA, 22 bp, Homo sapiens
tgtaagaacatgtgtgggcaca

SEQ ID NO: 7700674 - DNA, 20 bp, Homo sapiens
tgtaagaagtaggagggtta

SEQ ID NO: 7700675 - DNA, 20 bp, Homo sapiens
tgtaagaagtaggagggtta

SEQ ID NO: 7700676 - DNA, 22 bp, Homo sapiens
tgtaagaagggccagagctcca

SEQ ID NO: 7700677 - DNA, 22 bp, Homo sapiens
tgtaagaataatgatttctaag

SEQ ID NO: 7700678 - DNA, 22 bp, Homo sapiens
tgtaagaataatgatttctaag

SEQ ID NO: 7700679 - DNA, 22 bp, Homo sapiens
tgtaagaataatgatttctaag

SEQ ID NO: 7700680 - DNA, 22 bp, Homo sapiens
tgtaagaataatgatttctaag

SEQ ID NO: 7700681 - DNA, 22 bp, Homo sapiens
tgtacaaagagtatagctttga

SEQ ID NO: 7700682 - DNA, 22 bp, Homo sapiens
tgtacaaagccagaactcccaa

SEQ ID NO: 7700683 - DNA, 22 bp, Homo sapiens
tgtacaaagccagaactcccaa

SEQ ID NO: 7700684 - DNA, 22 bp, Homo sapiens
tgtacaaagccagaactcccaa

SEQ ID NO: 7700685 - DNA, 22 bp, Homo sapiens
tgtacaaaggtactttgatgtt

SEQ ID NO: 7700686 - DNA, 22 bp, Homo sapiens
tgtacaaaggtactttgatgtt

SEQ ID NO: 7700687 - DNA, 22 bp, Homo sapiens
tgtacaaaggtactttgatgtt

SEQ ID NO: 7700688 - DNA, 22 bp, Homo sapiens
tgtacaaagttaaacctatata

SEQ ID NO: 7700689 - DNA, 22 bp, Homo sapiens
tgtacaaagttaaacctatata

SEQ ID NO: 7700690 - DNA, 22 bp, Homo sapiens
tgtacaaagttaaacctatata

SEQ ID NO: 7700691 - DNA, 22 bp, Homo sapiens
tgtacaaagttaaacctatata

SEQ ID NO: 7700692 - DNA, 22 bp, Homo sapiens
tgtacaaagttaaacctatata

SEQ ID NO: 7700693 - DNA, 22 bp, Homo sapiens
tgtacaaagttaaacctatata

SEQ ID NO: 7700694 - DNA, 22 bp, Homo sapiens
tgtacaaaacaagatgggggta

SEQ ID NO: 7700695 - DNA, 22 bp, Homo sapiens
tgtacaaagagtatagctttga

SEQ ID NO: 7700696 - DNA, 22 bp, Homo sapiens
tgtacaaagagtatagctttga

SEQ ID NO: 7700697 - DNA, 22 bp, Homo sapiens
tgtacaaagagtatagctttga

SEQ ID NO: 7700698 - DNA, 22 bp, Homo sapiens
tgtacaaagagtatagctttga

SEQ ID NO: 7700699 - DNA, 22 bp, Homo sapiens
tgtacaaagagtatagctttga

SEQ ID NO: 7700700 - DNA, 22 bp, Homo sapiens
tgtacaaagagtatagctttga

SEQ ID NO: 7700701 - DNA, 22 bp, Homo sapiens
tgtacaaagagtatagctttga

SEQ ID NO: 7700702 - DNA, 22 bp, Homo sapiens
tgtacaaagagtatagctttga

SEQ ID NO: 7700703 - DNA, 22 bp, Homo sapiens
tgtacaaagagtatagctttga

SEQ ID NO: 7700704 - DNA, 22 bp, Homo sapiens
tgtacaaagagtatagctttga

SEQ ID NO: 7700705 - DNA, 22 bp, Homo sapiens
tgtaagtagaacaacataatct

SEQ ID NO: 7700706 - DNA, 22 bp, Homo sapiens
tgtaagtagaacaacataatct

SEQ ID NO: 7700707 - DNA, 22 bp, Homo sapiens
tgtaagtagaacaacataatct

SEQ ID NO: 7700708 - DNA, 22 bp, Homo sapiens
tgtaagtagaacaacataatct

SEQ ID NO: 7700709 - DNA, 22 bp, Homo sapiens
tgtaaggtgctcatgtatttct

SEQ ID NO: 7700710 - DNA, 22 bp, Homo sapiens
tgtaagtacattgaaacatctt

SEQ ID NO: 7700711 - DNA, 22 bp, Homo sapiens
tgtaaggtgctcatgtatttct

SEQ ID NO: 7700712 - DNA, 22 bp, Homo sapiens
tgtaattttacgtgacacagtt

SEQ ID NO: 7700713 - DNA, 22 bp, Homo sapiens
tgtaattttctcaagtttctac

SEQ ID NO: 7700714 - DNA, 22 bp, Homo sapiens
tgtaattttacgtgacacagtt

SEQ ID NO: 7700715 - DNA, 22 bp, Homo sapiens
tgtaattttctcaagtttctac

SEQ ID NO: 7700716 - DNA, 22 bp, Homo sapiens
tgtaattttctcaagtttctac

SEQ ID NO: 7700717 - DNA, 23 bp, Homo sapiens
tgtaacaatttcatatacatgca

SEQ ID NO: 7700718 - DNA, 23 bp, Homo sapiens
tgtaacaatttcatatacatgca

SEQ ID NO: 7700719 - DNA, 23 bp, Homo sapiens
tgtaacaatttcatatacatgca

SEQ ID NO: 7700720 - DNA, 23 bp, Homo sapiens
tgtaacaatttcatatacatgca

SEQ ID NO: 7700721 - DNA, 23 bp, Homo sapiens
tgtaacaatttcatatacatgca

SEQ ID NO: 7700722 - DNA, 23 bp, Homo sapiens
tgtaacaatttcatatacatgca

SEQ ID NO: 7700723 - DNA, 23 bp, Homo sapiens
tgtaacaatttcatatacatgca

SEQ ID NO: 7700724 - DNA, 23 bp, Homo sapiens
tgtaacaatttcatatacatgca

SEQ ID NO: 7700725 - DNA, 23 bp, Homo sapiens
tgtaacaatttcatatacatgca

SEQ ID NO: 7700726 - DNA, 23 bp, Homo sapiens
tgtaacaatttcatatacatgca

SEQ ID NO: 7700727 - DNA, 22 bp, Homo sapiens
tgtaacaatttcttactattgt

SEQ ID NO: 7700728 - DNA, 22 bp, Homo sapiens
tgtaacaatttcttactattgt

SEQ ID NO: 7700729 - DNA, 23 bp, Homo sapiens
tgtaacaatttcatatacatgca

SEQ ID NO: 7700730 - DNA, 22 bp, Homo sapiens
tgtaacaatttcttactattgt

SEQ ID NO: 7700731 - DNA, 22 bp, Homo sapiens
tgtaacaatttcttactattgt

SEQ ID NO: 7700732 - DNA, 22 bp, Homo sapiens
tgtaacactcaatctgtttaac

SEQ ID NO: 7700733 - DNA, 22 bp, Homo sapiens
tgtaacatggttcttactctca

SEQ ID NO: 7700734 - DNA, 22 bp, Homo sapiens
tgtaacatatgtaaaagcacct

SEQ ID NO: 7700735 - DNA, 22 bp, Homo sapiens
tgtaacatatgtaaaagcacct

SEQ ID NO: 7700736 - DNA, 22 bp, Homo sapiens
tgtaacatcacagtgatgtttg

SEQ ID NO: 7700737 - DNA, 22 bp, Homo sapiens
tgtaacatatagcatgttcttg

SEQ ID NO: 7700738 - DNA, 22 bp, Homo sapiens
tgtaacatatgtaaaagcacct

SEQ ID NO: 7700739 - DNA, 22 bp, Homo sapiens
tgtaacatatagcatgttcttg

SEQ ID NO: 7700740 - DNA, 22 bp, Homo sapiens
tgtaacatggttcttactctca

SEQ ID NO: 7700741 - DNA, 22 bp, Homo sapiens
tgtaacatggttcttactctca

SEQ ID NO: 7700742 - DNA, 22 bp, Homo sapiens
tgtaactaagcacattatctaa

SEQ ID NO: 7700743 - DNA, 22 bp, Homo sapiens
tgtaactataaaattaattgct

SEQ ID NO: 7700744 - DNA, 22 bp, Homo sapiens
tgtaacagctctccatgtgggg

SEQ ID NO: 7700745 - DNA, 22 bp, Homo sapiens
tgtaacagagcttttttatagc

SEQ ID NO: 7700746 - DNA, 22 bp, Homo sapiens
tgtaacagtaagcctgtgagct

SEQ ID NO: 7700747 - DNA, 22 bp, Homo sapiens
tgtaacagctctccatgtgggg

SEQ ID NO: 7700748 - DNA, 22 bp, Homo sapiens
tgtaacagtagataaggtcttg

SEQ ID NO: 7700749 - DNA, 22 bp, Homo sapiens
tgtaacagtagataaggtcttg

SEQ ID NO: 7700750 - DNA, 22 bp, Homo sapiens
tgtaacagtagttactattctt

SEQ ID NO: 7700751 - DNA, 22 bp, Homo sapiens
tgtaacagtagttactattctt

SEQ ID NO: 7700752 - DNA, 22 bp, Homo sapiens
tgtaacagttataacaatgtgg

SEQ ID NO: 7700753 - DNA, 22 bp, Homo sapiens
tgtaaattggaaatcaatcaag

SEQ ID NO: 7700754 - DNA, 22 bp, Homo sapiens
tgtaaattgaaggaaatttgtg

SEQ ID NO: 7700755 - DNA, 22 bp, Homo sapiens
tgtaaattggaaatcaatcaag

SEQ ID NO: 7700756 - DNA, 22 bp, Homo sapiens
tgtaaattgtcacctaaatgct

SEQ ID NO: 7700757 - DNA, 22 bp, Homo sapiens
tgtaaattgaaggaaatttgtg

SEQ ID NO: 7700758 - DNA, 22 bp, Homo sapiens
tgtaaattgaaggaaatttgtg

SEQ ID NO: 7700759 - DNA, 22 bp, Homo sapiens
tgtaaattgaaggaaatttgtg

SEQ ID NO: 7700760 - DNA, 22 bp, Homo sapiens
tgtaaattgaaggaaatttgtg

SEQ ID NO: 7700761 - DNA, 22 bp, Homo sapiens
tgtaaattctatacacttaaaa

SEQ ID NO: 7700762 - DNA, 23 bp, Homo sapiens
tgtaaattttgtagtcacatttt

SEQ ID NO: 7700763 - DNA, 23 bp, Homo sapiens
tgtaaattttgtagtcacatttt

SEQ ID NO: 7700764 - DNA, 22 bp, Homo sapiens
tgtaacaaaataccttggattg

SEQ ID NO: 7700765 - DNA, 22 bp, Homo sapiens
tgtaacaaaataccttggattg

SEQ ID NO: 7700766 - DNA, 23 bp, Homo sapiens
tgtaaattttgtagtcacatttt

SEQ ID NO: 7700767 - DNA, 23 bp, Homo sapiens
tgtaaattttgtagtcacatttt

SEQ ID NO: 7700768 - DNA, 22 bp, Homo sapiens
tgtaacaaaataccttggattg

SEQ ID NO: 7700769 - DNA, 21 bp, Homo sapiens
tgtaacaaaatactgcagatt

SEQ ID NO: 7700770 - DNA, 21 bp, Homo sapiens
tgtaacaaaatactgcagatt

SEQ ID NO: 7700771 - DNA, 22 bp, Homo sapiens
tgtaacaaaataccttggattg

SEQ ID NO: 7700772 - DNA, 22 bp, Homo sapiens
tgtaacaaatacccttgaagtt

SEQ ID NO: 7700773 - DNA, 21 bp, Homo sapiens
tgtaacaaaatactgcagatt

SEQ ID NO: 7700774 - DNA, 21 bp, Homo sapiens
tgtaacaaaatactgcagatt

SEQ ID NO: 7700775 - DNA, 22 bp, Homo sapiens
tgtaacaagtaatccatgggag

SEQ ID NO: 7700776 - DNA, 17 bp, Homo sapiens
tgtaacaactcctatta

SEQ ID NO: 7700777 - DNA, 17 bp, Homo sapiens
tgtaacaactcctatta

SEQ ID NO: 7700778 - DNA, 22 bp, Homo sapiens
tgtaacaacatttgatttttag

SEQ ID NO: 7700779 - DNA, 22 bp, Homo sapiens
tgtaacaaatacccttgaagtt

SEQ ID NO: 7700780 - DNA, 22 bp, Homo sapiens
tgtaacaatgaatatagtgact

SEQ ID NO: 7700781 - DNA, 22 bp, Homo sapiens
tgtaacaatgaatatagtgact

SEQ ID NO: 7700782 - DNA, 22 bp, Homo sapiens
tgtaacaagtgcttactttggg

SEQ ID NO: 7700783 - DNA, 21 bp, Homo sapiens
tgtaacaagttccctaggtga

SEQ ID NO: 7700784 - DNA, 22 bp, Homo sapiens
tgtaacaagtaatccatgggag

SEQ ID NO: 7700785 - DNA, 22 bp, Homo sapiens
tgtaacaatgaatatagtgact

SEQ ID NO: 7700786 - DNA, 22 bp, Homo sapiens
tgtaacaatgaatatagtgact

SEQ ID NO: 7700787 - DNA, 22 bp, Homo sapiens
tgtaacaatgaatatagtgact

SEQ ID NO: 7700788 - DNA, 23 bp, Homo sapiens
tgtaacaattcccagcctttgcc

SEQ ID NO: 7700789 - DNA, 22 bp, Homo sapiens
tgtaacaatgaatatagtgact

SEQ ID NO: 7700790 - DNA, 23 bp, Homo sapiens
tgtaacaattcccagcctttgcc

SEQ ID NO: 7700791 - DNA, 20 bp, Homo sapiens
tgtacacagtactttacaat

SEQ ID NO: 7700792 - DNA, 20 bp, Homo sapiens
tgtacacagtactttacaat

SEQ ID NO: 7700793 - DNA, 22 bp, Homo sapiens
tgtacacacacgtgtgtatcta

SEQ ID NO: 7700794 - DNA, 22 bp, Homo sapiens
tgtacacacacgtgtgtatcta

SEQ ID NO: 7700795 - DNA, 22 bp, Homo sapiens
tgtacacagtatgaggcatctt

SEQ ID NO: 7700796 - DNA, 20 bp, Homo sapiens
tgtacacagtactttacaat

SEQ ID NO: 7700797 - DNA, 20 bp, Homo sapiens
tgtacacagtactttacaat

SEQ ID NO: 7700798 - DNA, 22 bp, Homo sapiens
tgtacacagtatgaggcatctt

SEQ ID NO: 7700799 - DNA, 22 bp, Homo sapiens
tgtacacaattcttaacataca

SEQ ID NO: 7700800 - DNA, 22 bp, Homo sapiens
tgtacacaattcttaacataca

SEQ ID NO: 7700801 - DNA, 22 bp, Homo sapiens
tgtacacaattcttaacataca

SEQ ID NO: 7700802 - DNA, 22 bp, Homo sapiens
tgtacacaattcttaacataca

SEQ ID NO: 7700803 - DNA, 22 bp, Homo sapiens
tgtacacaattcttaacataca

SEQ ID NO: 7700804 - DNA, 22 bp, Homo sapiens
tgtacacaattcttaacataca

SEQ ID NO: 7700805 - DNA, 22 bp, Homo sapiens
tgtacacaattcttaacataca

SEQ ID NO: 7700806 - DNA, 22 bp, Homo sapiens
tgtacacaatgtgcaggtttgt

SEQ ID NO: 7700807 - DNA, 22 bp, Homo sapiens
tgtacacaatgtgcaggtttgt

SEQ ID NO: 7700808 - DNA, 22 bp, Homo sapiens
tgtacacaatgataaattatta

SEQ ID NO: 7700809 - DNA, 22 bp, Homo sapiens
tgtacacaacgtgcaggtttgt

SEQ ID NO: 7700810 - DNA, 22 bp, Homo sapiens
tgtacacaatgataaattatta

SEQ ID NO: 7700811 - DNA, 22 bp, Homo sapiens
tgtacacaacgtgcaggtttgt

SEQ ID NO: 7700812 - DNA, 22 bp, Homo sapiens
tgtacacaatgataaattatta

SEQ ID NO: 7700813 - DNA, 22 bp, Homo sapiens
tgtacacaatgataaattatta

SEQ ID NO: 7700814 - DNA, 22 bp, Homo sapiens
tgtacacaacctacagtctgct

SEQ ID NO: 7700815 - DNA, 22 bp, Homo sapiens
tgtacaatgtggccagtgttaa

SEQ ID NO: 7700816 - DNA, 22 bp, Homo sapiens
tgtacaatgtggccagtgttaa

SEQ ID NO: 7700817 - DNA, 22 bp, Homo sapiens
tgtacaatggctataataccct

SEQ ID NO: 7700818 - DNA, 22 bp, Homo sapiens
tgtacaatggctataataccct

SEQ ID NO: 7700819 - DNA, 22 bp, Homo sapiens
tgtacaatgccgagactaactc

SEQ ID NO: 7700820 - DNA, 22 bp, Homo sapiens
tgtacaagaataattttatata

SEQ ID NO: 7700821 - DNA, 22 bp, Homo sapiens
tgtacaagaataattttatata

SEQ ID NO: 7700822 - DNA, 22 bp, Homo sapiens
tgtacaaattcattgaactgta

SEQ ID NO: 7700823 - DNA, 19 bp, Homo sapiens
tgtacaaggattatgcagg

SEQ ID NO: 7700824 - DNA, 19 bp, Homo sapiens
tgtacaaggattatgcagg

SEQ ID NO: 7700825 - DNA, 19 bp, Homo sapiens
tgtacaaggattatgcagg

SEQ ID NO: 7700826 - DNA, 22 bp, Homo sapiens
tgtacaagcaaatagaccttca

SEQ ID NO: 7700827 - DNA, 22 bp, Homo sapiens
tgtacaaattcattgaactgta

SEQ ID NO: 7700828 - DNA, 22 bp, Homo sapiens
tgtacaaattcattgaactgta

SEQ ID NO: 7700829 - DNA, 22 bp, Homo sapiens
tgtacaaattcattgaactgta

SEQ ID NO: 7700830 - DNA, 22 bp, Homo sapiens
tgtacaaattcagttctagggt

SEQ ID NO: 7700831 - DNA, 22 bp, Homo sapiens
tgtacaaattcattgaactgta

SEQ ID NO: 7700832 - DNA, 22 bp, Homo sapiens
tgtacaaattcattgaactgta

SEQ ID NO: 7700833 - DNA, 22 bp, Homo sapiens
tgtacaaattcattgaactgta

SEQ ID NO: 7700834 - DNA, 22 bp, Homo sapiens
tgtacaaattcagttctagggt

SEQ ID NO: 7700835 - DNA, 22 bp, Homo sapiens
tgtacaaattcagttctagggt

SEQ ID NO: 7700836 - DNA, 22 bp, Homo sapiens
tgtacaaattcagttctagggt

SEQ ID NO: 7700837 - DNA, 22 bp, Homo sapiens
tgtacaaattcagttctagggt

SEQ ID NO: 7700838 - DNA, 22 bp, Homo sapiens
tgtacaaggcagaaggggcgag

SEQ ID NO: 7700839 - DNA, 22 bp, Homo sapiens
tgtacaagtgaaagatgtgggc

SEQ ID NO: 7700840 - DNA, 22 bp, Homo sapiens
tgtacaagttgcctgctatctc

SEQ ID NO: 7700841 - DNA, 22 bp, Homo sapiens
tgtacaatagctattatctcca

SEQ ID NO: 7700842 - DNA, 22 bp, Homo sapiens
tgtacaatagctattatctcca

SEQ ID NO: 7700843 - DNA, 22 bp, Homo sapiens
tgtacaatctgatgatgtatgg

SEQ ID NO: 7700844 - DNA, 22 bp, Homo sapiens
tgtacaatctgatgatgtatgg

SEQ ID NO: 7700845 - DNA, 22 bp, Homo sapiens
tgtacaatctgatgatgtatgg

SEQ ID NO: 7700846 - DNA, 22 bp, Homo sapiens
tgtacaatctgatgatgtatgg

SEQ ID NO: 7700847 - DNA, 22 bp, Homo sapiens
tgtacaatcttggtccctttat

SEQ ID NO: 7700848 - DNA, 22 bp, Homo sapiens
tgtacaatgccagggaacacca

SEQ ID NO: 7700849 - DNA, 22 bp, Homo sapiens
tgtacaatgccagggaacacca

SEQ ID NO: 7700850 - DNA, 22 bp, Homo sapiens
tgtacagtgccatgcagtttgc

SEQ ID NO: 7700851 - DNA, 22 bp, Homo sapiens
tgtacagtctgcagcttgctgt

SEQ ID NO: 7700852 - DNA, 22 bp, Homo sapiens
tgtacagtctgcagcttgctgt

SEQ ID NO: 7700853 - DNA, 22 bp, Homo sapiens
tgtacagtcatgctttctgttc

SEQ ID NO: 7700854 - DNA, 22 bp, Homo sapiens
tgtacagtcatgctttctgttc

SEQ ID NO: 7700855 - DNA, 22 bp, Homo sapiens
tgtaccaggccctgtggacatg

SEQ ID NO: 7700856 - DNA, 22 bp, Homo sapiens
tgtaccaggccctgtggacatg

SEQ ID NO: 7700857 - DNA, 22 bp, Homo sapiens
tgtacagtgccatgcagtttgc

SEQ ID NO: 7700858 - DNA, 22 bp, Homo sapiens
tgtaccagtgttgagaatgaga

SEQ ID NO: 7700859 - DNA, 22 bp, Homo sapiens
tgtaccttaggtgccttgcttg

SEQ ID NO: 7700860 - DNA, 22 bp, Homo sapiens
tgtacctttttctgtgcatgct

SEQ ID NO: 7700861 - DNA, 22 bp, Homo sapiens
tgtaccgcaaatgctgctgcct

SEQ ID NO: 7700862 - DNA, 22 bp, Homo sapiens
tgtaccatgcgacgcctctcac

SEQ ID NO: 7700863 - DNA, 22 bp, Homo sapiens
tgtaccaggtgatggagtcata

SEQ ID NO: 7700864 - DNA, 22 bp, Homo sapiens
tgtacaggagaacaatgagaaa

SEQ ID NO: 7700865 - DNA, 22 bp, Homo sapiens
tgtacagctgccttttttactt

SEQ ID NO: 7700866 - DNA, 22 bp, Homo sapiens
tgtacagctgccttttttactt

SEQ ID NO: 7700867 - DNA, 22 bp, Homo sapiens
tgtacagctgccttttttactt

SEQ ID NO: 7700868 - DNA, 22 bp, Homo sapiens
tgtacagctgccttttttactt

SEQ ID NO: 7700869 - DNA, 22 bp, Homo sapiens
tgtacaggagaacaatgagaaa

SEQ ID NO: 7700870 - DNA, 22 bp, Homo sapiens
tgtacaggaggccacattggaa

SEQ ID NO: 7700871 - DNA, 22 bp, Homo sapiens
tgtacagtacatgtgtagtgat

SEQ ID NO: 7700872 - DNA, 22 bp, Homo sapiens
tgtacagggtgcagcgagcgga

SEQ ID NO: 7700873 - DNA, 22 bp, Homo sapiens
tgtacagtatatttcaaagcca

SEQ ID NO: 7700874 - DNA, 22 bp, Homo sapiens
tgtacagtatatttcaaagcca

SEQ ID NO: 7700875 - DNA, 22 bp, Homo sapiens
tgtacagtaggaacttgttatt

SEQ ID NO: 7700876 - DNA, 22 bp, Homo sapiens
tgtacagtaggaacttgttatt

SEQ ID NO: 7700877 - DNA, 22 bp, Homo sapiens
tgtacagatatcaggagtgagg

SEQ ID NO: 7700878 - DNA, 22 bp, Homo sapiens
tgtacagataaagactgtaaat

SEQ ID NO: 7700879 - DNA, 22 bp, Homo sapiens
tgtacagataaagactgtaaat

SEQ ID NO: 7700880 - DNA, 22 bp, Homo sapiens
tgtacagataaagactgtaaat

SEQ ID NO: 7700881 - DNA, 22 bp, Homo sapiens
tgtacagattgatcatggagag

SEQ ID NO: 7700882 - DNA, 22 bp, Homo sapiens
tgtacagatatcaggagtgagg

SEQ ID NO: 7700883 - DNA, 22 bp, Homo sapiens
tgtacagattgatcatggagag

SEQ ID NO: 7700884 - DNA, 22 bp, Homo sapiens
tgtacagattgatcatggagag

SEQ ID NO: 7700885 - DNA, 22 bp, Homo sapiens
tgtacagattgatcatggagag

SEQ ID NO: 7700886 - DNA, 22 bp, Homo sapiens
tgtacacgtggccatctttaca

SEQ ID NO: 7700887 - DNA, 22 bp, Homo sapiens
tgtacacctgtctttacacata

SEQ ID NO: 7700888 - DNA, 22 bp, Homo sapiens
tgtacacctgtctttacacata

SEQ ID NO: 7700889 - DNA, 22 bp, Homo sapiens
tgtacacctgtctttacacata

SEQ ID NO: 7700890 - DNA, 22 bp, Homo sapiens
tgtacacatttttatgttaaca

SEQ ID NO: 7700891 - DNA, 22 bp, Homo sapiens
tgtacacatttttatgttaaca

SEQ ID NO: 7700892 - DNA, 22 bp, Homo sapiens
tgtacacatttattctctctca

SEQ ID NO: 7700893 - DNA, 22 bp, Homo sapiens
tgtacacattaagctctttaga

SEQ ID NO: 7700894 - DNA, 22 bp, Homo sapiens
tgtacacattaagctctttaga

SEQ ID NO: 7700895 - DNA, 22 bp, Homo sapiens
tgtacacattaagctctttaga

SEQ ID NO: 7700896 - DNA, 22 bp, Homo sapiens
tgtacacatgcccacttgaagc

SEQ ID NO: 7700897 - DNA, 22 bp, Homo sapiens
tgtacacataccactgagtgaa

SEQ ID NO: 7700898 - DNA, 22 bp, Homo sapiens
tgtacacatgcccacttgaagc

SEQ ID NO: 7700899 - DNA, 22 bp, Homo sapiens
tgtacacatggtgtacactccc

SEQ ID NO: 7700900 - DNA, 22 bp, Homo sapiens
tgtacacatggtgtacactccc

SEQ ID NO: 7700901 - DNA, 22 bp, Homo sapiens
tgtacacatggtgtacactccc

SEQ ID NO: 7700902 - DNA, 22 bp, Homo sapiens
tgtacacatggtgtacactccc

SEQ ID NO: 7700903 - DNA, 22 bp, Homo sapiens
tgtacacatggtgtacactccc

SEQ ID NO: 7700904 - DNA, 22 bp, Homo sapiens
tgtacagaggtgtacatatgat

SEQ ID NO: 7700905 - DNA, 22 bp, Homo sapiens
tgtacagaggtgtacatatgat

SEQ ID NO: 7700906 - DNA, 22 bp, Homo sapiens
tgtacagaggtgtacatatgat

SEQ ID NO: 7700907 - DNA, 22 bp, Homo sapiens
tgtacagaggtgtacatatgat

SEQ ID NO: 7700908 - DNA, 22 bp, Homo sapiens
tgtacagaggtgtacatatgat

SEQ ID NO: 7700909 - DNA, 22 bp, Homo sapiens
tgtacagagactaccattaata

SEQ ID NO: 7700910 - DNA, 22 bp, Homo sapiens
tgtacagagactaccattaata

SEQ ID NO: 7700911 - DNA, 22 bp, Homo sapiens
tgtacagactttgcagtgtgca

SEQ ID NO: 7700912 - DNA, 22 bp, Homo sapiens
tgtacagaaggcactaaggtca

SEQ ID NO: 7700913 - DNA, 22 bp, Homo sapiens
tgtacagactttgcagtgtgca

SEQ ID NO: 7700914 - DNA, 22 bp, Homo sapiens
tgtacagactgtatttacaagt

SEQ ID NO: 7700915 - DNA, 22 bp, Homo sapiens
tgtacagactgtatttacaagt

SEQ ID NO: 7700916 - DNA, 22 bp, Homo sapiens
tgtacagactgtatttacaagt

SEQ ID NO: 7700917 - DNA, 22 bp, Homo sapiens
tgtacagactgtatttacaagt

SEQ ID NO: 7700918 - DNA, 22 bp, Homo sapiens
tgtacagactgtatttacaagt

SEQ ID NO: 7700919 - DNA, 22 bp, Homo sapiens
tgtacagaaattcctactacat

SEQ ID NO: 7700920 - DNA, 23 bp, Homo sapiens
tgtacacttggtcaaggtactta

SEQ ID NO: 7700921 - DNA, 22 bp, Homo sapiens
tgtacactgcaggatgcattgc

SEQ ID NO: 7700922 - DNA, 22 bp, Homo sapiens
tgtacacgcttatggagtgaac

SEQ ID NO: 7700923 - DNA, 22 bp, Homo sapiens
tgtacactgcaggatgcattgc

SEQ ID NO: 7700924 - DNA, 22 bp, Homo sapiens
tgtacagaaggcactaaggtca

SEQ ID NO: 7700925 - DNA, 22 bp, Homo sapiens
tgtacagaaattcctactacat

SEQ ID NO: 7700926 - DNA, 22 bp, Homo sapiens
tgtacagaacttgctgtccctt

SEQ ID NO: 7700927 - DNA, 22 bp, Homo sapiens
tgtacagaaattcctactacat

SEQ ID NO: 7700928 - DNA, 19 bp, Homo sapiens
tggttgtgcacgggttggt

SEQ ID NO: 7700929 - DNA, 19 bp, Homo sapiens
tggttgtgcacgggttggt

SEQ ID NO: 7700930 - DNA, 22 bp, Homo sapiens
tggttgtggtcctccacatcgc

SEQ ID NO: 7700931 - DNA, 22 bp, Homo sapiens
tggttgtggtcctccacatcgc

SEQ ID NO: 7700932 - DNA, 22 bp, Homo sapiens
tggttgtgagcgatggatggag

SEQ ID NO: 7700933 - DNA, 22 bp, Homo sapiens
tggttgtgagcgatggatggag

SEQ ID NO: 7700934 - DNA, 22 bp, Homo sapiens
tggttgtataatgtcactaagc

SEQ ID NO: 7700935 - DNA, 22 bp, Homo sapiens
tggttgcctctcagagattccg

SEQ ID NO: 7700936 - DNA, 22 bp, Homo sapiens
tggttgcctctcagagattccg

SEQ ID NO: 7700937 - DNA, 22 bp, Homo sapiens
tggttgcctctcagagattccg

SEQ ID NO: 7700938 - DNA, 23 bp, Homo sapiens
tggttgcagtgccaagtatcacg

SEQ ID NO: 7700939 - DNA, 17 bp, Homo sapiens
tggttcttttcattccc

SEQ ID NO: 7700940 - DNA, 23 bp, Homo sapiens
tggttcttatgattttactacca

SEQ ID NO: 7700941 - DNA, 17 bp, Homo sapiens
tggttcttttcattccc

SEQ ID NO: 7700942 - DNA, 22 bp, Homo sapiens
tggttaagtccagaaaggaagc

SEQ ID NO: 7700943 - DNA, 22 bp, Homo sapiens
tggttaagtccagaaaggaagc

SEQ ID NO: 7700944 - DNA, 22 bp, Homo sapiens
tggttaagtccagaaaggaagc

SEQ ID NO: 7700945 - DNA, 22 bp, Homo sapiens
tggttaagtccagaaaggaagc

SEQ ID NO: 7700946 - DNA, 22 bp, Homo sapiens
tggttaaatgggaagagcaaca

SEQ ID NO: 7700947 - DNA, 22 bp, Homo sapiens
tggttcctcaagcgctggcggc

SEQ ID NO: 7700948 - DNA, 22 bp, Homo sapiens
tggttcctcagggcagctgtac

SEQ ID NO: 7700949 - DNA, 22 bp, Homo sapiens
tggttacacaagtgtgtgcagt

SEQ ID NO: 7700950 - DNA, 22 bp, Homo sapiens
tggttaagtccagaaaggaagc

SEQ ID NO: 7700951 - DNA, 18 bp, Homo sapiens
tggttccttgaaggggca

SEQ ID NO: 7700952 - DNA, 22 bp, Homo sapiens
tggttccttctgcattttcagc

SEQ ID NO: 7700953 - DNA, 22 bp, Homo sapiens
tggttcctggttcacttggcag

SEQ ID NO: 7700954 - DNA, 22 bp, Homo sapiens
tggtttcagtgccaatacagta

SEQ ID NO: 7700955 - DNA, 22 bp, Homo sapiens
tggtttcagtgccaatacagta

SEQ ID NO: 7700956 - DNA, 22 bp, Homo sapiens
tggtttcatgagatgagaattt

SEQ ID NO: 7700957 - DNA, 22 bp, Homo sapiens
tggtttcccattatctgcagga

SEQ ID NO: 7700958 - DNA, 22 bp, Homo sapiens
tggtttatttctctgaaaggtt

SEQ ID NO: 7700959 - DNA, 22 bp, Homo sapiens
tggtttctcagactctttgcag

SEQ ID NO: 7700960 - DNA, 22 bp, Homo sapiens
tggtttctcagactctttgcag

SEQ ID NO: 7700961 - DNA, 22 bp, Homo sapiens
tggtttctcagactctttgcag

SEQ ID NO: 7700962 - DNA, 22 bp, Homo sapiens
tggtttctctgaactctacgac

SEQ ID NO: 7700963 - DNA, 22 bp, Homo sapiens
tggtttctctgaactctacgac

SEQ ID NO: 7700964 - DNA, 22 bp, Homo sapiens
tggtttctgccctcagagctca

SEQ ID NO: 7700965 - DNA, 22 bp, Homo sapiens
tggtttctgggtttgtctagga

SEQ ID NO: 7700966 - DNA, 22 bp, Homo sapiens
tggtttctgtctgagttcctcc

SEQ ID NO: 7700967 - DNA, 22 bp, Homo sapiens
tggtttctttccactctccacc

SEQ ID NO: 7700968 - DNA, 22 bp, Homo sapiens
tggtttctgggtttgtctagga

SEQ ID NO: 7700969 - DNA, 18 bp, Homo sapiens
tggtttctggaggaataa

SEQ ID NO: 7700970 - DNA, 18 bp, Homo sapiens
tggtttctggaggaataa

SEQ ID NO: 7700971 - DNA, 22 bp, Homo sapiens
tggtttctgggtttgtctagga

SEQ ID NO: 7700972 - DNA, 22 bp, Homo sapiens
tggttgtgtcacttagattaga

SEQ ID NO: 7700973 - DNA, 22 bp, Homo sapiens
tggtttaacctgtctcttatta

SEQ ID NO: 7700974 - DNA, 22 bp, Homo sapiens
tggtttaatttccatttccttg

SEQ ID NO: 7700975 - DNA, 22 bp, Homo sapiens
tggtttaatttccatttccttg

SEQ ID NO: 7700976 - DNA, 22 bp, Homo sapiens
tggtttataacatgtctcatga

SEQ ID NO: 7700977 - DNA, 22 bp, Homo sapiens
tggtttactctgtaaaccagga

SEQ ID NO: 7700978 - DNA, 21 bp, Homo sapiens
tggtttatttcactcagcata

SEQ ID NO: 7700979 - DNA, 22 bp, Homo sapiens
tggtttcacactgcatggtgta

SEQ ID NO: 7700980 - DNA, 22 bp, Homo sapiens
tggtttatttctctgaaaggtt

SEQ ID NO: 7700981 - DNA, 23 bp, Homo sapiens
tggtttatgatatgtatgggaat

SEQ ID NO: 7700982 - DNA, 22 bp, Homo sapiens
tggtttatgctgttgcagctct

SEQ ID NO: 7700983 - DNA, 20 bp, Homo sapiens
tggtgttagaccagagagtg

SEQ ID NO: 7700984 - DNA, 20 bp, Homo sapiens
tggtgttatcctgaagaatt

SEQ ID NO: 7700985 - DNA, 22 bp, Homo sapiens
tggtgttgaacctcagcagggg

SEQ ID NO: 7700986 - DNA, 22 bp, Homo sapiens
tggtgttgaacctcagcagggg

SEQ ID NO: 7700987 - DNA, 22 bp, Homo sapiens
tggtgtgttagagctcagggca

SEQ ID NO: 7700988 - DNA, 22 bp, Homo sapiens
tggtgtgttagagctcagggca

SEQ ID NO: 7700989 - DNA, 22 bp, Homo sapiens
tggtgtgttagagctcagggca

SEQ ID NO: 7700990 - DNA, 22 bp, Homo sapiens
tggtgtgtacatttttgcttct

SEQ ID NO: 7700991 - DNA, 22 bp, Homo sapiens
tggtgtgtgagtcaagacaagt

SEQ ID NO: 7700992 - DNA, 22 bp, Homo sapiens
tggtgtggtccagtgacatact

SEQ ID NO: 7700993 - DNA, 22 bp, Homo sapiens
tggtgtggtccagtgacatact

SEQ ID NO: 7700994 - DNA, 22 bp, Homo sapiens
tggtgtttaatgggctgtttat

SEQ ID NO: 7700995 - DNA, 21 bp, Homo sapiens
tggttaaagttgtgtcatccc

SEQ ID NO: 7700996 - DNA, 22 bp, Homo sapiens
tggttaaaatgcagattcagta

SEQ ID NO: 7700997 - DNA, 22 bp, Homo sapiens
tggttaaaatgcagattcagta

SEQ ID NO: 7700998 - DNA, 22 bp, Homo sapiens
tggtgttttagcattaaagacc

SEQ ID NO: 7700999 - DNA, 22 bp, Homo sapiens
tggtgtcttggaagtaggtgct

SEQ ID NO: 7701000 - DNA, 22 bp, Homo sapiens
tggtgtctggcacacaggaagc

SEQ ID NO: 7701001 - DNA, 22 bp, Homo sapiens
tggtgtctcttagtacatagat

SEQ ID NO: 7701002 - DNA, 22 bp, Homo sapiens
tggtgtctcttagtacatagat

SEQ ID NO: 7701003 - DNA, 22 bp, Homo sapiens
tggtgtctgcactccctggcgt

SEQ ID NO: 7701004 - DNA, 22 bp, Homo sapiens
tggtgtcttggaagtaggtgct

SEQ ID NO: 7701005 - DNA, 22 bp, Homo sapiens
tggtgtgaggcgggagtgtagt

SEQ ID NO: 7701006 - DNA, 22 bp, Homo sapiens
tggtgtgggcgtggcaggcaag

SEQ ID NO: 7701007 - DNA, 22 bp, Homo sapiens
tggtgtgggcgtggcaggcaag

SEQ ID NO: 7701008 - DNA, 22 bp, Homo sapiens
tggtgtgggcagcagcaggtac

SEQ ID NO: 7701009 - DNA, 22 bp, Homo sapiens
tggtgtgggcagcagcaggtac

SEQ ID NO: 7701010 - DNA, 22 bp, Homo sapiens
tggtgtgggcgtggcaggcaag

SEQ ID NO: 7701011 - DNA, 22 bp, Homo sapiens
tggtgtggggataagcactctg

SEQ ID NO: 7701012 - DNA, 22 bp, Homo sapiens
tggtgtggggataagcactctg

SEQ ID NO: 7701013 - DNA, 22 bp, Homo sapiens
tggtgtggggataagcactctg

SEQ ID NO: 7701014 - DNA, 22 bp, Homo sapiens
tggtgtggggataagcactctg

SEQ ID NO: 7701015 - DNA, 22 bp, Homo sapiens
tggtgggtcggctgggagagct

SEQ ID NO: 7701016 - DNA, 23 bp, Homo sapiens
tggtggtcagccctttctggagg

SEQ ID NO: 7701017 - DNA, 22 bp, Homo sapiens
tggtgggtcggctgggagagct

SEQ ID NO: 7701018 - DNA, 22 bp, Homo sapiens
tggtggtcaaagccagtgttct

SEQ ID NO: 7701019 - DNA, 22 bp, Homo sapiens
tggtgggtcggctgggagagct

SEQ ID NO: 7701020 - DNA, 22 bp, Homo sapiens
tggtgggtcggctgggagagct

SEQ ID NO: 7701021 - DNA, 22 bp, Homo sapiens
tggtgggtcggctgggagagct

SEQ ID NO: 7701022 - DNA, 18 bp, Homo sapiens
tggtggtgacagggtcat

SEQ ID NO: 7701023 - DNA, 18 bp, Homo sapiens
tggtggtgacagggtcat

SEQ ID NO: 7701024 - DNA, 18 bp, Homo sapiens
tggtggtgacagggtcat

SEQ ID NO: 7701025 - DNA, 18 bp, Homo sapiens
tggtggtgacagggtcat

SEQ ID NO: 7701026 - DNA, 22 bp, Homo sapiens
tggtggtcatagcagaggccgt

SEQ ID NO: 7701027 - DNA, 22 bp, Homo sapiens
tggtggtccacaaatgggtaca

SEQ ID NO: 7701028 - DNA, 22 bp, Homo sapiens
tggtgtaatcagtttctagctc

SEQ ID NO: 7701029 - DNA, 22 bp, Homo sapiens
tggtgtcactcaagcccggccg

SEQ ID NO: 7701030 - DNA, 23 bp, Homo sapiens
tggtggttgatctggggcacagc

SEQ ID NO: 7701031 - DNA, 15 bp, Homo sapiens
tggtggtgttgagac

SEQ ID NO: 7701032 - DNA, 22 bp, Homo sapiens
tggtgtctccatcctgccctgc

SEQ ID NO: 7701033 - DNA, 22 bp, Homo sapiens
tggtgtcctaagtggaaggaca

SEQ ID NO: 7701034 - DNA, 22 bp, Homo sapiens
tggtgtcatggacctggtgcct

SEQ ID NO: 7701035 - DNA, 22 bp, Homo sapiens
tggtgtcaggcactagcatgca

SEQ ID NO: 7701036 - DNA, 23 bp, Homo sapiens
tggtggggtcttggagacagcac

SEQ ID NO: 7701037 - DNA, 23 bp, Homo sapiens
tggtggggtcttggagacagcac

SEQ ID NO: 7701038 - DNA, 23 bp, Homo sapiens
tggtggggtcttggagacagcac

SEQ ID NO: 7701039 - DNA, 23 bp, Homo sapiens
tggtggggtcttggagacagcac

SEQ ID NO: 7701040 - DNA, 23 bp, Homo sapiens
tggtggggtcttggagacagcac

SEQ ID NO: 7701041 - DNA, 22 bp, Homo sapiens
tggtggggtcatcgtcagatgc

SEQ ID NO: 7701042 - DNA, 22 bp, Homo sapiens
tggtggggtcatcgtcagatgc

SEQ ID NO: 7701043 - DNA, 22 bp, Homo sapiens
tggtggggtcatcgtcagatgc

SEQ ID NO: 7701044 - DNA, 22 bp, Homo sapiens
tggtggggtcatcgtcagatgc

SEQ ID NO: 7701045 - DNA, 22 bp, Homo sapiens
tggtggggtcatcgtcagatgc

SEQ ID NO: 7701046 - DNA, 23 bp, Homo sapiens
tggtggggtcttggagacagcac

SEQ ID NO: 7701047 - DNA, 23 bp, Homo sapiens
tggtggggtcttggagacagcac

SEQ ID NO: 7701048 - DNA, 23 bp, Homo sapiens
tggtggggtcttggagacagcac

SEQ ID NO: 7701049 - DNA, 23 bp, Homo sapiens
tggtggggtcttggagacagcac

SEQ ID NO: 7701050 - DNA, 23 bp, Homo sapiens
tggtggggtcttggagacagcac

SEQ ID NO: 7701051 - DNA, 22 bp, Homo sapiens
tgtaaagatccttagcaacatc

SEQ ID NO: 7701052 - DNA, 22 bp, Homo sapiens
tgtaaagatccttagcaacatc

SEQ ID NO: 7701053 - DNA, 23 bp, Homo sapiens
tgtaaagatcaagtgactgattt

SEQ ID NO: 7701054 - DNA, 22 bp, Homo sapiens
tgtaaagagaatggtatatgga

SEQ ID NO: 7701055 - DNA, 22 bp, Homo sapiens
tgtaaagagaatggtatatgga

SEQ ID NO: 7701056 - DNA, 22 bp, Homo sapiens
tgtaaagatccttagcaacatc

SEQ ID NO: 7701057 - DNA, 22 bp, Homo sapiens
tgtaaagatccttagcaacatc

SEQ ID NO: 7701058 - DNA, 22 bp, Homo sapiens
tgtaaagattagattacatgaa

SEQ ID NO: 7701059 - DNA, 22 bp, Homo sapiens
tgtaaagcatttcctaaatcca

SEQ ID NO: 7701060 - DNA, 22 bp, Homo sapiens
tgtaaagcatctctgtcatata

SEQ ID NO: 7701061 - DNA, 22 bp, Homo sapiens
tgtaaaggtaggtgcaaaatga

SEQ ID NO: 7701062 - DNA, 22 bp, Homo sapiens
tgtaaaggtaggtgcaaaatga

SEQ ID NO: 7701063 - DNA, 22 bp, Homo sapiens
tgtaaaggtaggtgcaaaatga

SEQ ID NO: 7701064 - DNA, 22 bp, Homo sapiens
tgtaaagggtgttaaattactc

SEQ ID NO: 7701065 - DNA, 22 bp, Homo sapiens
tgtaaagggtgttaaattactc

SEQ ID NO: 7701066 - DNA, 22 bp, Homo sapiens
tgtaaagctttgagtgtttatc

SEQ ID NO: 7701067 - DNA, 22 bp, Homo sapiens
tgtaaagtccaagatcaaagag

SEQ ID NO: 7701068 - DNA, 22 bp, Homo sapiens
tgtaaagtatctgtgagctctc

SEQ ID NO: 7701069 - DNA, 22 bp, Homo sapiens
tgtaaagtattcccaaccaggg

SEQ ID NO: 7701070 - DNA, 22 bp, Homo sapiens
tgtaaagtatctgtgagctctc

SEQ ID NO: 7701071 - DNA, 18 bp, Homo sapiens
tgtaaacactttcattct

SEQ ID NO: 7701072 - DNA, 18 bp, Homo sapiens
tgtaaacactttcattct

SEQ ID NO: 7701073 - DNA, 18 bp, Homo sapiens
tgtaaacactttcattct

SEQ ID NO: 7701074 - DNA, 20 bp, Homo sapiens
tgtaaacaatagtgttcttg

SEQ ID NO: 7701075 - DNA, 20 bp, Homo sapiens
tgtaaacaatagtgttcttg

SEQ ID NO: 7701076 - DNA, 22 bp, Homo sapiens
tgtaaacaaatgcattcttgct

SEQ ID NO: 7701077 - DNA, 22 bp, Homo sapiens
tgtaaacaaatgcattcttgct

SEQ ID NO: 7701078 - DNA, 22 bp, Homo sapiens
tgtaaacaaatgcattcttgct

SEQ ID NO: 7701079 - DNA, 22 bp, Homo sapiens
tgtaaagagaaggcttataaag

SEQ ID NO: 7701080 - DNA, 22 bp, Homo sapiens
tgtaaagagaatggtatatgga

SEQ ID NO: 7701081 - DNA, 22 bp, Homo sapiens
tgtaaacagccccatggagagc

SEQ ID NO: 7701082 - DNA, 18 bp, Homo sapiens
tgtaaacactttcattct

SEQ ID NO: 7701083 - DNA, 18 bp, Homo sapiens
tgtaaacactttcattct

SEQ ID NO: 7701084 - DNA, 18 bp, Homo sapiens
tgtaaacactttcattct

SEQ ID NO: 7701085 - DNA, 22 bp, Homo sapiens
tgtaaacagccccatggagagc

SEQ ID NO: 7701086 - DNA, 18 bp, Homo sapiens
tgtaaacactttcattct

SEQ ID NO: 7701087 - DNA, 18 bp, Homo sapiens
tgtaaacactttcattct

SEQ ID NO: 7701088 - DNA, 20 bp, Homo sapiens
tgtaaataggcattgtagtt

SEQ ID NO: 7701089 - DNA, 20 bp, Homo sapiens
tgtaaataggcattgtagtt

SEQ ID NO: 7701090 - DNA, 20 bp, Homo sapiens
tgtaaataggcattgtagtt

SEQ ID NO: 7701091 - DNA, 20 bp, Homo sapiens
tgtaaataggcattgtagtt

SEQ ID NO: 7701092 - DNA, 22 bp, Homo sapiens
tgtaaataattcctaggctttt

SEQ ID NO: 7701093 - DNA, 20 bp, Homo sapiens
tgtaaataggcattgtagtt

SEQ ID NO: 7701094 - DNA, 20 bp, Homo sapiens
tgtaaataggcattgtagtt

SEQ ID NO: 7701095 - DNA, 22 bp, Homo sapiens
tgtaaatgtgaatttccttttc

SEQ ID NO: 7701096 - DNA, 22 bp, Homo sapiens
tgtaaatggtcagataaaccta

SEQ ID NO: 7701097 - DNA, 22 bp, Homo sapiens
tgtaaatgaagtatgctttact

SEQ ID NO: 7701098 - DNA, 22 bp, Homo sapiens
tgtaaatgaagtatgctttact

SEQ ID NO: 7701099 - DNA, 22 bp, Homo sapiens
tgtaaatgaagtatgctttact

SEQ ID NO: 7701100 - DNA, 22 bp, Homo sapiens
tgtaaatgaagtatgctttact

SEQ ID NO: 7701101 - DNA, 22 bp, Homo sapiens
tgtaaatgaagtatgctttact

SEQ ID NO: 7701102 - DNA, 20 bp, Homo sapiens
tgtaaataggcattgtagtt

SEQ ID NO: 7701103 - DNA, 22 bp, Homo sapiens
tgtaaatcactgaactaaatga

SEQ ID NO: 7701104 - DNA, 22 bp, Homo sapiens
tgtaaataatgcatgtaaatca

SEQ ID NO: 7701105 - DNA, 22 bp, Homo sapiens
tgtaaataatgcatgtaaatca

SEQ ID NO: 7701106 - DNA, 22 bp, Homo sapiens
tgtaaataatgcatgtaaatca

SEQ ID NO: 7701107 - DNA, 22 bp, Homo sapiens
tgtaaataatgcatgtaaatca

SEQ ID NO: 7701108 - DNA, 22 bp, Homo sapiens
tgtaaataattcctaggctttt

SEQ ID NO: 7701109 - DNA, 22 bp, Homo sapiens
tgtaaagttacttttgaaagga

SEQ ID NO: 7701110 - DNA, 22 bp, Homo sapiens
tgtaaagttttattgttccttc

SEQ ID NO: 7701111 - DNA, 22 bp, Homo sapiens
tgtaaagtgaggataagaacag

SEQ ID NO: 7701112 - DNA, 22 bp, Homo sapiens
tgtaaagttttattgttccttc

SEQ ID NO: 7701113 - DNA, 22 bp, Homo sapiens
tgtaaataatgcatgtaaatca

SEQ ID NO: 7701114 - DNA, 22 bp, Homo sapiens
tgtaaataatgcatgtaaatca

SEQ ID NO: 7701115 - DNA, 22 bp, Homo sapiens
tgtaaataatgcatgtaaatca

SEQ ID NO: 7701116 - DNA, 22 bp, Homo sapiens
tgtaaataatgcatgtaaatca

SEQ ID NO: 7701117 - DNA, 22 bp, Homo sapiens
tgtaaataatgcatgtaaatca

SEQ ID NO: 7701118 - DNA, 22 bp, Homo sapiens
tgtaaataatgcatgtaaatca

SEQ ID NO: 7701119 - DNA, 22 bp, Homo sapiens
tgtaaataatgcatgtaaatca

SEQ ID NO: 7701120 - DNA, 22 bp, Homo sapiens
tgtaaataatgcatgtaaatca

SEQ ID NO: 7701121 - DNA, 22 bp, Homo sapiens
tgtaaataatgcatgtaaatca

SEQ ID NO: 7701122 - DNA, 22 bp, Homo sapiens
tggttttaaaagatgtttgaga

SEQ ID NO: 7701123 - DNA, 22 bp, Homo sapiens
tggtttgtttgttcatgtaaaa

SEQ ID NO: 7701124 - DNA, 22 bp, Homo sapiens
tggttttaaaaacatgctgcat

SEQ ID NO: 7701125 - DNA, 22 bp, Homo sapiens
tggttttaaaaacatgctgcat

SEQ ID NO: 7701126 - DNA, 22 bp, Homo sapiens
tggtttgtatatgtttgtgaga

SEQ ID NO: 7701127 - DNA, 18 bp, Homo sapiens
tggtttgtcatgagaatt

SEQ ID NO: 7701128 - DNA, 18 bp, Homo sapiens
tggtttgtcatgagaatt

SEQ ID NO: 7701129 - DNA, 18 bp, Homo sapiens
tggtttgtcatgagaatt

SEQ ID NO: 7701130 - DNA, 22 bp, Homo sapiens
tggtttgtctaaatgagtaata

SEQ ID NO: 7701131 - DNA, 22 bp, Homo sapiens
tggtttgtctaaatgagtaata

SEQ ID NO: 7701132 - DNA, 22 bp, Homo sapiens
tggtttgtttgttcatgtaaaa

SEQ ID NO: 7701133 - DNA, 22 bp, Homo sapiens
tggtttgagagtgtgagctttt

SEQ ID NO: 7701134 - DNA, 21 bp, Homo sapiens
tggtttgcggccaaagttaaa

SEQ ID NO: 7701135 - DNA, 22 bp, Homo sapiens
tggtttgggcgctggagcaagg

SEQ ID NO: 7701136 - DNA, 22 bp, Homo sapiens
tggtttgggcgctggagcaagg

SEQ ID NO: 7701137 - DNA, 22 bp, Homo sapiens
tggtttgggtagttattattat

SEQ ID NO: 7701138 - DNA, 22 bp, Homo sapiens
tggtttgtatatgtttgtgaga

SEQ ID NO: 7701139 - DNA, 22 bp, Homo sapiens
tggtttgtatatgtttgtgaga

SEQ ID NO: 7701140 - DNA, 22 bp, Homo sapiens
tggtttctttccactctccacc

SEQ ID NO: 7701141 - DNA, 22 bp, Homo sapiens
tggtttctttccactctccacc

SEQ ID NO: 7701142 - DNA, 22 bp, Homo sapiens
tggtttgagagtgtgagctttt

SEQ ID NO: 7701143 - DNA, 22 bp, Homo sapiens
tggtttctttccactctccacc

SEQ ID NO: 7701144 - DNA, 22 bp, Homo sapiens
tggttttcaacaagggcagcga

SEQ ID NO: 7701145 - DNA, 22 bp, Homo sapiens
tggttttcaacaagggcagcga

SEQ ID NO: 7701146 - DNA, 22 bp, Homo sapiens
tggttttctggtggtggcagtg

SEQ ID NO: 7701147 - DNA, 22 bp, Homo sapiens
tggttttctggtggtggcagtg

SEQ ID NO: 7701148 - DNA, 22 bp, Homo sapiens
tggttttgcatgactcttggga

SEQ ID NO: 7701149 - DNA, 22 bp, Homo sapiens
tggttttgcatgactcttggga

SEQ ID NO: 7701150 - DNA, 20 bp, Homo sapiens
tggttttgccagaaatccct

SEQ ID NO: 7701151 - DNA, 17 bp, Homo sapiens
tggttttgtttaaaggc

SEQ ID NO: 7701152 - DNA, 22 bp, Homo sapiens
tggtttttggtgttcacagagg

SEQ ID NO: 7701153 - DNA, 22 bp, Homo sapiens
tggttttgctccagtataaata

SEQ ID NO: 7701154 - DNA, 22 bp, Homo sapiens
tggttttgctaaaatagaaaga

SEQ ID NO: 7701155 - DNA, 22 bp, Homo sapiens
tggttttaaaaacatgctgcat

SEQ ID NO: 7701156 - DNA, 17 bp, Homo sapiens
tggttttgtttaaaggc

SEQ ID NO: 7701157 - DNA, 22 bp, Homo sapiens
tggttttgccctctttatgatt

SEQ ID NO: 7701158 - DNA, 22 bp, Homo sapiens
tggttttgctccagtataaata

SEQ ID NO: 7701159 - DNA, 22 bp, Homo sapiens
tggttttgctccagtataaata

SEQ ID NO: 7701160 - DNA, 22 bp, Homo sapiens
tggttttagagtatattcaggg

SEQ ID NO: 7701161 - DNA, 22 bp, Homo sapiens
tggttttaaaagatgtttgaga

SEQ ID NO: 7701162 - DNA, 22 bp, Homo sapiens
tggttttagatgcctttactgc

SEQ ID NO: 7701163 - DNA, 22 bp, Homo sapiens
tggttttagggaatcaatctat

SEQ ID NO: 7701164 - DNA, 22 bp, Homo sapiens
tggttttagatgcctttactgc

SEQ ID NO: 7701165 - DNA, 22 bp, Homo sapiens
tggttttatttatgttgagtca

SEQ ID NO: 7701166 - DNA, 22 bp, Homo sapiens
tgtaaaaagcccagccgctgag

SEQ ID NO: 7701167 - DNA, 22 bp, Homo sapiens
tggtttttggtttaacactatg

SEQ ID NO: 7701168 - DNA, 22 bp, Homo sapiens
tggttttttgttccctactctg

SEQ ID NO: 7701169 - DNA, 22 bp, Homo sapiens
tggtttttggtgttcacagagg

SEQ ID NO: 7701170 - DNA, 22 bp, Homo sapiens
tggtttttggtttaacactatg

SEQ ID NO: 7701171 - DNA, 22 bp, Homo sapiens
tgtaaaaagcccagccgctgag

SEQ ID NO: 7701172 - DNA, 22 bp, Homo sapiens
tgtaaaaagcccagccgctgag

SEQ ID NO: 7701173 - DNA, 22 bp, Homo sapiens
tgtaaaacaaaatttgtggaga

SEQ ID NO: 7701174 - DNA, 23 bp, Homo sapiens
tgtaaaagcatttgtcagcctgg

SEQ ID NO: 7701175 - DNA, 23 bp, Homo sapiens
tgtaaaagcatttgtcagcctgg

SEQ ID NO: 7701176 - DNA, 22 bp, Homo sapiens
tgtaaaagacatttctaagcaa

SEQ ID NO: 7701177 - DNA, 22 bp, Homo sapiens
tgtaaaagacatttctaagcaa

SEQ ID NO: 7701178 - DNA, 20 bp, Homo sapiens
tgtaaaacaaggtgaatcct

SEQ ID NO: 7701179 - DNA, 20 bp, Homo sapiens
tgtaaaacaaggtgaatcct

SEQ ID NO: 7701180 - DNA, 22 bp, Homo sapiens
tgtaaaaccaaatcaatctagt

SEQ ID NO: 7701181 - DNA, 22 bp, Homo sapiens
tgtaaaaccaaatcaatctagt

SEQ ID NO: 7701182 - DNA, 22 bp, Homo sapiens
tgtaaaataccattccttgtca

SEQ ID NO: 7701183 - DNA, 22 bp, Homo sapiens
tgtaaaataccattccttgtca

SEQ ID NO: 7701184 - DNA, 22 bp, Homo sapiens
tgtaaaataccattccttgtca

SEQ ID NO: 7701185 - DNA, 22 bp, Homo sapiens
tgtaaaataccattccttgtca

SEQ ID NO: 7701186 - DNA, 23 bp, Homo sapiens
tgtaaaatggggtagtgttacca

SEQ ID NO: 7701187 - DNA, 23 bp, Homo sapiens
tgtaaaatggggtagtgttacca

SEQ ID NO: 7701188 - DNA, 23 bp, Homo sapiens
tgtaaaatggggtagtgttacca

SEQ ID NO: 7701189 - DNA, 23 bp, Homo sapiens
tgtaaaatggggtagtgttacca

SEQ ID NO: 7701190 - DNA, 23 bp, Homo sapiens
tgtaaaatggggtagtgttacca

SEQ ID NO: 7701191 - DNA, 23 bp, Homo sapiens
tgtaaaatggggtagtgttacca

SEQ ID NO: 7701192 - DNA, 22 bp, Homo sapiens
tgtaaaataattctccatgttt

SEQ ID NO: 7701193 - DNA, 22 bp, Homo sapiens
tgtaaaataattctccatgttt

SEQ ID NO: 7701194 - DNA, 22 bp, Homo sapiens
tgtaaaataattctccatgttt

SEQ ID NO: 7701195 - DNA, 22 bp, Homo sapiens
tgtaaaataattctccatgttt

SEQ ID NO: 7701196 - DNA, 22 bp, Homo sapiens
tgtaaaataattctccatgttt

SEQ ID NO: 7701197 - DNA, 22 bp, Homo sapiens
tgtaaaaggaaatcaaagcact

SEQ ID NO: 7701198 - DNA, 22 bp, Homo sapiens
tgtaaaaggaaatcaaagcact

SEQ ID NO: 7701199 - DNA, 22 bp, Homo sapiens
tgggaggcttccagaccttgct

SEQ ID NO: 7701200 - DNA, 22 bp, Homo sapiens
tgggaggccgaggcaggtggat

SEQ ID NO: 7701201 - DNA, 22 bp, Homo sapiens
tgggaggccgaggcaggtggat

SEQ ID NO: 7701202 - DNA, 22 bp, Homo sapiens
tgggaggcttccagaccttgct

SEQ ID NO: 7701203 - DNA, 22 bp, Homo sapiens
tgggaggcttccagaccttgct

SEQ ID NO: 7701204 - DNA, 22 bp, Homo sapiens
tgggaggcttccagaccttgct

SEQ ID NO: 7701205 - DNA, 22 bp, Homo sapiens
tgggaggcttccagaccttgct

SEQ ID NO: 7701206 - DNA, 22 bp, Homo sapiens
tgggaggcttccagaccttgct

SEQ ID NO: 7701207 - DNA, 22 bp, Homo sapiens
tgggaggcttccagaccttgct

SEQ ID NO: 7701208 - DNA, 22 bp, Homo sapiens
tgggaggcttccagaccttgct

SEQ ID NO: 7701209 - DNA, 22 bp, Homo sapiens
tgggaggtctcttgcggcctag

SEQ ID NO: 7701210 - DNA, 22 bp, Homo sapiens
tgggaggtctcttgcggcctag

SEQ ID NO: 7701211 - DNA, 22 bp, Homo sapiens
tgggaggtgattaaattatggg

SEQ ID NO: 7701212 - DNA, 20 bp, Homo sapiens
tgggagtacaatcatgagca

SEQ ID NO: 7701213 - DNA, 22 bp, Homo sapiens
tgggaggtctcttgcggcctag

SEQ ID NO: 7701214 - DNA, 22 bp, Homo sapiens
tgggaggtctcttgcggcctag

SEQ ID NO: 7701215 - DNA, 22 bp, Homo sapiens
tgggaggtctcttgcggcctag

SEQ ID NO: 7701216 - DNA, 22 bp, Homo sapiens
tgggagtcactgttgttgaggg

SEQ ID NO: 7701217 - DNA, 22 bp, Homo sapiens
tgggagtcactgttgttgaggg

SEQ ID NO: 7701218 - DNA, 22 bp, Homo sapiens
tgggagtcactgttgttgaggg

SEQ ID NO: 7701219 - DNA, 22 bp, Homo sapiens
tgggagtcaaccctcacgagca

SEQ ID NO: 7701220 - DNA, 22 bp, Homo sapiens
tgggagtcagacagcctgagat

SEQ ID NO: 7701221 - DNA, 22 bp, Homo sapiens
tgggagtcagacagcctgagat

SEQ ID NO: 7701222 - DNA, 22 bp, Homo sapiens
tgggagtcagtcgttctcagag

SEQ ID NO: 7701223 - DNA, 22 bp, Homo sapiens
tgggagtagatgaggagtgggc

SEQ ID NO: 7701224 - DNA, 22 bp, Homo sapiens
tgggagtagatgaggagtgggc

SEQ ID NO: 7701225 - DNA, 20 bp, Homo sapiens
tgggagtacaatcatgagca

SEQ ID NO: 7701226 - DNA, 22 bp, Homo sapiens
tgggagtactatgtgataggat

SEQ ID NO: 7701227 - DNA, 22 bp, Homo sapiens
tgggagtagatgaggagtgggc

SEQ ID NO: 7701228 - DNA, 22 bp, Homo sapiens
tgggagtactatgtgataggat

SEQ ID NO: 7701229 - DNA, 22 bp, Homo sapiens
tgggagtcaaccctcacgagca

SEQ ID NO: 7701230 - DNA, 22 bp, Homo sapiens
tgggagtcatcgtgtttggatc

SEQ ID NO: 7701231 - DNA, 22 bp, Homo sapiens
tgggagtccaaggcaggcggat

SEQ ID NO: 7701232 - DNA, 22 bp, Homo sapiens
tgggagtcagtcgttctcagag

SEQ ID NO: 7701233 - DNA, 22 bp, Homo sapiens
tgggagtccaaggcaggcggat

SEQ ID NO: 7701234 - DNA, 22 bp, Homo sapiens
tgggagtcatcgtgtttggatc

SEQ ID NO: 7701235 - DNA, 22 bp, Homo sapiens
tgggagtccaaggtttttatag

SEQ ID NO: 7701236 - DNA, 22 bp, Homo sapiens
tgggagtccattgtcccaggca

SEQ ID NO: 7701237 - DNA, 22 bp, Homo sapiens
tgggagtgatacagtatggaat

SEQ ID NO: 7701238 - DNA, 22 bp, Homo sapiens
tgggagtctgaggcgggtcgat

SEQ ID NO: 7701239 - DNA, 22 bp, Homo sapiens
tgggagtccattgtcccaggca

SEQ ID NO: 7701240 - DNA, 22 bp, Homo sapiens
tgggagtgaggcagagtctatc

SEQ ID NO: 7701241 - DNA, 22 bp, Homo sapiens
tgggagtgaggcagagtctatc

SEQ ID NO: 7701242 - DNA, 22 bp, Homo sapiens
tgggaggccgaggcaggtggat

SEQ ID NO: 7701243 - DNA, 22 bp, Homo sapiens
tgggaggccgaggcaggtggat

SEQ ID NO: 7701244 - DNA, 22 bp, Homo sapiens
tgggaggccgaggcaggtggat

SEQ ID NO: 7701245 - DNA, 22 bp, Homo sapiens
tgggaggccgaggcaggtggat

SEQ ID NO: 7701246 - DNA, 22 bp, Homo sapiens
tgggaggccgaggcaggtggat

SEQ ID NO: 7701247 - DNA, 22 bp, Homo sapiens
tgggaggccgaggcaggtggat

SEQ ID NO: 7701248 - DNA, 22 bp, Homo sapiens
tgggaggccgaggcaggtggat

SEQ ID NO: 7701249 - DNA, 22 bp, Homo sapiens
tgggaggccgaggcaggtggat

SEQ ID NO: 7701250 - DNA, 22 bp, Homo sapiens
tgggaggccgaggcaggtggat

SEQ ID NO: 7701251 - DNA, 22 bp, Homo sapiens
tgggaggccgaggcaggtggat

SEQ ID NO: 7701252 - DNA, 22 bp, Homo sapiens
tgggaggccgaggcaggtggat

SEQ ID NO: 7701253 - DNA, 22 bp, Homo sapiens
tgggaggccgaggcaggtggat

SEQ ID NO: 7701254 - DNA, 22 bp, Homo sapiens
tgggaggcccaggcctggcagg

SEQ ID NO: 7701255 - DNA, 22 bp, Homo sapiens
tgggaggcccaggcctggcagg

SEQ ID NO: 7701256 - DNA, 22 bp, Homo sapiens
tgggaggcccaggcctggcagg

SEQ ID NO: 7701257 - DNA, 22 bp, Homo sapiens
tgggaggcccaggcctggcagg

SEQ ID NO: 7701258 - DNA, 22 bp, Homo sapiens
tgggaggcccaggcctggcagg

SEQ ID NO: 7701259 - DNA, 22 bp, Homo sapiens
tgggaggcccaggcctggcagg

SEQ ID NO: 7701260 - DNA, 22 bp, Homo sapiens
tgggaggccaaggcaggcggat

SEQ ID NO: 7701261 - DNA, 22 bp, Homo sapiens
tgggaggccaaggcaggcggat

SEQ ID NO: 7701262 - DNA, 22 bp, Homo sapiens
tgggaggccaaggcaggcggat

SEQ ID NO: 7701263 - DNA, 22 bp, Homo sapiens
tgggaggccaaggcaggcggat

SEQ ID NO: 7701264 - DNA, 22 bp, Homo sapiens
tgggaggccaaggcaggcggat

SEQ ID NO: 7701265 - DNA, 22 bp, Homo sapiens
tgggaggccaaggcaggcggat

SEQ ID NO: 7701266 - DNA, 22 bp, Homo sapiens
tgggaggccaaggcaggcggat

SEQ ID NO: 7701267 - DNA, 22 bp, Homo sapiens
tgggaggccaaggcaggcggat

SEQ ID NO: 7701268 - DNA, 22 bp, Homo sapiens
tgggaggccaaggcaggcggat

SEQ ID NO: 7701269 - DNA, 22 bp, Homo sapiens
tgggaggccaaggcaggcggat

SEQ ID NO: 7701270 - DNA, 22 bp, Homo sapiens
tgggaggccaaggcaggcggat

SEQ ID NO: 7701271 - DNA, 22 bp, Homo sapiens
tgggaggccaaggcaggcggat

SEQ ID NO: 7701272 - DNA, 22 bp, Homo sapiens
tgggaggcaggtaggtgatgat

SEQ ID NO: 7701273 - DNA, 22 bp, Homo sapiens
tgggaggcaggtaggtgatgat

SEQ ID NO: 7701274 - DNA, 22 bp, Homo sapiens
tgggaggccaaggcaggcggat

SEQ ID NO: 7701275 - DNA, 22 bp, Homo sapiens
tgggaggcaggtaggtgatgat

SEQ ID NO: 7701276 - DNA, 22 bp, Homo sapiens
tgggaggcaggtaggtgatgat

SEQ ID NO: 7701277 - DNA, 22 bp, Homo sapiens
tgggaggcaggtaggtgatgat

SEQ ID NO: 7701278 - DNA, 22 bp, Homo sapiens
tgggaggcaggtaggtgatgat

SEQ ID NO: 7701279 - DNA, 22 bp, Homo sapiens
tgggaggcaggtaggtgatgat

SEQ ID NO: 7701280 - DNA, 22 bp, Homo sapiens
tgggaggcaggtaggtgatgat

SEQ ID NO: 7701281 - DNA, 22 bp, Homo sapiens
tgggaggcaggtaggtgatgat

SEQ ID NO: 7701282 - DNA, 22 bp, Homo sapiens
tgggatgagttgttaggactga

SEQ ID NO: 7701283 - DNA, 19 bp, Homo sapiens
tgggatgatgcagaaggta

SEQ ID NO: 7701284 - DNA, 19 bp, Homo sapiens
tgggatgatgcagaaggta

SEQ ID NO: 7701285 - DNA, 22 bp, Homo sapiens
tgggatgagttgttaggactga

SEQ ID NO: 7701286 - DNA, 22 bp, Homo sapiens
tgggatgataggtaagtaatta

SEQ ID NO: 7701287 - DNA, 22 bp, Homo sapiens
tgggatgagggtgagccacatg

SEQ ID NO: 7701288 - DNA, 22 bp, Homo sapiens
tgggatgagttgttaggactga

SEQ ID NO: 7701289 - DNA, 22 bp, Homo sapiens
tgggatgagggtgagccacatg

SEQ ID NO: 7701290 - DNA, 22 bp, Homo sapiens
tgggatgagggtgagccacatg

SEQ ID NO: 7701291 - DNA, 22 bp, Homo sapiens
tgggatgccctgaccctctgga

SEQ ID NO: 7701292 - DNA, 22 bp, Homo sapiens
tgggatgctcagggcctggagc

SEQ ID NO: 7701293 - DNA, 22 bp, Homo sapiens
tgggatgccggcaggaggcaat

SEQ ID NO: 7701294 - DNA, 22 bp, Homo sapiens
tgggatgccggcaggaggcaat

SEQ ID NO: 7701295 - DNA, 18 bp, Homo sapiens
tgggatggagagtaactg

SEQ ID NO: 7701296 - DNA, 18 bp, Homo sapiens
tgggatggagagtaactg

SEQ ID NO: 7701297 - DNA, 22 bp, Homo sapiens
tgggatggagcctgagtatagt

SEQ ID NO: 7701298 - DNA, 18 bp, Homo sapiens
tgggatggagagtaactg

SEQ ID NO: 7701299 - DNA, 23 bp, Homo sapiens
tgggatggattcaccagtgtgct

SEQ ID NO: 7701300 - DNA, 22 bp, Homo sapiens
tgggatggcatcctgggccttg

SEQ ID NO: 7701301 - DNA, 23 bp, Homo sapiens
tgggatggattcaccagtgtgct

SEQ ID NO: 7701302 - DNA, 22 bp, Homo sapiens
tgggatggcatcctgggccttg

SEQ ID NO: 7701303 - DNA, 22 bp, Homo sapiens
tgggatggcatcctgggccttg

SEQ ID NO: 7701304 - DNA, 23 bp, Homo sapiens
tgggatggattcaccagtgtgct

SEQ ID NO: 7701305 - DNA, 22 bp, Homo sapiens
tgggatggcatcctgggccttg

SEQ ID NO: 7701306 - DNA, 22 bp, Homo sapiens
tgggatggcatcctgggccttg

SEQ ID NO: 7701307 - DNA, 23 bp, Homo sapiens
tgggatggattcaccagtgtgct

SEQ ID NO: 7701308 - DNA, 22 bp, Homo sapiens
tgggatggagcctgagtatagt

SEQ ID NO: 7701309 - DNA, 23 bp, Homo sapiens
tgggatggattcaccagtgtgct

SEQ ID NO: 7701310 - DNA, 18 bp, Homo sapiens
tgggatggagagtaactg

SEQ ID NO: 7701311 - DNA, 22 bp, Homo sapiens
tgggatggagcctgagtatagt

SEQ ID NO: 7701312 - DNA, 22 bp, Homo sapiens
tgggatggagcctgagtatagt

SEQ ID NO: 7701313 - DNA, 23 bp, Homo sapiens
tgggatggattcaccagtgtgct

SEQ ID NO: 7701314 - DNA, 23 bp, Homo sapiens
tgggatggattcaccagtgtgct

SEQ ID NO: 7701315 - DNA, 23 bp, Homo sapiens
tgggatggattcaccagtgtgct

SEQ ID NO: 7701316 - DNA, 23 bp, Homo sapiens
tgggatggattcaccagtgtgct

SEQ ID NO: 7701317 - DNA, 23 bp, Homo sapiens
tgggatggattcaccagtgtgct

SEQ ID NO: 7701318 - DNA, 22 bp, Homo sapiens
tgggatgaggcctctgttgtga

SEQ ID NO: 7701319 - DNA, 22 bp, Homo sapiens
tgggatgagctatatagaaagt

SEQ ID NO: 7701320 - DNA, 22 bp, Homo sapiens
tgggatgagaagtgcgagggtt

SEQ ID NO: 7701321 - DNA, 22 bp, Homo sapiens
tgggatgagctatatagaaagt

SEQ ID NO: 7701322 - DNA, 22 bp, Homo sapiens
tgggatgaatacaatgggatca

SEQ ID NO: 7701323 - DNA, 20 bp, Homo sapiens
tgggatcgaatcaagtctgt

SEQ ID NO: 7701324 - DNA, 22 bp, Homo sapiens
tgggatgagaagtgcgagggtt

SEQ ID NO: 7701325 - DNA, 22 bp, Homo sapiens
tgggatgaatacaatgggatca

SEQ ID NO: 7701326 - DNA, 22 bp, Homo sapiens
tgggatatctgtcagcagcttc

SEQ ID NO: 7701327 - DNA, 22 bp, Homo sapiens
tgggatattttgagctttcctc

SEQ ID NO: 7701328 - DNA, 17 bp, Homo sapiens
tgggatccgtctctgtg

SEQ ID NO: 7701329 - DNA, 22 bp, Homo sapiens
tgggatatacctatcctagaag

SEQ ID NO: 7701330 - DNA, 22 bp, Homo sapiens
tgggatatagtaaaacatgaat

SEQ ID NO: 7701331 - DNA, 22 bp, Homo sapiens
tgggatataatctgaaaagtat

SEQ ID NO: 7701332 - DNA, 22 bp, Homo sapiens
tgggatataatggtattacatc

SEQ ID NO: 7701333 - DNA, 22 bp, Homo sapiens
tgggatagtagctgagagacaa

SEQ ID NO: 7701334 - DNA, 22 bp, Homo sapiens
tgggatagtagctgagagacaa

SEQ ID NO: 7701335 - DNA, 22 bp, Homo sapiens
tgggatagtagctgagagacaa

SEQ ID NO: 7701336 - DNA, 22 bp, Homo sapiens
tgggatagggctattgctcaca

SEQ ID NO: 7701337 - DNA, 22 bp, Homo sapiens
tgggatagtggccaggaccccc

SEQ ID NO: 7701338 - DNA, 22 bp, Homo sapiens
tgggatagtggccaggaccccc

SEQ ID NO: 7701339 - DNA, 22 bp, Homo sapiens
tgggagtgatacagtatggaat

SEQ ID NO: 7701340 - DNA, 22 bp, Homo sapiens
tgggagtgaggcagagtctatc

SEQ ID NO: 7701341 - DNA, 22 bp, Homo sapiens
tgggagtgatacagtatggaat

SEQ ID NO: 7701342 - DNA, 22 bp, Homo sapiens
tgggagtgatacagtatggaat

SEQ ID NO: 7701343 - DNA, 22 bp, Homo sapiens
tgggagtgatacagtatggaat

SEQ ID NO: 7701344 - DNA, 22 bp, Homo sapiens
tgggagtgatacagtatggaat

SEQ ID NO: 7701345 - DNA, 22 bp, Homo sapiens
tgggagtgcacctgggacacga

SEQ ID NO: 7701346 - DNA, 22 bp, Homo sapiens
tgggagtgcacctgggacacga

SEQ ID NO: 7701347 - DNA, 22 bp, Homo sapiens
tgggagtgcacctgggacacga

SEQ ID NO: 7701348 - DNA, 22 bp, Homo sapiens
tgggagtgcacctgggacacga

SEQ ID NO: 7701349 - DNA, 22 bp, Homo sapiens
tgggagtgcacctgggacacga

SEQ ID NO: 7701350 - DNA, 22 bp, Homo sapiens
tgggagtgcacctgggacacga

SEQ ID NO: 7701351 - DNA, 18 bp, Homo sapiens
tgggagtgggagtggata

SEQ ID NO: 7701352 - DNA, 18 bp, Homo sapiens
tgggagtgggagtggata

SEQ ID NO: 7701353 - DNA, 22 bp, Homo sapiens
tgggagtgcacctgggacacga

SEQ ID NO: 7701354 - DNA, 23 bp, Homo sapiens
tgggatagaatttcatggctgct

SEQ ID NO: 7701355 - DNA, 18 bp, Homo sapiens
tgggagtgggagtggata

SEQ ID NO: 7701356 - DNA, 18 bp, Homo sapiens
tgggagtgggagtggata

SEQ ID NO: 7701357 - DNA, 22 bp, Homo sapiens
tgggatagtagctgagagacaa

SEQ ID NO: 7701358 - DNA, 22 bp, Homo sapiens
tgggatagggctattgctcaca

SEQ ID NO: 7701359 - DNA, 22 bp, Homo sapiens
tgggatagattgatggatagag

SEQ ID NO: 7701360 - DNA, 22 bp, Homo sapiens
tgggatagattgatggatagag

SEQ ID NO: 7701361 - DNA, 22 bp, Homo sapiens
tgggatagattgatggatagag

SEQ ID NO: 7701362 - DNA, 22 bp, Homo sapiens
tgggatagattgatggatagag

SEQ ID NO: 7701363 - DNA, 22 bp, Homo sapiens
tgggattcaccatgggcttcag

SEQ ID NO: 7701364 - DNA, 20 bp, Homo sapiens
tgggattgttttttagcttc

SEQ ID NO: 7701365 - DNA, 22 bp, Homo sapiens
tgggcaaactgtcaaccatgtc

SEQ ID NO: 7701366 - DNA, 22 bp, Homo sapiens
tgggattcaccatgggcttcag

SEQ ID NO: 7701367 - DNA, 22 bp, Homo sapiens
tgggattcaccatgggcttcag

SEQ ID NO: 7701368 - DNA, 22 bp, Homo sapiens
tgggatgtggccatggttctct

SEQ ID NO: 7701369 - DNA, 22 bp, Homo sapiens
tgggattcaccatgggcttcag

SEQ ID NO: 7701370 - DNA, 22 bp, Homo sapiens
tgggattcaccatgggcttcag

SEQ ID NO: 7701371 - DNA, 22 bp, Homo sapiens
tgggattcaccatgggcttcag

SEQ ID NO: 7701372 - DNA, 22 bp, Homo sapiens
tgggcaaaggctgtaacccatc

SEQ ID NO: 7701373 - DNA, 22 bp, Homo sapiens
tgggatttttaaatgtattaag

SEQ ID NO: 7701374 - DNA, 22 bp, Homo sapiens
tgggcaaactgtcaaccatgtc

SEQ ID NO: 7701375 - DNA, 22 bp, Homo sapiens
tgggcaaaggctgtaacccatc

SEQ ID NO: 7701376 - DNA, 22 bp, Homo sapiens
tgggcaaagtcacatacatgat

SEQ ID NO: 7701377 - DNA, 22 bp, Homo sapiens
tgggcaaagtcacatacatgat

SEQ ID NO: 7701378 - DNA, 22 bp, Homo sapiens
tgggcaaagtcacatacatgat

SEQ ID NO: 7701379 - DNA, 22 bp, Homo sapiens
tgggcaaatgctttttagtcaa

SEQ ID NO: 7701380 - DNA, 22 bp, Homo sapiens
tgggcaaagtcacatacatgat

SEQ ID NO: 7701381 - DNA, 22 bp, Homo sapiens
tgggcaaatgctttttagtcaa

SEQ ID NO: 7701382 - DNA, 22 bp, Homo sapiens
tgggcaagctctgggtggacac

SEQ ID NO: 7701383 - DNA, 22 bp, Homo sapiens
tgggcaagctctgggtggacac

SEQ ID NO: 7701384 - DNA, 22 bp, Homo sapiens
tgggcaagctctgggtggacac

SEQ ID NO: 7701385 - DNA, 22 bp, Homo sapiens
tgggcaagcaggagggcctcag

SEQ ID NO: 7701386 - DNA, 22 bp, Homo sapiens
tgggcaaatgtcactttctttt

SEQ ID NO: 7701387 - DNA, 22 bp, Homo sapiens
tgggcaaatgtcactttctttt

SEQ ID NO: 7701388 - DNA, 22 bp, Homo sapiens
tgggatgggatctcgctgtgtc

SEQ ID NO: 7701389 - DNA, 22 bp, Homo sapiens
tgggatggcctttgaaagccag

SEQ ID NO: 7701390 - DNA, 22 bp, Homo sapiens
tgggatgggatctcgctgtgtc

SEQ ID NO: 7701391 - DNA, 22 bp, Homo sapiens
tgggatgggatctcgctgtgtc

SEQ ID NO: 7701392 - DNA, 22 bp, Homo sapiens
tgggatgggatctcgctgtgtc

SEQ ID NO: 7701393 - DNA, 22 bp, Homo sapiens
tgggatggcctttgaaagccag

SEQ ID NO: 7701394 - DNA, 22 bp, Homo sapiens
tgggatggcctttgaaagccag

SEQ ID NO: 7701395 - DNA, 22 bp, Homo sapiens
tgggatggcctttgaaagccag

SEQ ID NO: 7701396 - DNA, 22 bp, Homo sapiens
tgggatggcatcctgggccttg

SEQ ID NO: 7701397 - DNA, 21 bp, Homo sapiens
tgggatgggtctgggaccagc

SEQ ID NO: 7701398 - DNA, 22 bp, Homo sapiens
tgggatgtggccatggttctct

SEQ ID NO: 7701399 - DNA, 21 bp, Homo sapiens
tgggatgggtctgggaccagc

SEQ ID NO: 7701400 - DNA, 22 bp, Homo sapiens
tgggatgtctttaggggaagag

SEQ ID NO: 7701401 - DNA, 21 bp, Homo sapiens
tgggatgggtctgggaccagc

SEQ ID NO: 7701402 - DNA, 22 bp, Homo sapiens
tgggatgggatctcgctgtgtc

SEQ ID NO: 7701403 - DNA, 22 bp, Homo sapiens
tgggatgggatctcgctgtgtc

SEQ ID NO: 7701404 - DNA, 21 bp, Homo sapiens
tgggatgggtctgggaccagc

SEQ ID NO: 7701405 - DNA, 21 bp, Homo sapiens
tgggatgggtctgggaccagc

SEQ ID NO: 7701406 - DNA, 21 bp, Homo sapiens
tgggatgggtctgggaccagc

SEQ ID NO: 7701407 - DNA, 22 bp, Homo sapiens
tgggatgggatctcgctgtgtc

SEQ ID NO: 7701408 - DNA, 21 bp, Homo sapiens
tgggatgggtctgggaccagc

SEQ ID NO: 7701409 - DNA, 22 bp, Homo sapiens
tgggcaatatgactcagtattt

SEQ ID NO: 7701410 - DNA, 22 bp, Homo sapiens
tgggcaatttatttggtcatca

SEQ ID NO: 7701411 - DNA, 22 bp, Homo sapiens
tgggcacaaacatctgcctgtt

SEQ ID NO: 7701412 - DNA, 22 bp, Homo sapiens
tgggcaagtatcggactctgag

SEQ ID NO: 7701413 - DNA, 22 bp, Homo sapiens
tgggcaagtcacttctgtcttt

SEQ ID NO: 7701414 - DNA, 21 bp, Homo sapiens
tgggcaagtttgggggtcctc

SEQ ID NO: 7701415 - DNA, 22 bp, Homo sapiens
tgggcaagtcacttctgtcttt

SEQ ID NO: 7701416 - DNA, 22 bp, Homo sapiens
tgggcaaggctggagcctgcag

SEQ ID NO: 7701417 - DNA, 22 bp, Homo sapiens
tgggcaaggctggagcctgcag

SEQ ID NO: 7701418 - DNA, 22 bp, Homo sapiens
tgggcaaggctggagcctgcag

SEQ ID NO: 7701419 - DNA, 22 bp, Homo sapiens
tgggcaagggacaggcctggct

SEQ ID NO: 7701420 - DNA, 22 bp, Homo sapiens
tgggcaagggacaggcctggct

SEQ ID NO: 7701421 - DNA, 22 bp, Homo sapiens
tgggcaagtatcggactctgag

SEQ ID NO: 7701422 - DNA, 22 bp, Homo sapiens
tgggcaagggacaggcctggct

SEQ ID NO: 7701423 - DNA, 22 bp, Homo sapiens
tgggcaagtatcggactctgag

SEQ ID NO: 7701424 - DNA, 22 bp, Homo sapiens
tgggcaagtatcggactctgag

SEQ ID NO: 7701425 - DNA, 22 bp, Homo sapiens
tgggcacagagtcccatctgcc

SEQ ID NO: 7701426 - DNA, 22 bp, Homo sapiens
tgggcacagagtcccatctgcc

SEQ ID NO: 7701427 - DNA, 22 bp, Homo sapiens
tgggcacagagtcccatctgcc

SEQ ID NO: 7701428 - DNA, 22 bp, Homo sapiens
tgggcacagaatagatggccca

SEQ ID NO: 7701429 - DNA, 22 bp, Homo sapiens
tgggcacagaatagatggccca

SEQ ID NO: 7701430 - DNA, 22 bp, Homo sapiens
tgggcacagaatagatggccca

SEQ ID NO: 7701431 - DNA, 18 bp, Homo sapiens
tgggcacaatgaacagca

SEQ ID NO: 7701432 - DNA, 22 bp, Homo sapiens
tgggcacagaatagatggccca

SEQ ID NO: 7701433 - DNA, 22 bp, Homo sapiens
tgggcacagaatagatggccca

SEQ ID NO: 7701434 - DNA, 22 bp, Homo sapiens
tgggcacagaatagatggccca

SEQ ID NO: 7701435 - DNA, 18 bp, Homo sapiens
tgggcacaatgaacagca

SEQ ID NO: 7701436 - DNA, 22 bp, Homo sapiens
tgggcacaaacatctgcctgtt

SEQ ID NO: 7701437 - DNA, 22 bp, Homo sapiens
tgggcacaaacatctgcctgtt

SEQ ID NO: 7701438 - DNA, 22 bp, Homo sapiens
tgggcacaaacatctgcctgtt

SEQ ID NO: 7701439 - DNA, 21 bp, Homo sapiens
tgggcaccaaaacctaggagt

SEQ ID NO: 7701440 - DNA, 21 bp, Homo sapiens
tgggcaccaaaacctaggagt

SEQ ID NO: 7701441 - DNA, 22 bp, Homo sapiens
tgggcacagtgagttgccttta

SEQ ID NO: 7701442 - DNA, 22 bp, Homo sapiens
tgggcacatagttttatggtca

SEQ ID NO: 7701443 - DNA, 20 bp, Homo sapiens
tgggcaccagatgggatgcc

SEQ ID NO: 7701444 - DNA, 20 bp, Homo sapiens
tgggcaccagatgggatgcc

SEQ ID NO: 7701445 - DNA, 22 bp, Homo sapiens
tgggcacctgaggcctggcagg

SEQ ID NO: 7701446 - DNA, 22 bp, Homo sapiens
tgggcacctagcaacccttctc

SEQ ID NO: 7701447 - DNA, 22 bp, Homo sapiens
tgggcacctagcaacccttctc

SEQ ID NO: 7701448 - DNA, 22 bp, Homo sapiens
tgggcacaggggtaggaatgag

SEQ ID NO: 7701449 - DNA, 22 bp, Homo sapiens
tgggcacaggggtaggaatgag

SEQ ID NO: 7701450 - DNA, 22 bp, Homo sapiens
tgggcacaggggtaggaatgag

SEQ ID NO: 7701451 - DNA, 22 bp, Homo sapiens
tgggcacaggggtaggaatgag

SEQ ID NO: 7701452 - DNA, 22 bp, Homo sapiens
tgggcacaggggtaggaatgag

SEQ ID NO: 7701453 - DNA, 22 bp, Homo sapiens
tgggcacaggggtaggaatgag

SEQ ID NO: 7701454 - DNA, 22 bp, Homo sapiens
tgggcacaggggaatggatgaa

SEQ ID NO: 7701455 - DNA, 22 bp, Homo sapiens
tgggcacaggggaatggatgaa

SEQ ID NO: 7701456 - DNA, 22 bp, Homo sapiens
tgggcacaggggaatggatgaa

SEQ ID NO: 7701457 - DNA, 20 bp, Homo sapiens
tgggcacagctttggagggc

SEQ ID NO: 7701458 - DNA, 22 bp, Homo sapiens
tgggcagactgagccctgtccc

SEQ ID NO: 7701459 - DNA, 22 bp, Homo sapiens
tgggcagactgagccctgtccc

SEQ ID NO: 7701460 - DNA, 22 bp, Homo sapiens
tgggcagactgagccctgtccc

SEQ ID NO: 7701461 - DNA, 22 bp, Homo sapiens
tgggcagagagtagaggcaacg

SEQ ID NO: 7701462 - DNA, 22 bp, Homo sapiens
tgggcagagagtagaggcaacg

SEQ ID NO: 7701463 - DNA, 22 bp, Homo sapiens
tgggcagagagtagaggcaacg

SEQ ID NO: 7701464 - DNA, 22 bp, Homo sapiens
tgggcagagagtagaggcaacg

SEQ ID NO: 7701465 - DNA, 22 bp, Homo sapiens
tgggcagagagtagaggcaacg

SEQ ID NO: 7701466 - DNA, 22 bp, Homo sapiens
tgggcagagagtagaggcaacg

SEQ ID NO: 7701467 - DNA, 22 bp, Homo sapiens
tgggcagagagtagaggcaacg

SEQ ID NO: 7701468 - DNA, 22 bp, Homo sapiens
tgggcactcaggctgaggccgt

SEQ ID NO: 7701469 - DNA, 22 bp, Homo sapiens
tgggcactcaggctgaggccgt

SEQ ID NO: 7701470 - DNA, 22 bp, Homo sapiens
tgggcactcaggctgaggccgt

SEQ ID NO: 7701471 - DNA, 22 bp, Homo sapiens
tgggcactcctggggacagctg

SEQ ID NO: 7701472 - DNA, 22 bp, Homo sapiens
tgggcactcaggctgaggccgt

SEQ ID NO: 7701473 - DNA, 22 bp, Homo sapiens
tgggcactatggctctgtgcac

SEQ ID NO: 7701474 - DNA, 22 bp, Homo sapiens
tgggcacctgaggcctggcagg

SEQ ID NO: 7701475 - DNA, 22 bp, Homo sapiens
tgggcacctgaggcctggcagg

SEQ ID NO: 7701476 - DNA, 22 bp, Homo sapiens
tgggcactatggctctgtgcac

SEQ ID NO: 7701477 - DNA, 22 bp, Homo sapiens
tgggcagagtagctcagaagaa

SEQ ID NO: 7701478 - DNA, 22 bp, Homo sapiens
tgggcagagtagctcagaagaa

SEQ ID NO: 7701479 - DNA, 22 bp, Homo sapiens
tgggcagaggctctgaagtcca

SEQ ID NO: 7701480 - DNA, 22 bp, Homo sapiens
tgggcagaggctctgaagtcca

SEQ ID NO: 7701481 - DNA, 22 bp, Homo sapiens
tgggcagagtcatacaggagac

SEQ ID NO: 7701482 - DNA, 22 bp, Homo sapiens
tgggcagagtcatacaggagac

SEQ ID NO: 7701483 - DNA, 22 bp, Homo sapiens
tgggcagagtcatacaggagac

SEQ ID NO: 7701484 - DNA, 22 bp, Homo sapiens
tgggcagagtcatacaggagac

SEQ ID NO: 7701485 - DNA, 22 bp, Homo sapiens
tgggcagagtagctcagaagaa

SEQ ID NO: 7701486 - DNA, 22 bp, Homo sapiens
tgggcagagtagctcagaagaa

SEQ ID NO: 7701487 - DNA, 22 bp, Homo sapiens
tgggcagagtcgtggggaatag

SEQ ID NO: 7701488 - DNA, 22 bp, Homo sapiens
tgggcagagtcgtggggaatag

SEQ ID NO: 7701489 - DNA, 22 bp, Homo sapiens
tgggcagagtcgtggggaatag

SEQ ID NO: 7701490 - DNA, 22 bp, Homo sapiens
tgggcagagtcgtggggaatag

SEQ ID NO: 7701491 - DNA, 22 bp, Homo sapiens
tgggcagagtcatacaggagac

SEQ ID NO: 7701492 - DNA, 22 bp, Homo sapiens
tgggcagagtcatacaggagac

SEQ ID NO: 7701493 - DNA, 22 bp, Homo sapiens
tgggcagagtcatacaggagac

SEQ ID NO: 7701494 - DNA, 22 bp, Homo sapiens
tgggcagagtcatacaggagac

SEQ ID NO: 7701495 - DNA, 22 bp, Homo sapiens
tgggcagaggacagggaagatc

SEQ ID NO: 7701496 - DNA, 22 bp, Homo sapiens
tgggcagagatctggatcaaac

SEQ ID NO: 7701497 - DNA, 22 bp, Homo sapiens
tgggcagagatctggatcaaac

SEQ ID NO: 7701498 - DNA, 22 bp, Homo sapiens
tgggcagagatctggatcaaac

SEQ ID NO: 7701499 - DNA, 22 bp, Homo sapiens
tgggcagagatctggatcaaac

SEQ ID NO: 7701500 - DNA, 22 bp, Homo sapiens
tgggcagagatctggatcaaac

SEQ ID NO: 7701501 - DNA, 22 bp, Homo sapiens
tgggcagagagtagaggcaacg

SEQ ID NO: 7701502 - DNA, 22 bp, Homo sapiens
tgggcagagatctggatcaaac

SEQ ID NO: 7701503 - DNA, 22 bp, Homo sapiens
tgggcagagatctggatcaaac

SEQ ID NO: 7701504 - DNA, 22 bp, Homo sapiens
tgggcagagatctggatcaaac

SEQ ID NO: 7701505 - DNA, 22 bp, Homo sapiens
tgggcagaggcagcagaaacct

SEQ ID NO: 7701506 - DNA, 22 bp, Homo sapiens
tgggcagaggcagcagaaacct

SEQ ID NO: 7701507 - DNA, 22 bp, Homo sapiens
tgggcagaggacagggaagatc

SEQ ID NO: 7701508 - DNA, 22 bp, Homo sapiens
tgggcagaggacagggaagatc

SEQ ID NO: 7701509 - DNA, 22 bp, Homo sapiens
tgggcagaggacagggaagatc

SEQ ID NO: 7701510 - DNA, 22 bp, Homo sapiens
tgggcagaggacagggaagatc

SEQ ID NO: 7701511 - DNA, 22 bp, Homo sapiens
tgggcagaggcagcagaaacct

SEQ ID NO: 7701512 - DNA, 22 bp, Homo sapiens
tgggcagaggcagcagaaacct

SEQ ID NO: 7701513 - DNA, 22 bp, Homo sapiens
tgggcagaggctctgaagtcca

SEQ ID NO: 7701514 - DNA, 22 bp, Homo sapiens
tgggcagaggctctgaagtcca

SEQ ID NO: 7701515 - DNA, 22 bp, Homo sapiens
tgggcagaggctctgaagtcca

SEQ ID NO: 7701516 - DNA, 22 bp, Homo sapiens
tgggcagaggctctgaagtcca

SEQ ID NO: 7701517 - DNA, 22 bp, Homo sapiens
tgggcagcaaagactgtgtgct

SEQ ID NO: 7701518 - DNA, 22 bp, Homo sapiens
tgggcagcaaagactgtgtgct

SEQ ID NO: 7701519 - DNA, 22 bp, Homo sapiens
tgggcagcaaagactgtgtgct

SEQ ID NO: 7701520 - DNA, 22 bp, Homo sapiens
tgggcagcaaagactgtgtgct

SEQ ID NO: 7701521 - DNA, 22 bp, Homo sapiens
tgggcagattaatgcagtggct

SEQ ID NO: 7701522 - DNA, 22 bp, Homo sapiens
tgggcagattaatgcagtggct

SEQ ID NO: 7701523 - DNA, 22 bp, Homo sapiens
tgggcagattaatgcagtggct

SEQ ID NO: 7701524 - DNA, 22 bp, Homo sapiens
tgggcagattaatgcagtggct

SEQ ID NO: 7701525 - DNA, 22 bp, Homo sapiens
tgggcagattaatgcagtggct

SEQ ID NO: 7701526 - DNA, 20 bp, Homo sapiens
tgggcagcactgctggctgg

SEQ ID NO: 7701527 - DNA, 20 bp, Homo sapiens
tgggcagcactgctggctgg

SEQ ID NO: 7701528 - DNA, 20 bp, Homo sapiens
tgggcagcactgctggctgg

SEQ ID NO: 7701529 - DNA, 20 bp, Homo sapiens
tgggcagcactgctggctgg

SEQ ID NO: 7701530 - DNA, 22 bp, Homo sapiens
tgggcagcaaagactgtgtgct

SEQ ID NO: 7701531 - DNA, 22 bp, Homo sapiens
tgggcagcagaaccaggccgac

SEQ ID NO: 7701532 - DNA, 22 bp, Homo sapiens
tgggcagcagaaccaggccgac

SEQ ID NO: 7701533 - DNA, 22 bp, Homo sapiens
tgggcagcagaaccaggccgac

SEQ ID NO: 7701534 - DNA, 22 bp, Homo sapiens
tgggcagcagaaccaggccgac

SEQ ID NO: 7701535 - DNA, 20 bp, Homo sapiens
tgggcagcactgctggctgg

SEQ ID NO: 7701536 - DNA, 20 bp, Homo sapiens
tgggcagcactgctggctgg

SEQ ID NO: 7701537 - DNA, 22 bp, Homo sapiens
tgggcagcagaaccaggccgac

SEQ ID NO: 7701538 - DNA, 22 bp, Homo sapiens
tgggcagcagaaccaggccgac

SEQ ID NO: 7701539 - DNA, 22 bp, Homo sapiens
tgggcagcagaaccaggccgac

SEQ ID NO: 7701540 - DNA, 22 bp, Homo sapiens
tgggcagcagaaccaggccgac

SEQ ID NO: 7701541 - DNA, 22 bp, Homo sapiens
tgggcagcagaaccaggccgac

SEQ ID NO: 7701542 - DNA, 22 bp, Homo sapiens
tgggcagcatcctccacagtca

SEQ ID NO: 7701543 - DNA, 22 bp, Homo sapiens
tgggcagcatcctccacagtca

SEQ ID NO: 7701544 - DNA, 22 bp, Homo sapiens
tgggcagcatcctccacagtca

SEQ ID NO: 7701545 - DNA, 22 bp, Homo sapiens
tgggcagcagcaaagccagact

SEQ ID NO: 7701546 - DNA, 22 bp, Homo sapiens
tgggcagcagcaaagccagact

SEQ ID NO: 7701547 - DNA, 22 bp, Homo sapiens
tgggcagcagcaaagccagact

SEQ ID NO: 7701548 - DNA, 22 bp, Homo sapiens
tgggcagcagcaaagccagact

SEQ ID NO: 7701549 - DNA, 22 bp, Homo sapiens
tgggcagcagcaaagccagact

SEQ ID NO: 7701550 - DNA, 22 bp, Homo sapiens
tgggcagatgtcctctgaagtg

SEQ ID NO: 7701551 - DNA, 22 bp, Homo sapiens
tgggcagatgtcctctgaagtg

SEQ ID NO: 7701552 - DNA, 22 bp, Homo sapiens
tgggcagatgtcctctgaagtg

SEQ ID NO: 7701553 - DNA, 22 bp, Homo sapiens
tgggcagatgtcctctgaagtg

SEQ ID NO: 7701554 - DNA, 21 bp, Homo sapiens
tgggcagatggcagtgtggct

SEQ ID NO: 7701555 - DNA, 21 bp, Homo sapiens
tgggcagatggcagtgtggct

SEQ ID NO: 7701556 - DNA, 21 bp, Homo sapiens
tgggcagatggcagtgtggct

SEQ ID NO: 7701557 - DNA, 21 bp, Homo sapiens
tgggcagatggcagtgtggct

SEQ ID NO: 7701558 - DNA, 22 bp, Homo sapiens
tgggcagatgtggctctccttg

SEQ ID NO: 7701559 - DNA, 22 bp, Homo sapiens
tgggcagatgtggctctccttg

SEQ ID NO: 7701560 - DNA, 22 bp, Homo sapiens
tgggcagatgtggctctccttg

SEQ ID NO: 7701561 - DNA, 22 bp, Homo sapiens
tgggcagatgtggctctccttg

SEQ ID NO: 7701562 - DNA, 22 bp, Homo sapiens
tgggcagattaatgcagtggct

SEQ ID NO: 7701563 - DNA, 22 bp, Homo sapiens
tgggcagatgtggctctccttg

SEQ ID NO: 7701564 - DNA, 22 bp, Homo sapiens
tgggcagattaatgcagtggct

SEQ ID NO: 7701565 - DNA, 22 bp, Homo sapiens
tgggcagattaatgcagtggct

SEQ ID NO: 7701566 - DNA, 22 bp, Homo sapiens
tgggcagattaatgcagtggct

SEQ ID NO: 7701567 - DNA, 22 bp, Homo sapiens
tgggcagattaatgcagtggct

SEQ ID NO: 7701568 - DNA, 22 bp, Homo sapiens
tgggcagattaatgcagtggct

SEQ ID NO: 7701569 - DNA, 22 bp, Homo sapiens
tgggcagatctttggtggctag

SEQ ID NO: 7701570 - DNA, 22 bp, Homo sapiens
tgggcagatctttggtggctag

SEQ ID NO: 7701571 - DNA, 16 bp, Homo sapiens
tgggcagatgagaaga

SEQ ID NO: 7701572 - DNA, 16 bp, Homo sapiens
tgggcagatgagaaga

SEQ ID NO: 7701573 - DNA, 21 bp, Homo sapiens
tgggcagatggcagtgtggct

SEQ ID NO: 7701574 - DNA, 21 bp, Homo sapiens
tgggcagatggcagtgtggct

SEQ ID NO: 7701575 - DNA, 15 bp, Homo sapiens
tgggcagatcacttg

SEQ ID NO: 7701576 - DNA, 15 bp, Homo sapiens
tgggcagatcacttg

SEQ ID NO: 7701577 - DNA, 22 bp, Homo sapiens
tgggcagatctttggtggctag

SEQ ID NO: 7701578 - DNA, 22 bp, Homo sapiens
tgggcagatctttggtggctag

SEQ ID NO: 7701579 - DNA, 22 bp, Homo sapiens
tgggcagatctttggtggctag

SEQ ID NO: 7701580 - DNA, 22 bp, Homo sapiens
tgggcagagttgtgatgaactg

SEQ ID NO: 7701581 - DNA, 22 bp, Homo sapiens
tgggcagagttgtgatgaactg

SEQ ID NO: 7701582 - DNA, 22 bp, Homo sapiens
tgggcagagttgtgatgaactg

SEQ ID NO: 7701583 - DNA, 22 bp, Homo sapiens
tgggcagagttgtgatgaactg

SEQ ID NO: 7701584 - DNA, 22 bp, Homo sapiens
tgggcagagttgtgatgaactg

SEQ ID NO: 7701585 - DNA, 22 bp, Homo sapiens
tgggcagagttgtgatgaactg

SEQ ID NO: 7701586 - DNA, 22 bp, Homo sapiens
tgggcagggatctcttttgcaa

SEQ ID NO: 7701587 - DNA, 22 bp, Homo sapiens
tgggcagggatctcttttgcaa

SEQ ID NO: 7701588 - DNA, 22 bp, Homo sapiens
tgggcagggatctcttttgcaa

SEQ ID NO: 7701589 - DNA, 22 bp, Homo sapiens
tgggcagggatctcttttgcaa

SEQ ID NO: 7701590 - DNA, 22 bp, Homo sapiens
tgggcagggatctcttttgcaa

SEQ ID NO: 7701591 - DNA, 22 bp, Homo sapiens
tgggcaggggccctgcttccgt

SEQ ID NO: 7701592 - DNA, 22 bp, Homo sapiens
tgggcagggatctcttttgcaa

SEQ ID NO: 7701593 - DNA, 22 bp, Homo sapiens
tgggcaggggccctgcttccgt

SEQ ID NO: 7701594 - DNA, 22 bp, Homo sapiens
tgggcaggggccctgcttccgt

SEQ ID NO: 7701595 - DNA, 22 bp, Homo sapiens
tgggcaggggccctgcttccgt

SEQ ID NO: 7701596 - DNA, 22 bp, Homo sapiens
tgggcaggggccctgcttccgt

SEQ ID NO: 7701597 - DNA, 22 bp, Homo sapiens
tgggcaggggccctgcttccgt

SEQ ID NO: 7701598 - DNA, 22 bp, Homo sapiens
tgggcaggggccctgcttccgt

SEQ ID NO: 7701599 - DNA, 22 bp, Homo sapiens
tgggcaggggccctgcttccgt

SEQ ID NO: 7701600 - DNA, 22 bp, Homo sapiens
tgggcaggggccctgcttccgt

SEQ ID NO: 7701601 - DNA, 22 bp, Homo sapiens
tgggcaggggccctgcttccgt

SEQ ID NO: 7701602 - DNA, 22 bp, Homo sapiens
tgggcaggggccctgcttccgt

SEQ ID NO: 7701603 - DNA, 22 bp, Homo sapiens
tgggcagggagctggaaccaca

SEQ ID NO: 7701604 - DNA, 22 bp, Homo sapiens
tgggcagggatctcttttgcaa

SEQ ID NO: 7701605 - DNA, 22 bp, Homo sapiens
tgggcagggatctcttttgcaa

SEQ ID NO: 7701606 - DNA, 22 bp, Homo sapiens
tgggcagggatctcttttgcaa

SEQ ID NO: 7701607 - DNA, 22 bp, Homo sapiens
tgggcagggatctcttttgcaa

SEQ ID NO: 7701608 - DNA, 22 bp, Homo sapiens
tgggcagggagctggaaccaca

SEQ ID NO: 7701609 - DNA, 22 bp, Homo sapiens
tgggcagggagctggaaccaca

SEQ ID NO: 7701610 - DNA, 22 bp, Homo sapiens
tgggcagggagctggaaccaca

SEQ ID NO: 7701611 - DNA, 22 bp, Homo sapiens
tgggcagggagctggaaccaca

SEQ ID NO: 7701612 - DNA, 22 bp, Homo sapiens
tgggcagggagctggaaccaca

SEQ ID NO: 7701613 - DNA, 22 bp, Homo sapiens
tgggcagggagctggaaccaca

SEQ ID NO: 7701614 - DNA, 22 bp, Homo sapiens
tgggcagggagctggaaccaca

SEQ ID NO: 7701615 - DNA, 22 bp, Homo sapiens
tgggcaggagagaagctaaaga

SEQ ID NO: 7701616 - DNA, 22 bp, Homo sapiens
tgggcagggagctggaaccaca

SEQ ID NO: 7701617 - DNA, 22 bp, Homo sapiens
tgggcagggagctggaaccaca

SEQ ID NO: 7701618 - DNA, 22 bp, Homo sapiens
tgggcagggagctggaaccaca

SEQ ID NO: 7701619 - DNA, 22 bp, Homo sapiens
tgggcagggagctggaaccaca

SEQ ID NO: 7701620 - DNA, 22 bp, Homo sapiens
tgggcagggagctggaaccaca

SEQ ID NO: 7701621 - DNA, 22 bp, Homo sapiens
tgggcagggagctggaaccaca

SEQ ID NO: 7701622 - DNA, 22 bp, Homo sapiens
tgggcagggagctggaaccaca

SEQ ID NO: 7701623 - DNA, 22 bp, Homo sapiens
tgggcaggagagaagctaaaga

SEQ ID NO: 7701624 - DNA, 22 bp, Homo sapiens
tgggcaggagagaagctaaaga

SEQ ID NO: 7701625 - DNA, 23 bp, Homo sapiens
tgggcagcttctgcatgcccacc

SEQ ID NO: 7701626 - DNA, 22 bp, Homo sapiens
tgggcagggagctggaaccaca

SEQ ID NO: 7701627 - DNA, 22 bp, Homo sapiens
tgggcagggagctggaaccaca

SEQ ID NO: 7701628 - DNA, 22 bp, Homo sapiens
tgggcagggagctggaaccaca

SEQ ID NO: 7701629 - DNA, 22 bp, Homo sapiens
tgggcagggagctggaaccaca

SEQ ID NO: 7701630 - DNA, 22 bp, Homo sapiens
tgggcagggagctggaaccaca

SEQ ID NO: 7701631 - DNA, 22 bp, Homo sapiens
tgggcagggagctggaaccaca

SEQ ID NO: 7701632 - DNA, 22 bp, Homo sapiens
tgggcagcttccacttagttag

SEQ ID NO: 7701633 - DNA, 23 bp, Homo sapiens
tgggcagcttctgcatgcccacc

SEQ ID NO: 7701634 - DNA, 19 bp, Homo sapiens
tgggcagctccctctgtcc

SEQ ID NO: 7701635 - DNA, 23 bp, Homo sapiens
tgggcagcttctgcatgcccacc

SEQ ID NO: 7701636 - DNA, 23 bp, Homo sapiens
tgggcagcttctgcatgcccacc

SEQ ID NO: 7701637 - DNA, 23 bp, Homo sapiens
tgggcagcttctgcatgcccacc

SEQ ID NO: 7701638 - DNA, 23 bp, Homo sapiens
tgggcagcttctgcatgcccacc

SEQ ID NO: 7701639 - DNA, 19 bp, Homo sapiens
tgggcagctccctctgtcc

SEQ ID NO: 7701640 - DNA, 19 bp, Homo sapiens
tgggcagctccctctgtcc

SEQ ID NO: 7701641 - DNA, 19 bp, Homo sapiens
tgggcagctccctctgtcc

SEQ ID NO: 7701642 - DNA, 22 bp, Homo sapiens
tgggcagccatcccagcctctc

SEQ ID NO: 7701643 - DNA, 22 bp, Homo sapiens
tgggcagccatcccagcctctc

SEQ ID NO: 7701644 - DNA, 22 bp, Homo sapiens
tgggcagcatcctccacagtca

SEQ ID NO: 7701645 - DNA, 22 bp, Homo sapiens
tgggcagcatcctccacagtca

SEQ ID NO: 7701646 - DNA, 22 bp, Homo sapiens
tgggcagccatcccagcctctc

SEQ ID NO: 7701647 - DNA, 22 bp, Homo sapiens
tgggcagccatcccagcctctc

SEQ ID NO: 7701648 - DNA, 22 bp, Homo sapiens
tgggcagccatcccagcctctc

SEQ ID NO: 7701649 - DNA, 19 bp, Homo sapiens
tgggcaggttcagtaatgg

SEQ ID NO: 7701650 - DNA, 19 bp, Homo sapiens
tgggcaggttcagtaatgg

SEQ ID NO: 7701651 - DNA, 19 bp, Homo sapiens
tgggcaggttcagtaatgg

SEQ ID NO: 7701652 - DNA, 19 bp, Homo sapiens
tgggcaggttcagtaatgg

SEQ ID NO: 7701653 - DNA, 19 bp, Homo sapiens
tgggcaggttcagtaatgg

SEQ ID NO: 7701654 - DNA, 19 bp, Homo sapiens
tgggcaggttcagtaatgg

SEQ ID NO: 7701655 - DNA, 19 bp, Homo sapiens
tgggcaggttcagtaatgg

SEQ ID NO: 7701656 - DNA, 19 bp, Homo sapiens
tgggcaggttcagtaatgg

SEQ ID NO: 7701657 - DNA, 19 bp, Homo sapiens
tgggcaggttcagtaatgg

SEQ ID NO: 7701658 - DNA, 22 bp, Homo sapiens
tgggcaggtgctattttccatg

SEQ ID NO: 7701659 - DNA, 22 bp, Homo sapiens
tgggcaggtgctattttccatg

SEQ ID NO: 7701660 - DNA, 22 bp, Homo sapiens
tgggcaggtgctattttccatg

SEQ ID NO: 7701661 - DNA, 22 bp, Homo sapiens
tgggcaggtgctattttccatg

SEQ ID NO: 7701662 - DNA, 22 bp, Homo sapiens
tgggcaggtgctattttccatg

SEQ ID NO: 7701663 - DNA, 22 bp, Homo sapiens
tgggcaggtgctattttccatg

SEQ ID NO: 7701664 - DNA, 22 bp, Homo sapiens
tgggcagggtctctgttatcag

SEQ ID NO: 7701665 - DNA, 22 bp, Homo sapiens
tgggcaggggccctgcttccgt

SEQ ID NO: 7701666 - DNA, 22 bp, Homo sapiens
tgggcaggggccctgcttccgt

SEQ ID NO: 7701667 - DNA, 22 bp, Homo sapiens
tgggcaggggccctgcttccgt

SEQ ID NO: 7701668 - DNA, 22 bp, Homo sapiens
tgggcaggggccctgcttccgt

SEQ ID NO: 7701669 - DNA, 22 bp, Homo sapiens
tgggcaggggccctgcttccgt

SEQ ID NO: 7701670 - DNA, 22 bp, Homo sapiens
tgggcaggggccctgcttccgt

SEQ ID NO: 7701671 - DNA, 22 bp, Homo sapiens
tgggcagggtctctgttatcag

SEQ ID NO: 7701672 - DNA, 22 bp, Homo sapiens
tgggcagggtctctgttatcag

SEQ ID NO: 7701673 - DNA, 22 bp, Homo sapiens
tgggcagggtctctgttatcag

SEQ ID NO: 7701674 - DNA, 22 bp, Homo sapiens
tgggcagggtctctgttatcag

SEQ ID NO: 7701675 - DNA, 22 bp, Homo sapiens
tgggcagggtctctgttatcag

SEQ ID NO: 7701676 - DNA, 22 bp, Homo sapiens
tgggcagggtctctgttatcag

SEQ ID NO: 7701677 - DNA, 22 bp, Homo sapiens
tgggcatggactgtggagccgc

SEQ ID NO: 7701678 - DNA, 22 bp, Homo sapiens
tgggcatggactgtggagccgc

SEQ ID NO: 7701679 - DNA, 22 bp, Homo sapiens
tgggcatgagtggacagagaag

SEQ ID NO: 7701680 - DNA, 22 bp, Homo sapiens
tgggccaacaggaggtctagga

SEQ ID NO: 7701681 - DNA, 22 bp, Homo sapiens
tgggccaacaggaggtctagga

SEQ ID NO: 7701682 - DNA, 22 bp, Homo sapiens
tgggccaacaggaggtctagga

SEQ ID NO: 7701683 - DNA, 22 bp, Homo sapiens
tgggcatcgttcccttggctat

SEQ ID NO: 7701684 - DNA, 22 bp, Homo sapiens
tgggcatctctgctgccggcct

SEQ ID NO: 7701685 - DNA, 22 bp, Homo sapiens
tgggcatctctgctgccggcct

SEQ ID NO: 7701686 - DNA, 22 bp, Homo sapiens
tgggcatgaagaaggaagtggg

SEQ ID NO: 7701687 - DNA, 22 bp, Homo sapiens
tgggcagtgtgtaatgcataga

SEQ ID NO: 7701688 - DNA, 22 bp, Homo sapiens
tgggcagtgggcctaggtgtga

SEQ ID NO: 7701689 - DNA, 22 bp, Homo sapiens
tgggcatcaccagcagctttat

SEQ ID NO: 7701690 - DNA, 22 bp, Homo sapiens
tgggcagtgtgtaatgcataga

SEQ ID NO: 7701691 - DNA, 22 bp, Homo sapiens
tgggcagttgctcctcagaccc

SEQ ID NO: 7701692 - DNA, 22 bp, Homo sapiens
tgggcatcatggacagcagagg

SEQ ID NO: 7701693 - DNA, 22 bp, Homo sapiens
tgggcatcatggacagcagagg

SEQ ID NO: 7701694 - DNA, 23 bp, Homo sapiens
tgggcatctcctctgtgccaggc

SEQ ID NO: 7701695 - DNA, 22 bp, Homo sapiens
tgggcatcccgcgtctggctgc

SEQ ID NO: 7701696 - DNA, 19 bp, Homo sapiens
tgggcagtgccagggctta

SEQ ID NO: 7701697 - DNA, 19 bp, Homo sapiens
tgggcagtgccagggctta

SEQ ID NO: 7701698 - DNA, 22 bp, Homo sapiens
tgggcagtgagaaaggtcaggt

SEQ ID NO: 7701699 - DNA, 22 bp, Homo sapiens
tgggcagtggcgcaatctctgg

SEQ ID NO: 7701700 - DNA, 22 bp, Homo sapiens
tgggcagtccagctggaaacgg

SEQ ID NO: 7701701 - DNA, 22 bp, Homo sapiens
tgggcagtatttgcagaataat

SEQ ID NO: 7701702 - DNA, 22 bp, Homo sapiens
tgggcagtatttgcagaataat

SEQ ID NO: 7701703 - DNA, 22 bp, Homo sapiens
tgggcaggttgttatttgacat

SEQ ID NO: 7701704 - DNA, 22 bp, Homo sapiens
tgggcaggttgttatttgacat

SEQ ID NO: 7701705 - DNA, 22 bp, Homo sapiens
tgggcaggttgttatttgacat

SEQ ID NO: 7701706 - DNA, 22 bp, Homo sapiens
tgggcaggttgttatttgacat

SEQ ID NO: 7701707 - DNA, 22 bp, Homo sapiens
tgggcaggttgttatttgacat

SEQ ID NO: 7701708 - DNA, 22 bp, Homo sapiens
tgggcaggttgttatttgacat

SEQ ID NO: 7701709 - DNA, 22 bp, Homo sapiens
tgggccaggatttcaagaccct

SEQ ID NO: 7701710 - DNA, 22 bp, Homo sapiens
tgggccaggatttcaagaccct

SEQ ID NO: 7701711 - DNA, 22 bp, Homo sapiens
tgggccagctgaagtgccgccc

SEQ ID NO: 7701712 - DNA, 22 bp, Homo sapiens
tgggccagctgaagtgccgccc

SEQ ID NO: 7701713 - DNA, 22 bp, Homo sapiens
tgggccagctgaagtgccgccc

SEQ ID NO: 7701714 - DNA, 22 bp, Homo sapiens
tgggccaggatttcaagaccct

SEQ ID NO: 7701715 - DNA, 22 bp, Homo sapiens
tgggccaggatttcaagaccct

SEQ ID NO: 7701716 - DNA, 22 bp, Homo sapiens
tgggccaggatttcaagaccct

SEQ ID NO: 7701717 - DNA, 22 bp, Homo sapiens
tgggccagctgaagtgccgccc

SEQ ID NO: 7701718 - DNA, 22 bp, Homo sapiens
tgggccagctgaagtgccgccc

SEQ ID NO: 7701719 - DNA, 22 bp, Homo sapiens
tgggccagctgaagtgccgccc

SEQ ID NO: 7701720 - DNA, 22 bp, Homo sapiens
tgggccagctgaagtgccgccc

SEQ ID NO: 7701721 - DNA, 22 bp, Homo sapiens
tgggccagctgaagtgccgccc

SEQ ID NO: 7701722 - DNA, 22 bp, Homo sapiens
tgggccagctgaagtgccgccc

SEQ ID NO: 7701723 - DNA, 22 bp, Homo sapiens
tgggccagctgaagtgccgccc

SEQ ID NO: 7701724 - DNA, 22 bp, Homo sapiens
tgggccagctgaagtgccgccc

SEQ ID NO: 7701725 - DNA, 22 bp, Homo sapiens
tgggccagctgaagtgccgccc

SEQ ID NO: 7701726 - DNA, 22 bp, Homo sapiens
tgggccagctccctgcccctgg

SEQ ID NO: 7701727 - DNA, 22 bp, Homo sapiens
tgggccagctccctgcccctgg

SEQ ID NO: 7701728 - DNA, 22 bp, Homo sapiens
tgggccagctccctgcccctgg

SEQ ID NO: 7701729 - DNA, 22 bp, Homo sapiens
tgggccagctccctgcccctgg

SEQ ID NO: 7701730 - DNA, 22 bp, Homo sapiens
tgggccagctccctgcccctgg

SEQ ID NO: 7701731 - DNA, 22 bp, Homo sapiens
tgggccagctccctgcccctgg

SEQ ID NO: 7701732 - DNA, 22 bp, Homo sapiens
tgggccagctccctgcccctgg

SEQ ID NO: 7701733 - DNA, 22 bp, Homo sapiens
tgggccagctccctgcccctgg

SEQ ID NO: 7701734 - DNA, 22 bp, Homo sapiens
tgggccagctccctgcccctgg

SEQ ID NO: 7701735 - DNA, 22 bp, Homo sapiens
tgggccagctccctgcccctgg

SEQ ID NO: 7701736 - DNA, 22 bp, Homo sapiens
tgggccagcactgggtgctcat

SEQ ID NO: 7701737 - DNA, 22 bp, Homo sapiens
tgggccagcactgggtgctcat

SEQ ID NO: 7701738 - DNA, 22 bp, Homo sapiens
tgggccagcactgggtgctcat

SEQ ID NO: 7701739 - DNA, 22 bp, Homo sapiens
tgggccagcactgggtgctcat

SEQ ID NO: 7701740 - DNA, 22 bp, Homo sapiens
tgggccagcactgggtgctcat

SEQ ID NO: 7701741 - DNA, 22 bp, Homo sapiens
tgggccagcactgggtgctcat

SEQ ID NO: 7701742 - DNA, 22 bp, Homo sapiens
tgggccagcactgggtgctcat

SEQ ID NO: 7701743 - DNA, 22 bp, Homo sapiens
tgggccagcactgggtgctcat

SEQ ID NO: 7701744 - DNA, 22 bp, Homo sapiens
tgggccagcactgggtgctcat

SEQ ID NO: 7701745 - DNA, 22 bp, Homo sapiens
tgggccagcactgggtgctcat

SEQ ID NO: 7701746 - DNA, 22 bp, Homo sapiens
tgggccagcactgggtgctcat

SEQ ID NO: 7701747 - DNA, 22 bp, Homo sapiens
tgggccagcaattgctgctcag

SEQ ID NO: 7701748 - DNA, 22 bp, Homo sapiens
tgggccagcaattgctgctcag

SEQ ID NO: 7701749 - DNA, 22 bp, Homo sapiens
tgggccacgtcatctcccacaa

SEQ ID NO: 7701750 - DNA, 22 bp, Homo sapiens
tgggccacgtcatctcccacaa

SEQ ID NO: 7701751 - DNA, 22 bp, Homo sapiens
tgggccacgtcatctcccacaa

SEQ ID NO: 7701752 - DNA, 22 bp, Homo sapiens
tgggccacgtcatctcccacaa

SEQ ID NO: 7701753 - DNA, 22 bp, Homo sapiens
tgggccacgggggtggagagct

SEQ ID NO: 7701754 - DNA, 22 bp, Homo sapiens
tgggccacgggggtggagagct

SEQ ID NO: 7701755 - DNA, 22 bp, Homo sapiens
tgggccacacacagaagaatca

SEQ ID NO: 7701756 - DNA, 22 bp, Homo sapiens
tgggccacaagccatgggacca

SEQ ID NO: 7701757 - DNA, 22 bp, Homo sapiens
tgggccacacacagaagaatca

SEQ ID NO: 7701758 - DNA, 22 bp, Homo sapiens
tgggccacaagccatgggacca

SEQ ID NO: 7701759 - DNA, 22 bp, Homo sapiens
tgggccaagttaaatgccaggg

SEQ ID NO: 7701760 - DNA, 22 bp, Homo sapiens
tgggccaagttaaatgccaggg

SEQ ID NO: 7701761 - DNA, 22 bp, Homo sapiens
tgggccaagttaaatgccaggg

SEQ ID NO: 7701762 - DNA, 22 bp, Homo sapiens
tgggccaagttaaatgccaggg

SEQ ID NO: 7701763 - DNA, 22 bp, Homo sapiens
tgggccacaagccatgggacca

SEQ ID NO: 7701764 - DNA, 22 bp, Homo sapiens
tgggccacaagccatgggacca

SEQ ID NO: 7701765 - DNA, 22 bp, Homo sapiens
tgggccacgggggtggagagct

SEQ ID NO: 7701766 - DNA, 22 bp, Homo sapiens
tgggccacgggggtggagagct

SEQ ID NO: 7701767 - DNA, 22 bp, Homo sapiens
tgggccacgggggtggagagct

SEQ ID NO: 7701768 - DNA, 22 bp, Homo sapiens
tgggccacctgcttttttgcat

SEQ ID NO: 7701769 - DNA, 22 bp, Homo sapiens
tgggccacctgctctgtttcta

SEQ ID NO: 7701770 - DNA, 22 bp, Homo sapiens
tgggccacctgctctgtttcta

SEQ ID NO: 7701771 - DNA, 22 bp, Homo sapiens
tgggccacattccaaaccagct

SEQ ID NO: 7701772 - DNA, 22 bp, Homo sapiens
tgggccacagttcaccaatccc

SEQ ID NO: 7701773 - DNA, 22 bp, Homo sapiens
tgggccacagttcaccaatccc

SEQ ID NO: 7701774 - DNA, 22 bp, Homo sapiens
tgggccacagctcacacatcca

SEQ ID NO: 7701775 - DNA, 22 bp, Homo sapiens
tgggccacagctcacacatcca

SEQ ID NO: 7701776 - DNA, 22 bp, Homo sapiens
tgggccacagctcacacatcca

SEQ ID NO: 7701777 - DNA, 22 bp, Homo sapiens
tgggccacagctcacacatcca

SEQ ID NO: 7701778 - DNA, 22 bp, Homo sapiens
tgggccacaagccatgggacca

SEQ ID NO: 7701779 - DNA, 22 bp, Homo sapiens
tgggcctgttgcctgagtccat

SEQ ID NO: 7701780 - DNA, 22 bp, Homo sapiens
tgggcctgttgcctgagtccat

SEQ ID NO: 7701781 - DNA, 22 bp, Homo sapiens
tgggcctgttgcctgagtccat

SEQ ID NO: 7701782 - DNA, 22 bp, Homo sapiens
tgggcctgttgcctgagtccat

SEQ ID NO: 7701783 - DNA, 22 bp, Homo sapiens
tgggcctgtggggatcttgaag

SEQ ID NO: 7701784 - DNA, 22 bp, Homo sapiens
tgggcctgttggggttgagtta

SEQ ID NO: 7701785 - DNA, 22 bp, Homo sapiens
tgggcctgttggggttgagtta

SEQ ID NO: 7701786 - DNA, 22 bp, Homo sapiens
tgggcctgttgcctgagtccat

SEQ ID NO: 7701787 - DNA, 22 bp, Homo sapiens
tgggcctgttgcctgagtccat

SEQ ID NO: 7701788 - DNA, 22 bp, Homo sapiens
tgggcctgttgcctgagtccat

SEQ ID NO: 7701789 - DNA, 22 bp, Homo sapiens
tgggcctgtttcccttcagggc

SEQ ID NO: 7701790 - DNA, 22 bp, Homo sapiens
tgggcctgtttcccttcagggc

SEQ ID NO: 7701791 - DNA, 22 bp, Homo sapiens
tgggcctgttggggttgagtta

SEQ ID NO: 7701792 - DNA, 22 bp, Homo sapiens
tgggcctgtttcccttcagggc

SEQ ID NO: 7701793 - DNA, 22 bp, Homo sapiens
tgggcctgtttcccttcagggc

SEQ ID NO: 7701794 - DNA, 22 bp, Homo sapiens
tgggcctgtttcccttcagggc

SEQ ID NO: 7701795 - DNA, 22 bp, Homo sapiens
tgggcctgtttcccttcagggc

SEQ ID NO: 7701796 - DNA, 22 bp, Homo sapiens
tgggccttgtcccctcagctgt

SEQ ID NO: 7701797 - DNA, 22 bp, Homo sapiens
tgggcgacagagcaagactccg

SEQ ID NO: 7701798 - DNA, 22 bp, Homo sapiens
tgggcgacagagcaagactccg

SEQ ID NO: 7701799 - DNA, 22 bp, Homo sapiens
tgggcgaggagaatgctgtgaa

SEQ ID NO: 7701800 - DNA, 23 bp, Homo sapiens
tgggcgaggcaggagtggagcac

SEQ ID NO: 7701801 - DNA, 23 bp, Homo sapiens
tgggcgaggcaggagtggagcac

SEQ ID NO: 7701802 - DNA, 22 bp, Homo sapiens
tgggcgaggagaatgctgtgaa

SEQ ID NO: 7701803 - DNA, 22 bp, Homo sapiens
tgggcgaggagaatgctgtgaa

SEQ ID NO: 7701804 - DNA, 22 bp, Homo sapiens
tgggcgacagagcaagactccg

SEQ ID NO: 7701805 - DNA, 22 bp, Homo sapiens
tgggccttctcaatgcactgga

SEQ ID NO: 7701806 - DNA, 22 bp, Homo sapiens
tgggccttctcaatgcactgga

SEQ ID NO: 7701807 - DNA, 22 bp, Homo sapiens
tgggcctgtttcccttcagggc

SEQ ID NO: 7701808 - DNA, 22 bp, Homo sapiens
tgggccttctaatctggtccct

SEQ ID NO: 7701809 - DNA, 22 bp, Homo sapiens
tgggccttctaatctggtccct

SEQ ID NO: 7701810 - DNA, 22 bp, Homo sapiens
tgggccttacttggggctgact

SEQ ID NO: 7701811 - DNA, 22 bp, Homo sapiens
tgggccttacttggggctgact

SEQ ID NO: 7701812 - DNA, 22 bp, Homo sapiens
tgggcgacagagcaagactccg

SEQ ID NO: 7701813 - DNA, 22 bp, Homo sapiens
tgggcgacagagcaagactccg

SEQ ID NO: 7701814 - DNA, 22 bp, Homo sapiens
tgggccttggatcgctaagctg

SEQ ID NO: 7701815 - DNA, 22 bp, Homo sapiens
tgggccttgctgagctatggag

SEQ ID NO: 7701816 - DNA, 22 bp, Homo sapiens
tgggccttgctgagctatggag

SEQ ID NO: 7701817 - DNA, 22 bp, Homo sapiens
tgggccttctcaatgcactgga

SEQ ID NO: 7701818 - DNA, 22 bp, Homo sapiens
tgggcctgggttcctcctgggc

SEQ ID NO: 7701819 - DNA, 22 bp, Homo sapiens
tgggcctgggttcctcctgggc

SEQ ID NO: 7701820 - DNA, 22 bp, Homo sapiens
tgggcctgggttcctcctgggc

SEQ ID NO: 7701821 - DNA, 22 bp, Homo sapiens
tgggcctgggttcctcctgggc

SEQ ID NO: 7701822 - DNA, 22 bp, Homo sapiens
tgggcctgggttcctcctgggc

SEQ ID NO: 7701823 - DNA, 22 bp, Homo sapiens
tgggcctgggttcctcctgggc

SEQ ID NO: 7701824 - DNA, 22 bp, Homo sapiens
tgggcctgggttcctcctgggc

SEQ ID NO: 7701825 - DNA, 22 bp, Homo sapiens
tgggcctgggttcctcctgggc

SEQ ID NO: 7701826 - DNA, 22 bp, Homo sapiens
tgggcctgggttcctcctgggc

SEQ ID NO: 7701827 - DNA, 22 bp, Homo sapiens
tgggcctgggtctttgctgcca

SEQ ID NO: 7701828 - DNA, 22 bp, Homo sapiens
tgggcctgggtctttgctgcca

SEQ ID NO: 7701829 - DNA, 22 bp, Homo sapiens
tgggcctgtgatgctgggctat

SEQ ID NO: 7701830 - DNA, 22 bp, Homo sapiens
tgggcctgtgatgctgggctat

SEQ ID NO: 7701831 - DNA, 22 bp, Homo sapiens
tgggcctgtgatgctgggctat

SEQ ID NO: 7701832 - DNA, 22 bp, Homo sapiens
tgggcctgtgatgctgggctat

SEQ ID NO: 7701833 - DNA, 22 bp, Homo sapiens
tgggcctgtgatgctgggctat

SEQ ID NO: 7701834 - DNA, 21 bp, Homo sapiens
tgggcctgtccctcttggagg

SEQ ID NO: 7701835 - DNA, 21 bp, Homo sapiens
tgggcctgtccctcttggagg

SEQ ID NO: 7701836 - DNA, 22 bp, Homo sapiens
tgggcctgtgatgctgggctat

SEQ ID NO: 7701837 - DNA, 21 bp, Homo sapiens
tgggcctgtccctcttggagg

SEQ ID NO: 7701838 - DNA, 20 bp, Homo sapiens
tgggcctgtggcagaagtct

SEQ ID NO: 7701839 - DNA, 20 bp, Homo sapiens
tgggcctgtggcagaagtct

SEQ ID NO: 7701840 - DNA, 20 bp, Homo sapiens
tgggcctgtggcagaagtct

SEQ ID NO: 7701841 - DNA, 20 bp, Homo sapiens
tgggcctgtggcagaagtct

SEQ ID NO: 7701842 - DNA, 20 bp, Homo sapiens
tgggcctgtggcagaagtct

SEQ ID NO: 7701843 - DNA, 22 bp, Homo sapiens
tgggcctgtgatgctgggctat

SEQ ID NO: 7701844 - DNA, 22 bp, Homo sapiens
tgggcctgtgatgctgggctat

SEQ ID NO: 7701845 - DNA, 22 bp, Homo sapiens
tgggcctgtggcttggctctag

SEQ ID NO: 7701846 - DNA, 22 bp, Homo sapiens
tgggcctgtggcttggctctag

SEQ ID NO: 7701847 - DNA, 22 bp, Homo sapiens
tgggcctgtggcttggctctag

SEQ ID NO: 7701848 - DNA, 22 bp, Homo sapiens
tgggcctgtggcttggctctag

SEQ ID NO: 7701849 - DNA, 22 bp, Homo sapiens
tgggcctgtggcttggctctag

SEQ ID NO: 7701850 - DNA, 22 bp, Homo sapiens
tgggcctgtggcttggctctag

SEQ ID NO: 7701851 - DNA, 22 bp, Homo sapiens
tgggcctgtggcttggctctag

SEQ ID NO: 7701852 - DNA, 22 bp, Homo sapiens
tgggcctgtggcttggctctag

SEQ ID NO: 7701853 - DNA, 22 bp, Homo sapiens
tgggcctgtggcttggctctag

SEQ ID NO: 7701854 - DNA, 22 bp, Homo sapiens
tgggctcagccttcatgtggcc

SEQ ID NO: 7701855 - DNA, 22 bp, Homo sapiens
tgggctcagccttcatgtggcc

SEQ ID NO: 7701856 - DNA, 22 bp, Homo sapiens
tgggctcagccttcatgtggcc

SEQ ID NO: 7701857 - DNA, 22 bp, Homo sapiens
tgggctcagccttcatgtggcc

SEQ ID NO: 7701858 - DNA, 22 bp, Homo sapiens
tgggctcagccttcatgtggcc

SEQ ID NO: 7701859 - DNA, 22 bp, Homo sapiens
tgggctcagccttcatgtggcc

SEQ ID NO: 7701860 - DNA, 21 bp, Homo sapiens
tgggctcagccccagccctgc

SEQ ID NO: 7701861 - DNA, 22 bp, Homo sapiens
tgggctcagcctcagtctgtgg

SEQ ID NO: 7701862 - DNA, 22 bp, Homo sapiens
tgggctcagcctcagtctgtgg

SEQ ID NO: 7701863 - DNA, 22 bp, Homo sapiens
tgggctcagcctcagtctgtgg

SEQ ID NO: 7701864 - DNA, 22 bp, Homo sapiens
tgggctcagcctcagtctgtgg

SEQ ID NO: 7701865 - DNA, 22 bp, Homo sapiens
tgggctcactggggcagggacc

SEQ ID NO: 7701866 - DNA, 22 bp, Homo sapiens
tgggctcactggggcagggacc

SEQ ID NO: 7701867 - DNA, 22 bp, Homo sapiens
tgggctcagaagatagtttcca

SEQ ID NO: 7701868 - DNA, 22 bp, Homo sapiens
tgggctcactggggcagggacc

SEQ ID NO: 7701869 - DNA, 22 bp, Homo sapiens
tgggctcactggggcagggacc

SEQ ID NO: 7701870 - DNA, 22 bp, Homo sapiens
tgggctcagccatgacctccac

SEQ ID NO: 7701871 - DNA, 22 bp, Homo sapiens
tgggctcagccatgacctccac

SEQ ID NO: 7701872 - DNA, 22 bp, Homo sapiens
tgggctcagccatgacctccac

SEQ ID NO: 7701873 - DNA, 22 bp, Homo sapiens
tgggctcagccatgacctccac

SEQ ID NO: 7701874 - DNA, 21 bp, Homo sapiens
tgggctcagccccagccctgc

SEQ ID NO: 7701875 - DNA, 21 bp, Homo sapiens
tgggctcagccccagccctgc

SEQ ID NO: 7701876 - DNA, 21 bp, Homo sapiens
tgggctcagccccagccctgc

SEQ ID NO: 7701877 - DNA, 22 bp, Homo sapiens
tgggctcagccatgacctccac

SEQ ID NO: 7701878 - DNA, 22 bp, Homo sapiens
tgggctcagggtcgaggacttt

SEQ ID NO: 7701879 - DNA, 22 bp, Homo sapiens
tgggctcagggaagcttggcct

SEQ ID NO: 7701880 - DNA, 22 bp, Homo sapiens
tgggctcagggaagcttggcct

SEQ ID NO: 7701881 - DNA, 22 bp, Homo sapiens
tgggctcaggaccccagaggcc

SEQ ID NO: 7701882 - DNA, 22 bp, Homo sapiens
tgggctcaggaccccagaggcc

SEQ ID NO: 7701883 - DNA, 22 bp, Homo sapiens
tgggctcagtctgcacctgcgg

SEQ ID NO: 7701884 - DNA, 22 bp, Homo sapiens
tgggctcagtctgcacctgcgg

SEQ ID NO: 7701885 - DNA, 22 bp, Homo sapiens
tgggctcagggtcgaggacttt

SEQ ID NO: 7701886 - DNA, 22 bp, Homo sapiens
tgggctcagggtcgaggacttt

SEQ ID NO: 7701887 - DNA, 22 bp, Homo sapiens
tgggctcaggaccccagaggcc

SEQ ID NO: 7701888 - DNA, 22 bp, Homo sapiens
tgggctcaggaccccagaggcc

SEQ ID NO: 7701889 - DNA, 23 bp, Homo sapiens
tgggctcagcttccagtggggag

SEQ ID NO: 7701890 - DNA, 22 bp, Homo sapiens
tgggctcagctcccaagggaag

SEQ ID NO: 7701891 - DNA, 22 bp, Homo sapiens
tgggctcagctcccaagggaag

SEQ ID NO: 7701892 - DNA, 23 bp, Homo sapiens
tgggctcagcttccagtggggag

SEQ ID NO: 7701893 - DNA, 22 bp, Homo sapiens
tgggctcagctcccaagggaag

SEQ ID NO: 7701894 - DNA, 23 bp, Homo sapiens
tgggctcagcttccagtggggag

SEQ ID NO: 7701895 - DNA, 22 bp, Homo sapiens
tgggctagatatttttgggctg

SEQ ID NO: 7701896 - DNA, 22 bp, Homo sapiens
tgggctaaatagagaaaggata

SEQ ID NO: 7701897 - DNA, 22 bp, Homo sapiens
tgggctaccagagttctaactt

SEQ ID NO: 7701898 - DNA, 22 bp, Homo sapiens
tgggctagatttggtgacccag

SEQ ID NO: 7701899 - DNA, 22 bp, Homo sapiens
tgggctagcagggaagagagac

SEQ ID NO: 7701900 - DNA, 22 bp, Homo sapiens
tgggctagcagggaagagagac

SEQ ID NO: 7701901 - DNA, 22 bp, Homo sapiens
tgggctcaaactggaggttgtt

SEQ ID NO: 7701902 - DNA, 22 bp, Homo sapiens
tgggctcaaactggaggttgtt

SEQ ID NO: 7701903 - DNA, 22 bp, Homo sapiens
tgggctattaggaccaggccat

SEQ ID NO: 7701904 - DNA, 22 bp, Homo sapiens
tgggctattaggaccaggccat

SEQ ID NO: 7701905 - DNA, 22 bp, Homo sapiens
tgggctcaatctgcttctgttt

SEQ ID NO: 7701906 - DNA, 22 bp, Homo sapiens
tgggctcaatctgcttctgttt

SEQ ID NO: 7701907 - DNA, 22 bp, Homo sapiens
tgggctcaatctgcttctgttt

SEQ ID NO: 7701908 - DNA, 22 bp, Homo sapiens
tgggctcaagtgatgctcctgt

SEQ ID NO: 7701909 - DNA, 22 bp, Homo sapiens
tgggctcaagtgatgctcctgt

SEQ ID NO: 7701910 - DNA, 22 bp, Homo sapiens
tgggctcaaactggaggttgtt

SEQ ID NO: 7701911 - DNA, 18 bp, Homo sapiens
tgggctcaaaggatcctc

SEQ ID NO: 7701912 - DNA, 22 bp, Homo sapiens
tgggctcaagtgatgctcctgt

SEQ ID NO: 7701913 - DNA, 22 bp, Homo sapiens
tgggctcaagtgatgctcctgt

SEQ ID NO: 7701914 - DNA, 18 bp, Homo sapiens
tgggctcaaaggatcctc

SEQ ID NO: 7701915 - DNA, 18 bp, Homo sapiens
tgggctcaaaggatcctc

SEQ ID NO: 7701916 - DNA, 22 bp, Homo sapiens
tgggcggtgtgcaggctctgct

SEQ ID NO: 7701917 - DNA, 22 bp, Homo sapiens
tgggcggtgtgcaggctctgct

SEQ ID NO: 7701918 - DNA, 23 bp, Homo sapiens
tgggcggggcttttcactctgcc

SEQ ID NO: 7701919 - DNA, 23 bp, Homo sapiens
tgggcggggcttttcactctgcc

SEQ ID NO: 7701920 - DNA, 22 bp, Homo sapiens
tgggcgggcaggagcgcacctg

SEQ ID NO: 7701921 - DNA, 23 bp, Homo sapiens
tgggcggggcttttcactctgcc

SEQ ID NO: 7701922 - DNA, 23 bp, Homo sapiens
tgggcggggcttttcactctgcc

SEQ ID NO: 7701923 - DNA, 21 bp, Homo sapiens
tgggcgcttgacctctgcact

SEQ ID NO: 7701924 - DNA, 22 bp, Homo sapiens
tgggcgggcaggagcgcacctg

SEQ ID NO: 7701925 - DNA, 22 bp, Homo sapiens
tgggcgggcaggagcgcacctg

SEQ ID NO: 7701926 - DNA, 23 bp, Homo sapiens
tgggcgaggcaggagtggagcac

SEQ ID NO: 7701927 - DNA, 22 bp, Homo sapiens
tgggcgaggcccagggctgcgt

SEQ ID NO: 7701928 - DNA, 22 bp, Homo sapiens
tgggcgaggcccagggctgcgt

SEQ ID NO: 7701929 - DNA, 22 bp, Homo sapiens
tgggcgaggcccagggctgcgt

SEQ ID NO: 7701930 - DNA, 21 bp, Homo sapiens
tgggcgcttgacctctgcact

SEQ ID NO: 7701931 - DNA, 21 bp, Homo sapiens
tgggcgcttgacctctgcact

SEQ ID NO: 7701932 - DNA, 22 bp, Homo sapiens
tgggcgctgtgctcctctttgt

SEQ ID NO: 7701933 - DNA, 22 bp, Homo sapiens
tgggcgctgtgctcctctttgt

SEQ ID NO: 7701934 - DNA, 22 bp, Homo sapiens
tgggcgaggcccagggctgcgt

SEQ ID NO: 7701935 - DNA, 22 bp, Homo sapiens
tgggctgccagctctccagatg

SEQ ID NO: 7701936 - DNA, 22 bp, Homo sapiens
tgggctgcaggggttgagagct

SEQ ID NO: 7701937 - DNA, 22 bp, Homo sapiens
tgggctgcaggggttgagagct

SEQ ID NO: 7701938 - DNA, 22 bp, Homo sapiens
tgggctgcagagcccggccttc

SEQ ID NO: 7701939 - DNA, 22 bp, Homo sapiens
tgggctgcagagcccggccttc

SEQ ID NO: 7701940 - DNA, 22 bp, Homo sapiens
tgggctgcactccattttctgc

SEQ ID NO: 7701941 - DNA, 22 bp, Homo sapiens
tgggctgcactgctctttatcg

SEQ ID NO: 7701942 - DNA, 22 bp, Homo sapiens
tgggctgcacctttgtaaatct

SEQ ID NO: 7701943 - DNA, 22 bp, Homo sapiens
tgggctgcaccctcagcctctg

SEQ ID NO: 7701944 - DNA, 22 bp, Homo sapiens
tgggctgcaccctcagcctctg

SEQ ID NO: 7701945 - DNA, 22 bp, Homo sapiens
tgggctgcaccctcagcctctg

SEQ ID NO: 7701946 - DNA, 22 bp, Homo sapiens
tgggctgagtgtggaactagtt

SEQ ID NO: 7701947 - DNA, 22 bp, Homo sapiens
tgggctgagtgtggaactagtt

SEQ ID NO: 7701948 - DNA, 22 bp, Homo sapiens
tgggctgcaccctcagcctctg

SEQ ID NO: 7701949 - DNA, 22 bp, Homo sapiens
tgggctgcaccctcagcctctg

SEQ ID NO: 7701950 - DNA, 22 bp, Homo sapiens
tgggctgcaccctcagcctctg

SEQ ID NO: 7701951 - DNA, 22 bp, Homo sapiens
tgggctgcaccctcagcctctg

SEQ ID NO: 7701952 - DNA, 22 bp, Homo sapiens
tgggctgcaccctcagcctctg

SEQ ID NO: 7701953 - DNA, 22 bp, Homo sapiens
tgggctgccggcaggctctgcc

SEQ ID NO: 7701954 - DNA, 22 bp, Homo sapiens
tgggctgccggcaggctctgcc

SEQ ID NO: 7701955 - DNA, 22 bp, Homo sapiens
tgggctgccggcaggctctgcc

SEQ ID NO: 7701956 - DNA, 22 bp, Homo sapiens
tgggctgccggcaggctctgcc

SEQ ID NO: 7701957 - DNA, 22 bp, Homo sapiens
tgggctgccggcaggctctgcc

SEQ ID NO: 7701958 - DNA, 22 bp, Homo sapiens
tgggctgccctgatggtcctca

SEQ ID NO: 7701959 - DNA, 22 bp, Homo sapiens
tgggctgccctgatggtcctca

SEQ ID NO: 7701960 - DNA, 22 bp, Homo sapiens
tgggctgcccaaggtggccatg

SEQ ID NO: 7701961 - DNA, 22 bp, Homo sapiens
tgggctgccagctctccagatg

SEQ ID NO: 7701962 - DNA, 22 bp, Homo sapiens
tgggctgcccaaggtggccatg

SEQ ID NO: 7701963 - DNA, 22 bp, Homo sapiens
tgggctgccctgatggtcctca

SEQ ID NO: 7701964 - DNA, 22 bp, Homo sapiens
tgggctgcccaaggtggccatg

SEQ ID NO: 7701965 - DNA, 22 bp, Homo sapiens
tgggctgaaatgctgtggacta

SEQ ID NO: 7701966 - DNA, 21 bp, Homo sapiens
tgggctctttaacccaggcac

SEQ ID NO: 7701967 - DNA, 21 bp, Homo sapiens
tgggctctttaacccaggcac

SEQ ID NO: 7701968 - DNA, 21 bp, Homo sapiens
tgggctctttaacccaggcac

SEQ ID NO: 7701969 - DNA, 21 bp, Homo sapiens
tgggctctttaacccaggcac

SEQ ID NO: 7701970 - DNA, 21 bp, Homo sapiens
tgggctctttaacccaggcac

SEQ ID NO: 7701971 - DNA, 22 bp, Homo sapiens
tgggctcttcctatagtttata

SEQ ID NO: 7701972 - DNA, 22 bp, Homo sapiens
tgggctctgtgccaggttggtg

SEQ ID NO: 7701973 - DNA, 22 bp, Homo sapiens
tgggctcttcagctttgatcag

SEQ ID NO: 7701974 - DNA, 22 bp, Homo sapiens
tgggctctggtttcctggctgg

SEQ ID NO: 7701975 - DNA, 22 bp, Homo sapiens
tgggctctggtttcctggctgg

SEQ ID NO: 7701976 - DNA, 22 bp, Homo sapiens
tgggctctggtttcctggctgg

SEQ ID NO: 7701977 - DNA, 22 bp, Homo sapiens
tgggctctggtttcctggctgg

SEQ ID NO: 7701978 - DNA, 22 bp, Homo sapiens
tgggctctggtttcctggctgg

SEQ ID NO: 7701979 - DNA, 22 bp, Homo sapiens
tgggctgagcactgaggaagga

SEQ ID NO: 7701980 - DNA, 22 bp, Homo sapiens
tgggctgagagtaccttataaa

SEQ ID NO: 7701981 - DNA, 22 bp, Homo sapiens
tgggctgagagtaccttataaa

SEQ ID NO: 7701982 - DNA, 20 bp, Homo sapiens
tgggctgaggatcaggtgcc

SEQ ID NO: 7701983 - DNA, 22 bp, Homo sapiens
tgggctgagcactgaggaagga

SEQ ID NO: 7701984 - DNA, 22 bp, Homo sapiens
tgggctgagcactgaggaagga

SEQ ID NO: 7701985 - DNA, 22 bp, Homo sapiens
tgggctgagcactgaggaagga

SEQ ID NO: 7701986 - DNA, 22 bp, Homo sapiens
tgggctgagtgtggaactagtt

SEQ ID NO: 7701987 - DNA, 22 bp, Homo sapiens
tgggctgagtggcagccagagt

SEQ ID NO: 7701988 - DNA, 22 bp, Homo sapiens
tgggctgagtggcagccagagt

SEQ ID NO: 7701989 - DNA, 22 bp, Homo sapiens
tgggctgaggggccttgatgac

SEQ ID NO: 7701990 - DNA, 22 bp, Homo sapiens
tgggctgaggggccttgatgac

SEQ ID NO: 7701991 - DNA, 20 bp, Homo sapiens
tgggctgaggatcaggtgcc

SEQ ID NO: 7701992 - DNA, 20 bp, Homo sapiens
tgggctgaggatcaggtgcc

SEQ ID NO: 7701993 - DNA, 22 bp, Homo sapiens
tgggctgagcagtgaagctcat

SEQ ID NO: 7701994 - DNA, 20 bp, Homo sapiens
tgggctgaggatcaggtgcc

SEQ ID NO: 7701995 - DNA, 22 bp, Homo sapiens
tgggctctggggaaactgtgat

SEQ ID NO: 7701996 - DNA, 22 bp, Homo sapiens
tgggctctgggtggcctgagca

SEQ ID NO: 7701997 - DNA, 22 bp, Homo sapiens
tgggctctgggtggcctgagca

SEQ ID NO: 7701998 - DNA, 22 bp, Homo sapiens
tgggctctgggtggcctgagca

SEQ ID NO: 7701999 - DNA, 22 bp, Homo sapiens
tgggctctgggtggcctgagca

SEQ ID NO: 7702000 - DNA, 22 bp, Homo sapiens
tgggctctggtttcctggctgg

SEQ ID NO: 7702001 - DNA, 22 bp, Homo sapiens
tgggctctggagggcctaggat

SEQ ID NO: 7702002 - DNA, 22 bp, Homo sapiens
tgggctctggagggcctaggat

SEQ ID NO: 7702003 - DNA, 22 bp, Homo sapiens
tgggctctggagggcctaggat

SEQ ID NO: 7702004 - DNA, 22 bp, Homo sapiens
tgggctctggagggcctaggat

SEQ ID NO: 7702005 - DNA, 22 bp, Homo sapiens
tgggctctggagggcctaggat

SEQ ID NO: 7702006 - DNA, 22 bp, Homo sapiens
tgggctctggacaaacccttgc

SEQ ID NO: 7702007 - DNA, 22 bp, Homo sapiens
tgggctctggacaaacccttgc

SEQ ID NO: 7702008 - DNA, 22 bp, Homo sapiens
tgggctctggaattgagtggcc

SEQ ID NO: 7702009 - DNA, 22 bp, Homo sapiens
tgggctctggaattgagtggcc

SEQ ID NO: 7702010 - DNA, 22 bp, Homo sapiens
tgggctctggaattgagtggcc

SEQ ID NO: 7702011 - DNA, 22 bp, Homo sapiens
tgggctctgctgcgtaccagtt

SEQ ID NO: 7702012 - DNA, 22 bp, Homo sapiens
tgggctctgctgcgtaccagtt

SEQ ID NO: 7702013 - DNA, 22 bp, Homo sapiens
tgggctctgctgcgtaccagtt

SEQ ID NO: 7702014 - DNA, 22 bp, Homo sapiens
tgggctctgctgcgtaccagtt

SEQ ID NO: 7702015 - DNA, 22 bp, Homo sapiens
tgggctctgctgcgtaccagtt

SEQ ID NO: 7702016 - DNA, 20 bp, Homo sapiens
tgggctctgcttcctggagt

SEQ ID NO: 7702017 - DNA, 20 bp, Homo sapiens
tgggctctgcttcctggagt

SEQ ID NO: 7702018 - DNA, 20 bp, Homo sapiens
tgggctctgcttcctggagt

SEQ ID NO: 7702019 - DNA, 22 bp, Homo sapiens
tgggctctggaattgagtggcc

SEQ ID NO: 7702020 - DNA, 22 bp, Homo sapiens
tgggctctgaagtcagtctgct

SEQ ID NO: 7702021 - DNA, 22 bp, Homo sapiens
tgggctctgaagtcagtctgct

SEQ ID NO: 7702022 - DNA, 22 bp, Homo sapiens
tgggctctgcatcagtgcccat

SEQ ID NO: 7702023 - DNA, 22 bp, Homo sapiens
tgggctctgcatcagtgcccat

SEQ ID NO: 7702024 - DNA, 22 bp, Homo sapiens
tgggctctgcatcagtgcccat

SEQ ID NO: 7702025 - DNA, 22 bp, Homo sapiens
tgggctctgcatcagtgcccat

SEQ ID NO: 7702026 - DNA, 22 bp, Homo sapiens
tgggctctgaagggtcccggat

SEQ ID NO: 7702027 - DNA, 22 bp, Homo sapiens
tgggctctgaagtcagtctgct

SEQ ID NO: 7702028 - DNA, 22 bp, Homo sapiens
tgggctctgaagtcagtctgct

SEQ ID NO: 7702029 - DNA, 22 bp, Homo sapiens
tgggctctgaagggtcccggat

SEQ ID NO: 7702030 - DNA, 22 bp, Homo sapiens
tgggctctctttacctcataac

SEQ ID NO: 7702031 - DNA, 22 bp, Homo sapiens
tgggctctctttacctcataac

SEQ ID NO: 7702032 - DNA, 22 bp, Homo sapiens
tgggctctcgtccctgcagaag

SEQ ID NO: 7702033 - DNA, 22 bp, Homo sapiens
tgggctctcgtccctgcagaag

SEQ ID NO: 7702034 - DNA, 22 bp, Homo sapiens
tgggctctcgtccctgcagaag

SEQ ID NO: 7702035 - DNA, 22 bp, Homo sapiens
tgggctctcgtccctgcagaag

SEQ ID NO: 7702036 - DNA, 22 bp, Homo sapiens
tgggctctcgtccctgcagaag

SEQ ID NO: 7702037 - DNA, 22 bp, Homo sapiens
tgggctctctcacctggaggct

SEQ ID NO: 7702038 - DNA, 22 bp, Homo sapiens
tgggctctctcacctggaggct

SEQ ID NO: 7702039 - DNA, 22 bp, Homo sapiens
tgggctctctcacctggaggct

SEQ ID NO: 7702040 - DNA, 19 bp, Homo sapiens
tgggctctcaagagcggaa

SEQ ID NO: 7702041 - DNA, 19 bp, Homo sapiens
tgggctctcaagagcggaa

SEQ ID NO: 7702042 - DNA, 22 bp, Homo sapiens
tgggctctcaaagtgcggcttg

SEQ ID NO: 7702043 - DNA, 22 bp, Homo sapiens
tgggctcagtctgcttggtcct

SEQ ID NO: 7702044 - DNA, 22 bp, Homo sapiens
tgggctcagtctgcttggtcct

SEQ ID NO: 7702045 - DNA, 22 bp, Homo sapiens
tgggctcagtctgcacctgcgg

SEQ ID NO: 7702046 - DNA, 22 bp, Homo sapiens
tgggctcagtctgcacctgcgg

SEQ ID NO: 7702047 - DNA, 22 bp, Homo sapiens
tgggctcagtctgcttggtcct

SEQ ID NO: 7702048 - DNA, 22 bp, Homo sapiens
tgggctcagtctgcttggtcct

SEQ ID NO: 7702049 - DNA, 22 bp, Homo sapiens
tgggctctcctggaggacaaca

SEQ ID NO: 7702050 - DNA, 22 bp, Homo sapiens
tgggctctcagtcagactggca

SEQ ID NO: 7702051 - DNA, 22 bp, Homo sapiens
tgggctctcctggaggacaaca

SEQ ID NO: 7702052 - DNA, 22 bp, Homo sapiens
tgggctctcctggaggacaaca

SEQ ID NO: 7702053 - DNA, 22 bp, Homo sapiens
tgggctctcctggaggacaaca

SEQ ID NO: 7702054 - DNA, 22 bp, Homo sapiens
tgggctctcacacatgttctga

SEQ ID NO: 7702055 - DNA, 22 bp, Homo sapiens
tgggctctcacacatgttctga

SEQ ID NO: 7702056 - DNA, 22 bp, Homo sapiens
tgggctctcagtcagactggca

SEQ ID NO: 7702057 - DNA, 22 bp, Homo sapiens
tgggctctcagtcagactggca

SEQ ID NO: 7702058 - DNA, 22 bp, Homo sapiens
tgggctctcagtcagactggca

SEQ ID NO: 7702059 - DNA, 22 bp, Homo sapiens
tgggctctcagtcagactggca

SEQ ID NO: 7702060 - DNA, 22 bp, Homo sapiens
tgggccaggcatgtgatcagca

SEQ ID NO: 7702061 - DNA, 22 bp, Homo sapiens
tgggccaggcatgtgatcagca

SEQ ID NO: 7702062 - DNA, 22 bp, Homo sapiens
tgggccaggcatgtgatcagca

SEQ ID NO: 7702063 - DNA, 22 bp, Homo sapiens
tgggccaggcatgtgatcagca

SEQ ID NO: 7702064 - DNA, 22 bp, Homo sapiens
tgggccaggcatgtgatcagca

SEQ ID NO: 7702065 - DNA, 22 bp, Homo sapiens
tgggccaggcatgtgatcagca

SEQ ID NO: 7702066 - DNA, 22 bp, Homo sapiens
tgggccagggcacccagtccag

SEQ ID NO: 7702067 - DNA, 22 bp, Homo sapiens
tgggccagggcacccagtccag

SEQ ID NO: 7702068 - DNA, 22 bp, Homo sapiens
tgggccagggcacccagtccag

SEQ ID NO: 7702069 - DNA, 23 bp, Homo sapiens
tgggccagggagtccggtttctt

SEQ ID NO: 7702070 - DNA, 23 bp, Homo sapiens
tgggccagggagtccggtttctt

SEQ ID NO: 7702071 - DNA, 22 bp, Homo sapiens
tgggccagggcacccagtccag

SEQ ID NO: 7702072 - DNA, 22 bp, Homo sapiens
tgggccagggcacccagtccag

SEQ ID NO: 7702073 - DNA, 22 bp, Homo sapiens
tgggccagggcacccagtccag

SEQ ID NO: 7702074 - DNA, 22 bp, Homo sapiens
tgggccaggtctgtgtcagctg

SEQ ID NO: 7702075 - DNA, 22 bp, Homo sapiens
tgggccaggtctgtgtcagctg

SEQ ID NO: 7702076 - DNA, 22 bp, Homo sapiens
tgggccaggtctgtgtcagctg

SEQ ID NO: 7702077 - DNA, 22 bp, Homo sapiens
tgggccaggtctgtgtcagctg

SEQ ID NO: 7702078 - DNA, 22 bp, Homo sapiens
tgggccaggtctgtgtcagctg

SEQ ID NO: 7702079 - DNA, 22 bp, Homo sapiens
tgggccaggtctgtgtcagctg

SEQ ID NO: 7702080 - DNA, 22 bp, Homo sapiens
tgggccaggtctgtgtcagctg

SEQ ID NO: 7702081 - DNA, 22 bp, Homo sapiens
tgggccaggggcctcttctgat

SEQ ID NO: 7702082 - DNA, 22 bp, Homo sapiens
tgggccaggggcctcttctgat

SEQ ID NO: 7702083 - DNA, 22 bp, Homo sapiens
tgggccagggcacccagtccag

SEQ ID NO: 7702084 - DNA, 22 bp, Homo sapiens
tgggccaggtctgcggtcattt

SEQ ID NO: 7702085 - DNA, 22 bp, Homo sapiens
tgggccaggggcctcttctgat

SEQ ID NO: 7702086 - DNA, 22 bp, Homo sapiens
tgggccaggggcctcttctgat

SEQ ID NO: 7702087 - DNA, 22 bp, Homo sapiens
tgggccagtagctactcgcaag

SEQ ID NO: 7702088 - DNA, 17 bp, Homo sapiens
tgggccagtagaaggga

SEQ ID NO: 7702089 - DNA, 22 bp, Homo sapiens
tgggccagtagctactcgcaag

SEQ ID NO: 7702090 - DNA, 22 bp, Homo sapiens
tgggccagtagctactcgcaag

SEQ ID NO: 7702091 - DNA, 22 bp, Homo sapiens
tgggccagtagctactcgcaag

SEQ ID NO: 7702092 - DNA, 22 bp, Homo sapiens
tgggccagtagctactcgcaag

SEQ ID NO: 7702093 - DNA, 22 bp, Homo sapiens
tgggccagtagctactcgcaag

SEQ ID NO: 7702094 - DNA, 22 bp, Homo sapiens
tgggccagtagctactcgcaag

SEQ ID NO: 7702095 - DNA, 22 bp, Homo sapiens
tgggccagtccagccccaggga

SEQ ID NO: 7702096 - DNA, 22 bp, Homo sapiens
tgggccagtccagccccaggga

SEQ ID NO: 7702097 - DNA, 22 bp, Homo sapiens
tgggccagtccagccccaggga

SEQ ID NO: 7702098 - DNA, 22 bp, Homo sapiens
tgggccagtccagccccaggga

SEQ ID NO: 7702099 - DNA, 22 bp, Homo sapiens
tgggccagtccagccccaggga

SEQ ID NO: 7702100 - DNA, 22 bp, Homo sapiens
tgggccagtccagccccaggga

SEQ ID NO: 7702101 - DNA, 22 bp, Homo sapiens
tgggccagtccagccccaggga

SEQ ID NO: 7702102 - DNA, 22 bp, Homo sapiens
tgggccagtcctgcctaaggtg

SEQ ID NO: 7702103 - DNA, 22 bp, Homo sapiens
tgggccagtccagccccaggga

SEQ ID NO: 7702104 - DNA, 22 bp, Homo sapiens
tgggccagtccagccccaggga

SEQ ID NO: 7702105 - DNA, 22 bp, Homo sapiens
tgggccagtccagccccaggga

SEQ ID NO: 7702106 - DNA, 21 bp, Homo sapiens
tgggccagtagaaaggaaggc

SEQ ID NO: 7702107 - DNA, 21 bp, Homo sapiens
tgggccagtagaaaggaaggc

SEQ ID NO: 7702108 - DNA, 21 bp, Homo sapiens
tgggccagtagaaaggaaggc

SEQ ID NO: 7702109 - DNA, 21 bp, Homo sapiens
tgggccagtagaaaggaaggc

SEQ ID NO: 7702110 - DNA, 21 bp, Homo sapiens
tgggccagtagaaaggaaggc

SEQ ID NO: 7702111 - DNA, 21 bp, Homo sapiens
tgggccagtagaaaggaaggc

SEQ ID NO: 7702112 - DNA, 22 bp, Homo sapiens
tgggccaggtgcagtgctttag

SEQ ID NO: 7702113 - DNA, 22 bp, Homo sapiens
tgggccaggtgcagtgctttag

SEQ ID NO: 7702114 - DNA, 22 bp, Homo sapiens
tgggccaggtgcagtgctttag

SEQ ID NO: 7702115 - DNA, 17 bp, Homo sapiens
tgggccagtagaaggga

SEQ ID NO: 7702116 - DNA, 17 bp, Homo sapiens
tgggccagtagaaggga

SEQ ID NO: 7702117 - DNA, 21 bp, Homo sapiens
tgggccagtagaaaggaaggc

SEQ ID NO: 7702118 - DNA, 17 bp, Homo sapiens
tgggccagtagaaggga

SEQ ID NO: 7702119 - DNA, 17 bp, Homo sapiens
tgggccagtagaaggga

SEQ ID NO: 7702120 - DNA, 17 bp, Homo sapiens
tgggccagtagaaggga

SEQ ID NO: 7702121 - DNA, 17 bp, Homo sapiens
tgggccagtagaaggga

SEQ ID NO: 7702122 - DNA, 17 bp, Homo sapiens
tgggccagtagaaggga

SEQ ID NO: 7702123 - DNA, 22 bp, Homo sapiens
tgggccagttatttcacctctg

SEQ ID NO: 7702124 - DNA, 22 bp, Homo sapiens
tgggccagttatttcacctctg

SEQ ID NO: 7702125 - DNA, 22 bp, Homo sapiens
tgggccagtcctgcctaaggtg

SEQ ID NO: 7702126 - DNA, 22 bp, Homo sapiens
tgggccagtcctgcctaaggtg

SEQ ID NO: 7702127 - DNA, 22 bp, Homo sapiens
tgggccagtcctgcctaaggtg

SEQ ID NO: 7702128 - DNA, 22 bp, Homo sapiens
tgggccagtcctgcctaaggtg

SEQ ID NO: 7702129 - DNA, 22 bp, Homo sapiens
tgggccagtcctgcctaaggtg

SEQ ID NO: 7702130 - DNA, 22 bp, Homo sapiens
tgggccagtcctgcctaaggtg

SEQ ID NO: 7702131 - DNA, 22 bp, Homo sapiens
tgggccagtcctgcctaaggtg

SEQ ID NO: 7702132 - DNA, 22 bp, Homo sapiens
tgggccagttatttcacctctg

SEQ ID NO: 7702133 - DNA, 22 bp, Homo sapiens
tgggccagttatttcacctctg

SEQ ID NO: 7702134 - DNA, 22 bp, Homo sapiens
tgggccagttatttcacctctg

SEQ ID NO: 7702135 - DNA, 23 bp, Homo sapiens
tgggccagttctgttgaaagcca

SEQ ID NO: 7702136 - DNA, 23 bp, Homo sapiens
tgggccagttctgttgaaagcca

SEQ ID NO: 7702137 - DNA, 23 bp, Homo sapiens
tgggccagttctgttgaaagcca

SEQ ID NO: 7702138 - DNA, 23 bp, Homo sapiens
tgggccagttctgttgaaagcca

SEQ ID NO: 7702139 - DNA, 22 bp, Homo sapiens
tgggccagttctttactcgtcc

SEQ ID NO: 7702140 - DNA, 22 bp, Homo sapiens
tgggccagttctttactcgtcc

SEQ ID NO: 7702141 - DNA, 22 bp, Homo sapiens
tgggcctcaccttcttggcagc

SEQ ID NO: 7702142 - DNA, 22 bp, Homo sapiens
tgggcctcaccttcttggcagc

SEQ ID NO: 7702143 - DNA, 22 bp, Homo sapiens
tgggcctcaccttcttggcagc

SEQ ID NO: 7702144 - DNA, 22 bp, Homo sapiens
tgggcctcaccttcttggcagc

SEQ ID NO: 7702145 - DNA, 19 bp, Homo sapiens
tgggcctcacaatgctccc

SEQ ID NO: 7702146 - DNA, 22 bp, Homo sapiens
tgggccagtttctcattgaaat

SEQ ID NO: 7702147 - DNA, 19 bp, Homo sapiens
tgggcctcacaatgctccc

SEQ ID NO: 7702148 - DNA, 22 bp, Homo sapiens
tgggccagtttctcattgaaat

SEQ ID NO: 7702149 - DNA, 22 bp, Homo sapiens
tgggccagttggtgactacaaa

SEQ ID NO: 7702150 - DNA, 22 bp, Homo sapiens
tgggccagtttctcattgaaat

SEQ ID NO: 7702151 - DNA, 22 bp, Homo sapiens
tgggccagttggaatggatact

SEQ ID NO: 7702152 - DNA, 22 bp, Homo sapiens
tgggccagttggaatggatact

SEQ ID NO: 7702153 - DNA, 22 bp, Homo sapiens
tgggccagttggaatggatact

SEQ ID NO: 7702154 - DNA, 22 bp, Homo sapiens
tgggccagttggaatggatact

SEQ ID NO: 7702155 - DNA, 22 bp, Homo sapiens
tgggccagttggtgactacaaa

SEQ ID NO: 7702156 - DNA, 22 bp, Homo sapiens
tgggccagttggtgactacaaa

SEQ ID NO: 7702157 - DNA, 22 bp, Homo sapiens
tgggccagttggtgactacaaa

SEQ ID NO: 7702158 - DNA, 22 bp, Homo sapiens
tgggccagttggtgactacaaa

SEQ ID NO: 7702159 - DNA, 22 bp, Homo sapiens
tgggccagttggtgactacaaa

SEQ ID NO: 7702160 - DNA, 22 bp, Homo sapiens
tgggccagttggtgactacaaa

SEQ ID NO: 7702161 - DNA, 21 bp, Homo sapiens
tgggcctcaggcagctgtgac

SEQ ID NO: 7702162 - DNA, 21 bp, Homo sapiens
tgggcctcaggcagctgtgac

SEQ ID NO: 7702163 - DNA, 21 bp, Homo sapiens
tgggcctcaggcagctgtgac

SEQ ID NO: 7702164 - DNA, 22 bp, Homo sapiens
tgggcctcagtttccttaggat

SEQ ID NO: 7702165 - DNA, 22 bp, Homo sapiens
tgggcctcagtttccttaggat

SEQ ID NO: 7702166 - DNA, 22 bp, Homo sapiens
tgggcctcagtttccttaggat

SEQ ID NO: 7702167 - DNA, 22 bp, Homo sapiens
tgggcctcagtttccttaggat

SEQ ID NO: 7702168 - DNA, 22 bp, Homo sapiens
tgggcctcatcttcaatgagtc

SEQ ID NO: 7702169 - DNA, 22 bp, Homo sapiens
tgggcctcatcttcaatgagtc

SEQ ID NO: 7702170 - DNA, 22 bp, Homo sapiens
tgggcctcagtttgcttaatgt

SEQ ID NO: 7702171 - DNA, 22 bp, Homo sapiens
tgggcctcagtttgcttaatgt

SEQ ID NO: 7702172 - DNA, 22 bp, Homo sapiens
tgggcctcatcttcaatgagtc

SEQ ID NO: 7702173 - DNA, 22 bp, Homo sapiens
tgggcctcatgcccagccaccc

SEQ ID NO: 7702174 - DNA, 22 bp, Homo sapiens
tgggcctcatgcccagccaccc

SEQ ID NO: 7702175 - DNA, 22 bp, Homo sapiens
tgggcctcatgcccagccaccc

SEQ ID NO: 7702176 - DNA, 22 bp, Homo sapiens
tgggcctcatgcccagccaccc

SEQ ID NO: 7702177 - DNA, 22 bp, Homo sapiens
tgggcctcatgcccagccaccc

SEQ ID NO: 7702178 - DNA, 22 bp, Homo sapiens
tgggcctcatgcccagccaccc

SEQ ID NO: 7702179 - DNA, 22 bp, Homo sapiens
tgggcctccaattccagcggga

SEQ ID NO: 7702180 - DNA, 22 bp, Homo sapiens
tgggcctccaattccagcggga

SEQ ID NO: 7702181 - DNA, 22 bp, Homo sapiens
tgggcctcctggaagaatgtgg

SEQ ID NO: 7702182 - DNA, 22 bp, Homo sapiens
tgggcctcctggaagaatgtgg

SEQ ID NO: 7702183 - DNA, 22 bp, Homo sapiens
tgggcctcctttccattcagag

SEQ ID NO: 7702184 - DNA, 22 bp, Homo sapiens
tgggcctcctttccattcagag

SEQ ID NO: 7702185 - DNA, 22 bp, Homo sapiens
tgggcctcctttccattcagag

SEQ ID NO: 7702186 - DNA, 22 bp, Homo sapiens
tgggcctcctggaagaatgtgg

SEQ ID NO: 7702187 - DNA, 22 bp, Homo sapiens
tgggcctcctggaagaatgtgg

SEQ ID NO: 7702188 - DNA, 22 bp, Homo sapiens
tgggcctcctgccctggcctag

SEQ ID NO: 7702189 - DNA, 22 bp, Homo sapiens
tgggcctcctgccctggcctag

SEQ ID NO: 7702190 - DNA, 22 bp, Homo sapiens
tgggcctccgcatggcccagcg

SEQ ID NO: 7702191 - DNA, 22 bp, Homo sapiens
tgggcctccgcatggcccagcg

SEQ ID NO: 7702192 - DNA, 22 bp, Homo sapiens
tgggcctcccatgtcttaggga

SEQ ID NO: 7702193 - DNA, 22 bp, Homo sapiens
tgggcctcccatgtcttaggga

SEQ ID NO: 7702194 - DNA, 22 bp, Homo sapiens
tgggcctccgcatggcccagcg

SEQ ID NO: 7702195 - DNA, 22 bp, Homo sapiens
tgggcctccgcatggcccagcg

SEQ ID NO: 7702196 - DNA, 22 bp, Homo sapiens
tgggcctccgcatggcccagcg

SEQ ID NO: 7702197 - DNA, 22 bp, Homo sapiens
tgggcctcctgccctggcctag

SEQ ID NO: 7702198 - DNA, 22 bp, Homo sapiens
tgggcctcctgccctggcctag

SEQ ID NO: 7702199 - DNA, 22 bp, Homo sapiens
tgggcctcctccgacagccggg

SEQ ID NO: 7702200 - DNA, 22 bp, Homo sapiens
tgggcctcctgccctggcctag

SEQ ID NO: 7702201 - DNA, 22 bp, Homo sapiens
tgggcctccgcatggcccagcg

SEQ ID NO: 7702202 - DNA, 22 bp, Homo sapiens
tgggcctcctccgacagccggg

SEQ ID NO: 7702203 - DNA, 22 bp, Homo sapiens
tgggcctcctccgacagccggg

SEQ ID NO: 7702204 - DNA, 22 bp, Homo sapiens
tgggcctgggctcctgtcctct

SEQ ID NO: 7702205 - DNA, 22 bp, Homo sapiens
tgggcctgggctcctgtcctct

SEQ ID NO: 7702206 - DNA, 22 bp, Homo sapiens
tgggcctgggctcctgtcctct

SEQ ID NO: 7702207 - DNA, 22 bp, Homo sapiens
tgggcctgggctcctgtcctct

SEQ ID NO: 7702208 - DNA, 22 bp, Homo sapiens
tgggcctgggctcctgtcctct

SEQ ID NO: 7702209 - DNA, 22 bp, Homo sapiens
tgggcctgggctcctgtcctct

SEQ ID NO: 7702210 - DNA, 22 bp, Homo sapiens
tgggcctgggctcctgtcctct

SEQ ID NO: 7702211 - DNA, 22 bp, Homo sapiens
tgggcctgggctcctgtcctct

SEQ ID NO: 7702212 - DNA, 22 bp, Homo sapiens
tgggcctggacaaggccactag

SEQ ID NO: 7702213 - DNA, 22 bp, Homo sapiens
tgggcctggacaaggccactag

SEQ ID NO: 7702214 - DNA, 22 bp, Homo sapiens
tgggcctgggctcctgtcctct

SEQ ID NO: 7702215 - DNA, 22 bp, Homo sapiens
tgggcctggacaaggccactag

SEQ ID NO: 7702216 - DNA, 22 bp, Homo sapiens
tgggcctgctggggcattttca

SEQ ID NO: 7702217 - DNA, 23 bp, Homo sapiens
tgggcctggaaagccttagagag

SEQ ID NO: 7702218 - DNA, 23 bp, Homo sapiens
tgggcctggaaagccttagagag

SEQ ID NO: 7702219 - DNA, 22 bp, Homo sapiens
tgggcctgctggggcattttca

SEQ ID NO: 7702220 - DNA, 23 bp, Homo sapiens
tgggcctggaaagccttagagag

SEQ ID NO: 7702221 - DNA, 23 bp, Homo sapiens
tgggcctggaaagccttagagag

SEQ ID NO: 7702222 - DNA, 22 bp, Homo sapiens
tgggcctgggctggacagcctg

SEQ ID NO: 7702223 - DNA, 22 bp, Homo sapiens
tgggcctgggctcctgtcctct

SEQ ID NO: 7702224 - DNA, 22 bp, Homo sapiens
tgggcctgggctcctgtcctct

SEQ ID NO: 7702225 - DNA, 22 bp, Homo sapiens
tgggcctgggctggacagcctg

SEQ ID NO: 7702226 - DNA, 22 bp, Homo sapiens
tgggcctgggctggacagcctg

SEQ ID NO: 7702227 - DNA, 22 bp, Homo sapiens
tgggcctgggctggacagcctg

SEQ ID NO: 7702228 - DNA, 22 bp, Homo sapiens
tgggcctgggctggacagcctg

SEQ ID NO: 7702229 - DNA, 22 bp, Homo sapiens
tgggcctgggctggacagcctg

SEQ ID NO: 7702230 - DNA, 22 bp, Homo sapiens
tgggcctgggtctttgctgcca

SEQ ID NO: 7702231 - DNA, 22 bp, Homo sapiens
tgggcctgggtctttgctgcca

SEQ ID NO: 7702232 - DNA, 22 bp, Homo sapiens
tgggcctgggtctttgctgcca

SEQ ID NO: 7702233 - DNA, 22 bp, Homo sapiens
tgggcctgggctggacagcctg

SEQ ID NO: 7702234 - DNA, 22 bp, Homo sapiens
tgggcctggggcagcccaaatc

SEQ ID NO: 7702235 - DNA, 22 bp, Homo sapiens
tgggcctggggcagcccaaatc

SEQ ID NO: 7702236 - DNA, 22 bp, Homo sapiens
tgggcctggggcagcccaaatc

SEQ ID NO: 7702237 - DNA, 22 bp, Homo sapiens
tgggcctgatttatcatcttca

SEQ ID NO: 7702238 - DNA, 18 bp, Homo sapiens
tgggcctgcatcctagtc

SEQ ID NO: 7702239 - DNA, 18 bp, Homo sapiens
tgggcctgcatcctagtc

SEQ ID NO: 7702240 - DNA, 18 bp, Homo sapiens
tgggcctgcatcctagtc

SEQ ID NO: 7702241 - DNA, 18 bp, Homo sapiens
tgggcctgcatcctagtc

SEQ ID NO: 7702242 - DNA, 18 bp, Homo sapiens
tgggcctgcatcctagtc

SEQ ID NO: 7702243 - DNA, 21 bp, Homo sapiens
tgggcctgattcccagggtca

SEQ ID NO: 7702244 - DNA, 21 bp, Homo sapiens
tgggcctgattcccagggtca

SEQ ID NO: 7702245 - DNA, 21 bp, Homo sapiens
tgggcctgattcccagggtca

SEQ ID NO: 7702246 - DNA, 21 bp, Homo sapiens
tgggcctgattcccagggtca

SEQ ID NO: 7702247 - DNA, 21 bp, Homo sapiens
tgggcctgattcccagggtca

SEQ ID NO: 7702248 - DNA, 22 bp, Homo sapiens
tgggcctgattcttgaatcctg

SEQ ID NO: 7702249 - DNA, 22 bp, Homo sapiens
tgggcctgattcttgaatcctg

SEQ ID NO: 7702250 - DNA, 22 bp, Homo sapiens
tgggcctgattcttgaatcctg

SEQ ID NO: 7702251 - DNA, 19 bp, Homo sapiens
tgggcctgcatctgggtct

SEQ ID NO: 7702252 - DNA, 19 bp, Homo sapiens
tgggcctgcatctgggtct

SEQ ID NO: 7702253 - DNA, 19 bp, Homo sapiens
tgggcctgcatctgggtct

SEQ ID NO: 7702254 - DNA, 18 bp, Homo sapiens
tgggcctgcatcctagtc

SEQ ID NO: 7702255 - DNA, 18 bp, Homo sapiens
tgggcctgcatcctagtc

SEQ ID NO: 7702256 - DNA, 22 bp, Homo sapiens
tgggcctgccccaggcttcagc

SEQ ID NO: 7702257 - DNA, 19 bp, Homo sapiens
tgggcctgcatctgggtct

SEQ ID NO: 7702258 - DNA, 19 bp, Homo sapiens
tgggcctgcatctgggtct

SEQ ID NO: 7702259 - DNA, 19 bp, Homo sapiens
tgggcctgcatctgggtct

SEQ ID NO: 7702260 - DNA, 22 bp, Homo sapiens
tgggcctgccccaggcttcagc

SEQ ID NO: 7702261 - DNA, 22 bp, Homo sapiens
tgggcctgccccaggcttcagc

SEQ ID NO: 7702262 - DNA, 22 bp, Homo sapiens
tgggcctgccccaggcttcagc

SEQ ID NO: 7702263 - DNA, 22 bp, Homo sapiens
tgggcctgccccaggcttcagc

SEQ ID NO: 7702264 - DNA, 22 bp, Homo sapiens
tgggcctgccccaggcttcagc

SEQ ID NO: 7702265 - DNA, 22 bp, Homo sapiens
tgggcctgccccaggcttcagc

SEQ ID NO: 7702266 - DNA, 22 bp, Homo sapiens
tgggcctgccccaggcttcagc

SEQ ID NO: 7702267 - DNA, 22 bp, Homo sapiens
tgggcctgccccaggcttcagc

SEQ ID NO: 7702268 - DNA, 22 bp, Homo sapiens
tgggcctgccccaggcttcagc

SEQ ID NO: 7702269 - DNA, 22 bp, Homo sapiens
tgggcctgccccaggcttcagc

SEQ ID NO: 7702270 - DNA, 22 bp, Homo sapiens
tgggcctgactcacctgcctcc

SEQ ID NO: 7702271 - DNA, 22 bp, Homo sapiens
tgggcctgactcacctgcctcc

SEQ ID NO: 7702272 - DNA, 22 bp, Homo sapiens
tgggcctgactcacctgcctcc

SEQ ID NO: 7702273 - DNA, 22 bp, Homo sapiens
tgggcctgactcacctgcctcc

SEQ ID NO: 7702274 - DNA, 22 bp, Homo sapiens
tgggcctgactcacctgcctcc

SEQ ID NO: 7702275 - DNA, 22 bp, Homo sapiens
tgggcctgactcacctgcctcc

SEQ ID NO: 7702276 - DNA, 22 bp, Homo sapiens
tgggcctgacacttactaggga

SEQ ID NO: 7702277 - DNA, 22 bp, Homo sapiens
tgggcctgacacttactaggga

SEQ ID NO: 7702278 - DNA, 22 bp, Homo sapiens
tgggcctgacacttactaggga

SEQ ID NO: 7702279 - DNA, 22 bp, Homo sapiens
tgggcctgacacttactaggga

SEQ ID NO: 7702280 - DNA, 22 bp, Homo sapiens
tgggcctgacacttactaggga

SEQ ID NO: 7702281 - DNA, 22 bp, Homo sapiens
tgggcctgactcacctgcctcc

SEQ ID NO: 7702282 - DNA, 20 bp, Homo sapiens
tgggcctgagcctgtgggct

SEQ ID NO: 7702283 - DNA, 20 bp, Homo sapiens
tgggcctgagcctgtgggct

SEQ ID NO: 7702284 - DNA, 20 bp, Homo sapiens
tgggcctgagcctgtgggct

SEQ ID NO: 7702285 - DNA, 20 bp, Homo sapiens
tgggcctgagcctgtgggct

SEQ ID NO: 7702286 - DNA, 22 bp, Homo sapiens
tgggcctgactcacctgcctcc

SEQ ID NO: 7702287 - DNA, 22 bp, Homo sapiens
tgggcctgactcacctgcctcc

SEQ ID NO: 7702288 - DNA, 21 bp, Homo sapiens
tgggcctgattcccagggtca

SEQ ID NO: 7702289 - DNA, 21 bp, Homo sapiens
tgggcctgattcccagggtca

SEQ ID NO: 7702290 - DNA, 21 bp, Homo sapiens
tgggcctgattcccagggtca

SEQ ID NO: 7702291 - DNA, 21 bp, Homo sapiens
tgggcctgattcccagggtca

SEQ ID NO: 7702292 - DNA, 21 bp, Homo sapiens
tgggcctgattcccagggtca

SEQ ID NO: 7702293 - DNA, 22 bp, Homo sapiens
tgggcctgagtttgggaactgg

SEQ ID NO: 7702294 - DNA, 22 bp, Homo sapiens
tgggcctgagctcaccaggggc

SEQ ID NO: 7702295 - DNA, 22 bp, Homo sapiens
tgggcctgagtttgggaactgg

SEQ ID NO: 7702296 - DNA, 22 bp, Homo sapiens
tgggcctgagtttgggaactgg

SEQ ID NO: 7702297 - DNA, 22 bp, Homo sapiens
tgggcctgagctcaccaggggc

SEQ ID NO: 7702298 - DNA, 20 bp, Homo sapiens
tgggcctgagcctgtgggct

SEQ ID NO: 7702299 - DNA, 20 bp, Homo sapiens
tgggcctgagcctgtgggct

SEQ ID NO: 7702300 - DNA, 20 bp, Homo sapiens
tgggcctgagcctgtgggct

SEQ ID NO: 7702301 - DNA, 22 bp, Homo sapiens
tgggcctgagctcaccaggggc

SEQ ID NO: 7702302 - DNA, 22 bp, Homo sapiens
tgggcctgagctcaccaggggc

SEQ ID NO: 7702303 - DNA, 22 bp, Homo sapiens
tgggcctgagctcaccaggggc

SEQ ID NO: 7702304 - DNA, 22 bp, Homo sapiens
tgggcctgagctcaccaggggc

SEQ ID NO: 7702305 - DNA, 22 bp, Homo sapiens
tgggcctgagctcaccaggggc

SEQ ID NO: 7702306 - DNA, 22 bp, Homo sapiens
tgggcctcggagcacaggagac

SEQ ID NO: 7702307 - DNA, 22 bp, Homo sapiens
tgggcctcggagcacaggagac

SEQ ID NO: 7702308 - DNA, 19 bp, Homo sapiens
tgggcctctcatatctgcc

SEQ ID NO: 7702309 - DNA, 22 bp, Homo sapiens
tgggcctcggggaagcccgtgt

SEQ ID NO: 7702310 - DNA, 22 bp, Homo sapiens
tgggcctcggggaagcccgtgt

SEQ ID NO: 7702311 - DNA, 22 bp, Homo sapiens
tgggcctcggggaagcccgtgt

SEQ ID NO: 7702312 - DNA, 22 bp, Homo sapiens
tgggcctcggggaagcccgtgt

SEQ ID NO: 7702313 - DNA, 20 bp, Homo sapiens
tgggcctctggtgcctctgg

SEQ ID NO: 7702314 - DNA, 20 bp, Homo sapiens
tgggcctctggtgcctctgg

SEQ ID NO: 7702315 - DNA, 22 bp, Homo sapiens
tgggcctctgggttagtcccta

SEQ ID NO: 7702316 - DNA, 22 bp, Homo sapiens
tgggcctctgggttagtcccta

SEQ ID NO: 7702317 - DNA, 22 bp, Homo sapiens
tgggcctctgggttagtcccta

SEQ ID NO: 7702318 - DNA, 22 bp, Homo sapiens
tgggcctctgccacgctccccc

SEQ ID NO: 7702319 - DNA, 22 bp, Homo sapiens
tgggcctctgccacgctccccc

SEQ ID NO: 7702320 - DNA, 23 bp, Homo sapiens
tgggcctctccacccttttctgt

SEQ ID NO: 7702321 - DNA, 22 bp, Homo sapiens
tgggcctctgccacgctccccc

SEQ ID NO: 7702322 - DNA, 23 bp, Homo sapiens
tgggcctctccacccttttctgt

SEQ ID NO: 7702323 - DNA, 23 bp, Homo sapiens
tgggcctctccacccttttctgt

SEQ ID NO: 7702324 - DNA, 22 bp, Homo sapiens
tgggcctgaaggagctgcgccc

SEQ ID NO: 7702325 - DNA, 22 bp, Homo sapiens
tgggcctgaaggagctgcgccc

SEQ ID NO: 7702326 - DNA, 22 bp, Homo sapiens
tgggcctgaaattcccatttta

SEQ ID NO: 7702327 - DNA, 22 bp, Homo sapiens
tgggcctgaaggagctgcgccc

SEQ ID NO: 7702328 - DNA, 22 bp, Homo sapiens
tgggcctgaaggagctgcgccc

SEQ ID NO: 7702329 - DNA, 22 bp, Homo sapiens
tgggcctgaaggagctgcgccc

SEQ ID NO: 7702330 - DNA, 22 bp, Homo sapiens
tgggcctgaaggagctgcgccc

SEQ ID NO: 7702331 - DNA, 22 bp, Homo sapiens
tgggcctgaaggagctgcgccc

SEQ ID NO: 7702332 - DNA, 22 bp, Homo sapiens
tgggcctgaaggagctgcgccc

SEQ ID NO: 7702333 - DNA, 22 bp, Homo sapiens
tgggcctgaaggagctgcgccc

SEQ ID NO: 7702334 - DNA, 22 bp, Homo sapiens
tgggcctctgtttcctcatctg

SEQ ID NO: 7702335 - DNA, 22 bp, Homo sapiens
tgggcctctgtttcctcatctg

SEQ ID NO: 7702336 - DNA, 20 bp, Homo sapiens
tgggcctctggtgcctctgg

SEQ ID NO: 7702337 - DNA, 20 bp, Homo sapiens
tgggcctctggtgcctctgg

SEQ ID NO: 7702338 - DNA, 22 bp, Homo sapiens
tgggcctctgtttcctcatctg

SEQ ID NO: 7702339 - DNA, 22 bp, Homo sapiens
tgggcctctgtttcctcatctg

SEQ ID NO: 7702340 - DNA, 22 bp, Homo sapiens
tgggcctctgtttcctcatctg

SEQ ID NO: 7702341 - DNA, 22 bp, Homo sapiens
tggggagtgatgcctcggataa

SEQ ID NO: 7702342 - DNA, 22 bp, Homo sapiens
tggggagtgatgcctcggataa

SEQ ID NO: 7702343 - DNA, 22 bp, Homo sapiens
tggggagtgatgcctcggataa

SEQ ID NO: 7702344 - DNA, 22 bp, Homo sapiens
tggggagtgatgcctcggataa

SEQ ID NO: 7702345 - DNA, 20 bp, Homo sapiens
tggggagttgagcacgagca

SEQ ID NO: 7702346 - DNA, 22 bp, Homo sapiens
tggggatgaaacccaggcatct

SEQ ID NO: 7702347 - DNA, 22 bp, Homo sapiens
tggggatcataaattgatggag

SEQ ID NO: 7702348 - DNA, 20 bp, Homo sapiens
tggggagttgagcacgagca

SEQ ID NO: 7702349 - DNA, 19 bp, Homo sapiens
tggggatgctgatgaccaa

SEQ ID NO: 7702350 - DNA, 22 bp, Homo sapiens
tggggatggatgaatctttgct

SEQ ID NO: 7702351 - DNA, 19 bp, Homo sapiens
tggggatgctgatgaccaa

SEQ ID NO: 7702352 - DNA, 19 bp, Homo sapiens
tggggatgctgatgaccaa

SEQ ID NO: 7702353 - DNA, 22 bp, Homo sapiens
tggggatgaaacccaggcatct

SEQ ID NO: 7702354 - DNA, 22 bp, Homo sapiens
tggggatgaaacccaggcatct

SEQ ID NO: 7702355 - DNA, 22 bp, Homo sapiens
tggggatgaaacccaggcatct

SEQ ID NO: 7702356 - DNA, 22 bp, Homo sapiens
tggggatgtcatataagaggaa

SEQ ID NO: 7702357 - DNA, 22 bp, Homo sapiens
tggggatgtcatataagaggaa

SEQ ID NO: 7702358 - DNA, 22 bp, Homo sapiens
tggggcaagaagtgccctgaag

SEQ ID NO: 7702359 - DNA, 22 bp, Homo sapiens
tggggcaagaagtgccctgaag

SEQ ID NO: 7702360 - DNA, 22 bp, Homo sapiens
tggggatgtcatataagaggaa

SEQ ID NO: 7702361 - DNA, 22 bp, Homo sapiens
tggggatgtagaaatgaacaac

SEQ ID NO: 7702362 - DNA, 22 bp, Homo sapiens
tggggatgtagaaatgaacaac

SEQ ID NO: 7702363 - DNA, 22 bp, Homo sapiens
tggggatgtaaatgaggtgata

SEQ ID NO: 7702364 - DNA, 22 bp, Homo sapiens
tggggatgtaaatgaggtgata

SEQ ID NO: 7702365 - DNA, 16 bp, Homo sapiens
tggggatggggaagag

SEQ ID NO: 7702366 - DNA, 16 bp, Homo sapiens
tggggatggggaagag

SEQ ID NO: 7702367 - DNA, 16 bp, Homo sapiens
tggggatggggaagag

SEQ ID NO: 7702368 - DNA, 17 bp, Homo sapiens
tggggatggttcatgag

SEQ ID NO: 7702369 - DNA, 17 bp, Homo sapiens
tggggatggttcatgag

SEQ ID NO: 7702370 - DNA, 17 bp, Homo sapiens
tggggatggttcatgag

SEQ ID NO: 7702371 - DNA, 17 bp, Homo sapiens
tggggatggttcatgag

SEQ ID NO: 7702372 - DNA, 22 bp, Homo sapiens
tggggatgtaaatgaggtgata

SEQ ID NO: 7702373 - DNA, 22 bp, Homo sapiens
tggggatgtaaatgaggtgata

SEQ ID NO: 7702374 - DNA, 22 bp, Homo sapiens
tggggatgtaaatgaggtgata

SEQ ID NO: 7702375 - DNA, 22 bp, Homo sapiens
tggggagtgatgcctcggataa

SEQ ID NO: 7702376 - DNA, 22 bp, Homo sapiens
tggggagtgatgcctcggataa

SEQ ID NO: 7702377 - DNA, 22 bp, Homo sapiens
tggggagtcgctgcagagcgat

SEQ ID NO: 7702378 - DNA, 22 bp, Homo sapiens
tggggagtcgctgcagagcgat

SEQ ID NO: 7702379 - DNA, 22 bp, Homo sapiens
tggggagtcgctgcagagcgat

SEQ ID NO: 7702380 - DNA, 22 bp, Homo sapiens
tggggaggttcgggaatcttgt

SEQ ID NO: 7702381 - DNA, 22 bp, Homo sapiens
tggggaggttcgggaatcttgt

SEQ ID NO: 7702382 - DNA, 22 bp, Homo sapiens
tggggaggttcgggaatcttgt

SEQ ID NO: 7702383 - DNA, 22 bp, Homo sapiens
tggggaggttcgggaatcttgt

SEQ ID NO: 7702384 - DNA, 22 bp, Homo sapiens
tggggaggttcgggaatcttgt

SEQ ID NO: 7702385 - DNA, 22 bp, Homo sapiens
tggggaggttcgggaatcttgt

SEQ ID NO: 7702386 - DNA, 22 bp, Homo sapiens
tggggaggttcgggaatcttgt

SEQ ID NO: 7702387 - DNA, 22 bp, Homo sapiens
tggggaggttcgggaatcttgt

SEQ ID NO: 7702388 - DNA, 22 bp, Homo sapiens
tggggaggttcgggaatcttgt

SEQ ID NO: 7702389 - DNA, 22 bp, Homo sapiens
tggggaggttcgggaatcttgt

SEQ ID NO: 7702390 - DNA, 22 bp, Homo sapiens
tggggaggttcgggaatcttgt

SEQ ID NO: 7702391 - DNA, 22 bp, Homo sapiens
tggggaggttcgggaatcttgt

SEQ ID NO: 7702392 - DNA, 22 bp, Homo sapiens
tggggaggttcgggaatcttgt

SEQ ID NO: 7702393 - DNA, 22 bp, Homo sapiens
tggggaggttcgggaatcttgt

SEQ ID NO: 7702394 - DNA, 22 bp, Homo sapiens
tggggaggtaacaatttcaggc

SEQ ID NO: 7702395 - DNA, 21 bp, Homo sapiens
tggggaggggacctgattatg

SEQ ID NO: 7702396 - DNA, 21 bp, Homo sapiens
tggggaggggacctgattatg

SEQ ID NO: 7702397 - DNA, 21 bp, Homo sapiens
tggggaggggacctgattatg

SEQ ID NO: 7702398 - DNA, 21 bp, Homo sapiens
tggggaggggacctgattatg

SEQ ID NO: 7702399 - DNA, 21 bp, Homo sapiens
tggggaggggacctgattatg

SEQ ID NO: 7702400 - DNA, 21 bp, Homo sapiens
tggggaggggacctgattatg

SEQ ID NO: 7702401 - DNA, 22 bp, Homo sapiens
tggggaggtaacaatttcaggc

SEQ ID NO: 7702402 - DNA, 22 bp, Homo sapiens
tggggaggtaacaatttcaggc

SEQ ID NO: 7702403 - DNA, 22 bp, Homo sapiens
tggggaggtaacaatttcaggc

SEQ ID NO: 7702404 - DNA, 22 bp, Homo sapiens
tggggaggtaacaatttcaggc

SEQ ID NO: 7702405 - DNA, 22 bp, Homo sapiens
tggggaggtaacaatttcaggc

SEQ ID NO: 7702406 - DNA, 22 bp, Homo sapiens
tggggaggtaacaatttcaggc

SEQ ID NO: 7702407 - DNA, 22 bp, Homo sapiens
tggggaggtaacaatttcaggc

SEQ ID NO: 7702408 - DNA, 22 bp, Homo sapiens
tggggaggtaacaatttcaggc

SEQ ID NO: 7702409 - DNA, 22 bp, Homo sapiens
tggggacatagccagtctggct

SEQ ID NO: 7702410 - DNA, 22 bp, Homo sapiens
tggggacatagccagtctggct

SEQ ID NO: 7702411 - DNA, 22 bp, Homo sapiens
tggggacatagccagtctggct

SEQ ID NO: 7702412 - DNA, 22 bp, Homo sapiens
tggggacatagccagtctggct

SEQ ID NO: 7702413 - DNA, 22 bp, Homo sapiens
tggggacatagccagtctggct

SEQ ID NO: 7702414 - DNA, 22 bp, Homo sapiens
tggggacatagccagtctggct

SEQ ID NO: 7702415 - DNA, 22 bp, Homo sapiens
tggggacattcatgcaggttgt

SEQ ID NO: 7702416 - DNA, 22 bp, Homo sapiens
tggggacattcatgcaggttgt

SEQ ID NO: 7702417 - DNA, 22 bp, Homo sapiens
tggggacattcatgcaggttgt

SEQ ID NO: 7702418 - DNA, 22 bp, Homo sapiens
tggggacattcatgcaggttgt

SEQ ID NO: 7702419 - DNA, 22 bp, Homo sapiens
tggggacattcatgcaggttgt

SEQ ID NO: 7702420 - DNA, 22 bp, Homo sapiens
tggggacagggctcagcaattt

SEQ ID NO: 7702421 - DNA, 22 bp, Homo sapiens
tggggacagggctcagcaattt

SEQ ID NO: 7702422 - DNA, 22 bp, Homo sapiens
tggggacaggagacttacagct

SEQ ID NO: 7702423 - DNA, 22 bp, Homo sapiens
tggggacagggctcagcaattt

SEQ ID NO: 7702424 - DNA, 22 bp, Homo sapiens
tggggacagggctcagcaattt

SEQ ID NO: 7702425 - DNA, 22 bp, Homo sapiens
tggggacatagccagtctggct

SEQ ID NO: 7702426 - DNA, 22 bp, Homo sapiens
tggggaggaagtcagatttcag

SEQ ID NO: 7702427 - DNA, 22 bp, Homo sapiens
tggggaggaagtcagatttcag

SEQ ID NO: 7702428 - DNA, 22 bp, Homo sapiens
tggggaggaagtcagatttcag

SEQ ID NO: 7702429 - DNA, 22 bp, Homo sapiens
tggggaggaagtcagatttcag

SEQ ID NO: 7702430 - DNA, 22 bp, Homo sapiens
tggggaggaagtcagatttcag

SEQ ID NO: 7702431 - DNA, 22 bp, Homo sapiens
tggggaggaagtcagatttcag

SEQ ID NO: 7702432 - DNA, 22 bp, Homo sapiens
tggggaggaagtcagatttcag

SEQ ID NO: 7702433 - DNA, 22 bp, Homo sapiens
tggggaggaagtcagatttcag

SEQ ID NO: 7702434 - DNA, 22 bp, Homo sapiens
tggggaggaagtcagatttcag

SEQ ID NO: 7702435 - DNA, 22 bp, Homo sapiens
tggggaggaagtcagatttcag

SEQ ID NO: 7702436 - DNA, 22 bp, Homo sapiens
tggggaggaagtcagatttcag

SEQ ID NO: 7702437 - DNA, 22 bp, Homo sapiens
tggggaggaagtcagatttcag

SEQ ID NO: 7702438 - DNA, 22 bp, Homo sapiens
tggggactgacagccaggcctc

SEQ ID NO: 7702439 - DNA, 22 bp, Homo sapiens
tggggactgacagccaggcctc

SEQ ID NO: 7702440 - DNA, 22 bp, Homo sapiens
tggggactgacagccaggcctc

SEQ ID NO: 7702441 - DNA, 22 bp, Homo sapiens
tggggacgtactgagaggtccg

SEQ ID NO: 7702442 - DNA, 22 bp, Homo sapiens
tggggacgtactgagaggtccg

SEQ ID NO: 7702443 - DNA, 22 bp, Homo sapiens
tggggacccggactcctgggtc

SEQ ID NO: 7702444 - DNA, 22 bp, Homo sapiens
tggggacattcatgcaggttgt

SEQ ID NO: 7702445 - DNA, 22 bp, Homo sapiens
tggggaccagattagaccatgg

SEQ ID NO: 7702446 - DNA, 22 bp, Homo sapiens
tggggaccagattagaccatgg

SEQ ID NO: 7702447 - DNA, 22 bp, Homo sapiens
tggggaggatatgtgagttatt

SEQ ID NO: 7702448 - DNA, 22 bp, Homo sapiens
tggggaggatatgtgagttatt

SEQ ID NO: 7702449 - DNA, 22 bp, Homo sapiens
tggggaggatatgtgagttatt

SEQ ID NO: 7702450 - DNA, 22 bp, Homo sapiens
tggggaggatatgtgagttatt

SEQ ID NO: 7702451 - DNA, 22 bp, Homo sapiens
tggggaggatatgtgagttatt

SEQ ID NO: 7702452 - DNA, 22 bp, Homo sapiens
tggggaggatatgtgagttatt

SEQ ID NO: 7702453 - DNA, 22 bp, Homo sapiens
tggggaggatatgtgagttatt

SEQ ID NO: 7702454 - DNA, 22 bp, Homo sapiens
tggggaggatatgtgagttatt

SEQ ID NO: 7702455 - DNA, 22 bp, Homo sapiens
tggggaggatatgtgagttatt

SEQ ID NO: 7702456 - DNA, 22 bp, Homo sapiens
tggggaggacgggcgccttcct

SEQ ID NO: 7702457 - DNA, 22 bp, Homo sapiens
tggggaggacgggcgccttcct

SEQ ID NO: 7702458 - DNA, 22 bp, Homo sapiens
tggggaggacgggcgccttcct

SEQ ID NO: 7702459 - DNA, 22 bp, Homo sapiens
tggggaggacgggcgccttcct

SEQ ID NO: 7702460 - DNA, 22 bp, Homo sapiens
tggggaggacgggcgccttcct

SEQ ID NO: 7702461 - DNA, 22 bp, Homo sapiens
tggggaggacgggcgccttcct

SEQ ID NO: 7702462 - DNA, 22 bp, Homo sapiens
tggggaggacgggcgccttcct

SEQ ID NO: 7702463 - DNA, 22 bp, Homo sapiens
tggggaggacgggcgccttcct

SEQ ID NO: 7702464 - DNA, 22 bp, Homo sapiens
tggggaggacgggcgccttcct

SEQ ID NO: 7702465 - DNA, 22 bp, Homo sapiens
tggggaggatatgtgagttatt

SEQ ID NO: 7702466 - DNA, 22 bp, Homo sapiens
tggggaggatatgtgagttatt

SEQ ID NO: 7702467 - DNA, 23 bp, Homo sapiens
tggggagggaagtcatttctgta

SEQ ID NO: 7702468 - DNA, 23 bp, Homo sapiens
tggggagggaagtcatttctgta

SEQ ID NO: 7702469 - DNA, 23 bp, Homo sapiens
tggggagggaagtcatttctgta

SEQ ID NO: 7702470 - DNA, 23 bp, Homo sapiens
tggggagggaagtcatttctgta

SEQ ID NO: 7702471 - DNA, 23 bp, Homo sapiens
tggggagggaagtcatttctgta

SEQ ID NO: 7702472 - DNA, 23 bp, Homo sapiens
tggggagggaagtcatttctgta

SEQ ID NO: 7702473 - DNA, 23 bp, Homo sapiens
tggggagggaagtcatttctgta

SEQ ID NO: 7702474 - DNA, 23 bp, Homo sapiens
tggggagggaagtcatttctgta

SEQ ID NO: 7702475 - DNA, 23 bp, Homo sapiens
tggggagggaagtcatttctgta

SEQ ID NO: 7702476 - DNA, 23 bp, Homo sapiens
tggggagggaagtcatttctgta

SEQ ID NO: 7702477 - DNA, 21 bp, Homo sapiens
tggggaggggacctgattatg

SEQ ID NO: 7702478 - DNA, 21 bp, Homo sapiens
tggggaggggacctgattatg

SEQ ID NO: 7702479 - DNA, 21 bp, Homo sapiens
tggggaggggacctgattatg

SEQ ID NO: 7702480 - DNA, 21 bp, Homo sapiens
tggggaggggacctgattatg

SEQ ID NO: 7702481 - DNA, 21 bp, Homo sapiens
tggggaggggacctgattatg

SEQ ID NO: 7702482 - DNA, 23 bp, Homo sapiens
tgggcttctgagaaagcacctaa

SEQ ID NO: 7702483 - DNA, 22 bp, Homo sapiens
tgggcttcctggagcctgtgct

SEQ ID NO: 7702484 - DNA, 23 bp, Homo sapiens
tgggcttctgagaaagcacctaa

SEQ ID NO: 7702485 - DNA, 19 bp, Homo sapiens
tgggcttccccagggcaga

SEQ ID NO: 7702486 - DNA, 22 bp, Homo sapiens
tgggcttcataattggtcctag

SEQ ID NO: 7702487 - DNA, 22 bp, Homo sapiens
tgggcttaggtcggaggcggcc

SEQ ID NO: 7702488 - DNA, 22 bp, Homo sapiens
tgggcttaggtcggaggcggcc

SEQ ID NO: 7702489 - DNA, 22 bp, Homo sapiens
tgggctgtggagaggagctgga

SEQ ID NO: 7702490 - DNA, 22 bp, Homo sapiens
tgggctgtggagaggagctgga

SEQ ID NO: 7702491 - DNA, 22 bp, Homo sapiens
tgggctgtggagaggagctgga

SEQ ID NO: 7702492 - DNA, 22 bp, Homo sapiens
tggggaaaatgcagaagattac

SEQ ID NO: 7702493 - DNA, 22 bp, Homo sapiens
tggggaaaatgcttgtagtcag

SEQ ID NO: 7702494 - DNA, 22 bp, Homo sapiens
tggggaaaatgcagaagattac

SEQ ID NO: 7702495 - DNA, 22 bp, Homo sapiens
tgggctttgagctcggtcacct

SEQ ID NO: 7702496 - DNA, 22 bp, Homo sapiens
tggggaaaacagaggaaattag

SEQ ID NO: 7702497 - DNA, 22 bp, Homo sapiens
tggggaaaagcgttaggagttc

SEQ ID NO: 7702498 - DNA, 22 bp, Homo sapiens
tggggaaaagcgttaggagttc

SEQ ID NO: 7702499 - DNA, 22 bp, Homo sapiens
tggggaaaagcgttaggagttc

SEQ ID NO: 7702500 - DNA, 22 bp, Homo sapiens
tgggctttatcatgggtctggt

SEQ ID NO: 7702501 - DNA, 22 bp, Homo sapiens
tgggcttggaaagctgctgtgc

SEQ ID NO: 7702502 - DNA, 22 bp, Homo sapiens
tgggcttggtttctaggtaggt

SEQ ID NO: 7702503 - DNA, 22 bp, Homo sapiens
tgggcttggtttctaggtaggt

SEQ ID NO: 7702504 - DNA, 22 bp, Homo sapiens
tgggcttctggagtggggcaga

SEQ ID NO: 7702505 - DNA, 18 bp, Homo sapiens
tgggcttgaaagcaaggt

SEQ ID NO: 7702506 - DNA, 22 bp, Homo sapiens
tgggcttggaaagctgctgtgc

SEQ ID NO: 7702507 - DNA, 22 bp, Homo sapiens
tgggctggcgtggagagtttag

SEQ ID NO: 7702508 - DNA, 22 bp, Homo sapiens
tgggctggctgaacttcaacct

SEQ ID NO: 7702509 - DNA, 22 bp, Homo sapiens
tgggctggctgaacttcaacct

SEQ ID NO: 7702510 - DNA, 22 bp, Homo sapiens
tgggctggcgtggagagtttag

SEQ ID NO: 7702511 - DNA, 22 bp, Homo sapiens
tgggctggctgaacttcaacct

SEQ ID NO: 7702512 - DNA, 22 bp, Homo sapiens
tgggctggctgaacttcaacct

SEQ ID NO: 7702513 - DNA, 22 bp, Homo sapiens
tgggctggctgaacttcaacct

SEQ ID NO: 7702514 - DNA, 22 bp, Homo sapiens
tgggctggctgaacttcaacct

SEQ ID NO: 7702515 - DNA, 22 bp, Homo sapiens
tgggctggctgaacttcaacct

SEQ ID NO: 7702516 - DNA, 22 bp, Homo sapiens
tgggctggcgtggagagtttag

SEQ ID NO: 7702517 - DNA, 22 bp, Homo sapiens
tgggctggcgtggagagtttag

SEQ ID NO: 7702518 - DNA, 22 bp, Homo sapiens
tgggctggcgtggagagtttag

SEQ ID NO: 7702519 - DNA, 22 bp, Homo sapiens
tgggctggcgtggagagtttag

SEQ ID NO: 7702520 - DNA, 22 bp, Homo sapiens
tgggctggcgtggagagtttag

SEQ ID NO: 7702521 - DNA, 18 bp, Homo sapiens
tgggctgcctggcctctg

SEQ ID NO: 7702522 - DNA, 18 bp, Homo sapiens
tgggctgcctggcctctg

SEQ ID NO: 7702523 - DNA, 18 bp, Homo sapiens
tgggctgcctggcctctg

SEQ ID NO: 7702524 - DNA, 18 bp, Homo sapiens
tgggctgcctggcctctg

SEQ ID NO: 7702525 - DNA, 22 bp, Homo sapiens
tgggctggcgtggagagtttag

SEQ ID NO: 7702526 - DNA, 22 bp, Homo sapiens
tgggctggcccaccacacctcg

SEQ ID NO: 7702527 - DNA, 22 bp, Homo sapiens
tgggctggctgaggcattcact

SEQ ID NO: 7702528 - DNA, 22 bp, Homo sapiens
tgggctggctgaggcattcact

SEQ ID NO: 7702529 - DNA, 22 bp, Homo sapiens
tgggctggctgaggcattcact

SEQ ID NO: 7702530 - DNA, 22 bp, Homo sapiens
tgggctggctgaacttcaacct

SEQ ID NO: 7702531 - DNA, 22 bp, Homo sapiens
tgggctggctgaacttcaacct

SEQ ID NO: 7702532 - DNA, 22 bp, Homo sapiens
tgggctggctgaggcattcact

SEQ ID NO: 7702533 - DNA, 22 bp, Homo sapiens
tgggctggctgaggcattcact

SEQ ID NO: 7702534 - DNA, 22 bp, Homo sapiens
tgggctggctgaggcattcact

SEQ ID NO: 7702535 - DNA, 22 bp, Homo sapiens
tgggctggctgaggcattcact

SEQ ID NO: 7702536 - DNA, 22 bp, Homo sapiens
tgggctggctgaggcattcact

SEQ ID NO: 7702537 - DNA, 22 bp, Homo sapiens
tgggctggtgagggatcattta

SEQ ID NO: 7702538 - DNA, 22 bp, Homo sapiens
tgggctggtgagggatcattta

SEQ ID NO: 7702539 - DNA, 22 bp, Homo sapiens
tgggctggtgagggatcattta

SEQ ID NO: 7702540 - DNA, 22 bp, Homo sapiens
tgggctggtgagggatcattta

SEQ ID NO: 7702541 - DNA, 22 bp, Homo sapiens
tgggctggctgaggcattcact

SEQ ID NO: 7702542 - DNA, 22 bp, Homo sapiens
tgggctggctgaggcattcact

SEQ ID NO: 7702543 - DNA, 22 bp, Homo sapiens
tgggctggtgagggatcattta

SEQ ID NO: 7702544 - DNA, 22 bp, Homo sapiens
tgggctggtgagggatcattta

SEQ ID NO: 7702545 - DNA, 22 bp, Homo sapiens
tgggctgtccagcacctgggct

SEQ ID NO: 7702546 - DNA, 22 bp, Homo sapiens
tgggctggtgagggatcattta

SEQ ID NO: 7702547 - DNA, 22 bp, Homo sapiens
tggggaaagatagttttctcta

SEQ ID NO: 7702548 - DNA, 22 bp, Homo sapiens
tggggaaagacattcatacagt

SEQ ID NO: 7702549 - DNA, 22 bp, Homo sapiens
tggggaaagacattcatacagt

SEQ ID NO: 7702550 - DNA, 22 bp, Homo sapiens
tggggaaaatgcttgtagtcag

SEQ ID NO: 7702551 - DNA, 22 bp, Homo sapiens
tggggaaaggagagcattattt

SEQ ID NO: 7702552 - DNA, 22 bp, Homo sapiens
tggggaaaggagagcattattt

SEQ ID NO: 7702553 - DNA, 22 bp, Homo sapiens
tggggaaaggagagcattattt

SEQ ID NO: 7702554 - DNA, 22 bp, Homo sapiens
tggggaagacagcagacactgt

SEQ ID NO: 7702555 - DNA, 22 bp, Homo sapiens
tggggaagcactttgaacttaa

SEQ ID NO: 7702556 - DNA, 22 bp, Homo sapiens
tggggaagcactttgaacttaa

SEQ ID NO: 7702557 - DNA, 22 bp, Homo sapiens
tggggaagacagcagacactgt

SEQ ID NO: 7702558 - DNA, 22 bp, Homo sapiens
tggggaagacagcagacactgt

SEQ ID NO: 7702559 - DNA, 22 bp, Homo sapiens
tggggaagacagcagacactgt

SEQ ID NO: 7702560 - DNA, 22 bp, Homo sapiens
tggggaagacagcagacactgt

SEQ ID NO: 7702561 - DNA, 17 bp, Homo sapiens
tggggaagctcagattt

SEQ ID NO: 7702562 - DNA, 17 bp, Homo sapiens
tggggaagctcagattt

SEQ ID NO: 7702563 - DNA, 17 bp, Homo sapiens
tggggaagctcagattt

SEQ ID NO: 7702564 - DNA, 22 bp, Homo sapiens
tggggaagcactttgaacttaa

SEQ ID NO: 7702565 - DNA, 22 bp, Homo sapiens
tggggaagcactttgaacttaa

SEQ ID NO: 7702566 - DNA, 22 bp, Homo sapiens
tggggaagacagcagacactgt

SEQ ID NO: 7702567 - DNA, 22 bp, Homo sapiens
tggggaagacagcagacactgt

SEQ ID NO: 7702568 - DNA, 22 bp, Homo sapiens
tggggaagacagcagacactgt

SEQ ID NO: 7702569 - DNA, 22 bp, Homo sapiens
tggggaagacagcagacactgt

SEQ ID NO: 7702570 - DNA, 22 bp, Homo sapiens
tggggaagaataatgtatgtac

SEQ ID NO: 7702571 - DNA, 22 bp, Homo sapiens
tggggaagacagcagacactgt

SEQ ID NO: 7702572 - DNA, 22 bp, Homo sapiens
tggggaagacagcagacactgt

SEQ ID NO: 7702573 - DNA, 22 bp, Homo sapiens
tggggaagaataatgtatgtac

SEQ ID NO: 7702574 - DNA, 22 bp, Homo sapiens
tggggaagaataatgtatgtac

SEQ ID NO: 7702575 - DNA, 22 bp, Homo sapiens
tggggaagaataatgtatgtac

SEQ ID NO: 7702576 - DNA, 22 bp, Homo sapiens
tggggaagaataatgtatgtac

SEQ ID NO: 7702577 - DNA, 22 bp, Homo sapiens
tggggaagaataatgtatgtac

SEQ ID NO: 7702578 - DNA, 22 bp, Homo sapiens
tggggaaagttcttgaaagtaa

SEQ ID NO: 7702579 - DNA, 22 bp, Homo sapiens
tggggacacagagccaaactat

SEQ ID NO: 7702580 - DNA, 22 bp, Homo sapiens
tggggacacagagccaaactat

SEQ ID NO: 7702581 - DNA, 22 bp, Homo sapiens
tggggacacagagccaaactat

SEQ ID NO: 7702582 - DNA, 22 bp, Homo sapiens
tggggacacagagccaaactat

SEQ ID NO: 7702583 - DNA, 22 bp, Homo sapiens
tggggacaggagacttacagct

SEQ ID NO: 7702584 - DNA, 22 bp, Homo sapiens
tggggacacagaggttcgttgg

SEQ ID NO: 7702585 - DNA, 22 bp, Homo sapiens
tggggaagggcaccctggagac

SEQ ID NO: 7702586 - DNA, 22 bp, Homo sapiens
tggggaagggcaccctggagac

SEQ ID NO: 7702587 - DNA, 22 bp, Homo sapiens
tggggaagggcaccctggagac

SEQ ID NO: 7702588 - DNA, 22 bp, Homo sapiens
tggggaagggcaccctggagac

SEQ ID NO: 7702589 - DNA, 22 bp, Homo sapiens
tggggaaggcggagcttgcagc

SEQ ID NO: 7702590 - DNA, 22 bp, Homo sapiens
tggggaagggcaccctggagac

SEQ ID NO: 7702591 - DNA, 22 bp, Homo sapiens
tggggaaggcggagcttgcagc

SEQ ID NO: 7702592 - DNA, 22 bp, Homo sapiens
tggggaaggcggagcttgcagc

SEQ ID NO: 7702593 - DNA, 22 bp, Homo sapiens
tggggaaggcggagcttgcagc

SEQ ID NO: 7702594 - DNA, 22 bp, Homo sapiens
tggggaaggcggagcttgcagc

SEQ ID NO: 7702595 - DNA, 22 bp, Homo sapiens
tggggaaggatcaccacaatct

SEQ ID NO: 7702596 - DNA, 22 bp, Homo sapiens
tggggaaggatcaccacaatct

SEQ ID NO: 7702597 - DNA, 22 bp, Homo sapiens
tggggaaggcggagcttgcagc

SEQ ID NO: 7702598 - DNA, 22 bp, Homo sapiens
tggggaaggatcaccacaatct

SEQ ID NO: 7702599 - DNA, 16 bp, Homo sapiens
tggggaagctcgtgag

SEQ ID NO: 7702600 - DNA, 22 bp, Homo sapiens
tggggaaggatcaccacaatct

SEQ ID NO: 7702601 - DNA, 16 bp, Homo sapiens
tggggaagctcgtgag

SEQ ID NO: 7702602 - DNA, 16 bp, Homo sapiens
tggggaagctcgtgag

SEQ ID NO: 7702603 - DNA, 17 bp, Homo sapiens
tggggaagctcagattt

SEQ ID NO: 7702604 - DNA, 17 bp, Homo sapiens
tggggaagctcagattt

SEQ ID NO: 7702605 - DNA, 17 bp, Homo sapiens
tggggaagctcagattt

SEQ ID NO: 7702606 - DNA, 17 bp, Homo sapiens
tggggaagctcagattt

SEQ ID NO: 7702607 - DNA, 17 bp, Homo sapiens
tggggaagctcagattt

SEQ ID NO: 7702608 - DNA, 17 bp, Homo sapiens
tggggaagctcagattt

SEQ ID NO: 7702609 - DNA, 22 bp, Homo sapiens
tggggcgcgaggtcctggctcc

SEQ ID NO: 7702610 - DNA, 22 bp, Homo sapiens
tggggcgcgaggtcctggctcc

SEQ ID NO: 7702611 - DNA, 22 bp, Homo sapiens
tggggcgcgaggtcctggctcc

SEQ ID NO: 7702612 - DNA, 22 bp, Homo sapiens
tggggcgcccccactccacaga

SEQ ID NO: 7702613 - DNA, 22 bp, Homo sapiens
tggggccttggcctcattagat

SEQ ID NO: 7702614 - DNA, 20 bp, Homo sapiens
tggggcctgtttctgtggtt

SEQ ID NO: 7702615 - DNA, 20 bp, Homo sapiens
tggggcctgtttctgtggtt

SEQ ID NO: 7702616 - DNA, 20 bp, Homo sapiens
tggggcctgtttctgtggtt

SEQ ID NO: 7702617 - DNA, 22 bp, Homo sapiens
tggggctcacctaggctggaag

SEQ ID NO: 7702618 - DNA, 22 bp, Homo sapiens
tggggctagaatcctgcaggaa

SEQ ID NO: 7702619 - DNA, 22 bp, Homo sapiens
tggggctagaatcctgcaggaa

SEQ ID NO: 7702620 - DNA, 22 bp, Homo sapiens
tggggctaaacacgcctggcct

SEQ ID NO: 7702621 - DNA, 22 bp, Homo sapiens
tggggctaaacacgcctggcct

SEQ ID NO: 7702622 - DNA, 22 bp, Homo sapiens
tggggctaaacacgcctggcct

SEQ ID NO: 7702623 - DNA, 22 bp, Homo sapiens
tggggctaacgagagagcagag

SEQ ID NO: 7702624 - DNA, 22 bp, Homo sapiens
tggggctaacgagagagcagag

SEQ ID NO: 7702625 - DNA, 22 bp, Homo sapiens
tggggcctggtcagagctgcac

SEQ ID NO: 7702626 - DNA, 22 bp, Homo sapiens
tggggcctggtcagagctgcac

SEQ ID NO: 7702627 - DNA, 22 bp, Homo sapiens
tggggcctggtcagagctgcac

SEQ ID NO: 7702628 - DNA, 22 bp, Homo sapiens
tggggcctggtcagagctgcac

SEQ ID NO: 7702629 - DNA, 22 bp, Homo sapiens
tggggcctggtcagagctgcac

SEQ ID NO: 7702630 - DNA, 22 bp, Homo sapiens
tggggcctggtcagagctgcac

SEQ ID NO: 7702631 - DNA, 22 bp, Homo sapiens
tggggcctgtgacgggtccaga

SEQ ID NO: 7702632 - DNA, 20 bp, Homo sapiens
tggggcctgtttctgtggtt

SEQ ID NO: 7702633 - DNA, 22 bp, Homo sapiens
tggggcctgaggtggagctgca

SEQ ID NO: 7702634 - DNA, 22 bp, Homo sapiens
tggggcctgaggtggagctgca

SEQ ID NO: 7702635 - DNA, 22 bp, Homo sapiens
tggggcctgcacaggctgaatg

SEQ ID NO: 7702636 - DNA, 22 bp, Homo sapiens
tggggcctgcacaggctgaatg

SEQ ID NO: 7702637 - DNA, 22 bp, Homo sapiens
tggggcctgcacaggctgaatg

SEQ ID NO: 7702638 - DNA, 22 bp, Homo sapiens
tggggcctgaggtggagctgca

SEQ ID NO: 7702639 - DNA, 22 bp, Homo sapiens
tggggcctgaggtggagctgca

SEQ ID NO: 7702640 - DNA, 22 bp, Homo sapiens
tggggctgaggagcctcactct

SEQ ID NO: 7702641 - DNA, 23 bp, Homo sapiens
tggggctctggcaggcctgaggt

SEQ ID NO: 7702642 - DNA, 22 bp, Homo sapiens
tggggctgaggagcctcactct

SEQ ID NO: 7702643 - DNA, 23 bp, Homo sapiens
tggggctctggcaggcctgaggt

SEQ ID NO: 7702644 - DNA, 22 bp, Homo sapiens
tggggctgaggagcctcactct

SEQ ID NO: 7702645 - DNA, 22 bp, Homo sapiens
tggggctgaggagcctcactct

SEQ ID NO: 7702646 - DNA, 22 bp, Homo sapiens
tggggctgaggagcctcactct

SEQ ID NO: 7702647 - DNA, 22 bp, Homo sapiens
tggggctgaggagcctcactct

SEQ ID NO: 7702648 - DNA, 22 bp, Homo sapiens
tggggctgaggagcctcactct

SEQ ID NO: 7702649 - DNA, 22 bp, Homo sapiens
tggggctgaggagcctcactct

SEQ ID NO: 7702650 - DNA, 22 bp, Homo sapiens
tggggctgaggagcctcactct

SEQ ID NO: 7702651 - DNA, 23 bp, Homo sapiens
tggggctgatggagacggaccag

SEQ ID NO: 7702652 - DNA, 23 bp, Homo sapiens
tggggctgatggagacggaccag

SEQ ID NO: 7702653 - DNA, 23 bp, Homo sapiens
tggggctgatggagacggaccag

SEQ ID NO: 7702654 - DNA, 23 bp, Homo sapiens
tggggctgatggagacggaccag

SEQ ID NO: 7702655 - DNA, 23 bp, Homo sapiens
tggggctgatggagacggaccag

SEQ ID NO: 7702656 - DNA, 22 bp, Homo sapiens
tggggctggcacagtctctatt

SEQ ID NO: 7702657 - DNA, 22 bp, Homo sapiens
tggggctggcacagtctctatt

SEQ ID NO: 7702658 - DNA, 22 bp, Homo sapiens
tggggctggcacagtctctatt

SEQ ID NO: 7702659 - DNA, 22 bp, Homo sapiens
tggggctggcacagtctctatt

SEQ ID NO: 7702660 - DNA, 22 bp, Homo sapiens
tggggctctccacagtgtctca

SEQ ID NO: 7702661 - DNA, 22 bp, Homo sapiens
tggggctctccacagtgtctca

SEQ ID NO: 7702662 - DNA, 22 bp, Homo sapiens
tggggctctccacagtgtctca

SEQ ID NO: 7702663 - DNA, 23 bp, Homo sapiens
tggggctctggcaggcctgaggt

SEQ ID NO: 7702664 - DNA, 23 bp, Homo sapiens
tggggctctggcaggcctgaggt

SEQ ID NO: 7702665 - DNA, 22 bp, Homo sapiens
tggggctctccacagtgtctca

SEQ ID NO: 7702666 - DNA, 22 bp, Homo sapiens
tggggctctccacagtgtctca

SEQ ID NO: 7702667 - DNA, 22 bp, Homo sapiens
tggggctctccacagtgtctca

SEQ ID NO: 7702668 - DNA, 22 bp, Homo sapiens
tggggctctccacagtgtctca

SEQ ID NO: 7702669 - DNA, 22 bp, Homo sapiens
tggggctcatgcctgctggaac

SEQ ID NO: 7702670 - DNA, 22 bp, Homo sapiens
tggggctcctcctggcaggagg

SEQ ID NO: 7702671 - DNA, 22 bp, Homo sapiens
tggggctcctcctggcaggagg

SEQ ID NO: 7702672 - DNA, 22 bp, Homo sapiens
tggggctcctcctggcaggagg

SEQ ID NO: 7702673 - DNA, 22 bp, Homo sapiens
tggggctcatgcctgctggaac

SEQ ID NO: 7702674 - DNA, 22 bp, Homo sapiens
tggggctcatgcctgctggaac

SEQ ID NO: 7702675 - DNA, 22 bp, Homo sapiens
tggggctcacctaggctggaag

SEQ ID NO: 7702676 - DNA, 22 bp, Homo sapiens
tggggctcatgcctgctggaac

SEQ ID NO: 7702677 - DNA, 22 bp, Homo sapiens
tggggctcatgcctgctggaac

SEQ ID NO: 7702678 - DNA, 22 bp, Homo sapiens
tggggctcatgcctgctggaac

SEQ ID NO: 7702679 - DNA, 22 bp, Homo sapiens
tggggctcatgcctgctggaac

SEQ ID NO: 7702680 - DNA, 22 bp, Homo sapiens
tggggccagcggggaggactca

SEQ ID NO: 7702681 - DNA, 22 bp, Homo sapiens
tggggccagcggggaggactca

SEQ ID NO: 7702682 - DNA, 22 bp, Homo sapiens
tggggccagcggggaggactca

SEQ ID NO: 7702683 - DNA, 22 bp, Homo sapiens
tggggccagcggggaggactca

SEQ ID NO: 7702684 - DNA, 22 bp, Homo sapiens
tggggccagcggggaggactca

SEQ ID NO: 7702685 - DNA, 22 bp, Homo sapiens
tggggccagcggggaggactca

SEQ ID NO: 7702686 - DNA, 22 bp, Homo sapiens
tggggccagcggggaggactca

SEQ ID NO: 7702687 - DNA, 22 bp, Homo sapiens
tggggccagcggggaggactca

SEQ ID NO: 7702688 - DNA, 22 bp, Homo sapiens
tggggccagggaggaccagaca

SEQ ID NO: 7702689 - DNA, 22 bp, Homo sapiens
tggggccagggaggaccagaca

SEQ ID NO: 7702690 - DNA, 22 bp, Homo sapiens
tggggccaggtggctgcaggtc

SEQ ID NO: 7702691 - DNA, 22 bp, Homo sapiens
tggggccaggtggctgcaggtc

SEQ ID NO: 7702692 - DNA, 22 bp, Homo sapiens
tggggccaggtggctgcaggtc

SEQ ID NO: 7702693 - DNA, 22 bp, Homo sapiens
tggggcctgaggtggagctgca

SEQ ID NO: 7702694 - DNA, 22 bp, Homo sapiens
tggggcctgaggtggagctgca

SEQ ID NO: 7702695 - DNA, 22 bp, Homo sapiens
tggggcctgaggtggagctgca

SEQ ID NO: 7702696 - DNA, 22 bp, Homo sapiens
tggggcctgaggtggagctgca

SEQ ID NO: 7702697 - DNA, 22 bp, Homo sapiens
tggggcctgaaaggttctcgcc

SEQ ID NO: 7702698 - DNA, 22 bp, Homo sapiens
tggggcctgaaaggttctcgcc

SEQ ID NO: 7702699 - DNA, 19 bp, Homo sapiens
tggggcctcctgtccctgg

SEQ ID NO: 7702700 - DNA, 19 bp, Homo sapiens
tggggcctcctgtccctgg

SEQ ID NO: 7702701 - DNA, 22 bp, Homo sapiens
tggggcctcaggccttttccta

SEQ ID NO: 7702702 - DNA, 19 bp, Homo sapiens
tggggcctcctgtccctgg

SEQ ID NO: 7702703 - DNA, 22 bp, Homo sapiens
tggggccatctcacccactgtt

SEQ ID NO: 7702704 - DNA, 22 bp, Homo sapiens
tggggccatctcacccactgtt

SEQ ID NO: 7702705 - DNA, 22 bp, Homo sapiens
tggggccaggtggctgcaggtc

SEQ ID NO: 7702706 - DNA, 22 bp, Homo sapiens
tggggccaggtggctgcaggtc

SEQ ID NO: 7702707 - DNA, 22 bp, Homo sapiens
tggggccaggtggctgcaggtc

SEQ ID NO: 7702708 - DNA, 22 bp, Homo sapiens
tggggccagagctgcagggagc

SEQ ID NO: 7702709 - DNA, 22 bp, Homo sapiens
tggggccagagatggggcgcag

SEQ ID NO: 7702710 - DNA, 22 bp, Homo sapiens
tggggccagagctgcagggagc

SEQ ID NO: 7702711 - DNA, 22 bp, Homo sapiens
tggggccagagctgcagggagc

SEQ ID NO: 7702712 - DNA, 22 bp, Homo sapiens
tggggccagagctgcagggagc

SEQ ID NO: 7702713 - DNA, 22 bp, Homo sapiens
tggggccagagctgcagggagc

SEQ ID NO: 7702714 - DNA, 22 bp, Homo sapiens
tggggccagagctgcagggagc

SEQ ID NO: 7702715 - DNA, 22 bp, Homo sapiens
tggggccagagatggggcgcag

SEQ ID NO: 7702716 - DNA, 22 bp, Homo sapiens
tggggccacagcctcctagctt

SEQ ID NO: 7702717 - DNA, 22 bp, Homo sapiens
tggggccacagcctcctagctt

SEQ ID NO: 7702718 - DNA, 22 bp, Homo sapiens
tggggccacagcctcctagctt

SEQ ID NO: 7702719 - DNA, 22 bp, Homo sapiens
tggggcagcagacctttcttgg

SEQ ID NO: 7702720 - DNA, 22 bp, Homo sapiens
tggggcagcagacctttcttgg

SEQ ID NO: 7702721 - DNA, 22 bp, Homo sapiens
tggggccacagcctcctagctt

SEQ ID NO: 7702722 - DNA, 22 bp, Homo sapiens
tggggcagagtaggattttggc

SEQ ID NO: 7702723 - DNA, 22 bp, Homo sapiens
tggggcagagtaggattttggc

SEQ ID NO: 7702724 - DNA, 22 bp, Homo sapiens
tggggcagagtaggattttggc

SEQ ID NO: 7702725 - DNA, 22 bp, Homo sapiens
tggggcagagtaggattttggc

SEQ ID NO: 7702726 - DNA, 22 bp, Homo sapiens
tggggcagcagacctttcttgg

SEQ ID NO: 7702727 - DNA, 22 bp, Homo sapiens
tggggcagcagacctttcttgg

SEQ ID NO: 7702728 - DNA, 22 bp, Homo sapiens
tggggcacagctgagaaagcac

SEQ ID NO: 7702729 - DNA, 22 bp, Homo sapiens
tggggcaagaagtgccctgaag

SEQ ID NO: 7702730 - DNA, 20 bp, Homo sapiens
tggggcacatgcagattggt

SEQ ID NO: 7702731 - DNA, 22 bp, Homo sapiens
tggggcacttatgatgtgccac

SEQ ID NO: 7702732 - DNA, 22 bp, Homo sapiens
tggggcacttatgatgtgccac

SEQ ID NO: 7702733 - DNA, 22 bp, Homo sapiens
tggggcagagtaggattttggc

SEQ ID NO: 7702734 - DNA, 22 bp, Homo sapiens
tggggcagagtaggattttggc

SEQ ID NO: 7702735 - DNA, 22 bp, Homo sapiens
tgggggcatggaccagcctggc

SEQ ID NO: 7702736 - DNA, 22 bp, Homo sapiens
tgggggcatggaccagcctggc

SEQ ID NO: 7702737 - DNA, 22 bp, Homo sapiens
tgggggcatggaccagcctggc

SEQ ID NO: 7702738 - DNA, 22 bp, Homo sapiens
tgggggcatggaccagcctggc

SEQ ID NO: 7702739 - DNA, 22 bp, Homo sapiens
tgggggcatggaccagcctggc

SEQ ID NO: 7702740 - DNA, 22 bp, Homo sapiens
tgggggcatggaccagcctggc

SEQ ID NO: 7702741 - DNA, 22 bp, Homo sapiens
tgggggcatggaccagcctggc

SEQ ID NO: 7702742 - DNA, 22 bp, Homo sapiens
tgggggcatggaccagcctggc

SEQ ID NO: 7702743 - DNA, 22 bp, Homo sapiens
tgggggcagccaggctgtcaag

SEQ ID NO: 7702744 - DNA, 22 bp, Homo sapiens
tgggggcagccaggctgtcaag

SEQ ID NO: 7702745 - DNA, 22 bp, Homo sapiens
tgggggcagccaggctgtcaag

SEQ ID NO: 7702746 - DNA, 22 bp, Homo sapiens
tgggggcagccaggctgtcaag

SEQ ID NO: 7702747 - DNA, 22 bp, Homo sapiens
tgggggcagccaggctgtcaag

SEQ ID NO: 7702748 - DNA, 22 bp, Homo sapiens
tgggggcagccaggctgtcaag

SEQ ID NO: 7702749 - DNA, 22 bp, Homo sapiens
tgggggcagccaggctgtcaag

SEQ ID NO: 7702750 - DNA, 22 bp, Homo sapiens
tgggggcagaggattcaggaat

SEQ ID NO: 7702751 - DNA, 22 bp, Homo sapiens
tgggggcacttcgaggtcgcct

SEQ ID NO: 7702752 - DNA, 22 bp, Homo sapiens
tgggggcagaggattcaggaat

SEQ ID NO: 7702753 - DNA, 22 bp, Homo sapiens
tgggggcatggaccagcctggc

SEQ ID NO: 7702754 - DNA, 17 bp, Homo sapiens
tgggggcgccagggtct

SEQ ID NO: 7702755 - DNA, 22 bp, Homo sapiens
tgggggcatggaccagcctggc

SEQ ID NO: 7702756 - DNA, 17 bp, Homo sapiens
tgggggcgccagggtct

SEQ ID NO: 7702757 - DNA, 17 bp, Homo sapiens
tgggggcgccagggtct

SEQ ID NO: 7702758 - DNA, 17 bp, Homo sapiens
tgggggcgccagggtct

SEQ ID NO: 7702759 - DNA, 22 bp, Homo sapiens
tgggggctagaacccagggatt

SEQ ID NO: 7702760 - DNA, 22 bp, Homo sapiens
tgggggctagaacccagggatt

SEQ ID NO: 7702761 - DNA, 22 bp, Homo sapiens
tgggggctagaacccagggatt

SEQ ID NO: 7702762 - DNA, 22 bp, Homo sapiens
tgggggctccaggctccaggga

SEQ ID NO: 7702763 - DNA, 22 bp, Homo sapiens
tgggggctccaggctccaggga

SEQ ID NO: 7702764 - DNA, 22 bp, Homo sapiens
tgggggctccaggctccaggga

SEQ ID NO: 7702765 - DNA, 22 bp, Homo sapiens
tgggggctgggatgtcactttc

SEQ ID NO: 7702766 - DNA, 22 bp, Homo sapiens
tgggggctgggatgtcactttc

SEQ ID NO: 7702767 - DNA, 22 bp, Homo sapiens
tgggggctgagtaagatgagat

SEQ ID NO: 7702768 - DNA, 22 bp, Homo sapiens
tgggggctgagtaagatgagat

SEQ ID NO: 7702769 - DNA, 22 bp, Homo sapiens
tgggggctgagtaagatgagat

SEQ ID NO: 7702770 - DNA, 22 bp, Homo sapiens
tgggggctgagtaagatgagat

SEQ ID NO: 7702771 - DNA, 22 bp, Homo sapiens
tgggggctccaggctccaggga

SEQ ID NO: 7702772 - DNA, 22 bp, Homo sapiens
tgggggctccaggctccaggga

SEQ ID NO: 7702773 - DNA, 22 bp, Homo sapiens
tgggggctccaggctccaggga

SEQ ID NO: 7702774 - DNA, 22 bp, Homo sapiens
tgggggagtatagtctggcctc

SEQ ID NO: 7702775 - DNA, 22 bp, Homo sapiens
tgggggagtatagtctggcctc

SEQ ID NO: 7702776 - DNA, 22 bp, Homo sapiens
tgggggagtatagtctggcctc

SEQ ID NO: 7702777 - DNA, 22 bp, Homo sapiens
tgggggagtatagtctggcctc

SEQ ID NO: 7702778 - DNA, 22 bp, Homo sapiens
tgggggagtatagtctggcctc

SEQ ID NO: 7702779 - DNA, 22 bp, Homo sapiens
tgggggagtatagtctggcctc

SEQ ID NO: 7702780 - DNA, 22 bp, Homo sapiens
tgggggagctcagtccagccca

SEQ ID NO: 7702781 - DNA, 22 bp, Homo sapiens
tgggggagctcagtccagccca

SEQ ID NO: 7702782 - DNA, 22 bp, Homo sapiens
tgggggcacttcgaggtcgcct

SEQ ID NO: 7702783 - DNA, 22 bp, Homo sapiens
tgggggcacttcgaggtcgcct

SEQ ID NO: 7702784 - DNA, 22 bp, Homo sapiens
tgggggcacttcgaggtcgcct

SEQ ID NO: 7702785 - DNA, 22 bp, Homo sapiens
tgggggcacttcgaggtcgcct

SEQ ID NO: 7702786 - DNA, 22 bp, Homo sapiens
tgggggagtatagtctggcctc

SEQ ID NO: 7702787 - DNA, 22 bp, Homo sapiens
tgggggcacttcgaggtcgcct

SEQ ID NO: 7702788 - DNA, 22 bp, Homo sapiens
tgggggcacttcgaggtcgcct

SEQ ID NO: 7702789 - DNA, 22 bp, Homo sapiens
tgggggcacttcgaggtcgcct

SEQ ID NO: 7702790 - DNA, 22 bp, Homo sapiens
tgggggcacttcgaggtcgcct

SEQ ID NO: 7702791 - DNA, 22 bp, Homo sapiens
tgggggagattgtgcatctcta

SEQ ID NO: 7702792 - DNA, 22 bp, Homo sapiens
tgggggagccttcacagtagct

SEQ ID NO: 7702793 - DNA, 22 bp, Homo sapiens
tgggggagccttcacagtagct

SEQ ID NO: 7702794 - DNA, 22 bp, Homo sapiens
tgggggagccttcacagtagct

SEQ ID NO: 7702795 - DNA, 22 bp, Homo sapiens
tgggggagccttcacagtagct

SEQ ID NO: 7702796 - DNA, 22 bp, Homo sapiens
tgggggagccttcacagtagct

SEQ ID NO: 7702797 - DNA, 22 bp, Homo sapiens
tgggggagccttcacagtagct

SEQ ID NO: 7702798 - DNA, 22 bp, Homo sapiens
tgggggagctcagtccagccca

SEQ ID NO: 7702799 - DNA, 22 bp, Homo sapiens
tgggggagctcagtccagccca

SEQ ID NO: 7702800 - DNA, 22 bp, Homo sapiens
tgggggagctcagtccagccca

SEQ ID NO: 7702801 - DNA, 22 bp, Homo sapiens
tgggggagctcagtccagccca

SEQ ID NO: 7702802 - DNA, 22 bp, Homo sapiens
tgggggagccttcacagtagct

SEQ ID NO: 7702803 - DNA, 22 bp, Homo sapiens
tgggggagccttcacagtagct

SEQ ID NO: 7702804 - DNA, 22 bp, Homo sapiens
tgggggagcgacagacataatt

SEQ ID NO: 7702805 - DNA, 22 bp, Homo sapiens
tgggggagcgacagacataatt

SEQ ID NO: 7702806 - DNA, 22 bp, Homo sapiens
tgggggagcgacagacataatt

SEQ ID NO: 7702807 - DNA, 22 bp, Homo sapiens
tgggggagcgacagacataatt

SEQ ID NO: 7702808 - DNA, 22 bp, Homo sapiens
tgggggagcgacagacataatt

SEQ ID NO: 7702809 - DNA, 22 bp, Homo sapiens
tggggctggggatcttgagcct

SEQ ID NO: 7702810 - DNA, 22 bp, Homo sapiens
tggggctggggatcttgagcct

SEQ ID NO: 7702811 - DNA, 22 bp, Homo sapiens
tggggctggggatcttgagcct

SEQ ID NO: 7702812 - DNA, 22 bp, Homo sapiens
tggggctggggatcttgagcct

SEQ ID NO: 7702813 - DNA, 22 bp, Homo sapiens
tggggctgtcccggtttggcga

SEQ ID NO: 7702814 - DNA, 22 bp, Homo sapiens
tggggctgtcccggtttggcga

SEQ ID NO: 7702815 - DNA, 22 bp, Homo sapiens
tggggctgtcccggtttggcga

SEQ ID NO: 7702816 - DNA, 22 bp, Homo sapiens
tggggctgtccttagtctgaga

SEQ ID NO: 7702817 - DNA, 22 bp, Homo sapiens
tggggctgtcccggtttggcga

SEQ ID NO: 7702818 - DNA, 22 bp, Homo sapiens
tggggctgtcccggtttggcga

SEQ ID NO: 7702819 - DNA, 22 bp, Homo sapiens
tggggctgtcccggtttggcga

SEQ ID NO: 7702820 - DNA, 22 bp, Homo sapiens
tggggctgtccttagtctgaga

SEQ ID NO: 7702821 - DNA, 22 bp, Homo sapiens
tggggctgtccttagtctgaga

SEQ ID NO: 7702822 - DNA, 22 bp, Homo sapiens
tggggctgtccttagtctgaga

SEQ ID NO: 7702823 - DNA, 22 bp, Homo sapiens
tggggctgtccttagtctgaga

SEQ ID NO: 7702824 - DNA, 22 bp, Homo sapiens
tggggctgtccttagtctgaga

SEQ ID NO: 7702825 - DNA, 22 bp, Homo sapiens
tggggctgtccttagtctgaga

SEQ ID NO: 7702826 - DNA, 22 bp, Homo sapiens
tggggctgtccttagtctgaga

SEQ ID NO: 7702827 - DNA, 22 bp, Homo sapiens
tggggctggggatcttgagcct

SEQ ID NO: 7702828 - DNA, 22 bp, Homo sapiens
tggggctggggatcttgagcct

SEQ ID NO: 7702829 - DNA, 22 bp, Homo sapiens
tggggctggggatcttgagcct

SEQ ID NO: 7702830 - DNA, 22 bp, Homo sapiens
tggggctggggatcttgagcct

SEQ ID NO: 7702831 - DNA, 22 bp, Homo sapiens
tggggctggctattgtctccct

SEQ ID NO: 7702832 - DNA, 22 bp, Homo sapiens
tggggctggctattgtctccct

SEQ ID NO: 7702833 - DNA, 22 bp, Homo sapiens
tggggctggctattgtctccct

SEQ ID NO: 7702834 - DNA, 22 bp, Homo sapiens
tggggctggctattgtctccct

SEQ ID NO: 7702835 - DNA, 22 bp, Homo sapiens
tggggctggctattgtctccct

SEQ ID NO: 7702836 - DNA, 22 bp, Homo sapiens
tggggctggctattgtctccct

SEQ ID NO: 7702837 - DNA, 22 bp, Homo sapiens
tggggctggctattgtctccct

SEQ ID NO: 7702838 - DNA, 22 bp, Homo sapiens
tggggctggctattgtctccct

SEQ ID NO: 7702839 - DNA, 22 bp, Homo sapiens
tggggctggctattgtctccct

SEQ ID NO: 7702840 - DNA, 22 bp, Homo sapiens
tggggctggctattgtctccct

SEQ ID NO: 7702841 - DNA, 22 bp, Homo sapiens
tggggctggcacagtctctatt

SEQ ID NO: 7702842 - DNA, 22 bp, Homo sapiens
tggggctggcacagtctctatt

SEQ ID NO: 7702843 - DNA, 22 bp, Homo sapiens
tggggctgtccttagtctgaga

SEQ ID NO: 7702844 - DNA, 22 bp, Homo sapiens
tggggctgtccttagtctgaga

SEQ ID NO: 7702845 - DNA, 22 bp, Homo sapiens
tggggctgtccttagtctgaga

SEQ ID NO: 7702846 - DNA, 22 bp, Homo sapiens
tggggctgtccttagtctgaga

SEQ ID NO: 7702847 - DNA, 22 bp, Homo sapiens
tgggggagagtgcaagcatgaa

SEQ ID NO: 7702848 - DNA, 22 bp, Homo sapiens
tgggggagagtgcaagcatgaa

SEQ ID NO: 7702849 - DNA, 22 bp, Homo sapiens
tgggggagagtgcaagcatgaa

SEQ ID NO: 7702850 - DNA, 22 bp, Homo sapiens
tgggggagagtgcaagcatgaa

SEQ ID NO: 7702851 - DNA, 22 bp, Homo sapiens
tgggggagagtgcaagcatgaa

SEQ ID NO: 7702852 - DNA, 22 bp, Homo sapiens
tgggggagagtgcaagcatgaa

SEQ ID NO: 7702853 - DNA, 22 bp, Homo sapiens
tgggggagagtttagatgattt

SEQ ID NO: 7702854 - DNA, 22 bp, Homo sapiens
tgggggagagtttagatgattt

SEQ ID NO: 7702855 - DNA, 22 bp, Homo sapiens
tgggggagagtttagatgattt

SEQ ID NO: 7702856 - DNA, 22 bp, Homo sapiens
tgggggagagtttagatgattt

SEQ ID NO: 7702857 - DNA, 22 bp, Homo sapiens
tgggggagagtgcaagcatgaa

SEQ ID NO: 7702858 - DNA, 22 bp, Homo sapiens
tgggggagagtgcaagcatgaa

SEQ ID NO: 7702859 - DNA, 22 bp, Homo sapiens
tgggggagagtgcaagcatgaa

SEQ ID NO: 7702860 - DNA, 22 bp, Homo sapiens
tgggggagagtgcaagcatgaa

SEQ ID NO: 7702861 - DNA, 22 bp, Homo sapiens
tgggggagatagagtctgatgg

SEQ ID NO: 7702862 - DNA, 22 bp, Homo sapiens
tgggggagatagagtctgatgg

SEQ ID NO: 7702863 - DNA, 22 bp, Homo sapiens
tgggggagatagagtctgatgg

SEQ ID NO: 7702864 - DNA, 22 bp, Homo sapiens
tgggggagatagagtctgatgg

SEQ ID NO: 7702865 - DNA, 22 bp, Homo sapiens
tgggggagatagagtctgatgg

SEQ ID NO: 7702866 - DNA, 22 bp, Homo sapiens
tgggggagattagagcttctta

SEQ ID NO: 7702867 - DNA, 22 bp, Homo sapiens
tgggggagattagagcttctta

SEQ ID NO: 7702868 - DNA, 22 bp, Homo sapiens
tgggggagattagagcttctta

SEQ ID NO: 7702869 - DNA, 22 bp, Homo sapiens
tgggggagattagagcttctta

SEQ ID NO: 7702870 - DNA, 22 bp, Homo sapiens
tgggggagattgtgcatctcta

SEQ ID NO: 7702871 - DNA, 22 bp, Homo sapiens
tgggggagattgtgcatctcta

SEQ ID NO: 7702872 - DNA, 22 bp, Homo sapiens
tgggggagattagagcttctta

SEQ ID NO: 7702873 - DNA, 22 bp, Homo sapiens
tgggggagattagagcttctta

SEQ ID NO: 7702874 - DNA, 22 bp, Homo sapiens
tgggggagattgtgcatctcta

SEQ ID NO: 7702875 - DNA, 22 bp, Homo sapiens
tgggggagattgtgcatctcta

SEQ ID NO: 7702876 - DNA, 22 bp, Homo sapiens
tgggggagattgtgcatctcta

SEQ ID NO: 7702877 - DNA, 22 bp, Homo sapiens
tgggggagattgtgcatctcta

SEQ ID NO: 7702878 - DNA, 22 bp, Homo sapiens
tgggggagattgtgcatctcta

SEQ ID NO: 7702879 - DNA, 22 bp, Homo sapiens
tgggggagattgtgcatctcta

SEQ ID NO: 7702880 - DNA, 22 bp, Homo sapiens
tgggggagattgtgcatctcta

SEQ ID NO: 7702881 - DNA, 22 bp, Homo sapiens
tggggtggggttactcattctg

SEQ ID NO: 7702882 - DNA, 22 bp, Homo sapiens
tggggtggggttactcattctg

SEQ ID NO: 7702883 - DNA, 22 bp, Homo sapiens
tggggtggggttactcattctg

SEQ ID NO: 7702884 - DNA, 22 bp, Homo sapiens
tggggtggggttactcattctg

SEQ ID NO: 7702885 - DNA, 22 bp, Homo sapiens
tggggtggggttactcattctg

SEQ ID NO: 7702886 - DNA, 22 bp, Homo sapiens
tggggtggggttactcattctg

SEQ ID NO: 7702887 - DNA, 22 bp, Homo sapiens
tggggtggggttactcattctg

SEQ ID NO: 7702888 - DNA, 22 bp, Homo sapiens
tggggtggggttactcattctg

SEQ ID NO: 7702889 - DNA, 22 bp, Homo sapiens
tggggtggggttactcattctg

SEQ ID NO: 7702890 - DNA, 22 bp, Homo sapiens
tggggtggggttactcattctg

SEQ ID NO: 7702891 - DNA, 22 bp, Homo sapiens
tggggtggggttactcattctg

SEQ ID NO: 7702892 - DNA, 22 bp, Homo sapiens
tggggtggggttactcattctg

SEQ ID NO: 7702893 - DNA, 22 bp, Homo sapiens
tggggtggtaatacaccgttct

SEQ ID NO: 7702894 - DNA, 22 bp, Homo sapiens
tggggtgggcatgcgctgtcct

SEQ ID NO: 7702895 - DNA, 22 bp, Homo sapiens
tggggtgggcatgcgctgtcct

SEQ ID NO: 7702896 - DNA, 22 bp, Homo sapiens
tggggtgggcatgcgctgtcct

SEQ ID NO: 7702897 - DNA, 22 bp, Homo sapiens
tggggtgggcatgcgctgtcct

SEQ ID NO: 7702898 - DNA, 22 bp, Homo sapiens
tggggtgggcatgcgctgtcct

SEQ ID NO: 7702899 - DNA, 22 bp, Homo sapiens
tggggtgggcatgcgctgtcct

SEQ ID NO: 7702900 - DNA, 22 bp, Homo sapiens
tggggtgggcatgcgctgtcct

SEQ ID NO: 7702901 - DNA, 22 bp, Homo sapiens
tggggtgggcatgcgctgtcct

SEQ ID NO: 7702902 - DNA, 22 bp, Homo sapiens
tggggtgggcatgcgctgtcct

SEQ ID NO: 7702903 - DNA, 22 bp, Homo sapiens
tggggtgggcatgcgctgtcct

SEQ ID NO: 7702904 - DNA, 22 bp, Homo sapiens
tggggtggtaatacaccgttct

SEQ ID NO: 7702905 - DNA, 22 bp, Homo sapiens
tggggtggtaatacaccgttct

SEQ ID NO: 7702906 - DNA, 22 bp, Homo sapiens
tggggtggtaatacaccgttct

SEQ ID NO: 7702907 - DNA, 22 bp, Homo sapiens
tggggtggtaatacaccgttct

SEQ ID NO: 7702908 - DNA, 22 bp, Homo sapiens
tggggtggtgggaaccaagtag

SEQ ID NO: 7702909 - DNA, 22 bp, Homo sapiens
tggggtggtgggaaccaagtag

SEQ ID NO: 7702910 - DNA, 22 bp, Homo sapiens
tggggtggtgggaaccaagtag

SEQ ID NO: 7702911 - DNA, 22 bp, Homo sapiens
tggggtggtgggaaccaagtag

SEQ ID NO: 7702912 - DNA, 22 bp, Homo sapiens
tggggtggtgggaaccaagtag

SEQ ID NO: 7702913 - DNA, 17 bp, Homo sapiens
tggggtgttgaagggtt

SEQ ID NO: 7702914 - DNA, 17 bp, Homo sapiens
tggggtgttgaagggtt

SEQ ID NO: 7702915 - DNA, 17 bp, Homo sapiens
tggggtgttgaagggtt

SEQ ID NO: 7702916 - DNA, 22 bp, Homo sapiens
tggggtgtgctcagagcagggg

SEQ ID NO: 7702917 - DNA, 22 bp, Homo sapiens
tggggtgtgagaagtagaggga

SEQ ID NO: 7702918 - DNA, 22 bp, Homo sapiens
tggggtgtgagaagtagaggga

SEQ ID NO: 7702919 - DNA, 22 bp, Homo sapiens
tggggtgtgagaagtagaggga

SEQ ID NO: 7702920 - DNA, 22 bp, Homo sapiens
tggggtgtgctcagagcagggg

SEQ ID NO: 7702921 - DNA, 22 bp, Homo sapiens
tggggtgctttcttgcctgtac

SEQ ID NO: 7702922 - DNA, 22 bp, Homo sapiens
tggggtgctttcttgcctgtac

SEQ ID NO: 7702923 - DNA, 22 bp, Homo sapiens
tggggtgctttcttgcctgtac

SEQ ID NO: 7702924 - DNA, 22 bp, Homo sapiens
tggggtggaacccttctgctgg

SEQ ID NO: 7702925 - DNA, 22 bp, Homo sapiens
tggggtggaacccttctgctgg

SEQ ID NO: 7702926 - DNA, 22 bp, Homo sapiens
tggggtggaacccttctgctgg

SEQ ID NO: 7702927 - DNA, 22 bp, Homo sapiens
tggggtggaacccttctgctgg

SEQ ID NO: 7702928 - DNA, 22 bp, Homo sapiens
tggggtggaacccttctgctgg

SEQ ID NO: 7702929 - DNA, 22 bp, Homo sapiens
tggggtgccgacagggagggca

SEQ ID NO: 7702930 - DNA, 22 bp, Homo sapiens
tggggtgccgacagggagggca

SEQ ID NO: 7702931 - DNA, 22 bp, Homo sapiens
tggggtgctttcttgcctgtac

SEQ ID NO: 7702932 - DNA, 22 bp, Homo sapiens
tggggtgccgacagggagggca

SEQ ID NO: 7702933 - DNA, 22 bp, Homo sapiens
tggggtgagattcagatattca

SEQ ID NO: 7702934 - DNA, 22 bp, Homo sapiens
tggggtgacagtgcagtggtca

SEQ ID NO: 7702935 - DNA, 22 bp, Homo sapiens
tggggtgacagtgcagtggtca

SEQ ID NO: 7702936 - DNA, 22 bp, Homo sapiens
tggggtgacagtgcagtggtca

SEQ ID NO: 7702937 - DNA, 22 bp, Homo sapiens
tggggtgccgacagggagggca

SEQ ID NO: 7702938 - DNA, 22 bp, Homo sapiens
tggggtgccgacagggagggca

SEQ ID NO: 7702939 - DNA, 22 bp, Homo sapiens
tggggtgccgacagggagggca

SEQ ID NO: 7702940 - DNA, 22 bp, Homo sapiens
tggggtgccgacagggagggca

SEQ ID NO: 7702941 - DNA, 22 bp, Homo sapiens
tggggtgccgacagggagggca

SEQ ID NO: 7702942 - DNA, 22 bp, Homo sapiens
tggggtgaggcagccacattta

SEQ ID NO: 7702943 - DNA, 22 bp, Homo sapiens
tggggtgggcatgcgctgtcct

SEQ ID NO: 7702944 - DNA, 22 bp, Homo sapiens
tggggtgggcatgcgctgtcct

SEQ ID NO: 7702945 - DNA, 22 bp, Homo sapiens
tggggtggatagaaagtgatgt

SEQ ID NO: 7702946 - DNA, 22 bp, Homo sapiens
tggggtggatagaaagtgatgt

SEQ ID NO: 7702947 - DNA, 22 bp, Homo sapiens
tggggtggatagaaagtgatgt

SEQ ID NO: 7702948 - DNA, 22 bp, Homo sapiens
tggggtggatagaaagtgatgt

SEQ ID NO: 7702949 - DNA, 22 bp, Homo sapiens
tggggtggatagaaagtgatgt

SEQ ID NO: 7702950 - DNA, 22 bp, Homo sapiens
tggggtggatagaaagtgatgt

SEQ ID NO: 7702951 - DNA, 22 bp, Homo sapiens
tggggtggaacccttctgctgg

SEQ ID NO: 7702952 - DNA, 22 bp, Homo sapiens
tggggtggaacccttctgctgg

SEQ ID NO: 7702953 - DNA, 22 bp, Homo sapiens
tggggtggatagaaagtgatgt

SEQ ID NO: 7702954 - DNA, 22 bp, Homo sapiens
tggggtggaacccttctgctgg

SEQ ID NO: 7702955 - DNA, 22 bp, Homo sapiens
tggggtggaacccttctgctgg

SEQ ID NO: 7702956 - DNA, 22 bp, Homo sapiens
tggggtggaacccttctgctgg

SEQ ID NO: 7702957 - DNA, 22 bp, Homo sapiens
tggggtggaacccttctgctgg

SEQ ID NO: 7702958 - DNA, 22 bp, Homo sapiens
tggggtggaacccttctgctgg

SEQ ID NO: 7702959 - DNA, 22 bp, Homo sapiens
tgggggtgaaagtctggacagt

SEQ ID NO: 7702960 - DNA, 22 bp, Homo sapiens
tgggggtgaaagtctggacagt

SEQ ID NO: 7702961 - DNA, 22 bp, Homo sapiens
tgggggtgaaagtctggacagt

SEQ ID NO: 7702962 - DNA, 22 bp, Homo sapiens
tgggggtcctcctctgcttaag

SEQ ID NO: 7702963 - DNA, 22 bp, Homo sapiens
tgggggtgaaagtctggacagt

SEQ ID NO: 7702964 - DNA, 22 bp, Homo sapiens
tgggggtgaaagtctggacagt

SEQ ID NO: 7702965 - DNA, 22 bp, Homo sapiens
tgggggtgaaagtctggacagt

SEQ ID NO: 7702966 - DNA, 22 bp, Homo sapiens
tgggggtgaaagtctggacagt

SEQ ID NO: 7702967 - DNA, 22 bp, Homo sapiens
tgggggtgaaagtctggacagt

SEQ ID NO: 7702968 - DNA, 21 bp, Homo sapiens
tgggggtgaggcctaggaatc

SEQ ID NO: 7702969 - DNA, 21 bp, Homo sapiens
tgggggtgaggcctaggaatc

SEQ ID NO: 7702970 - DNA, 22 bp, Homo sapiens
tgggggtgactatctcgggaat

SEQ ID NO: 7702971 - DNA, 22 bp, Homo sapiens
tgggggtgactatctcgggaat

SEQ ID NO: 7702972 - DNA, 22 bp, Homo sapiens
tgggggtgactatctcgggaat

SEQ ID NO: 7702973 - DNA, 22 bp, Homo sapiens
tgggggtgactatctcgggaat

SEQ ID NO: 7702974 - DNA, 22 bp, Homo sapiens
tgggggtgactatctcgggaat

SEQ ID NO: 7702975 - DNA, 22 bp, Homo sapiens
tgggggtgactatctcgggaat

SEQ ID NO: 7702976 - DNA, 22 bp, Homo sapiens
tgggggctgtgcacaggctcac

SEQ ID NO: 7702977 - DNA, 22 bp, Homo sapiens
tgggggctgtgcacaggctcac

SEQ ID NO: 7702978 - DNA, 22 bp, Homo sapiens
tgggggctgtgcacaggctcac

SEQ ID NO: 7702979 - DNA, 22 bp, Homo sapiens
tgggggctgtgcacaggctcac

SEQ ID NO: 7702980 - DNA, 22 bp, Homo sapiens
tgggggctgtgcacaggctcac

SEQ ID NO: 7702981 - DNA, 22 bp, Homo sapiens
tgggggctgtgcacaggctcac

SEQ ID NO: 7702982 - DNA, 22 bp, Homo sapiens
tgggggctgggatgtcactttc

SEQ ID NO: 7702983 - DNA, 22 bp, Homo sapiens
tgggggctgtgcacaggctcac

SEQ ID NO: 7702984 - DNA, 22 bp, Homo sapiens
tggggggatacttgctactggc

SEQ ID NO: 7702985 - DNA, 22 bp, Homo sapiens
tggggggatacttgctactggc

SEQ ID NO: 7702986 - DNA, 22 bp, Homo sapiens
tgggggctttatgtaatgcaca

SEQ ID NO: 7702987 - DNA, 22 bp, Homo sapiens
tgggggctgtgcacaggctcac

SEQ ID NO: 7702988 - DNA, 22 bp, Homo sapiens
tggggggcatgaacctccacgg

SEQ ID NO: 7702989 - DNA, 22 bp, Homo sapiens
tggggggcatgaacctccacgg

SEQ ID NO: 7702990 - DNA, 22 bp, Homo sapiens
tggggggcatgaacctccacgg

SEQ ID NO: 7702991 - DNA, 18 bp, Homo sapiens
tggggggcttgtctgaag

SEQ ID NO: 7702992 - DNA, 18 bp, Homo sapiens
tggggggcttgtctgaag

SEQ ID NO: 7702993 - DNA, 18 bp, Homo sapiens
tggggggcttgtctgaag

SEQ ID NO: 7702994 - DNA, 22 bp, Homo sapiens
tggggggcacttcagcacaatg

SEQ ID NO: 7702995 - DNA, 22 bp, Homo sapiens
tggggggatacttgctactggc

SEQ ID NO: 7702996 - DNA, 22 bp, Homo sapiens
tggggggatacttgctactggc

SEQ ID NO: 7702997 - DNA, 22 bp, Homo sapiens
tggggggcacttcagcacaatg

SEQ ID NO: 7702998 - DNA, 22 bp, Homo sapiens
tggggggcacttcagcacaatg

SEQ ID NO: 7702999 - DNA, 22 bp, Homo sapiens
tgggggtggttcttgcctccag

SEQ ID NO: 7703000 - DNA, 22 bp, Homo sapiens
tgggggtggttcttgcctccag

SEQ ID NO: 7703001 - DNA, 22 bp, Homo sapiens
tgggggtggttcttgcctccag

SEQ ID NO: 7703002 - DNA, 22 bp, Homo sapiens
tgggggtggttcttgcctccag

SEQ ID NO: 7703003 - DNA, 20 bp, Homo sapiens
tggggtctagttggcctggg

SEQ ID NO: 7703004 - DNA, 22 bp, Homo sapiens
tgggggtggttcttgcctccag

SEQ ID NO: 7703005 - DNA, 20 bp, Homo sapiens
tggggtctagttggcctggg

SEQ ID NO: 7703006 - DNA, 18 bp, Homo sapiens
tggggtctctcaggtaag

SEQ ID NO: 7703007 - DNA, 22 bp, Homo sapiens
tggggtctgagtatctgcattt

SEQ ID NO: 7703008 - DNA, 22 bp, Homo sapiens
tggggtctgagtatctgcattt

SEQ ID NO: 7703009 - DNA, 18 bp, Homo sapiens
tggggtctctcaggtaag

SEQ ID NO: 7703010 - DNA, 20 bp, Homo sapiens
tggggtctagttggcctggg

SEQ ID NO: 7703011 - DNA, 22 bp, Homo sapiens
tggggtgaatctttgttgtccg

SEQ ID NO: 7703012 - DNA, 22 bp, Homo sapiens
tggggtgaatctttgttgtccg

SEQ ID NO: 7703013 - DNA, 22 bp, Homo sapiens
tggggtctgagtatctgcattt

SEQ ID NO: 7703014 - DNA, 22 bp, Homo sapiens
tgggggtgctgagaagacagga

SEQ ID NO: 7703015 - DNA, 22 bp, Homo sapiens
tgggggtgctgagaagacagga

SEQ ID NO: 7703016 - DNA, 22 bp, Homo sapiens
tgggggtgctgagaagacagga

SEQ ID NO: 7703017 - DNA, 22 bp, Homo sapiens
tgggggtgctgagaagacagga

SEQ ID NO: 7703018 - DNA, 22 bp, Homo sapiens
tgggggtgccctatgaggaagc

SEQ ID NO: 7703019 - DNA, 22 bp, Homo sapiens
tgggggtgccctatgaggaagc

SEQ ID NO: 7703020 - DNA, 22 bp, Homo sapiens
tgggggtgccctatgaggaagc

SEQ ID NO: 7703021 - DNA, 22 bp, Homo sapiens
tgggggtgccctatgaggaagc

SEQ ID NO: 7703022 - DNA, 22 bp, Homo sapiens
tgggggtgccctatgaggaagc

SEQ ID NO: 7703023 - DNA, 22 bp, Homo sapiens
tgggggtgccctatgaggaagc

SEQ ID NO: 7703024 - DNA, 22 bp, Homo sapiens
tgggggtgccctatgaggaagc

SEQ ID NO: 7703025 - DNA, 22 bp, Homo sapiens
tgggggtgccctatgaggaagc

SEQ ID NO: 7703026 - DNA, 23 bp, Homo sapiens
tgggggtgcacgggccacatctt

SEQ ID NO: 7703027 - DNA, 23 bp, Homo sapiens
tgggggtgcacgggccacatctt

SEQ ID NO: 7703028 - DNA, 23 bp, Homo sapiens
tgggggtgcacgggccacatctt

SEQ ID NO: 7703029 - DNA, 23 bp, Homo sapiens
tgggggtgcacgggccacatctt

SEQ ID NO: 7703030 - DNA, 23 bp, Homo sapiens
tgggggtgcacgggccacatctt

SEQ ID NO: 7703031 - DNA, 21 bp, Homo sapiens
tgggggtgaggcctaggaatc

SEQ ID NO: 7703032 - DNA, 21 bp, Homo sapiens
tgggggtgaggcctaggaatc

SEQ ID NO: 7703033 - DNA, 21 bp, Homo sapiens
tgggggtgaggcctaggaatc

SEQ ID NO: 7703034 - DNA, 22 bp, Homo sapiens
tgggtagcagggctgagctgtg

SEQ ID NO: 7703035 - DNA, 22 bp, Homo sapiens
tgggtaggaatcgagtgtatgg

SEQ ID NO: 7703036 - DNA, 22 bp, Homo sapiens
tgggtaggaatcgagtgtatgg

SEQ ID NO: 7703037 - DNA, 22 bp, Homo sapiens
tgggtagcagggctgagctgtg

SEQ ID NO: 7703038 - DNA, 22 bp, Homo sapiens
tgggtaggaatcgagtgtatgg

SEQ ID NO: 7703039 - DNA, 22 bp, Homo sapiens
tgggtagaggaattgggctacc

SEQ ID NO: 7703040 - DNA, 22 bp, Homo sapiens
tgggtactcctattagttcagt

SEQ ID NO: 7703041 - DNA, 22 bp, Homo sapiens
tgggtactcctattagttcagt

SEQ ID NO: 7703042 - DNA, 22 bp, Homo sapiens
tgggtactcctattagttcagt

SEQ ID NO: 7703043 - DNA, 22 bp, Homo sapiens
tgggtagagcaggctggggctt

SEQ ID NO: 7703044 - DNA, 22 bp, Homo sapiens
tgggtagaaacaaggctggact

SEQ ID NO: 7703045 - DNA, 23 bp, Homo sapiens
tggggttgaattgtagctgtgcc

SEQ ID NO: 7703046 - DNA, 22 bp, Homo sapiens
tggggttgaagaaaggatctag

SEQ ID NO: 7703047 - DNA, 23 bp, Homo sapiens
tggggttgaattgtagctgtgcc

SEQ ID NO: 7703048 - DNA, 23 bp, Homo sapiens
tggggttgaattgtagctgtgcc

SEQ ID NO: 7703049 - DNA, 22 bp, Homo sapiens
tggggttacctacaagtctgag

SEQ ID NO: 7703050 - DNA, 22 bp, Homo sapiens
tggggttgaagaaaggatctag

SEQ ID NO: 7703051 - DNA, 22 bp, Homo sapiens
tggggttctttgtttcctgcct

SEQ ID NO: 7703052 - DNA, 22 bp, Homo sapiens
tggggttgcctcccgccctgga

SEQ ID NO: 7703053 - DNA, 22 bp, Homo sapiens
tgggtaaaatgagttaggagaa

SEQ ID NO: 7703054 - DNA, 22 bp, Homo sapiens
tgggtaaactgggtctggagag

SEQ ID NO: 7703055 - DNA, 22 bp, Homo sapiens
tgggtaagaattgggggctctg

SEQ ID NO: 7703056 - DNA, 22 bp, Homo sapiens
tgggtactcctattagttcagt

SEQ ID NO: 7703057 - DNA, 22 bp, Homo sapiens
tgggtaatggagaaataaatct

SEQ ID NO: 7703058 - DNA, 22 bp, Homo sapiens
tgggtaatggagaaataaatct

SEQ ID NO: 7703059 - DNA, 22 bp, Homo sapiens
tgggtaagtggaggacaaagta

SEQ ID NO: 7703060 - DNA, 22 bp, Homo sapiens
tgggtagggcctgcgcctgtgc

SEQ ID NO: 7703061 - DNA, 22 bp, Homo sapiens
tgggtagggcctgcgcctgtgc

SEQ ID NO: 7703062 - DNA, 22 bp, Homo sapiens
tgggtagggcctgcgcctgtgc

SEQ ID NO: 7703063 - DNA, 22 bp, Homo sapiens
tgggtagggagctggaatccta

SEQ ID NO: 7703064 - DNA, 22 bp, Homo sapiens
tgggtagggagctggaatccta

SEQ ID NO: 7703065 - DNA, 22 bp, Homo sapiens
tgggtagggagctggaatccta

SEQ ID NO: 7703066 - DNA, 22 bp, Homo sapiens
tgggtagggacttagctggctg

SEQ ID NO: 7703067 - DNA, 22 bp, Homo sapiens
tgggtagggacttagctggctg

SEQ ID NO: 7703068 - DNA, 22 bp, Homo sapiens
tgggtagggacttagctggctg

SEQ ID NO: 7703069 - DNA, 22 bp, Homo sapiens
tgggtagggacttagctggctg

SEQ ID NO: 7703070 - DNA, 22 bp, Homo sapiens
tgggtaggccaggaagcagtgt

SEQ ID NO: 7703071 - DNA, 22 bp, Homo sapiens
tgggtagggacttagctggctg

SEQ ID NO: 7703072 - DNA, 22 bp, Homo sapiens
tgggtaggccaggaagcagtgt

SEQ ID NO: 7703073 - DNA, 22 bp, Homo sapiens
tgggtaggccaggaagcagtgt

SEQ ID NO: 7703074 - DNA, 22 bp, Homo sapiens
tgggtaggaccagaaatgcact

SEQ ID NO: 7703075 - DNA, 22 bp, Homo sapiens
tgggtaggaccagaaatgcact

SEQ ID NO: 7703076 - DNA, 22 bp, Homo sapiens
tgggtaggccaggaagcagtgt

SEQ ID NO: 7703077 - DNA, 22 bp, Homo sapiens
tgggtaggccaggaagcagtgt

SEQ ID NO: 7703078 - DNA, 22 bp, Homo sapiens
tgggtaggccaggaagcagtgt

SEQ ID NO: 7703079 - DNA, 22 bp, Homo sapiens
tgggtagggacttagctggctg

SEQ ID NO: 7703080 - DNA, 22 bp, Homo sapiens
tgggtaggccaggaagcagtgt

SEQ ID NO: 7703081 - DNA, 22 bp, Homo sapiens
tgggtccacggaagacttaggg

SEQ ID NO: 7703082 - DNA, 22 bp, Homo sapiens
tgggtccacggaagacttaggg

SEQ ID NO: 7703083 - DNA, 22 bp, Homo sapiens
tgggtaggggacgtggaagaaa

SEQ ID NO: 7703084 - DNA, 22 bp, Homo sapiens
tgggtagggcctgcgcctgtgc

SEQ ID NO: 7703085 - DNA, 22 bp, Homo sapiens
tgggtaggggacgtggaagaaa

SEQ ID NO: 7703086 - DNA, 22 bp, Homo sapiens
tgggtaggggacgtggaagaaa

SEQ ID NO: 7703087 - DNA, 22 bp, Homo sapiens
tgggtaggggacgtggaagaaa

SEQ ID NO: 7703088 - DNA, 22 bp, Homo sapiens
tgggtaggggacgtggaagaaa

SEQ ID NO: 7703089 - DNA, 22 bp, Homo sapiens
tgggtaggggacgtggaagaaa

SEQ ID NO: 7703090 - DNA, 22 bp, Homo sapiens
tgggtagggcctgcgcctgtgc

SEQ ID NO: 7703091 - DNA, 22 bp, Homo sapiens
tgggtccagtgcagctgcgcgt

SEQ ID NO: 7703092 - DNA, 22 bp, Homo sapiens
tgggtccagtgcagctgcgcgt

SEQ ID NO: 7703093 - DNA, 22 bp, Homo sapiens
tgggtccagtgtcctggctatg

SEQ ID NO: 7703094 - DNA, 22 bp, Homo sapiens
tgggtccacttctgcactgtgg

SEQ ID NO: 7703095 - DNA, 22 bp, Homo sapiens
tgggtccagtgcagctgcgcgt

SEQ ID NO: 7703096 - DNA, 22 bp, Homo sapiens
tgggtccagtgcagctgcgcgt

SEQ ID NO: 7703097 - DNA, 22 bp, Homo sapiens
tgggtccagtgcagctgcgcgt

SEQ ID NO: 7703098 - DNA, 22 bp, Homo sapiens
tgggtccacttctgcactgtgg

SEQ ID NO: 7703099 - DNA, 22 bp, Homo sapiens
tgggtccacttctgcactgtgg

SEQ ID NO: 7703100 - DNA, 22 bp, Homo sapiens
tgggtccacggaagacttaggg

SEQ ID NO: 7703101 - DNA, 22 bp, Homo sapiens
tgggtccacttctgcactgtgg

SEQ ID NO: 7703102 - DNA, 22 bp, Homo sapiens
tgggtccttgctgattgctgag

SEQ ID NO: 7703103 - DNA, 22 bp, Homo sapiens
tgggtcctttttggacttcttc

SEQ ID NO: 7703104 - DNA, 22 bp, Homo sapiens
tgggtcctttttggacttcttc

SEQ ID NO: 7703105 - DNA, 22 bp, Homo sapiens
tgggtccttgctggcttcaaag

SEQ ID NO: 7703106 - DNA, 22 bp, Homo sapiens
tgggtccttgctgattgctgag

SEQ ID NO: 7703107 - DNA, 22 bp, Homo sapiens
tgggtccttgctgattgctgag

SEQ ID NO: 7703108 - DNA, 22 bp, Homo sapiens
tgggtcctttttggacttcttc

SEQ ID NO: 7703109 - DNA, 22 bp, Homo sapiens
tgggtccttcaaagctgggtct

SEQ ID NO: 7703110 - DNA, 22 bp, Homo sapiens
tgggtccttcaaagctgggtct

SEQ ID NO: 7703111 - DNA, 22 bp, Homo sapiens
tgggtccttcaaagctgggtct

SEQ ID NO: 7703112 - DNA, 22 bp, Homo sapiens
tgggtcctgtctccttgttctg

SEQ ID NO: 7703113 - DNA, 22 bp, Homo sapiens
tgggtccttcaaagctgggtct

SEQ ID NO: 7703114 - DNA, 22 bp, Homo sapiens
tgggtccttgccatcttggagt

SEQ ID NO: 7703115 - DNA, 22 bp, Homo sapiens
tgggtccttgccatcttggagt

SEQ ID NO: 7703116 - DNA, 20 bp, Homo sapiens
tgggtcctgtgggagaagaa

SEQ ID NO: 7703117 - DNA, 20 bp, Homo sapiens
tgggtcctgtgggagaagaa

SEQ ID NO: 7703118 - DNA, 22 bp, Homo sapiens
tgggtctccagttcagggcagg

SEQ ID NO: 7703119 - DNA, 22 bp, Homo sapiens
tgggtctcctgtgcctgggagg

SEQ ID NO: 7703120 - DNA, 23 bp, Homo sapiens
tgggtctctagtacaggcaggca

SEQ ID NO: 7703121 - DNA, 22 bp, Homo sapiens
tgggtctcctgtgcctgggagg

SEQ ID NO: 7703122 - DNA, 20 bp, Homo sapiens
tgggtctgcttggcttcagt

SEQ ID NO: 7703123 - DNA, 20 bp, Homo sapiens
tgggtctgcttggcttcagt

SEQ ID NO: 7703124 - DNA, 20 bp, Homo sapiens
tgggtctgcttggcttcagt

SEQ ID NO: 7703125 - DNA, 23 bp, Homo sapiens
tgggtctctagtacaggcaggca

SEQ ID NO: 7703126 - DNA, 23 bp, Homo sapiens
tgggtctctagtacaggcaggca

SEQ ID NO: 7703127 - DNA, 22 bp, Homo sapiens
tgggtgaagaggctatgctact

SEQ ID NO: 7703128 - DNA, 22 bp, Homo sapiens
tgggtctgtagggctgtccaat

SEQ ID NO: 7703129 - DNA, 22 bp, Homo sapiens
tgggtctttatgggggccagga

SEQ ID NO: 7703130 - DNA, 22 bp, Homo sapiens
tgggtgacagagcaagactctg

SEQ ID NO: 7703131 - DNA, 22 bp, Homo sapiens
tgggtgacagagcaagactctg

SEQ ID NO: 7703132 - DNA, 22 bp, Homo sapiens
tgggtgaccccagaagaggatc

SEQ ID NO: 7703133 - DNA, 22 bp, Homo sapiens
tgggtgacagacacctctctgt

SEQ ID NO: 7703134 - DNA, 20 bp, Homo sapiens
tgggtgagagtgtttgctct

SEQ ID NO: 7703135 - DNA, 22 bp, Homo sapiens
tgggtctgtagggctgtccaat

SEQ ID NO: 7703136 - DNA, 22 bp, Homo sapiens
tgggtctgtagggctgtccaat

SEQ ID NO: 7703137 - DNA, 22 bp, Homo sapiens
tgggtctgtagggctgtccaat

SEQ ID NO: 7703138 - DNA, 20 bp, Homo sapiens
tgggtctgcttggcttcagt

SEQ ID NO: 7703139 - DNA, 22 bp, Homo sapiens
tgggtcctctggagcagcagca

SEQ ID NO: 7703140 - DNA, 22 bp, Homo sapiens
tgggtcctctggagcagcagca

SEQ ID NO: 7703141 - DNA, 22 bp, Homo sapiens
tgggtcctctggagcagcagca

SEQ ID NO: 7703142 - DNA, 22 bp, Homo sapiens
tgggtcctctgagagggcagcg

SEQ ID NO: 7703143 - DNA, 22 bp, Homo sapiens
tgggtcctctgagagggcagcg

SEQ ID NO: 7703144 - DNA, 20 bp, Homo sapiens
tgggtcctgcacattctcca

SEQ ID NO: 7703145 - DNA, 20 bp, Homo sapiens
tgggtcctgcacattctcca

SEQ ID NO: 7703146 - DNA, 22 bp, Homo sapiens
tgggtcctgcactgcaagcacc

SEQ ID NO: 7703147 - DNA, 22 bp, Homo sapiens
tgggtcctgcactgcaagcacc

SEQ ID NO: 7703148 - DNA, 22 bp, Homo sapiens
tgggtcctctggagcagcagca

SEQ ID NO: 7703149 - DNA, 22 bp, Homo sapiens
tgggtcctggctttgtcagggt

SEQ ID NO: 7703150 - DNA, 22 bp, Homo sapiens
tgggtcctggaaggcgacaggt

SEQ ID NO: 7703151 - DNA, 22 bp, Homo sapiens
tgggtcctgtctccttgttctg

SEQ ID NO: 7703152 - DNA, 22 bp, Homo sapiens
tgggtcctggctttgtcagggt

SEQ ID NO: 7703153 - DNA, 22 bp, Homo sapiens
tgggtcctggctttgtcagggt

SEQ ID NO: 7703154 - DNA, 22 bp, Homo sapiens
tgggtcctggaaggcgacaggt

SEQ ID NO: 7703155 - DNA, 20 bp, Homo sapiens
tgggtcctgcttcttcctga

SEQ ID NO: 7703156 - DNA, 20 bp, Homo sapiens
tgggtcctgcttcttcctga

SEQ ID NO: 7703157 - DNA, 22 bp, Homo sapiens
tgggtcctcgtcttccaaggca

SEQ ID NO: 7703158 - DNA, 22 bp, Homo sapiens
tgggtcctcgtcttccaaggca

SEQ ID NO: 7703159 - DNA, 22 bp, Homo sapiens
tgggtcctcgtcttccaaggca

SEQ ID NO: 7703160 - DNA, 20 bp, Homo sapiens
tgggtccctgcagtttgaag

SEQ ID NO: 7703161 - DNA, 22 bp, Homo sapiens
tgggtcctaaatgcagtcacat

SEQ ID NO: 7703162 - DNA, 22 bp, Homo sapiens
tgggtcctaaatgcagtcacat

SEQ ID NO: 7703163 - DNA, 22 bp, Homo sapiens
tgggtccctcatgagaggcatt

SEQ ID NO: 7703164 - DNA, 22 bp, Homo sapiens
tgggtccctcatgagaggcatt

SEQ ID NO: 7703165 - DNA, 22 bp, Homo sapiens
tgggtccctctggagtagtaca

SEQ ID NO: 7703166 - DNA, 22 bp, Homo sapiens
tgggtccatggaacagaggtgc

SEQ ID NO: 7703167 - DNA, 22 bp, Homo sapiens
tgggtccatggaacagaggtgc

SEQ ID NO: 7703168 - DNA, 22 bp, Homo sapiens
tgggtccatggaacagaggtgc

SEQ ID NO: 7703169 - DNA, 22 bp, Homo sapiens
tgggtccatggaacagaggtgc

SEQ ID NO: 7703170 - DNA, 22 bp, Homo sapiens
tgggtccagtgtcctggctatg

SEQ ID NO: 7703171 - DNA, 22 bp, Homo sapiens
tgggtcccaggaaggaccagca

SEQ ID NO: 7703172 - DNA, 22 bp, Homo sapiens
tgggtcccaggaaggaccagca

SEQ ID NO: 7703173 - DNA, 22 bp, Homo sapiens
tgggtcccaaactcctagaggt

SEQ ID NO: 7703174 - DNA, 22 bp, Homo sapiens
tgggtcccaatctgaaatgtca

SEQ ID NO: 7703175 - DNA, 22 bp, Homo sapiens
tgggtgagtgggaaaagcccag

SEQ ID NO: 7703176 - DNA, 22 bp, Homo sapiens
tgggtgagtgggaaaagcccag

SEQ ID NO: 7703177 - DNA, 22 bp, Homo sapiens
tgggtgagtgggaaaagcccag

SEQ ID NO: 7703178 - DNA, 22 bp, Homo sapiens
tgggtgagtgggaaaagcccag

SEQ ID NO: 7703179 - DNA, 22 bp, Homo sapiens
tgggtgagtggagggcattcta

SEQ ID NO: 7703180 - DNA, 22 bp, Homo sapiens
tgggtgagtggagggcattcta

SEQ ID NO: 7703181 - DNA, 22 bp, Homo sapiens
tgggtgagtggagggcattcta

SEQ ID NO: 7703182 - DNA, 22 bp, Homo sapiens
tgggtgagtggagggcattcta

SEQ ID NO: 7703183 - DNA, 22 bp, Homo sapiens
tgggtgagtggagggcattcta

SEQ ID NO: 7703184 - DNA, 22 bp, Homo sapiens
tgggtgaggatgatgaggcagc

SEQ ID NO: 7703185 - DNA, 22 bp, Homo sapiens
tgggtgaggatgatgaggcagc

SEQ ID NO: 7703186 - DNA, 22 bp, Homo sapiens
tgggtgagtggagggcattcta

SEQ ID NO: 7703187 - DNA, 22 bp, Homo sapiens
tgggtgagggacaaaagtttct

SEQ ID NO: 7703188 - DNA, 22 bp, Homo sapiens
tgggtgaggatgatgaggcagc

SEQ ID NO: 7703189 - DNA, 22 bp, Homo sapiens
tgggtgaggatgatgaggcagc

SEQ ID NO: 7703190 - DNA, 22 bp, Homo sapiens
tgggtgaggatgatgaggcagc

SEQ ID NO: 7703191 - DNA, 22 bp, Homo sapiens
tgggtgaggagaggctgtctaa

SEQ ID NO: 7703192 - DNA, 22 bp, Homo sapiens
tgggtgaggagaggctgtctaa

SEQ ID NO: 7703193 - DNA, 22 bp, Homo sapiens
tgggtgaggatgatgaggcagc

SEQ ID NO: 7703194 - DNA, 22 bp, Homo sapiens
tgggtgaggatgatgaggcagc

SEQ ID NO: 7703195 - DNA, 22 bp, Homo sapiens
tgggtgaggatgatgaggcagc

SEQ ID NO: 7703196 - DNA, 22 bp, Homo sapiens
tgggtgaggatgatgaggcagc

SEQ ID NO: 7703197 - DNA, 22 bp, Homo sapiens
tgggtgaggatgatgaggcagc

SEQ ID NO: 7703198 - DNA, 22 bp, Homo sapiens
tgggtgaggatgatgaggcagc

SEQ ID NO: 7703199 - DNA, 22 bp, Homo sapiens
tgggtgagccacaggagttgtc

SEQ ID NO: 7703200 - DNA, 22 bp, Homo sapiens
tgggtgagccacaggagttgtc

SEQ ID NO: 7703201 - DNA, 22 bp, Homo sapiens
tgggtgagccacaggagttgtc

SEQ ID NO: 7703202 - DNA, 20 bp, Homo sapiens
tgggtgagagtgtttgctct

SEQ ID NO: 7703203 - DNA, 22 bp, Homo sapiens
tgggtgagccacaggagttgtc

SEQ ID NO: 7703204 - DNA, 22 bp, Homo sapiens
tgggtgagccacaggagttgtc

SEQ ID NO: 7703205 - DNA, 22 bp, Homo sapiens
tgggtgagccacaggagttgtc

SEQ ID NO: 7703206 - DNA, 22 bp, Homo sapiens
tgggtgagcggctgcacacccg

SEQ ID NO: 7703207 - DNA, 22 bp, Homo sapiens
tgggtgagcggctgcacacccg

SEQ ID NO: 7703208 - DNA, 22 bp, Homo sapiens
tgggtgaggagaggctgtctaa

SEQ ID NO: 7703209 - DNA, 22 bp, Homo sapiens
tgggtgagcggctgcacacccg

SEQ ID NO: 7703210 - DNA, 22 bp, Homo sapiens
tgggtgaggagaggctgtctaa

SEQ ID NO: 7703211 - DNA, 22 bp, Homo sapiens
tgggtgaggagaggctgtctaa

SEQ ID NO: 7703212 - DNA, 22 bp, Homo sapiens
tgggtgaggagaggctgtctaa

SEQ ID NO: 7703213 - DNA, 22 bp, Homo sapiens
tgggtgaggatgatgaggcagc

SEQ ID NO: 7703214 - DNA, 22 bp, Homo sapiens
tgggtgaggagaggctgtctaa

SEQ ID NO: 7703215 - DNA, 22 bp, Homo sapiens
tgggtgcatgtgagcacgtgca

SEQ ID NO: 7703216 - DNA, 22 bp, Homo sapiens
tgggtgcatgtgagcacgtgca

SEQ ID NO: 7703217 - DNA, 21 bp, Homo sapiens
tgggtgcaagctgcggatgct

SEQ ID NO: 7703218 - DNA, 22 bp, Homo sapiens
tgggtgcaggtcttgtgccagg

SEQ ID NO: 7703219 - DNA, 21 bp, Homo sapiens
tgggtgcaagctgcggatgct

SEQ ID NO: 7703220 - DNA, 21 bp, Homo sapiens
tgggtgcaagctgcggatgct

SEQ ID NO: 7703221 - DNA, 22 bp, Homo sapiens
tgggtgcaggatgagtgctggc

SEQ ID NO: 7703222 - DNA, 22 bp, Homo sapiens
tgggtgcaggatgagtgctggc

SEQ ID NO: 7703223 - DNA, 22 bp, Homo sapiens
tgggtgctctgcgaccgtaggg

SEQ ID NO: 7703224 - DNA, 22 bp, Homo sapiens
tgggtgctctgcgaccgtaggg

SEQ ID NO: 7703225 - DNA, 22 bp, Homo sapiens
tgggtgcatgtgagcacgtgca

SEQ ID NO: 7703226 - DNA, 22 bp, Homo sapiens
tgggtgccaacctctggtggcc

SEQ ID NO: 7703227 - DNA, 22 bp, Homo sapiens
tgggtgggagcgccctgtctgg

SEQ ID NO: 7703228 - DNA, 21 bp, Homo sapiens
tgggtggaagcgggaggccgc

SEQ ID NO: 7703229 - DNA, 21 bp, Homo sapiens
tgggtggaagcgggaggccgc

SEQ ID NO: 7703230 - DNA, 21 bp, Homo sapiens
tgggtggaagcgggaggccgc

SEQ ID NO: 7703231 - DNA, 22 bp, Homo sapiens
tgggtgcttcgtcagctctgag

SEQ ID NO: 7703232 - DNA, 21 bp, Homo sapiens
tgggtggaagcgggaggccgc

SEQ ID NO: 7703233 - DNA, 22 bp, Homo sapiens
tgggtgctgctttagggggtca

SEQ ID NO: 7703234 - DNA, 17 bp, Homo sapiens
tgggtgctgggatgagg

SEQ ID NO: 7703235 - DNA, 22 bp, Homo sapiens
tgggtgctgctttagggggtca

SEQ ID NO: 7703236 - DNA, 22 bp, Homo sapiens
tgggtgctctgcgaccgtaggg

SEQ ID NO: 7703237 - DNA, 22 bp, Homo sapiens
tgggtgctctgcgaccgtaggg

SEQ ID NO: 7703238 - DNA, 22 bp, Homo sapiens
tgggtgctctgcgaccgtaggg

SEQ ID NO: 7703239 - DNA, 22 bp, Homo sapiens
tgggtgctctgcgaccgtaggg

SEQ ID NO: 7703240 - DNA, 22 bp, Homo sapiens
tgggtgctctgcttccctgcac

SEQ ID NO: 7703241 - DNA, 22 bp, Homo sapiens
tgggtgctctgcttccctgcac

SEQ ID NO: 7703242 - DNA, 22 bp, Homo sapiens
tgggtgctctgcttccctgcac

SEQ ID NO: 7703243 - DNA, 22 bp, Homo sapiens
tgggtggttgctgaggctcctt

SEQ ID NO: 7703244 - DNA, 22 bp, Homo sapiens
tgggtggttgctgaggctcctt

SEQ ID NO: 7703245 - DNA, 22 bp, Homo sapiens
tgggtggtcttgcttcccagga

SEQ ID NO: 7703246 - DNA, 22 bp, Homo sapiens
tgggtggttatagagatcaact

SEQ ID NO: 7703247 - DNA, 22 bp, Homo sapiens
tgggtggttgctgaggctcctt

SEQ ID NO: 7703248 - DNA, 22 bp, Homo sapiens
tgggtggtcttgcttcccagga

SEQ ID NO: 7703249 - DNA, 22 bp, Homo sapiens
tgggtggtggcagtaatgagaa

SEQ ID NO: 7703250 - DNA, 22 bp, Homo sapiens
tgggtggtcttgcttcccagga

SEQ ID NO: 7703251 - DNA, 22 bp, Homo sapiens
tgggtggtccaggctcagcaga

SEQ ID NO: 7703252 - DNA, 22 bp, Homo sapiens
tgggtggtccaggctcagcaga

SEQ ID NO: 7703253 - DNA, 22 bp, Homo sapiens
tgggtggtccaggctcagcaga

SEQ ID NO: 7703254 - DNA, 22 bp, Homo sapiens
tgggtgtgaagtctgttggcct

SEQ ID NO: 7703255 - DNA, 22 bp, Homo sapiens
tgggtgtccagaccctgcacat

SEQ ID NO: 7703256 - DNA, 22 bp, Homo sapiens
tgggtgtccagaccctgcacat

SEQ ID NO: 7703257 - DNA, 22 bp, Homo sapiens
tgggtgtgaagtctgttggcct

SEQ ID NO: 7703258 - DNA, 19 bp, Homo sapiens
tgggtgtgaccatctctgc

SEQ ID NO: 7703259 - DNA, 22 bp, Homo sapiens
tgggtgtgaagtctgttggcct

SEQ ID NO: 7703260 - DNA, 22 bp, Homo sapiens
tgggtggttgctgaggctcctt

SEQ ID NO: 7703261 - DNA, 22 bp, Homo sapiens
tgggtggtttatgagtgggttt

SEQ ID NO: 7703262 - DNA, 22 bp, Homo sapiens
tgggtggtttatgagtgggttt

SEQ ID NO: 7703263 - DNA, 22 bp, Homo sapiens
tgggtggtttatgagtgggttt

SEQ ID NO: 7703264 - DNA, 22 bp, Homo sapiens
tgggtggtttatgagtgggttt

SEQ ID NO: 7703265 - DNA, 22 bp, Homo sapiens
tgggtggtttatgagtgggttt

SEQ ID NO: 7703266 - DNA, 18 bp, Homo sapiens
tgggtggtttttctctcc

SEQ ID NO: 7703267 - DNA, 18 bp, Homo sapiens
tgggtggtttttctctcc

SEQ ID NO: 7703268 - DNA, 22 bp, Homo sapiens
tgggttaacagtttataccaga

SEQ ID NO: 7703269 - DNA, 22 bp, Homo sapiens
tgggtgtgcccagatggtgtcc

SEQ ID NO: 7703270 - DNA, 19 bp, Homo sapiens
tgggtgtgaccatctctgc

SEQ ID NO: 7703271 - DNA, 22 bp, Homo sapiens
tgggtgtgagcccgggagccgc

SEQ ID NO: 7703272 - DNA, 22 bp, Homo sapiens
tgggtgtgagcccgggagccgc

SEQ ID NO: 7703273 - DNA, 22 bp, Homo sapiens
tgggtgtgcccagatggtgtcc

SEQ ID NO: 7703274 - DNA, 22 bp, Homo sapiens
tgggtgtgcccagatggtgtcc

SEQ ID NO: 7703275 - DNA, 22 bp, Homo sapiens
tgggtgtgcccagatggtgtcc

SEQ ID NO: 7703276 - DNA, 22 bp, Homo sapiens
tgggtgtgccatattccatttc

SEQ ID NO: 7703277 - DNA, 22 bp, Homo sapiens
tgggtgtgagcccgggagccgc

SEQ ID NO: 7703278 - DNA, 22 bp, Homo sapiens
tgggtgtgagcccgggagccgc

SEQ ID NO: 7703279 - DNA, 22 bp, Homo sapiens
tgggtgggagcgccctgtctgg

SEQ ID NO: 7703280 - DNA, 22 bp, Homo sapiens
tgggtgggagcgccctgtctgg

SEQ ID NO: 7703281 - DNA, 22 bp, Homo sapiens
tgggtgggagcgccctgtctgg

SEQ ID NO: 7703282 - DNA, 22 bp, Homo sapiens
tgggtgggagcgccctgtctgg

SEQ ID NO: 7703283 - DNA, 22 bp, Homo sapiens
tgggtgggagcgccctgtctgg

SEQ ID NO: 7703284 - DNA, 22 bp, Homo sapiens
tgggtgggagcgccctgtctgg

SEQ ID NO: 7703285 - DNA, 22 bp, Homo sapiens
tgggtgggagcgccctgtctgg

SEQ ID NO: 7703286 - DNA, 22 bp, Homo sapiens
tgggtgggagcgccctgtctgg

SEQ ID NO: 7703287 - DNA, 22 bp, Homo sapiens
tgggtgggagcgccctgtctgg

SEQ ID NO: 7703288 - DNA, 22 bp, Homo sapiens
tgggtgggagcgccctgtctgg

SEQ ID NO: 7703289 - DNA, 16 bp, Homo sapiens
tgggtgggaggagcgg

SEQ ID NO: 7703290 - DNA, 16 bp, Homo sapiens
tgggtgggaggagcgg

SEQ ID NO: 7703291 - DNA, 16 bp, Homo sapiens
tgggtgggaggagcgg

SEQ ID NO: 7703292 - DNA, 16 bp, Homo sapiens
tgggtgggaggagcgg

SEQ ID NO: 7703293 - DNA, 16 bp, Homo sapiens
tgggtgggaggagcgg

SEQ ID NO: 7703294 - DNA, 16 bp, Homo sapiens
tgggtgggaggagcgg

SEQ ID NO: 7703295 - DNA, 16 bp, Homo sapiens
tgggtgggaggagcgg

SEQ ID NO: 7703296 - DNA, 16 bp, Homo sapiens
tgggtgggaggagcgg

SEQ ID NO: 7703297 - DNA, 16 bp, Homo sapiens
tgggtgggaggagcgg

SEQ ID NO: 7703298 - DNA, 16 bp, Homo sapiens
tgggtgggaggagcgg

SEQ ID NO: 7703299 - DNA, 22 bp, Homo sapiens
tgggtggtccaggctcagcaga

SEQ ID NO: 7703300 - DNA, 22 bp, Homo sapiens
tgggtggtccaggctcagcaga

SEQ ID NO: 7703301 - DNA, 17 bp, Homo sapiens
tgggtggtagggagagg

SEQ ID NO: 7703302 - DNA, 17 bp, Homo sapiens
tgggtggtagggagagg

SEQ ID NO: 7703303 - DNA, 17 bp, Homo sapiens
tgggtggtagggagagg

SEQ ID NO: 7703304 - DNA, 17 bp, Homo sapiens
tgggtggtagggagagg

SEQ ID NO: 7703305 - DNA, 21 bp, Homo sapiens
tgggtgggcagagtctcttca

SEQ ID NO: 7703306 - DNA, 17 bp, Homo sapiens
tgggtggtagggagagg

SEQ ID NO: 7703307 - DNA, 21 bp, Homo sapiens
tgggtgggcagagtctcttca

SEQ ID NO: 7703308 - DNA, 21 bp, Homo sapiens
tgggtgggcagagtctcttca

SEQ ID NO: 7703309 - DNA, 21 bp, Homo sapiens
tgggtgggcagagtctcttca

SEQ ID NO: 7703310 - DNA, 21 bp, Homo sapiens
tgggtgggcagagtctcttca

SEQ ID NO: 7703311 - DNA, 21 bp, Homo sapiens
tgggtgggcagagtctcttca

SEQ ID NO: 7703312 - DNA, 21 bp, Homo sapiens
tgggtgggcagagtctcttca

SEQ ID NO: 7703313 - DNA, 21 bp, Homo sapiens
tgggtgggcagagtctcttca

SEQ ID NO: 7703314 - DNA, 21 bp, Homo sapiens
tgggtgggcagagtctcttca

SEQ ID NO: 7703315 - DNA, 21 bp, Homo sapiens
tgggtgggcagagtctcttca

SEQ ID NO: 7703316 - DNA, 22 bp, Homo sapiens
tgggttccctgacagcgatgct

SEQ ID NO: 7703317 - DNA, 23 bp, Homo sapiens
tgggttcattcttgaagtcagtg

SEQ ID NO: 7703318 - DNA, 22 bp, Homo sapiens
tgggttcagatcccagctctgt

SEQ ID NO: 7703319 - DNA, 22 bp, Homo sapiens
tgggttccctgacagcgatgct

SEQ ID NO: 7703320 - DNA, 22 bp, Homo sapiens
tgggttcgatgtatatgtagcc

SEQ ID NO: 7703321 - DNA, 22 bp, Homo sapiens
tgggttctagagggaccagaac

SEQ ID NO: 7703322 - DNA, 22 bp, Homo sapiens
tgggttcagatcccagctctgt

SEQ ID NO: 7703323 - DNA, 22 bp, Homo sapiens
tgggttcagatcccagctctgt

SEQ ID NO: 7703324 - DNA, 22 bp, Homo sapiens
tgggttcagatcccagctctgt

SEQ ID NO: 7703325 - DNA, 20 bp, Homo sapiens
tgggttcaactcctacagtc

SEQ ID NO: 7703326 - DNA, 22 bp, Homo sapiens
tgggttaggaaggggtatcacc

SEQ ID NO: 7703327 - DNA, 22 bp, Homo sapiens
tgggttagggcctggtctctga

SEQ ID NO: 7703328 - DNA, 19 bp, Homo sapiens
tgggttggaagggaatgaa

SEQ ID NO: 7703329 - DNA, 19 bp, Homo sapiens
tgggttggaagggaatgaa

SEQ ID NO: 7703330 - DNA, 19 bp, Homo sapiens
tgggttggaagggaatgaa

SEQ ID NO: 7703331 - DNA, 22 bp, Homo sapiens
tgggttggaagcaggaggcacc

SEQ ID NO: 7703332 - DNA, 22 bp, Homo sapiens
tgggttctttcacttctcagtt

SEQ ID NO: 7703333 - DNA, 22 bp, Homo sapiens
tgggttggaagcaggaggcacc

SEQ ID NO: 7703334 - DNA, 22 bp, Homo sapiens
tgggttggaagcaggaggcacc

SEQ ID NO: 7703335 - DNA, 22 bp, Homo sapiens
tgggttctttcacttctcagtt

SEQ ID NO: 7703336 - DNA, 22 bp, Homo sapiens
tgggttctttcacttctcagtt

SEQ ID NO: 7703337 - DNA, 22 bp, Homo sapiens
tggtaaaaaccgcaattacatt

SEQ ID NO: 7703338 - DNA, 22 bp, Homo sapiens
tgggtttttgtttctctggtat

SEQ ID NO: 7703339 - DNA, 22 bp, Homo sapiens
tgggttttgtgaccatagatta

SEQ ID NO: 7703340 - DNA, 22 bp, Homo sapiens
tgggttttgtgaccatagatta

SEQ ID NO: 7703341 - DNA, 22 bp, Homo sapiens
tgggttttgtcctgatccatca

SEQ ID NO: 7703342 - DNA, 22 bp, Homo sapiens
tgggttttatatgtggtggaca

SEQ ID NO: 7703343 - DNA, 22 bp, Homo sapiens
tgggtttgattctcagccaagg

SEQ ID NO: 7703344 - DNA, 22 bp, Homo sapiens
tgggttttcagcatgagtttat

SEQ ID NO: 7703345 - DNA, 22 bp, Homo sapiens
tgggttttccacatatgccatg

SEQ ID NO: 7703346 - DNA, 22 bp, Homo sapiens
tgggttttctgccgattgttcc

SEQ ID NO: 7703347 - DNA, 22 bp, Homo sapiens
tgggttttccatctatttactc

SEQ ID NO: 7703348 - DNA, 22 bp, Homo sapiens
tgggttttccacatatgccatg

SEQ ID NO: 7703349 - DNA, 22 bp, Homo sapiens
tgggttttccatctatttactc

SEQ ID NO: 7703350 - DNA, 22 bp, Homo sapiens
tgggttgtaagagagtgcactt

SEQ ID NO: 7703351 - DNA, 19 bp, Homo sapiens
tgggttggaagggaatgaa

SEQ ID NO: 7703352 - DNA, 22 bp, Homo sapiens
tgggttggtcagcataagatgg

SEQ ID NO: 7703353 - DNA, 19 bp, Homo sapiens
tgggttgtatctctaatgg

SEQ ID NO: 7703354 - DNA, 22 bp, Homo sapiens
tgggttgtcatgggtccaaccc

SEQ ID NO: 7703355 - DNA, 22 bp, Homo sapiens
tgggttgtcctctttctgttaa

SEQ ID NO: 7703356 - DNA, 22 bp, Homo sapiens
tgggttgtctttgtctccactt

SEQ ID NO: 7703357 - DNA, 22 bp, Homo sapiens
tgggttgttcccatccaggccc

SEQ ID NO: 7703358 - DNA, 22 bp, Homo sapiens
tgggttgttccccaagtccaca

SEQ ID NO: 7703359 - DNA, 22 bp, Homo sapiens
tgggttgttgtgacagttacca

SEQ ID NO: 7703360 - DNA, 22 bp, Homo sapiens
tggtaagggctctctttctggc

SEQ ID NO: 7703361 - DNA, 22 bp, Homo sapiens
tggtaaggcccagctggagtcc

SEQ ID NO: 7703362 - DNA, 22 bp, Homo sapiens
tggtaaggggtggaaccagagc

SEQ ID NO: 7703363 - DNA, 22 bp, Homo sapiens
tggtaagggtattatttcatcc

SEQ ID NO: 7703364 - DNA, 22 bp, Homo sapiens
tggtaagggtattatttcatcc

SEQ ID NO: 7703365 - DNA, 22 bp, Homo sapiens
tggtaaggtcttcactcagatt

SEQ ID NO: 7703366 - DNA, 22 bp, Homo sapiens
tggtaagataagagccaggcct

SEQ ID NO: 7703367 - DNA, 22 bp, Homo sapiens
tggtaaggattgtagaaacgaa

SEQ ID NO: 7703368 - DNA, 22 bp, Homo sapiens
tggtaaggattgtagaaacgaa

SEQ ID NO: 7703369 - DNA, 22 bp, Homo sapiens
tggtaaggacttagttatcaat

SEQ ID NO: 7703370 - DNA, 22 bp, Homo sapiens
tggtaagataagagccaggcct

SEQ ID NO: 7703371 - DNA, 22 bp, Homo sapiens
tggtaagaataggggctttgga

SEQ ID NO: 7703372 - DNA, 22 bp, Homo sapiens
tggtaagaataggggctttgga

SEQ ID NO: 7703373 - DNA, 22 bp, Homo sapiens
tggtaactttcagcatggtgac

SEQ ID NO: 7703374 - DNA, 22 bp, Homo sapiens
tggtaaattatttttatatccc

SEQ ID NO: 7703375 - DNA, 22 bp, Homo sapiens
tggtaacacaggcattaaagtt

SEQ ID NO: 7703376 - DNA, 22 bp, Homo sapiens
tggtaacacaggcattaaagtt

SEQ ID NO: 7703377 - DNA, 22 bp, Homo sapiens
tggtaactgtttagtgttaatg

SEQ ID NO: 7703378 - DNA, 22 bp, Homo sapiens
tggtaaccacaaccctccttgt

SEQ ID NO: 7703379 - DNA, 23 bp, Homo sapiens
tggtaaattgtttggcaagtctg

SEQ ID NO: 7703380 - DNA, 22 bp, Homo sapiens
tggtaaagcacattgcatttaa

SEQ ID NO: 7703381 - DNA, 22 bp, Homo sapiens
tggtaaagcacattgcatttaa

SEQ ID NO: 7703382 - DNA, 19 bp, Homo sapiens
tggtaaagactgtccccca

SEQ ID NO: 7703383 - DNA, 20 bp, Homo sapiens
tggtaaaggagggctggagg

SEQ ID NO: 7703384 - DNA, 22 bp, Homo sapiens
tggtaaagaaggctagatctga

SEQ ID NO: 7703385 - DNA, 19 bp, Homo sapiens
tggtaaagactgtccccca

SEQ ID NO: 7703386 - DNA, 22 bp, Homo sapiens
tggtaaagaaggctagatctga

SEQ ID NO: 7703387 - DNA, 22 bp, Homo sapiens
tggtaaagaaggctagatctga

SEQ ID NO: 7703388 - DNA, 22 bp, Homo sapiens
tggtaaagaaatgtcagggcag

SEQ ID NO: 7703389 - DNA, 22 bp, Homo sapiens
tggtaaaaactgcaattacttt

SEQ ID NO: 7703390 - DNA, 22 bp, Homo sapiens
tggtaaaaaccgcaattacatt

SEQ ID NO: 7703391 - DNA, 22 bp, Homo sapiens
tggtaaaaactgcaattacttt

SEQ ID NO: 7703392 - DNA, 22 bp, Homo sapiens
tggtaaaaactgcaattacttt

SEQ ID NO: 7703393 - DNA, 22 bp, Homo sapiens
tggtaaaaactgcaattacttt

SEQ ID NO: 7703394 - DNA, 22 bp, Homo sapiens
tggtaaaatattacaaggcact

SEQ ID NO: 7703395 - DNA, 22 bp, Homo sapiens
tggtaaagaaatgtcagggcag

SEQ ID NO: 7703396 - DNA, 22 bp, Homo sapiens
tggtaaagtgtactgaatatga

SEQ ID NO: 7703397 - DNA, 22 bp, Homo sapiens
tggtaaagtgtactgaatatga

SEQ ID NO: 7703398 - DNA, 22 bp, Homo sapiens
tggtaaagttgattggtgctct

SEQ ID NO: 7703399 - DNA, 22 bp, Homo sapiens
tggtaaagtgctctaacttcat

SEQ ID NO: 7703400 - DNA, 22 bp, Homo sapiens
tggtaaagtggcttcacagtgt

SEQ ID NO: 7703401 - DNA, 22 bp, Homo sapiens
tggtaaagtggcttcacagtgt

SEQ ID NO: 7703402 - DNA, 22 bp, Homo sapiens
tggtaaatgctattcctatatt

SEQ ID NO: 7703403 - DNA, 22 bp, Homo sapiens
tggtaaatgctccaagcagtac

SEQ ID NO: 7703404 - DNA, 22 bp, Homo sapiens
tggtaaatgtctaacaatcact

SEQ ID NO: 7703405 - DNA, 22 bp, Homo sapiens
tggtaaatatgtccattctctt

SEQ ID NO: 7703406 - DNA, 22 bp, Homo sapiens
tggtaaagttgattggtgctct

SEQ ID NO: 7703407 - DNA, 22 bp, Homo sapiens
tggtaaatatgtccattctctt

SEQ ID NO: 7703408 - DNA, 16 bp, Homo sapiens
tggtaaggttaccaga

SEQ ID NO: 7703409 - DNA, 22 bp, Homo sapiens
tggtaaggtcttcactcagatt

SEQ ID NO: 7703410 - DNA, 21 bp, Homo sapiens
tggtaggtactggcttcaggc

SEQ ID NO: 7703411 - DNA, 21 bp, Homo sapiens
tggtaggtactggcttcaggc

SEQ ID NO: 7703412 - DNA, 22 bp, Homo sapiens
tggtagtcggcctcggtggctc

SEQ ID NO: 7703413 - DNA, 21 bp, Homo sapiens
tggtaggtactggcttcaggc

SEQ ID NO: 7703414 - DNA, 23 bp, Homo sapiens
tggtataaaaacagtacctacct

SEQ ID NO: 7703415 - DNA, 22 bp, Homo sapiens
tggtagtcggcctcggtggctc

SEQ ID NO: 7703416 - DNA, 22 bp, Homo sapiens
tggtataatacagtaagtgttg

SEQ ID NO: 7703417 - DNA, 22 bp, Homo sapiens
tggtataagtaatcataattgc

SEQ ID NO: 7703418 - DNA, 22 bp, Homo sapiens
tggtataagtaatcataattgc

SEQ ID NO: 7703419 - DNA, 22 bp, Homo sapiens
tggtataagctgtgtcagagcc

SEQ ID NO: 7703420 - DNA, 22 bp, Homo sapiens
tggtataaacagttactggaga

SEQ ID NO: 7703421 - DNA, 22 bp, Homo sapiens
tggtataagctgtgtcagagcc

SEQ ID NO: 7703422 - DNA, 22 bp, Homo sapiens
tggtagtttctgtatctcacag

SEQ ID NO: 7703423 - DNA, 22 bp, Homo sapiens
tggtataaaagagtaaactatg

SEQ ID NO: 7703424 - DNA, 22 bp, Homo sapiens
tggtataaaagagtaaactatg

SEQ ID NO: 7703425 - DNA, 22 bp, Homo sapiens
tggtataaaactttttattgaa

SEQ ID NO: 7703426 - DNA, 22 bp, Homo sapiens
tggtataaaaatttgtgaatgt

SEQ ID NO: 7703427 - DNA, 22 bp, Homo sapiens
tggtatggctaacgaggtcaag

SEQ ID NO: 7703428 - DNA, 22 bp, Homo sapiens
tggtatgtaaattgtaactcaa

SEQ ID NO: 7703429 - DNA, 22 bp, Homo sapiens
tggtatgtaaattgtaactcaa

SEQ ID NO: 7703430 - DNA, 22 bp, Homo sapiens
tggtatgaccgtggtgcaagca

SEQ ID NO: 7703431 - DNA, 22 bp, Homo sapiens
tggtatgaccgtggtgcaagca

SEQ ID NO: 7703432 - DNA, 22 bp, Homo sapiens
tggtatgaccgtggtgcaagca

SEQ ID NO: 7703433 - DNA, 22 bp, Homo sapiens
tggtatgaccgtggtgcaagca

SEQ ID NO: 7703434 - DNA, 22 bp, Homo sapiens
tggtatctgtgaatgtgacatt

SEQ ID NO: 7703435 - DNA, 22 bp, Homo sapiens
tggtatcagagccatctgtatt

SEQ ID NO: 7703436 - DNA, 22 bp, Homo sapiens
tggtattctttctgtagatcat

SEQ ID NO: 7703437 - DNA, 22 bp, Homo sapiens
tggtattctttctgtagatcat

SEQ ID NO: 7703438 - DNA, 22 bp, Homo sapiens
tggtattctttctgtagatcat

SEQ ID NO: 7703439 - DNA, 22 bp, Homo sapiens
tggtatgtaaattgtaactcaa

SEQ ID NO: 7703440 - DNA, 22 bp, Homo sapiens
tggtattacttctagacacaag

SEQ ID NO: 7703441 - DNA, 22 bp, Homo sapiens
tggtattacttctagacacaag

SEQ ID NO: 7703442 - DNA, 22 bp, Homo sapiens
tggtattacttctagacacaag

SEQ ID NO: 7703443 - DNA, 22 bp, Homo sapiens
tggtattacttctagacacaag

SEQ ID NO: 7703444 - DNA, 22 bp, Homo sapiens
tggtatttccaggcttatggta

SEQ ID NO: 7703445 - DNA, 22 bp, Homo sapiens
tggtatttcagcttttgtatct

SEQ ID NO: 7703446 - DNA, 22 bp, Homo sapiens
tggtcacacatgtatctcaatg

SEQ ID NO: 7703447 - DNA, 22 bp, Homo sapiens
tggtcacacatgtatctcaatg

SEQ ID NO: 7703448 - DNA, 22 bp, Homo sapiens
tggtcaagttaagataaggtga

SEQ ID NO: 7703449 - DNA, 22 bp, Homo sapiens
tggtcaatgaagatacactatt

SEQ ID NO: 7703450 - DNA, 22 bp, Homo sapiens
tggtcaatgaagatacactatt

SEQ ID NO: 7703451 - DNA, 22 bp, Homo sapiens
tggtcacacatgtatctcaatg

SEQ ID NO: 7703452 - DNA, 22 bp, Homo sapiens
tggtcacacatgtatctcaatg

SEQ ID NO: 7703453 - DNA, 22 bp, Homo sapiens
tggtcaaggcttggagatagta

SEQ ID NO: 7703454 - DNA, 22 bp, Homo sapiens
tggtcaagattacacactggtg

SEQ ID NO: 7703455 - DNA, 22 bp, Homo sapiens
tggtcaagattacacactggtg

SEQ ID NO: 7703456 - DNA, 22 bp, Homo sapiens
tggtcaaggcttggagatagta

SEQ ID NO: 7703457 - DNA, 22 bp, Homo sapiens
tggtcaaggcttggagatagta

SEQ ID NO: 7703458 - DNA, 22 bp, Homo sapiens
tggtcaagggacagagctgaac

SEQ ID NO: 7703459 - DNA, 22 bp, Homo sapiens
tggtcaagggacagagctgaac

SEQ ID NO: 7703460 - DNA, 22 bp, Homo sapiens
tggtcaaatgccaatctgtagt

SEQ ID NO: 7703461 - DNA, 22 bp, Homo sapiens
tggtcaacaggcagggatgaaa

SEQ ID NO: 7703462 - DNA, 22 bp, Homo sapiens
tggtcaaatgccaatctgtagt

SEQ ID NO: 7703463 - DNA, 22 bp, Homo sapiens
tggtcaaaccagttatctgtaa

SEQ ID NO: 7703464 - DNA, 22 bp, Homo sapiens
tggtcaaaagctactatgaatg

SEQ ID NO: 7703465 - DNA, 22 bp, Homo sapiens
tggtatttgtcattcgagttct

SEQ ID NO: 7703466 - DNA, 22 bp, Homo sapiens
tggtcaaaagaaagctcagaac

SEQ ID NO: 7703467 - DNA, 22 bp, Homo sapiens
tggctcattctactctccctgg

SEQ ID NO: 7703468 - DNA, 22 bp, Homo sapiens
tggctcatggaattagctatta

SEQ ID NO: 7703469 - DNA, 21 bp, Homo sapiens
tggctcagttgctgggcacag

SEQ ID NO: 7703470 - DNA, 21 bp, Homo sapiens
tggctcagttgctgggcacag

SEQ ID NO: 7703471 - DNA, 21 bp, Homo sapiens
tggctcagttgctgggcacag

SEQ ID NO: 7703472 - DNA, 21 bp, Homo sapiens
tggctcagttgctgggcacag

SEQ ID NO: 7703473 - DNA, 22 bp, Homo sapiens
tggctcattctttagaatatac

SEQ ID NO: 7703474 - DNA, 22 bp, Homo sapiens
tggctcattctggggaagtcag

SEQ ID NO: 7703475 - DNA, 22 bp, Homo sapiens
tggctcattctttagaatatac

SEQ ID NO: 7703476 - DNA, 22 bp, Homo sapiens
tggctcattctggggaagtcag

SEQ ID NO: 7703477 - DNA, 22 bp, Homo sapiens
tggctcatggaattagctatta

SEQ ID NO: 7703478 - DNA, 22 bp, Homo sapiens
tggctcattctactctccctgg

SEQ ID NO: 7703479 - DNA, 22 bp, Homo sapiens
tggctccaaatcaactgctgtt

SEQ ID NO: 7703480 - DNA, 22 bp, Homo sapiens
tggctccaaatcaactgctgtt

SEQ ID NO: 7703481 - DNA, 22 bp, Homo sapiens
tggctccaaatcaactgctgtt

SEQ ID NO: 7703482 - DNA, 22 bp, Homo sapiens
tggctccaaatcaactgctgtt

SEQ ID NO: 7703483 - DNA, 22 bp, Homo sapiens
tggctccaaatcaactgctgtt

SEQ ID NO: 7703484 - DNA, 22 bp, Homo sapiens
tggctccaccgccgcggagctc

SEQ ID NO: 7703485 - DNA, 22 bp, Homo sapiens
tggctccaccgccgcggagctc

SEQ ID NO: 7703486 - DNA, 22 bp, Homo sapiens
tggctcagttaggtcagaaaca

SEQ ID NO: 7703487 - DNA, 22 bp, Homo sapiens
tggctcagttccatcatctgga

SEQ ID NO: 7703488 - DNA, 22 bp, Homo sapiens
tggctcagttaggtcagaaaca

SEQ ID NO: 7703489 - DNA, 22 bp, Homo sapiens
tggctcagttaggtcagaaaca

SEQ ID NO: 7703490 - DNA, 22 bp, Homo sapiens
tggctcagttaggtcagaaaca

SEQ ID NO: 7703491 - DNA, 22 bp, Homo sapiens
tggctcagtggcagccgcagct

SEQ ID NO: 7703492 - DNA, 21 bp, Homo sapiens
tggctcagttgctgggcacag

SEQ ID NO: 7703493 - DNA, 22 bp, Homo sapiens
tggctcagttccatcatctgga

SEQ ID NO: 7703494 - DNA, 22 bp, Homo sapiens
tggctcagttccatcatctgga

SEQ ID NO: 7703495 - DNA, 22 bp, Homo sapiens
tggctcagttccatcatctgga

SEQ ID NO: 7703496 - DNA, 22 bp, Homo sapiens
tggctcagttccatcatctgga

SEQ ID NO: 7703497 - DNA, 22 bp, Homo sapiens
tggctcagttccatcatctgga

SEQ ID NO: 7703498 - DNA, 22 bp, Homo sapiens
tggctcagttccatcatctgga

SEQ ID NO: 7703499 - DNA, 22 bp, Homo sapiens
tggctcagttccatcatctgga

SEQ ID NO: 7703500 - DNA, 22 bp, Homo sapiens
tggctcagttccatcatctgga

SEQ ID NO: 7703501 - DNA, 22 bp, Homo sapiens
tggctccagatttcctgctgca

SEQ ID NO: 7703502 - DNA, 22 bp, Homo sapiens
tggctccagatttcctgctgca

SEQ ID NO: 7703503 - DNA, 22 bp, Homo sapiens
tggctccagatttcctgctgca

SEQ ID NO: 7703504 - DNA, 22 bp, Homo sapiens
tggctccagatttcctgctgca

SEQ ID NO: 7703505 - DNA, 22 bp, Homo sapiens
tggctccagatttcctgctgca

SEQ ID NO: 7703506 - DNA, 22 bp, Homo sapiens
tggctccagatttcctgctgca

SEQ ID NO: 7703507 - DNA, 22 bp, Homo sapiens
tggctccagatctgtctcctgt

SEQ ID NO: 7703508 - DNA, 22 bp, Homo sapiens
tggctccagatctgtctcctgt

SEQ ID NO: 7703509 - DNA, 22 bp, Homo sapiens
tggctccagatttcctgctgca

SEQ ID NO: 7703510 - DNA, 22 bp, Homo sapiens
tggctccaccgccgcggagctc

SEQ ID NO: 7703511 - DNA, 22 bp, Homo sapiens
tggctccaccgccgcggagctc

SEQ ID NO: 7703512 - DNA, 22 bp, Homo sapiens
tggctccaccgccgcggagctc

SEQ ID NO: 7703513 - DNA, 22 bp, Homo sapiens
tggctccactactgggtgtgtt

SEQ ID NO: 7703514 - DNA, 22 bp, Homo sapiens
tggctccactctccaggagttt

SEQ ID NO: 7703515 - DNA, 22 bp, Homo sapiens
tggctccactctccaggagttt

SEQ ID NO: 7703516 - DNA, 22 bp, Homo sapiens
tggctccagaagggagggcgcc

SEQ ID NO: 7703517 - DNA, 23 bp, Homo sapiens
tggctccaggagaagccagaagc

SEQ ID NO: 7703518 - DNA, 23 bp, Homo sapiens
tggctccaggagaagccagaagc

SEQ ID NO: 7703519 - DNA, 23 bp, Homo sapiens
tggctccaggagaagccagaagc

SEQ ID NO: 7703520 - DNA, 23 bp, Homo sapiens
tggctccaggagaagccagaagc

SEQ ID NO: 7703521 - DNA, 23 bp, Homo sapiens
tggctccaggagaagccagaagc

SEQ ID NO: 7703522 - DNA, 23 bp, Homo sapiens
tggctccaggagaagccagaagc

SEQ ID NO: 7703523 - DNA, 22 bp, Homo sapiens
tggctccagctcaagtatggca

SEQ ID NO: 7703524 - DNA, 22 bp, Homo sapiens
tggctccagctcaagtatggca

SEQ ID NO: 7703525 - DNA, 22 bp, Homo sapiens
tggctccagctcaagtatggca

SEQ ID NO: 7703526 - DNA, 22 bp, Homo sapiens
tggctccagcgtccacgtcctg

SEQ ID NO: 7703527 - DNA, 22 bp, Homo sapiens
tggctccagcgtccacgtcctg

SEQ ID NO: 7703528 - DNA, 22 bp, Homo sapiens
tggctccagcgtccacgtcctg

SEQ ID NO: 7703529 - DNA, 20 bp, Homo sapiens
tggctccagcctcccctacc

SEQ ID NO: 7703530 - DNA, 20 bp, Homo sapiens
tggctccagcctcccctacc

SEQ ID NO: 7703531 - DNA, 22 bp, Homo sapiens
tggctccagccctgagcaagct

SEQ ID NO: 7703532 - DNA, 22 bp, Homo sapiens
tggctccagccctgagcaagct

SEQ ID NO: 7703533 - DNA, 22 bp, Homo sapiens
tggctccagccctgagcaagct

SEQ ID NO: 7703534 - DNA, 22 bp, Homo sapiens
tggctccagccctgagcaagct

SEQ ID NO: 7703535 - DNA, 22 bp, Homo sapiens
tggctccagccctgagcaagct

SEQ ID NO: 7703536 - DNA, 22 bp, Homo sapiens
tggctccagatttcctgctgca

SEQ ID NO: 7703537 - DNA, 22 bp, Homo sapiens
tggctccatcatccatgcaaga

SEQ ID NO: 7703538 - DNA, 22 bp, Homo sapiens
tggctccatcatccatgcaaga

SEQ ID NO: 7703539 - DNA, 22 bp, Homo sapiens
tggctccatcatccatgcaaga

SEQ ID NO: 7703540 - DNA, 22 bp, Homo sapiens
tggctccatcatccatgcaaga

SEQ ID NO: 7703541 - DNA, 22 bp, Homo sapiens
tggctccatcatccatgcaaga

SEQ ID NO: 7703542 - DNA, 22 bp, Homo sapiens
tggctccaggggacacgcagta

SEQ ID NO: 7703543 - DNA, 22 bp, Homo sapiens
tggctccaggggacacgcagta

SEQ ID NO: 7703544 - DNA, 22 bp, Homo sapiens
tggctccaggttgaactttggg

SEQ ID NO: 7703545 - DNA, 22 bp, Homo sapiens
tggctccaggggacacgcagta

SEQ ID NO: 7703546 - DNA, 22 bp, Homo sapiens
tggctccaggggacacgcagta

SEQ ID NO: 7703547 - DNA, 22 bp, Homo sapiens
tggctcccaaggagctcctgcc

SEQ ID NO: 7703548 - DNA, 22 bp, Homo sapiens
tggctcccaaggagctcctgcc

SEQ ID NO: 7703549 - DNA, 22 bp, Homo sapiens
tggctccattctttatgagttg

SEQ ID NO: 7703550 - DNA, 22 bp, Homo sapiens
tggctccatgatagttcttaca

SEQ ID NO: 7703551 - DNA, 22 bp, Homo sapiens
tggctccattctttatgagttg

SEQ ID NO: 7703552 - DNA, 22 bp, Homo sapiens
tggctcccacaaactcactact

SEQ ID NO: 7703553 - DNA, 22 bp, Homo sapiens
tggctcccacaaactcactact

SEQ ID NO: 7703554 - DNA, 22 bp, Homo sapiens
tggctcccacaaactcactact

SEQ ID NO: 7703555 - DNA, 22 bp, Homo sapiens
tggctcccaaggagctcctgcc

SEQ ID NO: 7703556 - DNA, 22 bp, Homo sapiens
tggctcccaaggagctcctgcc

SEQ ID NO: 7703557 - DNA, 22 bp, Homo sapiens
tggctcccaaggagctcctgcc

SEQ ID NO: 7703558 - DNA, 22 bp, Homo sapiens
tggctcccaaggagctcctgcc

SEQ ID NO: 7703559 - DNA, 22 bp, Homo sapiens
tggctcctaggatggtgcctgg

SEQ ID NO: 7703560 - DNA, 22 bp, Homo sapiens
tggctcctaggatggtgcctgg

SEQ ID NO: 7703561 - DNA, 22 bp, Homo sapiens
tggctcctaggatggtgcctgg

SEQ ID NO: 7703562 - DNA, 22 bp, Homo sapiens
tggctcctatcaaggagtgggt

SEQ ID NO: 7703563 - DNA, 22 bp, Homo sapiens
tggctcctatcaaggagtgggt

SEQ ID NO: 7703564 - DNA, 22 bp, Homo sapiens
tggctcctatcaaggagtgggt

SEQ ID NO: 7703565 - DNA, 22 bp, Homo sapiens
tggctcctaggatggtgcctgg

SEQ ID NO: 7703566 - DNA, 22 bp, Homo sapiens
tggctcctaatcggcttctttc

SEQ ID NO: 7703567 - DNA, 22 bp, Homo sapiens
tggctcctaatgctgcccagac

SEQ ID NO: 7703568 - DNA, 22 bp, Homo sapiens
tggctccgttgtacaggctgga

SEQ ID NO: 7703569 - DNA, 22 bp, Homo sapiens
tggctcccgcttgcacctaaga

SEQ ID NO: 7703570 - DNA, 22 bp, Homo sapiens
tggctcccgcttgcacctaaga

SEQ ID NO: 7703571 - DNA, 22 bp, Homo sapiens
tggctcccgcttgcacctaaga

SEQ ID NO: 7703572 - DNA, 22 bp, Homo sapiens
tggctcccgcttgcacctaaga

SEQ ID NO: 7703573 - DNA, 21 bp, Homo sapiens
tggctcccttgaattgtctgt

SEQ ID NO: 7703574 - DNA, 22 bp, Homo sapiens
tggctcccgcagaccctgtgct

SEQ ID NO: 7703575 - DNA, 22 bp, Homo sapiens
tggctcccgcagaccctgtgct

SEQ ID NO: 7703576 - DNA, 22 bp, Homo sapiens
tggctcccgcagaccctgtgct

SEQ ID NO: 7703577 - DNA, 22 bp, Homo sapiens
tggctcccgcagaccctgtgct

SEQ ID NO: 7703578 - DNA, 22 bp, Homo sapiens
tggctcctcacgtcctcagagc

SEQ ID NO: 7703579 - DNA, 22 bp, Homo sapiens
tggctcctcacgtcctcagagc

SEQ ID NO: 7703580 - DNA, 22 bp, Homo sapiens
tggctcctcacgtcctcagagc

SEQ ID NO: 7703581 - DNA, 22 bp, Homo sapiens
tggctcctcacgtcctcagagc

SEQ ID NO: 7703582 - DNA, 22 bp, Homo sapiens
tggctcctccctgtgtgtgcgt

SEQ ID NO: 7703583 - DNA, 22 bp, Homo sapiens
tggctcctcttctgggtgtccc

SEQ ID NO: 7703584 - DNA, 22 bp, Homo sapiens
tggctcctcatcacagttggtg

SEQ ID NO: 7703585 - DNA, 22 bp, Homo sapiens
tggctcctcatcacagttggtg

SEQ ID NO: 7703586 - DNA, 20 bp, Homo sapiens
tggctcctcttggctgtggc

SEQ ID NO: 7703587 - DNA, 20 bp, Homo sapiens
tggctcctcttggctgtggc

SEQ ID NO: 7703588 - DNA, 20 bp, Homo sapiens
tggctcctcttggctgtggc

SEQ ID NO: 7703589 - DNA, 22 bp, Homo sapiens
tggctcctcttctgggtgtccc

SEQ ID NO: 7703590 - DNA, 20 bp, Homo sapiens
tggctcctcttggctgtggc

SEQ ID NO: 7703591 - DNA, 18 bp, Homo sapiens
tggctcctgcctcctgca

SEQ ID NO: 7703592 - DNA, 18 bp, Homo sapiens
tggctcctgcctcctgca

SEQ ID NO: 7703593 - DNA, 22 bp, Homo sapiens
tggctcctgcagaccatctgga

SEQ ID NO: 7703594 - DNA, 22 bp, Homo sapiens
tggctcctgcagaccatctgga

SEQ ID NO: 7703595 - DNA, 18 bp, Homo sapiens
tggctcctgcctcctgca

SEQ ID NO: 7703596 - DNA, 22 bp, Homo sapiens
tggctcctgcatttgtgctaac

SEQ ID NO: 7703597 - DNA, 19 bp, Homo sapiens
tggctcctgcctgccttct

SEQ ID NO: 7703598 - DNA, 19 bp, Homo sapiens
tggctcctgcctgccttct

SEQ ID NO: 7703599 - DNA, 19 bp, Homo sapiens
tggctcctgcctgccttct

SEQ ID NO: 7703600 - DNA, 18 bp, Homo sapiens
tggctcctgcctcctgca

SEQ ID NO: 7703601 - DNA, 20 bp, Homo sapiens
tggctcctgcggtggaacca

SEQ ID NO: 7703602 - DNA, 20 bp, Homo sapiens
tggctcctgcggtggaacca

SEQ ID NO: 7703603 - DNA, 22 bp, Homo sapiens
tggctcagcaagacattgacct

SEQ ID NO: 7703604 - DNA, 22 bp, Homo sapiens
tggctcagcaagacattgacct

SEQ ID NO: 7703605 - DNA, 22 bp, Homo sapiens
tggctcagcaggttagaaacta

SEQ ID NO: 7703606 - DNA, 22 bp, Homo sapiens
tggctcagcaagacattgacct

SEQ ID NO: 7703607 - DNA, 22 bp, Homo sapiens
tggctcagcaagacattgacct

SEQ ID NO: 7703608 - DNA, 22 bp, Homo sapiens
tggctcagcaagacattgacct

SEQ ID NO: 7703609 - DNA, 22 bp, Homo sapiens
tggctcagatttttgtaggctt

SEQ ID NO: 7703610 - DNA, 22 bp, Homo sapiens
tggctcagatttttgtaggctt

SEQ ID NO: 7703611 - DNA, 22 bp, Homo sapiens
tggctcagatttttgtaggctt

SEQ ID NO: 7703612 - DNA, 22 bp, Homo sapiens
tggctcagcaggttagaaacta

SEQ ID NO: 7703613 - DNA, 22 bp, Homo sapiens
tggctcagcaggttagaaacta

SEQ ID NO: 7703614 - DNA, 22 bp, Homo sapiens
tggctcagcattcactggtctt

SEQ ID NO: 7703615 - DNA, 22 bp, Homo sapiens
tggctcagccagccctaggaac

SEQ ID NO: 7703616 - DNA, 22 bp, Homo sapiens
tggctcagcattcactggtctt

SEQ ID NO: 7703617 - DNA, 22 bp, Homo sapiens
tggctcagcattcactggtctt

SEQ ID NO: 7703618 - DNA, 22 bp, Homo sapiens
tggctcagcattcactggtctt

SEQ ID NO: 7703619 - DNA, 22 bp, Homo sapiens
tggctcagccagccctaggaac

SEQ ID NO: 7703620 - DNA, 22 bp, Homo sapiens
tggctcagccagccctaggaac

SEQ ID NO: 7703621 - DNA, 22 bp, Homo sapiens
tggctcagccagccctaggaac

SEQ ID NO: 7703622 - DNA, 22 bp, Homo sapiens
tggctcagccagccctaggaac

SEQ ID NO: 7703623 - DNA, 22 bp, Homo sapiens
tggctcagccagccctaggaac

SEQ ID NO: 7703624 - DNA, 22 bp, Homo sapiens
tggctcagccagccctaggaac

SEQ ID NO: 7703625 - DNA, 22 bp, Homo sapiens
tggctcagccagccctaggaac

SEQ ID NO: 7703626 - DNA, 22 bp, Homo sapiens
tggctcagccagccctaggaac

SEQ ID NO: 7703627 - DNA, 22 bp, Homo sapiens
tggctcagccagccctaggaac

SEQ ID NO: 7703628 - DNA, 22 bp, Homo sapiens
tggctcagccagccctaggaac

SEQ ID NO: 7703629 - DNA, 22 bp, Homo sapiens
tggctcagctgtcacagcctgg

SEQ ID NO: 7703630 - DNA, 22 bp, Homo sapiens
tggctcagctgtcacagcctgg

SEQ ID NO: 7703631 - DNA, 22 bp, Homo sapiens
tggctcagcttacttttgaggg

SEQ ID NO: 7703632 - DNA, 22 bp, Homo sapiens
tggctcagcttacttttgaggg

SEQ ID NO: 7703633 - DNA, 22 bp, Homo sapiens
tggctcagctttccccatctgg

SEQ ID NO: 7703634 - DNA, 22 bp, Homo sapiens
tggctcagcttacttttgaggg

SEQ ID NO: 7703635 - DNA, 22 bp, Homo sapiens
tggctcagcttacttttgaggg

SEQ ID NO: 7703636 - DNA, 22 bp, Homo sapiens
tggctcagctgtcacagcctgg

SEQ ID NO: 7703637 - DNA, 22 bp, Homo sapiens
tggctcagctgtcacagcctgg

SEQ ID NO: 7703638 - DNA, 22 bp, Homo sapiens
tggctcaggcttgaaaatagat

SEQ ID NO: 7703639 - DNA, 22 bp, Homo sapiens
tggctcaggcttgaaaatagat

SEQ ID NO: 7703640 - DNA, 22 bp, Homo sapiens
tggctcaggcttgaaaatagat

SEQ ID NO: 7703641 - DNA, 22 bp, Homo sapiens
tggctcaggcttgaaaatagat

SEQ ID NO: 7703642 - DNA, 22 bp, Homo sapiens
tggctcaggcctacgacgcctt

SEQ ID NO: 7703643 - DNA, 22 bp, Homo sapiens
tggctcaggcctacgacgcctt

SEQ ID NO: 7703644 - DNA, 22 bp, Homo sapiens
tggctcaggcctacgacgcctt

SEQ ID NO: 7703645 - DNA, 22 bp, Homo sapiens
tggctcaggcctacgacgcctt

SEQ ID NO: 7703646 - DNA, 22 bp, Homo sapiens
tggctcaggcctacgacgcctt

SEQ ID NO: 7703647 - DNA, 22 bp, Homo sapiens
tggctcaggccacttcttttat

SEQ ID NO: 7703648 - DNA, 22 bp, Homo sapiens
tggctcaggccacttcttttat

SEQ ID NO: 7703649 - DNA, 22 bp, Homo sapiens
tggctcaggccacttcttttat

SEQ ID NO: 7703650 - DNA, 22 bp, Homo sapiens
tggctcaggatctaagcagaat

SEQ ID NO: 7703651 - DNA, 22 bp, Homo sapiens
tggctcaggatctaagcagaat

SEQ ID NO: 7703652 - DNA, 22 bp, Homo sapiens
tggctcaggatctaagcagaat

SEQ ID NO: 7703653 - DNA, 22 bp, Homo sapiens
tggctcaggatctaagcagaat

SEQ ID NO: 7703654 - DNA, 22 bp, Homo sapiens
tggctcaggatctaagcagaat

SEQ ID NO: 7703655 - DNA, 22 bp, Homo sapiens
tggctcaggataattttcccaa

SEQ ID NO: 7703656 - DNA, 22 bp, Homo sapiens
tggctcaggatctaagcagaat

SEQ ID NO: 7703657 - DNA, 22 bp, Homo sapiens
tggctcaggataattttcccaa

SEQ ID NO: 7703658 - DNA, 22 bp, Homo sapiens
tggctcaggataattttcccaa

SEQ ID NO: 7703659 - DNA, 22 bp, Homo sapiens
tggctcaggataattttcccaa

SEQ ID NO: 7703660 - DNA, 22 bp, Homo sapiens
tggctcaggagggatctttgct

SEQ ID NO: 7703661 - DNA, 22 bp, Homo sapiens
tggctcaggagggatctttgct

SEQ ID NO: 7703662 - DNA, 22 bp, Homo sapiens
tggctcaggagggatctttgct

SEQ ID NO: 7703663 - DNA, 22 bp, Homo sapiens
tggctcaggagggatctttgct

SEQ ID NO: 7703664 - DNA, 22 bp, Homo sapiens
tggctcaggagggatctttgct

SEQ ID NO: 7703665 - DNA, 22 bp, Homo sapiens
tggctcagctttccccatctgg

SEQ ID NO: 7703666 - DNA, 22 bp, Homo sapiens
tggctcagctttccccatctgg

SEQ ID NO: 7703667 - DNA, 22 bp, Homo sapiens
tggctcagctttccccatctgg

SEQ ID NO: 7703668 - DNA, 22 bp, Homo sapiens
tggctcagctttccccatctgg

SEQ ID NO: 7703669 - DNA, 22 bp, Homo sapiens
tggctcagctttccccatctgg

SEQ ID NO: 7703670 - DNA, 23 bp, Homo sapiens
tggctcagggtctcttatgaagt

SEQ ID NO: 7703671 - DNA, 23 bp, Homo sapiens
tggctcagggtctcttatgaagt

SEQ ID NO: 7703672 - DNA, 23 bp, Homo sapiens
tggctcagggtctcttatgaagt

SEQ ID NO: 7703673 - DNA, 22 bp, Homo sapiens
tggctcagggtccccaaatggt

SEQ ID NO: 7703674 - DNA, 22 bp, Homo sapiens
tggctcagggtccccaaatggt

SEQ ID NO: 7703675 - DNA, 22 bp, Homo sapiens
tggctcagggtccccaaatggt

SEQ ID NO: 7703676 - DNA, 22 bp, Homo sapiens
tggctcagggtccccaaatggt

SEQ ID NO: 7703677 - DNA, 22 bp, Homo sapiens
tggctcaggggtctggctctgt

SEQ ID NO: 7703678 - DNA, 22 bp, Homo sapiens
tggctcaggggtctggctctgt

SEQ ID NO: 7703679 - DNA, 22 bp, Homo sapiens
tggctcaggggtctggctctgt

SEQ ID NO: 7703680 - DNA, 22 bp, Homo sapiens
tggctcaggggtctggctctgt

SEQ ID NO: 7703681 - DNA, 22 bp, Homo sapiens
tggctcaggggtctggctctgt

SEQ ID NO: 7703682 - DNA, 22 bp, Homo sapiens
tggctcaggggtctggctctgt

SEQ ID NO: 7703683 - DNA, 22 bp, Homo sapiens
tggctcaggcttgaaaatagat

SEQ ID NO: 7703684 - DNA, 22 bp, Homo sapiens
tggctcagtagcagtgtggtca

SEQ ID NO: 7703685 - DNA, 22 bp, Homo sapiens
tggctcagtagcagtgtggtca

SEQ ID NO: 7703686 - DNA, 22 bp, Homo sapiens
tggctcagtagcagtgtggtca

SEQ ID NO: 7703687 - DNA, 22 bp, Homo sapiens
tggctcagtagcagtgtggtca

SEQ ID NO: 7703688 - DNA, 22 bp, Homo sapiens
tggctcagtagcagtgtggtca

SEQ ID NO: 7703689 - DNA, 22 bp, Homo sapiens
tggctcaggtgtgagctgaaga

SEQ ID NO: 7703690 - DNA, 23 bp, Homo sapiens
tggctcagggtctcttatgaagt

SEQ ID NO: 7703691 - DNA, 22 bp, Homo sapiens
tggctcaggtgtgagctgaaga

SEQ ID NO: 7703692 - DNA, 22 bp, Homo sapiens
tggctcagtaatcgagtctcct

SEQ ID NO: 7703693 - DNA, 22 bp, Homo sapiens
tggctcaggtgtgagctgaaga

SEQ ID NO: 7703694 - DNA, 22 bp, Homo sapiens
tggctcagtaatcgagtctcct

SEQ ID NO: 7703695 - DNA, 22 bp, Homo sapiens
tggctcaggtgtgagctgaaga

SEQ ID NO: 7703696 - DNA, 22 bp, Homo sapiens
tggctcaggtgtgagctgaaga

SEQ ID NO: 7703697 - DNA, 22 bp, Homo sapiens
tggctcagtcatggatgagtaa

SEQ ID NO: 7703698 - DNA, 22 bp, Homo sapiens
tggctcagtagcagtgtggtca

SEQ ID NO: 7703699 - DNA, 22 bp, Homo sapiens
tggctcagtcatggatgagtaa

SEQ ID NO: 7703700 - DNA, 22 bp, Homo sapiens
tggctcagtcatggatgagtaa

SEQ ID NO: 7703701 - DNA, 22 bp, Homo sapiens
tggctcagtcatggatgagtaa

SEQ ID NO: 7703702 - DNA, 22 bp, Homo sapiens
tggctcagtcatggatgagtaa

SEQ ID NO: 7703703 - DNA, 22 bp, Homo sapiens
tggctcagtcatggatgagtaa

SEQ ID NO: 7703704 - DNA, 22 bp, Homo sapiens
tggctcagtcatggatgagtaa

SEQ ID NO: 7703705 - DNA, 22 bp, Homo sapiens
tggctcagtctgggttgactga

SEQ ID NO: 7703706 - DNA, 22 bp, Homo sapiens
tggctcagtgaagagataactt

SEQ ID NO: 7703707 - DNA, 22 bp, Homo sapiens
tggctcagtgaagagataactt

SEQ ID NO: 7703708 - DNA, 22 bp, Homo sapiens
tggctcagtgaagagataactt

SEQ ID NO: 7703709 - DNA, 22 bp, Homo sapiens
tggctcagtctgggttgactga

SEQ ID NO: 7703710 - DNA, 22 bp, Homo sapiens
tggctcagtgaagagataactt

SEQ ID NO: 7703711 - DNA, 22 bp, Homo sapiens
tggctcagtctgggttgactga

SEQ ID NO: 7703712 - DNA, 22 bp, Homo sapiens
tggctcagtctgggttgactga

SEQ ID NO: 7703713 - DNA, 22 bp, Homo sapiens
tggctcagtctgggttgactga

SEQ ID NO: 7703714 - DNA, 22 bp, Homo sapiens
tggctcagtggcagccgcagct

SEQ ID NO: 7703715 - DNA, 22 bp, Homo sapiens
tggctcagtggcagccgcagct

SEQ ID NO: 7703716 - DNA, 22 bp, Homo sapiens
tggctcagtggcagccgcagct

SEQ ID NO: 7703717 - DNA, 22 bp, Homo sapiens
tggctcagtggcagccgcagct

SEQ ID NO: 7703718 - DNA, 22 bp, Homo sapiens
tggctcagtggcagccgcagct

SEQ ID NO: 7703719 - DNA, 22 bp, Homo sapiens
tggctcagtggcagccgcagct

SEQ ID NO: 7703720 - DNA, 22 bp, Homo sapiens
tggctcagtggcagccgcagct

SEQ ID NO: 7703721 - DNA, 22 bp, Homo sapiens
tggctcagtgcattcacagtaa

SEQ ID NO: 7703722 - DNA, 22 bp, Homo sapiens
tggctcagtgcattcacagtaa

SEQ ID NO: 7703723 - DNA, 22 bp, Homo sapiens
tggctcagtgcattcacagtaa

SEQ ID NO: 7703724 - DNA, 22 bp, Homo sapiens
tggctcagtgcattcacagtaa

SEQ ID NO: 7703725 - DNA, 22 bp, Homo sapiens
tggctcagtgacattcctccca

SEQ ID NO: 7703726 - DNA, 22 bp, Homo sapiens
tggctcagtgcattcacagtaa

SEQ ID NO: 7703727 - DNA, 22 bp, Homo sapiens
tggctcagtgcattcacagtaa

SEQ ID NO: 7703728 - DNA, 22 bp, Homo sapiens
tggctcagtgacattcctccca

SEQ ID NO: 7703729 - DNA, 22 bp, Homo sapiens
tggctcagtgacattcctccca

SEQ ID NO: 7703730 - DNA, 22 bp, Homo sapiens
tggctcagtgacattcctccca

SEQ ID NO: 7703731 - DNA, 20 bp, Homo sapiens
tggcggggatgagggagtta

SEQ ID NO: 7703732 - DNA, 20 bp, Homo sapiens
tggcggggatgagggagtta

SEQ ID NO: 7703733 - DNA, 21 bp, Homo sapiens
tggcggggacttgtggctgcc

SEQ ID NO: 7703734 - DNA, 21 bp, Homo sapiens
tggcggggacttgtggctgcc

SEQ ID NO: 7703735 - DNA, 21 bp, Homo sapiens
tggcggggacttgtggctgcc

SEQ ID NO: 7703736 - DNA, 21 bp, Homo sapiens
tggcggggacttgtggctgcc

SEQ ID NO: 7703737 - DNA, 21 bp, Homo sapiens
tggcggggacttgtggctgcc

SEQ ID NO: 7703738 - DNA, 22 bp, Homo sapiens
tggcggctcaggaggggcagtt

SEQ ID NO: 7703739 - DNA, 22 bp, Homo sapiens
tggcggctcaggaggggcagtt

SEQ ID NO: 7703740 - DNA, 22 bp, Homo sapiens
tggcggagttccagctgggatc

SEQ ID NO: 7703741 - DNA, 22 bp, Homo sapiens
tggcggagttccagctgggatc

SEQ ID NO: 7703742 - DNA, 22 bp, Homo sapiens
tggcggagttccagctgggatc

SEQ ID NO: 7703743 - DNA, 22 bp, Homo sapiens
tggcggagttccagctgggatc

SEQ ID NO: 7703744 - DNA, 22 bp, Homo sapiens
tggcgcagtttctctgctgcct

SEQ ID NO: 7703745 - DNA, 22 bp, Homo sapiens
tggcgcgacgtgccccctgctt

SEQ ID NO: 7703746 - DNA, 22 bp, Homo sapiens
tggcgcgacgtgccccctgctt

SEQ ID NO: 7703747 - DNA, 21 bp, Homo sapiens
tggcgccgtcttgggactggc

SEQ ID NO: 7703748 - DNA, 22 bp, Homo sapiens
tggcgcgacgtgccccctgctt

SEQ ID NO: 7703749 - DNA, 22 bp, Homo sapiens
tggcgcgacgtgccccctgctt

SEQ ID NO: 7703750 - DNA, 22 bp, Homo sapiens
tggcgcgacgtgccccctgctt

SEQ ID NO: 7703751 - DNA, 22 bp, Homo sapiens
tggctaacaaggtgaaaccccg

SEQ ID NO: 7703752 - DNA, 22 bp, Homo sapiens
tggctaacaaggtgaaaccccg

SEQ ID NO: 7703753 - DNA, 22 bp, Homo sapiens
tggctagtccgttagaggcgtg

SEQ ID NO: 7703754 - DNA, 22 bp, Homo sapiens
tggctaacaaacaagacattag

SEQ ID NO: 7703755 - DNA, 22 bp, Homo sapiens
tggctaacaaggtgaaaccccg

SEQ ID NO: 7703756 - DNA, 22 bp, Homo sapiens
tggcgtgccctccagacttggc

SEQ ID NO: 7703757 - DNA, 22 bp, Homo sapiens
tggcgttgttctcgttccctac

SEQ ID NO: 7703758 - DNA, 23 bp, Homo sapiens
tggctaaacagtggagaaagctt

SEQ ID NO: 7703759 - DNA, 23 bp, Homo sapiens
tggctaaacagtggagaaagctt

SEQ ID NO: 7703760 - DNA, 20 bp, Homo sapiens
tggcggggatgagggagtta

SEQ ID NO: 7703761 - DNA, 20 bp, Homo sapiens
tggcggggatgagggagtta

SEQ ID NO: 7703762 - DNA, 20 bp, Homo sapiens
tggcggggatgagggagtta

SEQ ID NO: 7703763 - DNA, 20 bp, Homo sapiens
tggcggggatgagggagtta

SEQ ID NO: 7703764 - DNA, 22 bp, Homo sapiens
tggcggggcagctctggcttct

SEQ ID NO: 7703765 - DNA, 22 bp, Homo sapiens
tggcggtgacggcggcgcctgg

SEQ ID NO: 7703766 - DNA, 20 bp, Homo sapiens
tggcggggatgagggagtta

SEQ ID NO: 7703767 - DNA, 22 bp, Homo sapiens
tggcggggcagctctggcttct

SEQ ID NO: 7703768 - DNA, 22 bp, Homo sapiens
tggcgtctctcataagtatgtg

SEQ ID NO: 7703769 - DNA, 22 bp, Homo sapiens
tggcgtgaagctggaaggcgga

SEQ ID NO: 7703770 - DNA, 22 bp, Homo sapiens
tggctattgtgccaaatgaaca

SEQ ID NO: 7703771 - DNA, 22 bp, Homo sapiens
tggctattgtgccaaatgaaca

SEQ ID NO: 7703772 - DNA, 22 bp, Homo sapiens
tggctattgagtgatctctaga

SEQ ID NO: 7703773 - DNA, 22 bp, Homo sapiens
tggctatgcaaacctgaggctg

SEQ ID NO: 7703774 - DNA, 19 bp, Homo sapiens
tggctataattccagagct

SEQ ID NO: 7703775 - DNA, 22 bp, Homo sapiens
tggctatactctcagttaatac

SEQ ID NO: 7703776 - DNA, 22 bp, Homo sapiens
tggctatgaagtcttcacatga

SEQ ID NO: 7703777 - DNA, 22 bp, Homo sapiens
tggctatgaagtcttcacatga

SEQ ID NO: 7703778 - DNA, 22 bp, Homo sapiens
tggctatgacttcgtactgtct

SEQ ID NO: 7703779 - DNA, 22 bp, Homo sapiens
tggctcacaggactctctgggc

SEQ ID NO: 7703780 - DNA, 22 bp, Homo sapiens
tggctcacaatctcccatgaag

SEQ ID NO: 7703781 - DNA, 22 bp, Homo sapiens
tggctcactgtagccttgacct

SEQ ID NO: 7703782 - DNA, 22 bp, Homo sapiens
tggctcaagtgatcctcctgcc

SEQ ID NO: 7703783 - DNA, 22 bp, Homo sapiens
tggctcaccttcagaatatacc

SEQ ID NO: 7703784 - DNA, 22 bp, Homo sapiens
tggctatttacaaggtaggtga

SEQ ID NO: 7703785 - DNA, 22 bp, Homo sapiens
tggctcaagtaacaaaaatata

SEQ ID NO: 7703786 - DNA, 22 bp, Homo sapiens
tggctcaagtaacaaaaatata

SEQ ID NO: 7703787 - DNA, 22 bp, Homo sapiens
tggctcaagtaacaaaaatata

SEQ ID NO: 7703788 - DNA, 22 bp, Homo sapiens
tggctcacaatctcccatgaag

SEQ ID NO: 7703789 - DNA, 22 bp, Homo sapiens
tggctcacaatctcccatgaag

SEQ ID NO: 7703790 - DNA, 22 bp, Homo sapiens
tggctcagaagaaaaggtaaac

SEQ ID NO: 7703791 - DNA, 22 bp, Homo sapiens
tggctcagaagaaaaggtaaac

SEQ ID NO: 7703792 - DNA, 22 bp, Homo sapiens
tggctcagaagaaaaggtaaac

SEQ ID NO: 7703793 - DNA, 22 bp, Homo sapiens
tggctcagaactacttctagtt

SEQ ID NO: 7703794 - DNA, 22 bp, Homo sapiens
tggctcagaactacttctagtt

SEQ ID NO: 7703795 - DNA, 22 bp, Homo sapiens
tggctcagaactacttctagtt

SEQ ID NO: 7703796 - DNA, 22 bp, Homo sapiens
tggctcagaactacttctagtt

SEQ ID NO: 7703797 - DNA, 22 bp, Homo sapiens
tggctcagaactacttctagtt

SEQ ID NO: 7703798 - DNA, 22 bp, Homo sapiens
tggctcagaactacttctagtt

SEQ ID NO: 7703799 - DNA, 22 bp, Homo sapiens
tggctcagaactacttctagtt

SEQ ID NO: 7703800 - DNA, 22 bp, Homo sapiens
tggctcagaactacttctagtt

SEQ ID NO: 7703801 - DNA, 22 bp, Homo sapiens
tggctcacttccgtggagaggt

SEQ ID NO: 7703802 - DNA, 22 bp, Homo sapiens
tggctcactgtagccttgacct

SEQ ID NO: 7703803 - DNA, 22 bp, Homo sapiens
tggctcactgtagccttgacct

SEQ ID NO: 7703804 - DNA, 22 bp, Homo sapiens
tggctcacttccgtggagaggt

SEQ ID NO: 7703805 - DNA, 22 bp, Homo sapiens
tggctcacttccgtggagaggt

SEQ ID NO: 7703806 - DNA, 22 bp, Homo sapiens
tggctcacttccgtggagaggt

SEQ ID NO: 7703807 - DNA, 22 bp, Homo sapiens
tggctcagatttttgtaggctt

SEQ ID NO: 7703808 - DNA, 18 bp, Homo sapiens
tggctcagatggctttaa

SEQ ID NO: 7703809 - DNA, 22 bp, Homo sapiens
tggctcagatttttgtaggctt

SEQ ID NO: 7703810 - DNA, 22 bp, Homo sapiens
tggctcagatttttgtaggctt

SEQ ID NO: 7703811 - DNA, 22 bp, Homo sapiens
tggctcagatttttgtaggctt

SEQ ID NO: 7703812 - DNA, 22 bp, Homo sapiens
tggctcagatttttgtaggctt

SEQ ID NO: 7703813 - DNA, 18 bp, Homo sapiens
tggctcagatggctttaa

SEQ ID NO: 7703814 - DNA, 18 bp, Homo sapiens
tggctcagatggctttaa

SEQ ID NO: 7703815 - DNA, 22 bp, Homo sapiens
tggctcagatgctcttccagtg

SEQ ID NO: 7703816 - DNA, 22 bp, Homo sapiens
tggctcagatgctcttccagtg

SEQ ID NO: 7703817 - DNA, 22 bp, Homo sapiens
tggctcagatgctcttccagtg

SEQ ID NO: 7703818 - DNA, 22 bp, Homo sapiens
tggctcagatgctcttccagtg

SEQ ID NO: 7703819 - DNA, 22 bp, Homo sapiens
tggctcagatgctcttccagtg

SEQ ID NO: 7703820 - DNA, 22 bp, Homo sapiens
tggctcagatgctcttccagtg

SEQ ID NO: 7703821 - DNA, 22 bp, Homo sapiens
tggctcagatgctcttccagtg

SEQ ID NO: 7703822 - DNA, 18 bp, Homo sapiens
tggctcagatggctttaa

SEQ ID NO: 7703823 - DNA, 22 bp, Homo sapiens
tggctcagatgctcttccagtg

SEQ ID NO: 7703824 - DNA, 22 bp, Homo sapiens
tggctcagaggggaagtggttt

SEQ ID NO: 7703825 - DNA, 22 bp, Homo sapiens
tggctcagaggggaagtggttt

SEQ ID NO: 7703826 - DNA, 22 bp, Homo sapiens
tggctcagaggggaagtggttt

SEQ ID NO: 7703827 - DNA, 22 bp, Homo sapiens
tggctcagaggggaagtggttt

SEQ ID NO: 7703828 - DNA, 22 bp, Homo sapiens
tggctcagagttcatcttttag

SEQ ID NO: 7703829 - DNA, 22 bp, Homo sapiens
tggctcagataattcaaggggc

SEQ ID NO: 7703830 - DNA, 22 bp, Homo sapiens
tggctcagagttcatcttttag

SEQ ID NO: 7703831 - DNA, 22 bp, Homo sapiens
tggctcagataattcaaggggc

SEQ ID NO: 7703832 - DNA, 22 bp, Homo sapiens
tggctcagataattcaaggggc

SEQ ID NO: 7703833 - DNA, 22 bp, Homo sapiens
tggctcagataattcaaggggc

SEQ ID NO: 7703834 - DNA, 22 bp, Homo sapiens
tggctcagataattcaaggggc

SEQ ID NO: 7703835 - DNA, 22 bp, Homo sapiens
tggctcagataattcaaggggc

SEQ ID NO: 7703836 - DNA, 22 bp, Homo sapiens
tggctcagataattcaaggggc

SEQ ID NO: 7703837 - DNA, 22 bp, Homo sapiens
tggctcagagttcatcttttag

SEQ ID NO: 7703838 - DNA, 22 bp, Homo sapiens
tggctcagataattcaaggggc

SEQ ID NO: 7703839 - DNA, 22 bp, Homo sapiens
tggctcagatgctcttccagtg

SEQ ID NO: 7703840 - DNA, 22 bp, Homo sapiens
tggctcagataattcaaggggc

SEQ ID NO: 7703841 - DNA, 22 bp, Homo sapiens
tggctcagataattcaaggggc

SEQ ID NO: 7703842 - DNA, 22 bp, Homo sapiens
tggctcagaaggctgccttcac

SEQ ID NO: 7703843 - DNA, 22 bp, Homo sapiens
tggctcagaaggctgccttcac

SEQ ID NO: 7703844 - DNA, 22 bp, Homo sapiens
tggctcagaaggctgccttcac

SEQ ID NO: 7703845 - DNA, 22 bp, Homo sapiens
tggctcagaaggctgccttcac

SEQ ID NO: 7703846 - DNA, 22 bp, Homo sapiens
tggctcagaaggctgccttcac

SEQ ID NO: 7703847 - DNA, 22 bp, Homo sapiens
tggctcagaagaaaaggtaaac

SEQ ID NO: 7703848 - DNA, 22 bp, Homo sapiens
tggctcagaaggctgccttcac

SEQ ID NO: 7703849 - DNA, 22 bp, Homo sapiens
tggctcagaaggctgccttcac

SEQ ID NO: 7703850 - DNA, 22 bp, Homo sapiens
tggctcagaagaaaaggtaaac

SEQ ID NO: 7703851 - DNA, 22 bp, Homo sapiens
tggctcagagagggagtgtgga

SEQ ID NO: 7703852 - DNA, 22 bp, Homo sapiens
tggctcagagagggagtgtgga

SEQ ID NO: 7703853 - DNA, 22 bp, Homo sapiens
tggctcagagagggagtgtgga

SEQ ID NO: 7703854 - DNA, 22 bp, Homo sapiens
tggctcagagagggagtgtgga

SEQ ID NO: 7703855 - DNA, 22 bp, Homo sapiens
tggctcagagagggagtgtgga

SEQ ID NO: 7703856 - DNA, 22 bp, Homo sapiens
tggctcagagagggagtgtgga

SEQ ID NO: 7703857 - DNA, 22 bp, Homo sapiens
tggctcagaaggctgccttcac

SEQ ID NO: 7703858 - DNA, 22 bp, Homo sapiens
tggctcagaaggctgccttcac

SEQ ID NO: 7703859 - DNA, 22 bp, Homo sapiens
tggctcagagccttgagagctg

SEQ ID NO: 7703860 - DNA, 22 bp, Homo sapiens
tggctcagagccttgagagctg

SEQ ID NO: 7703861 - DNA, 22 bp, Homo sapiens
tggctcagagccttgagagctg

SEQ ID NO: 7703862 - DNA, 22 bp, Homo sapiens
tggctcagagccttgagagctg

SEQ ID NO: 7703863 - DNA, 22 bp, Homo sapiens
tggctcagaggggaagtggttt

SEQ ID NO: 7703864 - DNA, 22 bp, Homo sapiens
tggctcagagccttgagagctg

SEQ ID NO: 7703865 - DNA, 22 bp, Homo sapiens
tggctcagagccttgagagctg

SEQ ID NO: 7703866 - DNA, 22 bp, Homo sapiens
tggctcagagccttgagagctg

SEQ ID NO: 7703867 - DNA, 22 bp, Homo sapiens
tggctcagagccttgagagctg

SEQ ID NO: 7703868 - DNA, 22 bp, Homo sapiens
tggctcagagcagggactctgg

SEQ ID NO: 7703869 - DNA, 22 bp, Homo sapiens
tggctcagagccttgagagctg

SEQ ID NO: 7703870 - DNA, 22 bp, Homo sapiens
tggctcagagcagggactctgg

SEQ ID NO: 7703871 - DNA, 22 bp, Homo sapiens
tggctcagagcagggactctgg

SEQ ID NO: 7703872 - DNA, 22 bp, Homo sapiens
tggctcagagcagggactctgg

SEQ ID NO: 7703873 - DNA, 22 bp, Homo sapiens
tggctcagagcagggactctgg

SEQ ID NO: 7703874 - DNA, 22 bp, Homo sapiens
tggctcagagagggagtgtgga

SEQ ID NO: 7703875 - DNA, 22 bp, Homo sapiens
tggctcagagcagggactctgg

SEQ ID NO: 7703876 - DNA, 22 bp, Homo sapiens
tggctcagagcagggactctgg

SEQ ID NO: 7703877 - DNA, 22 bp, Homo sapiens
tggcctggtgctcaggcagtag

SEQ ID NO: 7703878 - DNA, 22 bp, Homo sapiens
tggcctggtgctcaggcagtag

SEQ ID NO: 7703879 - DNA, 22 bp, Homo sapiens
tggcctggtgctcaggcagtag

SEQ ID NO: 7703880 - DNA, 22 bp, Homo sapiens
tggcctggtgctcaggcagtag

SEQ ID NO: 7703881 - DNA, 22 bp, Homo sapiens
tggcctggtgctcaggcagtag

SEQ ID NO: 7703882 - DNA, 22 bp, Homo sapiens
tggcctggtccttgtcaaggca

SEQ ID NO: 7703883 - DNA, 22 bp, Homo sapiens
tggcctggtccttgtcaaggca

SEQ ID NO: 7703884 - DNA, 22 bp, Homo sapiens
tggcctggtccttgtcaaggca

SEQ ID NO: 7703885 - DNA, 22 bp, Homo sapiens
tggcctggtgtctgcgaggcct

SEQ ID NO: 7703886 - DNA, 22 bp, Homo sapiens
tggcctggtgtctgcgaggcct

SEQ ID NO: 7703887 - DNA, 22 bp, Homo sapiens
tggcctggtgtctgcgaggcct

SEQ ID NO: 7703888 - DNA, 22 bp, Homo sapiens
tggcctggtgtctgcgaggcct

SEQ ID NO: 7703889 - DNA, 22 bp, Homo sapiens
tggcctggtgtctgcgaggcct

SEQ ID NO: 7703890 - DNA, 22 bp, Homo sapiens
tggcctggtgtctgcgaggcct

SEQ ID NO: 7703891 - DNA, 22 bp, Homo sapiens
tggcctggtgctcaggcagtag

SEQ ID NO: 7703892 - DNA, 22 bp, Homo sapiens
tggcctggtgtctgcgaggcct

SEQ ID NO: 7703893 - DNA, 22 bp, Homo sapiens
tggcctgtcactgcccagggct

SEQ ID NO: 7703894 - DNA, 22 bp, Homo sapiens
tggcctggttgttgctgccgtt

SEQ ID NO: 7703895 - DNA, 22 bp, Homo sapiens
tggcctggttgttgctgccgtt

SEQ ID NO: 7703896 - DNA, 22 bp, Homo sapiens
tggcctggttgttgctgccgtt

SEQ ID NO: 7703897 - DNA, 22 bp, Homo sapiens
tggcctggttgttgctgccgtt

SEQ ID NO: 7703898 - DNA, 22 bp, Homo sapiens
tggcctggttgttgctgccgtt

SEQ ID NO: 7703899 - DNA, 22 bp, Homo sapiens
tggcctggttgttgctgccgtt

SEQ ID NO: 7703900 - DNA, 22 bp, Homo sapiens
tggcctggttgttgctgccgtt

SEQ ID NO: 7703901 - DNA, 22 bp, Homo sapiens
tggcctggttgttgctgccgtt

SEQ ID NO: 7703902 - DNA, 22 bp, Homo sapiens
tggcctggttgttgctgccgtt

SEQ ID NO: 7703903 - DNA, 22 bp, Homo sapiens
tggcctggttatattgctatca

SEQ ID NO: 7703904 - DNA, 22 bp, Homo sapiens
tggcctggttatattgctatca

SEQ ID NO: 7703905 - DNA, 22 bp, Homo sapiens
tggcctggtgtctgcgaggcct

SEQ ID NO: 7703906 - DNA, 22 bp, Homo sapiens
tggcctggtgtctgcgaggcct

SEQ ID NO: 7703907 - DNA, 22 bp, Homo sapiens
tggcctggtgtctgcgaggcct

SEQ ID NO: 7703908 - DNA, 22 bp, Homo sapiens
tggcctggtgtctgcgaggcct

SEQ ID NO: 7703909 - DNA, 22 bp, Homo sapiens
tggcctggtgtctgcgaggcct

SEQ ID NO: 7703910 - DNA, 22 bp, Homo sapiens
tggcctggctcacagtgagatt

SEQ ID NO: 7703911 - DNA, 22 bp, Homo sapiens
tggcctggctcacagtgagatt

SEQ ID NO: 7703912 - DNA, 22 bp, Homo sapiens
tggcctggccctgaggccctgt

SEQ ID NO: 7703913 - DNA, 22 bp, Homo sapiens
tggcctggctcacagtgagatt

SEQ ID NO: 7703914 - DNA, 22 bp, Homo sapiens
tggcctggccctgaggccctgt

SEQ ID NO: 7703915 - DNA, 22 bp, Homo sapiens
tggcctggccctgaggccctgt

SEQ ID NO: 7703916 - DNA, 22 bp, Homo sapiens
tggcctggccctgaggccctgt

SEQ ID NO: 7703917 - DNA, 22 bp, Homo sapiens
tggcctgggtcacaccagggtc

SEQ ID NO: 7703918 - DNA, 22 bp, Homo sapiens
tggcctgggtcacaccagggtc

SEQ ID NO: 7703919 - DNA, 22 bp, Homo sapiens
tggcctgggtcacaccagggtc

SEQ ID NO: 7703920 - DNA, 22 bp, Homo sapiens
tggcctgggtgctgctgacatc

SEQ ID NO: 7703921 - DNA, 22 bp, Homo sapiens
tggcctggctcacagtgagatt

SEQ ID NO: 7703922 - DNA, 22 bp, Homo sapiens
tggcctggctcacagtgagatt

SEQ ID NO: 7703923 - DNA, 22 bp, Homo sapiens
tggcctggctcacagtgagatt

SEQ ID NO: 7703924 - DNA, 22 bp, Homo sapiens
tggcctggtccttgtcaaggca

SEQ ID NO: 7703925 - DNA, 22 bp, Homo sapiens
tggcctggtccttgtcaaggca

SEQ ID NO: 7703926 - DNA, 22 bp, Homo sapiens
tggcctggtccttgtcaaggca

SEQ ID NO: 7703927 - DNA, 22 bp, Homo sapiens
tggcctggtccttgtcaaggca

SEQ ID NO: 7703928 - DNA, 22 bp, Homo sapiens
tggcctggtccttgtcaaggca

SEQ ID NO: 7703929 - DNA, 22 bp, Homo sapiens
tggcctggtccttgtcaaggca

SEQ ID NO: 7703930 - DNA, 22 bp, Homo sapiens
tggcctggtaccacatagattt

SEQ ID NO: 7703931 - DNA, 22 bp, Homo sapiens
tggcctgggtgctgctgacatc

SEQ ID NO: 7703932 - DNA, 22 bp, Homo sapiens
tggcctgggtgctgctgacatc

SEQ ID NO: 7703933 - DNA, 22 bp, Homo sapiens
tggcctgggtgctgctgacatc

SEQ ID NO: 7703934 - DNA, 22 bp, Homo sapiens
tggcctgggtgctgctgacatc

SEQ ID NO: 7703935 - DNA, 22 bp, Homo sapiens
tggcctggtaccacatagattt

SEQ ID NO: 7703936 - DNA, 22 bp, Homo sapiens
tggcctgggtgctgctgacatc

SEQ ID NO: 7703937 - DNA, 22 bp, Homo sapiens
tggcctgttgctcctaggggtc

SEQ ID NO: 7703938 - DNA, 22 bp, Homo sapiens
tggccttcctggtgactcatga

SEQ ID NO: 7703939 - DNA, 22 bp, Homo sapiens
tggccttcctggtgactcatga

SEQ ID NO: 7703940 - DNA, 22 bp, Homo sapiens
tggccttaattatgtaatttat

SEQ ID NO: 7703941 - DNA, 22 bp, Homo sapiens
tggccttgaactcatcacgtgg

SEQ ID NO: 7703942 - DNA, 22 bp, Homo sapiens
tggccttgaaccaggtctccac

SEQ ID NO: 7703943 - DNA, 22 bp, Homo sapiens
tggccttgaaccaggtctccac

SEQ ID NO: 7703944 - DNA, 22 bp, Homo sapiens
tggccttcctggtgactcatga

SEQ ID NO: 7703945 - DNA, 22 bp, Homo sapiens
tggcctgtcactgcccagggct

SEQ ID NO: 7703946 - DNA, 22 bp, Homo sapiens
tggcctgtgactgcctctgggc

SEQ ID NO: 7703947 - DNA, 22 bp, Homo sapiens
tggcctgtggcacgtgctccat

SEQ ID NO: 7703948 - DNA, 22 bp, Homo sapiens
tggcctgtggatcccagctctg

SEQ ID NO: 7703949 - DNA, 22 bp, Homo sapiens
tggcctgtggcacgtgctccat

SEQ ID NO: 7703950 - DNA, 22 bp, Homo sapiens
tggcctgtggcatgacctctag

SEQ ID NO: 7703951 - DNA, 18 bp, Homo sapiens
tggccttgaatcatatca

SEQ ID NO: 7703952 - DNA, 22 bp, Homo sapiens
tggccttgagaatgtccctagg

SEQ ID NO: 7703953 - DNA, 22 bp, Homo sapiens
tggccttgagaatgtccctagg

SEQ ID NO: 7703954 - DNA, 22 bp, Homo sapiens
tggccttgagagatcaaaaggt

SEQ ID NO: 7703955 - DNA, 22 bp, Homo sapiens
tggccttgagagatcaaaaggt

SEQ ID NO: 7703956 - DNA, 22 bp, Homo sapiens
tggccttgagatgcagcagcca

SEQ ID NO: 7703957 - DNA, 22 bp, Homo sapiens
tggccttgagatgcagcagcca

SEQ ID NO: 7703958 - DNA, 22 bp, Homo sapiens
tggccttgagatgcagcagcca

SEQ ID NO: 7703959 - DNA, 22 bp, Homo sapiens
tggccttgagtggtctccgccc

SEQ ID NO: 7703960 - DNA, 21 bp, Homo sapiens
tggccttgagagtctccttgc

SEQ ID NO: 7703961 - DNA, 22 bp, Homo sapiens
tggccttgataactggggagag

SEQ ID NO: 7703962 - DNA, 22 bp, Homo sapiens
tggccttgattatgccagtaga

SEQ ID NO: 7703963 - DNA, 22 bp, Homo sapiens
tggccttgccacatttgtcagc

SEQ ID NO: 7703964 - DNA, 22 bp, Homo sapiens
tggccttgattatgccagtaga

SEQ ID NO: 7703965 - DNA, 22 bp, Homo sapiens
tggccttgcccagcgcctaggt

SEQ ID NO: 7703966 - DNA, 22 bp, Homo sapiens
tggccttggacagagcgctcct

SEQ ID NO: 7703967 - DNA, 22 bp, Homo sapiens
tggccttggacagagcgctcct

SEQ ID NO: 7703968 - DNA, 22 bp, Homo sapiens
tggccttgccacatttgtcagc

SEQ ID NO: 7703969 - DNA, 22 bp, Homo sapiens
tggccttgcccagcgcctaggt

SEQ ID NO: 7703970 - DNA, 22 bp, Homo sapiens
tggccttggagaggcacggccc

SEQ ID NO: 7703971 - DNA, 22 bp, Homo sapiens
tggccttggagaggcacggccc

SEQ ID NO: 7703972 - DNA, 22 bp, Homo sapiens
tggccttggagaggcacggccc

SEQ ID NO: 7703973 - DNA, 22 bp, Homo sapiens
tggccttggcagtgagaagagt

SEQ ID NO: 7703974 - DNA, 22 bp, Homo sapiens
tggccttggagaggcacggccc

SEQ ID NO: 7703975 - DNA, 22 bp, Homo sapiens
tggcgcagtttctctgctgcct

SEQ ID NO: 7703976 - DNA, 22 bp, Homo sapiens
tggcgcagtttctctgctgcct

SEQ ID NO: 7703977 - DNA, 22 bp, Homo sapiens
tggcgcaactcattcatggtgt

SEQ ID NO: 7703978 - DNA, 18 bp, Homo sapiens
tggcgatggtcatttttc

SEQ ID NO: 7703979 - DNA, 22 bp, Homo sapiens
tggcgaggtttcagagagcggc

SEQ ID NO: 7703980 - DNA, 22 bp, Homo sapiens
tggcgaggtttcagagagcggc

SEQ ID NO: 7703981 - DNA, 22 bp, Homo sapiens
tggcgaggccaggccagggcct

SEQ ID NO: 7703982 - DNA, 22 bp, Homo sapiens
tggcgaggtttcagagagcggc

SEQ ID NO: 7703983 - DNA, 20 bp, Homo sapiens
tggccttttggcttggagct

SEQ ID NO: 7703984 - DNA, 20 bp, Homo sapiens
tggccttttggcttggagct

SEQ ID NO: 7703985 - DNA, 22 bp, Homo sapiens
tggcctttgttgatagctatgc

SEQ ID NO: 7703986 - DNA, 22 bp, Homo sapiens
tggcctttgttgatagctatgc

SEQ ID NO: 7703987 - DNA, 20 bp, Homo sapiens
tggcctttaaatagtattcc

SEQ ID NO: 7703988 - DNA, 20 bp, Homo sapiens
tggcctttaaatagtattcc

SEQ ID NO: 7703989 - DNA, 22 bp, Homo sapiens
tggccttgttctctctcccatc

SEQ ID NO: 7703990 - DNA, 22 bp, Homo sapiens
tggccttgttctctctcccatc

SEQ ID NO: 7703991 - DNA, 22 bp, Homo sapiens
tggcgaggccaggccagggcct

SEQ ID NO: 7703992 - DNA, 22 bp, Homo sapiens
tggcgaggccaggccagggcct

SEQ ID NO: 7703993 - DNA, 22 bp, Homo sapiens
tggcgagctttgttctccagga

SEQ ID NO: 7703994 - DNA, 22 bp, Homo sapiens
tggcgagctttgttctccagga

SEQ ID NO: 7703995 - DNA, 20 bp, Homo sapiens
tggccttttggcttggagct

SEQ ID NO: 7703996 - DNA, 22 bp, Homo sapiens
tggcgagccccgactgagtgtt

SEQ ID NO: 7703997 - DNA, 22 bp, Homo sapiens
tggcgagccccgactgagtgtt

SEQ ID NO: 7703998 - DNA, 22 bp, Homo sapiens
tggcgagcatccagcgcatcca

SEQ ID NO: 7703999 - DNA, 22 bp, Homo sapiens
tggccttggcagtgagaagagt

SEQ ID NO: 7704000 - DNA, 22 bp, Homo sapiens
tggccttggcagtgagaagagt

SEQ ID NO: 7704001 - DNA, 22 bp, Homo sapiens
tggccttggccgtgctggggtc

SEQ ID NO: 7704002 - DNA, 22 bp, Homo sapiens
tggccttggctgagagatttaa

SEQ ID NO: 7704003 - DNA, 22 bp, Homo sapiens
tggccttggccttttctgctcc

SEQ ID NO: 7704004 - DNA, 22 bp, Homo sapiens
tggccttgggcaggtggcctgc

SEQ ID NO: 7704005 - DNA, 22 bp, Homo sapiens
tggccttgggcaggtggcctgc

SEQ ID NO: 7704006 - DNA, 20 bp, Homo sapiens
tggccttggggagctcacac

SEQ ID NO: 7704007 - DNA, 20 bp, Homo sapiens
tggccttggggagctcacac

SEQ ID NO: 7704008 - DNA, 20 bp, Homo sapiens
tggccttggggagctcacac

SEQ ID NO: 7704009 - DNA, 20 bp, Homo sapiens
tggccttggggagctcacac

SEQ ID NO: 7704010 - DNA, 22 bp, Homo sapiens
tggccttgggtccttagcatca

SEQ ID NO: 7704011 - DNA, 22 bp, Homo sapiens
tggccttggtcacaatgcaaac

SEQ ID NO: 7704012 - DNA, 22 bp, Homo sapiens
tggccttgtctctcagaaccgc

SEQ ID NO: 7704013 - DNA, 22 bp, Homo sapiens
tggccttggtcctctttgcaat

SEQ ID NO: 7704014 - DNA, 22 bp, Homo sapiens
tggccttgtctctcagaaccgc

SEQ ID NO: 7704015 - DNA, 22 bp, Homo sapiens
tggccttgtgtttaagcaagaa

SEQ ID NO: 7704016 - DNA, 15 bp, Homo sapiens
tggccttgtggttgt

SEQ ID NO: 7704017 - DNA, 22 bp, Homo sapiens
tggccttgtgtttaagcaagaa

SEQ ID NO: 7704018 - DNA, 22 bp, Homo sapiens
tggccttgtgttttagagaaag

SEQ ID NO: 7704019 - DNA, 22 bp, Homo sapiens
tggccttgtgtttaagcaagaa

SEQ ID NO: 7704020 - DNA, 22 bp, Homo sapiens
tggccttgtgtttaagcaagaa

SEQ ID NO: 7704021 - DNA, 22 bp, Homo sapiens
tggctgagtaagttgtgatatg

SEQ ID NO: 7704022 - DNA, 22 bp, Homo sapiens
tggctgagtaagttgtgatatg

SEQ ID NO: 7704023 - DNA, 22 bp, Homo sapiens
tggctgagtaagttgtgatatg

SEQ ID NO: 7704024 - DNA, 22 bp, Homo sapiens
tggctgagtgaacatgtccatt

SEQ ID NO: 7704025 - DNA, 22 bp, Homo sapiens
tggctgaggttatgctggttgt

SEQ ID NO: 7704026 - DNA, 22 bp, Homo sapiens
tggctgaggttatgctggttgt

SEQ ID NO: 7704027 - DNA, 22 bp, Homo sapiens
tggctgagtaagttgtgatatg

SEQ ID NO: 7704028 - DNA, 22 bp, Homo sapiens
tggctgaggttatgctggttgt

SEQ ID NO: 7704029 - DNA, 22 bp, Homo sapiens
tggctgagggcactatgaagcc

SEQ ID NO: 7704030 - DNA, 22 bp, Homo sapiens
tggctgaggtctggggcttctg

SEQ ID NO: 7704031 - DNA, 22 bp, Homo sapiens
tggctgaggttatgctggttgt

SEQ ID NO: 7704032 - DNA, 22 bp, Homo sapiens
tggctgaggttatgctggttgt

SEQ ID NO: 7704033 - DNA, 22 bp, Homo sapiens
tggctgaggttatgctggttgt

SEQ ID NO: 7704034 - DNA, 22 bp, Homo sapiens
tggctgaggctggagtgcagtg

SEQ ID NO: 7704035 - DNA, 22 bp, Homo sapiens
tggctgaggctggagtgcagtg

SEQ ID NO: 7704036 - DNA, 22 bp, Homo sapiens
tggctgaggctggagtgcagtg

SEQ ID NO: 7704037 - DNA, 22 bp, Homo sapiens
tggctgaggctggagtgcagtg

SEQ ID NO: 7704038 - DNA, 22 bp, Homo sapiens
tggctgaggctggagtgcagtg

SEQ ID NO: 7704039 - DNA, 22 bp, Homo sapiens
tggctgaggctggagtgcagtg

SEQ ID NO: 7704040 - DNA, 22 bp, Homo sapiens
tggctgaggctggagtgcagtg

SEQ ID NO: 7704041 - DNA, 22 bp, Homo sapiens
tggctgaggctggagtgcagtg

SEQ ID NO: 7704042 - DNA, 22 bp, Homo sapiens
tggctgaggcacagctgccgcc

SEQ ID NO: 7704043 - DNA, 22 bp, Homo sapiens
tggctgaggcttttcttaaaga

SEQ ID NO: 7704044 - DNA, 22 bp, Homo sapiens
tggctgaggctggagtgcagtg

SEQ ID NO: 7704045 - DNA, 22 bp, Homo sapiens
tggctgagggcactatgaagcc

SEQ ID NO: 7704046 - DNA, 22 bp, Homo sapiens
tggctgagggcactatgaagcc

SEQ ID NO: 7704047 - DNA, 22 bp, Homo sapiens
tggctgaggcttttcttaaaga

SEQ ID NO: 7704048 - DNA, 22 bp, Homo sapiens
tggctgaggctggagtgcagtg

SEQ ID NO: 7704049 - DNA, 22 bp, Homo sapiens
tggctgaggctggagtgcagtg

SEQ ID NO: 7704050 - DNA, 22 bp, Homo sapiens
tggctgaggagagggcggaagt

SEQ ID NO: 7704051 - DNA, 22 bp, Homo sapiens
tggctgaggagagggcggaagt

SEQ ID NO: 7704052 - DNA, 22 bp, Homo sapiens
tggctgaggagagggcggaagt

SEQ ID NO: 7704053 - DNA, 22 bp, Homo sapiens
tggctgaggagagggcggaagt

SEQ ID NO: 7704054 - DNA, 19 bp, Homo sapiens
tggctgagctggactgagg

SEQ ID NO: 7704055 - DNA, 19 bp, Homo sapiens
tggctgagctggactgagg

SEQ ID NO: 7704056 - DNA, 19 bp, Homo sapiens
tggctgagctggactgagg

SEQ ID NO: 7704057 - DNA, 22 bp, Homo sapiens
tggctgaggagagggcggaagt

SEQ ID NO: 7704058 - DNA, 19 bp, Homo sapiens
tggctgagctggactgagg

SEQ ID NO: 7704059 - DNA, 22 bp, Homo sapiens
tggctgaggagggtcttctggt

SEQ ID NO: 7704060 - DNA, 22 bp, Homo sapiens
tggctgaggagggtcttctggt

SEQ ID NO: 7704061 - DNA, 22 bp, Homo sapiens
tggctgaggagggtcttctggt

SEQ ID NO: 7704062 - DNA, 22 bp, Homo sapiens
tggctgaggagggtcttctggt

SEQ ID NO: 7704063 - DNA, 22 bp, Homo sapiens
tggctgaggagggtcttctggt

SEQ ID NO: 7704064 - DNA, 22 bp, Homo sapiens
tggctgaggcacagctgccgcc

SEQ ID NO: 7704065 - DNA, 22 bp, Homo sapiens
tggctgaggcacagctgccgcc

SEQ ID NO: 7704066 - DNA, 22 bp, Homo sapiens
tggctgaggcacagctgccgcc

SEQ ID NO: 7704067 - DNA, 19 bp, Homo sapiens
tggctgagctggactgagg

SEQ ID NO: 7704068 - DNA, 19 bp, Homo sapiens
tggctgagctggactgagg

SEQ ID NO: 7704069 - DNA, 19 bp, Homo sapiens
tggctgagctggactgagg

SEQ ID NO: 7704070 - DNA, 22 bp, Homo sapiens
tggctgagctgcagcgtggctt

SEQ ID NO: 7704071 - DNA, 22 bp, Homo sapiens
tggctgagctgcagcgtggctt

SEQ ID NO: 7704072 - DNA, 22 bp, Homo sapiens
tggctgagctgcagcgtggctt

SEQ ID NO: 7704073 - DNA, 22 bp, Homo sapiens
tggctgagctccctgtgtgttg

SEQ ID NO: 7704074 - DNA, 22 bp, Homo sapiens
tggctgagctgcagcgtggctt

SEQ ID NO: 7704075 - DNA, 22 bp, Homo sapiens
tggctgagctccctgtgtgttg

SEQ ID NO: 7704076 - DNA, 22 bp, Homo sapiens
tggctgagctgcagcgtggctt

SEQ ID NO: 7704077 - DNA, 22 bp, Homo sapiens
tggctgagctgcagcgtggctt

SEQ ID NO: 7704078 - DNA, 22 bp, Homo sapiens
tggctgagcctttggggctttc

SEQ ID NO: 7704079 - DNA, 22 bp, Homo sapiens
tggctgagctccctgtgtgttg

SEQ ID NO: 7704080 - DNA, 22 bp, Homo sapiens
tggctgagccacttgttcagat

SEQ ID NO: 7704081 - DNA, 22 bp, Homo sapiens
tggctgagccacttgttcagat

SEQ ID NO: 7704082 - DNA, 22 bp, Homo sapiens
tggctgagccacttgttcagat

SEQ ID NO: 7704083 - DNA, 23 bp, Homo sapiens
tggctgagatcctactgtttgct

SEQ ID NO: 7704084 - DNA, 23 bp, Homo sapiens
tggctgagatcctactgtttgct

SEQ ID NO: 7704085 - DNA, 23 bp, Homo sapiens
tggctgagatcctactgtttgct

SEQ ID NO: 7704086 - DNA, 22 bp, Homo sapiens
tggctgagagtcatcctgtgtg

SEQ ID NO: 7704087 - DNA, 22 bp, Homo sapiens
tggctgagagtcatcctgtgtg

SEQ ID NO: 7704088 - DNA, 22 bp, Homo sapiens
tggctgagagcaattgactctg

SEQ ID NO: 7704089 - DNA, 22 bp, Homo sapiens
tggctgagaagttctggtggga

SEQ ID NO: 7704090 - DNA, 22 bp, Homo sapiens
tggctgagaagttctggtggga

SEQ ID NO: 7704091 - DNA, 22 bp, Homo sapiens
tggctgagagtcatcctgtgtg

SEQ ID NO: 7704092 - DNA, 22 bp, Homo sapiens
tggctgagagtcatcctgtgtg

SEQ ID NO: 7704093 - DNA, 22 bp, Homo sapiens
tggctgagagtcatcctgtgtg

SEQ ID NO: 7704094 - DNA, 23 bp, Homo sapiens
tggctgagcccactatcttggcc

SEQ ID NO: 7704095 - DNA, 21 bp, Homo sapiens
tggctgagccaggtgtgtgga

SEQ ID NO: 7704096 - DNA, 23 bp, Homo sapiens
tggctgagcccactatcttggcc

SEQ ID NO: 7704097 - DNA, 23 bp, Homo sapiens
tggctgagcccactatcttggcc

SEQ ID NO: 7704098 - DNA, 22 bp, Homo sapiens
tggctgagcctttggggctttc

SEQ ID NO: 7704099 - DNA, 22 bp, Homo sapiens
tggctgagcctttggggctttc

SEQ ID NO: 7704100 - DNA, 22 bp, Homo sapiens
tggctgagcctttggggctttc

SEQ ID NO: 7704101 - DNA, 22 bp, Homo sapiens
tggctgagccacttgttcagat

SEQ ID NO: 7704102 - DNA, 21 bp, Homo sapiens
tggctgagccaggtgtgtgga

SEQ ID NO: 7704103 - DNA, 21 bp, Homo sapiens
tggctgagccaggtgtgtgga

SEQ ID NO: 7704104 - DNA, 21 bp, Homo sapiens
tggctgagccaggtgtgtgga

SEQ ID NO: 7704105 - DNA, 21 bp, Homo sapiens
tggctgagccaggtgtgtgga

SEQ ID NO: 7704106 - DNA, 22 bp, Homo sapiens
tggctgagaaaatggttttagg

SEQ ID NO: 7704107 - DNA, 22 bp, Homo sapiens
tggctgagaagttctggtggga

SEQ ID NO: 7704108 - DNA, 22 bp, Homo sapiens
tggctgagaaaatggttttagg

SEQ ID NO: 7704109 - DNA, 22 bp, Homo sapiens
tggctgagaaaatggttttagg

SEQ ID NO: 7704110 - DNA, 22 bp, Homo sapiens
tggctgagaagttctggtggga

SEQ ID NO: 7704111 - DNA, 22 bp, Homo sapiens
tggctgagaagttctggtggga

SEQ ID NO: 7704112 - DNA, 22 bp, Homo sapiens
tggctgagaagttctggtggga

SEQ ID NO: 7704113 - DNA, 22 bp, Homo sapiens
tggctgagaagttctggtggga

SEQ ID NO: 7704114 - DNA, 22 bp, Homo sapiens
tggctgagaagttctggtggga

SEQ ID NO: 7704115 - DNA, 22 bp, Homo sapiens
tggctgagaaaaaagagctata

SEQ ID NO: 7704116 - DNA, 22 bp, Homo sapiens
tggctgagaaaaaagagctata

SEQ ID NO: 7704117 - DNA, 22 bp, Homo sapiens
tggctgagaaaatggttttagg

SEQ ID NO: 7704118 - DNA, 22 bp, Homo sapiens
tggctgagaaaaaagagctata

SEQ ID NO: 7704119 - DNA, 21 bp, Homo sapiens
tggctgactcttcctatcatt

SEQ ID NO: 7704120 - DNA, 21 bp, Homo sapiens
tggctgactcttcctatcatt

SEQ ID NO: 7704121 - DNA, 22 bp, Homo sapiens
tggctgagaaaaaagagctata

SEQ ID NO: 7704122 - DNA, 22 bp, Homo sapiens
tggctgagaaaaaagagctata

SEQ ID NO: 7704123 - DNA, 22 bp, Homo sapiens
tggctgaatctgcagcaggaag

SEQ ID NO: 7704124 - DNA, 22 bp, Homo sapiens
tggctgaatctgcagcaggaag

SEQ ID NO: 7704125 - DNA, 22 bp, Homo sapiens
tggctgaattcatcaagaaaat

SEQ ID NO: 7704126 - DNA, 22 bp, Homo sapiens
tggctgaataaaatatggtgtt

SEQ ID NO: 7704127 - DNA, 22 bp, Homo sapiens
tggctgacaaataggtgcagtt

SEQ ID NO: 7704128 - DNA, 22 bp, Homo sapiens
tggctgaattcatcaagaaaat

SEQ ID NO: 7704129 - DNA, 22 bp, Homo sapiens
tggctgacaaataggtgcagtt

SEQ ID NO: 7704130 - DNA, 22 bp, Homo sapiens
tggctgacaaataggtgcagtt

SEQ ID NO: 7704131 - DNA, 22 bp, Homo sapiens
tggctgacaatgtagcagtaac

SEQ ID NO: 7704132 - DNA, 22 bp, Homo sapiens
tggctgacaatgtagcagtaac

SEQ ID NO: 7704133 - DNA, 22 bp, Homo sapiens
tggctgacaatgtagcagtaac

SEQ ID NO: 7704134 - DNA, 22 bp, Homo sapiens
tggctgaataaaatatggtgtt

SEQ ID NO: 7704135 - DNA, 22 bp, Homo sapiens
tggctgaactaatgtgctgttt

SEQ ID NO: 7704136 - DNA, 22 bp, Homo sapiens
tggctgaagtgggcaggaggga

SEQ ID NO: 7704137 - DNA, 22 bp, Homo sapiens
tggctgaactaatgtgctgttt

SEQ ID NO: 7704138 - DNA, 22 bp, Homo sapiens
tggctgaaggaagattcttcta

SEQ ID NO: 7704139 - DNA, 22 bp, Homo sapiens
tggctgaagtgggcaggaggga

SEQ ID NO: 7704140 - DNA, 22 bp, Homo sapiens
tggctgaaagcctggcctgcca

SEQ ID NO: 7704141 - DNA, 22 bp, Homo sapiens
tggctgaaagcctggcctgcca

SEQ ID NO: 7704142 - DNA, 22 bp, Homo sapiens
tggctgaaagcctggcctgcca

SEQ ID NO: 7704143 - DNA, 22 bp, Homo sapiens
tggctcttttcacgtcccctct

SEQ ID NO: 7704144 - DNA, 19 bp, Homo sapiens
tggctctttttatgacatt

SEQ ID NO: 7704145 - DNA, 19 bp, Homo sapiens
tggctctttttatgacatt

SEQ ID NO: 7704146 - DNA, 19 bp, Homo sapiens
tggctctttttatgacatt

SEQ ID NO: 7704147 - DNA, 22 bp, Homo sapiens
tggctgctgctcactcagcctc

SEQ ID NO: 7704148 - DNA, 22 bp, Homo sapiens
tggctgctgctcactcagcctc

SEQ ID NO: 7704149 - DNA, 22 bp, Homo sapiens
tggctgctgcttggtcttcttc

SEQ ID NO: 7704150 - DNA, 22 bp, Homo sapiens
tggctgctgctcactcagcctc

SEQ ID NO: 7704151 - DNA, 22 bp, Homo sapiens
tggctgctgcagacagacagga

SEQ ID NO: 7704152 - DNA, 22 bp, Homo sapiens
tggctgctgcagacagacagga

SEQ ID NO: 7704153 - DNA, 22 bp, Homo sapiens
tggctgctgcagacagacagga

SEQ ID NO: 7704154 - DNA, 22 bp, Homo sapiens
tggctgctgagaaggcagctgt

SEQ ID NO: 7704155 - DNA, 22 bp, Homo sapiens
tggctgctgagaaggcagctgt

SEQ ID NO: 7704156 - DNA, 18 bp, Homo sapiens
tggctgctggagtagggt

SEQ ID NO: 7704157 - DNA, 22 bp, Homo sapiens
tggctgctgcttggtcttcttc

SEQ ID NO: 7704158 - DNA, 18 bp, Homo sapiens
tggctgctggagtagggt

SEQ ID NO: 7704159 - DNA, 22 bp, Homo sapiens
tggctgctgcttggtcttcttc

SEQ ID NO: 7704160 - DNA, 22 bp, Homo sapiens
tggctgctgtgggtagagggat

SEQ ID NO: 7704161 - DNA, 21 bp, Homo sapiens
tggctgctggccctctctcca

SEQ ID NO: 7704162 - DNA, 21 bp, Homo sapiens
tggctgctggccctctctcca

SEQ ID NO: 7704163 - DNA, 18 bp, Homo sapiens
tggctgctggagtagggt

SEQ ID NO: 7704164 - DNA, 21 bp, Homo sapiens
tggctgctggccctctctcca

SEQ ID NO: 7704165 - DNA, 22 bp, Homo sapiens
tggctggaatatgtggagacca

SEQ ID NO: 7704166 - DNA, 22 bp, Homo sapiens
tggctggaatatgtggagacca

SEQ ID NO: 7704167 - DNA, 22 bp, Homo sapiens
tggctggaagtcagaaatggga

SEQ ID NO: 7704168 - DNA, 22 bp, Homo sapiens
tggctggaagtcagaaatggga

SEQ ID NO: 7704169 - DNA, 22 bp, Homo sapiens
tggctggaaacaggagattcag

SEQ ID NO: 7704170 - DNA, 22 bp, Homo sapiens
tggctggaagtcagaaatggga

SEQ ID NO: 7704171 - DNA, 22 bp, Homo sapiens
tggctggaagtcagaaatggga

SEQ ID NO: 7704172 - DNA, 22 bp, Homo sapiens
tggctggaatggagctgagcct

SEQ ID NO: 7704173 - DNA, 22 bp, Homo sapiens
tggctggaatatgtggagacca

SEQ ID NO: 7704174 - DNA, 22 bp, Homo sapiens
tggctggaatatgtggagacca

SEQ ID NO: 7704175 - DNA, 22 bp, Homo sapiens
tggctggaatatgtggagacca

SEQ ID NO: 7704176 - DNA, 22 bp, Homo sapiens
tggctggaatatgtggagacca

SEQ ID NO: 7704177 - DNA, 18 bp, Homo sapiens
tggctgcttccaggtaca

SEQ ID NO: 7704178 - DNA, 22 bp, Homo sapiens
tggctgcttgttttagtgaggc

SEQ ID NO: 7704179 - DNA, 22 bp, Homo sapiens
tggctgcttgttttagtgaggc

SEQ ID NO: 7704180 - DNA, 22 bp, Homo sapiens
tggctgcttgttttagtgaggc

SEQ ID NO: 7704181 - DNA, 22 bp, Homo sapiens
tggctggaaacaggagattcag

SEQ ID NO: 7704182 - DNA, 22 bp, Homo sapiens
tggctggaaacaggagattcag

SEQ ID NO: 7704183 - DNA, 22 bp, Homo sapiens
tggctggaaacaggagattcag

SEQ ID NO: 7704184 - DNA, 22 bp, Homo sapiens
tggctgcttaaaattgctgcaa

SEQ ID NO: 7704185 - DNA, 18 bp, Homo sapiens
tggctgctggagtagggt

SEQ ID NO: 7704186 - DNA, 22 bp, Homo sapiens
tggctgctgtgggtagagggat

SEQ ID NO: 7704187 - DNA, 22 bp, Homo sapiens
tggctgctgtgggtagagggat

SEQ ID NO: 7704188 - DNA, 22 bp, Homo sapiens
tggctgctgtgggtagagggat

SEQ ID NO: 7704189 - DNA, 22 bp, Homo sapiens
tggctgcttaaaattgctgcaa

SEQ ID NO: 7704190 - DNA, 18 bp, Homo sapiens
tggctgcttccaggtaca

SEQ ID NO: 7704191 - DNA, 18 bp, Homo sapiens
tggctgcttccaggtaca

SEQ ID NO: 7704192 - DNA, 22 bp, Homo sapiens
tggctgcagtgcttgagatgtc

SEQ ID NO: 7704193 - DNA, 22 bp, Homo sapiens
tggctgcagtgcttgagatgtc

SEQ ID NO: 7704194 - DNA, 22 bp, Homo sapiens
tggctgcagttcacaggagcaa

SEQ ID NO: 7704195 - DNA, 22 bp, Homo sapiens
tggctgcagttcacaggagcaa

SEQ ID NO: 7704196 - DNA, 22 bp, Homo sapiens
tggctgcagtgcttgagatgtc

SEQ ID NO: 7704197 - DNA, 22 bp, Homo sapiens
tggctgcagtgcttgagatgtc

SEQ ID NO: 7704198 - DNA, 22 bp, Homo sapiens
tggctgcaggggtgtctgacat

SEQ ID NO: 7704199 - DNA, 22 bp, Homo sapiens
tggctgcagatctgtgggacac

SEQ ID NO: 7704200 - DNA, 22 bp, Homo sapiens
tggctgcagatctgtgggacac

SEQ ID NO: 7704201 - DNA, 22 bp, Homo sapiens
tggctgcagttgggccctcaga

SEQ ID NO: 7704202 - DNA, 22 bp, Homo sapiens
tggctgcagttgggccctcaga

SEQ ID NO: 7704203 - DNA, 22 bp, Homo sapiens
tggctgcagttcacaggagcaa

SEQ ID NO: 7704204 - DNA, 22 bp, Homo sapiens
tggctgcagttcacaggagcaa

SEQ ID NO: 7704205 - DNA, 22 bp, Homo sapiens
tggctgcagttcacaggagcaa

SEQ ID NO: 7704206 - DNA, 22 bp, Homo sapiens
tggctgcagttcacaggagcaa

SEQ ID NO: 7704207 - DNA, 22 bp, Homo sapiens
tggctgccaagcaggtcagaga

SEQ ID NO: 7704208 - DNA, 22 bp, Homo sapiens
tggctgccaagcaggtcagaga

SEQ ID NO: 7704209 - DNA, 22 bp, Homo sapiens
tggctgccaagcaggtcagaga

SEQ ID NO: 7704210 - DNA, 22 bp, Homo sapiens
tggctgccaagcaggtcagaga

SEQ ID NO: 7704211 - DNA, 22 bp, Homo sapiens
tggctgccaatggcttggaaag

SEQ ID NO: 7704212 - DNA, 22 bp, Homo sapiens
tggctgccaatggcttggaaag

SEQ ID NO: 7704213 - DNA, 22 bp, Homo sapiens
tggctgccaatggcttggaaag

SEQ ID NO: 7704214 - DNA, 22 bp, Homo sapiens
tggctgccagctcctcgccttg

SEQ ID NO: 7704215 - DNA, 22 bp, Homo sapiens
tggctgccagctcctcgccttg

SEQ ID NO: 7704216 - DNA, 20 bp, Homo sapiens
tggctgcccgaggcacacac

SEQ ID NO: 7704217 - DNA, 20 bp, Homo sapiens
tggctgcccgaggcacacac

SEQ ID NO: 7704218 - DNA, 22 bp, Homo sapiens
tggctgccccctcccgtggaca

SEQ ID NO: 7704219 - DNA, 22 bp, Homo sapiens
tggctgccatgacgcctgggga

SEQ ID NO: 7704220 - DNA, 22 bp, Homo sapiens
tggctgccatgacgcctgggga

SEQ ID NO: 7704221 - DNA, 22 bp, Homo sapiens
tggctgccccctcccgtggaca

SEQ ID NO: 7704222 - DNA, 22 bp, Homo sapiens
tggctgccccctcccgtggaca

SEQ ID NO: 7704223 - DNA, 22 bp, Homo sapiens
tggctgccatgacgcctgggga

SEQ ID NO: 7704224 - DNA, 22 bp, Homo sapiens
tggctgccatgacgcctgggga

SEQ ID NO: 7704225 - DNA, 22 bp, Homo sapiens
tggctgccatgacgcctgggga

SEQ ID NO: 7704226 - DNA, 22 bp, Homo sapiens
tggctgccatgacgcctgggga

SEQ ID NO: 7704227 - DNA, 22 bp, Homo sapiens
tggctgccatgacgcctgggga

SEQ ID NO: 7704228 - DNA, 22 bp, Homo sapiens
tggctgccatgacgcctgggga

SEQ ID NO: 7704229 - DNA, 22 bp, Homo sapiens
tggctgccagctcctcgccttg

SEQ ID NO: 7704230 - DNA, 22 bp, Homo sapiens
tggctgctctcttccccagggt

SEQ ID NO: 7704231 - DNA, 22 bp, Homo sapiens
tggctgctgagaaggcagctgt

SEQ ID NO: 7704232 - DNA, 22 bp, Homo sapiens
tggctgctgagaaggcagctgt

SEQ ID NO: 7704233 - DNA, 22 bp, Homo sapiens
tggctgctgagaaggcagctgt

SEQ ID NO: 7704234 - DNA, 22 bp, Homo sapiens
tggctgctgagaaggcagctgt

SEQ ID NO: 7704235 - DNA, 20 bp, Homo sapiens
tggctgcccgaggcacacac

SEQ ID NO: 7704236 - DNA, 20 bp, Homo sapiens
tggctgcccgaggcacacac

SEQ ID NO: 7704237 - DNA, 22 bp, Homo sapiens
tggctgctcaagggaggaggct

SEQ ID NO: 7704238 - DNA, 20 bp, Homo sapiens
tggctgcccgaggcacacac

SEQ ID NO: 7704239 - DNA, 22 bp, Homo sapiens
tggctgctcaagggaggaggct

SEQ ID NO: 7704240 - DNA, 22 bp, Homo sapiens
tggctgctgagaaggcagctgt

SEQ ID NO: 7704241 - DNA, 22 bp, Homo sapiens
tggctgctctcttccccagggt

SEQ ID NO: 7704242 - DNA, 22 bp, Homo sapiens
tggctgctctcttccccagggt

SEQ ID NO: 7704243 - DNA, 22 bp, Homo sapiens
tggctgctctcttccccagggt

SEQ ID NO: 7704244 - DNA, 22 bp, Homo sapiens
tggctgagttacgaacagagca

SEQ ID NO: 7704245 - DNA, 22 bp, Homo sapiens
tggctgagttcctggcacacgg

SEQ ID NO: 7704246 - DNA, 22 bp, Homo sapiens
tggctgagttacgaacagagca

SEQ ID NO: 7704247 - DNA, 22 bp, Homo sapiens
tggctgagttacgaacagagca

SEQ ID NO: 7704248 - DNA, 22 bp, Homo sapiens
tggctgagtgttccaaggagca

SEQ ID NO: 7704249 - DNA, 22 bp, Homo sapiens
tggctgagttacgaacagagca

SEQ ID NO: 7704250 - DNA, 22 bp, Homo sapiens
tggctgagttacgaacagagca

SEQ ID NO: 7704251 - DNA, 22 bp, Homo sapiens
tggctgagttcctggcacacgg

SEQ ID NO: 7704252 - DNA, 22 bp, Homo sapiens
tggctgagttcctggcacacgg

SEQ ID NO: 7704253 - DNA, 22 bp, Homo sapiens
tggctgagttcctggcacacgg

SEQ ID NO: 7704254 - DNA, 22 bp, Homo sapiens
tggctgagttcctggcacacgg

SEQ ID NO: 7704255 - DNA, 22 bp, Homo sapiens
tggctgagttctccaggagtag

SEQ ID NO: 7704256 - DNA, 22 bp, Homo sapiens
tggctgagttctccaggagtag

SEQ ID NO: 7704257 - DNA, 22 bp, Homo sapiens
tggctgagttctccaggagtag

SEQ ID NO: 7704258 - DNA, 22 bp, Homo sapiens
tggctgagttctccaggagtag

SEQ ID NO: 7704259 - DNA, 22 bp, Homo sapiens
tggctgagttctccaggagtag

SEQ ID NO: 7704260 - DNA, 22 bp, Homo sapiens
tggctgagttctccaggagtag

SEQ ID NO: 7704261 - DNA, 22 bp, Homo sapiens
tggctgagtgaacatgtccatt

SEQ ID NO: 7704262 - DNA, 22 bp, Homo sapiens
tggctgagtgaacatgtccatt

SEQ ID NO: 7704263 - DNA, 22 bp, Homo sapiens
tggctgagtgatatttgcaaag

SEQ ID NO: 7704264 - DNA, 22 bp, Homo sapiens
tggctgagtgaacatgtccatt

SEQ ID NO: 7704265 - DNA, 22 bp, Homo sapiens
tggctgagtgatatttgcaaag

SEQ ID NO: 7704266 - DNA, 22 bp, Homo sapiens
tggctgagtgatatttgcaaag

SEQ ID NO: 7704267 - DNA, 22 bp, Homo sapiens
tggctgagtgaacatgtccatt

SEQ ID NO: 7704268 - DNA, 21 bp, Homo sapiens
tggctgagtggatgcatgaat

SEQ ID NO: 7704269 - DNA, 22 bp, Homo sapiens
tggctgagtgttccaaggagca

SEQ ID NO: 7704270 - DNA, 22 bp, Homo sapiens
tggctgagtgttccaaggagca

SEQ ID NO: 7704271 - DNA, 22 bp, Homo sapiens
tggctgagtgttccaaggagca

SEQ ID NO: 7704272 - DNA, 22 bp, Homo sapiens
tggctgagtgttccaaggagca

SEQ ID NO: 7704273 - DNA, 22 bp, Homo sapiens
tggctgagtgttccaaggagca

SEQ ID NO: 7704274 - DNA, 22 bp, Homo sapiens
tggctgagtgttccaaggagca

SEQ ID NO: 7704275 - DNA, 21 bp, Homo sapiens
tggctgagtggatgcatgaat

SEQ ID NO: 7704276 - DNA, 22 bp, Homo sapiens
tggctgagtgttccaaggagca

SEQ ID NO: 7704277 - DNA, 21 bp, Homo sapiens
tggctgagtggatgcatgaat

SEQ ID NO: 7704278 - DNA, 20 bp, Homo sapiens
tggctgcacaccaggacagg

SEQ ID NO: 7704279 - DNA, 22 bp, Homo sapiens
tggctgcaagggcacggaccct

SEQ ID NO: 7704280 - DNA, 21 bp, Homo sapiens
tggctgcaagcagctgcctcc

SEQ ID NO: 7704281 - DNA, 21 bp, Homo sapiens
tggctgcaagcagctgcctcc

SEQ ID NO: 7704282 - DNA, 22 bp, Homo sapiens
tggctgattgatttcctatgta

SEQ ID NO: 7704283 - DNA, 21 bp, Homo sapiens
tggctgcaagcagctgcctcc

SEQ ID NO: 7704284 - DNA, 21 bp, Homo sapiens
tggctgcaagcagctgcctcc

SEQ ID NO: 7704285 - DNA, 22 bp, Homo sapiens
tggctgattggtaccatcttca

SEQ ID NO: 7704286 - DNA, 22 bp, Homo sapiens
tggctgattggtaccatcttca

SEQ ID NO: 7704287 - DNA, 22 bp, Homo sapiens
tggctgattggtaccatcttca

SEQ ID NO: 7704288 - DNA, 22 bp, Homo sapiens
tggctgatggagattttaggac

SEQ ID NO: 7704289 - DNA, 22 bp, Homo sapiens
tggctgatggagattttaggac

SEQ ID NO: 7704290 - DNA, 22 bp, Homo sapiens
tggctgattgatttcctatgta

SEQ ID NO: 7704291 - DNA, 22 bp, Homo sapiens
tggctgattgatttcctatgta

SEQ ID NO: 7704292 - DNA, 22 bp, Homo sapiens
tggctgattgatttcctatgta

SEQ ID NO: 7704293 - DNA, 22 bp, Homo sapiens
tggctgagtttcatgcatcatg

SEQ ID NO: 7704294 - DNA, 22 bp, Homo sapiens
tggctgagtttcatgcatcatg

SEQ ID NO: 7704295 - DNA, 22 bp, Homo sapiens
tggctgagtttcatgcatcatg

SEQ ID NO: 7704296 - DNA, 22 bp, Homo sapiens
tggctgagttctccaggagtag

SEQ ID NO: 7704297 - DNA, 22 bp, Homo sapiens
tggctgagtttcatgcatcatg

SEQ ID NO: 7704298 - DNA, 22 bp, Homo sapiens
tggctgagttctccaggagtag

SEQ ID NO: 7704299 - DNA, 22 bp, Homo sapiens
tggctgagttctccaggagtag

SEQ ID NO: 7704300 - DNA, 22 bp, Homo sapiens
tggctgagttctccaggagtag

SEQ ID NO: 7704301 - DNA, 22 bp, Homo sapiens
tggctgagttctccaggagtag

SEQ ID NO: 7704302 - DNA, 22 bp, Homo sapiens
tggctgcagatcaagggcaggc

SEQ ID NO: 7704303 - DNA, 22 bp, Homo sapiens
tggctgcagatcaagggcaggc

SEQ ID NO: 7704304 - DNA, 22 bp, Homo sapiens
tggctgcagatcaagggcaggc

SEQ ID NO: 7704305 - DNA, 22 bp, Homo sapiens
tggctgcagatcaagggcaggc

SEQ ID NO: 7704306 - DNA, 22 bp, Homo sapiens
tggctgcagatctgtgggacac

SEQ ID NO: 7704307 - DNA, 22 bp, Homo sapiens
tggctgcagatcaagggcaggc

SEQ ID NO: 7704308 - DNA, 22 bp, Homo sapiens
tggctgcagatcaagggcaggc

SEQ ID NO: 7704309 - DNA, 22 bp, Homo sapiens
tggctgcagatcaagggcaggc

SEQ ID NO: 7704310 - DNA, 21 bp, Homo sapiens
tggctgcactgtggctttcat

SEQ ID NO: 7704311 - DNA, 22 bp, Homo sapiens
tggctgcacttacctctcctgc

SEQ ID NO: 7704312 - DNA, 22 bp, Homo sapiens
tggctgcacttacctctcctgc

SEQ ID NO: 7704313 - DNA, 21 bp, Homo sapiens
tggctgcactgtggctttcat

SEQ ID NO: 7704314 - DNA, 20 bp, Homo sapiens
tggctgcacaccaggacagg

SEQ ID NO: 7704315 - DNA, 20 bp, Homo sapiens
tggctgcacaccaggacagg

SEQ ID NO: 7704316 - DNA, 20 bp, Homo sapiens
tggctgcacaccaggacagg

SEQ ID NO: 7704317 - DNA, 22 bp, Homo sapiens
tggctgcagacacctatggcag

SEQ ID NO: 7704318 - DNA, 22 bp, Homo sapiens
tggctgcagaacctcctcagga

SEQ ID NO: 7704319 - DNA, 22 bp, Homo sapiens
tggctgcagaacctcctcagga

SEQ ID NO: 7704320 - DNA, 22 bp, Homo sapiens
tggctgcagaacctcctcagga

SEQ ID NO: 7704321 - DNA, 22 bp, Homo sapiens
tggctgcacttcaacacatcct

SEQ ID NO: 7704322 - DNA, 21 bp, Homo sapiens
tggctcgatttatagcatttc

SEQ ID NO: 7704323 - DNA, 22 bp, Homo sapiens
tggctcctttccagcctggttt

SEQ ID NO: 7704324 - DNA, 22 bp, Homo sapiens
tggctcctttccgggtctccag

SEQ ID NO: 7704325 - DNA, 22 bp, Homo sapiens
tggctcctttccgggtctccag

SEQ ID NO: 7704326 - DNA, 22 bp, Homo sapiens
tggctcctttccagcctggttt

SEQ ID NO: 7704327 - DNA, 22 bp, Homo sapiens
tggctcctttccagcctggttt

SEQ ID NO: 7704328 - DNA, 22 bp, Homo sapiens
tggctctactcaaatatctggc

SEQ ID NO: 7704329 - DNA, 22 bp, Homo sapiens
tggctctcaatggctgtactat

SEQ ID NO: 7704330 - DNA, 22 bp, Homo sapiens
tggctcctttccgggtctccag

SEQ ID NO: 7704331 - DNA, 22 bp, Homo sapiens
tggctcggccacctgccagcca

SEQ ID NO: 7704332 - DNA, 22 bp, Homo sapiens
tggctcggccacctgccagcca

SEQ ID NO: 7704333 - DNA, 22 bp, Homo sapiens
tggctcgtattgatcttgaggc

SEQ ID NO: 7704334 - DNA, 22 bp, Homo sapiens
tggctctgagacacaggctctc

SEQ ID NO: 7704335 - DNA, 22 bp, Homo sapiens
tggctctgagacacaggctctc

SEQ ID NO: 7704336 - DNA, 22 bp, Homo sapiens
tggctctcaatggctgtactat

SEQ ID NO: 7704337 - DNA, 20 bp, Homo sapiens
tggctctcaccctgtgcgat

SEQ ID NO: 7704338 - DNA, 20 bp, Homo sapiens
tggctctcaccctgtgcgat

SEQ ID NO: 7704339 - DNA, 20 bp, Homo sapiens
tggctctcaccctgtgcgat

SEQ ID NO: 7704340 - DNA, 20 bp, Homo sapiens
tggctctcaccctgtgcgat

SEQ ID NO: 7704341 - DNA, 22 bp, Homo sapiens
tggctccttcattctcctgcca

SEQ ID NO: 7704342 - DNA, 22 bp, Homo sapiens
tggctccttcattctcctgcca

SEQ ID NO: 7704343 - DNA, 20 bp, Homo sapiens
tggctcctggctcctccctc

SEQ ID NO: 7704344 - DNA, 20 bp, Homo sapiens
tggctcctggctcctccctc

SEQ ID NO: 7704345 - DNA, 20 bp, Homo sapiens
tggctcctggctcctccctc

SEQ ID NO: 7704346 - DNA, 20 bp, Homo sapiens
tggctcctggctcctccctc

SEQ ID NO: 7704347 - DNA, 22 bp, Homo sapiens
tggctccttcattctcctgcca

SEQ ID NO: 7704348 - DNA, 22 bp, Homo sapiens
tggctccttcattctcctgcca

SEQ ID NO: 7704349 - DNA, 22 bp, Homo sapiens
tggctccttcattctcctgcca

SEQ ID NO: 7704350 - DNA, 22 bp, Homo sapiens
tggctccttccgcagcatgcct

SEQ ID NO: 7704351 - DNA, 22 bp, Homo sapiens
tggctccttccgcagcatgcct

SEQ ID NO: 7704352 - DNA, 22 bp, Homo sapiens
tggctccttccgcagcatgcct

SEQ ID NO: 7704353 - DNA, 22 bp, Homo sapiens
tggctccttccgcagcatgcct

SEQ ID NO: 7704354 - DNA, 22 bp, Homo sapiens
tggctctgagctgcaaagctgc

SEQ ID NO: 7704355 - DNA, 22 bp, Homo sapiens
tggctctgagctgcaaagctgc

SEQ ID NO: 7704356 - DNA, 21 bp, Homo sapiens
tggctctgagcctcatggctg

SEQ ID NO: 7704357 - DNA, 21 bp, Homo sapiens
tggctctgagcctcatggctg

SEQ ID NO: 7704358 - DNA, 21 bp, Homo sapiens
tggctctgagcctcatggctg

SEQ ID NO: 7704359 - DNA, 21 bp, Homo sapiens
tggctctgagcctcatggctg

SEQ ID NO: 7704360 - DNA, 21 bp, Homo sapiens
tggctctgagcctcatggctg

SEQ ID NO: 7704361 - DNA, 21 bp, Homo sapiens
tggctctgagcctcatggctg

SEQ ID NO: 7704362 - DNA, 21 bp, Homo sapiens
tggctctgagcctcatggctg

SEQ ID NO: 7704363 - DNA, 21 bp, Homo sapiens
tggctctgagcctcatggctg

SEQ ID NO: 7704364 - DNA, 23 bp, Homo sapiens
tggctctgagaggttcagatgct

SEQ ID NO: 7704365 - DNA, 21 bp, Homo sapiens
tggctctgagcctcatggctg

SEQ ID NO: 7704366 - DNA, 23 bp, Homo sapiens
tggctctgagaggttcagatgct

SEQ ID NO: 7704367 - DNA, 23 bp, Homo sapiens
tggctctgagaggttcagatgct

SEQ ID NO: 7704368 - DNA, 23 bp, Homo sapiens
tggctctgagaggttcagatgct

SEQ ID NO: 7704369 - DNA, 23 bp, Homo sapiens
tggctctgagaggttcagatgct

SEQ ID NO: 7704370 - DNA, 23 bp, Homo sapiens
tggctctgagaggttcagatgct

SEQ ID NO: 7704371 - DNA, 22 bp, Homo sapiens
tggctctgagacacaggctctc

SEQ ID NO: 7704372 - DNA, 22 bp, Homo sapiens
tggctctgagacacaggctctc

SEQ ID NO: 7704373 - DNA, 23 bp, Homo sapiens
tggctctgagaggttcagatgct

SEQ ID NO: 7704374 - DNA, 23 bp, Homo sapiens
tggctctgagaggttcagatgct

SEQ ID NO: 7704375 - DNA, 23 bp, Homo sapiens
tggctctgagaggttcagatgct

SEQ ID NO: 7704376 - DNA, 23 bp, Homo sapiens
tggctctgagcttcctggtggcc

SEQ ID NO: 7704377 - DNA, 23 bp, Homo sapiens
tggctctgagcttcctggtggcc

SEQ ID NO: 7704378 - DNA, 22 bp, Homo sapiens
tggctctgagctgcaaagctgc

SEQ ID NO: 7704379 - DNA, 22 bp, Homo sapiens
tggctctgagctgcaaagctgc

SEQ ID NO: 7704380 - DNA, 23 bp, Homo sapiens
tggctctgagcttcctggtggcc

SEQ ID NO: 7704381 - DNA, 23 bp, Homo sapiens
tggctctgagcttcctggtggcc

SEQ ID NO: 7704382 - DNA, 22 bp, Homo sapiens
tggctctgagctgcaaagctgc

SEQ ID NO: 7704383 - DNA, 23 bp, Homo sapiens
tggctctgagcttcctggtggcc

SEQ ID NO: 7704384 - DNA, 23 bp, Homo sapiens
tggctctgagcttcctggtggcc

SEQ ID NO: 7704385 - DNA, 17 bp, Homo sapiens
tggctctgaggctgaat

SEQ ID NO: 7704386 - DNA, 22 bp, Homo sapiens
tggctctgagctgcaaagctgc

SEQ ID NO: 7704387 - DNA, 23 bp, Homo sapiens
tggctctgagcttcctggtggcc

SEQ ID NO: 7704388 - DNA, 23 bp, Homo sapiens
tggctctgagcttcctggtggcc

SEQ ID NO: 7704389 - DNA, 22 bp, Homo sapiens
tggctctgagtctgcccttggc

SEQ ID NO: 7704390 - DNA, 22 bp, Homo sapiens
tggctctgagtctgcccttggc

SEQ ID NO: 7704391 - DNA, 22 bp, Homo sapiens
tggctctgagtctgcccttggc

SEQ ID NO: 7704392 - DNA, 22 bp, Homo sapiens
tggctctgagtctgcccttggc

SEQ ID NO: 7704393 - DNA, 22 bp, Homo sapiens
tggctctgagtctgcccttggc

SEQ ID NO: 7704394 - DNA, 17 bp, Homo sapiens
tggctctgaggctgaat

SEQ ID NO: 7704395 - DNA, 17 bp, Homo sapiens
tggctctgaggctgaat

SEQ ID NO: 7704396 - DNA, 17 bp, Homo sapiens
tggctctgaggctgaat

SEQ ID NO: 7704397 - DNA, 17 bp, Homo sapiens
tggctctgaggctgaat

SEQ ID NO: 7704398 - DNA, 17 bp, Homo sapiens
tggctctgaggctgaat

SEQ ID NO: 7704399 - DNA, 17 bp, Homo sapiens
tggctctgaggctgaat

SEQ ID NO: 7704400 - DNA, 17 bp, Homo sapiens
tggctctgaggctgaat

SEQ ID NO: 7704401 - DNA, 17 bp, Homo sapiens
tggctctgaggctgaat

SEQ ID NO: 7704402 - DNA, 17 bp, Homo sapiens
tggctctgaggctgaat

SEQ ID NO: 7704403 - DNA, 17 bp, Homo sapiens
tggctctgaggctgaat

SEQ ID NO: 7704404 - DNA, 22 bp, Homo sapiens
tggctctgccacctttccctaa

SEQ ID NO: 7704405 - DNA, 22 bp, Homo sapiens
tggctctgccacctttccctaa

SEQ ID NO: 7704406 - DNA, 22 bp, Homo sapiens
tggctctgccacctttccctaa

SEQ ID NO: 7704407 - DNA, 22 bp, Homo sapiens
tggctctgccacctttccctaa

SEQ ID NO: 7704408 - DNA, 22 bp, Homo sapiens
tggctctgccacctttccctaa

SEQ ID NO: 7704409 - DNA, 22 bp, Homo sapiens
tggctctgccactaacttggta

SEQ ID NO: 7704410 - DNA, 18 bp, Homo sapiens
tggctctgcagccagatg

SEQ ID NO: 7704411 - DNA, 18 bp, Homo sapiens
tggctctgcagccagatg

SEQ ID NO: 7704412 - DNA, 18 bp, Homo sapiens
tggctctgcagccagatg

SEQ ID NO: 7704413 - DNA, 18 bp, Homo sapiens
tggctctgccactcaccg

SEQ ID NO: 7704414 - DNA, 18 bp, Homo sapiens
tggctctgccactcaccg

SEQ ID NO: 7704415 - DNA, 18 bp, Homo sapiens
tggctctgccactcaccg

SEQ ID NO: 7704416 - DNA, 18 bp, Homo sapiens
tggctctgccactcaccg

SEQ ID NO: 7704417 - DNA, 18 bp, Homo sapiens
tggctctgccactcaccg

SEQ ID NO: 7704418 - DNA, 22 bp, Homo sapiens
tggctctgccactaacttggta

SEQ ID NO: 7704419 - DNA, 22 bp, Homo sapiens
tggctctgccactaacttggta

SEQ ID NO: 7704420 - DNA, 22 bp, Homo sapiens
tggctctgccccatacccctgc

SEQ ID NO: 7704421 - DNA, 22 bp, Homo sapiens
tggctctgccccatacccctgc

SEQ ID NO: 7704422 - DNA, 22 bp, Homo sapiens
tggctctgccccatacccctgc

SEQ ID NO: 7704423 - DNA, 18 bp, Homo sapiens
tggctctgccactcaccg

SEQ ID NO: 7704424 - DNA, 18 bp, Homo sapiens
tggctctgccactcaccg

SEQ ID NO: 7704425 - DNA, 18 bp, Homo sapiens
tggctctgccactcaccg

SEQ ID NO: 7704426 - DNA, 18 bp, Homo sapiens
tggctctgcagccagatg

SEQ ID NO: 7704427 - DNA, 22 bp, Homo sapiens
tggctctgcagcagtgtgcgtg

SEQ ID NO: 7704428 - DNA, 18 bp, Homo sapiens
tggctctgcagccagatg

SEQ ID NO: 7704429 - DNA, 18 bp, Homo sapiens
tggctctgcagccagatg

SEQ ID NO: 7704430 - DNA, 18 bp, Homo sapiens
tggctctgcagccagatg

SEQ ID NO: 7704431 - DNA, 18 bp, Homo sapiens
tggctctgcagccagatg

SEQ ID NO: 7704432 - DNA, 22 bp, Homo sapiens
tggctctgcagcagtgtgcgtg

SEQ ID NO: 7704433 - DNA, 22 bp, Homo sapiens
tggctctgcagcagtgtgcgtg

SEQ ID NO: 7704434 - DNA, 22 bp, Homo sapiens
tggctctgcagcagtgtgcgtg

SEQ ID NO: 7704435 - DNA, 22 bp, Homo sapiens
tggctctgcacctcagtgtacc

SEQ ID NO: 7704436 - DNA, 22 bp, Homo sapiens
tggctctgcagcagtgtgcgtg

SEQ ID NO: 7704437 - DNA, 22 bp, Homo sapiens
tggctctgcagcagtgtgcgtg

SEQ ID NO: 7704438 - DNA, 22 bp, Homo sapiens
tggctctgcacctcagtgtacc

SEQ ID NO: 7704439 - DNA, 22 bp, Homo sapiens
tggctctgcacctcagtgtacc

SEQ ID NO: 7704440 - DNA, 22 bp, Homo sapiens
tggctctgcacctcagtgtacc

SEQ ID NO: 7704441 - DNA, 22 bp, Homo sapiens
tggctctgcacctcagtgtacc

SEQ ID NO: 7704442 - DNA, 22 bp, Homo sapiens
tggctctgcacctcagtgtacc

SEQ ID NO: 7704443 - DNA, 22 bp, Homo sapiens
tggctctgcacctcagtgtacc

SEQ ID NO: 7704444 - DNA, 22 bp, Homo sapiens
tggctctgatgggaggtattgg

SEQ ID NO: 7704445 - DNA, 22 bp, Homo sapiens
tggctctgatgggaggtattgg

SEQ ID NO: 7704446 - DNA, 22 bp, Homo sapiens
tggctctgatcagatgtccagt

SEQ ID NO: 7704447 - DNA, 22 bp, Homo sapiens
tggctctgatgggaggtattgg

SEQ ID NO: 7704448 - DNA, 22 bp, Homo sapiens
tggctctgatcagatgtccagt

SEQ ID NO: 7704449 - DNA, 22 bp, Homo sapiens
tggctctgatcagatgtccagt

SEQ ID NO: 7704450 - DNA, 22 bp, Homo sapiens
tggctctgatcagatgtccagt

SEQ ID NO: 7704451 - DNA, 22 bp, Homo sapiens
tggctctgctgaacctagtgca

SEQ ID NO: 7704452 - DNA, 22 bp, Homo sapiens
tggctctgctgaacctagtgca

SEQ ID NO: 7704453 - DNA, 22 bp, Homo sapiens
tggctctgctgaacctagtgca

SEQ ID NO: 7704454 - DNA, 18 bp, Homo sapiens
tggctctggacttgctcc

SEQ ID NO: 7704455 - DNA, 18 bp, Homo sapiens
tggctctggacttgctcc

SEQ ID NO: 7704456 - DNA, 22 bp, Homo sapiens
tggctctgctgaacctagtgca

SEQ ID NO: 7704457 - DNA, 22 bp, Homo sapiens
tggctctgctgaacctagtgca

SEQ ID NO: 7704458 - DNA, 22 bp, Homo sapiens
tggctctgctgaacctagtgca

SEQ ID NO: 7704459 - DNA, 22 bp, Homo sapiens
tggctctgctgaacctagtgca

SEQ ID NO: 7704460 - DNA, 22 bp, Homo sapiens
tggctctggagctcctgggccc

SEQ ID NO: 7704461 - DNA, 22 bp, Homo sapiens
tggctctggagctggcggctga

SEQ ID NO: 7704462 - DNA, 22 bp, Homo sapiens
tggctctggagctcctgggccc

SEQ ID NO: 7704463 - DNA, 22 bp, Homo sapiens
tggctctggagctcctgggccc

SEQ ID NO: 7704464 - DNA, 22 bp, Homo sapiens
tggctctggagctcctgggccc

SEQ ID NO: 7704465 - DNA, 22 bp, Homo sapiens
tggctctggagctcctgggccc

SEQ ID NO: 7704466 - DNA, 22 bp, Homo sapiens
tggctctggagctcctgggccc

SEQ ID NO: 7704467 - DNA, 22 bp, Homo sapiens
tggctctggagctcctgggccc

SEQ ID NO: 7704468 - DNA, 22 bp, Homo sapiens
tggctctggagctcctgggccc

SEQ ID NO: 7704469 - DNA, 18 bp, Homo sapiens
tggctctggacttgctcc

SEQ ID NO: 7704470 - DNA, 18 bp, Homo sapiens
tggctctggacttgctcc

SEQ ID NO: 7704471 - DNA, 22 bp, Homo sapiens
tggctctggagctcctgggccc

SEQ ID NO: 7704472 - DNA, 22 bp, Homo sapiens
tggctctgccccatacccctgc

SEQ ID NO: 7704473 - DNA, 22 bp, Homo sapiens
tggctctgccccatacccctgc

SEQ ID NO: 7704474 - DNA, 22 bp, Homo sapiens
tggctctgcgtctgttcgtggg

SEQ ID NO: 7704475 - DNA, 22 bp, Homo sapiens
tggctctgcgtctgttcgtggg

SEQ ID NO: 7704476 - DNA, 21 bp, Homo sapiens
tggctctgctcagagcagtcc

SEQ ID NO: 7704477 - DNA, 21 bp, Homo sapiens
tggctctgctcagagcagtcc

SEQ ID NO: 7704478 - DNA, 21 bp, Homo sapiens
tggctctgctcagagcagtcc

SEQ ID NO: 7704479 - DNA, 22 bp, Homo sapiens
tggctctgcgtctgttcgtggg

SEQ ID NO: 7704480 - DNA, 21 bp, Homo sapiens
tggctctgctcagagcagtcc

SEQ ID NO: 7704481 - DNA, 21 bp, Homo sapiens
tggctctgctcagagcagtcc

SEQ ID NO: 7704482 - DNA, 21 bp, Homo sapiens
tggctctgctcagagcagtcc

SEQ ID NO: 7704483 - DNA, 21 bp, Homo sapiens
tggctctgctcagagcagtcc

SEQ ID NO: 7704484 - DNA, 22 bp, Homo sapiens
tggctctgctgaacctagtgca

SEQ ID NO: 7704485 - DNA, 21 bp, Homo sapiens
tggctctgctcagagcagtcc

SEQ ID NO: 7704486 - DNA, 21 bp, Homo sapiens
tggctctgctcagagcagtcc

SEQ ID NO: 7704487 - DNA, 21 bp, Homo sapiens
tggctctgctcagagcagtcc

SEQ ID NO: 7704488 - DNA, 21 bp, Homo sapiens
tggctctgctcagagcagtcc

SEQ ID NO: 7704489 - DNA, 22 bp, Homo sapiens
tggctctgttgtaaagaaattt

SEQ ID NO: 7704490 - DNA, 22 bp, Homo sapiens
tggctctgttgctcgcagtttt

SEQ ID NO: 7704491 - DNA, 22 bp, Homo sapiens
tggctctgttgctcgcagtttt

SEQ ID NO: 7704492 - DNA, 22 bp, Homo sapiens
tggctctgttgtgctgagccag

SEQ ID NO: 7704493 - DNA, 22 bp, Homo sapiens
tggctctgttgtgctgagccag

SEQ ID NO: 7704494 - DNA, 22 bp, Homo sapiens
tggctctgttgtaaagaaattt

SEQ ID NO: 7704495 - DNA, 22 bp, Homo sapiens
tggctctgttgaggtatggatt

SEQ ID NO: 7704496 - DNA, 22 bp, Homo sapiens
tggctctgttgaggtatggatt

SEQ ID NO: 7704497 - DNA, 22 bp, Homo sapiens
tggctctgttgaggtatggatt

SEQ ID NO: 7704498 - DNA, 22 bp, Homo sapiens
tggctctgttgctcgcagtttt

SEQ ID NO: 7704499 - DNA, 22 bp, Homo sapiens
tggctctgttgctcgcagtttt

SEQ ID NO: 7704500 - DNA, 22 bp, Homo sapiens
tggctctgttgctcgcagtttt

SEQ ID NO: 7704501 - DNA, 22 bp, Homo sapiens
tggctctgttgctcgcagtttt

SEQ ID NO: 7704502 - DNA, 22 bp, Homo sapiens
tggctctgttgaggtatggatt

SEQ ID NO: 7704503 - DNA, 22 bp, Homo sapiens
tggctctgttgaggtatggatt

SEQ ID NO: 7704504 - DNA, 22 bp, Homo sapiens
tggctctgttcgccatcaggag

SEQ ID NO: 7704505 - DNA, 22 bp, Homo sapiens
tggctctgttcgccatcaggag

SEQ ID NO: 7704506 - DNA, 22 bp, Homo sapiens
tggctctgttcgccatcaggag

SEQ ID NO: 7704507 - DNA, 22 bp, Homo sapiens
tggctctgttcgccatcaggag

SEQ ID NO: 7704508 - DNA, 22 bp, Homo sapiens
tggctctgttcgccatcaggag

SEQ ID NO: 7704509 - DNA, 22 bp, Homo sapiens
tggctctgttcgccatcaggag

SEQ ID NO: 7704510 - DNA, 22 bp, Homo sapiens
tggctctgttcgccatcaggag

SEQ ID NO: 7704511 - DNA, 23 bp, Homo sapiens
tggctctgtgtcacatacaggat

SEQ ID NO: 7704512 - DNA, 23 bp, Homo sapiens
tggctctgtgtcacatacaggat

SEQ ID NO: 7704513 - DNA, 23 bp, Homo sapiens
tggctctgtgtcacatacaggat

SEQ ID NO: 7704514 - DNA, 23 bp, Homo sapiens
tggctctgtgtcacatacaggat

SEQ ID NO: 7704515 - DNA, 23 bp, Homo sapiens
tggctctgtgtcacatacaggat

SEQ ID NO: 7704516 - DNA, 23 bp, Homo sapiens
tggctctgtgtcacatacaggat

SEQ ID NO: 7704517 - DNA, 23 bp, Homo sapiens
tggctctgtgtcacatacaggat

SEQ ID NO: 7704518 - DNA, 22 bp, Homo sapiens
tggctctgtgtctcccagcagc

SEQ ID NO: 7704519 - DNA, 23 bp, Homo sapiens
tggctctgtgtcacatacaggat

SEQ ID NO: 7704520 - DNA, 22 bp, Homo sapiens
tggctctgtgtctcccagcagc

SEQ ID NO: 7704521 - DNA, 22 bp, Homo sapiens
tggctctgtgtctcccagcagc

SEQ ID NO: 7704522 - DNA, 22 bp, Homo sapiens
tggctctgtgtctcccagcagc

SEQ ID NO: 7704523 - DNA, 22 bp, Homo sapiens
tggctctgtgtctcccagcagc

SEQ ID NO: 7704524 - DNA, 22 bp, Homo sapiens
tggctctgttcgccatcaggag

SEQ ID NO: 7704525 - DNA, 22 bp, Homo sapiens
tggctctgttcgccatcaggag

SEQ ID NO: 7704526 - DNA, 22 bp, Homo sapiens
tggctctgttcgccatcaggag

SEQ ID NO: 7704527 - DNA, 22 bp, Homo sapiens
tggctctgttcgccatcaggag

SEQ ID NO: 7704528 - DNA, 22 bp, Homo sapiens
tggctctgttcgccatcaggag

SEQ ID NO: 7704529 - DNA, 22 bp, Homo sapiens
tggctctgttcgccatcaggag

SEQ ID NO: 7704530 - DNA, 22 bp, Homo sapiens
tggctctgttcgccatcaggag

SEQ ID NO: 7704531 - DNA, 21 bp, Homo sapiens
tggctctgttcaatatatgga

SEQ ID NO: 7704532 - DNA, 21 bp, Homo sapiens
tggctctgttcaatatatgga

SEQ ID NO: 7704533 - DNA, 22 bp, Homo sapiens
tggctctgtgtctcccagcagc

SEQ ID NO: 7704534 - DNA, 22 bp, Homo sapiens
tggctctgtgtctcccagcagc

SEQ ID NO: 7704535 - DNA, 21 bp, Homo sapiens
tggctctgttcaatatatgga

SEQ ID NO: 7704536 - DNA, 19 bp, Homo sapiens
tggctctgtttctctggag

SEQ ID NO: 7704537 - DNA, 19 bp, Homo sapiens
tggctctgtttctctggag

SEQ ID NO: 7704538 - DNA, 19 bp, Homo sapiens
tggctctgtttctctggag

SEQ ID NO: 7704539 - DNA, 19 bp, Homo sapiens
tggctctgtttctctggag

SEQ ID NO: 7704540 - DNA, 19 bp, Homo sapiens
tggctctgtttctctggag

SEQ ID NO: 7704541 - DNA, 22 bp, Homo sapiens
tggctctgttgtgctgagccag

SEQ ID NO: 7704542 - DNA, 19 bp, Homo sapiens
tggctctgtttctctggag

SEQ ID NO: 7704543 - DNA, 19 bp, Homo sapiens
tggctctgtttctctggag

SEQ ID NO: 7704544 - DNA, 19 bp, Homo sapiens
tggctctgtttctctggag

SEQ ID NO: 7704545 - DNA, 19 bp, Homo sapiens
tggctctgtttctctggag

SEQ ID NO: 7704546 - DNA, 22 bp, Homo sapiens
tggctctgttgtgctgagccag

SEQ ID NO: 7704547 - DNA, 22 bp, Homo sapiens
tggctctgttgtgctgagccag

SEQ ID NO: 7704548 - DNA, 22 bp, Homo sapiens
tggctctgttgtgctgagccag

SEQ ID NO: 7704549 - DNA, 22 bp, Homo sapiens
tggctctgttgtgctgagccag

SEQ ID NO: 7704550 - DNA, 22 bp, Homo sapiens
tggctctgttgtgctgagccag

SEQ ID NO: 7704551 - DNA, 22 bp, Homo sapiens
tggctctgttgtaaagaaattt

SEQ ID NO: 7704552 - DNA, 22 bp, Homo sapiens
tggctctgttgtgctgagccag

SEQ ID NO: 7704553 - DNA, 22 bp, Homo sapiens
tggctctgttgtgctgagccag

SEQ ID NO: 7704554 - DNA, 22 bp, Homo sapiens
tggctctgttgtgctgagccag

SEQ ID NO: 7704555 - DNA, 22 bp, Homo sapiens
tggctctgttgtgctgagccag

SEQ ID NO: 7704556 - DNA, 22 bp, Homo sapiens
tggctcttggtgctagtttctg

SEQ ID NO: 7704557 - DNA, 19 bp, Homo sapiens
tggctcttgtgggactgca

SEQ ID NO: 7704558 - DNA, 22 bp, Homo sapiens
tggctctttcaaatttactaaa

SEQ ID NO: 7704559 - DNA, 22 bp, Homo sapiens
tggctctttcaaatttactaaa

SEQ ID NO: 7704560 - DNA, 22 bp, Homo sapiens
tggctcttctcaagcattggct

SEQ ID NO: 7704561 - DNA, 22 bp, Homo sapiens
tggctcttgcttacgaaggtta

SEQ ID NO: 7704562 - DNA, 22 bp, Homo sapiens
tggctcttgcttacgaaggtta

SEQ ID NO: 7704563 - DNA, 19 bp, Homo sapiens
tggctcttgtgggactgca

SEQ ID NO: 7704564 - DNA, 22 bp, Homo sapiens
tggctctttcaaatttactaaa

SEQ ID NO: 7704565 - DNA, 22 bp, Homo sapiens
tggctctttctgtctgggatcc

SEQ ID NO: 7704566 - DNA, 22 bp, Homo sapiens
tggctctttctagacttaatta

SEQ ID NO: 7704567 - DNA, 22 bp, Homo sapiens
tggctctttctgtctgggatcc

SEQ ID NO: 7704568 - DNA, 22 bp, Homo sapiens
tggctcttttcacgtcccctct

SEQ ID NO: 7704569 - DNA, 22 bp, Homo sapiens
tggctctgtttgttaactagac

SEQ ID NO: 7704570 - DNA, 22 bp, Homo sapiens
tggctctgttttatgagtacca

SEQ ID NO: 7704571 - DNA, 22 bp, Homo sapiens
tggctctgtttgttaactagac

SEQ ID NO: 7704572 - DNA, 22 bp, Homo sapiens
tggctctgtttgttaactagac

SEQ ID NO: 7704573 - DNA, 22 bp, Homo sapiens
tggctctgtttgttaactagac

SEQ ID NO: 7704574 - DNA, 22 bp, Homo sapiens
tggctcttaaggtccctgtgct

SEQ ID NO: 7704575 - DNA, 22 bp, Homo sapiens
tggctcttaaggtccctgtgct

SEQ ID NO: 7704576 - DNA, 22 bp, Homo sapiens
tggctcttaaggtccctgtgct

SEQ ID NO: 7704577 - DNA, 22 bp, Homo sapiens
tggctctgttttatgagtacca

SEQ ID NO: 7704578 - DNA, 22 bp, Homo sapiens
tggctctgttttatgagtacca

SEQ ID NO: 7704579 - DNA, 22 bp, Homo sapiens
tggctctgttttatgagtacca

SEQ ID NO: 7704580 - DNA, 22 bp, Homo sapiens
tggctctgttttatgagtacca

SEQ ID NO: 7704581 - DNA, 22 bp, Homo sapiens
tggctctggggacagtaagtcc

SEQ ID NO: 7704582 - DNA, 22 bp, Homo sapiens
tggctctggggacagtaagtcc

SEQ ID NO: 7704583 - DNA, 22 bp, Homo sapiens
tggctctgggcaccgtgtccac

SEQ ID NO: 7704584 - DNA, 22 bp, Homo sapiens
tggctctgggcaccgtgtccac

SEQ ID NO: 7704585 - DNA, 22 bp, Homo sapiens
tggctctgggcaccgtgtccac

SEQ ID NO: 7704586 - DNA, 22 bp, Homo sapiens
tggctctgggcaccgtgtccac

SEQ ID NO: 7704587 - DNA, 22 bp, Homo sapiens
tggctctgggcaccgtgtccac

SEQ ID NO: 7704588 - DNA, 22 bp, Homo sapiens
tggctctgggcaccgtgtccac

SEQ ID NO: 7704589 - DNA, 22 bp, Homo sapiens
tggctctgggaatgggaagatg

SEQ ID NO: 7704590 - DNA, 22 bp, Homo sapiens
tggctctgggaatgggaagatg

SEQ ID NO: 7704591 - DNA, 22 bp, Homo sapiens
tggctctgggaatgggaagatg

SEQ ID NO: 7704592 - DNA, 22 bp, Homo sapiens
tggctctgggaatgggaagatg

SEQ ID NO: 7704593 - DNA, 22 bp, Homo sapiens
tggctctgggaatgggaagatg

SEQ ID NO: 7704594 - DNA, 22 bp, Homo sapiens
tggctctgggaatctgttgctt

SEQ ID NO: 7704595 - DNA, 22 bp, Homo sapiens
tggctctgggaatctgttgctt

SEQ ID NO: 7704596 - DNA, 22 bp, Homo sapiens
tggctctggcgtgaagcccaga

SEQ ID NO: 7704597 - DNA, 22 bp, Homo sapiens
tggctctggcgtgaagcccaga

SEQ ID NO: 7704598 - DNA, 22 bp, Homo sapiens
tggctctgggaatctgttgctt

SEQ ID NO: 7704599 - DNA, 22 bp, Homo sapiens
tggctctgggaatctgttgctt

SEQ ID NO: 7704600 - DNA, 22 bp, Homo sapiens
tggctctggattaatctaggaa

SEQ ID NO: 7704601 - DNA, 22 bp, Homo sapiens
tggctctggagctggcggctga

SEQ ID NO: 7704602 - DNA, 22 bp, Homo sapiens
tggctctggattaatctaggaa

SEQ ID NO: 7704603 - DNA, 22 bp, Homo sapiens
tggctctggattaatctaggaa

SEQ ID NO: 7704604 - DNA, 22 bp, Homo sapiens
tggctctggattaatctaggaa

SEQ ID NO: 7704605 - DNA, 22 bp, Homo sapiens
tggctctggagctggcggctga

SEQ ID NO: 7704606 - DNA, 22 bp, Homo sapiens
tggctctggagctggcggctga

SEQ ID NO: 7704607 - DNA, 22 bp, Homo sapiens
tggctctggagctggcggctga

SEQ ID NO: 7704608 - DNA, 22 bp, Homo sapiens
tggctctggagctggcggctga

SEQ ID NO: 7704609 - DNA, 22 bp, Homo sapiens
tggctctggagctggcggctga

SEQ ID NO: 7704610 - DNA, 22 bp, Homo sapiens
tggctctggagctggcggctga

SEQ ID NO: 7704611 - DNA, 22 bp, Homo sapiens
tggctctggcgtgaagcccaga

SEQ ID NO: 7704612 - DNA, 22 bp, Homo sapiens
tggctctggcgtgaagcccaga

SEQ ID NO: 7704613 - DNA, 22 bp, Homo sapiens
tggctctggccaccgggagggc

SEQ ID NO: 7704614 - DNA, 22 bp, Homo sapiens
tggctctggccaccgggagggc

SEQ ID NO: 7704615 - DNA, 22 bp, Homo sapiens
tggctctggccaccgggagggc

SEQ ID NO: 7704616 - DNA, 22 bp, Homo sapiens
tggctctggccaccgggagggc

SEQ ID NO: 7704617 - DNA, 22 bp, Homo sapiens
tggctctggccaccgggagggc

SEQ ID NO: 7704618 - DNA, 22 bp, Homo sapiens
tggctctggattaatctaggaa

SEQ ID NO: 7704619 - DNA, 22 bp, Homo sapiens
tggctctggccaccgggagggc

SEQ ID NO: 7704620 - DNA, 22 bp, Homo sapiens
tggctctggattaatctaggaa

SEQ ID NO: 7704621 - DNA, 22 bp, Homo sapiens
tggctctggattaatctaggaa

SEQ ID NO: 7704622 - DNA, 22 bp, Homo sapiens
tggctctgtgaacagacgactg

SEQ ID NO: 7704623 - DNA, 22 bp, Homo sapiens
tggctctgtcgccgtttggaat

SEQ ID NO: 7704624 - DNA, 22 bp, Homo sapiens
tggctctgtcgccgtttggaat

SEQ ID NO: 7704625 - DNA, 19 bp, Homo sapiens
tggctctgtcgaaggcaca

SEQ ID NO: 7704626 - DNA, 19 bp, Homo sapiens
tggctctgtcgaaggcaca

SEQ ID NO: 7704627 - DNA, 22 bp, Homo sapiens
tggctctggggacagtaagtcc

SEQ ID NO: 7704628 - DNA, 22 bp, Homo sapiens
tggctctggggacagtaagtcc

SEQ ID NO: 7704629 - DNA, 22 bp, Homo sapiens
tggctctggggacagtaagtcc

SEQ ID NO: 7704630 - DNA, 22 bp, Homo sapiens
tggctctgtgcttctagtatct

SEQ ID NO: 7704631 - DNA, 22 bp, Homo sapiens
tggctctgtgcttctagtatct

SEQ ID NO: 7704632 - DNA, 22 bp, Homo sapiens
tggctctgtgcttctagtatct

SEQ ID NO: 7704633 - DNA, 22 bp, Homo sapiens
tggctctgtgcttctagtatct

SEQ ID NO: 7704634 - DNA, 22 bp, Homo sapiens
tggctctgtgcttctagtatct

SEQ ID NO: 7704635 - DNA, 22 bp, Homo sapiens
tggctctgtgcttctagtatct

SEQ ID NO: 7704636 - DNA, 22 bp, Homo sapiens
tggctctgtgaacagacgactg

SEQ ID NO: 7704637 - DNA, 22 bp, Homo sapiens
tggctctgtgaacagacgactg

SEQ ID NO: 7704638 - DNA, 22 bp, Homo sapiens
tggctctgtgaacagacgactg

SEQ ID NO: 7704639 - DNA, 22 bp, Homo sapiens
tggctctgtgaacagacgactg

SEQ ID NO: 7704640 - DNA, 22 bp, Homo sapiens
tggctctgtggatgttctgacc

SEQ ID NO: 7704641 - DNA, 23 bp, Homo sapiens
tggctctgtggatccctcaggag

SEQ ID NO: 7704642 - DNA, 23 bp, Homo sapiens
tggctctgtggatccctcaggag

SEQ ID NO: 7704643 - DNA, 23 bp, Homo sapiens
tggctctgtggatccctcaggag

SEQ ID NO: 7704644 - DNA, 23 bp, Homo sapiens
tggctctgtggatccctcaggag

SEQ ID NO: 7704645 - DNA, 23 bp, Homo sapiens
tggctctgtggatccctcaggag

SEQ ID NO: 7704646 - DNA, 23 bp, Homo sapiens
tggctctgtggatccctcaggag

SEQ ID NO: 7704647 - DNA, 23 bp, Homo sapiens
tggctctgtggatccctcaggag

SEQ ID NO: 7704648 - DNA, 23 bp, Homo sapiens
tggctctgtggatccctcaggag

SEQ ID NO: 7704649 - DNA, 23 bp, Homo sapiens
tggctctgtggatccctcaggag

SEQ ID NO: 7704650 - DNA, 23 bp, Homo sapiens
tggctctgtggatccctcaggag

SEQ ID NO: 7704651 - DNA, 23 bp, Homo sapiens
tggctctgtggatccctcaggag

SEQ ID NO: 7704652 - DNA, 23 bp, Homo sapiens
tggctctgtggatccctcaggag

SEQ ID NO: 7704653 - DNA, 22 bp, Homo sapiens
tggctctgtggatgttctgacc

SEQ ID NO: 7704654 - DNA, 22 bp, Homo sapiens
tggctctgtggatgttctgacc

SEQ ID NO: 7704655 - DNA, 22 bp, Homo sapiens
tggctctgtggatgttctgacc

SEQ ID NO: 7704656 - DNA, 22 bp, Homo sapiens
tggctctgtggtcttagcatgc

SEQ ID NO: 7704657 - DNA, 22 bp, Homo sapiens
tggctctgtggtcttagcatgc

SEQ ID NO: 7704658 - DNA, 22 bp, Homo sapiens
tggctctgtggtcttagcatgc

SEQ ID NO: 7704659 - DNA, 23 bp, Homo sapiens
tggctctgtgtcacatacaggat

SEQ ID NO: 7704660 - DNA, 22 bp, Homo sapiens
tgggaagaagcagagaactgga

SEQ ID NO: 7704661 - DNA, 22 bp, Homo sapiens
tgggaagaagcagagaactgga

SEQ ID NO: 7704662 - DNA, 22 bp, Homo sapiens
tgggaagaagcagagaactgga

SEQ ID NO: 7704663 - DNA, 22 bp, Homo sapiens
tgggaagaagcagagaactgga

SEQ ID NO: 7704664 - DNA, 22 bp, Homo sapiens
tgggaagaagcagagaactgga

SEQ ID NO: 7704665 - DNA, 22 bp, Homo sapiens
tgggaagaagcagagaactgga

SEQ ID NO: 7704666 - DNA, 22 bp, Homo sapiens
tgggaactgcaggtgttacata

SEQ ID NO: 7704667 - DNA, 22 bp, Homo sapiens
tgggaactgcaggtgttacata

SEQ ID NO: 7704668 - DNA, 22 bp, Homo sapiens
tgggaactgtactgccttgaac

SEQ ID NO: 7704669 - DNA, 19 bp, Homo sapiens
tgggaacttgttagacatg

SEQ ID NO: 7704670 - DNA, 22 bp, Homo sapiens
tgggaagaagcagagaactgga

SEQ ID NO: 7704671 - DNA, 18 bp, Homo sapiens
tgggaagaaattcttctc

SEQ ID NO: 7704672 - DNA, 18 bp, Homo sapiens
tgggaagaaattcttctc

SEQ ID NO: 7704673 - DNA, 19 bp, Homo sapiens
tgggaacttgttagacatg

SEQ ID NO: 7704674 - DNA, 18 bp, Homo sapiens
tgggaagaaattcttctc

SEQ ID NO: 7704675 - DNA, 22 bp, Homo sapiens
tgggaaccatgtagctgagatg

SEQ ID NO: 7704676 - DNA, 22 bp, Homo sapiens
tgggaactctctgggaggcatc

SEQ ID NO: 7704677 - DNA, 22 bp, Homo sapiens
tgggaaccaggactggctgagg

SEQ ID NO: 7704678 - DNA, 22 bp, Homo sapiens
tgggaacattttgagctgagag

SEQ ID NO: 7704679 - DNA, 22 bp, Homo sapiens
tgggaaccacaggactcggcac

SEQ ID NO: 7704680 - DNA, 22 bp, Homo sapiens
tgggaacattttgagctgagag

SEQ ID NO: 7704681 - DNA, 22 bp, Homo sapiens
tgggaacagtagctgctgagct

SEQ ID NO: 7704682 - DNA, 22 bp, Homo sapiens
tgggaacattttgagctgagag

SEQ ID NO: 7704683 - DNA, 22 bp, Homo sapiens
tgggaagaggatgaggcatatg

SEQ ID NO: 7704684 - DNA, 22 bp, Homo sapiens
tgggaagaggatgaggcatatg

SEQ ID NO: 7704685 - DNA, 22 bp, Homo sapiens
tgggaagaggatgaggcatatg

SEQ ID NO: 7704686 - DNA, 22 bp, Homo sapiens
tgggaagaggatgaggcatatg

SEQ ID NO: 7704687 - DNA, 22 bp, Homo sapiens
tgggaagaggatgaggcatatg

SEQ ID NO: 7704688 - DNA, 22 bp, Homo sapiens
tgggaagaggatgaggcatatg

SEQ ID NO: 7704689 - DNA, 22 bp, Homo sapiens
tgggaagaggagcactggaatg

SEQ ID NO: 7704690 - DNA, 22 bp, Homo sapiens
tgggaagaggcgggaggctgtt

SEQ ID NO: 7704691 - DNA, 22 bp, Homo sapiens
tgggaagaggcgggaggctgtt

SEQ ID NO: 7704692 - DNA, 22 bp, Homo sapiens
tgggaagaggcgggaggctgtt

SEQ ID NO: 7704693 - DNA, 22 bp, Homo sapiens
tgggaagaggcgggaggctgtt

SEQ ID NO: 7704694 - DNA, 22 bp, Homo sapiens
tgggaagaggcgggaggctgtt

SEQ ID NO: 7704695 - DNA, 22 bp, Homo sapiens
tgggaagaggcgggaggctgtt

SEQ ID NO: 7704696 - DNA, 22 bp, Homo sapiens
tgggaagactcctcaggaggcg

SEQ ID NO: 7704697 - DNA, 22 bp, Homo sapiens
tgggaagactcctcaggaggcg

SEQ ID NO: 7704698 - DNA, 22 bp, Homo sapiens
tgggaagactcctcaggaggcg

SEQ ID NO: 7704699 - DNA, 22 bp, Homo sapiens
tgggaagactcctcaggaggcg

SEQ ID NO: 7704700 - DNA, 22 bp, Homo sapiens
tgggaagactcctcaggaggcg

SEQ ID NO: 7704701 - DNA, 22 bp, Homo sapiens
tgggaagactcctcaggaggcg

SEQ ID NO: 7704702 - DNA, 22 bp, Homo sapiens
tgggaagactcctcaggaggcg

SEQ ID NO: 7704703 - DNA, 22 bp, Homo sapiens
tgggaagaggagcactggaatg

SEQ ID NO: 7704704 - DNA, 22 bp, Homo sapiens
tgggaagaggagcactggaatg

SEQ ID NO: 7704705 - DNA, 22 bp, Homo sapiens
tgggaagaggagcactggaatg

SEQ ID NO: 7704706 - DNA, 22 bp, Homo sapiens
tgggaagactcctcaggaggcg

SEQ ID NO: 7704707 - DNA, 22 bp, Homo sapiens
tgggaagactcctcaggaggcg

SEQ ID NO: 7704708 - DNA, 22 bp, Homo sapiens
tgggaaatataatttagctgtg

SEQ ID NO: 7704709 - DNA, 22 bp, Homo sapiens
tgggaaatatggcattgggcct

SEQ ID NO: 7704710 - DNA, 22 bp, Homo sapiens
tgggaaatattctaaaagtctt

SEQ ID NO: 7704711 - DNA, 22 bp, Homo sapiens
tgggaaatattctaaaagtctt

SEQ ID NO: 7704712 - DNA, 22 bp, Homo sapiens
tgggaaatattggttattggat

SEQ ID NO: 7704713 - DNA, 22 bp, Homo sapiens
tgggaaatattggttattggat

SEQ ID NO: 7704714 - DNA, 22 bp, Homo sapiens
tgggaaatgctgcattgggcaa

SEQ ID NO: 7704715 - DNA, 22 bp, Homo sapiens
tgggaaattgtatttctatttc

SEQ ID NO: 7704716 - DNA, 22 bp, Homo sapiens
tgggaacacctgctgcccagtg

SEQ ID NO: 7704717 - DNA, 22 bp, Homo sapiens
tgggaaatgtgtttctggacca

SEQ ID NO: 7704718 - DNA, 22 bp, Homo sapiens
tgggaaattgtatttctatttc

SEQ ID NO: 7704719 - DNA, 22 bp, Homo sapiens
tgggaacaacatgcactgccac

SEQ ID NO: 7704720 - DNA, 22 bp, Homo sapiens
tgggaacaacatgcactgccac

SEQ ID NO: 7704721 - DNA, 22 bp, Homo sapiens
tgggaacaacatgcactgccac

SEQ ID NO: 7704722 - DNA, 22 bp, Homo sapiens
tgggaaagtgtagcctgcaggc

SEQ ID NO: 7704723 - DNA, 22 bp, Homo sapiens
tgggaaagtgtagcctgcaggc

SEQ ID NO: 7704724 - DNA, 22 bp, Homo sapiens
tgggaaagtgtagcctgcaggc

SEQ ID NO: 7704725 - DNA, 22 bp, Homo sapiens
tgggaaagtgtagcctgcaggc

SEQ ID NO: 7704726 - DNA, 22 bp, Homo sapiens
tgggaaagtgtagcctgcaggc

SEQ ID NO: 7704727 - DNA, 22 bp, Homo sapiens
tgggaaagtgtagcctgcaggc

SEQ ID NO: 7704728 - DNA, 22 bp, Homo sapiens
tgggaaagtgttgaggtgtctt

SEQ ID NO: 7704729 - DNA, 22 bp, Homo sapiens
tgggaaagtgttgaggtgtctt

SEQ ID NO: 7704730 - DNA, 22 bp, Homo sapiens
tgggaaatataatttagctgtg

SEQ ID NO: 7704731 - DNA, 22 bp, Homo sapiens
tgggaaagtgttgaggtgtctt

SEQ ID NO: 7704732 - DNA, 22 bp, Homo sapiens
tgggaaagtgttgaggtgtctt

SEQ ID NO: 7704733 - DNA, 22 bp, Homo sapiens
tgggaaagtgttgaggtgtctt

SEQ ID NO: 7704734 - DNA, 22 bp, Homo sapiens
tgggaaagtgttgaggtgtctt

SEQ ID NO: 7704735 - DNA, 22 bp, Homo sapiens
tggctttataaatccactggtt

SEQ ID NO: 7704736 - DNA, 22 bp, Homo sapiens
tggctttatacttaagcacaat

SEQ ID NO: 7704737 - DNA, 22 bp, Homo sapiens
tggctttatacttaagcacaat

SEQ ID NO: 7704738 - DNA, 22 bp, Homo sapiens
tggctttatacttaagcacaat

SEQ ID NO: 7704739 - DNA, 22 bp, Homo sapiens
tggctttatacttaagcacaat

SEQ ID NO: 7704740 - DNA, 22 bp, Homo sapiens
tggctttatacttaagcacaat

SEQ ID NO: 7704741 - DNA, 20 bp, Homo sapiens
tggctttagtgagggaacat

SEQ ID NO: 7704742 - DNA, 22 bp, Homo sapiens
tggctttataaaaggaaagagg

SEQ ID NO: 7704743 - DNA, 22 bp, Homo sapiens
tggctttataaaaggaaagagg

SEQ ID NO: 7704744 - DNA, 22 bp, Homo sapiens
tggctttataaatccactggtt

SEQ ID NO: 7704745 - DNA, 22 bp, Homo sapiens
tggcttcttgtctaatttgtta

SEQ ID NO: 7704746 - DNA, 22 bp, Homo sapiens
tggcttcttgtctaatttgtta

SEQ ID NO: 7704747 - DNA, 22 bp, Homo sapiens
tggctttatgtgttacgaaaat

SEQ ID NO: 7704748 - DNA, 22 bp, Homo sapiens
tggctttatgtactcaagtcac

SEQ ID NO: 7704749 - DNA, 22 bp, Homo sapiens
tggctttatccatcatcgccaa

SEQ ID NO: 7704750 - DNA, 23 bp, Homo sapiens
tggctttattcacatatctgacc

SEQ ID NO: 7704751 - DNA, 22 bp, Homo sapiens
tggctttcccccagcccagttg

SEQ ID NO: 7704752 - DNA, 17 bp, Homo sapiens
tggctttcctgacacag

SEQ ID NO: 7704753 - DNA, 22 bp, Homo sapiens
tggctttcgctatagagcacgg

SEQ ID NO: 7704754 - DNA, 22 bp, Homo sapiens
tggctttcgctatagagcacgg

SEQ ID NO: 7704755 - DNA, 22 bp, Homo sapiens
tggctttcccccagcccagttg

SEQ ID NO: 7704756 - DNA, 22 bp, Homo sapiens
tggctttctcccccagcttctc

SEQ ID NO: 7704757 - DNA, 22 bp, Homo sapiens
tggcttcttgggatgggtcatt

SEQ ID NO: 7704758 - DNA, 22 bp, Homo sapiens
tggcttcttgatcttggacttg

SEQ ID NO: 7704759 - DNA, 22 bp, Homo sapiens
tggcttcttgggatgggtcatt

SEQ ID NO: 7704760 - DNA, 22 bp, Homo sapiens
tggcttcttgatcttggacttg

SEQ ID NO: 7704761 - DNA, 22 bp, Homo sapiens
tggcttcttgatcttggacttg

SEQ ID NO: 7704762 - DNA, 22 bp, Homo sapiens
tggcttcttgacttcttggctg

SEQ ID NO: 7704763 - DNA, 22 bp, Homo sapiens
tggcttcttgacttcttggctg

SEQ ID NO: 7704764 - DNA, 22 bp, Homo sapiens
tggcttcttgacttcttggctg

SEQ ID NO: 7704765 - DNA, 22 bp, Homo sapiens
tggcttcttagaccagtggcct

SEQ ID NO: 7704766 - DNA, 22 bp, Homo sapiens
tggcttcttagaccagtggcct

SEQ ID NO: 7704767 - DNA, 22 bp, Homo sapiens
tggcttcttactagggctcagt

SEQ ID NO: 7704768 - DNA, 16 bp, Homo sapiens
tggcttcttatttcta

SEQ ID NO: 7704769 - DNA, 22 bp, Homo sapiens
tggcttcttcatatgtgatctt

SEQ ID NO: 7704770 - DNA, 19 bp, Homo sapiens
tggcttcttcggtgttccc

SEQ ID NO: 7704771 - DNA, 19 bp, Homo sapiens
tggcttcttcggtgttccc

SEQ ID NO: 7704772 - DNA, 22 bp, Homo sapiens
tgggaaagactcaggacaggag

SEQ ID NO: 7704773 - DNA, 22 bp, Homo sapiens
tgggaaagactcaggacaggag

SEQ ID NO: 7704774 - DNA, 22 bp, Homo sapiens
tgggaaagactcaggacaggag

SEQ ID NO: 7704775 - DNA, 22 bp, Homo sapiens
tgggaaagactcaggacaggag

SEQ ID NO: 7704776 - DNA, 22 bp, Homo sapiens
tgggaaagactcaggacaggag

SEQ ID NO: 7704777 - DNA, 22 bp, Homo sapiens
tgggaaagactcaggacaggag

SEQ ID NO: 7704778 - DNA, 22 bp, Homo sapiens
tggcttttgttggtaccacctt

SEQ ID NO: 7704779 - DNA, 22 bp, Homo sapiens
tggcttttgttggtaccacctt

SEQ ID NO: 7704780 - DNA, 22 bp, Homo sapiens
tggctttttctcagctctggct

SEQ ID NO: 7704781 - DNA, 22 bp, Homo sapiens
tgggaaaccatgtgtgtcactt

SEQ ID NO: 7704782 - DNA, 21 bp, Homo sapiens
tggcttttatggagctctggg

SEQ ID NO: 7704783 - DNA, 21 bp, Homo sapiens
tggcttttatggagctctggg

SEQ ID NO: 7704784 - DNA, 21 bp, Homo sapiens
tggctttgccctgcttgcccc

SEQ ID NO: 7704785 - DNA, 22 bp, Homo sapiens
tggcttttgcctttcaaattgg

SEQ ID NO: 7704786 - DNA, 22 bp, Homo sapiens
tggcttttgcctttcaaattgg

SEQ ID NO: 7704787 - DNA, 21 bp, Homo sapiens
tggcttttatggagctctggg

SEQ ID NO: 7704788 - DNA, 22 bp, Homo sapiens
tggctttgatggacagaggtca

SEQ ID NO: 7704789 - DNA, 22 bp, Homo sapiens
tggctttgatggacagaggtca

SEQ ID NO: 7704790 - DNA, 22 bp, Homo sapiens
tggctttgaaatccagtcatta

SEQ ID NO: 7704791 - DNA, 22 bp, Homo sapiens
tggctttgaaatccagtcatta

SEQ ID NO: 7704792 - DNA, 20 bp, Homo sapiens
tgggaaagtctaagtgcctc

SEQ ID NO: 7704793 - DNA, 22 bp, Homo sapiens
tgggaaagtaattgtcatcctt

SEQ ID NO: 7704794 - DNA, 22 bp, Homo sapiens
tgggaaagtaattgtcatcctt

SEQ ID NO: 7704795 - DNA, 19 bp, Homo sapiens
tgggaaagtaacatacaaa

SEQ ID NO: 7704796 - DNA, 22 bp, Homo sapiens
tgggaaagtaattgtcatcctt

SEQ ID NO: 7704797 - DNA, 22 bp, Homo sapiens
tgggaaagtaattgtcatcctt

SEQ ID NO: 7704798 - DNA, 22 bp, Homo sapiens
tgggaaagccagcagtgtcacc

SEQ ID NO: 7704799 - DNA, 22 bp, Homo sapiens
tgggaaagactcaggacaggag

SEQ ID NO: 7704800 - DNA, 22 bp, Homo sapiens
tgggaaagccagcagtgtcacc

SEQ ID NO: 7704801 - DNA, 22 bp, Homo sapiens
tgggaaagccagcagtgtcacc

SEQ ID NO: 7704802 - DNA, 22 bp, Homo sapiens
tggcttctagtttgaggaaaaa

SEQ ID NO: 7704803 - DNA, 22 bp, Homo sapiens
tggcttctagtttgaggaaaaa

SEQ ID NO: 7704804 - DNA, 22 bp, Homo sapiens
tggcttctagtttgaggaaaaa

SEQ ID NO: 7704805 - DNA, 22 bp, Homo sapiens
tggcttctagtttgaggaaaaa

SEQ ID NO: 7704806 - DNA, 22 bp, Homo sapiens
tggcttctagagcccatccttc

SEQ ID NO: 7704807 - DNA, 22 bp, Homo sapiens
tggcttctagcagtgttgattt

SEQ ID NO: 7704808 - DNA, 22 bp, Homo sapiens
tggcttctagcagtgttgattt

SEQ ID NO: 7704809 - DNA, 22 bp, Homo sapiens
tggcttctagagcccatccttc

SEQ ID NO: 7704810 - DNA, 22 bp, Homo sapiens
tggcttctaaagtttcttttag

SEQ ID NO: 7704811 - DNA, 22 bp, Homo sapiens
tggcttcctgtttcccagaaag

SEQ ID NO: 7704812 - DNA, 22 bp, Homo sapiens
tggcttcggcattgctacaccc

SEQ ID NO: 7704813 - DNA, 22 bp, Homo sapiens
tggcttctaaagtttcttttag

SEQ ID NO: 7704814 - DNA, 22 bp, Homo sapiens
tggcttcctggacagatgcggt

SEQ ID NO: 7704815 - DNA, 22 bp, Homo sapiens
tggcttcctgtgtaatgaggtg

SEQ ID NO: 7704816 - DNA, 22 bp, Homo sapiens
tggcttcctgtttcccagaaag

SEQ ID NO: 7704817 - DNA, 22 bp, Homo sapiens
tggcttctccagaaatcttggt

SEQ ID NO: 7704818 - DNA, 22 bp, Homo sapiens
tggcttctccagaaatcttggt

SEQ ID NO: 7704819 - DNA, 22 bp, Homo sapiens
tggcttctcagtttcataatga

SEQ ID NO: 7704820 - DNA, 22 bp, Homo sapiens
tggcttctcagtttcataatga

SEQ ID NO: 7704821 - DNA, 22 bp, Homo sapiens
tggcttctcagtttcataatga

SEQ ID NO: 7704822 - DNA, 22 bp, Homo sapiens
tggcttctcagaatactctgga

SEQ ID NO: 7704823 - DNA, 22 bp, Homo sapiens
tggcttctcagaatactctgga

SEQ ID NO: 7704824 - DNA, 22 bp, Homo sapiens
tggcttctcagaatactctgga

SEQ ID NO: 7704825 - DNA, 22 bp, Homo sapiens
tggcttctcaaaataactggtt

SEQ ID NO: 7704826 - DNA, 22 bp, Homo sapiens
tggcttctattgctgtggcatt

SEQ ID NO: 7704827 - DNA, 18 bp, Homo sapiens
tggcttctattttactca

SEQ ID NO: 7704828 - DNA, 22 bp, Homo sapiens
tggcttctattgctgtggcatt

SEQ ID NO: 7704829 - DNA, 18 bp, Homo sapiens
tggcttctattttactca

SEQ ID NO: 7704830 - DNA, 22 bp, Homo sapiens
tggcttcagagtctgagttctt

SEQ ID NO: 7704831 - DNA, 22 bp, Homo sapiens
tggcttcagagtctgagttctt

SEQ ID NO: 7704832 - DNA, 22 bp, Homo sapiens
tggcttcaggagcacctggctt

SEQ ID NO: 7704833 - DNA, 22 bp, Homo sapiens
tggcttcaggagcacctggctt

SEQ ID NO: 7704834 - DNA, 17 bp, Homo sapiens
tggcttcagatgtacat

SEQ ID NO: 7704835 - DNA, 17 bp, Homo sapiens
tggcttcagatgtacat

SEQ ID NO: 7704836 - DNA, 21 bp, Homo sapiens
tggcttcagccattttctctg

SEQ ID NO: 7704837 - DNA, 22 bp, Homo sapiens
tggcttcagacttctgctacgt

SEQ ID NO: 7704838 - DNA, 22 bp, Homo sapiens
tggcttcactgctcaagtgatt

SEQ ID NO: 7704839 - DNA, 22 bp, Homo sapiens
tggcttcactgctcaagtgatt

SEQ ID NO: 7704840 - DNA, 22 bp, Homo sapiens
tggcttcactgctcaagtgatt

SEQ ID NO: 7704841 - DNA, 22 bp, Homo sapiens
tggcttcacctcagcatgaagg

SEQ ID NO: 7704842 - DNA, 22 bp, Homo sapiens
tggcttcagagacagaatctat

SEQ ID NO: 7704843 - DNA, 22 bp, Homo sapiens
tggcttcagagacagaatctat

SEQ ID NO: 7704844 - DNA, 22 bp, Homo sapiens
tggcttcagagacagaatctat

SEQ ID NO: 7704845 - DNA, 22 bp, Homo sapiens
tggcttcagacttctgctacgt

SEQ ID NO: 7704846 - DNA, 22 bp, Homo sapiens
tggcttcctaaactgatttcca

SEQ ID NO: 7704847 - DNA, 22 bp, Homo sapiens
tggcttcctaggagcccgtgct

SEQ ID NO: 7704848 - DNA, 22 bp, Homo sapiens
tggcttcctaaactgatttcca

SEQ ID NO: 7704849 - DNA, 22 bp, Homo sapiens
tggcttcctaaactgatttcca

SEQ ID NO: 7704850 - DNA, 22 bp, Homo sapiens
tggcttcctaggagcccgtgct

SEQ ID NO: 7704851 - DNA, 22 bp, Homo sapiens
tggcttcctccagagcaggagg

SEQ ID NO: 7704852 - DNA, 22 bp, Homo sapiens
tggcttccgccgcgggcctcgg

SEQ ID NO: 7704853 - DNA, 22 bp, Homo sapiens
tggcttccgccgcgggcctcgg

SEQ ID NO: 7704854 - DNA, 17 bp, Homo sapiens
tggcttccctgggccac

SEQ ID NO: 7704855 - DNA, 17 bp, Homo sapiens
tggcttccctgggccac

SEQ ID NO: 7704856 - DNA, 22 bp, Homo sapiens
tggcttcaggagcacctggctt

SEQ ID NO: 7704857 - DNA, 22 bp, Homo sapiens
tggcttcctgcacagtgtctgc

SEQ ID NO: 7704858 - DNA, 22 bp, Homo sapiens
tggcttcctgcatggatcctct

SEQ ID NO: 7704859 - DNA, 22 bp, Homo sapiens
tggcttcctgcatggatcctct

SEQ ID NO: 7704860 - DNA, 18 bp, Homo sapiens
tggcttcctgcgggctgc

SEQ ID NO: 7704861 - DNA, 19 bp, Homo sapiens
tggcttcctgactctcatc

SEQ ID NO: 7704862 - DNA, 19 bp, Homo sapiens
tggcttcctgactctcatc

SEQ ID NO: 7704863 - DNA, 22 bp, Homo sapiens
tggcttcctccagagcaggagg

SEQ ID NO: 7704864 - DNA, 19 bp, Homo sapiens
tggcttcctgactctcatc

SEQ ID NO: 7704865 - DNA, 22 bp, Homo sapiens
tggcttcctgcacagtgtctgc

SEQ ID NO: 7704866 - DNA, 22 bp, Homo sapiens
tggcttcctgcacagtgtctgc

SEQ ID NO: 7704867 - DNA, 22 bp, Homo sapiens
tggcttctggctggtgagaaat

SEQ ID NO: 7704868 - DNA, 22 bp, Homo sapiens
tggcttctggctggtgagaaat

SEQ ID NO: 7704869 - DNA, 22 bp, Homo sapiens
tggcttctgggacttgtgagca

SEQ ID NO: 7704870 - DNA, 22 bp, Homo sapiens
tggcttctgggacttgtgagca

SEQ ID NO: 7704871 - DNA, 22 bp, Homo sapiens
tggcttctggggtggcctgcat

SEQ ID NO: 7704872 - DNA, 22 bp, Homo sapiens
tggcttctggggtggcctgcat

SEQ ID NO: 7704873 - DNA, 22 bp, Homo sapiens
tggcttctgggacttgtgagca

SEQ ID NO: 7704874 - DNA, 22 bp, Homo sapiens
tggcttctgggacttgtgagca

SEQ ID NO: 7704875 - DNA, 22 bp, Homo sapiens
tggcttctgtccctgctacatt

SEQ ID NO: 7704876 - DNA, 22 bp, Homo sapiens
tggcttctggggtggcctgcat

SEQ ID NO: 7704877 - DNA, 22 bp, Homo sapiens
tggcttctggtttatccttata

SEQ ID NO: 7704878 - DNA, 19 bp, Homo sapiens
tggcttctgttttcatgtt

SEQ ID NO: 7704879 - DNA, 19 bp, Homo sapiens
tggcttctgttttcatgtt

SEQ ID NO: 7704880 - DNA, 19 bp, Homo sapiens
tggcttctgttttcatgtt

SEQ ID NO: 7704881 - DNA, 23 bp, Homo sapiens
tggcttctgccccattctctcca

SEQ ID NO: 7704882 - DNA, 22 bp, Homo sapiens
tggcttctgcatatttttagag

SEQ ID NO: 7704883 - DNA, 21 bp, Homo sapiens
tggcttctgccaatgttaaga

SEQ ID NO: 7704884 - DNA, 18 bp, Homo sapiens
tggcttctgctagctgga

SEQ ID NO: 7704885 - DNA, 22 bp, Homo sapiens
tggcttctgctcccagaatgat

SEQ ID NO: 7704886 - DNA, 23 bp, Homo sapiens
tggcttctgccccattctctcca

SEQ ID NO: 7704887 - DNA, 22 bp, Homo sapiens
tggcttctgctcccagaatgat

SEQ ID NO: 7704888 - DNA, 22 bp, Homo sapiens
tggcttctgctttcagtggagg

SEQ ID NO: 7704889 - DNA, 22 bp, Homo sapiens
tggcttctgctttcagtggagg

SEQ ID NO: 7704890 - DNA, 22 bp, Homo sapiens
tggcttctggccaggcacagga

SEQ ID NO: 7704891 - DNA, 22 bp, Homo sapiens
tggcttctggccaggcacagga

SEQ ID NO: 7704892 - DNA, 22 bp, Homo sapiens
tggcttctgctttcagtggagg

SEQ ID NO: 7704893 - DNA, 19 bp, Homo sapiens
tggcttctggcaacagatg

SEQ ID NO: 7704894 - DNA, 22 bp, Homo sapiens
tggcttctccctccccatctag

SEQ ID NO: 7704895 - DNA, 22 bp, Homo sapiens
tggcttctccctacaacatgcc

SEQ ID NO: 7704896 - DNA, 22 bp, Homo sapiens
tggcttctccctacaacatgcc

SEQ ID NO: 7704897 - DNA, 22 bp, Homo sapiens
tggcttctcccgacaccctggc

SEQ ID NO: 7704898 - DNA, 22 bp, Homo sapiens
tggcttctcccgacaccctggc

SEQ ID NO: 7704899 - DNA, 22 bp, Homo sapiens
tggcttctcccgacaccctggc

SEQ ID NO: 7704900 - DNA, 22 bp, Homo sapiens
tggcttctccctctgcctgatt

SEQ ID NO: 7704901 - DNA, 22 bp, Homo sapiens
tggcttctcgcctgtcatcccg

SEQ ID NO: 7704902 - DNA, 22 bp, Homo sapiens
tggcttctcgcctgtcatcccg

SEQ ID NO: 7704903 - DNA, 22 bp, Homo sapiens
tggcttctccctctgcctgatt

SEQ ID NO: 7704904 - DNA, 22 bp, Homo sapiens
tggcttctccctctgcctgatt

SEQ ID NO: 7704905 - DNA, 22 bp, Homo sapiens
tggcttctcgcctgtcatcccg

SEQ ID NO: 7704906 - DNA, 22 bp, Homo sapiens
tggcttctctggcatccccatc

SEQ ID NO: 7704907 - DNA, 22 bp, Homo sapiens
tggcttctctgtgtgagggaga

SEQ ID NO: 7704908 - DNA, 22 bp, Homo sapiens
tggcttctctgtggtggctccc

SEQ ID NO: 7704909 - DNA, 22 bp, Homo sapiens
tggcttctctgtggtggctccc

SEQ ID NO: 7704910 - DNA, 22 bp, Homo sapiens
tggcttctgagtctcctgacat

SEQ ID NO: 7704911 - DNA, 22 bp, Homo sapiens
tggcttctgagcattgaaacgt

SEQ ID NO: 7704912 - DNA, 22 bp, Homo sapiens
tggcttctgagcattgaaacgt

SEQ ID NO: 7704913 - DNA, 22 bp, Homo sapiens
tggcttctgagtctcctgacat

SEQ ID NO: 7704914 - DNA, 22 bp, Homo sapiens
tggcttctgagcattgaaacgt

SEQ ID NO: 7704915 - DNA, 22 bp, Homo sapiens
tggcttctgagtctcctgacat

SEQ ID NO: 7704916 - DNA, 22 bp, Homo sapiens
tggcttctgcatatttttagag

SEQ ID NO: 7704917 - DNA, 20 bp, Homo sapiens
tggcttctcttcactcctgt

SEQ ID NO: 7704918 - DNA, 22 bp, Homo sapiens
tggcttctctgttttagtattt

SEQ ID NO: 7704919 - DNA, 20 bp, Homo sapiens
tggcttctcttcactcctgt

SEQ ID NO: 7704920 - DNA, 22 bp, Homo sapiens
tggcttctctgtgtgagggaga

SEQ ID NO: 7704921 - DNA, 22 bp, Homo sapiens
tggcttctctgttttagtattt

SEQ ID NO: 7704922 - DNA, 22 bp, Homo sapiens
tggcttctctgttttagtattt

SEQ ID NO: 7704923 - DNA, 22 bp, Homo sapiens
tggcttctctgtgtgagggaga

SEQ ID NO: 7704924 - DNA, 22 bp, Homo sapiens
tggcttctctgttttagtattt

SEQ ID NO: 7704925 - DNA, 23 bp, Homo sapiens
tggctggcagaaactgaagcatg

SEQ ID NO: 7704926 - DNA, 23 bp, Homo sapiens
tggctggcagaaactgaagcatg

SEQ ID NO: 7704927 - DNA, 23 bp, Homo sapiens
tggctggcagaaactgaagcatg

SEQ ID NO: 7704928 - DNA, 22 bp, Homo sapiens
tggctggcaaggctggagtcag

SEQ ID NO: 7704929 - DNA, 22 bp, Homo sapiens
tggctggcaaggctggagtcag

SEQ ID NO: 7704930 - DNA, 22 bp, Homo sapiens
tggctggcaaggctggagtcag

SEQ ID NO: 7704931 - DNA, 22 bp, Homo sapiens
tggctggcaaggctggagtcag

SEQ ID NO: 7704932 - DNA, 22 bp, Homo sapiens
tggctggcaaggctggagtcag

SEQ ID NO: 7704933 - DNA, 22 bp, Homo sapiens
tggctggcaaggctggagtcag

SEQ ID NO: 7704934 - DNA, 22 bp, Homo sapiens
tggctggcaaggctggagtcag

SEQ ID NO: 7704935 - DNA, 22 bp, Homo sapiens
tggctggattattggctagtac

SEQ ID NO: 7704936 - DNA, 22 bp, Homo sapiens
tggctggattattggctagtac

SEQ ID NO: 7704937 - DNA, 22 bp, Homo sapiens
tggctggatatcaggcaagggg

SEQ ID NO: 7704938 - DNA, 22 bp, Homo sapiens
tggctggatgtgagatcaagag

SEQ ID NO: 7704939 - DNA, 22 bp, Homo sapiens
tggctggatgtgagatcaagag

SEQ ID NO: 7704940 - DNA, 22 bp, Homo sapiens
tggctggatatcaggcaagggg

SEQ ID NO: 7704941 - DNA, 22 bp, Homo sapiens
tggctggattattggctagtac

SEQ ID NO: 7704942 - DNA, 22 bp, Homo sapiens
tggctggattattggctagtac

SEQ ID NO: 7704943 - DNA, 22 bp, Homo sapiens
tggctggatgtgagatcaagag

SEQ ID NO: 7704944 - DNA, 22 bp, Homo sapiens
tggctggatgtgagatcaagag

SEQ ID NO: 7704945 - DNA, 22 bp, Homo sapiens
tggctggagtgggagaagttta

SEQ ID NO: 7704946 - DNA, 22 bp, Homo sapiens
tggctggagtctggtgctagcc

SEQ ID NO: 7704947 - DNA, 22 bp, Homo sapiens
tggctggagtctggtgctagcc

SEQ ID NO: 7704948 - DNA, 22 bp, Homo sapiens
tggctggagtctggtgctagcc

SEQ ID NO: 7704949 - DNA, 22 bp, Homo sapiens
tggctggagtctggtgctagcc

SEQ ID NO: 7704950 - DNA, 22 bp, Homo sapiens
tggctggagtataggagtagga

SEQ ID NO: 7704951 - DNA, 22 bp, Homo sapiens
tggctggagtataggagtagga

SEQ ID NO: 7704952 - DNA, 22 bp, Homo sapiens
tggctggagtataggagtagga

SEQ ID NO: 7704953 - DNA, 22 bp, Homo sapiens
tggctggagtataggagtagga

SEQ ID NO: 7704954 - DNA, 21 bp, Homo sapiens
tggctggatagatgggaactg

SEQ ID NO: 7704955 - DNA, 21 bp, Homo sapiens
tggctggatagatgggaactg

SEQ ID NO: 7704956 - DNA, 21 bp, Homo sapiens
tggctggatagatgggaactg

SEQ ID NO: 7704957 - DNA, 21 bp, Homo sapiens
tggctggatagatgggaactg

SEQ ID NO: 7704958 - DNA, 21 bp, Homo sapiens
tggctggatagatgggaactg

SEQ ID NO: 7704959 - DNA, 22 bp, Homo sapiens
tggctggagtgggagaagttta

SEQ ID NO: 7704960 - DNA, 22 bp, Homo sapiens
tggctggagtgggagaagttta

SEQ ID NO: 7704961 - DNA, 22 bp, Homo sapiens
tggctggagtgggagaagttta

SEQ ID NO: 7704962 - DNA, 22 bp, Homo sapiens
tggctggataatattctgttgt

SEQ ID NO: 7704963 - DNA, 22 bp, Homo sapiens
tggctggatatcaggcaagggg

SEQ ID NO: 7704964 - DNA, 22 bp, Homo sapiens
tggctggatatcaggcaagggg

SEQ ID NO: 7704965 - DNA, 22 bp, Homo sapiens
tggctggatatcagaggaagtg

SEQ ID NO: 7704966 - DNA, 22 bp, Homo sapiens
tggctggatatcagaggaagtg

SEQ ID NO: 7704967 - DNA, 22 bp, Homo sapiens
tggctggatatcagaggaagtg

SEQ ID NO: 7704968 - DNA, 22 bp, Homo sapiens
tggctggatatcagaggaagtg

SEQ ID NO: 7704969 - DNA, 22 bp, Homo sapiens
tggctggaatggagctgagcct

SEQ ID NO: 7704970 - DNA, 22 bp, Homo sapiens
tggctggaatggagctgagcct

SEQ ID NO: 7704971 - DNA, 22 bp, Homo sapiens
tggctggaatggagctgagcct

SEQ ID NO: 7704972 - DNA, 22 bp, Homo sapiens
tggctggacagtgggcagtgga

SEQ ID NO: 7704973 - DNA, 22 bp, Homo sapiens
tggctggacagtgggcagtgga

SEQ ID NO: 7704974 - DNA, 22 bp, Homo sapiens
tggctggaatggagctgagcct

SEQ ID NO: 7704975 - DNA, 22 bp, Homo sapiens
tggctggacagtgggcagtgga

SEQ ID NO: 7704976 - DNA, 22 bp, Homo sapiens
tggctggacagtgggcagtgga

SEQ ID NO: 7704977 - DNA, 22 bp, Homo sapiens
tggctggacagtgggcagtgga

SEQ ID NO: 7704978 - DNA, 22 bp, Homo sapiens
tggctggacagtgggcagtgga

SEQ ID NO: 7704979 - DNA, 19 bp, Homo sapiens
tggctggagatctgctact

SEQ ID NO: 7704980 - DNA, 22 bp, Homo sapiens
tggctggagagggtcccatgag

SEQ ID NO: 7704981 - DNA, 22 bp, Homo sapiens
tggctggagagggtcccatgag

SEQ ID NO: 7704982 - DNA, 22 bp, Homo sapiens
tggctggagaacttggggatct

SEQ ID NO: 7704983 - DNA, 22 bp, Homo sapiens
tggctggagaacttggggatct

SEQ ID NO: 7704984 - DNA, 22 bp, Homo sapiens
tggctggacctgggctggaatt

SEQ ID NO: 7704985 - DNA, 22 bp, Homo sapiens
tggctggagaacttggggatct

SEQ ID NO: 7704986 - DNA, 22 bp, Homo sapiens
tggctggagaacttggggatct

SEQ ID NO: 7704987 - DNA, 22 bp, Homo sapiens
tggctggacctgggctggaatt

SEQ ID NO: 7704988 - DNA, 22 bp, Homo sapiens
tggctggacctgggctggaatt

SEQ ID NO: 7704989 - DNA, 22 bp, Homo sapiens
tggctggacctgggctggaatt

SEQ ID NO: 7704990 - DNA, 22 bp, Homo sapiens
tggctggacctgggctggaatt

SEQ ID NO: 7704991 - DNA, 22 bp, Homo sapiens
tggctggagggttagtgagata

SEQ ID NO: 7704992 - DNA, 22 bp, Homo sapiens
tggctggagggttagtgagata

SEQ ID NO: 7704993 - DNA, 22 bp, Homo sapiens
tggctggagggttagtgagata

SEQ ID NO: 7704994 - DNA, 22 bp, Homo sapiens
tggctggagggttagtgagata

SEQ ID NO: 7704995 - DNA, 22 bp, Homo sapiens
tggctggagggttagtgagata

SEQ ID NO: 7704996 - DNA, 22 bp, Homo sapiens
tggctggagggacccactcaga

SEQ ID NO: 7704997 - DNA, 22 bp, Homo sapiens
tggctggagggacccactcaga

SEQ ID NO: 7704998 - DNA, 22 bp, Homo sapiens
tggctggaggcatgcaagctcc

SEQ ID NO: 7704999 - DNA, 22 bp, Homo sapiens
tggctggaggcatgcaagctcc

SEQ ID NO: 7705000 - DNA, 22 bp, Homo sapiens
tggctggaggcatgcaagctcc

SEQ ID NO: 7705001 - DNA, 22 bp, Homo sapiens
tggctggaggcatgcaagctcc

SEQ ID NO: 7705002 - DNA, 22 bp, Homo sapiens
tggctggaggaaggaactgagg

SEQ ID NO: 7705003 - DNA, 22 bp, Homo sapiens
tggctggaggaaggaactgagg

SEQ ID NO: 7705004 - DNA, 22 bp, Homo sapiens
tggctggagcccctcaagagca

SEQ ID NO: 7705005 - DNA, 22 bp, Homo sapiens
tggctggagcgccctcctctgc

SEQ ID NO: 7705006 - DNA, 22 bp, Homo sapiens
tggctggagcgccctcctctgc

SEQ ID NO: 7705007 - DNA, 22 bp, Homo sapiens
tggctggagcccctcaagagca

SEQ ID NO: 7705008 - DNA, 22 bp, Homo sapiens
tggctggagcccctcaagagca

SEQ ID NO: 7705009 - DNA, 22 bp, Homo sapiens
tggctggagcccctcaagagca

SEQ ID NO: 7705010 - DNA, 22 bp, Homo sapiens
tggctggagcattccttgtctt

SEQ ID NO: 7705011 - DNA, 22 bp, Homo sapiens
tggctggagcattccttgtctt

SEQ ID NO: 7705012 - DNA, 22 bp, Homo sapiens
tggctggccctgggagtgcaga

SEQ ID NO: 7705013 - DNA, 22 bp, Homo sapiens
tggctggcatagccattgctcc

SEQ ID NO: 7705014 - DNA, 22 bp, Homo sapiens
tggctggcatagccattgctcc

SEQ ID NO: 7705015 - DNA, 22 bp, Homo sapiens
tggctggcatagccattgctcc

SEQ ID NO: 7705016 - DNA, 22 bp, Homo sapiens
tggctggcatagccattgctcc

SEQ ID NO: 7705017 - DNA, 22 bp, Homo sapiens
tggctggcatagccattgctcc

SEQ ID NO: 7705018 - DNA, 22 bp, Homo sapiens
tggctggcagttatctttggat

SEQ ID NO: 7705019 - DNA, 18 bp, Homo sapiens
tggctggcagtgggcagc

SEQ ID NO: 7705020 - DNA, 22 bp, Homo sapiens
tggctggcgccgggctagccac

SEQ ID NO: 7705021 - DNA, 22 bp, Homo sapiens
tggctggcgccgggctagccac

SEQ ID NO: 7705022 - DNA, 22 bp, Homo sapiens
tggctggcgccgggctagccac

SEQ ID NO: 7705023 - DNA, 22 bp, Homo sapiens
tggctggcgccgggctagccac

SEQ ID NO: 7705024 - DNA, 22 bp, Homo sapiens
tggctggccctgggagtgcaga

SEQ ID NO: 7705025 - DNA, 22 bp, Homo sapiens
tggctggccctgggagtgcaga

SEQ ID NO: 7705026 - DNA, 22 bp, Homo sapiens
tggctggcgccgggctagccac

SEQ ID NO: 7705027 - DNA, 22 bp, Homo sapiens
tggctggccctgggagtgcaga

SEQ ID NO: 7705028 - DNA, 22 bp, Homo sapiens
tggctggccctgggagtgcaga

SEQ ID NO: 7705029 - DNA, 18 bp, Homo sapiens
tggctggcagtgggcagc

SEQ ID NO: 7705030 - DNA, 18 bp, Homo sapiens
tggctggcagtgggcagc

SEQ ID NO: 7705031 - DNA, 18 bp, Homo sapiens
tggctggcagtgggcagc

SEQ ID NO: 7705032 - DNA, 18 bp, Homo sapiens
tggctggcagtgggcagc

SEQ ID NO: 7705033 - DNA, 18 bp, Homo sapiens
tggctggcagtgggcagc

SEQ ID NO: 7705034 - DNA, 22 bp, Homo sapiens
tggctggcagtaggctagtggc

SEQ ID NO: 7705035 - DNA, 22 bp, Homo sapiens
tggctggcagtaggctagtggc

SEQ ID NO: 7705036 - DNA, 18 bp, Homo sapiens
tggctggcagtgggcagc

SEQ ID NO: 7705037 - DNA, 22 bp, Homo sapiens
tggctggcagtaggctagtggc

SEQ ID NO: 7705038 - DNA, 22 bp, Homo sapiens
tggctggcagtaggctagtggc

SEQ ID NO: 7705039 - DNA, 22 bp, Homo sapiens
tggctggcagtaggctagtggc

SEQ ID NO: 7705040 - DNA, 23 bp, Homo sapiens
tggctggcagaaactgaagcatg

SEQ ID NO: 7705041 - DNA, 23 bp, Homo sapiens
tggctggcagaaactgaagcatg

SEQ ID NO: 7705042 - DNA, 22 bp, Homo sapiens
tggctggcaaggctggagtcag

SEQ ID NO: 7705043 - DNA, 23 bp, Homo sapiens
tggctggcagaaactgaagcatg

SEQ ID NO: 7705044 - DNA, 22 bp, Homo sapiens
tggctggcagtaggctagtggc

SEQ ID NO: 7705045 - DNA, 22 bp, Homo sapiens
tggctggcagtaggctagtggc

SEQ ID NO: 7705046 - DNA, 22 bp, Homo sapiens
tggctggcagtaggctagtggc

SEQ ID NO: 7705047 - DNA, 22 bp, Homo sapiens
tggctggcagtaggctagtggc

SEQ ID NO: 7705048 - DNA, 22 bp, Homo sapiens
tggctggcagtaggctagtggc

SEQ ID NO: 7705049 - DNA, 22 bp, Homo sapiens
tggctggcagtaggctagtggc

SEQ ID NO: 7705050 - DNA, 22 bp, Homo sapiens
tggctgggccgggccttgtgcc

SEQ ID NO: 7705051 - DNA, 22 bp, Homo sapiens
tggctgggccgggccttgtgcc

SEQ ID NO: 7705052 - DNA, 22 bp, Homo sapiens
tggctgggcccccacctgcctc

SEQ ID NO: 7705053 - DNA, 22 bp, Homo sapiens
tggctgggcccccacctgcctc

SEQ ID NO: 7705054 - DNA, 22 bp, Homo sapiens
tggctgggcccccacctgcctc

SEQ ID NO: 7705055 - DNA, 22 bp, Homo sapiens
tggctgggcccccacctgcctc

SEQ ID NO: 7705056 - DNA, 22 bp, Homo sapiens
tggctgggcccccacctgcctc

SEQ ID NO: 7705057 - DNA, 22 bp, Homo sapiens
tggctgggcccccacctgcctc

SEQ ID NO: 7705058 - DNA, 22 bp, Homo sapiens
tggctgggcccccacctgcctc

SEQ ID NO: 7705059 - DNA, 22 bp, Homo sapiens
tggctgggcccccacctgcctc

SEQ ID NO: 7705060 - DNA, 22 bp, Homo sapiens
tggctgggagctggaactgggc

SEQ ID NO: 7705061 - DNA, 22 bp, Homo sapiens
tggctgggagctggaactgggc

SEQ ID NO: 7705062 - DNA, 22 bp, Homo sapiens
tggctgggagctggaactgggc

SEQ ID NO: 7705063 - DNA, 22 bp, Homo sapiens
tggctgggagctggaactgggc

SEQ ID NO: 7705064 - DNA, 22 bp, Homo sapiens
tggctgggagctggaactgggc

SEQ ID NO: 7705065 - DNA, 22 bp, Homo sapiens
tggctgggagctggaactgggc

SEQ ID NO: 7705066 - DNA, 22 bp, Homo sapiens
tggctgggagctggaactgggc

SEQ ID NO: 7705067 - DNA, 22 bp, Homo sapiens
tggctggctagaatggaaatgt

SEQ ID NO: 7705068 - DNA, 22 bp, Homo sapiens
tggctggcgttggggccagtga

SEQ ID NO: 7705069 - DNA, 22 bp, Homo sapiens
tggctggctagtgggcaggatt

SEQ ID NO: 7705070 - DNA, 22 bp, Homo sapiens
tggctgggagctggaactgggc

SEQ ID NO: 7705071 - DNA, 22 bp, Homo sapiens
tggctgggagctggaactgggc

SEQ ID NO: 7705072 - DNA, 22 bp, Homo sapiens
tggctgggagctggaactgggc

SEQ ID NO: 7705073 - DNA, 22 bp, Homo sapiens
tggctgggagctggaactgggc

SEQ ID NO: 7705074 - DNA, 22 bp, Homo sapiens
tggctgggagctggaactgggc

SEQ ID NO: 7705075 - DNA, 22 bp, Homo sapiens
tggctggcgttggggccagtga

SEQ ID NO: 7705076 - DNA, 22 bp, Homo sapiens
tggctggcgttggggccagtga

SEQ ID NO: 7705077 - DNA, 23 bp, Homo sapiens
tggctggcgcctgcctcaccctg

SEQ ID NO: 7705078 - DNA, 23 bp, Homo sapiens
tggctggcgcctgcctcaccctg

SEQ ID NO: 7705079 - DNA, 22 bp, Homo sapiens
tggctggcgccgggctagccac

SEQ ID NO: 7705080 - DNA, 22 bp, Homo sapiens
tggctggcgccgggctagccac

SEQ ID NO: 7705081 - DNA, 23 bp, Homo sapiens
tggctggcgcctgcctcaccctg

SEQ ID NO: 7705082 - DNA, 22 bp, Homo sapiens
tggcttcacaatttcataacta

SEQ ID NO: 7705083 - DNA, 22 bp, Homo sapiens
tggcttcaagtctaggttctac

SEQ ID NO: 7705084 - DNA, 23 bp, Homo sapiens
tggcttcaactctgtcggcagcc

SEQ ID NO: 7705085 - DNA, 22 bp, Homo sapiens
tggcttcaagtctaggttctac

SEQ ID NO: 7705086 - DNA, 23 bp, Homo sapiens
tggcttcaactctgtcggcagcc

SEQ ID NO: 7705087 - DNA, 23 bp, Homo sapiens
tggcttcaactctgtcggcagcc

SEQ ID NO: 7705088 - DNA, 22 bp, Homo sapiens
tggcttcaaaggtagcatacaa

SEQ ID NO: 7705089 - DNA, 22 bp, Homo sapiens
tggcttcaaaggtagcatacaa

SEQ ID NO: 7705090 - DNA, 22 bp, Homo sapiens
tggcttaatttctctgtgcctc

SEQ ID NO: 7705091 - DNA, 22 bp, Homo sapiens
tggcttaatatttcatatttaa

SEQ ID NO: 7705092 - DNA, 22 bp, Homo sapiens
tggcttacatgcctttctatct

SEQ ID NO: 7705093 - DNA, 22 bp, Homo sapiens
tggcttatcacattgtccatgg

SEQ ID NO: 7705094 - DNA, 22 bp, Homo sapiens
tggcttcaaaatctagtggtct

SEQ ID NO: 7705095 - DNA, 22 bp, Homo sapiens
tggctgtgtccctgtccagagt

SEQ ID NO: 7705096 - DNA, 22 bp, Homo sapiens
tggctgtgtgccaggctgtctg

SEQ ID NO: 7705097 - DNA, 22 bp, Homo sapiens
tggctgtgtgccaggctgtctg

SEQ ID NO: 7705098 - DNA, 22 bp, Homo sapiens
tggctgtgtcatcatagctgtg

SEQ ID NO: 7705099 - DNA, 22 bp, Homo sapiens
tggctgtgtccctgtccagagt

SEQ ID NO: 7705100 - DNA, 22 bp, Homo sapiens
tggctgtgtccctgtccagagt

SEQ ID NO: 7705101 - DNA, 22 bp, Homo sapiens
tggctgtgtccctgtccagagt

SEQ ID NO: 7705102 - DNA, 22 bp, Homo sapiens
tggctgtgttaccacttcatgt

SEQ ID NO: 7705103 - DNA, 22 bp, Homo sapiens
tggctgttactcttttcatttc

SEQ ID NO: 7705104 - DNA, 23 bp, Homo sapiens
tggcttaacctcttcctatgtct

SEQ ID NO: 7705105 - DNA, 22 bp, Homo sapiens
tggcttaagacgaaaagaaggg

SEQ ID NO: 7705106 - DNA, 22 bp, Homo sapiens
tggcttaagatttatgctttta

SEQ ID NO: 7705107 - DNA, 22 bp, Homo sapiens
tggcttaatatttcatatttaa

SEQ ID NO: 7705108 - DNA, 22 bp, Homo sapiens
tggctgtgatttgcacgagatg

SEQ ID NO: 7705109 - DNA, 22 bp, Homo sapiens
tggctgtcatgcccttcttacc

SEQ ID NO: 7705110 - DNA, 22 bp, Homo sapiens
tggctgtcagtcgcctgcattc

SEQ ID NO: 7705111 - DNA, 22 bp, Homo sapiens
tggctgtcagctgcctggtgcg

SEQ ID NO: 7705112 - DNA, 22 bp, Homo sapiens
tggctgtcagtcgcctgcattc

SEQ ID NO: 7705113 - DNA, 22 bp, Homo sapiens
tggctgtgcggcctcgggcaga

SEQ ID NO: 7705114 - DNA, 22 bp, Homo sapiens
tggctgtggactcagatggctc

SEQ ID NO: 7705115 - DNA, 22 bp, Homo sapiens
tggctgtggactcagatggctc

SEQ ID NO: 7705116 - DNA, 22 bp, Homo sapiens
tggctgtggactcagatggctc

SEQ ID NO: 7705117 - DNA, 22 bp, Homo sapiens
tggctgtgcctctttccaggcc

SEQ ID NO: 7705118 - DNA, 22 bp, Homo sapiens
tggctgtgcctctttccaggcc

SEQ ID NO: 7705119 - DNA, 22 bp, Homo sapiens
tggctgtgcctctttccaggcc

SEQ ID NO: 7705120 - DNA, 20 bp, Homo sapiens
tggctgtgggcatctgtttc

SEQ ID NO: 7705121 - DNA, 22 bp, Homo sapiens
tggctgtgggtggaaggaaacc

SEQ ID NO: 7705122 - DNA, 19 bp, Homo sapiens
tggctgtggggaaatgctt

SEQ ID NO: 7705123 - DNA, 22 bp, Homo sapiens
tggctgtggtttatcccagttc

SEQ ID NO: 7705124 - DNA, 22 bp, Homo sapiens
tggctgtgtcatcatagctgtg

SEQ ID NO: 7705125 - DNA, 22 bp, Homo sapiens
tggctgtggactcagatggctc

SEQ ID NO: 7705126 - DNA, 22 bp, Homo sapiens
tggctgtgggatatgtgactga

SEQ ID NO: 7705127 - DNA, 22 bp, Homo sapiens
tggctgtgggatatgtgactga

SEQ ID NO: 7705128 - DNA, 22 bp, Homo sapiens
tggctgtgggatgagagcctca

SEQ ID NO: 7705129 - DNA, 22 bp, Homo sapiens
tggctgggtgctatccagtact

SEQ ID NO: 7705130 - DNA, 22 bp, Homo sapiens
tggctgggtgctatccagtact

SEQ ID NO: 7705131 - DNA, 22 bp, Homo sapiens
tggctgggtgctatccagtact

SEQ ID NO: 7705132 - DNA, 22 bp, Homo sapiens
tggctgggtgctatccagtact

SEQ ID NO: 7705133 - DNA, 19 bp, Homo sapiens
tggctgggtgccaatggcc

SEQ ID NO: 7705134 - DNA, 22 bp, Homo sapiens
tggctgggtgctatccagtact

SEQ ID NO: 7705135 - DNA, 22 bp, Homo sapiens
tggctgggtgctatccagtact

SEQ ID NO: 7705136 - DNA, 22 bp, Homo sapiens
tggctgggtgctatccagtact

SEQ ID NO: 7705137 - DNA, 22 bp, Homo sapiens
tggctgggtgctatccagtact

SEQ ID NO: 7705138 - DNA, 22 bp, Homo sapiens
tggctggtgggcctcagcctgc

SEQ ID NO: 7705139 - DNA, 21 bp, Homo sapiens
tggctggtggcagggcttctc

SEQ ID NO: 7705140 - DNA, 22 bp, Homo sapiens
tggctgtcagctgcctggtgcg

SEQ ID NO: 7705141 - DNA, 22 bp, Homo sapiens
tggctgtagaatcagagacttg

SEQ ID NO: 7705142 - DNA, 22 bp, Homo sapiens
tggctggttttggtgagctccg

SEQ ID NO: 7705143 - DNA, 22 bp, Homo sapiens
tggctgggggtgctatagctgc

SEQ ID NO: 7705144 - DNA, 22 bp, Homo sapiens
tggctgggggtgctatagctgc

SEQ ID NO: 7705145 - DNA, 22 bp, Homo sapiens
tggctgggggtgctatagctgc

SEQ ID NO: 7705146 - DNA, 22 bp, Homo sapiens
tggctgggggtgctatagctgc

SEQ ID NO: 7705147 - DNA, 22 bp, Homo sapiens
tggctgggggtgctatagctgc

SEQ ID NO: 7705148 - DNA, 22 bp, Homo sapiens
tggctgggggtgctatagctgc

SEQ ID NO: 7705149 - DNA, 22 bp, Homo sapiens
tggctgggggtgctatagctgc

SEQ ID NO: 7705150 - DNA, 19 bp, Homo sapiens
tggctgggtgccaatggcc

SEQ ID NO: 7705151 - DNA, 22 bp, Homo sapiens
tggctgggggtgctatagctgc

SEQ ID NO: 7705152 - DNA, 22 bp, Homo sapiens
tggctgggggtgctatagctgc

SEQ ID NO: 7705153 - DNA, 19 bp, Homo sapiens
tggctgggtgccaatggcc

SEQ ID NO: 7705154 - DNA, 19 bp, Homo sapiens
tggctgggtgccaatggcc

SEQ ID NO: 7705155 - DNA, 19 bp, Homo sapiens
tggctgggtgccaatggcc

SEQ ID NO: 7705156 - DNA, 19 bp, Homo sapiens
tggctgggtgccaatggcc

SEQ ID NO: 7705157 - DNA, 19 bp, Homo sapiens
tggctgggtgccaatggcc

SEQ ID NO: 7705158 - DNA, 19 bp, Homo sapiens
tggctgggtgccaatggcc

SEQ ID NO: 7705159 - DNA, 19 bp, Homo sapiens
tggctgggtgccaatggcc

SEQ ID NO: 7705160 - DNA, 19 bp, Homo sapiens
tggctgggtgccaatggcc

SEQ ID NO: 7705161 - DNA, 19 bp, Homo sapiens
tggctgggtgccaatggcc

SEQ ID NO: 7705162 - DNA, 22 bp, Homo sapiens
tggctggggcctgaatcctgca

SEQ ID NO: 7705163 - DNA, 22 bp, Homo sapiens
tggctggggccacagttttcct

SEQ ID NO: 7705164 - DNA, 22 bp, Homo sapiens
tggctggggcctgaatcctgca

SEQ ID NO: 7705165 - DNA, 22 bp, Homo sapiens
tggctggggcctgaatcctgca

SEQ ID NO: 7705166 - DNA, 22 bp, Homo sapiens
tggctggggcctgaatcctgca

SEQ ID NO: 7705167 - DNA, 22 bp, Homo sapiens
tggctggggcctgaatcctgca

SEQ ID NO: 7705168 - DNA, 22 bp, Homo sapiens
tggctggggcctgaatcctgca

SEQ ID NO: 7705169 - DNA, 22 bp, Homo sapiens
tggctggggcctgaatcctgca

SEQ ID NO: 7705170 - DNA, 22 bp, Homo sapiens
tggctggggcctgaatcctgca

SEQ ID NO: 7705171 - DNA, 22 bp, Homo sapiens
tggctggggcctgaatcctgca

SEQ ID NO: 7705172 - DNA, 22 bp, Homo sapiens
tggctggggccacagttttcct

SEQ ID NO: 7705173 - DNA, 22 bp, Homo sapiens
tggctggggccacagttttcct

SEQ ID NO: 7705174 - DNA, 22 bp, Homo sapiens
tggctggggccacagttttcct

SEQ ID NO: 7705175 - DNA, 22 bp, Homo sapiens
tggctggggccacagttttcct

SEQ ID NO: 7705176 - DNA, 22 bp, Homo sapiens
tggctggggccacagttttcct

SEQ ID NO: 7705177 - DNA, 22 bp, Homo sapiens
tggctggggccacagttttcct

SEQ ID NO: 7705178 - DNA, 22 bp, Homo sapiens
tggctggggagccccgactccc

SEQ ID NO: 7705179 - DNA, 22 bp, Homo sapiens
tggctggggagccccgactccc

SEQ ID NO: 7705180 - DNA, 22 bp, Homo sapiens
tggctggggagccccgactccc

SEQ ID NO: 7705181 - DNA, 22 bp, Homo sapiens
tggctggggagccccgactccc

SEQ ID NO: 7705182 - DNA, 19 bp, Homo sapiens
tggctgggcgtgcctccgt

SEQ ID NO: 7705183 - DNA, 22 bp, Homo sapiens
tggctggggagccccgactccc

SEQ ID NO: 7705184 - DNA, 22 bp, Homo sapiens
tggctggggagccccgactccc

SEQ ID NO: 7705185 - DNA, 19 bp, Homo sapiens
tggctgggcgtgcctccgt

SEQ ID NO: 7705186 - DNA, 19 bp, Homo sapiens
tggctgggcgtgcctccgt

SEQ ID NO: 7705187 - DNA, 19 bp, Homo sapiens
tggctgggcgtgcctccgt

SEQ ID NO: 7705188 - DNA, 19 bp, Homo sapiens
tggctgggcgtgcctccgt

SEQ ID NO: 7705189 - DNA, 19 bp, Homo sapiens
tggctgggcgtgcctccgt

SEQ ID NO: 7705190 - DNA, 19 bp, Homo sapiens
tggctgggcgtgcctccgt

SEQ ID NO: 7705191 - DNA, 19 bp, Homo sapiens
tggctgggcgtgcctccgt

SEQ ID NO: 7705192 - DNA, 19 bp, Homo sapiens
tggctgggcgtgcctccgt

SEQ ID NO: 7705193 - DNA, 22 bp, Homo sapiens
tggctgggccgggccttgtgcc

SEQ ID NO: 7705194 - DNA, 22 bp, Homo sapiens
tggctgggccgggccttgtgcc

SEQ ID NO: 7705195 - DNA, 22 bp, Homo sapiens
tggctgggccgggccttgtgcc

SEQ ID NO: 7705196 - DNA, 22 bp, Homo sapiens
tggctgggccgggccttgtgcc

SEQ ID NO: 7705197 - DNA, 22 bp, Homo sapiens
tggctgggccgggccttgtgcc

SEQ ID NO: 7705198 - DNA, 22 bp, Homo sapiens
tggctgggccgggccttgtgcc

SEQ ID NO: 7705199 - DNA, 22 bp, Homo sapiens
tggctgggccgggccttgtgcc

SEQ ID NO: 7705200 - DNA, 22 bp, Homo sapiens
tggctgggccgggccttgtgcc

SEQ ID NO: 7705201 - DNA, 22 bp, Homo sapiens
tgggacagggaatctgatcccc

SEQ ID NO: 7705202 - DNA, 22 bp, Homo sapiens
tgggacacctcagatagtgtct

SEQ ID NO: 7705203 - DNA, 22 bp, Homo sapiens
tgggacaccctcacgcctgcac

SEQ ID NO: 7705204 - DNA, 22 bp, Homo sapiens
tgggacagggaatctgatcccc

SEQ ID NO: 7705205 - DNA, 22 bp, Homo sapiens
tgggacacagtgtgtgaagtgc

SEQ ID NO: 7705206 - DNA, 22 bp, Homo sapiens
tgggacacccaggagggagtgg

SEQ ID NO: 7705207 - DNA, 22 bp, Homo sapiens
tgggacacattagtcaccttac

SEQ ID NO: 7705208 - DNA, 22 bp, Homo sapiens
tgggacacccaggagggagtgg

SEQ ID NO: 7705209 - DNA, 22 bp, Homo sapiens
tgggacacccaggagggagtgg

SEQ ID NO: 7705210 - DNA, 22 bp, Homo sapiens
tgggacacagtgtgtgaagtgc

SEQ ID NO: 7705211 - DNA, 22 bp, Homo sapiens
tgggacacaaaccagaccagga

SEQ ID NO: 7705212 - DNA, 22 bp, Homo sapiens
tgggacacaaaccagaccagga

SEQ ID NO: 7705213 - DNA, 22 bp, Homo sapiens
tgggacacaaaccagaccagga

SEQ ID NO: 7705214 - DNA, 22 bp, Homo sapiens
tgggacacaaaccagaccagga

SEQ ID NO: 7705215 - DNA, 22 bp, Homo sapiens
tgggacacaaaccagaccagga

SEQ ID NO: 7705216 - DNA, 22 bp, Homo sapiens
tgggacacacaaggtcagctct

SEQ ID NO: 7705217 - DNA, 22 bp, Homo sapiens
tgggacacacaaggtcagctct

SEQ ID NO: 7705218 - DNA, 23 bp, Homo sapiens
tgggacacagggtcatggttatt

SEQ ID NO: 7705219 - DNA, 23 bp, Homo sapiens
tgggacacagggtcatggttatt

SEQ ID NO: 7705220 - DNA, 22 bp, Homo sapiens
tgggacacagaaaaggcaggtt

SEQ ID NO: 7705221 - DNA, 22 bp, Homo sapiens
tgggacacagaaaaggcaggtt

SEQ ID NO: 7705222 - DNA, 22 bp, Homo sapiens
tgggacacacaaggtcagctct

SEQ ID NO: 7705223 - DNA, 22 bp, Homo sapiens
tgggacaggttggagagaagca

SEQ ID NO: 7705224 - DNA, 22 bp, Homo sapiens
tgggacaggttggagagaagca

SEQ ID NO: 7705225 - DNA, 22 bp, Homo sapiens
tgggacagtgaccccagaggtc

SEQ ID NO: 7705226 - DNA, 22 bp, Homo sapiens
tgggacaggttggagagaagca

SEQ ID NO: 7705227 - DNA, 22 bp, Homo sapiens
tgggacagtgaccccagaggtc

SEQ ID NO: 7705228 - DNA, 22 bp, Homo sapiens
tgggacagtgaccccagaggtc

SEQ ID NO: 7705229 - DNA, 22 bp, Homo sapiens
tgggacagtgaccccagaggtc

SEQ ID NO: 7705230 - DNA, 22 bp, Homo sapiens
tgggacagtgaccccagaggtc

SEQ ID NO: 7705231 - DNA, 22 bp, Homo sapiens
tgggacagtgaccccagaggtc

SEQ ID NO: 7705232 - DNA, 22 bp, Homo sapiens
tgggacagtgaccccagaggtc

SEQ ID NO: 7705233 - DNA, 22 bp, Homo sapiens
tgggacaggttggagagaagca

SEQ ID NO: 7705234 - DNA, 22 bp, Homo sapiens
tgggacaggttggagagaagca

SEQ ID NO: 7705235 - DNA, 22 bp, Homo sapiens
tgggacaggttggagagaagca

SEQ ID NO: 7705236 - DNA, 22 bp, Homo sapiens
tgggacaggttggagagaagca

SEQ ID NO: 7705237 - DNA, 22 bp, Homo sapiens
tgggacaggttggagagaagca

SEQ ID NO: 7705238 - DNA, 22 bp, Homo sapiens
tgggacaggttggagagaagca

SEQ ID NO: 7705239 - DNA, 22 bp, Homo sapiens
tgggacaggttggagagaagca

SEQ ID NO: 7705240 - DNA, 22 bp, Homo sapiens
tgggacaggttggagagaagca

SEQ ID NO: 7705241 - DNA, 22 bp, Homo sapiens
tgggacaggttggagagaagca

SEQ ID NO: 7705242 - DNA, 22 bp, Homo sapiens
tgggaattgaggtgattgtgag

SEQ ID NO: 7705243 - DNA, 22 bp, Homo sapiens
tgggacaaggactagctccaat

SEQ ID NO: 7705244 - DNA, 22 bp, Homo sapiens
tgggaatgtgagcattcattca

SEQ ID NO: 7705245 - DNA, 22 bp, Homo sapiens
tgggaatgctgagcccatgtat

SEQ ID NO: 7705246 - DNA, 22 bp, Homo sapiens
tgggaatgggcctagaaggctg

SEQ ID NO: 7705247 - DNA, 23 bp, Homo sapiens
tgggaatgacatctagagcagag

SEQ ID NO: 7705248 - DNA, 22 bp, Homo sapiens
tgggaagttgtaccttctgtta

SEQ ID NO: 7705249 - DNA, 22 bp, Homo sapiens
tgggaagttgtaccttctgtta

SEQ ID NO: 7705250 - DNA, 22 bp, Homo sapiens
tgggaatacaattctgagagaa

SEQ ID NO: 7705251 - DNA, 22 bp, Homo sapiens
tgggaatagaacaagatagaga

SEQ ID NO: 7705252 - DNA, 22 bp, Homo sapiens
tgggaatacaagttattcacct

SEQ ID NO: 7705253 - DNA, 22 bp, Homo sapiens
tgggaagttaggatgccaggga

SEQ ID NO: 7705254 - DNA, 22 bp, Homo sapiens
tgggaaggttagcagtttgtca

SEQ ID NO: 7705255 - DNA, 22 bp, Homo sapiens
tgggaaggttagcagtttgtca

SEQ ID NO: 7705256 - DNA, 22 bp, Homo sapiens
tgggaaggttagcagtttgtca

SEQ ID NO: 7705257 - DNA, 22 bp, Homo sapiens
tgggaaggttagcagtttgtca

SEQ ID NO: 7705258 - DNA, 22 bp, Homo sapiens
tgggaaggttagcagtttgtca

SEQ ID NO: 7705259 - DNA, 22 bp, Homo sapiens
tgggaagttaggatgccaggga

SEQ ID NO: 7705260 - DNA, 22 bp, Homo sapiens
tgggaagttaggatgccaggga

SEQ ID NO: 7705261 - DNA, 22 bp, Homo sapiens
tgggaagtcgtagagttcatgt

SEQ ID NO: 7705262 - DNA, 22 bp, Homo sapiens
tgggaagtcgtagagttcatgt

SEQ ID NO: 7705263 - DNA, 22 bp, Homo sapiens
tgggaagtaggacagtgcagtt

SEQ ID NO: 7705264 - DNA, 22 bp, Homo sapiens
tgggaagtaggacagtgcagtt

SEQ ID NO: 7705265 - DNA, 22 bp, Homo sapiens
tgggaagtatcatttggcctgg

SEQ ID NO: 7705266 - DNA, 20 bp, Homo sapiens
tgggactgacccatctgagc

SEQ ID NO: 7705267 - DNA, 20 bp, Homo sapiens
tgggactgacccatctgagc

SEQ ID NO: 7705268 - DNA, 22 bp, Homo sapiens
tgggactcactcttttggccag

SEQ ID NO: 7705269 - DNA, 20 bp, Homo sapiens
tgggactgacccatctgagc

SEQ ID NO: 7705270 - DNA, 22 bp, Homo sapiens
tgggactcactcttttggccag

SEQ ID NO: 7705271 - DNA, 22 bp, Homo sapiens
tgggactcactcttttggccag

SEQ ID NO: 7705272 - DNA, 22 bp, Homo sapiens
tgggactcactcttttggccag

SEQ ID NO: 7705273 - DNA, 22 bp, Homo sapiens
tgggactcactcttttggccag

SEQ ID NO: 7705274 - DNA, 22 bp, Homo sapiens
tgggactcactcttttggccag

SEQ ID NO: 7705275 - DNA, 22 bp, Homo sapiens
tgggactcactcttttggccag

SEQ ID NO: 7705276 - DNA, 22 bp, Homo sapiens
tgggactgtgacctccagggta

SEQ ID NO: 7705277 - DNA, 22 bp, Homo sapiens
tgggactgtgacctccagggta

SEQ ID NO: 7705278 - DNA, 22 bp, Homo sapiens
tgggactgagaatatgatgggg

SEQ ID NO: 7705279 - DNA, 22 bp, Homo sapiens
tgggactgctcttgctggggtc

SEQ ID NO: 7705280 - DNA, 22 bp, Homo sapiens
tgggactgctcttgctggggtc

SEQ ID NO: 7705281 - DNA, 22 bp, Homo sapiens
tgggactgctcttgctggggtc

SEQ ID NO: 7705282 - DNA, 21 bp, Homo sapiens
tgggacctatttcaactggat

SEQ ID NO: 7705283 - DNA, 21 bp, Homo sapiens
tgggacctatttcaactggat

SEQ ID NO: 7705284 - DNA, 21 bp, Homo sapiens
tgggacctatttcaactggat

SEQ ID NO: 7705285 - DNA, 22 bp, Homo sapiens
tgggacctgaagcaggttggca

SEQ ID NO: 7705286 - DNA, 22 bp, Homo sapiens
tgggacctgaagcaggttggca

SEQ ID NO: 7705287 - DNA, 22 bp, Homo sapiens
tgggacctgaagcaggttggca

SEQ ID NO: 7705288 - DNA, 22 bp, Homo sapiens
tgggacctctcttgagagagca

SEQ ID NO: 7705289 - DNA, 21 bp, Homo sapiens
tgggacctagctttgcacagg

SEQ ID NO: 7705290 - DNA, 21 bp, Homo sapiens
tgggacctagctttgcacagg

SEQ ID NO: 7705291 - DNA, 22 bp, Homo sapiens
tgggaccagataaagggaggtc

SEQ ID NO: 7705292 - DNA, 22 bp, Homo sapiens
tgggaccacactttgaacaaca

SEQ ID NO: 7705293 - DNA, 22 bp, Homo sapiens
tgggaccagataaagggaggtc

SEQ ID NO: 7705294 - DNA, 22 bp, Homo sapiens
tgggacctgctcttggaatgag

SEQ ID NO: 7705295 - DNA, 22 bp, Homo sapiens
tgggacctgctcctggaatgag

SEQ ID NO: 7705296 - DNA, 22 bp, Homo sapiens
tgggacctgccctggccccatc

SEQ ID NO: 7705297 - DNA, 22 bp, Homo sapiens
tgggacctgccctggccccatc

SEQ ID NO: 7705298 - DNA, 22 bp, Homo sapiens
tgggacctgccctggccccatc

SEQ ID NO: 7705299 - DNA, 22 bp, Homo sapiens
tgggacctgttacattgagtta

SEQ ID NO: 7705300 - DNA, 23 bp, Homo sapiens
tgggacctgtttgcccacagatg

SEQ ID NO: 7705301 - DNA, 23 bp, Homo sapiens
tgggacctgtttgcccacagatg

SEQ ID NO: 7705302 - DNA, 23 bp, Homo sapiens
tgggacctgtttgcccacagatg

SEQ ID NO: 7705303 - DNA, 22 bp, Homo sapiens
tgggacagtgtgccttgctcct

SEQ ID NO: 7705304 - DNA, 22 bp, Homo sapiens
tgggacagtgtgccttgctcct

SEQ ID NO: 7705305 - DNA, 22 bp, Homo sapiens
tgggacagtgtgccttgctcct

SEQ ID NO: 7705306 - DNA, 22 bp, Homo sapiens
tgggacagttgtcctccactct

SEQ ID NO: 7705307 - DNA, 22 bp, Homo sapiens
tgggacagttgtcctccactct

SEQ ID NO: 7705308 - DNA, 22 bp, Homo sapiens
tgggacagttgtcctccactct

SEQ ID NO: 7705309 - DNA, 22 bp, Homo sapiens
tgggacagtgtgccttgctcct

SEQ ID NO: 7705310 - DNA, 22 bp, Homo sapiens
tgggacagttgtcctccactct

SEQ ID NO: 7705311 - DNA, 22 bp, Homo sapiens
tgggacagttgtcctccactct

SEQ ID NO: 7705312 - DNA, 22 bp, Homo sapiens
tgggacagttgtcctccactct

SEQ ID NO: 7705313 - DNA, 22 bp, Homo sapiens
tgggacagttgtcctccactct

SEQ ID NO: 7705314 - DNA, 22 bp, Homo sapiens
tgggacagttgtcctccactct

SEQ ID NO: 7705315 - DNA, 22 bp, Homo sapiens
tgggacagttgtcctccactct

SEQ ID NO: 7705316 - DNA, 22 bp, Homo sapiens
tgggacagttgtcctccactct

SEQ ID NO: 7705317 - DNA, 22 bp, Homo sapiens
tgggacatgcttggaatctaga

SEQ ID NO: 7705318 - DNA, 22 bp, Homo sapiens
tgggaccaagtcatttctttag

SEQ ID NO: 7705319 - DNA, 22 bp, Homo sapiens
tgggacatctgtgaagctgaat

SEQ ID NO: 7705320 - DNA, 22 bp, Homo sapiens
tgggaccaagtcatttctttag

SEQ ID NO: 7705321 - DNA, 22 bp, Homo sapiens
tgggaccacactttgaacaaca

SEQ ID NO: 7705322 - DNA, 22 bp, Homo sapiens
tgggaccagataaagggaggtc

SEQ ID NO: 7705323 - DNA, 22 bp, Homo sapiens
tgggaccagataaagggaggtc

SEQ ID NO: 7705324 - DNA, 22 bp, Homo sapiens
tgggacagtgaccccagaggtc

SEQ ID NO: 7705325 - DNA, 22 bp, Homo sapiens
tgggacagtgaccccagaggtc

SEQ ID NO: 7705326 - DNA, 22 bp, Homo sapiens
tgggacagtgaccccagaggtc

SEQ ID NO: 7705327 - DNA, 22 bp, Homo sapiens
tgggacagtgaccccagaggtc

SEQ ID NO: 7705328 - DNA, 21 bp, Homo sapiens
tgggacagtgatggctcctcc

SEQ ID NO: 7705329 - DNA, 21 bp, Homo sapiens
tgggacagtgatggctcctcc

SEQ ID NO: 7705330 - DNA, 21 bp, Homo sapiens
tgggacagtgatggctcctcc

SEQ ID NO: 7705331 - DNA, 22 bp, Homo sapiens
tgggacagtgaccccagaggtc

SEQ ID NO: 7705332 - DNA, 22 bp, Homo sapiens
tgggacagtgaccccagaggtc

SEQ ID NO: 7705333 - DNA, 21 bp, Homo sapiens
tgggacagtgatggctcctcc

SEQ ID NO: 7705334 - DNA, 21 bp, Homo sapiens
tgggacagtgatggctcctcc

SEQ ID NO: 7705335 - DNA, 21 bp, Homo sapiens
tgggacagtgatggctcctcc

SEQ ID NO: 7705336 - DNA, 21 bp, Homo sapiens
tgggacagtgatggctcctcc

SEQ ID NO: 7705337 - DNA, 21 bp, Homo sapiens
tgggacagtgatggctcctcc

SEQ ID NO: 7705338 - DNA, 21 bp, Homo sapiens
tgggacagtgatggctcctcc

SEQ ID NO: 7705339 - DNA, 22 bp, Homo sapiens
tgggacagtgtgccttgctcct

SEQ ID NO: 7705340 - DNA, 22 bp, Homo sapiens
tgggacagtgtgccttgctcct

SEQ ID NO: 7705341 - DNA, 22 bp, Homo sapiens
tgggacagtgtgccttgctcct

SEQ ID NO: 7705342 - DNA, 22 bp, Homo sapiens
tgggacagtgtgccttgctcct

SEQ ID NO: 7705343 - DNA, 22 bp, Homo sapiens
tgggacagtgtgccttgctcct

SEQ ID NO: 7705344 - DNA, 22 bp, Homo sapiens
tgggaagatgataattcacagt

SEQ ID NO: 7705345 - DNA, 22 bp, Homo sapiens
tgggaagatgataattcacagt

SEQ ID NO: 7705346 - DNA, 22 bp, Homo sapiens
tgggaagatgataattcacagt

SEQ ID NO: 7705347 - DNA, 23 bp, Homo sapiens
tgggaagatatgtatgttcaagg

SEQ ID NO: 7705348 - DNA, 22 bp, Homo sapiens
tgggaagatgaggtgccatggg

SEQ ID NO: 7705349 - DNA, 22 bp, Homo sapiens
tgggaagatgaggtgccatggg

SEQ ID NO: 7705350 - DNA, 22 bp, Homo sapiens
tgggaagatgaggtgccatggg

SEQ ID NO: 7705351 - DNA, 22 bp, Homo sapiens
tgggaagatgaggtgccatggg

SEQ ID NO: 7705352 - DNA, 22 bp, Homo sapiens
tgggaagatggagtgacaggca

SEQ ID NO: 7705353 - DNA, 22 bp, Homo sapiens
tgggaagatggagtgacaggca

SEQ ID NO: 7705354 - DNA, 22 bp, Homo sapiens
tgggaagatggagtgacaggca

SEQ ID NO: 7705355 - DNA, 22 bp, Homo sapiens
tgggaagatggagtgacaggca

SEQ ID NO: 7705356 - DNA, 22 bp, Homo sapiens
tgggaagatgataattcacagt

SEQ ID NO: 7705357 - DNA, 22 bp, Homo sapiens
tgggaagcattaatgatagggg

SEQ ID NO: 7705358 - DNA, 22 bp, Homo sapiens
tgggaagatggagtgacaggca

SEQ ID NO: 7705359 - DNA, 22 bp, Homo sapiens
tgggaagatggagtgacaggca

SEQ ID NO: 7705360 - DNA, 22 bp, Homo sapiens
tgggaagatggagtgacaggca

SEQ ID NO: 7705361 - DNA, 22 bp, Homo sapiens
tgggaagatggagtgacaggca

SEQ ID NO: 7705362 - DNA, 22 bp, Homo sapiens
tgggaagatatgagtgaccaac

SEQ ID NO: 7705363 - DNA, 22 bp, Homo sapiens
tgggaagatatgagtgaccaac

SEQ ID NO: 7705364 - DNA, 22 bp, Homo sapiens
tgggaagatatgagtgaccaac

SEQ ID NO: 7705365 - DNA, 22 bp, Homo sapiens
tgggaagatatgagtgaccaac

SEQ ID NO: 7705366 - DNA, 22 bp, Homo sapiens
tgggaagatgaggtgccatggg

SEQ ID NO: 7705367 - DNA, 22 bp, Homo sapiens
tgggaagatgaggtgccatggg

SEQ ID NO: 7705368 - DNA, 23 bp, Homo sapiens
tgggaagatatgtatgttcaagg

SEQ ID NO: 7705369 - DNA, 23 bp, Homo sapiens
tgggaagatatgtatgttcaagg

SEQ ID NO: 7705370 - DNA, 23 bp, Homo sapiens
tgggaagatatgtatgttcaagg

SEQ ID NO: 7705371 - DNA, 23 bp, Homo sapiens
tgggaagatatgtatgttcaagg

SEQ ID NO: 7705372 - DNA, 22 bp, Homo sapiens
tgggaagatatgagtgaccaac

SEQ ID NO: 7705373 - DNA, 22 bp, Homo sapiens
tgggaagatatgagtgaccaac

SEQ ID NO: 7705374 - DNA, 22 bp, Homo sapiens
tgggaagagttagagacagctg

SEQ ID NO: 7705375 - DNA, 22 bp, Homo sapiens
tgggaagagttagagacagctg

SEQ ID NO: 7705376 - DNA, 22 bp, Homo sapiens
tgggaagagttagagacagctg

SEQ ID NO: 7705377 - DNA, 22 bp, Homo sapiens
tgggaagagttagagacagctg

SEQ ID NO: 7705378 - DNA, 22 bp, Homo sapiens
tgggaagagttagagacagctg

SEQ ID NO: 7705379 - DNA, 22 bp, Homo sapiens
tgggaagagttagagacagctg

SEQ ID NO: 7705380 - DNA, 22 bp, Homo sapiens
tgggaagaggggtataaagaag

SEQ ID NO: 7705381 - DNA, 22 bp, Homo sapiens
tgggaagaggggtataaagaag

SEQ ID NO: 7705382 - DNA, 22 bp, Homo sapiens
tgggaagaggggtataaagaag

SEQ ID NO: 7705383 - DNA, 22 bp, Homo sapiens
tgggaagaggggtataaagaag

SEQ ID NO: 7705384 - DNA, 22 bp, Homo sapiens
tgggaagaggggtataaagaag

SEQ ID NO: 7705385 - DNA, 22 bp, Homo sapiens
tgggaagaggggtataaagaag

SEQ ID NO: 7705386 - DNA, 22 bp, Homo sapiens
tgggaagaggcgggaggctgtt

SEQ ID NO: 7705387 - DNA, 22 bp, Homo sapiens
tgggaagaggcgggaggctgtt

SEQ ID NO: 7705388 - DNA, 22 bp, Homo sapiens
tgggaagctactcatgcaggca

SEQ ID NO: 7705389 - DNA, 22 bp, Homo sapiens
tgggaaggcgtggaagtagaag

SEQ ID NO: 7705390 - DNA, 22 bp, Homo sapiens
tgggaaggcgtggaagtagaag

SEQ ID NO: 7705391 - DNA, 22 bp, Homo sapiens
tgggaaggcgtggaagtagaag

SEQ ID NO: 7705392 - DNA, 22 bp, Homo sapiens
tgggaagggagagtgtcctgga

SEQ ID NO: 7705393 - DNA, 22 bp, Homo sapiens
tgggaagggagagtgtcctgga

SEQ ID NO: 7705394 - DNA, 22 bp, Homo sapiens
tgggaagggagagtgtcctgga

SEQ ID NO: 7705395 - DNA, 22 bp, Homo sapiens
tgggaagggagagtgtcctgga

SEQ ID NO: 7705396 - DNA, 22 bp, Homo sapiens
tgggaaggcgtggaagtagaag

SEQ ID NO: 7705397 - DNA, 22 bp, Homo sapiens
tgggaagggagagtgtcctgga

SEQ ID NO: 7705398 - DNA, 22 bp, Homo sapiens
tgggaaggcgtggaagtagaag

SEQ ID NO: 7705399 - DNA, 22 bp, Homo sapiens
tgggaagggccgatggagcctc

SEQ ID NO: 7705400 - DNA, 22 bp, Homo sapiens
tgggaagggccgatggagcctc

SEQ ID NO: 7705401 - DNA, 22 bp, Homo sapiens
tgggaagggccgatggagcctc

SEQ ID NO: 7705402 - DNA, 22 bp, Homo sapiens
tgggaagggccgatggagcctc

SEQ ID NO: 7705403 - DNA, 22 bp, Homo sapiens
tgggaagggccgatggagcctc

SEQ ID NO: 7705404 - DNA, 22 bp, Homo sapiens
tgggaagggccgatggagcctc

SEQ ID NO: 7705405 - DNA, 22 bp, Homo sapiens
tgggaagggccgatggagcctc

SEQ ID NO: 7705406 - DNA, 22 bp, Homo sapiens
tgggaagggccgatggagcctc

SEQ ID NO: 7705407 - DNA, 22 bp, Homo sapiens
tgggaagggccgatggagcctc

SEQ ID NO: 7705408 - DNA, 22 bp, Homo sapiens
tgggaagggccgatggagcctc

SEQ ID NO: 7705409 - DNA, 22 bp, Homo sapiens
tgggaagggagtttcttggagt

SEQ ID NO: 7705410 - DNA, 22 bp, Homo sapiens
tgggaagggccgatggagcctc

SEQ ID NO: 7705411 - DNA, 22 bp, Homo sapiens
tgggaagggagtttcttggagt

SEQ ID NO: 7705412 - DNA, 22 bp, Homo sapiens
tgggaagggagtttcttggagt

SEQ ID NO: 7705413 - DNA, 22 bp, Homo sapiens
tgggaagggagtttcttggagt

SEQ ID NO: 7705414 - DNA, 22 bp, Homo sapiens
tgggaagggagtttcttggagt

SEQ ID NO: 7705415 - DNA, 22 bp, Homo sapiens
tgggaagggagtttcttggagt

SEQ ID NO: 7705416 - DNA, 22 bp, Homo sapiens
tgggaagggagtttcttggagt

SEQ ID NO: 7705417 - DNA, 22 bp, Homo sapiens
tgggaagggagagtgtcctgga

SEQ ID NO: 7705418 - DNA, 22 bp, Homo sapiens
tgggaagggtcaacagctggaa

SEQ ID NO: 7705419 - DNA, 22 bp, Homo sapiens
tgggaagggtcaacagctggaa

SEQ ID NO: 7705420 - DNA, 22 bp, Homo sapiens
tgggaaggggagctggaaagga

SEQ ID NO: 7705421 - DNA, 22 bp, Homo sapiens
tgggaagggtcaacagctggaa

SEQ ID NO: 7705422 - DNA, 22 bp, Homo sapiens
tgggaaggggagctggaaagga

SEQ ID NO: 7705423 - DNA, 22 bp, Homo sapiens
tgggaaggggagctggaaagga

SEQ ID NO: 7705424 - DNA, 22 bp, Homo sapiens
tgggaagggtcaacagctggaa

SEQ ID NO: 7705425 - DNA, 22 bp, Homo sapiens
tgggaagggtcaacagctggaa

SEQ ID NO: 7705426 - DNA, 22 bp, Homo sapiens
tgggaagggtcaacagctggaa

SEQ ID NO: 7705427 - DNA, 22 bp, Homo sapiens
tgggaagggtcaacagctggaa

SEQ ID NO: 7705428 - DNA, 22 bp, Homo sapiens
tgggaagggtcaacagctggaa

SEQ ID NO: 7705429 - DNA, 22 bp, Homo sapiens
tgggaagggtcaacagctggaa

SEQ ID NO: 7705430 - DNA, 22 bp, Homo sapiens
tgggaagggtcaacagctggaa

SEQ ID NO: 7705431 - DNA, 22 bp, Homo sapiens
tgggaagggtcaacagctggaa

SEQ ID NO: 7705432 - DNA, 22 bp, Homo sapiens
tgggaagggcctgcccttcctc

SEQ ID NO: 7705433 - DNA, 22 bp, Homo sapiens
tgggaagggcctgcccttcctc

SEQ ID NO: 7705434 - DNA, 22 bp, Homo sapiens
tgggaagggcctgcccttcctc

SEQ ID NO: 7705435 - DNA, 22 bp, Homo sapiens
tgggaagggcctgcccttcctc

SEQ ID NO: 7705436 - DNA, 22 bp, Homo sapiens
tgggaaggggagctggaaagga

SEQ ID NO: 7705437 - DNA, 22 bp, Homo sapiens
tgggaagggcctgcccttcctc

SEQ ID NO: 7705438 - DNA, 22 bp, Homo sapiens
tgggaaggggagctggaaagga

SEQ ID NO: 7705439 - DNA, 22 bp, Homo sapiens
tgggaagggcctgcccttcctc

SEQ ID NO: 7705440 - DNA, 22 bp, Homo sapiens
tgggaaggggagctggaaagga

SEQ ID NO: 7705441 - DNA, 22 bp, Homo sapiens
tgggaaggggagctggaaagga

SEQ ID NO: 7705442 - DNA, 22 bp, Homo sapiens
tgggaaggggagctggaaagga

SEQ ID NO: 7705443 - DNA, 22 bp, Homo sapiens
tgggaaggggagctggaaagga

SEQ ID NO: 7705444 - DNA, 22 bp, Homo sapiens
tgggaaggggagctggaaagga

SEQ ID NO: 7705445 - DNA, 22 bp, Homo sapiens
tgggaaggggagctggaaagga

SEQ ID NO: 7705446 - DNA, 22 bp, Homo sapiens
tgggaaggggagctggaaagga

SEQ ID NO: 7705447 - DNA, 22 bp, Homo sapiens
tgggaaggggagctggaaagga

SEQ ID NO: 7705448 - DNA, 22 bp, Homo sapiens
tgggaaggggagctggaaagga

SEQ ID NO: 7705449 - DNA, 22 bp, Homo sapiens
tgggaaggggagctggaaagga

SEQ ID NO: 7705450 - DNA, 22 bp, Homo sapiens
tgggaaggggagctggaaagga

SEQ ID NO: 7705451 - DNA, 22 bp, Homo sapiens
tgggaaggggagctggaaagga

SEQ ID NO: 7705452 - DNA, 22 bp, Homo sapiens
tgggaagggtctgaatctgaga

SEQ ID NO: 7705453 - DNA, 22 bp, Homo sapiens
tgggaagggtctgaatctgaga

SEQ ID NO: 7705454 - DNA, 22 bp, Homo sapiens
tgggaagggtctgaatctgaga

SEQ ID NO: 7705455 - DNA, 22 bp, Homo sapiens
tgggaagggtctgaatctgaga

SEQ ID NO: 7705456 - DNA, 22 bp, Homo sapiens
tgggaagggtctgaatctgaga

SEQ ID NO: 7705457 - DNA, 22 bp, Homo sapiens
tgggaagggtctgaatctgaga

SEQ ID NO: 7705458 - DNA, 22 bp, Homo sapiens
tgggaaggtacacgggaaagag

SEQ ID NO: 7705459 - DNA, 22 bp, Homo sapiens
tgggaaggtacacgggaaagag

SEQ ID NO: 7705460 - DNA, 22 bp, Homo sapiens
tgggaaggtacacgggaaagag

SEQ ID NO: 7705461 - DNA, 22 bp, Homo sapiens
tgggaagggtcaacagctggaa

SEQ ID NO: 7705462 - DNA, 22 bp, Homo sapiens
tgggaagggtcaacagctggaa

SEQ ID NO: 7705463 - DNA, 22 bp, Homo sapiens
tgggaagggtcaacagctggaa

SEQ ID NO: 7705464 - DNA, 22 bp, Homo sapiens
tgggaagggtcaacagctggaa

SEQ ID NO: 7705465 - DNA, 22 bp, Homo sapiens
tgggaagggtcagtttcttcat

SEQ ID NO: 7705466 - DNA, 22 bp, Homo sapiens
tgggaagggtcagtttcttcat

SEQ ID NO: 7705467 - DNA, 22 bp, Homo sapiens
tgggaagggtcagtttcttcat

SEQ ID NO: 7705468 - DNA, 22 bp, Homo sapiens
tgggaagggtcagtttcttcat

SEQ ID NO: 7705469 - DNA, 22 bp, Homo sapiens
tgggaaggtacacgggaaagag

SEQ ID NO: 7705470 - DNA, 22 bp, Homo sapiens
tgggaaggtacacgggaaagag

SEQ ID NO: 7705471 - DNA, 22 bp, Homo sapiens
tgggaaggtacacgggaaagag

SEQ ID NO: 7705472 - DNA, 22 bp, Homo sapiens
tgggaaggtacacgggaaagag

SEQ ID NO: 7705473 - DNA, 22 bp, Homo sapiens
tgggaaggtacacgggaaagag

SEQ ID NO: 7705474 - DNA, 22 bp, Homo sapiens
tgggaaggtacacgggaaagag

SEQ ID NO: 7705475 - DNA, 22 bp, Homo sapiens
tgggaaggtacacgggaaagag

SEQ ID NO: 7705476 - DNA, 22 bp, Homo sapiens
tgggaaggtacacgggaaagag

SEQ ID NO: 7705477 - DNA, 22 bp, Homo sapiens
tgggaaggtacacgggaaagag

SEQ ID NO: 7705478 - DNA, 22 bp, Homo sapiens
tgggaaggtacacgggaaagag

SEQ ID NO: 7705479 - DNA, 22 bp, Homo sapiens
tgggaaggtacacgggaaagag

SEQ ID NO: 7705480 - DNA, 22 bp, Homo sapiens
tgggaaggtgtagaaagaacaa

SEQ ID NO: 7705481 - DNA, 22 bp, Homo sapiens
tgggaaggtgtagaaagaacaa

SEQ ID NO: 7705482 - DNA, 22 bp, Homo sapiens
tgggaaggtgtagaaagaacaa

SEQ ID NO: 7705483 - DNA, 22 bp, Homo sapiens
tgggaaggtgtagaaagaacaa

SEQ ID NO: 7705484 - DNA, 22 bp, Homo sapiens
tgggaaggtgtagaaagaacaa

SEQ ID NO: 7705485 - DNA, 22 bp, Homo sapiens
tgggaaggtgtagaaagaacaa

SEQ ID NO: 7705486 - DNA, 22 bp, Homo sapiens
tgggaaggtgattttccaaaag

SEQ ID NO: 7705487 - DNA, 22 bp, Homo sapiens
tgggaaggtgattttccaaaag

SEQ ID NO: 7705488 - DNA, 22 bp, Homo sapiens
tgggaaggtgattttccaaaag

SEQ ID NO: 7705489 - DNA, 22 bp, Homo sapiens
tgggaaggtgtagaaagaacaa

SEQ ID NO: 7705490 - DNA, 22 bp, Homo sapiens
tgggagagtaaccaattccttc

SEQ ID NO: 7705491 - DNA, 22 bp, Homo sapiens
tgggagagtaaccaattccttc

SEQ ID NO: 7705492 - DNA, 21 bp, Homo sapiens
tgggagagggctcagctaccc

SEQ ID NO: 7705493 - DNA, 21 bp, Homo sapiens
tgggagagggctcagctaccc

SEQ ID NO: 7705494 - DNA, 22 bp, Homo sapiens
tgggagagtaaccaattccttc

SEQ ID NO: 7705495 - DNA, 22 bp, Homo sapiens
tgggagagtctaaaaccgaggt

SEQ ID NO: 7705496 - DNA, 21 bp, Homo sapiens
tgggagagggctcagctaccc

SEQ ID NO: 7705497 - DNA, 21 bp, Homo sapiens
tgggagagggctcagctaccc

SEQ ID NO: 7705498 - DNA, 22 bp, Homo sapiens
tgggagaggctgccatcttgca

SEQ ID NO: 7705499 - DNA, 21 bp, Homo sapiens
tgggagagggctcagctaccc

SEQ ID NO: 7705500 - DNA, 21 bp, Homo sapiens
tgggagagggctcagctaccc

SEQ ID NO: 7705501 - DNA, 21 bp, Homo sapiens
tgggagagggctcagctaccc

SEQ ID NO: 7705502 - DNA, 21 bp, Homo sapiens
tgggagagggctcagctaccc

SEQ ID NO: 7705503 - DNA, 21 bp, Homo sapiens
tgggagagggctcagctaccc

SEQ ID NO: 7705504 - DNA, 21 bp, Homo sapiens
tgggagagggctcagctaccc

SEQ ID NO: 7705505 - DNA, 19 bp, Homo sapiens
tgggagaggcaacagagta

SEQ ID NO: 7705506 - DNA, 19 bp, Homo sapiens
tgggagaggcaacagagta

SEQ ID NO: 7705507 - DNA, 19 bp, Homo sapiens
tgggagaggcaacagagta

SEQ ID NO: 7705508 - DNA, 22 bp, Homo sapiens
tgggagaggctgccatcttgca

SEQ ID NO: 7705509 - DNA, 22 bp, Homo sapiens
tgggagaggctgccatcttgca

SEQ ID NO: 7705510 - DNA, 22 bp, Homo sapiens
tgggagaggctgccatcttgca

SEQ ID NO: 7705511 - DNA, 22 bp, Homo sapiens
tgggagagcttcatgccttcag

SEQ ID NO: 7705512 - DNA, 19 bp, Homo sapiens
tgggagaggcaacagagta

SEQ ID NO: 7705513 - DNA, 19 bp, Homo sapiens
tgggagaggcaacagagta

SEQ ID NO: 7705514 - DNA, 19 bp, Homo sapiens
tgggagaggcaacagagta

SEQ ID NO: 7705515 - DNA, 19 bp, Homo sapiens
tgggagaggcaacagagta

SEQ ID NO: 7705516 - DNA, 22 bp, Homo sapiens
tgggagagcttcatgccttcag

SEQ ID NO: 7705517 - DNA, 19 bp, Homo sapiens
tgggagaggcaacagagta

SEQ ID NO: 7705518 - DNA, 19 bp, Homo sapiens
tgggagaggcaacagagta

SEQ ID NO: 7705519 - DNA, 19 bp, Homo sapiens
tgggagaggcaacagagta

SEQ ID NO: 7705520 - DNA, 22 bp, Homo sapiens
tgggagcaaatgactgggagat

SEQ ID NO: 7705521 - DNA, 22 bp, Homo sapiens
tgggagcaaatgactgggagat

SEQ ID NO: 7705522 - DNA, 22 bp, Homo sapiens
tgggagcaaatgactgggagat

SEQ ID NO: 7705523 - DNA, 22 bp, Homo sapiens
tgggagatggttctgagacttt

SEQ ID NO: 7705524 - DNA, 20 bp, Homo sapiens
tgggagatgatctccttgct

SEQ ID NO: 7705525 - DNA, 22 bp, Homo sapiens
tgggagcaaatgactgggagat

SEQ ID NO: 7705526 - DNA, 22 bp, Homo sapiens
tgggagcaaatgactgggagat

SEQ ID NO: 7705527 - DNA, 22 bp, Homo sapiens
tgggagcaaatgactgggagat

SEQ ID NO: 7705528 - DNA, 22 bp, Homo sapiens
tgggagcaaatgactgggagat

SEQ ID NO: 7705529 - DNA, 22 bp, Homo sapiens
tgggagcaagctacttagggaa

SEQ ID NO: 7705530 - DNA, 22 bp, Homo sapiens
tgggagcaagctacttagggaa

SEQ ID NO: 7705531 - DNA, 22 bp, Homo sapiens
tgggagcaagctacttagggaa

SEQ ID NO: 7705532 - DNA, 22 bp, Homo sapiens
tgggagcaagctacttagggaa

SEQ ID NO: 7705533 - DNA, 22 bp, Homo sapiens
tgggagcaagctacttagggaa

SEQ ID NO: 7705534 - DNA, 22 bp, Homo sapiens
tgggagagtttgtttagagtga

SEQ ID NO: 7705535 - DNA, 22 bp, Homo sapiens
tgggagagtttgtttagagtga

SEQ ID NO: 7705536 - DNA, 22 bp, Homo sapiens
tgggagatattgctgtggctgt

SEQ ID NO: 7705537 - DNA, 22 bp, Homo sapiens
tgggagatatccggcctccgtg

SEQ ID NO: 7705538 - DNA, 22 bp, Homo sapiens
tgggagagtttgtttagagtga

SEQ ID NO: 7705539 - DNA, 22 bp, Homo sapiens
tgggagagtgctcaatgtgcaa

SEQ ID NO: 7705540 - DNA, 22 bp, Homo sapiens
tgggagagtgctcaatgtgcaa

SEQ ID NO: 7705541 - DNA, 22 bp, Homo sapiens
tgggagagtctaaaaccgaggt

SEQ ID NO: 7705542 - DNA, 22 bp, Homo sapiens
tgggagagtctaaaaccgaggt

SEQ ID NO: 7705543 - DNA, 22 bp, Homo sapiens
tgggagagtctaaaaccgaggt

SEQ ID NO: 7705544 - DNA, 22 bp, Homo sapiens
tgggagagtctaaaaccgaggt

SEQ ID NO: 7705545 - DNA, 22 bp, Homo sapiens
tgggagagtgctcaatgtgcaa

SEQ ID NO: 7705546 - DNA, 22 bp, Homo sapiens
tgggagagtgctcaatgtgcaa

SEQ ID NO: 7705547 - DNA, 21 bp, Homo sapiens
tgggagaccgccttcctggga

SEQ ID NO: 7705548 - DNA, 22 bp, Homo sapiens
tgggagacactggtgggagctt

SEQ ID NO: 7705549 - DNA, 21 bp, Homo sapiens
tgggagaccgccttcctggga

SEQ ID NO: 7705550 - DNA, 22 bp, Homo sapiens
tgggagacactggtgggagctt

SEQ ID NO: 7705551 - DNA, 22 bp, Homo sapiens
tgggagacactggtgggagctt

SEQ ID NO: 7705552 - DNA, 22 bp, Homo sapiens
tgggagacactggtgggagctt

SEQ ID NO: 7705553 - DNA, 21 bp, Homo sapiens
tgggagacacagccttgagct

SEQ ID NO: 7705554 - DNA, 21 bp, Homo sapiens
tgggagacacagccttgagct

SEQ ID NO: 7705555 - DNA, 22 bp, Homo sapiens
tgggagacactggtgggagctt

SEQ ID NO: 7705556 - DNA, 22 bp, Homo sapiens
tgggagacactggtgggagctt

SEQ ID NO: 7705557 - DNA, 22 bp, Homo sapiens
tgggagagcttcatgccttcag

SEQ ID NO: 7705558 - DNA, 22 bp, Homo sapiens
tgggagagcttcatgccttcag

SEQ ID NO: 7705559 - DNA, 22 bp, Homo sapiens
tgggagagaataatcaataggt

SEQ ID NO: 7705560 - DNA, 22 bp, Homo sapiens
tgggagagcttcatgccttcag

SEQ ID NO: 7705561 - DNA, 22 bp, Homo sapiens
tgggagactccagaactgatcc

SEQ ID NO: 7705562 - DNA, 22 bp, Homo sapiens
tgggagactccagaactgatcc

SEQ ID NO: 7705563 - DNA, 23 bp, Homo sapiens
tgggagacttttcattttgttct

SEQ ID NO: 7705564 - DNA, 21 bp, Homo sapiens
tgggagaccgccttcctggga

SEQ ID NO: 7705565 - DNA, 23 bp, Homo sapiens
tgggagacttttcattttgttct

SEQ ID NO: 7705566 - DNA, 22 bp, Homo sapiens
tgggagagaataatcaataggt

SEQ ID NO: 7705567 - DNA, 22 bp, Homo sapiens
tgggagaagcagtgggacagta

SEQ ID NO: 7705568 - DNA, 22 bp, Homo sapiens
tgggagaagcagtgggacagta

SEQ ID NO: 7705569 - DNA, 22 bp, Homo sapiens
tgggagaagcagtgggacagta

SEQ ID NO: 7705570 - DNA, 22 bp, Homo sapiens
tgggagaagcagtgggacagta

SEQ ID NO: 7705571 - DNA, 22 bp, Homo sapiens
tgggagaagcatggggtgcaga

SEQ ID NO: 7705572 - DNA, 22 bp, Homo sapiens
tgggagaagcatggggtgcaga

SEQ ID NO: 7705573 - DNA, 22 bp, Homo sapiens
tgggagaagcatggggtgcaga

SEQ ID NO: 7705574 - DNA, 22 bp, Homo sapiens
tgggagaagcatggggtgcaga

SEQ ID NO: 7705575 - DNA, 22 bp, Homo sapiens
tgggagaagcagtgggacagta

SEQ ID NO: 7705576 - DNA, 22 bp, Homo sapiens
tgggagaagcagtgggacagta

SEQ ID NO: 7705577 - DNA, 22 bp, Homo sapiens
tgggagaatatatttaaaactt

SEQ ID NO: 7705578 - DNA, 22 bp, Homo sapiens
tgggagaatatatttaaaactt

SEQ ID NO: 7705579 - DNA, 22 bp, Homo sapiens
tgggagaagcatggggtgcaga

SEQ ID NO: 7705580 - DNA, 22 bp, Homo sapiens
tgggagaagcatggggtgcaga

SEQ ID NO: 7705581 - DNA, 22 bp, Homo sapiens
tgggagaagcatggggtgcaga

SEQ ID NO: 7705582 - DNA, 22 bp, Homo sapiens
tgggagaatatatttaaaactt

SEQ ID NO: 7705583 - DNA, 22 bp, Homo sapiens
tgggagaatcttgctctgctac

SEQ ID NO: 7705584 - DNA, 22 bp, Homo sapiens
tgggagaatcttgctctgctac

SEQ ID NO: 7705585 - DNA, 22 bp, Homo sapiens
tgggagaatcttgctctgctac

SEQ ID NO: 7705586 - DNA, 22 bp, Homo sapiens
tgggagaatcttgctctgctac

SEQ ID NO: 7705587 - DNA, 22 bp, Homo sapiens
tgggagaacccagggtcaggct

SEQ ID NO: 7705588 - DNA, 22 bp, Homo sapiens
tgggagaacccagggtcaggct

SEQ ID NO: 7705589 - DNA, 22 bp, Homo sapiens
tgggagaacccagggtcaggct

SEQ ID NO: 7705590 - DNA, 22 bp, Homo sapiens
tgggagaacccagggtcaggct

SEQ ID NO: 7705591 - DNA, 22 bp, Homo sapiens
tgggagaacccagggtcaggct

SEQ ID NO: 7705592 - DNA, 22 bp, Homo sapiens
tgggagaagacgtactttagac

SEQ ID NO: 7705593 - DNA, 22 bp, Homo sapiens
tgggagaagacgtactttagac

SEQ ID NO: 7705594 - DNA, 22 bp, Homo sapiens
tgggagaagacgtactttagac

SEQ ID NO: 7705595 - DNA, 20 bp, Homo sapiens
tgggagaagaacactggaac

SEQ ID NO: 7705596 - DNA, 20 bp, Homo sapiens
tgggagaagaacactggaac

SEQ ID NO: 7705597 - DNA, 20 bp, Homo sapiens
tgggagaagaacactggaac

SEQ ID NO: 7705598 - DNA, 22 bp, Homo sapiens
tgggagaagagaaattactgcc

SEQ ID NO: 7705599 - DNA, 22 bp, Homo sapiens
tgggagaagagaaattactgcc

SEQ ID NO: 7705600 - DNA, 22 bp, Homo sapiens
tgggagaagagaaattactgcc

SEQ ID NO: 7705601 - DNA, 22 bp, Homo sapiens
tgggagaagcagcagccaagtg

SEQ ID NO: 7705602 - DNA, 22 bp, Homo sapiens
tgggagaagcagcagccaagtg

SEQ ID NO: 7705603 - DNA, 22 bp, Homo sapiens
tgggagaagcagcagccaagtg

SEQ ID NO: 7705604 - DNA, 22 bp, Homo sapiens
tgggagaagcagcagccaagtg

SEQ ID NO: 7705605 - DNA, 22 bp, Homo sapiens
tgggagaagcagcagccaagtg

SEQ ID NO: 7705606 - DNA, 22 bp, Homo sapiens
tgggagaagcagtgggacagta

SEQ ID NO: 7705607 - DNA, 22 bp, Homo sapiens
tgggagaagcagtgggacagta

SEQ ID NO: 7705608 - DNA, 22 bp, Homo sapiens
tgggagaagcagtgggacagta

SEQ ID NO: 7705609 - DNA, 22 bp, Homo sapiens
tgggagaagcagtgggacagta

SEQ ID NO: 7705610 - DNA, 22 bp, Homo sapiens
tgggagaagcagtgggacagta

SEQ ID NO: 7705611 - DNA, 22 bp, Homo sapiens
tgggagaagcagcagccaagtg

SEQ ID NO: 7705612 - DNA, 22 bp, Homo sapiens
tgggagaagcagcagccaagtg

SEQ ID NO: 7705613 - DNA, 22 bp, Homo sapiens
tgggagaagcagcagccaagtg

SEQ ID NO: 7705614 - DNA, 22 bp, Homo sapiens
tgggactgtggtcaaggacaaa

SEQ ID NO: 7705615 - DNA, 22 bp, Homo sapiens
tgggacttcaatgcaatgaggt

SEQ ID NO: 7705616 - DNA, 22 bp, Homo sapiens
tgggagaaactgtctctcccac

SEQ ID NO: 7705617 - DNA, 22 bp, Homo sapiens
tgggacttgcctcgagggctgc

SEQ ID NO: 7705618 - DNA, 22 bp, Homo sapiens
tgggagaaactgtctctcccac

SEQ ID NO: 7705619 - DNA, 22 bp, Homo sapiens
tgggagaaactgtctctcccac

SEQ ID NO: 7705620 - DNA, 22 bp, Homo sapiens
tgggagaaactgtctctcccac

SEQ ID NO: 7705621 - DNA, 22 bp, Homo sapiens
tgggacttgtgtggcagtattt

SEQ ID NO: 7705622 - DNA, 22 bp, Homo sapiens
tgggagaacccagggtcaggct

SEQ ID NO: 7705623 - DNA, 22 bp, Homo sapiens
tgggagaacccagggtcaggct

SEQ ID NO: 7705624 - DNA, 22 bp, Homo sapiens
tgggagaacccagggtcaggct

SEQ ID NO: 7705625 - DNA, 22 bp, Homo sapiens
tgggagaacccagggtcaggct

SEQ ID NO: 7705626 - DNA, 22 bp, Homo sapiens
tgggagaacccagggtcaggct

SEQ ID NO: 7705627 - DNA, 22 bp, Homo sapiens
tgggagaacactgctctggatg

SEQ ID NO: 7705628 - DNA, 22 bp, Homo sapiens
tgggagaaagaaccctgagtga

SEQ ID NO: 7705629 - DNA, 22 bp, Homo sapiens
tgggagaacactgctctggatg

SEQ ID NO: 7705630 - DNA, 22 bp, Homo sapiens
tgggagaacactgctctggatg

SEQ ID NO: 7705631 - DNA, 22 bp, Homo sapiens
tgggagaacactgctctggatg

SEQ ID NO: 7705632 - DNA, 22 bp, Homo sapiens
tgggagaaagaaccctgagtga

SEQ ID NO: 7705633 - DNA, 22 bp, Homo sapiens
tgggagaaagaaccctgagtga

SEQ ID NO: 7705634 - DNA, 22 bp, Homo sapiens
tgggagaaagaaccctgagtga

SEQ ID NO: 7705635 - DNA, 22 bp, Homo sapiens
tgggagaaagaaccctgagtga

SEQ ID NO: 7705636 - DNA, 22 bp, Homo sapiens
tgggaggagccctctgggaagg

SEQ ID NO: 7705637 - DNA, 22 bp, Homo sapiens
tgggaggagccctctgggaagg

SEQ ID NO: 7705638 - DNA, 22 bp, Homo sapiens
tgggaggagccctctgggaagg

SEQ ID NO: 7705639 - DNA, 22 bp, Homo sapiens
tgggaggagccctctgggaagg

SEQ ID NO: 7705640 - DNA, 22 bp, Homo sapiens
tgggaggatcgcttgagcccag

SEQ ID NO: 7705641 - DNA, 22 bp, Homo sapiens
tgggaggatcgcttgagcccag

SEQ ID NO: 7705642 - DNA, 22 bp, Homo sapiens
tgggaggatcgcttgagcccag

SEQ ID NO: 7705643 - DNA, 22 bp, Homo sapiens
tgggaggatcgcttgagcccag

SEQ ID NO: 7705644 - DNA, 22 bp, Homo sapiens
tgggaggagccctctgggaagg

SEQ ID NO: 7705645 - DNA, 22 bp, Homo sapiens
tgggaggagccctctgggaagg

SEQ ID NO: 7705646 - DNA, 22 bp, Homo sapiens
tgggaggagccctctgggaagg

SEQ ID NO: 7705647 - DNA, 22 bp, Homo sapiens
tgggaggatcgcttgagcccag

SEQ ID NO: 7705648 - DNA, 22 bp, Homo sapiens
tgggaggagccctctgggaagg

SEQ ID NO: 7705649 - DNA, 22 bp, Homo sapiens
tgggaggatcgcttgagcccag

SEQ ID NO: 7705650 - DNA, 22 bp, Homo sapiens
tgggaggatcgcttgagcccag

SEQ ID NO: 7705651 - DNA, 22 bp, Homo sapiens
tgggaggatcgcttgagcccag

SEQ ID NO: 7705652 - DNA, 22 bp, Homo sapiens
tgggaggatctcttgaggccag

SEQ ID NO: 7705653 - DNA, 22 bp, Homo sapiens
tgggaggatctcttgaggccag

SEQ ID NO: 7705654 - DNA, 22 bp, Homo sapiens
tgggaggatcgcttgagcccag

SEQ ID NO: 7705655 - DNA, 22 bp, Homo sapiens
tgggaggatcgcttgagcccag

SEQ ID NO: 7705656 - DNA, 22 bp, Homo sapiens
tgggaggcaggtaggtgatgat

SEQ ID NO: 7705657 - DNA, 22 bp, Homo sapiens
tgggaggcaggtaggtgatgat

SEQ ID NO: 7705658 - DNA, 22 bp, Homo sapiens
tgggaggcagaagttgactgga

SEQ ID NO: 7705659 - DNA, 22 bp, Homo sapiens
tgggaggcagaagttgactgga

SEQ ID NO: 7705660 - DNA, 22 bp, Homo sapiens
tgggaggcagaagttgactgga

SEQ ID NO: 7705661 - DNA, 22 bp, Homo sapiens
tgggaggcagaagttgactgga

SEQ ID NO: 7705662 - DNA, 22 bp, Homo sapiens
tgggaggcagaagttgactgga

SEQ ID NO: 7705663 - DNA, 22 bp, Homo sapiens
tgggaggcagaagttgactgga

SEQ ID NO: 7705664 - DNA, 22 bp, Homo sapiens
tgggaggcagaagttgactgga

SEQ ID NO: 7705665 - DNA, 22 bp, Homo sapiens
tgggaggcagaagttgactgga

SEQ ID NO: 7705666 - DNA, 22 bp, Homo sapiens
tgggaggcagaagttgactgga

SEQ ID NO: 7705667 - DNA, 22 bp, Homo sapiens
tgggaggcagaagttgactgga

SEQ ID NO: 7705668 - DNA, 22 bp, Homo sapiens
tgggaggatctcttgaggccag

SEQ ID NO: 7705669 - DNA, 22 bp, Homo sapiens
tgggaggcagaagttgactgga

SEQ ID NO: 7705670 - DNA, 22 bp, Homo sapiens
tgggaggatctcttgaggccag

SEQ ID NO: 7705671 - DNA, 22 bp, Homo sapiens
tgggaggatctcttgaggccag

SEQ ID NO: 7705672 - DNA, 22 bp, Homo sapiens
tgggaggatctcttgaggccag

SEQ ID NO: 7705673 - DNA, 22 bp, Homo sapiens
tgggaggatctcttgaggccag

SEQ ID NO: 7705674 - DNA, 22 bp, Homo sapiens
tgggaggatctcttgaggccag

SEQ ID NO: 7705675 - DNA, 22 bp, Homo sapiens
tgggaggatctcttgaggccag

SEQ ID NO: 7705676 - DNA, 22 bp, Homo sapiens
tgggaggatctcttgaggccag

SEQ ID NO: 7705677 - DNA, 22 bp, Homo sapiens
tgggaggatctcttgaggccag

SEQ ID NO: 7705678 - DNA, 22 bp, Homo sapiens
tgggaggacttgtgggcttcat

SEQ ID NO: 7705679 - DNA, 22 bp, Homo sapiens
tgggaggacttgtgggcttcat

SEQ ID NO: 7705680 - DNA, 22 bp, Homo sapiens
tgggaggacttgtgggcttcat

SEQ ID NO: 7705681 - DNA, 22 bp, Homo sapiens
tgggaggacttgtgggcttcat

SEQ ID NO: 7705682 - DNA, 22 bp, Homo sapiens
tgggaggacttgtgggcttcat

SEQ ID NO: 7705683 - DNA, 22 bp, Homo sapiens
tgggaggacttgtgggcttcat

SEQ ID NO: 7705684 - DNA, 22 bp, Homo sapiens
tgggaggaatgtcactgagcca

SEQ ID NO: 7705685 - DNA, 22 bp, Homo sapiens
tgggaggaatgtcactgagcca

SEQ ID NO: 7705686 - DNA, 22 bp, Homo sapiens
tgggaggaatgtcactgagcca

SEQ ID NO: 7705687 - DNA, 22 bp, Homo sapiens
tgggaggaatgtcactgagcca

SEQ ID NO: 7705688 - DNA, 22 bp, Homo sapiens
tgggaggaatgtcactgagcca

SEQ ID NO: 7705689 - DNA, 22 bp, Homo sapiens
tgggaggaatgtcactgagcca

SEQ ID NO: 7705690 - DNA, 22 bp, Homo sapiens
tgggaggaagtgctaatgggag

SEQ ID NO: 7705691 - DNA, 22 bp, Homo sapiens
tgggaggaagtgctaatgggag

SEQ ID NO: 7705692 - DNA, 20 bp, Homo sapiens
tgggagctggtgaggtctca

SEQ ID NO: 7705693 - DNA, 20 bp, Homo sapiens
tgggagctggtgaggtctca

SEQ ID NO: 7705694 - DNA, 20 bp, Homo sapiens
tgggagctggtgaggtctca

SEQ ID NO: 7705695 - DNA, 22 bp, Homo sapiens
tgggaggaagtgctaatgggag

SEQ ID NO: 7705696 - DNA, 22 bp, Homo sapiens
tgggaggaagtgctaatgggag

SEQ ID NO: 7705697 - DNA, 20 bp, Homo sapiens
tgggagctggtgaggtctca

SEQ ID NO: 7705698 - DNA, 22 bp, Homo sapiens
tgggaggaagtgctaatgggag

SEQ ID NO: 7705699 - DNA, 22 bp, Homo sapiens
tgggaggaagtgctaatgggag

SEQ ID NO: 7705700 - DNA, 22 bp, Homo sapiens
tgggagctgagctaaaccccag

SEQ ID NO: 7705701 - DNA, 22 bp, Homo sapiens
tgggagctggggttggacgtct

SEQ ID NO: 7705702 - DNA, 22 bp, Homo sapiens
tgggagctctgagcctgctgtg

SEQ ID NO: 7705703 - DNA, 22 bp, Homo sapiens
tgggagctctgagcctgctgtg

SEQ ID NO: 7705704 - DNA, 22 bp, Homo sapiens
tgggagctctgagcctgctatg

SEQ ID NO: 7705705 - DNA, 22 bp, Homo sapiens
tgggagctctgagcctgctatg

SEQ ID NO: 7705706 - DNA, 22 bp, Homo sapiens
tgggagctctgagcctgctatg

SEQ ID NO: 7705707 - DNA, 22 bp, Homo sapiens
tgggagctcctggagggcagga

SEQ ID NO: 7705708 - DNA, 22 bp, Homo sapiens
tgggagcactctttgggaagca

SEQ ID NO: 7705709 - DNA, 22 bp, Homo sapiens
tgggagcaccttgagggcagaa

SEQ ID NO: 7705710 - DNA, 22 bp, Homo sapiens
tgggagcaccttgagggcagaa

SEQ ID NO: 7705711 - DNA, 22 bp, Homo sapiens
tgggagcaccttgagggcagaa

SEQ ID NO: 7705712 - DNA, 22 bp, Homo sapiens
tgggagcaccttgagggcagaa

SEQ ID NO: 7705713 - DNA, 22 bp, Homo sapiens
tgggagcactctttgggaagca

SEQ ID NO: 7705714 - DNA, 22 bp, Homo sapiens
tgggagcactctttgggaagca

SEQ ID NO: 7705715 - DNA, 22 bp, Homo sapiens
tgggagcactctttgggaagca

SEQ ID NO: 7705716 - DNA, 22 bp, Homo sapiens
tgggagcactctttgggaagca

SEQ ID NO: 7705717 - DNA, 22 bp, Homo sapiens
tgggagcactctttgggaagca

SEQ ID NO: 7705718 - DNA, 22 bp, Homo sapiens
tgggagcactctttgggaagca

SEQ ID NO: 7705719 - DNA, 22 bp, Homo sapiens
tgggagcaccttgagggcagaa

SEQ ID NO: 7705720 - DNA, 22 bp, Homo sapiens
tgggagcaccttgagggcagaa

SEQ ID NO: 7705721 - DNA, 22 bp, Homo sapiens
tgggagcaccttgagggcagaa

SEQ ID NO: 7705722 - DNA, 22 bp, Homo sapiens
tgggagcaccttgagggcagaa

SEQ ID NO: 7705723 - DNA, 22 bp, Homo sapiens
tgggagcaccttgagggcagaa

SEQ ID NO: 7705724 - DNA, 22 bp, Homo sapiens
tgggagcaccttgagggcagaa

SEQ ID NO: 7705725 - DNA, 22 bp, Homo sapiens
tgggagcaccttgagggcagaa

SEQ ID NO: 7705726 - DNA, 22 bp, Homo sapiens
tgggagcaccctgaggagcttc

SEQ ID NO: 7705727 - DNA, 22 bp, Homo sapiens
tgggagcaccctgaggagcttc

SEQ ID NO: 7705728 - DNA, 22 bp, Homo sapiens
tgggagcaccctgaggagcttc

SEQ ID NO: 7705729 - DNA, 22 bp, Homo sapiens
tgggagcaagctggtgctggag

SEQ ID NO: 7705730 - DNA, 22 bp, Homo sapiens
tgggagcaagctggtgctggag

SEQ ID NO: 7705731 - DNA, 22 bp, Homo sapiens
tgggagcaagctggtgctggag

SEQ ID NO: 7705732 - DNA, 22 bp, Homo sapiens
tgggagcaagctggtgctggag

SEQ ID NO: 7705733 - DNA, 22 bp, Homo sapiens
tgggagcaagctggtgctggag

SEQ ID NO: 7705734 - DNA, 22 bp, Homo sapiens
tgggagcaagctggtgctggag

SEQ ID NO: 7705735 - DNA, 22 bp, Homo sapiens
tgggagcaagctggtgctggag

SEQ ID NO: 7705736 - DNA, 22 bp, Homo sapiens
tgggagcaagctggtgctggag

SEQ ID NO: 7705737 - DNA, 22 bp, Homo sapiens
tgggagcaagctggtgctggag

SEQ ID NO: 7705738 - DNA, 22 bp, Homo sapiens
tgggagcaagctggtgctggag

SEQ ID NO: 7705739 - DNA, 22 bp, Homo sapiens
tgggagcaccctgaggagcttc

SEQ ID NO: 7705740 - DNA, 22 bp, Homo sapiens
tgggagcaccctgaggagcttc

SEQ ID NO: 7705741 - DNA, 22 bp, Homo sapiens
tgggagcaccctgaggagcttc

SEQ ID NO: 7705742 - DNA, 22 bp, Homo sapiens
tgggagcaagctggtgctggag

SEQ ID NO: 7705743 - DNA, 22 bp, Homo sapiens
tgggagcaagctggtgctggag

SEQ ID NO: 7705744 - DNA, 22 bp, Homo sapiens
tgggagcaccctgaggagcttc

SEQ ID NO: 7705745 - DNA, 22 bp, Homo sapiens
tgggagcaccctgaggagcttc

SEQ ID NO: 7705746 - DNA, 22 bp, Homo sapiens
tgggagcaccctgaggagcttc

SEQ ID NO: 7705747 - DNA, 22 bp, Homo sapiens
tgggagcaccctgaggagcttc

SEQ ID NO: 7705748 - DNA, 22 bp, Homo sapiens
tgggagcaccctgaggagcttc

SEQ ID NO: 7705749 - DNA, 22 bp, Homo sapiens
tgggagcaggaagcaggaagta

SEQ ID NO: 7705750 - DNA, 22 bp, Homo sapiens
tgggagcaggaagcaggaagta

SEQ ID NO: 7705751 - DNA, 22 bp, Homo sapiens
tgggagcaggaagcaggaagta

SEQ ID NO: 7705752 - DNA, 22 bp, Homo sapiens
tgggagctcctggagggcagga

SEQ ID NO: 7705753 - DNA, 22 bp, Homo sapiens
tgggagctcctggagggcagga

SEQ ID NO: 7705754 - DNA, 22 bp, Homo sapiens
tgggagcaggaagcaggaagta

SEQ ID NO: 7705755 - DNA, 22 bp, Homo sapiens
tgggagcaggaagcaggaagta

SEQ ID NO: 7705756 - DNA, 22 bp, Homo sapiens
tgggagcaggaagcaggaagta

SEQ ID NO: 7705757 - DNA, 22 bp, Homo sapiens
tgggagcagctttgcgagggag

SEQ ID NO: 7705758 - DNA, 22 bp, Homo sapiens
tgggagcagctttgcgagggag

SEQ ID NO: 7705759 - DNA, 22 bp, Homo sapiens
tgggagcagcctcagcttcggg

SEQ ID NO: 7705760 - DNA, 22 bp, Homo sapiens
tgggagcagctgggaacacagc

SEQ ID NO: 7705761 - DNA, 22 bp, Homo sapiens
tgggagcagcctcagcttcggg

SEQ ID NO: 7705762 - DNA, 22 bp, Homo sapiens
tgggagcagcctcagcttcggg

SEQ ID NO: 7705763 - DNA, 22 bp, Homo sapiens
tgggagcagctgggaacacagc

SEQ ID NO: 7705764 - DNA, 22 bp, Homo sapiens
tgggagcagctgggaacacagc

SEQ ID NO: 7705765 - DNA, 22 bp, Homo sapiens
tgggagcagctgggaacacagc

SEQ ID NO: 7705766 - DNA, 22 bp, Homo sapiens
tgggagcagctgggaacacagc

SEQ ID NO: 7705767 - DNA, 22 bp, Homo sapiens
tgggagcagctttgcgagggag

SEQ ID NO: 7705768 - DNA, 22 bp, Homo sapiens
tgggagcagctttgcgagggag

SEQ ID NO: 7705769 - DNA, 22 bp, Homo sapiens
tgggagcagctttgcgagggag

SEQ ID NO: 7705770 - DNA, 22 bp, Homo sapiens
tgggagcagctttgcgagggag

SEQ ID NO: 7705771 - DNA, 22 bp, Homo sapiens
tgggagcagctttgcgagggag

SEQ ID NO: 7705772 - DNA, 22 bp, Homo sapiens
tgggagcagctttgcgagggag

SEQ ID NO: 7705773 - DNA, 22 bp, Homo sapiens
tgggagcagccaacatggcctt

SEQ ID NO: 7705774 - DNA, 22 bp, Homo sapiens
tgggagcagccaacatggcctt

SEQ ID NO: 7705775 - DNA, 22 bp, Homo sapiens
tgggagcagccaacatggcctt

SEQ ID NO: 7705776 - DNA, 22 bp, Homo sapiens
tgggagcagccaacatggcctt

SEQ ID NO: 7705777 - DNA, 22 bp, Homo sapiens
tgggagcagccaacatggcctt

SEQ ID NO: 7705778 - DNA, 22 bp, Homo sapiens
tgggagcagcattgccatgtgc

SEQ ID NO: 7705779 - DNA, 22 bp, Homo sapiens
tgggagcagcattgccatgtgc

SEQ ID NO: 7705780 - DNA, 22 bp, Homo sapiens
tgggagcagccaacatggcctt

SEQ ID NO: 7705781 - DNA, 22 bp, Homo sapiens
tgggagcagccaacatggcctt

SEQ ID NO: 7705782 - DNA, 22 bp, Homo sapiens
tgggagcagccaacatggcctt

SEQ ID NO: 7705783 - DNA, 22 bp, Homo sapiens
tgggagcagccaacatggcctt

SEQ ID NO: 7705784 - DNA, 22 bp, Homo sapiens
tgggagcagcagggagatgcgg

SEQ ID NO: 7705785 - DNA, 22 bp, Homo sapiens
tgggagcagcagggagatgcgg

SEQ ID NO: 7705786 - DNA, 22 bp, Homo sapiens
tgggagcagcagggagatgcgg

SEQ ID NO: 7705787 - DNA, 22 bp, Homo sapiens
tgggagcagcattgccatgtgc

SEQ ID NO: 7705788 - DNA, 22 bp, Homo sapiens
tgggagcagcattgccatgtgc

SEQ ID NO: 7705789 - DNA, 22 bp, Homo sapiens
tgggagcagcattgccatgtgc

SEQ ID NO: 7705790 - DNA, 22 bp, Homo sapiens
tgggagcagcagggagatgcgg

SEQ ID NO: 7705791 - DNA, 22 bp, Homo sapiens
tgggagcactctttgggaagca

SEQ ID NO: 7705792 - DNA, 22 bp, Homo sapiens
tgggagcagcagggagatgcgg

SEQ ID NO: 7705793 - DNA, 22 bp, Homo sapiens
tgggagcagcagggagatgcgg

SEQ ID NO: 7705794 - DNA, 22 bp, Homo sapiens
tgggagcagcagggagatgcgg

SEQ ID NO: 7705795 - DNA, 22 bp, Homo sapiens
tggcagagcccagactccagtc

SEQ ID NO: 7705796 - DNA, 22 bp, Homo sapiens
tggcagagcccagactccagtc

SEQ ID NO: 7705797 - DNA, 22 bp, Homo sapiens
tggcagagcccagactccagtc

SEQ ID NO: 7705798 - DNA, 22 bp, Homo sapiens
tggcagagcccagactccagtc

SEQ ID NO: 7705799 - DNA, 22 bp, Homo sapiens
tggcagagcccagactccagtc

SEQ ID NO: 7705800 - DNA, 22 bp, Homo sapiens
tggcagagcccagactccagtc

SEQ ID NO: 7705801 - DNA, 22 bp, Homo sapiens
tggcagagcccagactccagtc

SEQ ID NO: 7705802 - DNA, 22 bp, Homo sapiens
tggcagagcccagactccagtc

SEQ ID NO: 7705803 - DNA, 22 bp, Homo sapiens
tggcagagcccagactccagtc

SEQ ID NO: 7705804 - DNA, 22 bp, Homo sapiens
tggcagagcccagaactgagca

SEQ ID NO: 7705805 - DNA, 22 bp, Homo sapiens
tggcagagcccagaactgagca

SEQ ID NO: 7705806 - DNA, 22 bp, Homo sapiens
tggcagagcccagaactgagca

SEQ ID NO: 7705807 - DNA, 22 bp, Homo sapiens
tggcagagcccagaactgagca

SEQ ID NO: 7705808 - DNA, 22 bp, Homo sapiens
tggcagagcccagaactgagca

SEQ ID NO: 7705809 - DNA, 22 bp, Homo sapiens
tggcagagcccagaactgagca

SEQ ID NO: 7705810 - DNA, 22 bp, Homo sapiens
tggcagagcccagaactgagca

SEQ ID NO: 7705811 - DNA, 22 bp, Homo sapiens
tggcagagcccagaactgagca

SEQ ID NO: 7705812 - DNA, 22 bp, Homo sapiens
tggcagagcccagaactgagca

SEQ ID NO: 7705813 - DNA, 22 bp, Homo sapiens
tggcagagcccagaactgagca

SEQ ID NO: 7705814 - DNA, 22 bp, Homo sapiens
tggcagagatgaagagttgttt

SEQ ID NO: 7705815 - DNA, 22 bp, Homo sapiens
tggcagagatgaagagttgttt

SEQ ID NO: 7705816 - DNA, 22 bp, Homo sapiens
tggcagagatgaagagttgttt

SEQ ID NO: 7705817 - DNA, 22 bp, Homo sapiens
tggcagagatgaagagttgttt

SEQ ID NO: 7705818 - DNA, 22 bp, Homo sapiens
tggcagagatgaagagttgttt

SEQ ID NO: 7705819 - DNA, 22 bp, Homo sapiens
tggcagagatgaagagttgttt

SEQ ID NO: 7705820 - DNA, 22 bp, Homo sapiens
tggcagagatgaagagttgttt

SEQ ID NO: 7705821 - DNA, 22 bp, Homo sapiens
tggcagagatgaagagttgttt

SEQ ID NO: 7705822 - DNA, 22 bp, Homo sapiens
tggcagagatgaagagttgttt

SEQ ID NO: 7705823 - DNA, 22 bp, Homo sapiens
tggcagagcaaaaagatagaat

SEQ ID NO: 7705824 - DNA, 22 bp, Homo sapiens
tggcagagcaaaaagatagaat

SEQ ID NO: 7705825 - DNA, 22 bp, Homo sapiens
tggcagagcaaaaagatagaat

SEQ ID NO: 7705826 - DNA, 22 bp, Homo sapiens
tggcagagcaaaaagatagaat

SEQ ID NO: 7705827 - DNA, 22 bp, Homo sapiens
tggcagagcaaaaagatagaat

SEQ ID NO: 7705828 - DNA, 22 bp, Homo sapiens
tggcagagcccagaactgagca

SEQ ID NO: 7705829 - DNA, 22 bp, Homo sapiens
tggcagagcaaaaagatagaat

SEQ ID NO: 7705830 - DNA, 22 bp, Homo sapiens
tggcagagcaaaaagatagaat

SEQ ID NO: 7705831 - DNA, 22 bp, Homo sapiens
tggcagagcaaaaagatagaat

SEQ ID NO: 7705832 - DNA, 22 bp, Homo sapiens
tggcagagcaaaaagatagaat

SEQ ID NO: 7705833 - DNA, 22 bp, Homo sapiens
tggcagagctggctgcggatga

SEQ ID NO: 7705834 - DNA, 22 bp, Homo sapiens
tggcagagccttgccaaactcc

SEQ ID NO: 7705835 - DNA, 22 bp, Homo sapiens
tggcagagctggctgcggatga

SEQ ID NO: 7705836 - DNA, 22 bp, Homo sapiens
tggcagagctggctgcggatga

SEQ ID NO: 7705837 - DNA, 22 bp, Homo sapiens
tggcagagctggctgcggatga

SEQ ID NO: 7705838 - DNA, 22 bp, Homo sapiens
tggcagagctggctgcggatga

SEQ ID NO: 7705839 - DNA, 22 bp, Homo sapiens
tggcagagctggctgcggatga

SEQ ID NO: 7705840 - DNA, 22 bp, Homo sapiens
tggcagagctggctgcggatga

SEQ ID NO: 7705841 - DNA, 22 bp, Homo sapiens
tggcagagctggctgcggatga

SEQ ID NO: 7705842 - DNA, 22 bp, Homo sapiens
tggcagagccttgccaaactcc

SEQ ID NO: 7705843 - DNA, 22 bp, Homo sapiens
tggcagagccttgccaaactcc

SEQ ID NO: 7705844 - DNA, 22 bp, Homo sapiens
tggcagagccttgccaaactcc

SEQ ID NO: 7705845 - DNA, 22 bp, Homo sapiens
tggcagagccttgccaaactcc

SEQ ID NO: 7705846 - DNA, 22 bp, Homo sapiens
tggcagagcccagactccagtc

SEQ ID NO: 7705847 - DNA, 22 bp, Homo sapiens
tggcagagccttgccaaactcc

SEQ ID NO: 7705848 - DNA, 22 bp, Homo sapiens
tggcagaggaaaaagtcactgg

SEQ ID NO: 7705849 - DNA, 22 bp, Homo sapiens
tggcagaggaaaaagtcactgg

SEQ ID NO: 7705850 - DNA, 22 bp, Homo sapiens
tggcagaggaaaaagtcactgg

SEQ ID NO: 7705851 - DNA, 22 bp, Homo sapiens
tggcagaggaaaaagtcactgg

SEQ ID NO: 7705852 - DNA, 22 bp, Homo sapiens
tggcagagctggctgcggatga

SEQ ID NO: 7705853 - DNA, 22 bp, Homo sapiens
tggcagagctggctgcggatga

SEQ ID NO: 7705854 - DNA, 22 bp, Homo sapiens
tggcagagctggctgcggatga

SEQ ID NO: 7705855 - DNA, 22 bp, Homo sapiens
tggcagaggaaaaagtcactgg

SEQ ID NO: 7705856 - DNA, 22 bp, Homo sapiens
tggcagaggaaaaagtcactgg

SEQ ID NO: 7705857 - DNA, 22 bp, Homo sapiens
tggcagaggaaaaagtcactgg

SEQ ID NO: 7705858 - DNA, 22 bp, Homo sapiens
tggcagaggaaaaagtcactgg

SEQ ID NO: 7705859 - DNA, 22 bp, Homo sapiens
tggcagaggaaaaagtcactgg

SEQ ID NO: 7705860 - DNA, 22 bp, Homo sapiens
tggcagaggaaaaagtcactgg

SEQ ID NO: 7705861 - DNA, 16 bp, Homo sapiens
tggcagaggttcagcc

SEQ ID NO: 7705862 - DNA, 16 bp, Homo sapiens
tggcagaggttcagcc

SEQ ID NO: 7705863 - DNA, 16 bp, Homo sapiens
tggcagaggttcagcc

SEQ ID NO: 7705864 - DNA, 22 bp, Homo sapiens
tggcagaggtatattgggagga

SEQ ID NO: 7705865 - DNA, 22 bp, Homo sapiens
tggcagaggaaaaagtcactgg

SEQ ID NO: 7705866 - DNA, 22 bp, Homo sapiens
tggcagaggaaaaagtcactgg

SEQ ID NO: 7705867 - DNA, 22 bp, Homo sapiens
tggcagaggaaaaagtcactgg

SEQ ID NO: 7705868 - DNA, 22 bp, Homo sapiens
tggcagaggtatattgggagga

SEQ ID NO: 7705869 - DNA, 22 bp, Homo sapiens
tggcagaggtatattgggagga

SEQ ID NO: 7705870 - DNA, 22 bp, Homo sapiens
tggcagaggtatattgggagga

SEQ ID NO: 7705871 - DNA, 22 bp, Homo sapiens
tggcagagagagtgcagtcgac

SEQ ID NO: 7705872 - DNA, 22 bp, Homo sapiens
tggcagagagagtgcagtcgac

SEQ ID NO: 7705873 - DNA, 22 bp, Homo sapiens
tggcagagagagtgcagtcgac

SEQ ID NO: 7705874 - DNA, 22 bp, Homo sapiens
tggcagagagagtgcagtcgac

SEQ ID NO: 7705875 - DNA, 22 bp, Homo sapiens
tggcagagagagtgcagtcgac

SEQ ID NO: 7705876 - DNA, 22 bp, Homo sapiens
tggcagagagagtgcagtcgac

SEQ ID NO: 7705877 - DNA, 22 bp, Homo sapiens
tggcagagagagtgcagtcgac

SEQ ID NO: 7705878 - DNA, 22 bp, Homo sapiens
tggcagagagagtgcagtcgac

SEQ ID NO: 7705879 - DNA, 22 bp, Homo sapiens
tggcagagagagtgcagtcgac

SEQ ID NO: 7705880 - DNA, 22 bp, Homo sapiens
tggcagagagactctccttgat

SEQ ID NO: 7705881 - DNA, 22 bp, Homo sapiens
tggcagagagactctccttgat

SEQ ID NO: 7705882 - DNA, 22 bp, Homo sapiens
tggcagagagactctccttgat

SEQ ID NO: 7705883 - DNA, 22 bp, Homo sapiens
tggcagagagactctccttgat

SEQ ID NO: 7705884 - DNA, 22 bp, Homo sapiens
tggcagagagactctccttgat

SEQ ID NO: 7705885 - DNA, 22 bp, Homo sapiens
tggcagagagagtgcagtcgac

SEQ ID NO: 7705886 - DNA, 23 bp, Homo sapiens
tggcagagacccagaatctacat

SEQ ID NO: 7705887 - DNA, 23 bp, Homo sapiens
tggcagagacccagaatctacat

SEQ ID NO: 7705888 - DNA, 22 bp, Homo sapiens
tggcagagactcctcctgggag

SEQ ID NO: 7705889 - DNA, 22 bp, Homo sapiens
tggcagagactcctcctgggag

SEQ ID NO: 7705890 - DNA, 22 bp, Homo sapiens
tggcagagactcctcctgggag

SEQ ID NO: 7705891 - DNA, 22 bp, Homo sapiens
tggcagagactcctcctgggag

SEQ ID NO: 7705892 - DNA, 22 bp, Homo sapiens
tggcagagactcctcctgggag

SEQ ID NO: 7705893 - DNA, 22 bp, Homo sapiens
tggcagagactcctcctgggag

SEQ ID NO: 7705894 - DNA, 22 bp, Homo sapiens
tggcagagactcctcctgggag

SEQ ID NO: 7705895 - DNA, 22 bp, Homo sapiens
tggcagagactcctcctgggag

SEQ ID NO: 7705896 - DNA, 22 bp, Homo sapiens
tggcagagactcctcctgggag

SEQ ID NO: 7705897 - DNA, 22 bp, Homo sapiens
tggcagagactcctcctgggag

SEQ ID NO: 7705898 - DNA, 22 bp, Homo sapiens
tggcagagactcctcctgggag

SEQ ID NO: 7705899 - DNA, 22 bp, Homo sapiens
tggcagagagactctccttgat

SEQ ID NO: 7705900 - DNA, 22 bp, Homo sapiens
tggcagagagactctccttgat

SEQ ID NO: 7705901 - DNA, 22 bp, Homo sapiens
tggcagagagactctccttgat

SEQ ID NO: 7705902 - DNA, 22 bp, Homo sapiens
tggcagagagactctccttgat

SEQ ID NO: 7705903 - DNA, 22 bp, Homo sapiens
tggcagagagactctccttgat

SEQ ID NO: 7705904 - DNA, 22 bp, Homo sapiens
tggcagagacaaggccgggcct

SEQ ID NO: 7705905 - DNA, 23 bp, Homo sapiens
tggcagagacccagaatctacat

SEQ ID NO: 7705906 - DNA, 23 bp, Homo sapiens
tggcagagacccagaatctacat

SEQ ID NO: 7705907 - DNA, 23 bp, Homo sapiens
tggcagagacccagaatctacat

SEQ ID NO: 7705908 - DNA, 22 bp, Homo sapiens
tggcagagacaaggccgggcct

SEQ ID NO: 7705909 - DNA, 22 bp, Homo sapiens
tggcagagacaaggccgggcct

SEQ ID NO: 7705910 - DNA, 22 bp, Homo sapiens
tggcagagacaaggccgggcct

SEQ ID NO: 7705911 - DNA, 22 bp, Homo sapiens
tggcagagaataaatcttgact

SEQ ID NO: 7705912 - DNA, 22 bp, Homo sapiens
tggcagagaataaatcttgact

SEQ ID NO: 7705913 - DNA, 22 bp, Homo sapiens
tggcagagacaaggccgggcct

SEQ ID NO: 7705914 - DNA, 22 bp, Homo sapiens
tggcagagacaaggccgggcct

SEQ ID NO: 7705915 - DNA, 22 bp, Homo sapiens
tggcagagacaaggccgggcct

SEQ ID NO: 7705916 - DNA, 22 bp, Homo sapiens
tggcagagacaaggccgggcct

SEQ ID NO: 7705917 - DNA, 22 bp, Homo sapiens
tggcagagacaaggccgggcct

SEQ ID NO: 7705918 - DNA, 22 bp, Homo sapiens
tggcagagaacctgggctttgt

SEQ ID NO: 7705919 - DNA, 22 bp, Homo sapiens
tggcagagaacctgggctttgt

SEQ ID NO: 7705920 - DNA, 22 bp, Homo sapiens
tggcagagaacctgggctttgt

SEQ ID NO: 7705921 - DNA, 22 bp, Homo sapiens
tggcagagaacctgggctttgt

SEQ ID NO: 7705922 - DNA, 22 bp, Homo sapiens
tggcagagaataaatcttgact

SEQ ID NO: 7705923 - DNA, 22 bp, Homo sapiens
tggcagagaataaatcttgact

SEQ ID NO: 7705924 - DNA, 22 bp, Homo sapiens
tggcagagaacctgggctttgt

SEQ ID NO: 7705925 - DNA, 22 bp, Homo sapiens
tggcagagaacctgggctttgt

SEQ ID NO: 7705926 - DNA, 22 bp, Homo sapiens
tggcagagaacacggctgatct

SEQ ID NO: 7705927 - DNA, 22 bp, Homo sapiens
tggcagagaacacggctgatct

SEQ ID NO: 7705928 - DNA, 22 bp, Homo sapiens
tggcagagaacacggctgatct

SEQ ID NO: 7705929 - DNA, 22 bp, Homo sapiens
tggcagagaacacggctgatct

SEQ ID NO: 7705930 - DNA, 22 bp, Homo sapiens
tggcagagaacacggctgatct

SEQ ID NO: 7705931 - DNA, 22 bp, Homo sapiens
tggcagagaacacggctgatct

SEQ ID NO: 7705932 - DNA, 22 bp, Homo sapiens
tggcagagaacacggctgatct

SEQ ID NO: 7705933 - DNA, 22 bp, Homo sapiens
tggcagagaacacggctgatct

SEQ ID NO: 7705934 - DNA, 22 bp, Homo sapiens
tggcagagaacacggctgatct

SEQ ID NO: 7705935 - DNA, 22 bp, Homo sapiens
tggcactgccaacctgctaggt

SEQ ID NO: 7705936 - DNA, 22 bp, Homo sapiens
tggcactgccaacctgctaggt

SEQ ID NO: 7705937 - DNA, 22 bp, Homo sapiens
tggcactgccaacctgctaggt

SEQ ID NO: 7705938 - DNA, 22 bp, Homo sapiens
tggcactgagcagccgcggcag

SEQ ID NO: 7705939 - DNA, 22 bp, Homo sapiens
tggcactgccaacctgctaggt

SEQ ID NO: 7705940 - DNA, 22 bp, Homo sapiens
tggcactgccaacctgctaggt

SEQ ID NO: 7705941 - DNA, 22 bp, Homo sapiens
tggcactgccaacctgctaggt

SEQ ID NO: 7705942 - DNA, 22 bp, Homo sapiens
tggcactgaccccaggcctgtg

SEQ ID NO: 7705943 - DNA, 22 bp, Homo sapiens
tggcactgaccccaggcctgtg

SEQ ID NO: 7705944 - DNA, 22 bp, Homo sapiens
tggcactgaccccaggcctgtg

SEQ ID NO: 7705945 - DNA, 22 bp, Homo sapiens
tggcactgaccccaggcctgtg

SEQ ID NO: 7705946 - DNA, 22 bp, Homo sapiens
tggcactgagcagccgcggcag

SEQ ID NO: 7705947 - DNA, 22 bp, Homo sapiens
tggcactgcctggcagggcccc

SEQ ID NO: 7705948 - DNA, 22 bp, Homo sapiens
tggcactgccaacctgctaggt

SEQ ID NO: 7705949 - DNA, 21 bp, Homo sapiens
tggcactgcttagcaggttcc

SEQ ID NO: 7705950 - DNA, 21 bp, Homo sapiens
tggcactgcttagcaggttcc

SEQ ID NO: 7705951 - DNA, 22 bp, Homo sapiens
tggcactgcctggcagggcccc

SEQ ID NO: 7705952 - DNA, 22 bp, Homo sapiens
tggcactgcctggcagggcccc

SEQ ID NO: 7705953 - DNA, 22 bp, Homo sapiens
tggcactgcctggcagggcccc

SEQ ID NO: 7705954 - DNA, 22 bp, Homo sapiens
tggcactgccaacctgctaggt

SEQ ID NO: 7705955 - DNA, 22 bp, Homo sapiens
tggcactggaatcgtagccttg

SEQ ID NO: 7705956 - DNA, 22 bp, Homo sapiens
tggcactggaatcgtagccttg

SEQ ID NO: 7705957 - DNA, 21 bp, Homo sapiens
tggcactgcttagcaggttcc

SEQ ID NO: 7705958 - DNA, 22 bp, Homo sapiens
tggcactggaatcgtagccttg

SEQ ID NO: 7705959 - DNA, 22 bp, Homo sapiens
tggcactggcgcaggatggcgg

SEQ ID NO: 7705960 - DNA, 22 bp, Homo sapiens
tggcactggaatcgtagccttg

SEQ ID NO: 7705961 - DNA, 22 bp, Homo sapiens
tggcactgtcaccaatgctgtc

SEQ ID NO: 7705962 - DNA, 22 bp, Homo sapiens
tggcactgtcaccaatgctgtc

SEQ ID NO: 7705963 - DNA, 22 bp, Homo sapiens
tggcactgtcaccaatgctgtc

SEQ ID NO: 7705964 - DNA, 22 bp, Homo sapiens
tggcactgggatgctactgtta

SEQ ID NO: 7705965 - DNA, 22 bp, Homo sapiens
tggcactgtagccactactgcc

SEQ ID NO: 7705966 - DNA, 22 bp, Homo sapiens
tggcactgggatgctactgtta

SEQ ID NO: 7705967 - DNA, 22 bp, Homo sapiens
tggcactgtagccactactgcc

SEQ ID NO: 7705968 - DNA, 22 bp, Homo sapiens
tggcactgggacagatgctctc

SEQ ID NO: 7705969 - DNA, 22 bp, Homo sapiens
tggcactgggacagatgctctc

SEQ ID NO: 7705970 - DNA, 22 bp, Homo sapiens
tggcactgggacagatgctctc

SEQ ID NO: 7705971 - DNA, 22 bp, Homo sapiens
tggcactgggatgctactgtta

SEQ ID NO: 7705972 - DNA, 22 bp, Homo sapiens
tggcactgggacagatgctctc

SEQ ID NO: 7705973 - DNA, 22 bp, Homo sapiens
tggcactggcgcaggatggcgg

SEQ ID NO: 7705974 - DNA, 22 bp, Homo sapiens
tggcactggcgcaggatggcgg

SEQ ID NO: 7705975 - DNA, 22 bp, Homo sapiens
tggcacttaaaaattattcttc

SEQ ID NO: 7705976 - DNA, 22 bp, Homo sapiens
tggcactgtggatttcacaagt

SEQ ID NO: 7705977 - DNA, 22 bp, Homo sapiens
tggcactgtggatttcacaagt

SEQ ID NO: 7705978 - DNA, 22 bp, Homo sapiens
tggcactgtcaccaatgctgtc

SEQ ID NO: 7705979 - DNA, 22 bp, Homo sapiens
tggcacttaatgcatgtgctat

SEQ ID NO: 7705980 - DNA, 22 bp, Homo sapiens
tggcacttccactgtggctgct

SEQ ID NO: 7705981 - DNA, 22 bp, Homo sapiens
tggcacttccgtctgccttgtg

SEQ ID NO: 7705982 - DNA, 22 bp, Homo sapiens
tggcacttccactgtggctgct

SEQ ID NO: 7705983 - DNA, 22 bp, Homo sapiens
tggcacatggttaatcataatt

SEQ ID NO: 7705984 - DNA, 22 bp, Homo sapiens
tggcacatggttaatcataatt

SEQ ID NO: 7705985 - DNA, 22 bp, Homo sapiens
tggcacatggtaagtgcttaac

SEQ ID NO: 7705986 - DNA, 22 bp, Homo sapiens
tggcacatggtaagactcagta

SEQ ID NO: 7705987 - DNA, 22 bp, Homo sapiens
tggcacatatttttagtgctca

SEQ ID NO: 7705988 - DNA, 22 bp, Homo sapiens
tggcacatccacagaatctgga

SEQ ID NO: 7705989 - DNA, 22 bp, Homo sapiens
tggcacatatttttagtgctca

SEQ ID NO: 7705990 - DNA, 22 bp, Homo sapiens
tggcacatggtaagactcagta

SEQ ID NO: 7705991 - DNA, 22 bp, Homo sapiens
tggcacatgatgttgtggcatc

SEQ ID NO: 7705992 - DNA, 22 bp, Homo sapiens
tggcacatgatgttgtggcatc

SEQ ID NO: 7705993 - DNA, 22 bp, Homo sapiens
tggcacatagtaggtgctcaat

SEQ ID NO: 7705994 - DNA, 22 bp, Homo sapiens
tggcacatagaaaaggatcaat

SEQ ID NO: 7705995 - DNA, 22 bp, Homo sapiens
tggcacatagcaggtactcagt

SEQ ID NO: 7705996 - DNA, 22 bp, Homo sapiens
tggcacatagaaaaggatcaat

SEQ ID NO: 7705997 - DNA, 22 bp, Homo sapiens
tggcacagttaaagttgtagaa

SEQ ID NO: 7705998 - DNA, 22 bp, Homo sapiens
tggcacagttaaagttgtagaa

SEQ ID NO: 7705999 - DNA, 22 bp, Homo sapiens
tggcacagttaaagttgtagaa

SEQ ID NO: 7706000 - DNA, 22 bp, Homo sapiens
tggcacagttaaagttgtagaa

SEQ ID NO: 7706001 - DNA, 22 bp, Homo sapiens
tggcaccaccagacaccaggag

SEQ ID NO: 7706002 - DNA, 22 bp, Homo sapiens
tggcaccaccagacaccaggag

SEQ ID NO: 7706003 - DNA, 22 bp, Homo sapiens
tggcaccaccagacaccaggag

SEQ ID NO: 7706004 - DNA, 22 bp, Homo sapiens
tggcacatggttaatcataatt

SEQ ID NO: 7706005 - DNA, 22 bp, Homo sapiens
tggcaccagcacctagatgggg

SEQ ID NO: 7706006 - DNA, 22 bp, Homo sapiens
tggcaccagcacctagatgggg

SEQ ID NO: 7706007 - DNA, 22 bp, Homo sapiens
tggcaccaccagacaccaggag

SEQ ID NO: 7706008 - DNA, 23 bp, Homo sapiens
tggcaccaggcattctaggggta

SEQ ID NO: 7706009 - DNA, 22 bp, Homo sapiens
tggcaccagggaacaagcattt

SEQ ID NO: 7706010 - DNA, 22 bp, Homo sapiens
tggcaccagggaacaagcattt

SEQ ID NO: 7706011 - DNA, 22 bp, Homo sapiens
tggcaccagggaacaagcattt

SEQ ID NO: 7706012 - DNA, 22 bp, Homo sapiens
tggcaccaggcggggtggctgt

SEQ ID NO: 7706013 - DNA, 20 bp, Homo sapiens
tggcaccaggtggtggcccc

SEQ ID NO: 7706014 - DNA, 20 bp, Homo sapiens
tggcaccaggtggtggcccc

SEQ ID NO: 7706015 - DNA, 22 bp, Homo sapiens
tggcaccatcaaggctgagaac

SEQ ID NO: 7706016 - DNA, 22 bp, Homo sapiens
tggcactgaagctggaaagcct

SEQ ID NO: 7706017 - DNA, 22 bp, Homo sapiens
tggcactgaaaaaggagaggtt

SEQ ID NO: 7706018 - DNA, 22 bp, Homo sapiens
tggcactgaaaaaggagaggtt

SEQ ID NO: 7706019 - DNA, 22 bp, Homo sapiens
tggcactgaaaaaggagaggtt

SEQ ID NO: 7706020 - DNA, 22 bp, Homo sapiens
tggcactatggatgagactgat

SEQ ID NO: 7706021 - DNA, 22 bp, Homo sapiens
tggcactgaaaaaggagaggtt

SEQ ID NO: 7706022 - DNA, 22 bp, Homo sapiens
tggcactcactctcagagtctg

SEQ ID NO: 7706023 - DNA, 22 bp, Homo sapiens
tggcactatggatgagactgat

SEQ ID NO: 7706024 - DNA, 22 bp, Homo sapiens
tggcactgaagctggaaagcct

SEQ ID NO: 7706025 - DNA, 22 bp, Homo sapiens
tggcactgaagctggaaagcct

SEQ ID NO: 7706026 - DNA, 22 bp, Homo sapiens
tggcactgaagctggaaagcct

SEQ ID NO: 7706027 - DNA, 22 bp, Homo sapiens
tggcactgaagctggaaagcct

SEQ ID NO: 7706028 - DNA, 22 bp, Homo sapiens
tggcactgacagggtgctcaag

SEQ ID NO: 7706029 - DNA, 22 bp, Homo sapiens
tggcactgacagggtgctcaag

SEQ ID NO: 7706030 - DNA, 22 bp, Homo sapiens
tggcactgacagggtgctcaag

SEQ ID NO: 7706031 - DNA, 22 bp, Homo sapiens
tggcactgacagggtgctcaag

SEQ ID NO: 7706032 - DNA, 22 bp, Homo sapiens
tggcactgaagctggaaagcct

SEQ ID NO: 7706033 - DNA, 22 bp, Homo sapiens
tggcacccagtggagctgtgct

SEQ ID NO: 7706034 - DNA, 22 bp, Homo sapiens
tggcacccagtggagctgtgct

SEQ ID NO: 7706035 - DNA, 22 bp, Homo sapiens
tggcacccagtggagctgtgct

SEQ ID NO: 7706036 - DNA, 22 bp, Homo sapiens
tggcaccctgaagttggtcact

SEQ ID NO: 7706037 - DNA, 22 bp, Homo sapiens
tggcaccatgttggcaaatgtt

SEQ ID NO: 7706038 - DNA, 22 bp, Homo sapiens
tggcacctggtgcagggtggcc

SEQ ID NO: 7706039 - DNA, 22 bp, Homo sapiens
tggcacctggtgcagggtggcc

SEQ ID NO: 7706040 - DNA, 22 bp, Homo sapiens
tggcacctgaacttagaggtgt

SEQ ID NO: 7706041 - DNA, 22 bp, Homo sapiens
tggcacctgaacttagaggtgt

SEQ ID NO: 7706042 - DNA, 22 bp, Homo sapiens
tggcacctgaacttagaggtgt

SEQ ID NO: 7706043 - DNA, 22 bp, Homo sapiens
tggcactaagacggtgcttccc

SEQ ID NO: 7706044 - DNA, 22 bp, Homo sapiens
tggcacgacaattggcaccaat

SEQ ID NO: 7706045 - DNA, 22 bp, Homo sapiens
tggcacgacaattggcaccaat

SEQ ID NO: 7706046 - DNA, 22 bp, Homo sapiens
tggcacgacaattggcaccaat

SEQ ID NO: 7706047 - DNA, 22 bp, Homo sapiens
tggcacgacaattggcaccaat

SEQ ID NO: 7706048 - DNA, 22 bp, Homo sapiens
tggcacgacaattggcaccaat

SEQ ID NO: 7706049 - DNA, 22 bp, Homo sapiens
tggcacgacaattggcaccaat

SEQ ID NO: 7706050 - DNA, 22 bp, Homo sapiens
tggcacgacaattggcaccaat

SEQ ID NO: 7706051 - DNA, 22 bp, Homo sapiens
tggcacgacaattggcaccaat

SEQ ID NO: 7706052 - DNA, 20 bp, Homo sapiens
tggcacagaacccttgccta

SEQ ID NO: 7706053 - DNA, 20 bp, Homo sapiens
tggcacagaacccttgccta

SEQ ID NO: 7706054 - DNA, 22 bp, Homo sapiens
tggcacagacagatcaggagtc

SEQ ID NO: 7706055 - DNA, 20 bp, Homo sapiens
tggcacagaacccttgccta

SEQ ID NO: 7706056 - DNA, 22 bp, Homo sapiens
tggcacagacagatcaggagtc

SEQ ID NO: 7706057 - DNA, 22 bp, Homo sapiens
tggcacagacagatcaggagtc

SEQ ID NO: 7706058 - DNA, 20 bp, Homo sapiens
tggcacagaacccttgccta

SEQ ID NO: 7706059 - DNA, 22 bp, Homo sapiens
tggcacagacagatcaggagtc

SEQ ID NO: 7706060 - DNA, 22 bp, Homo sapiens
tggcacagacagatcaggagtc

SEQ ID NO: 7706061 - DNA, 22 bp, Homo sapiens
tggcacagacagatcaggagtc

SEQ ID NO: 7706062 - DNA, 22 bp, Homo sapiens
tggcacagaaaaatgctccatt

SEQ ID NO: 7706063 - DNA, 21 bp, Homo sapiens
tggcacagaaaggaaagttca

SEQ ID NO: 7706064 - DNA, 21 bp, Homo sapiens
tggcacagaaaggaaagttca

SEQ ID NO: 7706065 - DNA, 20 bp, Homo sapiens
tggcacagaacccttgccta

SEQ ID NO: 7706066 - DNA, 20 bp, Homo sapiens
tggcacagaacccttgccta

SEQ ID NO: 7706067 - DNA, 20 bp, Homo sapiens
tggcacagaacccttgccta

SEQ ID NO: 7706068 - DNA, 22 bp, Homo sapiens
tggcacagaaaaatgctccatt

SEQ ID NO: 7706069 - DNA, 22 bp, Homo sapiens
tggcacagacagcacagcaatg

SEQ ID NO: 7706070 - DNA, 22 bp, Homo sapiens
tggcacagacagcacagcaatg

SEQ ID NO: 7706071 - DNA, 22 bp, Homo sapiens
tggcacagacagcacagcaatg

SEQ ID NO: 7706072 - DNA, 22 bp, Homo sapiens
tggcacagacagcacagcaatg

SEQ ID NO: 7706073 - DNA, 22 bp, Homo sapiens
tggcacagacagcacagcaatg

SEQ ID NO: 7706074 - DNA, 22 bp, Homo sapiens
tggcacagacagatcaggagtc

SEQ ID NO: 7706075 - DNA, 22 bp, Homo sapiens
tggcacagacagatcaggagtc

SEQ ID NO: 7706076 - DNA, 22 bp, Homo sapiens
tggcacagacagatcaggagtc

SEQ ID NO: 7706077 - DNA, 22 bp, Homo sapiens
tggcacagacagatcaggagtc

SEQ ID NO: 7706078 - DNA, 22 bp, Homo sapiens
tggcacagacatttaatagcct

SEQ ID NO: 7706079 - DNA, 22 bp, Homo sapiens
tggcacagacagcacagcaatg

SEQ ID NO: 7706080 - DNA, 22 bp, Homo sapiens
tggcacagacagcacagcaatg

SEQ ID NO: 7706081 - DNA, 22 bp, Homo sapiens
tggcacagacagcacagcaatg

SEQ ID NO: 7706082 - DNA, 22 bp, Homo sapiens
tggcacagacagcacagcaatg

SEQ ID NO: 7706083 - DNA, 22 bp, Homo sapiens
tggcacagaccttatcttctct

SEQ ID NO: 7706084 - DNA, 22 bp, Homo sapiens
tggcacagaccttatcttctct

SEQ ID NO: 7706085 - DNA, 22 bp, Homo sapiens
tggcacagaccttatcttctct

SEQ ID NO: 7706086 - DNA, 22 bp, Homo sapiens
tggcacagaccttatcttctct

SEQ ID NO: 7706087 - DNA, 22 bp, Homo sapiens
tggcacagacatttaatagcct

SEQ ID NO: 7706088 - DNA, 21 bp, Homo sapiens
tggcaatggccaacagtcatc

SEQ ID NO: 7706089 - DNA, 22 bp, Homo sapiens
tggcaatgaggtcagatgtctt

SEQ ID NO: 7706090 - DNA, 22 bp, Homo sapiens
tggcaatgagcaggtgctctgg

SEQ ID NO: 7706091 - DNA, 22 bp, Homo sapiens
tggcaatgagcaggtgctctgg

SEQ ID NO: 7706092 - DNA, 22 bp, Homo sapiens
tggcaatattaacagtacttat

SEQ ID NO: 7706093 - DNA, 21 bp, Homo sapiens
tggcaatggccaacagtcatc

SEQ ID NO: 7706094 - DNA, 21 bp, Homo sapiens
tggcaatggccaacagtcatc

SEQ ID NO: 7706095 - DNA, 22 bp, Homo sapiens
tggcaatgtaaattgaactaga

SEQ ID NO: 7706096 - DNA, 22 bp, Homo sapiens
tggcaatgtaggcaagaacatt

SEQ ID NO: 7706097 - DNA, 22 bp, Homo sapiens
tggcaatgtggcatcaacgaag

SEQ ID NO: 7706098 - DNA, 22 bp, Homo sapiens
tggcaattcccttggtcaacag

SEQ ID NO: 7706099 - DNA, 22 bp, Homo sapiens
tggcaattcctgagctctgaga

SEQ ID NO: 7706100 - DNA, 22 bp, Homo sapiens
tggcaattcctgagctctgaga

SEQ ID NO: 7706101 - DNA, 22 bp, Homo sapiens
tggcaatgttagcaaagcattt

SEQ ID NO: 7706102 - DNA, 22 bp, Homo sapiens
tggcaattctctacctttctca

SEQ ID NO: 7706103 - DNA, 23 bp, Homo sapiens
tggcaattcctgagctctgagaa

SEQ ID NO: 7706104 - DNA, 23 bp, Homo sapiens
tggcaattcctgagctctgagaa

SEQ ID NO: 7706105 - DNA, 22 bp, Homo sapiens
tggcaattgtccactgtctgcc

SEQ ID NO: 7706106 - DNA, 22 bp, Homo sapiens
tggcaattggcaatttcgtatg

SEQ ID NO: 7706107 - DNA, 22 bp, Homo sapiens
tggcaattgtccactgtctgcc

SEQ ID NO: 7706108 - DNA, 22 bp, Homo sapiens
tggcaattttctagcagatggc

SEQ ID NO: 7706109 - DNA, 22 bp, Homo sapiens
tggcacaaaagtaattgcagtt

SEQ ID NO: 7706110 - DNA, 22 bp, Homo sapiens
tggcacaaaagtaattgcagtt

SEQ ID NO: 7706111 - DNA, 22 bp, Homo sapiens
tggcaatttgtagagtaaatta

SEQ ID NO: 7706112 - DNA, 22 bp, Homo sapiens
tggcaattttaggtggtttagt

SEQ ID NO: 7706113 - DNA, 22 bp, Homo sapiens
tggcaatttgtagagtaaatta

SEQ ID NO: 7706114 - DNA, 22 bp, Homo sapiens
tggcaatttcacatggcttaac

SEQ ID NO: 7706115 - DNA, 22 bp, Homo sapiens
tggcaatttcagaaaatagaat

SEQ ID NO: 7706116 - DNA, 22 bp, Homo sapiens
tggcaatttcagaaaatagaat

SEQ ID NO: 7706117 - DNA, 22 bp, Homo sapiens
tggcacagaaaaatgctccatt

SEQ ID NO: 7706118 - DNA, 22 bp, Homo sapiens
tggcacagaaaaatgctccatt

SEQ ID NO: 7706119 - DNA, 22 bp, Homo sapiens
tggcacacagagaagacacttg

SEQ ID NO: 7706120 - DNA, 22 bp, Homo sapiens
tggcacagaaaaatgctccatt

SEQ ID NO: 7706121 - DNA, 22 bp, Homo sapiens
tggcacagaaaaatgctccatt

SEQ ID NO: 7706122 - DNA, 22 bp, Homo sapiens
tggcacagaaaaatgctccatt

SEQ ID NO: 7706123 - DNA, 22 bp, Homo sapiens
tggcacaagggctattccttag

SEQ ID NO: 7706124 - DNA, 22 bp, Homo sapiens
tggcacacagagaagacacttg

SEQ ID NO: 7706125 - DNA, 22 bp, Homo sapiens
tggcacacagagaagacacttg

SEQ ID NO: 7706126 - DNA, 22 bp, Homo sapiens
tggcacagcttgtcataaactc

SEQ ID NO: 7706127 - DNA, 22 bp, Homo sapiens
tggcacagtgctggatggtgct

SEQ ID NO: 7706128 - DNA, 22 bp, Homo sapiens
tggcacagcctttaaagtacca

SEQ ID NO: 7706129 - DNA, 22 bp, Homo sapiens
tggcacagcctttaaagtacca

SEQ ID NO: 7706130 - DNA, 22 bp, Homo sapiens
tggcacagcccggattctatga

SEQ ID NO: 7706131 - DNA, 22 bp, Homo sapiens
tggcacagtgctggatggtgct

SEQ ID NO: 7706132 - DNA, 22 bp, Homo sapiens
tggcacagtgctggatggtgct

SEQ ID NO: 7706133 - DNA, 22 bp, Homo sapiens
tggcacagcccattcagagaag

SEQ ID NO: 7706134 - DNA, 22 bp, Homo sapiens
tggcacagcccattcagagaag

SEQ ID NO: 7706135 - DNA, 22 bp, Homo sapiens
tggcacagcccattcagagaag

SEQ ID NO: 7706136 - DNA, 22 bp, Homo sapiens
tggcacagcctccatgtcgtcc

SEQ ID NO: 7706137 - DNA, 22 bp, Homo sapiens
tggcacagcccggattctatga

SEQ ID NO: 7706138 - DNA, 22 bp, Homo sapiens
tggcacagcccggattctatga

SEQ ID NO: 7706139 - DNA, 22 bp, Homo sapiens
tggcacagcccattcagagaag

SEQ ID NO: 7706140 - DNA, 22 bp, Homo sapiens
tggcacagcccattcagagaag

SEQ ID NO: 7706141 - DNA, 22 bp, Homo sapiens
tggcacagcccattcagagaag

SEQ ID NO: 7706142 - DNA, 22 bp, Homo sapiens
tggcacagcccagagctcttga

SEQ ID NO: 7706143 - DNA, 22 bp, Homo sapiens
tggcacagcccagagctcttga

SEQ ID NO: 7706144 - DNA, 22 bp, Homo sapiens
tggcacagcccagagctcttga

SEQ ID NO: 7706145 - DNA, 22 bp, Homo sapiens
tggcacagccatcttctcctgc

SEQ ID NO: 7706146 - DNA, 22 bp, Homo sapiens
tggcacagccatcttctcctgc

SEQ ID NO: 7706147 - DNA, 22 bp, Homo sapiens
tggcacagccatcttctcctgc

SEQ ID NO: 7706148 - DNA, 22 bp, Homo sapiens
tggcacagccactgaatcggga

SEQ ID NO: 7706149 - DNA, 22 bp, Homo sapiens
tggcacagccactgaatcggga

SEQ ID NO: 7706150 - DNA, 22 bp, Homo sapiens
tggcacagccactgaatcggga

SEQ ID NO: 7706151 - DNA, 23 bp, Homo sapiens
tggcacagcaggtgtgctttgtt

SEQ ID NO: 7706152 - DNA, 23 bp, Homo sapiens
tggcacagcaggtgtgctttgtt

SEQ ID NO: 7706153 - DNA, 23 bp, Homo sapiens
tggcacagcaggtgtgctttgtt

SEQ ID NO: 7706154 - DNA, 23 bp, Homo sapiens
tggcacagcaggtgtgctttgtt

SEQ ID NO: 7706155 - DNA, 23 bp, Homo sapiens
tggcacagcaggtgtgctttgtt

SEQ ID NO: 7706156 - DNA, 21 bp, Homo sapiens
tggcacagcaagtgggctcat

SEQ ID NO: 7706157 - DNA, 21 bp, Homo sapiens
tggcacagcaagtgggctcat

SEQ ID NO: 7706158 - DNA, 21 bp, Homo sapiens
tggcacagcaagtgggctcat

SEQ ID NO: 7706159 - DNA, 21 bp, Homo sapiens
tggcacagcaagtgggctcat

SEQ ID NO: 7706160 - DNA, 22 bp, Homo sapiens
tggcacagagggacccagcagc

SEQ ID NO: 7706161 - DNA, 22 bp, Homo sapiens
tggcacagagggacccagcagc

SEQ ID NO: 7706162 - DNA, 22 bp, Homo sapiens
tggcacagagggacccagcagc

SEQ ID NO: 7706163 - DNA, 23 bp, Homo sapiens
tggcacagaggaccatgctttgc

SEQ ID NO: 7706164 - DNA, 16 bp, Homo sapiens
tggcacagagcagata

SEQ ID NO: 7706165 - DNA, 23 bp, Homo sapiens
tggcacagaggaccatgctttgc

SEQ ID NO: 7706166 - DNA, 22 bp, Homo sapiens
tggcacagactgggccaaggaa

SEQ ID NO: 7706167 - DNA, 22 bp, Homo sapiens
tggcacagactgggccaaggaa

SEQ ID NO: 7706168 - DNA, 22 bp, Homo sapiens
tggcacagactgggccaaggaa

SEQ ID NO: 7706169 - DNA, 22 bp, Homo sapiens
tggcacagactgggccaaggaa

SEQ ID NO: 7706170 - DNA, 22 bp, Homo sapiens
tggcacagactgggccaaggaa

SEQ ID NO: 7706171 - DNA, 22 bp, Homo sapiens
tggcacagactgggccaaggaa

SEQ ID NO: 7706172 - DNA, 22 bp, Homo sapiens
tggcacagactgggccaaggaa

SEQ ID NO: 7706173 - DNA, 22 bp, Homo sapiens
tggcacagactgggccaaggaa

SEQ ID NO: 7706174 - DNA, 22 bp, Homo sapiens
tggcacagactgggccaaggaa

SEQ ID NO: 7706175 - DNA, 22 bp, Homo sapiens
tggcacagactgggccaaggaa

SEQ ID NO: 7706176 - DNA, 22 bp, Homo sapiens
tggcacagactgggccaaggaa

SEQ ID NO: 7706177 - DNA, 22 bp, Homo sapiens
tggcacagactgggccaaggaa

SEQ ID NO: 7706178 - DNA, 17 bp, Homo sapiens
tggcacagaggtgctat

SEQ ID NO: 7706179 - DNA, 17 bp, Homo sapiens
tggcacagaggtgctat

SEQ ID NO: 7706180 - DNA, 17 bp, Homo sapiens
tggcacagaggtgctat

SEQ ID NO: 7706181 - DNA, 17 bp, Homo sapiens
tggcacagaggtgctat

SEQ ID NO: 7706182 - DNA, 17 bp, Homo sapiens
tggcacagaggtgctat

SEQ ID NO: 7706183 - DNA, 17 bp, Homo sapiens
tggcacagaggtgctat

SEQ ID NO: 7706184 - DNA, 17 bp, Homo sapiens
tggcacagaggtgctat

SEQ ID NO: 7706185 - DNA, 22 bp, Homo sapiens
tggcacagagggacccagcagc

SEQ ID NO: 7706186 - DNA, 22 bp, Homo sapiens
tggcacagagggacccagcagc

SEQ ID NO: 7706187 - DNA, 22 bp, Homo sapiens
tggcacagagggacccagcagc

SEQ ID NO: 7706188 - DNA, 22 bp, Homo sapiens
tggcacagagggacccagcagc

SEQ ID NO: 7706189 - DNA, 17 bp, Homo sapiens
tggcacagaggtgctat

SEQ ID NO: 7706190 - DNA, 17 bp, Homo sapiens
tggcacagaggtgctat

SEQ ID NO: 7706191 - DNA, 17 bp, Homo sapiens
tggcacagaggtgctat

SEQ ID NO: 7706192 - DNA, 17 bp, Homo sapiens
tggcacagaggtgctat

SEQ ID NO: 7706193 - DNA, 22 bp, Homo sapiens
tggcacagcaagagtttgggaa

SEQ ID NO: 7706194 - DNA, 19 bp, Homo sapiens
tggcacagatttcctccct

SEQ ID NO: 7706195 - DNA, 19 bp, Homo sapiens
tggcacagatttcctccct

SEQ ID NO: 7706196 - DNA, 21 bp, Homo sapiens
tggcacagcaagtgggctcat

SEQ ID NO: 7706197 - DNA, 21 bp, Homo sapiens
tggcacagcaagtgggctcat

SEQ ID NO: 7706198 - DNA, 22 bp, Homo sapiens
tggcacagcaagagtttgggaa

SEQ ID NO: 7706199 - DNA, 21 bp, Homo sapiens
tggcacagcaagtgggctcat

SEQ ID NO: 7706200 - DNA, 22 bp, Homo sapiens
tggattcaaatttcagctctgt

SEQ ID NO: 7706201 - DNA, 22 bp, Homo sapiens
tggattcacaccattctcctgc

SEQ ID NO: 7706202 - DNA, 22 bp, Homo sapiens
tggattcaaatttcagctctgt

SEQ ID NO: 7706203 - DNA, 22 bp, Homo sapiens
tggattattgtaagacaaagta

SEQ ID NO: 7706204 - DNA, 22 bp, Homo sapiens
tggattagttaagaaatgttag

SEQ ID NO: 7706205 - DNA, 22 bp, Homo sapiens
tggattagtttaacaatgtggc

SEQ ID NO: 7706206 - DNA, 22 bp, Homo sapiens
tggattagtttcaaggcagcaa

SEQ ID NO: 7706207 - DNA, 22 bp, Homo sapiens
tggatgtgtcgccctggctctc

SEQ ID NO: 7706208 - DNA, 17 bp, Homo sapiens
tggatgtgggatctgga

SEQ ID NO: 7706209 - DNA, 17 bp, Homo sapiens
tggatgtgggatctgga

SEQ ID NO: 7706210 - DNA, 22 bp, Homo sapiens
tggatgtgagaaggatcaggct

SEQ ID NO: 7706211 - DNA, 22 bp, Homo sapiens
tggatgtgtcgccctggctctc

SEQ ID NO: 7706212 - DNA, 22 bp, Homo sapiens
tggattaaagattaaaatgaca

SEQ ID NO: 7706213 - DNA, 22 bp, Homo sapiens
tggattagaactctgggtttaa

SEQ ID NO: 7706214 - DNA, 22 bp, Homo sapiens
tggatgggttgaaatgtgagcc

SEQ ID NO: 7706215 - DNA, 22 bp, Homo sapiens
tggatgggttgaaatgtgagcc

SEQ ID NO: 7706216 - DNA, 22 bp, Homo sapiens
tggatgggttgaaatgtgagcc

SEQ ID NO: 7706217 - DNA, 22 bp, Homo sapiens
tggatgggttgaaatgtgagcc

SEQ ID NO: 7706218 - DNA, 22 bp, Homo sapiens
tggatggggcagcttaggtgtg

SEQ ID NO: 7706219 - DNA, 22 bp, Homo sapiens
tggatgggttgaaatgtgagcc

SEQ ID NO: 7706220 - DNA, 22 bp, Homo sapiens
tggatggttctgggcggcagca

SEQ ID NO: 7706221 - DNA, 22 bp, Homo sapiens
tggatgggttgaaatgtgagcc

SEQ ID NO: 7706222 - DNA, 22 bp, Homo sapiens
tggatgggttgaaatgtgagcc

SEQ ID NO: 7706223 - DNA, 22 bp, Homo sapiens
tggatgggttgaaatgtgagcc

SEQ ID NO: 7706224 - DNA, 22 bp, Homo sapiens
tggatgtagatgctcttgctga

SEQ ID NO: 7706225 - DNA, 22 bp, Homo sapiens
tggatggttgaaaacgggcagt

SEQ ID NO: 7706226 - DNA, 22 bp, Homo sapiens
tggatggttctgggcggcagca

SEQ ID NO: 7706227 - DNA, 22 bp, Homo sapiens
tggatgtcatagttggatatac

SEQ ID NO: 7706228 - DNA, 20 bp, Homo sapiens
tggatgtcaaattaggctgg

SEQ ID NO: 7706229 - DNA, 22 bp, Homo sapiens
tggatgtcaaaggagtttccag

SEQ ID NO: 7706230 - DNA, 22 bp, Homo sapiens
tggatgtctcagcttgagctgc

SEQ ID NO: 7706231 - DNA, 22 bp, Homo sapiens
tggatgtgagaaggatcaggct

SEQ ID NO: 7706232 - DNA, 22 bp, Homo sapiens
tggatgtgagaaggatcaggct

SEQ ID NO: 7706233 - DNA, 22 bp, Homo sapiens
tggattctaatgcacttcaaat

SEQ ID NO: 7706234 - DNA, 22 bp, Homo sapiens
tggattctcatgggaccagtag

SEQ ID NO: 7706235 - DNA, 22 bp, Homo sapiens
tggattcacaccattctcctgc

SEQ ID NO: 7706236 - DNA, 22 bp, Homo sapiens
tggattcacaccattctcctgc

SEQ ID NO: 7706237 - DNA, 22 bp, Homo sapiens
tggattcacaccattctcctgc

SEQ ID NO: 7706238 - DNA, 22 bp, Homo sapiens
tggattcacaccattctcctgc

SEQ ID NO: 7706239 - DNA, 22 bp, Homo sapiens
tggattctgggagagttctata

SEQ ID NO: 7706240 - DNA, 22 bp, Homo sapiens
tggattctgggagagttctata

SEQ ID NO: 7706241 - DNA, 18 bp, Homo sapiens
tggattgaattgagaggt

SEQ ID NO: 7706242 - DNA, 22 bp, Homo sapiens
tggattctgggctgtttgcatt

SEQ ID NO: 7706243 - DNA, 22 bp, Homo sapiens
tggattgataaaatgggatgtt

SEQ ID NO: 7706244 - DNA, 22 bp, Homo sapiens
tggattgaattaacacctccca

SEQ ID NO: 7706245 - DNA, 22 bp, Homo sapiens
tggattgataagagacaagtga

SEQ ID NO: 7706246 - DNA, 22 bp, Homo sapiens
tggattgataaaatgggatgtt

SEQ ID NO: 7706247 - DNA, 22 bp, Homo sapiens
tggatttcagcaagggtgggtg

SEQ ID NO: 7706248 - DNA, 22 bp, Homo sapiens
tggatttcagcaagggtgggtg

SEQ ID NO: 7706249 - DNA, 22 bp, Homo sapiens
tggatttcagcatatggatttt

SEQ ID NO: 7706250 - DNA, 22 bp, Homo sapiens
tggatttattaggttggtgaaa

SEQ ID NO: 7706251 - DNA, 22 bp, Homo sapiens
tggatttgagatgtgttcagat

SEQ ID NO: 7706252 - DNA, 21 bp, Homo sapiens
tggatttgagcagtgcctcgg

SEQ ID NO: 7706253 - DNA, 22 bp, Homo sapiens
tggatttgctaccttctgatat

SEQ ID NO: 7706254 - DNA, 22 bp, Homo sapiens
tggattgcacctctgcccggaa

SEQ ID NO: 7706255 - DNA, 22 bp, Homo sapiens
tggattgcagcagctcctgtgg

SEQ ID NO: 7706256 - DNA, 22 bp, Homo sapiens
tggattgcagcagctcctgtgg

SEQ ID NO: 7706257 - DNA, 22 bp, Homo sapiens
tggatttaacagaataccaggt

SEQ ID NO: 7706258 - DNA, 22 bp, Homo sapiens
tggatttagttcttcacaggcc

SEQ ID NO: 7706259 - DNA, 22 bp, Homo sapiens
tggcaaagacgctagctaagat

SEQ ID NO: 7706260 - DNA, 22 bp, Homo sapiens
tggcaaaatgagcaattacttt

SEQ ID NO: 7706261 - DNA, 22 bp, Homo sapiens
tggcaaactggaggaagccctg

SEQ ID NO: 7706262 - DNA, 22 bp, Homo sapiens
tggcaaaagttttaggttattt

SEQ ID NO: 7706263 - DNA, 22 bp, Homo sapiens
tggcaaaatgagcaattacttt

SEQ ID NO: 7706264 - DNA, 22 bp, Homo sapiens
tggcaaagacgctagctaagat

SEQ ID NO: 7706265 - DNA, 22 bp, Homo sapiens
tggatttgggagcctttccttc

SEQ ID NO: 7706266 - DNA, 22 bp, Homo sapiens
tggattttagcatgtaactgtg

SEQ ID NO: 7706267 - DNA, 22 bp, Homo sapiens
tggattttagcatgtaactgtg

SEQ ID NO: 7706268 - DNA, 22 bp, Homo sapiens
tggattttagcatgtaactgtg

SEQ ID NO: 7706269 - DNA, 22 bp, Homo sapiens
tggcaaaacccacaattatatc

SEQ ID NO: 7706270 - DNA, 22 bp, Homo sapiens
tggcaaaacccacaattatatc

SEQ ID NO: 7706271 - DNA, 22 bp, Homo sapiens
tggcaaaacccacaattatatc

SEQ ID NO: 7706272 - DNA, 22 bp, Homo sapiens
tggcaaaagttttaggttattt

SEQ ID NO: 7706273 - DNA, 23 bp, Homo sapiens
tggcaaagcattcttataacagt

SEQ ID NO: 7706274 - DNA, 22 bp, Homo sapiens
tggcaaaggaaatgatttaaga

SEQ ID NO: 7706275 - DNA, 22 bp, Homo sapiens
tggcaaagattaccacatctac

SEQ ID NO: 7706276 - DNA, 23 bp, Homo sapiens
tggcaaagcattcttataacagt

SEQ ID NO: 7706277 - DNA, 22 bp, Homo sapiens
tggcaaaggggaccatgttgaa

SEQ ID NO: 7706278 - DNA, 22 bp, Homo sapiens
tggcaaaggcgctcacatgcct

SEQ ID NO: 7706279 - DNA, 22 bp, Homo sapiens
tggcaaaggaacctattttaaa

SEQ ID NO: 7706280 - DNA, 22 bp, Homo sapiens
tggcaaaggaaatgatttaaga

SEQ ID NO: 7706281 - DNA, 22 bp, Homo sapiens
tggcaaaggcgctcacatgcct

SEQ ID NO: 7706282 - DNA, 22 bp, Homo sapiens
tggcaacatgtcgaagtgctgt

SEQ ID NO: 7706283 - DNA, 22 bp, Homo sapiens
tggcaacatgtcgaagtgctgt

SEQ ID NO: 7706284 - DNA, 22 bp, Homo sapiens
tggcaacatgtcgaagtgctgt

SEQ ID NO: 7706285 - DNA, 22 bp, Homo sapiens
tggcaacatgtcgaagtgctgt

SEQ ID NO: 7706286 - DNA, 22 bp, Homo sapiens
tggcaacatggacaggtctgcc

SEQ ID NO: 7706287 - DNA, 22 bp, Homo sapiens
tggcaacatggacaggtctgcc

SEQ ID NO: 7706288 - DNA, 22 bp, Homo sapiens
tggcaacatggacaggtctgcc

SEQ ID NO: 7706289 - DNA, 22 bp, Homo sapiens
tggcaacacctggaagacatgg

SEQ ID NO: 7706290 - DNA, 22 bp, Homo sapiens
tggcaacacctggaagacatgg

SEQ ID NO: 7706291 - DNA, 22 bp, Homo sapiens
tggcaacacctggaagacatgg

SEQ ID NO: 7706292 - DNA, 22 bp, Homo sapiens
tggcaacacctggaagacatgg

SEQ ID NO: 7706293 - DNA, 22 bp, Homo sapiens
tggcaacaagaaaggcagaggg

SEQ ID NO: 7706294 - DNA, 22 bp, Homo sapiens
tggcaacaagaaaggcagaggg

SEQ ID NO: 7706295 - DNA, 22 bp, Homo sapiens
tggcaacaagaaaggcagaggg

SEQ ID NO: 7706296 - DNA, 22 bp, Homo sapiens
tggcaacaagaaaggcagaggg

SEQ ID NO: 7706297 - DNA, 22 bp, Homo sapiens
tggcaacaagaaaggcagaggg

SEQ ID NO: 7706298 - DNA, 22 bp, Homo sapiens
tggcaaattttggcaagctgaa

SEQ ID NO: 7706299 - DNA, 22 bp, Homo sapiens
tggcaaattttggcaagctgaa

SEQ ID NO: 7706300 - DNA, 22 bp, Homo sapiens
tggcaaattccaaagttaattc

SEQ ID NO: 7706301 - DNA, 22 bp, Homo sapiens
tggcaaattccaaagttaattc

SEQ ID NO: 7706302 - DNA, 22 bp, Homo sapiens
tggcaaagtatctgtcccagct

SEQ ID NO: 7706303 - DNA, 22 bp, Homo sapiens
tggcaaagtttatcaggaatat

SEQ ID NO: 7706304 - DNA, 22 bp, Homo sapiens
tggcaaagtgactccttggggc

SEQ ID NO: 7706305 - DNA, 22 bp, Homo sapiens
tggcaatataatcatctgctct

SEQ ID NO: 7706306 - DNA, 22 bp, Homo sapiens
tggcaatatccacaattacttt

SEQ ID NO: 7706307 - DNA, 22 bp, Homo sapiens
tggcaatatgctttcagtggcc

SEQ ID NO: 7706308 - DNA, 22 bp, Homo sapiens
tggcaatattaacagtacttat

SEQ ID NO: 7706309 - DNA, 22 bp, Homo sapiens
tggcaataattgtaattcaatt

SEQ ID NO: 7706310 - DNA, 22 bp, Homo sapiens
tggcaataaatacatctgggca

SEQ ID NO: 7706311 - DNA, 22 bp, Homo sapiens
tggcaatacataatcttaatgg

SEQ ID NO: 7706312 - DNA, 23 bp, Homo sapiens
tggcaagtttgactttcctttac

SEQ ID NO: 7706313 - DNA, 22 bp, Homo sapiens
tggcaactcctgactctactca

SEQ ID NO: 7706314 - DNA, 22 bp, Homo sapiens
tggcaactcctgactctactca

SEQ ID NO: 7706315 - DNA, 22 bp, Homo sapiens
tggcaagttggtgggtttagtg

SEQ ID NO: 7706316 - DNA, 23 bp, Homo sapiens
tggcaactagtggtgaagagcct

SEQ ID NO: 7706317 - DNA, 22 bp, Homo sapiens
tggcaaccgcatggcctgcttc

SEQ ID NO: 7706318 - DNA, 22 bp, Homo sapiens
tggcaacatgtcgaagtgctgt

SEQ ID NO: 7706319 - DNA, 22 bp, Homo sapiens
tggcaacatgtcgaagtgctgt

SEQ ID NO: 7706320 - DNA, 20 bp, Homo sapiens
tggcaggaatagggccagag

SEQ ID NO: 7706321 - DNA, 20 bp, Homo sapiens
tggcaggaatagggccagag

SEQ ID NO: 7706322 - DNA, 20 bp, Homo sapiens
tggcaggaatagggccagag

SEQ ID NO: 7706323 - DNA, 20 bp, Homo sapiens
tggcaggaatagggccagag

SEQ ID NO: 7706324 - DNA, 20 bp, Homo sapiens
tggcaggaatagggccagag

SEQ ID NO: 7706325 - DNA, 20 bp, Homo sapiens
tggcaggaatagggccagag

SEQ ID NO: 7706326 - DNA, 20 bp, Homo sapiens
tggcaggaatagggccagag

SEQ ID NO: 7706327 - DNA, 22 bp, Homo sapiens
tggcaggaaggagactcagccc

SEQ ID NO: 7706328 - DNA, 22 bp, Homo sapiens
tggcaggaaggagactcagccc

SEQ ID NO: 7706329 - DNA, 22 bp, Homo sapiens
tggcaggaaggagactcagccc

SEQ ID NO: 7706330 - DNA, 22 bp, Homo sapiens
tggcaggaaggagactcagccc

SEQ ID NO: 7706331 - DNA, 22 bp, Homo sapiens
tggcaggaaggagactcagccc

SEQ ID NO: 7706332 - DNA, 22 bp, Homo sapiens
tggcaggaaggagactcagccc

SEQ ID NO: 7706333 - DNA, 22 bp, Homo sapiens
tggcaggaagcatctataggtc

SEQ ID NO: 7706334 - DNA, 22 bp, Homo sapiens
tggcaggaagcatctataggtc

SEQ ID NO: 7706335 - DNA, 22 bp, Homo sapiens
tggcaggaagacgtggggcacc

SEQ ID NO: 7706336 - DNA, 22 bp, Homo sapiens
tggcaggaagcatctataggtc

SEQ ID NO: 7706337 - DNA, 22 bp, Homo sapiens
tggcaggaagcatctataggtc

SEQ ID NO: 7706338 - DNA, 22 bp, Homo sapiens
tggcaggaagcatctataggtc

SEQ ID NO: 7706339 - DNA, 22 bp, Homo sapiens
tggcaggaagcatctataggtc

SEQ ID NO: 7706340 - DNA, 22 bp, Homo sapiens
tggcaggaagacgtggggcacc

SEQ ID NO: 7706341 - DNA, 22 bp, Homo sapiens
tggcaggaagacgtggggcacc

SEQ ID NO: 7706342 - DNA, 22 bp, Homo sapiens
tggcaggagagcgtcagatcag

SEQ ID NO: 7706343 - DNA, 22 bp, Homo sapiens
tggcaggagagcgtcagatcag

SEQ ID NO: 7706344 - DNA, 22 bp, Homo sapiens
tggcaggagagcgtcagatcag

SEQ ID NO: 7706345 - DNA, 22 bp, Homo sapiens
tggcaggagagcgtcagatcag

SEQ ID NO: 7706346 - DNA, 22 bp, Homo sapiens
tggcaggagagcgtcagatcag

SEQ ID NO: 7706347 - DNA, 22 bp, Homo sapiens
tggcaggagagcgtcagatcag

SEQ ID NO: 7706348 - DNA, 22 bp, Homo sapiens
tggcaggagacacatggcatag

SEQ ID NO: 7706349 - DNA, 22 bp, Homo sapiens
tggcaggagacacatggcatag

SEQ ID NO: 7706350 - DNA, 22 bp, Homo sapiens
tggcaggagacacatggcatag

SEQ ID NO: 7706351 - DNA, 22 bp, Homo sapiens
tggcaggagacacatggcatag

SEQ ID NO: 7706352 - DNA, 22 bp, Homo sapiens
tggcaggagacacatggcatag

SEQ ID NO: 7706353 - DNA, 22 bp, Homo sapiens
tggcaggagacacatggcatag

SEQ ID NO: 7706354 - DNA, 20 bp, Homo sapiens
tggcaggactggctccaccc

SEQ ID NO: 7706355 - DNA, 20 bp, Homo sapiens
tggcaggactggctccaccc

SEQ ID NO: 7706356 - DNA, 20 bp, Homo sapiens
tggcaggactggctccaccc

SEQ ID NO: 7706357 - DNA, 20 bp, Homo sapiens
tggcaggaatagggccagag

SEQ ID NO: 7706358 - DNA, 20 bp, Homo sapiens
tggcaggaatagggccagag

SEQ ID NO: 7706359 - DNA, 20 bp, Homo sapiens
tggcaggactggctccaccc

SEQ ID NO: 7706360 - DNA, 20 bp, Homo sapiens
tggcaggactggctccaccc

SEQ ID NO: 7706361 - DNA, 20 bp, Homo sapiens
tggcaggaggcagcagtgga

SEQ ID NO: 7706362 - DNA, 20 bp, Homo sapiens
tggcaggaggcagcagtgga

SEQ ID NO: 7706363 - DNA, 20 bp, Homo sapiens
tggcaggaggcagcagtgga

SEQ ID NO: 7706364 - DNA, 20 bp, Homo sapiens
tggcaggaggcagcagtgga

SEQ ID NO: 7706365 - DNA, 20 bp, Homo sapiens
tggcaggaggcagcagtgga

SEQ ID NO: 7706366 - DNA, 20 bp, Homo sapiens
tggcaggaggcagcagtgga

SEQ ID NO: 7706367 - DNA, 20 bp, Homo sapiens
tggcaggaggcagcagtgga

SEQ ID NO: 7706368 - DNA, 20 bp, Homo sapiens
tggcaggaggcagcagtgga

SEQ ID NO: 7706369 - DNA, 20 bp, Homo sapiens
tggcaggaggcagcagtgga

SEQ ID NO: 7706370 - DNA, 20 bp, Homo sapiens
tggcaggaggcagcagtgga

SEQ ID NO: 7706371 - DNA, 20 bp, Homo sapiens
tggcaggaggcagcagtgga

SEQ ID NO: 7706372 - DNA, 22 bp, Homo sapiens
tggcaggaggttttctccagga

SEQ ID NO: 7706373 - DNA, 20 bp, Homo sapiens
tggcaggaggcagcagtgga

SEQ ID NO: 7706374 - DNA, 22 bp, Homo sapiens
tggcaggaggttttctccagga

SEQ ID NO: 7706375 - DNA, 22 bp, Homo sapiens
tggcaggaggttttctccagga

SEQ ID NO: 7706376 - DNA, 22 bp, Homo sapiens
tggcaggaggttttctccagga

SEQ ID NO: 7706377 - DNA, 22 bp, Homo sapiens
tggcaggaggttttctccagga

SEQ ID NO: 7706378 - DNA, 22 bp, Homo sapiens
tggcaggatctttgagagtgaa

SEQ ID NO: 7706379 - DNA, 22 bp, Homo sapiens
tggcaggatctttgagagtgaa

SEQ ID NO: 7706380 - DNA, 20 bp, Homo sapiens
tggcaggagccactggaagc

SEQ ID NO: 7706381 - DNA, 22 bp, Homo sapiens
tggcaggagcctgcggggaggt

SEQ ID NO: 7706382 - DNA, 22 bp, Homo sapiens
tggcaggagcctgcggggaggt

SEQ ID NO: 7706383 - DNA, 22 bp, Homo sapiens
tggcaggagcctgcggggaggt

SEQ ID NO: 7706384 - DNA, 22 bp, Homo sapiens
tggcaggagcctgcggggaggt

SEQ ID NO: 7706385 - DNA, 22 bp, Homo sapiens
tggcaggagcctgcggggaggt

SEQ ID NO: 7706386 - DNA, 22 bp, Homo sapiens
tggcaggagcctgcggggaggt

SEQ ID NO: 7706387 - DNA, 22 bp, Homo sapiens
tggcaggagcctgcggggaggt

SEQ ID NO: 7706388 - DNA, 20 bp, Homo sapiens
tggcaggagccactggaagc

SEQ ID NO: 7706389 - DNA, 20 bp, Homo sapiens
tggcaggagccactggaagc

SEQ ID NO: 7706390 - DNA, 20 bp, Homo sapiens
tggcaggagccactggaagc

SEQ ID NO: 7706391 - DNA, 20 bp, Homo sapiens
tggcaggagccactggaagc

SEQ ID NO: 7706392 - DNA, 20 bp, Homo sapiens
tggcaggagccactggaagc

SEQ ID NO: 7706393 - DNA, 20 bp, Homo sapiens
tggcaggagccactggaagc

SEQ ID NO: 7706394 - DNA, 20 bp, Homo sapiens
tggcaggagccactggaagc

SEQ ID NO: 7706395 - DNA, 22 bp, Homo sapiens
tggcaggaggatgaggcggcta

SEQ ID NO: 7706396 - DNA, 22 bp, Homo sapiens
tggcaggaggatgaggcggcta

SEQ ID NO: 7706397 - DNA, 22 bp, Homo sapiens
tggcaggaggatgaggcggcta

SEQ ID NO: 7706398 - DNA, 22 bp, Homo sapiens
tggcaggagcctgcggggaggt

SEQ ID NO: 7706399 - DNA, 22 bp, Homo sapiens
tggcaggaggatgaggcggcta

SEQ ID NO: 7706400 - DNA, 22 bp, Homo sapiens
tggcaggaggatgaggcggcta

SEQ ID NO: 7706401 - DNA, 22 bp, Homo sapiens
tggcaggaggatgaggcggcta

SEQ ID NO: 7706402 - DNA, 22 bp, Homo sapiens
tggcaggaggatgaggcggcta

SEQ ID NO: 7706403 - DNA, 22 bp, Homo sapiens
tggcaggaggatgaggcggcta

SEQ ID NO: 7706404 - DNA, 22 bp, Homo sapiens
tggcaggaggatgaggcggcta

SEQ ID NO: 7706405 - DNA, 22 bp, Homo sapiens
tggcaggaggatgaggcggcta

SEQ ID NO: 7706406 - DNA, 23 bp, Homo sapiens
tggcaggaaatgagaatgttcct

SEQ ID NO: 7706407 - DNA, 23 bp, Homo sapiens
tggcaggaaatgagaatgttcct

SEQ ID NO: 7706408 - DNA, 23 bp, Homo sapiens
tggcaggaaatgagaatgttcct

SEQ ID NO: 7706409 - DNA, 23 bp, Homo sapiens
tggcaggaaatgagaatgttcct

SEQ ID NO: 7706410 - DNA, 22 bp, Homo sapiens
tggcaggaaataccctgcctag

SEQ ID NO: 7706411 - DNA, 18 bp, Homo sapiens
tggcaggaaatgcacttt

SEQ ID NO: 7706412 - DNA, 23 bp, Homo sapiens
tggcaggaaatgagaatgttcct

SEQ ID NO: 7706413 - DNA, 23 bp, Homo sapiens
tggcaggaaatgagaatgttcct

SEQ ID NO: 7706414 - DNA, 22 bp, Homo sapiens
tggcaggaaataccctgcctag

SEQ ID NO: 7706415 - DNA, 22 bp, Homo sapiens
tggcaggaaataccctgcctag

SEQ ID NO: 7706416 - DNA, 22 bp, Homo sapiens
tggcaggaaataccctgcctag

SEQ ID NO: 7706417 - DNA, 22 bp, Homo sapiens
tggcaggaaataccctgcctag

SEQ ID NO: 7706418 - DNA, 22 bp, Homo sapiens
tggcaggaaataccctgcctag

SEQ ID NO: 7706419 - DNA, 22 bp, Homo sapiens
tggcaggaaataccctgcctag

SEQ ID NO: 7706420 - DNA, 22 bp, Homo sapiens
tggcaggaaataccctgcctag

SEQ ID NO: 7706421 - DNA, 22 bp, Homo sapiens
tggcaggaaataccctgcctag

SEQ ID NO: 7706422 - DNA, 22 bp, Homo sapiens
tggcaggaaagtaacagagcac

SEQ ID NO: 7706423 - DNA, 22 bp, Homo sapiens
tggcaggaaagtaacagagcac

SEQ ID NO: 7706424 - DNA, 22 bp, Homo sapiens
tggcaggaaagtaacagagcac

SEQ ID NO: 7706425 - DNA, 22 bp, Homo sapiens
tggcaggaaagtaacagagcac

SEQ ID NO: 7706426 - DNA, 22 bp, Homo sapiens
tggcaggaaagtaacagagcac

SEQ ID NO: 7706427 - DNA, 22 bp, Homo sapiens
tggcaggaaagtaacagagcac

SEQ ID NO: 7706428 - DNA, 22 bp, Homo sapiens
tggcaggaaagtaacagagcac

SEQ ID NO: 7706429 - DNA, 22 bp, Homo sapiens
tggcaggaaaaagggccagagg

SEQ ID NO: 7706430 - DNA, 22 bp, Homo sapiens
tggcaggaaagtaacagagcac

SEQ ID NO: 7706431 - DNA, 22 bp, Homo sapiens
tggcaggaagacgtggggcacc

SEQ ID NO: 7706432 - DNA, 22 bp, Homo sapiens
tggcaggaagacgtggggcacc

SEQ ID NO: 7706433 - DNA, 22 bp, Homo sapiens
tggcaggaagacgtggggcacc

SEQ ID NO: 7706434 - DNA, 22 bp, Homo sapiens
tggcaggaagacgtggggcacc

SEQ ID NO: 7706435 - DNA, 22 bp, Homo sapiens
tggcaggaagacgtggggcacc

SEQ ID NO: 7706436 - DNA, 22 bp, Homo sapiens
tggcaggaagacgtggggcacc

SEQ ID NO: 7706437 - DNA, 22 bp, Homo sapiens
tggcaggaagacgtggggcacc

SEQ ID NO: 7706438 - DNA, 22 bp, Homo sapiens
tggcaggaaccttaaccacaaa

SEQ ID NO: 7706439 - DNA, 22 bp, Homo sapiens
tggcaggaaccttaaccacaaa

SEQ ID NO: 7706440 - DNA, 22 bp, Homo sapiens
tggcaggaaccttaaccacaaa

SEQ ID NO: 7706441 - DNA, 22 bp, Homo sapiens
tggcaggaaccttaaccacaaa

SEQ ID NO: 7706442 - DNA, 22 bp, Homo sapiens
tggcaggaaccttaaccacaaa

SEQ ID NO: 7706443 - DNA, 22 bp, Homo sapiens
tggcaggaaccaggaggctctc

SEQ ID NO: 7706444 - DNA, 22 bp, Homo sapiens
tggcaggaaccaggaggctctc

SEQ ID NO: 7706445 - DNA, 22 bp, Homo sapiens
tggcaggaaccaggaggctctc

SEQ ID NO: 7706446 - DNA, 22 bp, Homo sapiens
tggcaggaaccaggaggctctc

SEQ ID NO: 7706447 - DNA, 22 bp, Homo sapiens
tggcaggaaccaggaggctctc

SEQ ID NO: 7706448 - DNA, 22 bp, Homo sapiens
tggcaggaaccaggaggctctc

SEQ ID NO: 7706449 - DNA, 22 bp, Homo sapiens
tggcaggaaccaggaggctctc

SEQ ID NO: 7706450 - DNA, 18 bp, Homo sapiens
tggcaggaaatgcacttt

SEQ ID NO: 7706451 - DNA, 18 bp, Homo sapiens
tggcaggaaatgcacttt

SEQ ID NO: 7706452 - DNA, 18 bp, Homo sapiens
tggcaggaaatgcacttt

SEQ ID NO: 7706453 - DNA, 18 bp, Homo sapiens
tggcaggaaatgcacttt

SEQ ID NO: 7706454 - DNA, 18 bp, Homo sapiens
tggcaggaaatgcacttt

SEQ ID NO: 7706455 - DNA, 22 bp, Homo sapiens
tggcaggaaccaggaggctctc

SEQ ID NO: 7706456 - DNA, 18 bp, Homo sapiens
tggcaggaaatgcacttt

SEQ ID NO: 7706457 - DNA, 22 bp, Homo sapiens
tggcagctgaggggaggctttg

SEQ ID NO: 7706458 - DNA, 22 bp, Homo sapiens
tggcagctgaggggaggctttg

SEQ ID NO: 7706459 - DNA, 22 bp, Homo sapiens
tggcagctgagtgcaccccctc

SEQ ID NO: 7706460 - DNA, 22 bp, Homo sapiens
tggcagctgaggggaggctttg

SEQ ID NO: 7706461 - DNA, 22 bp, Homo sapiens
tggcagctgaggggaggctttg

SEQ ID NO: 7706462 - DNA, 22 bp, Homo sapiens
tggcagctgattagatggtgcc

SEQ ID NO: 7706463 - DNA, 22 bp, Homo sapiens
tggcagctgattagatggtgcc

SEQ ID NO: 7706464 - DNA, 22 bp, Homo sapiens
tggcagctgagtgcaccccctc

SEQ ID NO: 7706465 - DNA, 22 bp, Homo sapiens
tggcagctgattagatggtgcc

SEQ ID NO: 7706466 - DNA, 22 bp, Homo sapiens
tggcagctgattagatggtgcc

SEQ ID NO: 7706467 - DNA, 22 bp, Homo sapiens
tggcagctgattagatggtgcc

SEQ ID NO: 7706468 - DNA, 22 bp, Homo sapiens
tggcagctctgttcaacatgag

SEQ ID NO: 7706469 - DNA, 22 bp, Homo sapiens
tggcagctctgttcaacatgag

SEQ ID NO: 7706470 - DNA, 22 bp, Homo sapiens
tggcagctctgttcaacatgag

SEQ ID NO: 7706471 - DNA, 22 bp, Homo sapiens
tggcagctctgttcaacatgag

SEQ ID NO: 7706472 - DNA, 22 bp, Homo sapiens
tggcagctctgttcaacatgag

SEQ ID NO: 7706473 - DNA, 22 bp, Homo sapiens
tggcagctctgttcaacatgag

SEQ ID NO: 7706474 - DNA, 17 bp, Homo sapiens
tggcagctgaaagctct

SEQ ID NO: 7706475 - DNA, 17 bp, Homo sapiens
tggcagctgaaagctct

SEQ ID NO: 7706476 - DNA, 22 bp, Homo sapiens
tggcagctgaatggctggatgg

SEQ ID NO: 7706477 - DNA, 22 bp, Homo sapiens
tggcagctgaatggctggatgg

SEQ ID NO: 7706478 - DNA, 22 bp, Homo sapiens
tggcagctgaatggctggatgg

SEQ ID NO: 7706479 - DNA, 22 bp, Homo sapiens
tggcagctgaggggaggctttg

SEQ ID NO: 7706480 - DNA, 22 bp, Homo sapiens
tggcagctgcaggcctcctgag

SEQ ID NO: 7706481 - DNA, 22 bp, Homo sapiens
tggcagctgcaggcctcctgag

SEQ ID NO: 7706482 - DNA, 22 bp, Homo sapiens
tggcagctgcaggcctcctgag

SEQ ID NO: 7706483 - DNA, 22 bp, Homo sapiens
tggcagctgcaggcctcctgag

SEQ ID NO: 7706484 - DNA, 22 bp, Homo sapiens
tggcagctgcaggcctcctgag

SEQ ID NO: 7706485 - DNA, 22 bp, Homo sapiens
tggcagctgcaggcctcctgag

SEQ ID NO: 7706486 - DNA, 22 bp, Homo sapiens
tggcagctgcaggcctcctgag

SEQ ID NO: 7706487 - DNA, 22 bp, Homo sapiens
tggcagctgccatgtccacgtg

SEQ ID NO: 7706488 - DNA, 22 bp, Homo sapiens
tggcagctgccatgtccacgtg

SEQ ID NO: 7706489 - DNA, 22 bp, Homo sapiens
tggcagctgccatgtccacgtg

SEQ ID NO: 7706490 - DNA, 22 bp, Homo sapiens
tggcagctgccatgtccacgtg

SEQ ID NO: 7706491 - DNA, 22 bp, Homo sapiens
tggcagctgccatgtccacgtg

SEQ ID NO: 7706492 - DNA, 22 bp, Homo sapiens
tggcagctgcaggcctcctgag

SEQ ID NO: 7706493 - DNA, 22 bp, Homo sapiens
tggcaggaaaaagggccagagg

SEQ ID NO: 7706494 - DNA, 22 bp, Homo sapiens
tggcaggaaaaagggccagagg

SEQ ID NO: 7706495 - DNA, 22 bp, Homo sapiens
tggcagctgcgttgtgtttctg

SEQ ID NO: 7706496 - DNA, 22 bp, Homo sapiens
tggcagctgcgttgtgtttctg

SEQ ID NO: 7706497 - DNA, 22 bp, Homo sapiens
tggcagctggagggcaatggcc

SEQ ID NO: 7706498 - DNA, 22 bp, Homo sapiens
tggcagctgcgttgtgtttctg

SEQ ID NO: 7706499 - DNA, 22 bp, Homo sapiens
tggcaggaaaaagggccagagg

SEQ ID NO: 7706500 - DNA, 22 bp, Homo sapiens
tggcaggaaagtaacagagcac

SEQ ID NO: 7706501 - DNA, 22 bp, Homo sapiens
tggcaggaaaaagggccagagg

SEQ ID NO: 7706502 - DNA, 22 bp, Homo sapiens
tggcaggaaaaagggccagagg

SEQ ID NO: 7706503 - DNA, 22 bp, Homo sapiens
tggcaggcaagttcagctccac

SEQ ID NO: 7706504 - DNA, 22 bp, Homo sapiens
tggcaggcaagttcagctccac

SEQ ID NO: 7706505 - DNA, 22 bp, Homo sapiens
tggcaggcaagttcagctccac

SEQ ID NO: 7706506 - DNA, 22 bp, Homo sapiens
tggcaggcaagttcagctccac

SEQ ID NO: 7706507 - DNA, 21 bp, Homo sapiens
tggcaggcagctggaagcttg

SEQ ID NO: 7706508 - DNA, 22 bp, Homo sapiens
tggcaggcagagagcggccttt

SEQ ID NO: 7706509 - DNA, 22 bp, Homo sapiens
tggcaggcagagagcggccttt

SEQ ID NO: 7706510 - DNA, 22 bp, Homo sapiens
tggcaggcagagagcggccttt

SEQ ID NO: 7706511 - DNA, 22 bp, Homo sapiens
tggcaggcagagagcggccttt

SEQ ID NO: 7706512 - DNA, 22 bp, Homo sapiens
tggcaggatctttgagagtgaa

SEQ ID NO: 7706513 - DNA, 22 bp, Homo sapiens
tggcaggatctttgagagtgaa

SEQ ID NO: 7706514 - DNA, 22 bp, Homo sapiens
tggcaggatctttgagagtgaa

SEQ ID NO: 7706515 - DNA, 22 bp, Homo sapiens
tggcaggatctttgagagtgaa

SEQ ID NO: 7706516 - DNA, 22 bp, Homo sapiens
tggcaggatctttgagagtgaa

SEQ ID NO: 7706517 - DNA, 22 bp, Homo sapiens
tggcaggatctttgagagtgaa

SEQ ID NO: 7706518 - DNA, 22 bp, Homo sapiens
tggcaggatctttgagagtgaa

SEQ ID NO: 7706519 - DNA, 22 bp, Homo sapiens
tggcaggaggttttctccagga

SEQ ID NO: 7706520 - DNA, 22 bp, Homo sapiens
tggcaggatctttgagagtgaa

SEQ ID NO: 7706521 - DNA, 22 bp, Homo sapiens
tggcaggatttgcccggaagga

SEQ ID NO: 7706522 - DNA, 22 bp, Homo sapiens
tggcaggatttgcccggaagga

SEQ ID NO: 7706523 - DNA, 22 bp, Homo sapiens
tggcaggatttgcccggaagga

SEQ ID NO: 7706524 - DNA, 22 bp, Homo sapiens
tggcaggatttgcccggaagga

SEQ ID NO: 7706525 - DNA, 22 bp, Homo sapiens
tggcaggatttgcccggaagga

SEQ ID NO: 7706526 - DNA, 21 bp, Homo sapiens
tggcaggcagctggaagcttg

SEQ ID NO: 7706527 - DNA, 22 bp, Homo sapiens
tggcaggcagctggcatcctaa

SEQ ID NO: 7706528 - DNA, 22 bp, Homo sapiens
tggcaggcagctggcatcctaa

SEQ ID NO: 7706529 - DNA, 22 bp, Homo sapiens
tggcaggcagctggcatcctaa

SEQ ID NO: 7706530 - DNA, 21 bp, Homo sapiens
tggcaggcagctggaagcttg

SEQ ID NO: 7706531 - DNA, 21 bp, Homo sapiens
tggcaggcagctggaagcttg

SEQ ID NO: 7706532 - DNA, 21 bp, Homo sapiens
tggcaggcagctggaagcttg

SEQ ID NO: 7706533 - DNA, 21 bp, Homo sapiens
tggcaggcagctggaagcttg

SEQ ID NO: 7706534 - DNA, 21 bp, Homo sapiens
tggcaggcagctggaagcttg

SEQ ID NO: 7706535 - DNA, 22 bp, Homo sapiens
tggcaggcagtgtgggagctgg

SEQ ID NO: 7706536 - DNA, 22 bp, Homo sapiens
tggcaggcagtgtgggagctgg

SEQ ID NO: 7706537 - DNA, 22 bp, Homo sapiens
tggcaggcagtgtgggagctgg

SEQ ID NO: 7706538 - DNA, 22 bp, Homo sapiens
tggcaggcaggcagccttctga

SEQ ID NO: 7706539 - DNA, 22 bp, Homo sapiens
tggcaggcagctggcatcctaa

SEQ ID NO: 7706540 - DNA, 22 bp, Homo sapiens
tggcaggcaggcagccttctga

SEQ ID NO: 7706541 - DNA, 22 bp, Homo sapiens
tggcaggcaggcagccttctga

SEQ ID NO: 7706542 - DNA, 22 bp, Homo sapiens
tggcaggcaggcagccttctga

SEQ ID NO: 7706543 - DNA, 22 bp, Homo sapiens
tggcagggagccaccggtcatg

SEQ ID NO: 7706544 - DNA, 22 bp, Homo sapiens
tggcagggagccaccggtcatg

SEQ ID NO: 7706545 - DNA, 22 bp, Homo sapiens
tggcaggcattgatgcgagttc

SEQ ID NO: 7706546 - DNA, 22 bp, Homo sapiens
tggcaggcattgatgcgagttc

SEQ ID NO: 7706547 - DNA, 22 bp, Homo sapiens
tggcaggcatccggcaccttct

SEQ ID NO: 7706548 - DNA, 22 bp, Homo sapiens
tggcaggcatccggcaccttct

SEQ ID NO: 7706549 - DNA, 22 bp, Homo sapiens
tggcaggcatccggcaccttct

SEQ ID NO: 7706550 - DNA, 18 bp, Homo sapiens
tggcagggaggaaatata

SEQ ID NO: 7706551 - DNA, 18 bp, Homo sapiens
tggcagggaggaaatata

SEQ ID NO: 7706552 - DNA, 18 bp, Homo sapiens
tggcagggaggaaatata

SEQ ID NO: 7706553 - DNA, 18 bp, Homo sapiens
tggcagggaggaaatata

SEQ ID NO: 7706554 - DNA, 18 bp, Homo sapiens
tggcagggaggaaatata

SEQ ID NO: 7706555 - DNA, 18 bp, Homo sapiens
tggcagggaggaaatata

SEQ ID NO: 7706556 - DNA, 18 bp, Homo sapiens
tggcagggaggaaatata

SEQ ID NO: 7706557 - DNA, 18 bp, Homo sapiens
tggcagggaggaaatata

SEQ ID NO: 7706558 - DNA, 22 bp, Homo sapiens
tggcagggagttcgttcacaac

SEQ ID NO: 7706559 - DNA, 22 bp, Homo sapiens
tggcagggagttcgttcacaac

SEQ ID NO: 7706560 - DNA, 22 bp, Homo sapiens
tggcagggagttcgttcacaac

SEQ ID NO: 7706561 - DNA, 22 bp, Homo sapiens
tggcagggagttcgttcacaac

SEQ ID NO: 7706562 - DNA, 22 bp, Homo sapiens
tggcagggagttcgttcacaac

SEQ ID NO: 7706563 - DNA, 22 bp, Homo sapiens
tggcagggagttcgttcacaac

SEQ ID NO: 7706564 - DNA, 19 bp, Homo sapiens
tggcagggagtgatattag

SEQ ID NO: 7706565 - DNA, 19 bp, Homo sapiens
tggcagggagtgatattag

SEQ ID NO: 7706566 - DNA, 19 bp, Homo sapiens
tggcagggagtgatattag

SEQ ID NO: 7706567 - DNA, 19 bp, Homo sapiens
tggcagggagtgatattag

SEQ ID NO: 7706568 - DNA, 19 bp, Homo sapiens
tggcagggagtgatattag

SEQ ID NO: 7706569 - DNA, 19 bp, Homo sapiens
tggcagggagtgatattag

SEQ ID NO: 7706570 - DNA, 19 bp, Homo sapiens
tggcagggagtgatattag

SEQ ID NO: 7706571 - DNA, 22 bp, Homo sapiens
tggcagggcctgaatcttatac

SEQ ID NO: 7706572 - DNA, 22 bp, Homo sapiens
tggcagggcctgaatcttatac

SEQ ID NO: 7706573 - DNA, 22 bp, Homo sapiens
tggcagggcctgaatcttatac

SEQ ID NO: 7706574 - DNA, 22 bp, Homo sapiens
tggcagggcctgaatcttatac

SEQ ID NO: 7706575 - DNA, 22 bp, Homo sapiens
tggcagggcctgaatcttatac

SEQ ID NO: 7706576 - DNA, 22 bp, Homo sapiens
tggcagggcctgctcatcatcc

SEQ ID NO: 7706577 - DNA, 22 bp, Homo sapiens
tggcagggcctgctcatcatcc

SEQ ID NO: 7706578 - DNA, 22 bp, Homo sapiens
tggcagggcctgctcatcatcc

SEQ ID NO: 7706579 - DNA, 22 bp, Homo sapiens
tggcagggcctgctcatcatcc

SEQ ID NO: 7706580 - DNA, 22 bp, Homo sapiens
tggcaggggaggtgcttgctta

SEQ ID NO: 7706581 - DNA, 22 bp, Homo sapiens
tggcagggagttgcaggatttc

SEQ ID NO: 7706582 - DNA, 22 bp, Homo sapiens
tggcagggagttgcaggatttc

SEQ ID NO: 7706583 - DNA, 22 bp, Homo sapiens
tggcagggagttgcaggatttc

SEQ ID NO: 7706584 - DNA, 22 bp, Homo sapiens
tggcagggagttgcaggatttc

SEQ ID NO: 7706585 - DNA, 22 bp, Homo sapiens
tggcagggagttgcaggatttc

SEQ ID NO: 7706586 - DNA, 22 bp, Homo sapiens
tggcagggagttgcaggatttc

SEQ ID NO: 7706587 - DNA, 22 bp, Homo sapiens
tggcagggagttgcaggatttc

SEQ ID NO: 7706588 - DNA, 22 bp, Homo sapiens
tggcagggagttcgttcacaac

SEQ ID NO: 7706589 - DNA, 22 bp, Homo sapiens
tggcagggcctaccccaatatc

SEQ ID NO: 7706590 - DNA, 22 bp, Homo sapiens
tggcagggcctaccccaatatc

SEQ ID NO: 7706591 - DNA, 22 bp, Homo sapiens
tggcagggcctaccccaatatc

SEQ ID NO: 7706592 - DNA, 22 bp, Homo sapiens
tggcagggagttgcaggatttc

SEQ ID NO: 7706593 - DNA, 22 bp, Homo sapiens
tggcagggagttgcaggatttc

SEQ ID NO: 7706594 - DNA, 22 bp, Homo sapiens
tggcagggagttgcaggatttc

SEQ ID NO: 7706595 - DNA, 18 bp, Homo sapiens
tggcaggggcagtacgcc

SEQ ID NO: 7706596 - DNA, 18 bp, Homo sapiens
tggcaggggcagtacgcc

SEQ ID NO: 7706597 - DNA, 18 bp, Homo sapiens
tggcaggggcagtacgcc

SEQ ID NO: 7706598 - DNA, 18 bp, Homo sapiens
tggcaggggcagtacgcc

SEQ ID NO: 7706599 - DNA, 18 bp, Homo sapiens
tggcaggggcagtacgcc

SEQ ID NO: 7706600 - DNA, 18 bp, Homo sapiens
tggcaggggcagtacgcc

SEQ ID NO: 7706601 - DNA, 22 bp, Homo sapiens
tggcaggggaggtgcttgctta

SEQ ID NO: 7706602 - DNA, 22 bp, Homo sapiens
tggcaggggaggtgcttgctta

SEQ ID NO: 7706603 - DNA, 22 bp, Homo sapiens
tggcaggggaggtgcttgctta

SEQ ID NO: 7706604 - DNA, 22 bp, Homo sapiens
tggcagggcctgctcatcatcc

SEQ ID NO: 7706605 - DNA, 22 bp, Homo sapiens
tggcaggggaggtgcttgctta

SEQ ID NO: 7706606 - DNA, 22 bp, Homo sapiens
tggcaggggaggtgcttgctta

SEQ ID NO: 7706607 - DNA, 22 bp, Homo sapiens
tggcaggggaggtgcttgctta

SEQ ID NO: 7706608 - DNA, 22 bp, Homo sapiens
tggcaggggaggtgcttgctta

SEQ ID NO: 7706609 - DNA, 22 bp, Homo sapiens
tggcagggtacaccttaacacc

SEQ ID NO: 7706610 - DNA, 22 bp, Homo sapiens
tggcagggtacaccttaacacc

SEQ ID NO: 7706611 - DNA, 22 bp, Homo sapiens
tggcagggtacaccttaacacc

SEQ ID NO: 7706612 - DNA, 22 bp, Homo sapiens
tggcagggtacaccttaacacc

SEQ ID NO: 7706613 - DNA, 22 bp, Homo sapiens
tggcagggtacaccttaacacc

SEQ ID NO: 7706614 - DNA, 21 bp, Homo sapiens
tggcaggggtagtagtacagc

SEQ ID NO: 7706615 - DNA, 21 bp, Homo sapiens
tggcaggggtagtagtacagc

SEQ ID NO: 7706616 - DNA, 21 bp, Homo sapiens
tggcaggggtagtagtacagc

SEQ ID NO: 7706617 - DNA, 21 bp, Homo sapiens
tggcaggggtagtagtacagc

SEQ ID NO: 7706618 - DNA, 21 bp, Homo sapiens
tggcaggggtagtagtacagc

SEQ ID NO: 7706619 - DNA, 21 bp, Homo sapiens
tggcaggggtagtagtacagc

SEQ ID NO: 7706620 - DNA, 21 bp, Homo sapiens
tggcaggggtagtagtacagc

SEQ ID NO: 7706621 - DNA, 21 bp, Homo sapiens
tggcaggggtagtagtacagc

SEQ ID NO: 7706622 - DNA, 18 bp, Homo sapiens
tggcaggggcagtacgcc

SEQ ID NO: 7706623 - DNA, 18 bp, Homo sapiens
tggcaggggcagtacgcc

SEQ ID NO: 7706624 - DNA, 18 bp, Homo sapiens
tggcaggggcagtacgcc

SEQ ID NO: 7706625 - DNA, 18 bp, Homo sapiens
tggcaggggcagtacgcc

SEQ ID NO: 7706626 - DNA, 22 bp, Homo sapiens
tggcagctcatttggaaatgga

SEQ ID NO: 7706627 - DNA, 22 bp, Homo sapiens
tggcagctattacaaggaagtc

SEQ ID NO: 7706628 - DNA, 22 bp, Homo sapiens
tggcagctattacaaggaagtc

SEQ ID NO: 7706629 - DNA, 22 bp, Homo sapiens
tggcagctattacaaggaagtc

SEQ ID NO: 7706630 - DNA, 22 bp, Homo sapiens
tggcagctagctgttttcatgc

SEQ ID NO: 7706631 - DNA, 22 bp, Homo sapiens
tggcagctcccagagcttccaa

SEQ ID NO: 7706632 - DNA, 22 bp, Homo sapiens
tggcagctcccagagcttccaa

SEQ ID NO: 7706633 - DNA, 22 bp, Homo sapiens
tggcagctccgggtaggggctg

SEQ ID NO: 7706634 - DNA, 22 bp, Homo sapiens
tggcagctccgggtaggggctg

SEQ ID NO: 7706635 - DNA, 22 bp, Homo sapiens
tggcagctcatttggaaatgga

SEQ ID NO: 7706636 - DNA, 22 bp, Homo sapiens
tggcagctcctggggccagcac

SEQ ID NO: 7706637 - DNA, 22 bp, Homo sapiens
tggcagctcctggggccagcac

SEQ ID NO: 7706638 - DNA, 22 bp, Homo sapiens
tggcagctcctggggccagcac

SEQ ID NO: 7706639 - DNA, 22 bp, Homo sapiens
tggcagctccgggtaggggctg

SEQ ID NO: 7706640 - DNA, 22 bp, Homo sapiens
tggcagctcctggggccagcac

SEQ ID NO: 7706641 - DNA, 22 bp, Homo sapiens
tggcagctcctggggccagcac

SEQ ID NO: 7706642 - DNA, 22 bp, Homo sapiens
tggcagctcctggggccagcac

SEQ ID NO: 7706643 - DNA, 22 bp, Homo sapiens
tggcagctccgggtaggggctg

SEQ ID NO: 7706644 - DNA, 22 bp, Homo sapiens
tggcagctatggtctaagggcc

SEQ ID NO: 7706645 - DNA, 22 bp, Homo sapiens
tggcagctatggtctaagggcc

SEQ ID NO: 7706646 - DNA, 22 bp, Homo sapiens
tggcagctatggtctaagggcc

SEQ ID NO: 7706647 - DNA, 22 bp, Homo sapiens
tggcagctatctttaatgagat

SEQ ID NO: 7706648 - DNA, 18 bp, Homo sapiens
tggcagctaggtaaagaa

SEQ ID NO: 7706649 - DNA, 22 bp, Homo sapiens
tggcagctagctgttttcatgc

SEQ ID NO: 7706650 - DNA, 22 bp, Homo sapiens
tggcagctagatagtgtgttta

SEQ ID NO: 7706651 - DNA, 18 bp, Homo sapiens
tggcagctaggtaaagaa

SEQ ID NO: 7706652 - DNA, 22 bp, Homo sapiens
tggcagctagatagtgtgttta

SEQ ID NO: 7706653 - DNA, 22 bp, Homo sapiens
tggcagctacagacagaggtga

SEQ ID NO: 7706654 - DNA, 22 bp, Homo sapiens
tggcagctacagacagaggtga

SEQ ID NO: 7706655 - DNA, 22 bp, Homo sapiens
tggcagctacagacagaggtga

SEQ ID NO: 7706656 - DNA, 22 bp, Homo sapiens
tggcagctacagacagaggtga

SEQ ID NO: 7706657 - DNA, 22 bp, Homo sapiens
tggcagctacagacagaggtga

SEQ ID NO: 7706658 - DNA, 22 bp, Homo sapiens
tggcagctacagacagaggtga

SEQ ID NO: 7706659 - DNA, 22 bp, Homo sapiens
tggcagccttctctgagaaggt

SEQ ID NO: 7706660 - DNA, 22 bp, Homo sapiens
tggcagccttctctgagaaggt

SEQ ID NO: 7706661 - DNA, 22 bp, Homo sapiens
tggcagccttctctgagaaggt

SEQ ID NO: 7706662 - DNA, 22 bp, Homo sapiens
tggcagcctggaatctctcagc

SEQ ID NO: 7706663 - DNA, 22 bp, Homo sapiens
tggcagcctggaatctctcagc

SEQ ID NO: 7706664 - DNA, 22 bp, Homo sapiens
tggcagccttctctgagaaggt

SEQ ID NO: 7706665 - DNA, 22 bp, Homo sapiens
tggcagcctggaatctctcagc

SEQ ID NO: 7706666 - DNA, 22 bp, Homo sapiens
tggcagcctgcgtgaaggagct

SEQ ID NO: 7706667 - DNA, 22 bp, Homo sapiens
tggcagcctgcgtgaaggagct

SEQ ID NO: 7706668 - DNA, 22 bp, Homo sapiens
tggcagcctcccagctgcattc

SEQ ID NO: 7706669 - DNA, 22 bp, Homo sapiens
tggcagcctcccagctgcattc

SEQ ID NO: 7706670 - DNA, 22 bp, Homo sapiens
tggcagccatctgagggtgggg

SEQ ID NO: 7706671 - DNA, 22 bp, Homo sapiens
tggcagccatctgagggtgggg

SEQ ID NO: 7706672 - DNA, 22 bp, Homo sapiens
tggcagccatctgagggtgggg

SEQ ID NO: 7706673 - DNA, 22 bp, Homo sapiens
tggcagccatctgagggtgggg

SEQ ID NO: 7706674 - DNA, 22 bp, Homo sapiens
tggcagcctcccagctgcattc

SEQ ID NO: 7706675 - DNA, 22 bp, Homo sapiens
tggcagcctcagacaaggacct

SEQ ID NO: 7706676 - DNA, 19 bp, Homo sapiens
tggcagcctccacttttgc

SEQ ID NO: 7706677 - DNA, 22 bp, Homo sapiens
tggcagcctcagacaaggacct

SEQ ID NO: 7706678 - DNA, 22 bp, Homo sapiens
tggcagcctcagacaaggacct

SEQ ID NO: 7706679 - DNA, 22 bp, Homo sapiens
tggcagcctcagacaaggacct

SEQ ID NO: 7706680 - DNA, 19 bp, Homo sapiens
tggcagcattggtaccttg

SEQ ID NO: 7706681 - DNA, 22 bp, Homo sapiens
tggcagcattttttccagaaca

SEQ ID NO: 7706682 - DNA, 22 bp, Homo sapiens
tggcagcattttttccagaaca

SEQ ID NO: 7706683 - DNA, 22 bp, Homo sapiens
tggcagcattttttccagaaca

SEQ ID NO: 7706684 - DNA, 22 bp, Homo sapiens
tggcagcattttttccagaaca

SEQ ID NO: 7706685 - DNA, 22 bp, Homo sapiens
tggcagcattaattattcaggt

SEQ ID NO: 7706686 - DNA, 22 bp, Homo sapiens
tggcagcattaattattcaggt

SEQ ID NO: 7706687 - DNA, 22 bp, Homo sapiens
tggcagcattaattattcaggt

SEQ ID NO: 7706688 - DNA, 19 bp, Homo sapiens
tggcagcattggtaccttg

SEQ ID NO: 7706689 - DNA, 19 bp, Homo sapiens
tggcagcattggtaccttg

SEQ ID NO: 7706690 - DNA, 22 bp, Homo sapiens
tggcagcattttttccagaaca

SEQ ID NO: 7706691 - DNA, 22 bp, Homo sapiens
tggcagcattttttccagaaca

SEQ ID NO: 7706692 - DNA, 22 bp, Homo sapiens
tggcagccacatctcgtggatt

SEQ ID NO: 7706693 - DNA, 22 bp, Homo sapiens
tggcagccatcagagcaggggt

SEQ ID NO: 7706694 - DNA, 22 bp, Homo sapiens
tggcagccatcagagcaggggt

SEQ ID NO: 7706695 - DNA, 22 bp, Homo sapiens
tggcagccatcagagcaggggt

SEQ ID NO: 7706696 - DNA, 22 bp, Homo sapiens
tggcagccatcagagcaggggt

SEQ ID NO: 7706697 - DNA, 22 bp, Homo sapiens
tggcagccatcagagcaggggt

SEQ ID NO: 7706698 - DNA, 22 bp, Homo sapiens
tggcagccatcagagcaggggt

SEQ ID NO: 7706699 - DNA, 22 bp, Homo sapiens
tggcagccatcagagcaggggt

SEQ ID NO: 7706700 - DNA, 22 bp, Homo sapiens
tggcagcagacatctgaggtct

SEQ ID NO: 7706701 - DNA, 22 bp, Homo sapiens
tggcagcagacatctgaggtct

SEQ ID NO: 7706702 - DNA, 22 bp, Homo sapiens
tggcagcagacatctgaggtct

SEQ ID NO: 7706703 - DNA, 22 bp, Homo sapiens
tggcagcagacatctgaggtct

SEQ ID NO: 7706704 - DNA, 22 bp, Homo sapiens
tggcagcagacatctgaggtct

SEQ ID NO: 7706705 - DNA, 22 bp, Homo sapiens
tggcagcagacatctgaggtct

SEQ ID NO: 7706706 - DNA, 22 bp, Homo sapiens
tggcagcagacaaaaggccatt

SEQ ID NO: 7706707 - DNA, 22 bp, Homo sapiens
tggcagcagacaaaaggccatt

SEQ ID NO: 7706708 - DNA, 22 bp, Homo sapiens
tggcagcagacaaaaggccatt

SEQ ID NO: 7706709 - DNA, 22 bp, Homo sapiens
tggcagcagcaaatggcatatc

SEQ ID NO: 7706710 - DNA, 22 bp, Homo sapiens
tggcagcagcaaatggcatatc

SEQ ID NO: 7706711 - DNA, 22 bp, Homo sapiens
tggcagcagcaaatggcatatc

SEQ ID NO: 7706712 - DNA, 22 bp, Homo sapiens
tggcagcagcaaatggcatatc

SEQ ID NO: 7706713 - DNA, 22 bp, Homo sapiens
tggcagcagcaaatggcatatc

SEQ ID NO: 7706714 - DNA, 22 bp, Homo sapiens
tggcagcagcaaatggcatatc

SEQ ID NO: 7706715 - DNA, 23 bp, Homo sapiens
tggcagcagatcttaaagtgacc

SEQ ID NO: 7706716 - DNA, 23 bp, Homo sapiens
tggcagcagatcttaaagtgacc

SEQ ID NO: 7706717 - DNA, 22 bp, Homo sapiens
tggcagcagacatctgaggtct

SEQ ID NO: 7706718 - DNA, 22 bp, Homo sapiens
tggcagcagacatctgaggtct

SEQ ID NO: 7706719 - DNA, 22 bp, Homo sapiens
tggcagcagccatggaaggccc

SEQ ID NO: 7706720 - DNA, 22 bp, Homo sapiens
tggcagcagccatggaaggccc

SEQ ID NO: 7706721 - DNA, 22 bp, Homo sapiens
tggcagcagccatggaaggccc

SEQ ID NO: 7706722 - DNA, 22 bp, Homo sapiens
tggcagcagccatggaaggccc

SEQ ID NO: 7706723 - DNA, 22 bp, Homo sapiens
tggcagcagccatggaaggccc

SEQ ID NO: 7706724 - DNA, 22 bp, Homo sapiens
tggcagcagccatggaaggccc

SEQ ID NO: 7706725 - DNA, 22 bp, Homo sapiens
tggcagcagccatggaaggccc

SEQ ID NO: 7706726 - DNA, 22 bp, Homo sapiens
tggcagcagccatggaaggccc

SEQ ID NO: 7706727 - DNA, 22 bp, Homo sapiens
tggcagcagccatggaaggccc

SEQ ID NO: 7706728 - DNA, 18 bp, Homo sapiens
tggcagcaggaagccatt

SEQ ID NO: 7706729 - DNA, 18 bp, Homo sapiens
tggcagcaggaagccatt

SEQ ID NO: 7706730 - DNA, 18 bp, Homo sapiens
tggcagcaggaagccatt

SEQ ID NO: 7706731 - DNA, 18 bp, Homo sapiens
tggcagcaggaagccatt

SEQ ID NO: 7706732 - DNA, 22 bp, Homo sapiens
tggcagcagctaacttaggcag

SEQ ID NO: 7706733 - DNA, 22 bp, Homo sapiens
tggcagcagctaacttaggcag

SEQ ID NO: 7706734 - DNA, 22 bp, Homo sapiens
tggcagcagctaacttaggcag

SEQ ID NO: 7706735 - DNA, 22 bp, Homo sapiens
tggcagcagctaacttaggcag

SEQ ID NO: 7706736 - DNA, 22 bp, Homo sapiens
tggcagcagctaacttaggcag

SEQ ID NO: 7706737 - DNA, 22 bp, Homo sapiens
tggcagcatgtcccggcctcag

SEQ ID NO: 7706738 - DNA, 22 bp, Homo sapiens
tggcagcatgtcccggcctcag

SEQ ID NO: 7706739 - DNA, 22 bp, Homo sapiens
tggcagcataaagcatttagct

SEQ ID NO: 7706740 - DNA, 22 bp, Homo sapiens
tggcagcatgtcccggcctcag

SEQ ID NO: 7706741 - DNA, 22 bp, Homo sapiens
tggcagcatgtcccggcctcag

SEQ ID NO: 7706742 - DNA, 22 bp, Homo sapiens
tggcagcatgtcccggcctcag

SEQ ID NO: 7706743 - DNA, 22 bp, Homo sapiens
tggcagcatgttatgtaaggaa

SEQ ID NO: 7706744 - DNA, 22 bp, Homo sapiens
tggcagcatgttatgtaaggaa

SEQ ID NO: 7706745 - DNA, 22 bp, Homo sapiens
tggcagcatgttatgtaaggaa

SEQ ID NO: 7706746 - DNA, 22 bp, Homo sapiens
tggcagcatgttatgtaaggaa

SEQ ID NO: 7706747 - DNA, 22 bp, Homo sapiens
tggcagcatgttatgtaaggaa

SEQ ID NO: 7706748 - DNA, 22 bp, Homo sapiens
tggcagcattaattattcaggt

SEQ ID NO: 7706749 - DNA, 22 bp, Homo sapiens
tggcagcattaattattcaggt

SEQ ID NO: 7706750 - DNA, 22 bp, Homo sapiens
tggcagcagtggaggtagaaag

SEQ ID NO: 7706751 - DNA, 22 bp, Homo sapiens
tggcagcagtggaggtagaaag

SEQ ID NO: 7706752 - DNA, 22 bp, Homo sapiens
tggcagcagtggaggtagaaag

SEQ ID NO: 7706753 - DNA, 22 bp, Homo sapiens
tggcagcagtagccaccccagc

SEQ ID NO: 7706754 - DNA, 22 bp, Homo sapiens
tggcagcagtagccaccccagc

SEQ ID NO: 7706755 - DNA, 22 bp, Homo sapiens
tggcagcagtggaggtagaaag

SEQ ID NO: 7706756 - DNA, 22 bp, Homo sapiens
tggcagcataaagcatttagct

SEQ ID NO: 7706757 - DNA, 22 bp, Homo sapiens
tggcagcagtggaggtagaaag

SEQ ID NO: 7706758 - DNA, 22 bp, Homo sapiens
tggcagcagtggaggtagaaag

SEQ ID NO: 7706759 - DNA, 22 bp, Homo sapiens
tggcagcagggaggccagtgtt

SEQ ID NO: 7706760 - DNA, 22 bp, Homo sapiens
tggcagcagggaggccagtgtt

SEQ ID NO: 7706761 - DNA, 22 bp, Homo sapiens
tggcagcagggaggccagtgtt

SEQ ID NO: 7706762 - DNA, 22 bp, Homo sapiens
tggcagcagggaggccagtgtt

SEQ ID NO: 7706763 - DNA, 22 bp, Homo sapiens
tggcagcagggaggccagtgtt

SEQ ID NO: 7706764 - DNA, 18 bp, Homo sapiens
tggcagcaggaagccatt

SEQ ID NO: 7706765 - DNA, 22 bp, Homo sapiens
tggcagcagtagccaccccagc

SEQ ID NO: 7706766 - DNA, 22 bp, Homo sapiens
tggcagcagtagccaccccagc

SEQ ID NO: 7706767 - DNA, 22 bp, Homo sapiens
tggcagcagggcccctggagga

SEQ ID NO: 7706768 - DNA, 22 bp, Homo sapiens
tggcagcagggcccctggagga

SEQ ID NO: 7706769 - DNA, 22 bp, Homo sapiens
tggcagcagggcccctggagga

SEQ ID NO: 7706770 - DNA, 22 bp, Homo sapiens
tggcagcagggcccctggagga

SEQ ID NO: 7706771 - DNA, 22 bp, Homo sapiens
tggcagcagggcccctggagga

SEQ ID NO: 7706772 - DNA, 22 bp, Homo sapiens
tggcagcagggcccctggagga

SEQ ID NO: 7706773 - DNA, 22 bp, Homo sapiens
tggcagcagggaggccagtgtt

SEQ ID NO: 7706774 - DNA, 22 bp, Homo sapiens
tggcagcagggaggccagtgtt

SEQ ID NO: 7706775 - DNA, 22 bp, Homo sapiens
tggcagagtctctcctttccag

SEQ ID NO: 7706776 - DNA, 22 bp, Homo sapiens
tggcagagtctctcctttccag

SEQ ID NO: 7706777 - DNA, 22 bp, Homo sapiens
tggcagagtctctcctttccag

SEQ ID NO: 7706778 - DNA, 22 bp, Homo sapiens
tggcagagtctctcctttccag

SEQ ID NO: 7706779 - DNA, 22 bp, Homo sapiens
tggcagagtctctcctttccag

SEQ ID NO: 7706780 - DNA, 22 bp, Homo sapiens
tggcagagtcatcacatctgga

SEQ ID NO: 7706781 - DNA, 22 bp, Homo sapiens
tggcagagtctctcctttccag

SEQ ID NO: 7706782 - DNA, 22 bp, Homo sapiens
tggcagagtctctcctttccag

SEQ ID NO: 7706783 - DNA, 22 bp, Homo sapiens
tggcagagtcatcacatctgga

SEQ ID NO: 7706784 - DNA, 22 bp, Homo sapiens
tggcagagtctctcctttccag

SEQ ID NO: 7706785 - DNA, 22 bp, Homo sapiens
tggcagagtctgggcttgggca

SEQ ID NO: 7706786 - DNA, 22 bp, Homo sapiens
tggcagagtctgggcttgggca

SEQ ID NO: 7706787 - DNA, 22 bp, Homo sapiens
tggcagagtctgggcttgggca

SEQ ID NO: 7706788 - DNA, 22 bp, Homo sapiens
tggcagagtctgggcttgggca

SEQ ID NO: 7706789 - DNA, 22 bp, Homo sapiens
tggcagagtctgggcttgggca

SEQ ID NO: 7706790 - DNA, 22 bp, Homo sapiens
tggcagagtctgggcttgggca

SEQ ID NO: 7706791 - DNA, 22 bp, Homo sapiens
tggcagagtcatcacatctgga

SEQ ID NO: 7706792 - DNA, 22 bp, Homo sapiens
tggcagagtcatcacatctgga

SEQ ID NO: 7706793 - DNA, 22 bp, Homo sapiens
tggcagagtcatcacatctgga

SEQ ID NO: 7706794 - DNA, 22 bp, Homo sapiens
tggcagagtcatcacatctgga

SEQ ID NO: 7706795 - DNA, 22 bp, Homo sapiens
tggcagagtcatcacatctgga

SEQ ID NO: 7706796 - DNA, 22 bp, Homo sapiens
tggcagagtcatcacatctgga

SEQ ID NO: 7706797 - DNA, 22 bp, Homo sapiens
tggcagagtcatcacatctgga

SEQ ID NO: 7706798 - DNA, 22 bp, Homo sapiens
tggcagagtcatcacatctgga

SEQ ID NO: 7706799 - DNA, 22 bp, Homo sapiens
tggcagagtaggatggccctgt

SEQ ID NO: 7706800 - DNA, 22 bp, Homo sapiens
tggcagagtaggatggccctgt

SEQ ID NO: 7706801 - DNA, 22 bp, Homo sapiens
tggcagagtaggatggccctgt

SEQ ID NO: 7706802 - DNA, 22 bp, Homo sapiens
tggcagagtaggatggccctgt

SEQ ID NO: 7706803 - DNA, 22 bp, Homo sapiens
tggcagagtaggatggccctgt

SEQ ID NO: 7706804 - DNA, 22 bp, Homo sapiens
tggcagagtaggatggccctgt

SEQ ID NO: 7706805 - DNA, 22 bp, Homo sapiens
tggcagagtaggatggccctgt

SEQ ID NO: 7706806 - DNA, 22 bp, Homo sapiens
tggcagagtggaccatactcaa

SEQ ID NO: 7706807 - DNA, 22 bp, Homo sapiens
tggcagagtggaccatactcaa

SEQ ID NO: 7706808 - DNA, 22 bp, Homo sapiens
tggcagagtggaccatactcaa

SEQ ID NO: 7706809 - DNA, 22 bp, Homo sapiens
tggcagagtggaccatactcaa

SEQ ID NO: 7706810 - DNA, 22 bp, Homo sapiens
tggcagagtggaccatactcaa

SEQ ID NO: 7706811 - DNA, 22 bp, Homo sapiens
tggcagagtggaccatactcaa

SEQ ID NO: 7706812 - DNA, 22 bp, Homo sapiens
tggcagagtgcggcatcccctg

SEQ ID NO: 7706813 - DNA, 22 bp, Homo sapiens
tggcagagtggaccatactcaa

SEQ ID NO: 7706814 - DNA, 22 bp, Homo sapiens
tggcagagtggaccatactcaa

SEQ ID NO: 7706815 - DNA, 22 bp, Homo sapiens
tggcagagtgcggcatcccctg

SEQ ID NO: 7706816 - DNA, 22 bp, Homo sapiens
tggcagagtgcggcatcccctg

SEQ ID NO: 7706817 - DNA, 22 bp, Homo sapiens
tggcagagtgcggcatcccctg

SEQ ID NO: 7706818 - DNA, 22 bp, Homo sapiens
tggcagagtgcggcatcccctg

SEQ ID NO: 7706819 - DNA, 22 bp, Homo sapiens
tggcagagtgcggcatcccctg

SEQ ID NO: 7706820 - DNA, 22 bp, Homo sapiens
tggcagagtgcggcatcccctg

SEQ ID NO: 7706821 - DNA, 21 bp, Homo sapiens
tggcagagtgcagtctataca

SEQ ID NO: 7706822 - DNA, 21 bp, Homo sapiens
tggcagagtgcagtctataca

SEQ ID NO: 7706823 - DNA, 21 bp, Homo sapiens
tggcagagtgcagtctataca

SEQ ID NO: 7706824 - DNA, 21 bp, Homo sapiens
tggcagagtgcagtctataca

SEQ ID NO: 7706825 - DNA, 21 bp, Homo sapiens
tggcagagtgcagtctataca

SEQ ID NO: 7706826 - DNA, 21 bp, Homo sapiens
tggcagagtgcagtctataca

SEQ ID NO: 7706827 - DNA, 22 bp, Homo sapiens
tggcagagtgcagaagaggcat

SEQ ID NO: 7706828 - DNA, 22 bp, Homo sapiens
tggcagagtgcagaagaggcat

SEQ ID NO: 7706829 - DNA, 22 bp, Homo sapiens
tggcagagtgcagaagaggcat

SEQ ID NO: 7706830 - DNA, 22 bp, Homo sapiens
tggcagagtgcagaagaggcat

SEQ ID NO: 7706831 - DNA, 22 bp, Homo sapiens
tggcagagtgcagaagaggcat

SEQ ID NO: 7706832 - DNA, 21 bp, Homo sapiens
tggcagagtgcagtctataca

SEQ ID NO: 7706833 - DNA, 21 bp, Homo sapiens
tggcagagtgcagtctataca

SEQ ID NO: 7706834 - DNA, 22 bp, Homo sapiens
tggcagagtctgggcttgggca

SEQ ID NO: 7706835 - DNA, 22 bp, Homo sapiens
tggcagagtctgggcttgggca

SEQ ID NO: 7706836 - DNA, 22 bp, Homo sapiens
tggcagagtctgggcttgggca

SEQ ID NO: 7706837 - DNA, 22 bp, Homo sapiens
tggcagagtgcagaagaggcat

SEQ ID NO: 7706838 - DNA, 22 bp, Homo sapiens
tggcagagtgcagaagaggcat

SEQ ID NO: 7706839 - DNA, 22 bp, Homo sapiens
tggcagagtgcagaagaggcat

SEQ ID NO: 7706840 - DNA, 22 bp, Homo sapiens
tggcagagtgcagaagaggcat

SEQ ID NO: 7706841 - DNA, 22 bp, Homo sapiens
tggcagagtgcagaagaggcat

SEQ ID NO: 7706842 - DNA, 22 bp, Homo sapiens
tggcagagtgcagaagaggcat

SEQ ID NO: 7706843 - DNA, 22 bp, Homo sapiens
tggcagagttatgggtatttat

SEQ ID NO: 7706844 - DNA, 18 bp, Homo sapiens
tggcagagtgtctgttct

SEQ ID NO: 7706845 - DNA, 18 bp, Homo sapiens
tggcagagtgtctgttct

SEQ ID NO: 7706846 - DNA, 18 bp, Homo sapiens
tggcagagtgtctgttct

SEQ ID NO: 7706847 - DNA, 22 bp, Homo sapiens
tggcagagttcgctcctattca

SEQ ID NO: 7706848 - DNA, 22 bp, Homo sapiens
tggcagagttatgggtatttat

SEQ ID NO: 7706849 - DNA, 22 bp, Homo sapiens
tggcagagttatgggtatttat

SEQ ID NO: 7706850 - DNA, 22 bp, Homo sapiens
tggcagagttatgggtatttat

SEQ ID NO: 7706851 - DNA, 22 bp, Homo sapiens
tggcagagttatgggtatttat

SEQ ID NO: 7706852 - DNA, 22 bp, Homo sapiens
tggcagagtggaccatactcaa

SEQ ID NO: 7706853 - DNA, 22 bp, Homo sapiens
tggcagagtggaccatactcaa

SEQ ID NO: 7706854 - DNA, 18 bp, Homo sapiens
tggcagagtgtctgttct

SEQ ID NO: 7706855 - DNA, 18 bp, Homo sapiens
tggcagagtgtctgttct

SEQ ID NO: 7706856 - DNA, 18 bp, Homo sapiens
tggcagagtgtctgttct

SEQ ID NO: 7706857 - DNA, 18 bp, Homo sapiens
tggcagagtgtctgttct

SEQ ID NO: 7706858 - DNA, 18 bp, Homo sapiens
tggcagagtgtctgttct

SEQ ID NO: 7706859 - DNA, 22 bp, Homo sapiens
tggcagagttcgctgtgccttt

SEQ ID NO: 7706860 - DNA, 22 bp, Homo sapiens
tggcagagttcgctgtgccttt

SEQ ID NO: 7706861 - DNA, 22 bp, Homo sapiens
tggcagagttcgctgtgccttt

SEQ ID NO: 7706862 - DNA, 22 bp, Homo sapiens
tggcagagttcgctgtgccttt

SEQ ID NO: 7706863 - DNA, 21 bp, Homo sapiens
tggcagagttgagtagttatg

SEQ ID NO: 7706864 - DNA, 21 bp, Homo sapiens
tggcagagttgagtagttatg

SEQ ID NO: 7706865 - DNA, 21 bp, Homo sapiens
tggcagagttgagtagttatg

SEQ ID NO: 7706866 - DNA, 21 bp, Homo sapiens
tggcagagttgagtagttatg

SEQ ID NO: 7706867 - DNA, 22 bp, Homo sapiens
tggcagagttcgctcctattca

SEQ ID NO: 7706868 - DNA, 22 bp, Homo sapiens
tggcagagttcgctcctattca

SEQ ID NO: 7706869 - DNA, 22 bp, Homo sapiens
tggcagagttcgctcctattca

SEQ ID NO: 7706870 - DNA, 22 bp, Homo sapiens
tggcagagttcgctcctattca

SEQ ID NO: 7706871 - DNA, 22 bp, Homo sapiens
tggcagagttcgctgtgccttt

SEQ ID NO: 7706872 - DNA, 22 bp, Homo sapiens
tggcagagttcgctgtgccttt

SEQ ID NO: 7706873 - DNA, 22 bp, Homo sapiens
tggcagagttcgctgtgccttt

SEQ ID NO: 7706874 - DNA, 22 bp, Homo sapiens
tggcagagttcgctgtgccttt

SEQ ID NO: 7706875 - DNA, 22 bp, Homo sapiens
tggcagagttcgctgtgccttt

SEQ ID NO: 7706876 - DNA, 21 bp, Homo sapiens
tggcagagttgagtagttatg

SEQ ID NO: 7706877 - DNA, 21 bp, Homo sapiens
tggcagagttgagtagttatg

SEQ ID NO: 7706878 - DNA, 22 bp, Homo sapiens
tggcagagttggaggtggaaga

SEQ ID NO: 7706879 - DNA, 22 bp, Homo sapiens
tggcagagttggaggtggaaga

SEQ ID NO: 7706880 - DNA, 22 bp, Homo sapiens
tggcagagttggaggtggaaga

SEQ ID NO: 7706881 - DNA, 22 bp, Homo sapiens
tggcagagttggaggtggaaga

SEQ ID NO: 7706882 - DNA, 22 bp, Homo sapiens
tggcagagttggaggtggaaga

SEQ ID NO: 7706883 - DNA, 22 bp, Homo sapiens
tggcagagttggaggtggaaga

SEQ ID NO: 7706884 - DNA, 22 bp, Homo sapiens
tggcagagttggaggtggaaga

SEQ ID NO: 7706885 - DNA, 22 bp, Homo sapiens
tggcagagttggaggtggaaga

SEQ ID NO: 7706886 - DNA, 22 bp, Homo sapiens
tggcagagttggaggtggaaga

SEQ ID NO: 7706887 - DNA, 22 bp, Homo sapiens
tggcagagttggaggtggaaga

SEQ ID NO: 7706888 - DNA, 20 bp, Homo sapiens
tggcagagttgtcccaccca

SEQ ID NO: 7706889 - DNA, 20 bp, Homo sapiens
tggcagagttgtcccaccca

SEQ ID NO: 7706890 - DNA, 20 bp, Homo sapiens
tggcagagttgtcccaccca

SEQ ID NO: 7706891 - DNA, 20 bp, Homo sapiens
tggcagagttgtcccaccca

SEQ ID NO: 7706892 - DNA, 20 bp, Homo sapiens
tggcagagttgtcccaccca

SEQ ID NO: 7706893 - DNA, 20 bp, Homo sapiens
tggcagagttgtcccaccca

SEQ ID NO: 7706894 - DNA, 20 bp, Homo sapiens
tggcagagttgtcccaccca

SEQ ID NO: 7706895 - DNA, 20 bp, Homo sapiens
tggcagagttgtcccaccca

SEQ ID NO: 7706896 - DNA, 22 bp, Homo sapiens
tggcagataaaataatagggaa

SEQ ID NO: 7706897 - DNA, 22 bp, Homo sapiens
tggcagataaacatgtgataaa

SEQ ID NO: 7706898 - DNA, 22 bp, Homo sapiens
tggcagataacctgctgtgccc

SEQ ID NO: 7706899 - DNA, 19 bp, Homo sapiens
tggcagataatttgtgtta

SEQ ID NO: 7706900 - DNA, 22 bp, Homo sapiens
tggcagatacccaggcaaatgg

SEQ ID NO: 7706901 - DNA, 22 bp, Homo sapiens
tggcagatacccaggcaaatgg

SEQ ID NO: 7706902 - DNA, 22 bp, Homo sapiens
tggcagcacttgaacttgagcc

SEQ ID NO: 7706903 - DNA, 22 bp, Homo sapiens
tggcagcacttgaacttgagcc

SEQ ID NO: 7706904 - DNA, 22 bp, Homo sapiens
tggcagcagacaaaaggccatt

SEQ ID NO: 7706905 - DNA, 22 bp, Homo sapiens
tggcagcagacaaaaggccatt

SEQ ID NO: 7706906 - DNA, 22 bp, Homo sapiens
tggcagcagacaaaaggccatt

SEQ ID NO: 7706907 - DNA, 22 bp, Homo sapiens
tggcagcacttgaacttgagcc

SEQ ID NO: 7706908 - DNA, 22 bp, Homo sapiens
tggcagcagaacatgaaaccca

SEQ ID NO: 7706909 - DNA, 22 bp, Homo sapiens
tggcagcagaacatgaaaccca

SEQ ID NO: 7706910 - DNA, 22 bp, Homo sapiens
tggcatgcggcaacacgtcggt

SEQ ID NO: 7706911 - DNA, 22 bp, Homo sapiens
tggcatgccttgtcagacagtg

SEQ ID NO: 7706912 - DNA, 22 bp, Homo sapiens
tggcatgccttgtcagacagtg

SEQ ID NO: 7706913 - DNA, 18 bp, Homo sapiens
tggcatgctttgatacat

SEQ ID NO: 7706914 - DNA, 22 bp, Homo sapiens
tggcatgctatgggcaaaaggg

SEQ ID NO: 7706915 - DNA, 22 bp, Homo sapiens
tggcatggaccttggaagaatt

SEQ ID NO: 7706916 - DNA, 22 bp, Homo sapiens
tggcatgcatctgttgtcctag

SEQ ID NO: 7706917 - DNA, 22 bp, Homo sapiens
tggcatgcatctgttgtcctag

SEQ ID NO: 7706918 - DNA, 22 bp, Homo sapiens
tggcatgcatctgttgtcctag

SEQ ID NO: 7706919 - DNA, 22 bp, Homo sapiens
tggcatgccttgtcagacagtg

SEQ ID NO: 7706920 - DNA, 22 bp, Homo sapiens
tggcatgcattgtgggtaatta

SEQ ID NO: 7706921 - DNA, 22 bp, Homo sapiens
tggcatgcattgtgggtaatta

SEQ ID NO: 7706922 - DNA, 21 bp, Homo sapiens
tggcatgcagtgttcctgtgc

SEQ ID NO: 7706923 - DNA, 22 bp, Homo sapiens
tggcatgcacagccctgttcgg

SEQ ID NO: 7706924 - DNA, 22 bp, Homo sapiens
tggcatgcacagccctgttcgg

SEQ ID NO: 7706925 - DNA, 22 bp, Homo sapiens
tggcatgataggaggtgcagaa

SEQ ID NO: 7706926 - DNA, 22 bp, Homo sapiens
tggcatgagtataggcttctca

SEQ ID NO: 7706927 - DNA, 17 bp, Homo sapiens
tggcatgagggtgtggg

SEQ ID NO: 7706928 - DNA, 22 bp, Homo sapiens
tggcatgcaagaggaggctccc

SEQ ID NO: 7706929 - DNA, 22 bp, Homo sapiens
tggcatgcaagaggaggctccc

SEQ ID NO: 7706930 - DNA, 19 bp, Homo sapiens
tggcatgatgatggatggg

SEQ ID NO: 7706931 - DNA, 22 bp, Homo sapiens
tggcatgcaagaggaggctccc

SEQ ID NO: 7706932 - DNA, 22 bp, Homo sapiens
tggcatgataggaggtgcagaa

SEQ ID NO: 7706933 - DNA, 19 bp, Homo sapiens
tggcatgatgatggatggg

SEQ ID NO: 7706934 - DNA, 22 bp, Homo sapiens
tggcatgaagtcagcagctggg

SEQ ID NO: 7706935 - DNA, 22 bp, Homo sapiens
tggcatgaagtcagcagctggg

SEQ ID NO: 7706936 - DNA, 22 bp, Homo sapiens
tggcatgaagtcagcagctggg

SEQ ID NO: 7706937 - DNA, 22 bp, Homo sapiens
tggcatgagaatactgagggat

SEQ ID NO: 7706938 - DNA, 23 bp, Homo sapiens
tggcatcttggcatcttgctgct

SEQ ID NO: 7706939 - DNA, 23 bp, Homo sapiens
tggcatcttggcatcttgctgct

SEQ ID NO: 7706940 - DNA, 20 bp, Homo sapiens
tggcatctctcaattgtagg

SEQ ID NO: 7706941 - DNA, 19 bp, Homo sapiens
tggcatctgggccctccag

SEQ ID NO: 7706942 - DNA, 22 bp, Homo sapiens
tggcatcgggccaccccatccc

SEQ ID NO: 7706943 - DNA, 22 bp, Homo sapiens
tggcatggactagtgctgaggt

SEQ ID NO: 7706944 - DNA, 22 bp, Homo sapiens
tggcatggactagtgctgaggt

SEQ ID NO: 7706945 - DNA, 22 bp, Homo sapiens
tggcatggactagtgctgaggt

SEQ ID NO: 7706946 - DNA, 22 bp, Homo sapiens
tggcatggactagtgctgaggt

SEQ ID NO: 7706947 - DNA, 22 bp, Homo sapiens
tggcatggactagtgctgaggt

SEQ ID NO: 7706948 - DNA, 22 bp, Homo sapiens
tggcatggactagtgctgaggt

SEQ ID NO: 7706949 - DNA, 22 bp, Homo sapiens
tggcatggactagtgctgaggt

SEQ ID NO: 7706950 - DNA, 21 bp, Homo sapiens
tggcatggaggtagcagtgtg

SEQ ID NO: 7706951 - DNA, 21 bp, Homo sapiens
tggcatggaggtagcagtgtg

SEQ ID NO: 7706952 - DNA, 21 bp, Homo sapiens
tggcatggaggtagcagtgtg

SEQ ID NO: 7706953 - DNA, 22 bp, Homo sapiens
tggcatggcaaccctgcaggga

SEQ ID NO: 7706954 - DNA, 21 bp, Homo sapiens
tggcatggaggtagcagtgtg

SEQ ID NO: 7706955 - DNA, 21 bp, Homo sapiens
tggcatggaggtagcagtgtg

SEQ ID NO: 7706956 - DNA, 22 bp, Homo sapiens
tggcatggcaaccctgcaggga

SEQ ID NO: 7706957 - DNA, 22 bp, Homo sapiens
tggcatggcaaccctgcaggga

SEQ ID NO: 7706958 - DNA, 22 bp, Homo sapiens
tggcatggcaaccctgcaggga

SEQ ID NO: 7706959 - DNA, 22 bp, Homo sapiens
tggcatggccagtgctgggagt

SEQ ID NO: 7706960 - DNA, 22 bp, Homo sapiens
tggcatggcaaccctgcaggga

SEQ ID NO: 7706961 - DNA, 22 bp, Homo sapiens
tggcatggcaaccctgcaggga

SEQ ID NO: 7706962 - DNA, 22 bp, Homo sapiens
tggcatggcatttagagaatta

SEQ ID NO: 7706963 - DNA, 22 bp, Homo sapiens
tggcatggctactggaatggcg

SEQ ID NO: 7706964 - DNA, 22 bp, Homo sapiens
tggcatggctactggaatggcg

SEQ ID NO: 7706965 - DNA, 22 bp, Homo sapiens
tggcatggctactggaatggcg

SEQ ID NO: 7706966 - DNA, 22 bp, Homo sapiens
tggcatggcgtggcatcgtgtg

SEQ ID NO: 7706967 - DNA, 22 bp, Homo sapiens
tggcatgggcaaaccagggaaa

SEQ ID NO: 7706968 - DNA, 22 bp, Homo sapiens
tggcatggccagtgctgggagt

SEQ ID NO: 7706969 - DNA, 22 bp, Homo sapiens
tggcatggccagtgctgggagt

SEQ ID NO: 7706970 - DNA, 22 bp, Homo sapiens
tggcatggccagtgctgggagt

SEQ ID NO: 7706971 - DNA, 22 bp, Homo sapiens
tggcatgggccagggagagctg

SEQ ID NO: 7706972 - DNA, 22 bp, Homo sapiens
tggcatgggccagggagagctg

SEQ ID NO: 7706973 - DNA, 22 bp, Homo sapiens
tggcatgggcaaaccagggaaa

SEQ ID NO: 7706974 - DNA, 22 bp, Homo sapiens
tggcatgggtggagagagcaca

SEQ ID NO: 7706975 - DNA, 22 bp, Homo sapiens
tggcatgggtggagagagcaca

SEQ ID NO: 7706976 - DNA, 22 bp, Homo sapiens
tggcatggggcagaacattaca

SEQ ID NO: 7706977 - DNA, 22 bp, Homo sapiens
tggcatgggccagggagagctg

SEQ ID NO: 7706978 - DNA, 22 bp, Homo sapiens
tggcagtggcatcaccccaata

SEQ ID NO: 7706979 - DNA, 22 bp, Homo sapiens
tggcagtggcactgcccccata

SEQ ID NO: 7706980 - DNA, 22 bp, Homo sapiens
tggcagtggcatcaccccaata

SEQ ID NO: 7706981 - DNA, 22 bp, Homo sapiens
tggcagtggcactgcccccata

SEQ ID NO: 7706982 - DNA, 22 bp, Homo sapiens
tggcagtggcactgcccccata

SEQ ID NO: 7706983 - DNA, 22 bp, Homo sapiens
tggcagtggataggggagcggt

SEQ ID NO: 7706984 - DNA, 22 bp, Homo sapiens
tggcagtggcgggactcagggc

SEQ ID NO: 7706985 - DNA, 22 bp, Homo sapiens
tggcagtggcgggactcagggc

SEQ ID NO: 7706986 - DNA, 22 bp, Homo sapiens
tggcagtggcgggactcagggc

SEQ ID NO: 7706987 - DNA, 23 bp, Homo sapiens
tggcagtgcccagggagatgatc

SEQ ID NO: 7706988 - DNA, 22 bp, Homo sapiens
tggcagtgctgcagtgccctta

SEQ ID NO: 7706989 - DNA, 22 bp, Homo sapiens
tggcagtgctgcagtgccctta

SEQ ID NO: 7706990 - DNA, 22 bp, Homo sapiens
tggcagtgccccttgaccagtg

SEQ ID NO: 7706991 - DNA, 22 bp, Homo sapiens
tggcagtgccccttgaccagtg

SEQ ID NO: 7706992 - DNA, 22 bp, Homo sapiens
tggcagtgctgcagtgccctta

SEQ ID NO: 7706993 - DNA, 22 bp, Homo sapiens
tggcagtggataggggagcggt

SEQ ID NO: 7706994 - DNA, 22 bp, Homo sapiens
tggcagtggataggggagcggt

SEQ ID NO: 7706995 - DNA, 22 bp, Homo sapiens
tggcagtggataggggagcggt

SEQ ID NO: 7706996 - DNA, 22 bp, Homo sapiens
tggcagtggataggggagcggt

SEQ ID NO: 7706997 - DNA, 22 bp, Homo sapiens
tggcagtggctcagagtgcaga

SEQ ID NO: 7706998 - DNA, 22 bp, Homo sapiens
tggcagtggctcagagtgcaga

SEQ ID NO: 7706999 - DNA, 22 bp, Homo sapiens
tggcagtggctcagagtgcaga

SEQ ID NO: 7707000 - DNA, 22 bp, Homo sapiens
tggcagtggctcagagtgcaga

SEQ ID NO: 7707001 - DNA, 22 bp, Homo sapiens
tggcagtggctcagagtgcaga

SEQ ID NO: 7707002 - DNA, 19 bp, Homo sapiens
tggcagtgtggggtatgaa

SEQ ID NO: 7707003 - DNA, 22 bp, Homo sapiens
tggcagtgttgtgccacattcc

SEQ ID NO: 7707004 - DNA, 22 bp, Homo sapiens
tggcagtgttgtgccacattcc

SEQ ID NO: 7707005 - DNA, 22 bp, Homo sapiens
tggcagtgttgtgccacattcc

SEQ ID NO: 7707006 - DNA, 22 bp, Homo sapiens
tggcagtgtttctaaggggctc

SEQ ID NO: 7707007 - DNA, 22 bp, Homo sapiens
tggcagtgtttctaaggggctc

SEQ ID NO: 7707008 - DNA, 22 bp, Homo sapiens
tggcagtgtttctaaggggctc

SEQ ID NO: 7707009 - DNA, 18 bp, Homo sapiens
tggcataaaatcagagtc

SEQ ID NO: 7707010 - DNA, 23 bp, Homo sapiens
tggcagttttcttttgtgccagc

SEQ ID NO: 7707011 - DNA, 23 bp, Homo sapiens
tggcagttttcttttgtgccagc

SEQ ID NO: 7707012 - DNA, 22 bp, Homo sapiens
tggcagttttgtatttgagcat

SEQ ID NO: 7707013 - DNA, 22 bp, Homo sapiens
tggcagttttgtatttgagcat

SEQ ID NO: 7707014 - DNA, 23 bp, Homo sapiens
tggcatagtgaggggcacagaga

SEQ ID NO: 7707015 - DNA, 22 bp, Homo sapiens
tggcagttttgtatttgagcat

SEQ ID NO: 7707016 - DNA, 22 bp, Homo sapiens
tggcagtttacagagttctgaa

SEQ ID NO: 7707017 - DNA, 22 bp, Homo sapiens
tggcagtttacagagttctgaa

SEQ ID NO: 7707018 - DNA, 22 bp, Homo sapiens
tggcagtttacagagttctgaa

SEQ ID NO: 7707019 - DNA, 22 bp, Homo sapiens
tggcagtttcatgtgattcaac

SEQ ID NO: 7707020 - DNA, 22 bp, Homo sapiens
tggcagtttcatgtgattcaac

SEQ ID NO: 7707021 - DNA, 22 bp, Homo sapiens
tggcagttttcaagagttctgt

SEQ ID NO: 7707022 - DNA, 22 bp, Homo sapiens
tggcagttttcaagagttctgt

SEQ ID NO: 7707023 - DNA, 22 bp, Homo sapiens
tggcagttttcaagagttctgt

SEQ ID NO: 7707024 - DNA, 23 bp, Homo sapiens
tggcagttttcttttgtgccagc

SEQ ID NO: 7707025 - DNA, 22 bp, Homo sapiens
tggcagtgtttctaaggggctc

SEQ ID NO: 7707026 - DNA, 22 bp, Homo sapiens
tggcagtgtttctaaggggctc

SEQ ID NO: 7707027 - DNA, 22 bp, Homo sapiens
tggcagttatattgccttaggg

SEQ ID NO: 7707028 - DNA, 22 bp, Homo sapiens
tggcagttattaatcaagtctt

SEQ ID NO: 7707029 - DNA, 22 bp, Homo sapiens
tggcagttattaatcaagtctt

SEQ ID NO: 7707030 - DNA, 22 bp, Homo sapiens
tggcagttcaggctgcaatcat

SEQ ID NO: 7707031 - DNA, 22 bp, Homo sapiens
tggcagttcaggctgcaatcat

SEQ ID NO: 7707032 - DNA, 22 bp, Homo sapiens
tggcagttcaggctgcaatcat

SEQ ID NO: 7707033 - DNA, 22 bp, Homo sapiens
tggcagttcaggttggactctt

SEQ ID NO: 7707034 - DNA, 22 bp, Homo sapiens
tggcagttgtgaggttcatatt

SEQ ID NO: 7707035 - DNA, 22 bp, Homo sapiens
tggcagttggaaaaacggtttg

SEQ ID NO: 7707036 - DNA, 22 bp, Homo sapiens
tggcagttggggatgaagtgag

SEQ ID NO: 7707037 - DNA, 22 bp, Homo sapiens
tggcagttggggatgaagtgag

SEQ ID NO: 7707038 - DNA, 22 bp, Homo sapiens
tggcagttggggatgaagtgag

SEQ ID NO: 7707039 - DNA, 22 bp, Homo sapiens
tggcagttctaattgaccattt

SEQ ID NO: 7707040 - DNA, 22 bp, Homo sapiens
tggcagttgagttactgggtga

SEQ ID NO: 7707041 - DNA, 22 bp, Homo sapiens
tggcagttgagttactgggtga

SEQ ID NO: 7707042 - DNA, 22 bp, Homo sapiens
tggcagttggaaaaacggtttg

SEQ ID NO: 7707043 - DNA, 22 bp, Homo sapiens
tggcatcatagccaaggtgctt

SEQ ID NO: 7707044 - DNA, 22 bp, Homo sapiens
tggcatataaagatgtgttcaa

SEQ ID NO: 7707045 - DNA, 22 bp, Homo sapiens
tggcatataaagatgtgttcaa

SEQ ID NO: 7707046 - DNA, 23 bp, Homo sapiens
tggcatagtgaggggcacagaga

SEQ ID NO: 7707047 - DNA, 23 bp, Homo sapiens
tggcatagtgaggggcacagaga

SEQ ID NO: 7707048 - DNA, 22 bp, Homo sapiens
tggcatcattttcagctggcca

SEQ ID NO: 7707049 - DNA, 22 bp, Homo sapiens
tggcatatgattcttggcatcc

SEQ ID NO: 7707050 - DNA, 22 bp, Homo sapiens
tggcatcctttatctgcaggct

SEQ ID NO: 7707051 - DNA, 22 bp, Homo sapiens
tggcatcctctcttctgagtgc

SEQ ID NO: 7707052 - DNA, 22 bp, Homo sapiens
tggcatcctccctcaagctgaa

SEQ ID NO: 7707053 - DNA, 22 bp, Homo sapiens
tggcatcctccctcaagctgaa

SEQ ID NO: 7707054 - DNA, 19 bp, Homo sapiens
tggcatcccagtaaagctt

SEQ ID NO: 7707055 - DNA, 22 bp, Homo sapiens
tggcagtccagaccctggactc

SEQ ID NO: 7707056 - DNA, 22 bp, Homo sapiens
tggcagtcagcatttgtagtat

SEQ ID NO: 7707057 - DNA, 22 bp, Homo sapiens
tggcagtcattatcgctgagtc

SEQ ID NO: 7707058 - DNA, 22 bp, Homo sapiens
tggcagtcattatcgctgagtc

SEQ ID NO: 7707059 - DNA, 22 bp, Homo sapiens
tggcagtcagcatttgtagtat

SEQ ID NO: 7707060 - DNA, 22 bp, Homo sapiens
tggcaggtttcgttaaaaatgg

SEQ ID NO: 7707061 - DNA, 21 bp, Homo sapiens
tggcaggttcaaaggcctatc

SEQ ID NO: 7707062 - DNA, 22 bp, Homo sapiens
tggcagtctgggttggcagtta

SEQ ID NO: 7707063 - DNA, 22 bp, Homo sapiens
tggcagtctgggttggcagtta

SEQ ID NO: 7707064 - DNA, 22 bp, Homo sapiens
tggcagtctgggttggcagtta

SEQ ID NO: 7707065 - DNA, 22 bp, Homo sapiens
tggcagtctgcctcttcaccat

SEQ ID NO: 7707066 - DNA, 22 bp, Homo sapiens
tggcagtcctcttcctcgggcg

SEQ ID NO: 7707067 - DNA, 22 bp, Homo sapiens
tggcagtcgatcatattcagca

SEQ ID NO: 7707068 - DNA, 22 bp, Homo sapiens
tggcagtcgatcatattcagca

SEQ ID NO: 7707069 - DNA, 22 bp, Homo sapiens
tggcagtcggacttctatctca

SEQ ID NO: 7707070 - DNA, 22 bp, Homo sapiens
tggcagtcggacttctatctca

SEQ ID NO: 7707071 - DNA, 22 bp, Homo sapiens
tggcagtcccctgtgcctggaa

SEQ ID NO: 7707072 - DNA, 22 bp, Homo sapiens
tggcagtcccctgtgcctggaa

SEQ ID NO: 7707073 - DNA, 22 bp, Homo sapiens
tggcagtccagaccctggactc

SEQ ID NO: 7707074 - DNA, 22 bp, Homo sapiens
tggcagtccagaccctggactc

SEQ ID NO: 7707075 - DNA, 22 bp, Homo sapiens
tggcagtccagaccctggactc

SEQ ID NO: 7707076 - DNA, 22 bp, Homo sapiens
tggcagtccctctggtagcacc

SEQ ID NO: 7707077 - DNA, 22 bp, Homo sapiens
tggcagtccctctggtagcacc

SEQ ID NO: 7707078 - DNA, 22 bp, Homo sapiens
tggcagtcccctgtgcctggaa

SEQ ID NO: 7707079 - DNA, 22 bp, Homo sapiens
tggcagtcccctgtgcctggaa

SEQ ID NO: 7707080 - DNA, 22 bp, Homo sapiens
tggcagtccctctggtagcacc

SEQ ID NO: 7707081 - DNA, 22 bp, Homo sapiens
tggcagtcttgctctctaagag

SEQ ID NO: 7707082 - DNA, 22 bp, Homo sapiens
tggcagtcttgctctctaagag

SEQ ID NO: 7707083 - DNA, 22 bp, Homo sapiens
tggcagtcttcatcagttctgg

SEQ ID NO: 7707084 - DNA, 22 bp, Homo sapiens
tggcagtcttcatcagttctgg

SEQ ID NO: 7707085 - DNA, 22 bp, Homo sapiens
tggcagtcttgtaggcatctcc

SEQ ID NO: 7707086 - DNA, 22 bp, Homo sapiens
tggcagtcttgtaggcatctcc

SEQ ID NO: 7707087 - DNA, 22 bp, Homo sapiens
tggcagtcttgtaggcatctcc

SEQ ID NO: 7707088 - DNA, 22 bp, Homo sapiens
tggcagtgaaagacaattgggc

SEQ ID NO: 7707089 - DNA, 22 bp, Homo sapiens
tggcagtgaaccaaggctccaa

SEQ ID NO: 7707090 - DNA, 22 bp, Homo sapiens
tggcagtgaaccaaggctccaa

SEQ ID NO: 7707091 - DNA, 22 bp, Homo sapiens
tggcagtgaaagacaattgggc

SEQ ID NO: 7707092 - DNA, 22 bp, Homo sapiens
tggcagtgaaccaaggctccaa

SEQ ID NO: 7707093 - DNA, 22 bp, Homo sapiens
tggcagtgaagctgtctttagg

SEQ ID NO: 7707094 - DNA, 18 bp, Homo sapiens
tggcagtgaggtaggcat

SEQ ID NO: 7707095 - DNA, 18 bp, Homo sapiens
tggcagtgaggtaggcat

SEQ ID NO: 7707096 - DNA, 18 bp, Homo sapiens
tggcagtgaggtaggcat

SEQ ID NO: 7707097 - DNA, 23 bp, Homo sapiens
tggcagtgatcaaaagcttacat

SEQ ID NO: 7707098 - DNA, 18 bp, Homo sapiens
tggcagtgaggtaggcat

SEQ ID NO: 7707099 - DNA, 23 bp, Homo sapiens
tggcagtgcccagggagatgatc

SEQ ID NO: 7707100 - DNA, 18 bp, Homo sapiens
tggcagtgccaccttctc

SEQ ID NO: 7707101 - DNA, 22 bp, Homo sapiens
tggcagtgccccttgaccagtg

SEQ ID NO: 7707102 - DNA, 22 bp, Homo sapiens
tggcagtgccccttgaccagtg

SEQ ID NO: 7707103 - DNA, 23 bp, Homo sapiens
tggcagtgcccagggagatgatc

SEQ ID NO: 7707104 - DNA, 18 bp, Homo sapiens
tggcagtgccaccttctc

SEQ ID NO: 7707105 - DNA, 18 bp, Homo sapiens
tggcagtgaggtaggcat

SEQ ID NO: 7707106 - DNA, 22 bp, Homo sapiens
tggcagtgatgcggcaggacat

SEQ ID NO: 7707107 - DNA, 22 bp, Homo sapiens
tggcagtgatgcggcaggacat

SEQ ID NO: 7707108 - DNA, 22 bp, Homo sapiens
tggcagtgatgcggcaggacat

SEQ ID NO: 7707109 - DNA, 22 bp, Homo sapiens
tggcagtgatgcggcaggacat

SEQ ID NO: 7707110 - DNA, 22 bp, Homo sapiens
tggcagtgatgcggcaggacat

SEQ ID NO: 7707111 - DNA, 22 bp, Homo sapiens
tggcagtgatgcggcaggacat

SEQ ID NO: 7707112 - DNA, 22 bp, Homo sapiens
tggcagtgatgcggcaggacat

SEQ ID NO: 7707113 - DNA, 22 bp, Homo sapiens
tggcaggtcatgagtggccacc

SEQ ID NO: 7707114 - DNA, 22 bp, Homo sapiens
tggcagggtggcaacttttggt

SEQ ID NO: 7707115 - DNA, 22 bp, Homo sapiens
tggcagggtggcaacttttggt

SEQ ID NO: 7707116 - DNA, 22 bp, Homo sapiens
tggcagggtggcaacttttggt

SEQ ID NO: 7707117 - DNA, 22 bp, Homo sapiens
tggcagggtgccagttgcgagt

SEQ ID NO: 7707118 - DNA, 22 bp, Homo sapiens
tggcagggtgccagttgcgagt

SEQ ID NO: 7707119 - DNA, 22 bp, Homo sapiens
tggcagggtgccagttgcgagt

SEQ ID NO: 7707120 - DNA, 22 bp, Homo sapiens
tggcagggtgccagttgcgagt

SEQ ID NO: 7707121 - DNA, 22 bp, Homo sapiens
tggcagggtgccagttgcgagt

SEQ ID NO: 7707122 - DNA, 22 bp, Homo sapiens
tggcagggtgccagttgcgagt

SEQ ID NO: 7707123 - DNA, 22 bp, Homo sapiens
tggcagggtgccagttgcgagt

SEQ ID NO: 7707124 - DNA, 22 bp, Homo sapiens
tggcagggtcttgctgtgttgc

SEQ ID NO: 7707125 - DNA, 22 bp, Homo sapiens
tggcagggtcttgctgtgttgc

SEQ ID NO: 7707126 - DNA, 22 bp, Homo sapiens
tggcagggtcttgctgtgttgc

SEQ ID NO: 7707127 - DNA, 22 bp, Homo sapiens
tggcagggtgccagttgcgagt

SEQ ID NO: 7707128 - DNA, 22 bp, Homo sapiens
tggcagggtcttgctgtgttgc

SEQ ID NO: 7707129 - DNA, 22 bp, Homo sapiens
tggcagggtcttgctgtgttgc

SEQ ID NO: 7707130 - DNA, 22 bp, Homo sapiens
tggcagggtcttgctgtgttgc

SEQ ID NO: 7707131 - DNA, 22 bp, Homo sapiens
tggcagggtcttgctgtgttgc

SEQ ID NO: 7707132 - DNA, 22 bp, Homo sapiens
tggcagggtcttgctgtgttgc

SEQ ID NO: 7707133 - DNA, 22 bp, Homo sapiens
tggcagggtcttgctgtgttgc

SEQ ID NO: 7707134 - DNA, 22 bp, Homo sapiens
tggcagggtcttgctgtgttgc

SEQ ID NO: 7707135 - DNA, 22 bp, Homo sapiens
tggcaggtggagacagcagagc

SEQ ID NO: 7707136 - DNA, 22 bp, Homo sapiens
tggcaggtggcacagcctggga

SEQ ID NO: 7707137 - DNA, 22 bp, Homo sapiens
tggcaggtggctctggcattct

SEQ ID NO: 7707138 - DNA, 22 bp, Homo sapiens
tggcaggtgcctgtaatctcag

SEQ ID NO: 7707139 - DNA, 22 bp, Homo sapiens
tggcaggtgaagttgttaggga

SEQ ID NO: 7707140 - DNA, 22 bp, Homo sapiens
tggcaggtgaagttgttaggga

SEQ ID NO: 7707141 - DNA, 22 bp, Homo sapiens
tggcaggtccactcacagatct

SEQ ID NO: 7707142 - DNA, 18 bp, Homo sapiens
tggcaggtccagctgtgg

SEQ ID NO: 7707143 - DNA, 18 bp, Homo sapiens
tggcaggtccagctgtgg

SEQ ID NO: 7707144 - DNA, 18 bp, Homo sapiens
tggcaggtccagctgtgg

SEQ ID NO: 7707145 - DNA, 21 bp, Homo sapiens
tggccagctggagtctccaca

SEQ ID NO: 7707146 - DNA, 21 bp, Homo sapiens
tggccagctggagtctccaca

SEQ ID NO: 7707147 - DNA, 21 bp, Homo sapiens
tggccagctgctcgtctcctc

SEQ ID NO: 7707148 - DNA, 21 bp, Homo sapiens
tggccagctgctcgtctcctc

SEQ ID NO: 7707149 - DNA, 21 bp, Homo sapiens
tggccagctgctcgtctcctc

SEQ ID NO: 7707150 - DNA, 21 bp, Homo sapiens
tggccagctgctcgtctcctc

SEQ ID NO: 7707151 - DNA, 22 bp, Homo sapiens
tggccaggcattcagataagac

SEQ ID NO: 7707152 - DNA, 21 bp, Homo sapiens
tggccagctggagtctccaca

SEQ ID NO: 7707153 - DNA, 21 bp, Homo sapiens
tggccagctggagtctccaca

SEQ ID NO: 7707154 - DNA, 22 bp, Homo sapiens
tggccaggcattcagataagac

SEQ ID NO: 7707155 - DNA, 22 bp, Homo sapiens
tggccagctgagatttagcaca

SEQ ID NO: 7707156 - DNA, 22 bp, Homo sapiens
tggccagccttgtcatcgcttt

SEQ ID NO: 7707157 - DNA, 22 bp, Homo sapiens
tggccagccttgtcatcgcttt

SEQ ID NO: 7707158 - DNA, 22 bp, Homo sapiens
tggccagctgagatttagcaca

SEQ ID NO: 7707159 - DNA, 22 bp, Homo sapiens
tggccagcctggtgcttgctcc

SEQ ID NO: 7707160 - DNA, 22 bp, Homo sapiens
tggccaggccggggacagaact

SEQ ID NO: 7707161 - DNA, 22 bp, Homo sapiens
tggccaggccggggacagaact

SEQ ID NO: 7707162 - DNA, 22 bp, Homo sapiens
tggccaggccggggacagaact

SEQ ID NO: 7707163 - DNA, 22 bp, Homo sapiens
tggccaggcctcttggtgccca

SEQ ID NO: 7707164 - DNA, 22 bp, Homo sapiens
tggccaggcctcttggtgccca

SEQ ID NO: 7707165 - DNA, 22 bp, Homo sapiens
tggccaggcctcttggtgccca

SEQ ID NO: 7707166 - DNA, 22 bp, Homo sapiens
tggccaggcctcttggtgccca

SEQ ID NO: 7707167 - DNA, 22 bp, Homo sapiens
tggccaggccggggacagaact

SEQ ID NO: 7707168 - DNA, 22 bp, Homo sapiens
tggccaggccggggacagaact

SEQ ID NO: 7707169 - DNA, 22 bp, Homo sapiens
tggccaggccggggacagaact

SEQ ID NO: 7707170 - DNA, 22 bp, Homo sapiens
tggccaggccggggacagaact

SEQ ID NO: 7707171 - DNA, 17 bp, Homo sapiens
tggccaggccccgccag

SEQ ID NO: 7707172 - DNA, 17 bp, Homo sapiens
tggccaggccccgccag

SEQ ID NO: 7707173 - DNA, 22 bp, Homo sapiens
tggccagcacttagcccttacc

SEQ ID NO: 7707174 - DNA, 22 bp, Homo sapiens
tggccagcacttagcccttacc

SEQ ID NO: 7707175 - DNA, 22 bp, Homo sapiens
tggccagcacttagcccttacc

SEQ ID NO: 7707176 - DNA, 22 bp, Homo sapiens
tggccagcacttagcccttacc

SEQ ID NO: 7707177 - DNA, 23 bp, Homo sapiens
tggccagcagaagcaaggggagc

SEQ ID NO: 7707178 - DNA, 23 bp, Homo sapiens
tggccagcagaagcaaggggagc

SEQ ID NO: 7707179 - DNA, 23 bp, Homo sapiens
tggccagcagaagcaaggggagc

SEQ ID NO: 7707180 - DNA, 23 bp, Homo sapiens
tggccagcagaagcaaggggagc

SEQ ID NO: 7707181 - DNA, 22 bp, Homo sapiens
tggccagattcatgcatgtatc

SEQ ID NO: 7707182 - DNA, 22 bp, Homo sapiens
tggccagattcatgcatgtatc

SEQ ID NO: 7707183 - DNA, 22 bp, Homo sapiens
tggccagagtccagtgagcctt

SEQ ID NO: 7707184 - DNA, 22 bp, Homo sapiens
tggccagagttgagggggtttc

SEQ ID NO: 7707185 - DNA, 22 bp, Homo sapiens
tggccagccacaatataaagta

SEQ ID NO: 7707186 - DNA, 22 bp, Homo sapiens
tggccagccagaaagaagcctt

SEQ ID NO: 7707187 - DNA, 22 bp, Homo sapiens
tggccagccacaatataaagta

SEQ ID NO: 7707188 - DNA, 22 bp, Homo sapiens
tggccagccagaaagaagcctt

SEQ ID NO: 7707189 - DNA, 22 bp, Homo sapiens
tggccagccagaaagaagcctt

SEQ ID NO: 7707190 - DNA, 22 bp, Homo sapiens
tggccagccagaaagaagcctt

SEQ ID NO: 7707191 - DNA, 22 bp, Homo sapiens
tggccagccagaaagaagcctt

SEQ ID NO: 7707192 - DNA, 22 bp, Homo sapiens
tggccagcagagttcactctct

SEQ ID NO: 7707193 - DNA, 22 bp, Homo sapiens
tggccagcagagttcactctct

SEQ ID NO: 7707194 - DNA, 22 bp, Homo sapiens
tggccagcagagttcactctct

SEQ ID NO: 7707195 - DNA, 22 bp, Homo sapiens
tggccagcagagttcactctct

SEQ ID NO: 7707196 - DNA, 22 bp, Homo sapiens
tggccagccctcttcccacact

SEQ ID NO: 7707197 - DNA, 22 bp, Homo sapiens
tggccagccataaaagaaccca

SEQ ID NO: 7707198 - DNA, 22 bp, Homo sapiens
tggccagccataaaagaaccca

SEQ ID NO: 7707199 - DNA, 22 bp, Homo sapiens
tggccagccagaaagaagcctt

SEQ ID NO: 7707200 - DNA, 22 bp, Homo sapiens
tggccagccataaaagaaccca

SEQ ID NO: 7707201 - DNA, 22 bp, Homo sapiens
tggccagccataaaagaaccca

SEQ ID NO: 7707202 - DNA, 22 bp, Homo sapiens
tggccagcccttcagccatgcc

SEQ ID NO: 7707203 - DNA, 22 bp, Homo sapiens
tggccagccctcttcccacact

SEQ ID NO: 7707204 - DNA, 22 bp, Homo sapiens
tggccagccctcttcccacact

SEQ ID NO: 7707205 - DNA, 22 bp, Homo sapiens
tggccagccctcttcccacact

SEQ ID NO: 7707206 - DNA, 22 bp, Homo sapiens
tggccagccctcttcccacact

SEQ ID NO: 7707207 - DNA, 22 bp, Homo sapiens
tggccagcccttcagccatgcc

SEQ ID NO: 7707208 - DNA, 22 bp, Homo sapiens
tggccagcccttcagccatgcc

SEQ ID NO: 7707209 - DNA, 22 bp, Homo sapiens
tggccagcccttcagccatgcc

SEQ ID NO: 7707210 - DNA, 22 bp, Homo sapiens
tggccagcccttcagccatgcc

SEQ ID NO: 7707211 - DNA, 22 bp, Homo sapiens
tggccagcccttcagccatgcc

SEQ ID NO: 7707212 - DNA, 22 bp, Homo sapiens
tggccagcccttcagccatgcc

SEQ ID NO: 7707213 - DNA, 22 bp, Homo sapiens
tggccagcccttcagccatgcc

SEQ ID NO: 7707214 - DNA, 22 bp, Homo sapiens
tggccagcccttcagccatgcc

SEQ ID NO: 7707215 - DNA, 22 bp, Homo sapiens
tggccagcccttcagccatgcc

SEQ ID NO: 7707216 - DNA, 22 bp, Homo sapiens
tggccagcccttcagccatgcc

SEQ ID NO: 7707217 - DNA, 22 bp, Homo sapiens
tggccaggctggtctggaacgc

SEQ ID NO: 7707218 - DNA, 22 bp, Homo sapiens
tggccaggctggtctggaacgc

SEQ ID NO: 7707219 - DNA, 22 bp, Homo sapiens
tggccaggctggtctggaacgc

SEQ ID NO: 7707220 - DNA, 22 bp, Homo sapiens
tggccaggctggtctggaacgc

SEQ ID NO: 7707221 - DNA, 22 bp, Homo sapiens
tggccaggctggtctggaacgc

SEQ ID NO: 7707222 - DNA, 22 bp, Homo sapiens
tggccaggcctcttggtgccca

SEQ ID NO: 7707223 - DNA, 22 bp, Homo sapiens
tggccaggcctcttggtgccca

SEQ ID NO: 7707224 - DNA, 22 bp, Homo sapiens
tggccaggcctcttggtgccca

SEQ ID NO: 7707225 - DNA, 22 bp, Homo sapiens
tggccaggcctcttggtgccca

SEQ ID NO: 7707226 - DNA, 22 bp, Homo sapiens
tggccaggctggtctggaacgc

SEQ ID NO: 7707227 - DNA, 22 bp, Homo sapiens
tggccaggctggtctggaacgc

SEQ ID NO: 7707228 - DNA, 22 bp, Homo sapiens
tggccaggctggtctggaacgc

SEQ ID NO: 7707229 - DNA, 22 bp, Homo sapiens
tggccaggggagttcccctcca

SEQ ID NO: 7707230 - DNA, 22 bp, Homo sapiens
tggccaggggagttcccctcca

SEQ ID NO: 7707231 - DNA, 22 bp, Homo sapiens
tggccaggctggtctggaacgc

SEQ ID NO: 7707232 - DNA, 23 bp, Homo sapiens
tggccagggtactacacccaccc

SEQ ID NO: 7707233 - DNA, 23 bp, Homo sapiens
tggccagggtactacacccaccc

SEQ ID NO: 7707234 - DNA, 23 bp, Homo sapiens
tggccagggtactacacccaccc

SEQ ID NO: 7707235 - DNA, 19 bp, Homo sapiens
tggccaggtactgtctgct

SEQ ID NO: 7707236 - DNA, 19 bp, Homo sapiens
tggccaggtactgtctgct

SEQ ID NO: 7707237 - DNA, 19 bp, Homo sapiens
tggccaggtactgtctgct

SEQ ID NO: 7707238 - DNA, 19 bp, Homo sapiens
tggccaggtactgtctgct

SEQ ID NO: 7707239 - DNA, 19 bp, Homo sapiens
tggccaggtactgtctgct

SEQ ID NO: 7707240 - DNA, 22 bp, Homo sapiens
tggccaggggagttcccctcca

SEQ ID NO: 7707241 - DNA, 23 bp, Homo sapiens
tggccagggtactacacccaccc

SEQ ID NO: 7707242 - DNA, 23 bp, Homo sapiens
tggccagggtactacacccaccc

SEQ ID NO: 7707243 - DNA, 22 bp, Homo sapiens
tggccaggggagttcccctcca

SEQ ID NO: 7707244 - DNA, 23 bp, Homo sapiens
tggccagggtactacacccaccc

SEQ ID NO: 7707245 - DNA, 22 bp, Homo sapiens
tggccagtagagctcagatagt

SEQ ID NO: 7707246 - DNA, 22 bp, Homo sapiens
tggccagtaatagcttctggtg

SEQ ID NO: 7707247 - DNA, 22 bp, Homo sapiens
tggccagtaatagcttctggtg

SEQ ID NO: 7707248 - DNA, 22 bp, Homo sapiens
tggccagtagataggcaggcaa

SEQ ID NO: 7707249 - DNA, 22 bp, Homo sapiens
tggccagtagataggcaggcaa

SEQ ID NO: 7707250 - DNA, 22 bp, Homo sapiens
tggccagtagagctcagatagt

SEQ ID NO: 7707251 - DNA, 22 bp, Homo sapiens
tggccagtagataggcaggcaa

SEQ ID NO: 7707252 - DNA, 22 bp, Homo sapiens
tggccagtagataggcaggcaa

SEQ ID NO: 7707253 - DNA, 22 bp, Homo sapiens
tggccagtagataggcaggcaa

SEQ ID NO: 7707254 - DNA, 22 bp, Homo sapiens
tggccaggttgggctttgcagc

SEQ ID NO: 7707255 - DNA, 22 bp, Homo sapiens
tggccaggttgggctttgcagc

SEQ ID NO: 7707256 - DNA, 22 bp, Homo sapiens
tggccaggtgtgggttctcaga

SEQ ID NO: 7707257 - DNA, 22 bp, Homo sapiens
tggccaggtgtgggttctcaga

SEQ ID NO: 7707258 - DNA, 22 bp, Homo sapiens
tggccaggtgtgggttctcaga

SEQ ID NO: 7707259 - DNA, 23 bp, Homo sapiens
tggccaggtagaggaggtagtga

SEQ ID NO: 7707260 - DNA, 23 bp, Homo sapiens
tggccaggtagaggaggtagtga

SEQ ID NO: 7707261 - DNA, 23 bp, Homo sapiens
tggccaggtagaggaggtagtga

SEQ ID NO: 7707262 - DNA, 23 bp, Homo sapiens
tggccaggtagaggaggtagtga

SEQ ID NO: 7707263 - DNA, 23 bp, Homo sapiens
tggccaggtagaggaggtagtga

SEQ ID NO: 7707264 - DNA, 23 bp, Homo sapiens
tggccaggtagaggaggtagtga

SEQ ID NO: 7707265 - DNA, 19 bp, Homo sapiens
tggccaggtactgtctgct

SEQ ID NO: 7707266 - DNA, 19 bp, Homo sapiens
tggccaggtactgtctgct

SEQ ID NO: 7707267 - DNA, 19 bp, Homo sapiens
tggccaggtactgtctgct

SEQ ID NO: 7707268 - DNA, 19 bp, Homo sapiens
tggccaggtactgtctgct

SEQ ID NO: 7707269 - DNA, 23 bp, Homo sapiens
tggccaggtagaggaggtagtga

SEQ ID NO: 7707270 - DNA, 23 bp, Homo sapiens
tggccaggtagaggaggtagtga

SEQ ID NO: 7707271 - DNA, 20 bp, Homo sapiens
tggccacctgcgtcccagcc

SEQ ID NO: 7707272 - DNA, 22 bp, Homo sapiens
tggccactcctccctgcaggct

SEQ ID NO: 7707273 - DNA, 22 bp, Homo sapiens
tggccactcctccctgcaggct

SEQ ID NO: 7707274 - DNA, 22 bp, Homo sapiens
tggccactcctccctgcaggct

SEQ ID NO: 7707275 - DNA, 22 bp, Homo sapiens
tggccactcctccctgcaggct

SEQ ID NO: 7707276 - DNA, 22 bp, Homo sapiens
tggccacttggcatgtgtgcca

SEQ ID NO: 7707277 - DNA, 22 bp, Homo sapiens
tggccacttggcatgtgtgcca

SEQ ID NO: 7707278 - DNA, 22 bp, Homo sapiens
tggccacttggcatgtgtgcca

SEQ ID NO: 7707279 - DNA, 20 bp, Homo sapiens
tggccactggccactggagc

SEQ ID NO: 7707280 - DNA, 22 bp, Homo sapiens
tggccactggcttccactgagt

SEQ ID NO: 7707281 - DNA, 22 bp, Homo sapiens
tggccaccttatggctattgga

SEQ ID NO: 7707282 - DNA, 22 bp, Homo sapiens
tggccaccttcccacttctgcc

SEQ ID NO: 7707283 - DNA, 22 bp, Homo sapiens
tggccaccttcccacttctgcc

SEQ ID NO: 7707284 - DNA, 22 bp, Homo sapiens
tggccactcagggatgcaggaa

SEQ ID NO: 7707285 - DNA, 22 bp, Homo sapiens
tggccactcagggatgcaggaa

SEQ ID NO: 7707286 - DNA, 20 bp, Homo sapiens
tggccacctgcgtcccagcc

SEQ ID NO: 7707287 - DNA, 22 bp, Homo sapiens
tggccaccttatggctattgga

SEQ ID NO: 7707288 - DNA, 20 bp, Homo sapiens
tggccacctgcgtcccagcc

SEQ ID NO: 7707289 - DNA, 19 bp, Homo sapiens
tggccacctctgctgttct

SEQ ID NO: 7707290 - DNA, 19 bp, Homo sapiens
tggccacctctgctgttct

SEQ ID NO: 7707291 - DNA, 19 bp, Homo sapiens
tggccacctctgctgttct

SEQ ID NO: 7707292 - DNA, 22 bp, Homo sapiens
tggccagagtccagtgagcctt

SEQ ID NO: 7707293 - DNA, 22 bp, Homo sapiens
tggccagagtccagtgagcctt

SEQ ID NO: 7707294 - DNA, 17 bp, Homo sapiens
tggccagagcaggcccc

SEQ ID NO: 7707295 - DNA, 22 bp, Homo sapiens
tggccagagtccagtgagcctt

SEQ ID NO: 7707296 - DNA, 22 bp, Homo sapiens
tggccagagtccagtgagcctt

SEQ ID NO: 7707297 - DNA, 17 bp, Homo sapiens
tggccagagcaggcccc

SEQ ID NO: 7707298 - DNA, 17 bp, Homo sapiens
tggccagagcaggcccc

SEQ ID NO: 7707299 - DNA, 22 bp, Homo sapiens
tggccagacctgactgtcaggg

SEQ ID NO: 7707300 - DNA, 22 bp, Homo sapiens
tggccagacagagaggctttgt

SEQ ID NO: 7707301 - DNA, 22 bp, Homo sapiens
tggccagacagagaggctttgt

SEQ ID NO: 7707302 - DNA, 22 bp, Homo sapiens
tggccagaactcagacatgtgg

SEQ ID NO: 7707303 - DNA, 22 bp, Homo sapiens
tggccagaacctgcagtaggcc

SEQ ID NO: 7707304 - DNA, 22 bp, Homo sapiens
tggccagaacctgcagtaggcc

SEQ ID NO: 7707305 - DNA, 22 bp, Homo sapiens
tggccagaactcagacatgtgg

SEQ ID NO: 7707306 - DNA, 22 bp, Homo sapiens
tggccagaactcagacatgtgg

SEQ ID NO: 7707307 - DNA, 23 bp, Homo sapiens
tggccacagtccatgcatgccca

SEQ ID NO: 7707308 - DNA, 23 bp, Homo sapiens
tggccacagtccatgcatgccca

SEQ ID NO: 7707309 - DNA, 22 bp, Homo sapiens
tggccacagtgtccagcagcag

SEQ ID NO: 7707310 - DNA, 23 bp, Homo sapiens
tggccacagtccatgcatgccca

SEQ ID NO: 7707311 - DNA, 22 bp, Homo sapiens
tggccacagtgtccagcagcag

SEQ ID NO: 7707312 - DNA, 22 bp, Homo sapiens
tggccacagtgtccagcagcag

SEQ ID NO: 7707313 - DNA, 22 bp, Homo sapiens
tggccacagtgtccagcagcag

SEQ ID NO: 7707314 - DNA, 22 bp, Homo sapiens
tggccacagtgtccagcagcag

SEQ ID NO: 7707315 - DNA, 22 bp, Homo sapiens
tggccacatatgtgggacagct

SEQ ID NO: 7707316 - DNA, 22 bp, Homo sapiens
tggccacatatgtgggacagct

SEQ ID NO: 7707317 - DNA, 22 bp, Homo sapiens
tggccacatatgtgggacagct

SEQ ID NO: 7707318 - DNA, 22 bp, Homo sapiens
tggccacatcctttccttgtca

SEQ ID NO: 7707319 - DNA, 22 bp, Homo sapiens
tggccacatatgtgggacagct

SEQ ID NO: 7707320 - DNA, 22 bp, Homo sapiens
tggccacatgcgtctgtgaggc

SEQ ID NO: 7707321 - DNA, 22 bp, Homo sapiens
tggccacatctgaaatgagtgt

SEQ ID NO: 7707322 - DNA, 22 bp, Homo sapiens
tggccacatctgaaatgagtgt

SEQ ID NO: 7707323 - DNA, 22 bp, Homo sapiens
tggccacatcctttccttgtca

SEQ ID NO: 7707324 - DNA, 22 bp, Homo sapiens
tggccacatatgtgggacagct

SEQ ID NO: 7707325 - DNA, 22 bp, Homo sapiens
tggccacatcctttccttgtca

SEQ ID NO: 7707326 - DNA, 22 bp, Homo sapiens
tggccacatctgaaatgagtgt

SEQ ID NO: 7707327 - DNA, 22 bp, Homo sapiens
tggccacatcctttccttgtca

SEQ ID NO: 7707328 - DNA, 22 bp, Homo sapiens
tggccacatgcgtctgtgaggc

SEQ ID NO: 7707329 - DNA, 22 bp, Homo sapiens
tggccacatgcgtctgtgaggc

SEQ ID NO: 7707330 - DNA, 22 bp, Homo sapiens
tggccacatgcgtctgtgaggc

SEQ ID NO: 7707331 - DNA, 22 bp, Homo sapiens
tggccacatgcgtctgtgaggc

SEQ ID NO: 7707332 - DNA, 22 bp, Homo sapiens
tggccacatgcgtctgtgaggc

SEQ ID NO: 7707333 - DNA, 22 bp, Homo sapiens
tggccaccaccaatacttgcct

SEQ ID NO: 7707334 - DNA, 20 bp, Homo sapiens
tggccaccactgtatatcaa

SEQ ID NO: 7707335 - DNA, 20 bp, Homo sapiens
tggccaccactgtatatcaa

SEQ ID NO: 7707336 - DNA, 22 bp, Homo sapiens
tggccacccaccctaatctttc

SEQ ID NO: 7707337 - DNA, 22 bp, Homo sapiens
tggccaccaccaatacttgcct

SEQ ID NO: 7707338 - DNA, 22 bp, Homo sapiens
tggccacccagctgacgccttc

SEQ ID NO: 7707339 - DNA, 22 bp, Homo sapiens
tggccacccctttctctgcact

SEQ ID NO: 7707340 - DNA, 22 bp, Homo sapiens
tggccacccctttctctgcact

SEQ ID NO: 7707341 - DNA, 22 bp, Homo sapiens
tggccacccctttctctgcact

SEQ ID NO: 7707342 - DNA, 22 bp, Homo sapiens
tggccacccctttctctgcact

SEQ ID NO: 7707343 - DNA, 22 bp, Homo sapiens
tggccacccctttctctgcact

SEQ ID NO: 7707344 - DNA, 22 bp, Homo sapiens
tggccacccccaatgtcagtag

SEQ ID NO: 7707345 - DNA, 22 bp, Homo sapiens
tggccacccccaatgtcagtag

SEQ ID NO: 7707346 - DNA, 22 bp, Homo sapiens
tggccacccccaatgtcagtag

SEQ ID NO: 7707347 - DNA, 22 bp, Homo sapiens
tggccacccagctgacgccttc

SEQ ID NO: 7707348 - DNA, 22 bp, Homo sapiens
tggccacccagctgacgccttc

SEQ ID NO: 7707349 - DNA, 22 bp, Homo sapiens
tggcatttcctcagtgctcaga

SEQ ID NO: 7707350 - DNA, 22 bp, Homo sapiens
tggcatttcagtattttcataa

SEQ ID NO: 7707351 - DNA, 22 bp, Homo sapiens
tggcatttcagtattttcataa

SEQ ID NO: 7707352 - DNA, 22 bp, Homo sapiens
tggcatttcagtattttcataa

SEQ ID NO: 7707353 - DNA, 23 bp, Homo sapiens
tggcatttctatactggcaagtg

SEQ ID NO: 7707354 - DNA, 22 bp, Homo sapiens
tggcatttcctcagtgctcaga

SEQ ID NO: 7707355 - DNA, 22 bp, Homo sapiens
tggcatttcctcagtgctcaga

SEQ ID NO: 7707356 - DNA, 22 bp, Homo sapiens
tggcatttcctcagtgctcaga

SEQ ID NO: 7707357 - DNA, 22 bp, Homo sapiens
tggcatttcacctttcatttcc

SEQ ID NO: 7707358 - DNA, 22 bp, Homo sapiens
tggcatttcacctttcatttcc

SEQ ID NO: 7707359 - DNA, 22 bp, Homo sapiens
tggcatttcacctttcatttcc

SEQ ID NO: 7707360 - DNA, 22 bp, Homo sapiens
tggcatttcacctttcatttcc

SEQ ID NO: 7707361 - DNA, 22 bp, Homo sapiens
tggcatttcagtattttcataa

SEQ ID NO: 7707362 - DNA, 22 bp, Homo sapiens
tggcatttagagaaatgaagga

SEQ ID NO: 7707363 - DNA, 22 bp, Homo sapiens
tggcatttagttgcgtattgca

SEQ ID NO: 7707364 - DNA, 22 bp, Homo sapiens
tggcatttatatcccagtttat

SEQ ID NO: 7707365 - DNA, 22 bp, Homo sapiens
tggcatttatatcccagtttat

SEQ ID NO: 7707366 - DNA, 22 bp, Homo sapiens
tggcatttatatcccagtttat

SEQ ID NO: 7707367 - DNA, 22 bp, Homo sapiens
tggcattggttgccaggctgtg

SEQ ID NO: 7707368 - DNA, 22 bp, Homo sapiens
tggcatttagaaaacaacatgt

SEQ ID NO: 7707369 - DNA, 22 bp, Homo sapiens
tggcatttagaaaacaacatgt

SEQ ID NO: 7707370 - DNA, 22 bp, Homo sapiens
tggcatttagaaaacaacatgt

SEQ ID NO: 7707371 - DNA, 22 bp, Homo sapiens
tggcatttagaaaacaacatgt

SEQ ID NO: 7707372 - DNA, 22 bp, Homo sapiens
tggcatttagagaaatgaagga

SEQ ID NO: 7707373 - DNA, 22 bp, Homo sapiens
tggccacagcctctgccagttc

SEQ ID NO: 7707374 - DNA, 22 bp, Homo sapiens
tggccacactgcccccactggg

SEQ ID NO: 7707375 - DNA, 22 bp, Homo sapiens
tggccacagcctctgccagttc

SEQ ID NO: 7707376 - DNA, 22 bp, Homo sapiens
tggccacagcctctgccagttc

SEQ ID NO: 7707377 - DNA, 22 bp, Homo sapiens
tggccacagcctctgccagttc

SEQ ID NO: 7707378 - DNA, 22 bp, Homo sapiens
tggccacagcctctgccagttc

SEQ ID NO: 7707379 - DNA, 22 bp, Homo sapiens
tggccacagcctctgccagttc

SEQ ID NO: 7707380 - DNA, 22 bp, Homo sapiens
tggccacactgcccccactggg

SEQ ID NO: 7707381 - DNA, 23 bp, Homo sapiens
tggccacagtccatgcatgccca

SEQ ID NO: 7707382 - DNA, 23 bp, Homo sapiens
tggccacagtccatgcatgccca

SEQ ID NO: 7707383 - DNA, 23 bp, Homo sapiens
tggccacagggtgctccattgta

SEQ ID NO: 7707384 - DNA, 23 bp, Homo sapiens
tggccacagggtgctccattgta

SEQ ID NO: 7707385 - DNA, 22 bp, Homo sapiens
tggccacactgcccccactggg

SEQ ID NO: 7707386 - DNA, 22 bp, Homo sapiens
tggccacactgcccccactggg

SEQ ID NO: 7707387 - DNA, 22 bp, Homo sapiens
tggccacacccacctagaggag

SEQ ID NO: 7707388 - DNA, 22 bp, Homo sapiens
tggccacacccacctagaggag

SEQ ID NO: 7707389 - DNA, 22 bp, Homo sapiens
tggcatttctgttagactctca

SEQ ID NO: 7707390 - DNA, 22 bp, Homo sapiens
tggcatttctggccatttgtgt

SEQ ID NO: 7707391 - DNA, 22 bp, Homo sapiens
tggcatttctggccatttgtgt

SEQ ID NO: 7707392 - DNA, 23 bp, Homo sapiens
tggcatttctatactggcaagtg

SEQ ID NO: 7707393 - DNA, 23 bp, Homo sapiens
tggcatttctatactggcaagtg

SEQ ID NO: 7707394 - DNA, 23 bp, Homo sapiens
tggcatttctatactggcaagtg

SEQ ID NO: 7707395 - DNA, 22 bp, Homo sapiens
tggcatttctggccatttgtgt

SEQ ID NO: 7707396 - DNA, 22 bp, Homo sapiens
tggcatgtggcaatgttgggat

SEQ ID NO: 7707397 - DNA, 22 bp, Homo sapiens
tggcatgtctgagggaggtttg

SEQ ID NO: 7707398 - DNA, 22 bp, Homo sapiens
tggcatgtggcagctggttcag

SEQ ID NO: 7707399 - DNA, 22 bp, Homo sapiens
tggcatgtccacttcaacagtt

SEQ ID NO: 7707400 - DNA, 22 bp, Homo sapiens
tggcatgtccacttcaacagtt

SEQ ID NO: 7707401 - DNA, 22 bp, Homo sapiens
tggcatgtccacttcaacagtt

SEQ ID NO: 7707402 - DNA, 22 bp, Homo sapiens
tggcatgtatttgtggtgaatt

SEQ ID NO: 7707403 - DNA, 22 bp, Homo sapiens
tggcatgtatttgtggtgaatt

SEQ ID NO: 7707404 - DNA, 22 bp, Homo sapiens
tggcatgtggctttgagtcatc

SEQ ID NO: 7707405 - DNA, 22 bp, Homo sapiens
tggcatgtggctttgagtcatc

SEQ ID NO: 7707406 - DNA, 22 bp, Homo sapiens
tggcatgtggcagctggttcag

SEQ ID NO: 7707407 - DNA, 22 bp, Homo sapiens
tggcatgttctcttagcagctc

SEQ ID NO: 7707408 - DNA, 22 bp, Homo sapiens
tggcatgtgtgtgtaggataca

SEQ ID NO: 7707409 - DNA, 22 bp, Homo sapiens
tggcatgtgtgtgtaggataca

SEQ ID NO: 7707410 - DNA, 22 bp, Homo sapiens
tggcatgtgtggttacaggttc

SEQ ID NO: 7707411 - DNA, 22 bp, Homo sapiens
tggcatgtagtaggtgctataa

SEQ ID NO: 7707412 - DNA, 22 bp, Homo sapiens
tggcatgtatacttgagtagga

SEQ ID NO: 7707413 - DNA, 22 bp, Homo sapiens
tggcatgtaacatctccagatt

SEQ ID NO: 7707414 - DNA, 22 bp, Homo sapiens
tggcatgtacccaggaatggac

SEQ ID NO: 7707415 - DNA, 22 bp, Homo sapiens
tggcatggtggagtgacgggca

SEQ ID NO: 7707416 - DNA, 22 bp, Homo sapiens
tggcatggtggagtgacgggca

SEQ ID NO: 7707417 - DNA, 22 bp, Homo sapiens
tggcatggtcaaggctatgtta

SEQ ID NO: 7707418 - DNA, 22 bp, Homo sapiens
tggcatggtggagtgacgggca

SEQ ID NO: 7707419 - DNA, 22 bp, Homo sapiens
tggcatgggtggagagagcaca

SEQ ID NO: 7707420 - DNA, 19 bp, Homo sapiens
tggcatgtttggctaagga

SEQ ID NO: 7707421 - DNA, 22 bp, Homo sapiens
tggcatgtttgcttgtgcatat

SEQ ID NO: 7707422 - DNA, 19 bp, Homo sapiens
tggcatgtttggctaagga

SEQ ID NO: 7707423 - DNA, 22 bp, Homo sapiens
tggcatgtttcatggctgcaaa

SEQ ID NO: 7707424 - DNA, 22 bp, Homo sapiens
tggcatgtttcatggctgcaaa

SEQ ID NO: 7707425 - DNA, 22 bp, Homo sapiens
tggcatgtttaatgtactgtat

SEQ ID NO: 7707426 - DNA, 22 bp, Homo sapiens
tggcatgtttaatgtactgtat

SEQ ID NO: 7707427 - DNA, 22 bp, Homo sapiens
tggcatgtttaatgtactgtat

SEQ ID NO: 7707428 - DNA, 22 bp, Homo sapiens
tggcatgtttaaatggcaataa

SEQ ID NO: 7707429 - DNA, 22 bp, Homo sapiens
tggcatgtttaaatggcaataa

SEQ ID NO: 7707430 - DNA, 22 bp, Homo sapiens
tggcatgttgataatggagaag

SEQ ID NO: 7707431 - DNA, 22 bp, Homo sapiens
tggcatgttgataatggagaag

SEQ ID NO: 7707432 - DNA, 22 bp, Homo sapiens
tggcatgttgagaggcaagatt

SEQ ID NO: 7707433 - DNA, 22 bp, Homo sapiens
tggcatgttgagaggcaagatt

SEQ ID NO: 7707434 - DNA, 22 bp, Homo sapiens
tggcatgttctcttagcagctc

SEQ ID NO: 7707435 - DNA, 22 bp, Homo sapiens
tggcattggttgccaggctgtg

SEQ ID NO: 7707436 - DNA, 19 bp, Homo sapiens
tggcattggtccagataaa

SEQ ID NO: 7707437 - DNA, 22 bp, Homo sapiens
tggcattgggttgatgtctcag

SEQ ID NO: 7707438 - DNA, 22 bp, Homo sapiens
tggcattgcttctgaagtggag

SEQ ID NO: 7707439 - DNA, 22 bp, Homo sapiens
tggcattgctagtgacccagca

SEQ ID NO: 7707440 - DNA, 22 bp, Homo sapiens
tggcattgctgtagtgtcagaa

SEQ ID NO: 7707441 - DNA, 22 bp, Homo sapiens
tggcattagtgctcctactcag

SEQ ID NO: 7707442 - DNA, 22 bp, Homo sapiens
tggcatgtttcatggctgcaaa

SEQ ID NO: 7707443 - DNA, 22 bp, Homo sapiens
tggcattgacgctgacctgcac

SEQ ID NO: 7707444 - DNA, 22 bp, Homo sapiens
tggcctgctttcttaggtgttc

SEQ ID NO: 7707445 - DNA, 22 bp, Homo sapiens
tggcctgctttcttaggtgttc

SEQ ID NO: 7707446 - DNA, 22 bp, Homo sapiens
tggcctgctttcatttgatgct

SEQ ID NO: 7707447 - DNA, 22 bp, Homo sapiens
tggcctgctttcatttgatgct

SEQ ID NO: 7707448 - DNA, 22 bp, Homo sapiens
tggcctgctttcttaggtgttc

SEQ ID NO: 7707449 - DNA, 22 bp, Homo sapiens
tggcctggaaaaatgcagatgg

SEQ ID NO: 7707450 - DNA, 22 bp, Homo sapiens
tggcctggaaaaatgcagatgg

SEQ ID NO: 7707451 - DNA, 22 bp, Homo sapiens
tggcctggaaaaatgcagatgg

SEQ ID NO: 7707452 - DNA, 22 bp, Homo sapiens
tggcctggaaaaatgcagatgg

SEQ ID NO: 7707453 - DNA, 22 bp, Homo sapiens
tggcctggaaaaatgcagatgg

SEQ ID NO: 7707454 - DNA, 22 bp, Homo sapiens
tggcctggaaaaatgcagatgg

SEQ ID NO: 7707455 - DNA, 22 bp, Homo sapiens
tggcctgccttcgctgagctga

SEQ ID NO: 7707456 - DNA, 22 bp, Homo sapiens
tggcctgccttcgctgagctga

SEQ ID NO: 7707457 - DNA, 22 bp, Homo sapiens
tggcctgccttcgctgagctga

SEQ ID NO: 7707458 - DNA, 22 bp, Homo sapiens
tggcctgccttcgctgagctga

SEQ ID NO: 7707459 - DNA, 22 bp, Homo sapiens
tggcctgccttcgctgagctga

SEQ ID NO: 7707460 - DNA, 22 bp, Homo sapiens
tggcctgctctgactttggggg

SEQ ID NO: 7707461 - DNA, 22 bp, Homo sapiens
tggcctgctctgactttggggg

SEQ ID NO: 7707462 - DNA, 22 bp, Homo sapiens
tggcctgctcacagtcagatgg

SEQ ID NO: 7707463 - DNA, 22 bp, Homo sapiens
tggcctgctcacagtcagatgg

SEQ ID NO: 7707464 - DNA, 22 bp, Homo sapiens
tggcctgctcacagtcagatgg

SEQ ID NO: 7707465 - DNA, 22 bp, Homo sapiens
tggcctgccttcgctgagctga

SEQ ID NO: 7707466 - DNA, 22 bp, Homo sapiens
tggcctggaagagaggtcgagg

SEQ ID NO: 7707467 - DNA, 22 bp, Homo sapiens
tggcctggaagagaggtcgagg

SEQ ID NO: 7707468 - DNA, 22 bp, Homo sapiens
tggcctggaacctggcagggac

SEQ ID NO: 7707469 - DNA, 22 bp, Homo sapiens
tggcctggaagagaggtcgagg

SEQ ID NO: 7707470 - DNA, 22 bp, Homo sapiens
tggcctggaacctggcagggac

SEQ ID NO: 7707471 - DNA, 22 bp, Homo sapiens
tggcctggaacctggcagggac

SEQ ID NO: 7707472 - DNA, 22 bp, Homo sapiens
tggcctggaacctggcagggac

SEQ ID NO: 7707473 - DNA, 22 bp, Homo sapiens
tggcctggaacctggcagggac

SEQ ID NO: 7707474 - DNA, 22 bp, Homo sapiens
tggcctggaacctggcagggac

SEQ ID NO: 7707475 - DNA, 22 bp, Homo sapiens
tggcctggaacctggcagggac

SEQ ID NO: 7707476 - DNA, 22 bp, Homo sapiens
tggcctggaacctggcagggac

SEQ ID NO: 7707477 - DNA, 22 bp, Homo sapiens
tggcctggaacctggcagggac

SEQ ID NO: 7707478 - DNA, 22 bp, Homo sapiens
tggcctggaaaaatgcagatgg

SEQ ID NO: 7707479 - DNA, 22 bp, Homo sapiens
tggcctggaaaaatgcagatgg

SEQ ID NO: 7707480 - DNA, 22 bp, Homo sapiens
tggcctggaaaaatgcagatgg

SEQ ID NO: 7707481 - DNA, 22 bp, Homo sapiens
tggcctggcagagcaaggcctg

SEQ ID NO: 7707482 - DNA, 22 bp, Homo sapiens
tggcctggcagagcaaggcctg

SEQ ID NO: 7707483 - DNA, 22 bp, Homo sapiens
tggcctggcagagcaaggcctg

SEQ ID NO: 7707484 - DNA, 22 bp, Homo sapiens
tggcctggcagagcaaggcctg

SEQ ID NO: 7707485 - DNA, 22 bp, Homo sapiens
tggcctggcagagcaaggcctg

SEQ ID NO: 7707486 - DNA, 22 bp, Homo sapiens
tggcctggccacatccagcagg

SEQ ID NO: 7707487 - DNA, 22 bp, Homo sapiens
tggcctggccacatccagcagg

SEQ ID NO: 7707488 - DNA, 22 bp, Homo sapiens
tggcctggccacatccagcagg

SEQ ID NO: 7707489 - DNA, 22 bp, Homo sapiens
tggcctggccacatccagcagg

SEQ ID NO: 7707490 - DNA, 22 bp, Homo sapiens
tggcctggcagagcaaggcctg

SEQ ID NO: 7707491 - DNA, 22 bp, Homo sapiens
tggcctggccctgaggccctgt

SEQ ID NO: 7707492 - DNA, 22 bp, Homo sapiens
tggcctggccctgaggccctgt

SEQ ID NO: 7707493 - DNA, 22 bp, Homo sapiens
tggcctggccacatccagcagg

SEQ ID NO: 7707494 - DNA, 22 bp, Homo sapiens
tggcctggccacatccagcagg

SEQ ID NO: 7707495 - DNA, 22 bp, Homo sapiens
tggcctggccacatccagcagg

SEQ ID NO: 7707496 - DNA, 22 bp, Homo sapiens
tggcctggccacatccagcagg

SEQ ID NO: 7707497 - DNA, 22 bp, Homo sapiens
tggcctggccacatccagcagg

SEQ ID NO: 7707498 - DNA, 23 bp, Homo sapiens
tggcctggagagaaaagatgagt

SEQ ID NO: 7707499 - DNA, 23 bp, Homo sapiens
tggcctggagagaaaagatgagt

SEQ ID NO: 7707500 - DNA, 23 bp, Homo sapiens
tggcctggagagaaaagatgagt

SEQ ID NO: 7707501 - DNA, 18 bp, Homo sapiens
tggcctggagacaactct

SEQ ID NO: 7707502 - DNA, 23 bp, Homo sapiens
tggcctggagagaaaagatgagt

SEQ ID NO: 7707503 - DNA, 18 bp, Homo sapiens
tggcctggagacaactct

SEQ ID NO: 7707504 - DNA, 18 bp, Homo sapiens
tggcctggagacaactct

SEQ ID NO: 7707505 - DNA, 18 bp, Homo sapiens
tggcctggagacaactct

SEQ ID NO: 7707506 - DNA, 22 bp, Homo sapiens
tggcctggaagagaggtcgagg

SEQ ID NO: 7707507 - DNA, 22 bp, Homo sapiens
tggcctggaagagaggtcgagg

SEQ ID NO: 7707508 - DNA, 22 bp, Homo sapiens
tggcctggaagagaggtcgagg

SEQ ID NO: 7707509 - DNA, 22 bp, Homo sapiens
tggcctggaagagaggtcgagg

SEQ ID NO: 7707510 - DNA, 22 bp, Homo sapiens
tggcctggaagagaggtcgagg

SEQ ID NO: 7707511 - DNA, 22 bp, Homo sapiens
tggcctgactgtcaggctgtat

SEQ ID NO: 7707512 - DNA, 22 bp, Homo sapiens
tggcctgactgtcaggctgtat

SEQ ID NO: 7707513 - DNA, 22 bp, Homo sapiens
tggcctgactgtcaggctgtat

SEQ ID NO: 7707514 - DNA, 22 bp, Homo sapiens
tggcctgaattatggcagatct

SEQ ID NO: 7707515 - DNA, 22 bp, Homo sapiens
tggcctgaattatggcagatct

SEQ ID NO: 7707516 - DNA, 22 bp, Homo sapiens
tggcctctttcttccctttgac

SEQ ID NO: 7707517 - DNA, 22 bp, Homo sapiens
tggcctctttcttccctttgac

SEQ ID NO: 7707518 - DNA, 21 bp, Homo sapiens
tggcctgaagctccctctccc

SEQ ID NO: 7707519 - DNA, 22 bp, Homo sapiens
tggcctcttaggacatcctcta

SEQ ID NO: 7707520 - DNA, 22 bp, Homo sapiens
tggcctcttaggacatcctcta

SEQ ID NO: 7707521 - DNA, 22 bp, Homo sapiens
tggcctcttaaggatgacacaa

SEQ ID NO: 7707522 - DNA, 22 bp, Homo sapiens
tggcctctgtgggagctgagca

SEQ ID NO: 7707523 - DNA, 22 bp, Homo sapiens
tggcctctggctgaggactaac

SEQ ID NO: 7707524 - DNA, 20 bp, Homo sapiens
tggcctctgtagaggccaag

SEQ ID NO: 7707525 - DNA, 22 bp, Homo sapiens
tggcctctgtgggagctgagca

SEQ ID NO: 7707526 - DNA, 22 bp, Homo sapiens
tggcctctgtgggagctgagca

SEQ ID NO: 7707527 - DNA, 22 bp, Homo sapiens
tggcctcttaggacatcctcta

SEQ ID NO: 7707528 - DNA, 22 bp, Homo sapiens
tggcctcttacgacatagcctt

SEQ ID NO: 7707529 - DNA, 22 bp, Homo sapiens
tggcctcttacgacatagcctt

SEQ ID NO: 7707530 - DNA, 22 bp, Homo sapiens
tggcctcttacgacatagcctt

SEQ ID NO: 7707531 - DNA, 22 bp, Homo sapiens
tggcctcttaaggatgacacaa

SEQ ID NO: 7707532 - DNA, 22 bp, Homo sapiens
tggcctcttaaggatgacacaa

SEQ ID NO: 7707533 - DNA, 22 bp, Homo sapiens
tggcctctggctgaggactaac

SEQ ID NO: 7707534 - DNA, 22 bp, Homo sapiens
tggcctctggctgaggactaac

SEQ ID NO: 7707535 - DNA, 22 bp, Homo sapiens
tggcctctggctgaggactaac

SEQ ID NO: 7707536 - DNA, 20 bp, Homo sapiens
tggcctctgtagaggccaag

SEQ ID NO: 7707537 - DNA, 20 bp, Homo sapiens
tggcctctgtagaggccaag

SEQ ID NO: 7707538 - DNA, 20 bp, Homo sapiens
tggcctctgagatgccacgg

SEQ ID NO: 7707539 - DNA, 20 bp, Homo sapiens
tggcctctgagatgccacgg

SEQ ID NO: 7707540 - DNA, 20 bp, Homo sapiens
tggcctctgagatgccacgg

SEQ ID NO: 7707541 - DNA, 22 bp, Homo sapiens
tggcctcaaccgtcctaagcac

SEQ ID NO: 7707542 - DNA, 22 bp, Homo sapiens
tggcctctgaggcacctttgcc

SEQ ID NO: 7707543 - DNA, 22 bp, Homo sapiens
tggcctctgcactgggctcccc

SEQ ID NO: 7707544 - DNA, 22 bp, Homo sapiens
tggcctctgcactgggctcccc

SEQ ID NO: 7707545 - DNA, 22 bp, Homo sapiens
tggcctctgcactgggctcccc

SEQ ID NO: 7707546 - DNA, 22 bp, Homo sapiens
tggcctctgcaatggattcacc

SEQ ID NO: 7707547 - DNA, 22 bp, Homo sapiens
tggcctctgcaatggattcacc

SEQ ID NO: 7707548 - DNA, 22 bp, Homo sapiens
tggcctgcagaggctgtggggc

SEQ ID NO: 7707549 - DNA, 22 bp, Homo sapiens
tggcctgcaagctaaaaatcta

SEQ ID NO: 7707550 - DNA, 22 bp, Homo sapiens
tggcctgcaagctaaaaatcta

SEQ ID NO: 7707551 - DNA, 22 bp, Homo sapiens
tggcctgcagaggctgtggggc

SEQ ID NO: 7707552 - DNA, 22 bp, Homo sapiens
tggcctgcagaggctgtggggc

SEQ ID NO: 7707553 - DNA, 22 bp, Homo sapiens
tggcctgcagctctcagggaag

SEQ ID NO: 7707554 - DNA, 23 bp, Homo sapiens
tggcctgcagagtttctgctggg

SEQ ID NO: 7707555 - DNA, 23 bp, Homo sapiens
tggcctgcagagtttctgctggg

SEQ ID NO: 7707556 - DNA, 23 bp, Homo sapiens
tggcctgcagagtttctgctggg

SEQ ID NO: 7707557 - DNA, 23 bp, Homo sapiens
tggcctgcagagtttctgctggg

SEQ ID NO: 7707558 - DNA, 23 bp, Homo sapiens
tggcctgcagagtttctgctggg

SEQ ID NO: 7707559 - DNA, 22 bp, Homo sapiens
tggcctgagttgtctgcaggcc

SEQ ID NO: 7707560 - DNA, 22 bp, Homo sapiens
tggcctgagttgtctgcaggcc

SEQ ID NO: 7707561 - DNA, 22 bp, Homo sapiens
tggcctgaggctcggcatgggt

SEQ ID NO: 7707562 - DNA, 22 bp, Homo sapiens
tggcctgaggctcggcatgggt

SEQ ID NO: 7707563 - DNA, 22 bp, Homo sapiens
tggcctgaggctcggcatgggt

SEQ ID NO: 7707564 - DNA, 22 bp, Homo sapiens
tggcctgactgtccagccaggg

SEQ ID NO: 7707565 - DNA, 22 bp, Homo sapiens
tggcctgcaaagtcttcttgct

SEQ ID NO: 7707566 - DNA, 22 bp, Homo sapiens
tggcctgattttgctaagagaa

SEQ ID NO: 7707567 - DNA, 22 bp, Homo sapiens
tggcctgcaaagtcttcttgct

SEQ ID NO: 7707568 - DNA, 22 bp, Homo sapiens
tggcctgcaaagtcttcttgct

SEQ ID NO: 7707569 - DNA, 22 bp, Homo sapiens
tggcctgagttgtctgcaggcc

SEQ ID NO: 7707570 - DNA, 22 bp, Homo sapiens
tggcctgatacttccagagttc

SEQ ID NO: 7707571 - DNA, 22 bp, Homo sapiens
tggcctgcccagagcagctctg

SEQ ID NO: 7707572 - DNA, 22 bp, Homo sapiens
tggcctgccccgagatcctggc

SEQ ID NO: 7707573 - DNA, 22 bp, Homo sapiens
tggcctgccccgagatcctggc

SEQ ID NO: 7707574 - DNA, 22 bp, Homo sapiens
tggcctgccccgagatcctggc

SEQ ID NO: 7707575 - DNA, 22 bp, Homo sapiens
tggcctgcctgggagcagcagg

SEQ ID NO: 7707576 - DNA, 22 bp, Homo sapiens
tggcctgcctgggagcagcagg

SEQ ID NO: 7707577 - DNA, 22 bp, Homo sapiens
tggcctgcctcccggcttcttt

SEQ ID NO: 7707578 - DNA, 22 bp, Homo sapiens
tggcctgcctcccggcttcttt

SEQ ID NO: 7707579 - DNA, 22 bp, Homo sapiens
tggcctgcctcccggcttcttt

SEQ ID NO: 7707580 - DNA, 22 bp, Homo sapiens
tggcctgcctcccggcttcttt

SEQ ID NO: 7707581 - DNA, 22 bp, Homo sapiens
tggcctgcctcacttgcttatt

SEQ ID NO: 7707582 - DNA, 22 bp, Homo sapiens
tggcctgcccagagcagctctg

SEQ ID NO: 7707583 - DNA, 22 bp, Homo sapiens
tggcctgcccagagcagctctg

SEQ ID NO: 7707584 - DNA, 22 bp, Homo sapiens
tggcctgcccagagcagctctg

SEQ ID NO: 7707585 - DNA, 22 bp, Homo sapiens
tggcctgcccagagcagctctg

SEQ ID NO: 7707586 - DNA, 22 bp, Homo sapiens
tggcctgcccaagtcaatcgga

SEQ ID NO: 7707587 - DNA, 22 bp, Homo sapiens
tggcctgccactgccacgccac

SEQ ID NO: 7707588 - DNA, 22 bp, Homo sapiens
tggcctgccactgccacgccac

SEQ ID NO: 7707589 - DNA, 22 bp, Homo sapiens
tggcctgccactgccacgccac

SEQ ID NO: 7707590 - DNA, 22 bp, Homo sapiens
tggcctgccactgccacgccac

SEQ ID NO: 7707591 - DNA, 22 bp, Homo sapiens
tggcctgcattggctttggtgt

SEQ ID NO: 7707592 - DNA, 22 bp, Homo sapiens
tggcctgcattggctttggtgt

SEQ ID NO: 7707593 - DNA, 22 bp, Homo sapiens
tggccctgtgtcctgctgccag

SEQ ID NO: 7707594 - DNA, 22 bp, Homo sapiens
tggccctgtgtcctgctgccag

SEQ ID NO: 7707595 - DNA, 22 bp, Homo sapiens
tggccctgtgtcctgctgccag

SEQ ID NO: 7707596 - DNA, 22 bp, Homo sapiens
tggccctgtgtcctgctgccag

SEQ ID NO: 7707597 - DNA, 22 bp, Homo sapiens
tggccctgtgtcctgctgccag

SEQ ID NO: 7707598 - DNA, 22 bp, Homo sapiens
tggccctgtgtcctgctgccag

SEQ ID NO: 7707599 - DNA, 22 bp, Homo sapiens
tggccctgtgtcctgctgccag

SEQ ID NO: 7707600 - DNA, 22 bp, Homo sapiens
tggccctgtgtgcaggctgcac

SEQ ID NO: 7707601 - DNA, 22 bp, Homo sapiens
tggccctgtgtgcaggctgcac

SEQ ID NO: 7707602 - DNA, 22 bp, Homo sapiens
tggccctgtgtgcaggctgcac

SEQ ID NO: 7707603 - DNA, 22 bp, Homo sapiens
tggccctgtgtgcaggctgcac

SEQ ID NO: 7707604 - DNA, 22 bp, Homo sapiens
tggccctgtgtgcaggctgcac

SEQ ID NO: 7707605 - DNA, 22 bp, Homo sapiens
tggccctgtggaggtcagtgag

SEQ ID NO: 7707606 - DNA, 22 bp, Homo sapiens
tggccctgtggaggtcagtgag

SEQ ID NO: 7707607 - DNA, 22 bp, Homo sapiens
tggccctgtggaggtcagtgag

SEQ ID NO: 7707608 - DNA, 22 bp, Homo sapiens
tggccctgtggaggtcagtgag

SEQ ID NO: 7707609 - DNA, 22 bp, Homo sapiens
tggccctgtggcttcagaacag

SEQ ID NO: 7707610 - DNA, 22 bp, Homo sapiens
tggccctgtggcttcagaacag

SEQ ID NO: 7707611 - DNA, 22 bp, Homo sapiens
tggccctgtggcttcagaacag

SEQ ID NO: 7707612 - DNA, 22 bp, Homo sapiens
tggccctgtggcttcagaacag

SEQ ID NO: 7707613 - DNA, 22 bp, Homo sapiens
tggccctgtgtcctgctgccag

SEQ ID NO: 7707614 - DNA, 22 bp, Homo sapiens
tggccctgtggaggtcagtgag

SEQ ID NO: 7707615 - DNA, 22 bp, Homo sapiens
tggccctgtggaggtcagtgag

SEQ ID NO: 7707616 - DNA, 22 bp, Homo sapiens
tggccctgtggaggtcagtgag

SEQ ID NO: 7707617 - DNA, 22 bp, Homo sapiens
tggccctgtggaggtcagtgag

SEQ ID NO: 7707618 - DNA, 23 bp, Homo sapiens
tggccctgtgcatgctgcttccc

SEQ ID NO: 7707619 - DNA, 23 bp, Homo sapiens
tggccctgtgcatgctgcttccc

SEQ ID NO: 7707620 - DNA, 23 bp, Homo sapiens
tggccctgtgcatgctgcttccc

SEQ ID NO: 7707621 - DNA, 20 bp, Homo sapiens
tggccctgttttctccaggc

SEQ ID NO: 7707622 - DNA, 20 bp, Homo sapiens
tggccctgttttctccaggc

SEQ ID NO: 7707623 - DNA, 20 bp, Homo sapiens
tggccctgttttctccaggc

SEQ ID NO: 7707624 - DNA, 20 bp, Homo sapiens
tggccctgttttctccaggc

SEQ ID NO: 7707625 - DNA, 20 bp, Homo sapiens
tggccctgttttctccaggc

SEQ ID NO: 7707626 - DNA, 22 bp, Homo sapiens
tggccctgttctgtacctcata

SEQ ID NO: 7707627 - DNA, 22 bp, Homo sapiens
tggccctgttctgtacctcata

SEQ ID NO: 7707628 - DNA, 22 bp, Homo sapiens
tggccctgttctgtacctcata

SEQ ID NO: 7707629 - DNA, 22 bp, Homo sapiens
tggccctgtgtgcaggctgcac

SEQ ID NO: 7707630 - DNA, 22 bp, Homo sapiens
tggccctgttctgtacctcata

SEQ ID NO: 7707631 - DNA, 22 bp, Homo sapiens
tggccctgttctgtacctcata

SEQ ID NO: 7707632 - DNA, 20 bp, Homo sapiens
tggccctgttttctccaggc

SEQ ID NO: 7707633 - DNA, 20 bp, Homo sapiens
tggccctgttttctccaggc

SEQ ID NO: 7707634 - DNA, 22 bp, Homo sapiens
tggcccttctgagcacagggcc

SEQ ID NO: 7707635 - DNA, 22 bp, Homo sapiens
tggcccttcaaattccctagtc

SEQ ID NO: 7707636 - DNA, 22 bp, Homo sapiens
tggcccttcaaattccctagtc

SEQ ID NO: 7707637 - DNA, 22 bp, Homo sapiens
tggcccttcaaattccctagtc

SEQ ID NO: 7707638 - DNA, 22 bp, Homo sapiens
tggcccttcaaattccctagtc

SEQ ID NO: 7707639 - DNA, 22 bp, Homo sapiens
tggcctcaaccgtcctaagcac

SEQ ID NO: 7707640 - DNA, 22 bp, Homo sapiens
tggcctatttcatcagttcaat

SEQ ID NO: 7707641 - DNA, 22 bp, Homo sapiens
tggcctcaaccgtcctaagcac

SEQ ID NO: 7707642 - DNA, 22 bp, Homo sapiens
tggcctagagaagccaaaagat

SEQ ID NO: 7707643 - DNA, 22 bp, Homo sapiens
tggccgctgcactcgctcctct

SEQ ID NO: 7707644 - DNA, 22 bp, Homo sapiens
tggccgctatgagtcacctgca

SEQ ID NO: 7707645 - DNA, 22 bp, Homo sapiens
tggcccttttgtgaagtggcca

SEQ ID NO: 7707646 - DNA, 22 bp, Homo sapiens
tggccctttggtttatgactga

SEQ ID NO: 7707647 - DNA, 22 bp, Homo sapiens
tggccctttgggtgcaggggca

SEQ ID NO: 7707648 - DNA, 22 bp, Homo sapiens
tggccctttgggtgcaggggca

SEQ ID NO: 7707649 - DNA, 22 bp, Homo sapiens
tggcccttgtcctgggagagtt

SEQ ID NO: 7707650 - DNA, 22 bp, Homo sapiens
tggcccttctgagcacagggcc

SEQ ID NO: 7707651 - DNA, 22 bp, Homo sapiens
tggcccttgtcctgggagagtt

SEQ ID NO: 7707652 - DNA, 22 bp, Homo sapiens
tggccctgtctgcacacaggat

SEQ ID NO: 7707653 - DNA, 22 bp, Homo sapiens
tggccctgtctgcacacaggat

SEQ ID NO: 7707654 - DNA, 22 bp, Homo sapiens
tggccctgtctgcacacaggat

SEQ ID NO: 7707655 - DNA, 22 bp, Homo sapiens
tggccctgtctgcacacaggat

SEQ ID NO: 7707656 - DNA, 22 bp, Homo sapiens
tggccctgtcctcatttcatct

SEQ ID NO: 7707657 - DNA, 22 bp, Homo sapiens
tggccctgtcctcatttcatct

SEQ ID NO: 7707658 - DNA, 22 bp, Homo sapiens
tggccctgtcctcatttcatct

SEQ ID NO: 7707659 - DNA, 22 bp, Homo sapiens
tggccctgtcctcatttcatct

SEQ ID NO: 7707660 - DNA, 22 bp, Homo sapiens
tggccctgtgactgagttctag

SEQ ID NO: 7707661 - DNA, 22 bp, Homo sapiens
tggccctgtctgcacacaggat

SEQ ID NO: 7707662 - DNA, 22 bp, Homo sapiens
tggccctgtgactgagttctag

SEQ ID NO: 7707663 - DNA, 22 bp, Homo sapiens
tggccctgtctgcacacaggat

SEQ ID NO: 7707664 - DNA, 22 bp, Homo sapiens
tggccctgtctgcacacaggat

SEQ ID NO: 7707665 - DNA, 23 bp, Homo sapiens
tggccctgtgcatgctgcttccc

SEQ ID NO: 7707666 - DNA, 23 bp, Homo sapiens
tggccctgtgcatgctgcttccc

SEQ ID NO: 7707667 - DNA, 22 bp, Homo sapiens
tggccctgtgactgagttctag

SEQ ID NO: 7707668 - DNA, 22 bp, Homo sapiens
tggccctgtgactgagttctag

SEQ ID NO: 7707669 - DNA, 22 bp, Homo sapiens
tggccctggtggcacagcctgc

SEQ ID NO: 7707670 - DNA, 22 bp, Homo sapiens
tggccctggtggcacagcctgc

SEQ ID NO: 7707671 - DNA, 22 bp, Homo sapiens
tggccctggtggcacagcctgc

SEQ ID NO: 7707672 - DNA, 22 bp, Homo sapiens
tggccctggtggcacagcctgc

SEQ ID NO: 7707673 - DNA, 22 bp, Homo sapiens
tggccctggtggcacagcctgc

SEQ ID NO: 7707674 - DNA, 22 bp, Homo sapiens
tggccctggtggcacagcctgc

SEQ ID NO: 7707675 - DNA, 22 bp, Homo sapiens
tggccctgggtggaatgtccca

SEQ ID NO: 7707676 - DNA, 22 bp, Homo sapiens
tggccctgggcatctttcgtga

SEQ ID NO: 7707677 - DNA, 22 bp, Homo sapiens
tggccctgggtggaatgtccca

SEQ ID NO: 7707678 - DNA, 22 bp, Homo sapiens
tggccctgggtggaatgtccca

SEQ ID NO: 7707679 - DNA, 22 bp, Homo sapiens
tggccctgtccctggagcctgg

SEQ ID NO: 7707680 - DNA, 22 bp, Homo sapiens
tggccctggtggcacagcctgc

SEQ ID NO: 7707681 - DNA, 22 bp, Homo sapiens
tggccctgtccctggagcctgg

SEQ ID NO: 7707682 - DNA, 22 bp, Homo sapiens
tggccctgtccctggagcctgg

SEQ ID NO: 7707683 - DNA, 22 bp, Homo sapiens
tggccctgtccctggagcctgg

SEQ ID NO: 7707684 - DNA, 22 bp, Homo sapiens
tggccctgtccctggagcctgg

SEQ ID NO: 7707685 - DNA, 22 bp, Homo sapiens
tggccctgtccctggagcctgg

SEQ ID NO: 7707686 - DNA, 22 bp, Homo sapiens
tggccctgtccctggagcctgg

SEQ ID NO: 7707687 - DNA, 22 bp, Homo sapiens
tggccctggctgagttagattt

SEQ ID NO: 7707688 - DNA, 22 bp, Homo sapiens
tggccctgccgcactatcctca

SEQ ID NO: 7707689 - DNA, 22 bp, Homo sapiens
tggccctgccgccacgacgtct

SEQ ID NO: 7707690 - DNA, 22 bp, Homo sapiens
tggccctggctgagttagattt

SEQ ID NO: 7707691 - DNA, 22 bp, Homo sapiens
tggccctggctgagttagattt

SEQ ID NO: 7707692 - DNA, 22 bp, Homo sapiens
tggccctgggcagaggcaacat

SEQ ID NO: 7707693 - DNA, 22 bp, Homo sapiens
tggccctgggcagaggcaacat

SEQ ID NO: 7707694 - DNA, 22 bp, Homo sapiens
tggccctgggcagaggcaacat

SEQ ID NO: 7707695 - DNA, 22 bp, Homo sapiens
tggccctgggcagaggcaacat

SEQ ID NO: 7707696 - DNA, 22 bp, Homo sapiens
tggccctgggcagaggcaacat

SEQ ID NO: 7707697 - DNA, 22 bp, Homo sapiens
tggccctgggcagaggcaacat

SEQ ID NO: 7707698 - DNA, 22 bp, Homo sapiens
tggccctgggcagaggcaacat

SEQ ID NO: 7707699 - DNA, 22 bp, Homo sapiens
tggccctgggcagaggcaacat

SEQ ID NO: 7707700 - DNA, 22 bp, Homo sapiens
tggccctgggcatctttcgtga

SEQ ID NO: 7707701 - DNA, 22 bp, Homo sapiens
tggccctgggcatctttcgtga

SEQ ID NO: 7707702 - DNA, 22 bp, Homo sapiens
tggccctgccgccacgacgtct

SEQ ID NO: 7707703 - DNA, 22 bp, Homo sapiens
tggccctgccgccacgacgtct

SEQ ID NO: 7707704 - DNA, 22 bp, Homo sapiens
tggccctgccgcactatcctca

SEQ ID NO: 7707705 - DNA, 22 bp, Homo sapiens
tggccctgccgcactatcctca

SEQ ID NO: 7707706 - DNA, 22 bp, Homo sapiens
tggccctgccctcttcatcttt

SEQ ID NO: 7707707 - DNA, 22 bp, Homo sapiens
tggccctgccctcttcatcttt

SEQ ID NO: 7707708 - DNA, 22 bp, Homo sapiens
tggccctgccactcactgctga

SEQ ID NO: 7707709 - DNA, 22 bp, Homo sapiens
tggccctgccactcactgctga

SEQ ID NO: 7707710 - DNA, 22 bp, Homo sapiens
tggccctgccactcactgctga

SEQ ID NO: 7707711 - DNA, 22 bp, Homo sapiens
tggccctgccactcactgctga

SEQ ID NO: 7707712 - DNA, 22 bp, Homo sapiens
tggccctgccctcttcatcttt

SEQ ID NO: 7707713 - DNA, 22 bp, Homo sapiens
tggccctgccctcttcatcttt

SEQ ID NO: 7707714 - DNA, 22 bp, Homo sapiens
tggccctgccactcactgctga

SEQ ID NO: 7707715 - DNA, 22 bp, Homo sapiens
tggcccaggaggccagagggca

SEQ ID NO: 7707716 - DNA, 22 bp, Homo sapiens
tggcccaggaggccagagggca

SEQ ID NO: 7707717 - DNA, 22 bp, Homo sapiens
tggcccaggaggccagagggca

SEQ ID NO: 7707718 - DNA, 22 bp, Homo sapiens
tggcccagctgcagatggtgga

SEQ ID NO: 7707719 - DNA, 22 bp, Homo sapiens
tggcccaggaggccagagggca

SEQ ID NO: 7707720 - DNA, 22 bp, Homo sapiens
tggcccagctgcagatggtgga

SEQ ID NO: 7707721 - DNA, 22 bp, Homo sapiens
tggcccaggaggccagagggca

SEQ ID NO: 7707722 - DNA, 22 bp, Homo sapiens
tggcccagctgcagatggtgga

SEQ ID NO: 7707723 - DNA, 22 bp, Homo sapiens
tggcccagctgcagatggtgga

SEQ ID NO: 7707724 - DNA, 22 bp, Homo sapiens
tggcccagctgcagatggtgga

SEQ ID NO: 7707725 - DNA, 22 bp, Homo sapiens
tggcccaggaggccagagggca

SEQ ID NO: 7707726 - DNA, 22 bp, Homo sapiens
tggcccaggaggccagagggca

SEQ ID NO: 7707727 - DNA, 22 bp, Homo sapiens
tggcccaggaggccagagggca

SEQ ID NO: 7707728 - DNA, 22 bp, Homo sapiens
tggcccaggccaaagccctgga

SEQ ID NO: 7707729 - DNA, 22 bp, Homo sapiens
tggcccaggccaaagccctgga

SEQ ID NO: 7707730 - DNA, 22 bp, Homo sapiens
tggcccaggccaaagccctgga

SEQ ID NO: 7707731 - DNA, 22 bp, Homo sapiens
tggcccaggccaaagccctgga

SEQ ID NO: 7707732 - DNA, 22 bp, Homo sapiens
tggcccaggccaaagccctgga

SEQ ID NO: 7707733 - DNA, 22 bp, Homo sapiens
tggcccaggccaaagccctgga

SEQ ID NO: 7707734 - DNA, 22 bp, Homo sapiens
tggcccagggagttcatggtgt

SEQ ID NO: 7707735 - DNA, 22 bp, Homo sapiens
tggcccagggagttcatggtgt

SEQ ID NO: 7707736 - DNA, 22 bp, Homo sapiens
tggcccagggagttcatggtgt

SEQ ID NO: 7707737 - DNA, 22 bp, Homo sapiens
tggcccagggagttcatggtgt

SEQ ID NO: 7707738 - DNA, 22 bp, Homo sapiens
tggcccagggagttcatggtgt

SEQ ID NO: 7707739 - DNA, 22 bp, Homo sapiens
tggcccagggagttcatggtgt

SEQ ID NO: 7707740 - DNA, 22 bp, Homo sapiens
tggcccaggcgaggtgggcaga

SEQ ID NO: 7707741 - DNA, 22 bp, Homo sapiens
tggcccaggcgaggtgggcaga

SEQ ID NO: 7707742 - DNA, 22 bp, Homo sapiens
tggcccaggcgaggtgggcaga

SEQ ID NO: 7707743 - DNA, 22 bp, Homo sapiens
tggcccaggcgaggtgggcaga

SEQ ID NO: 7707744 - DNA, 22 bp, Homo sapiens
tggcccaggcgaggtgggcaga

SEQ ID NO: 7707745 - DNA, 22 bp, Homo sapiens
tggcccaggcgaggtgggcaga

SEQ ID NO: 7707746 - DNA, 22 bp, Homo sapiens
tggcccaggcgaggtgggcaga

SEQ ID NO: 7707747 - DNA, 22 bp, Homo sapiens
tggcccaggcgaggtgggcaga

SEQ ID NO: 7707748 - DNA, 22 bp, Homo sapiens
tggcccaggccaaagccctgga

SEQ ID NO: 7707749 - DNA, 22 bp, Homo sapiens
tggcccaggccaaagccctgga

SEQ ID NO: 7707750 - DNA, 22 bp, Homo sapiens
tggcccaggcgaggtgggcaga

SEQ ID NO: 7707751 - DNA, 22 bp, Homo sapiens
tggcccaggtctctctgagccc

SEQ ID NO: 7707752 - DNA, 22 bp, Homo sapiens
tggcccaggtctctctgagccc

SEQ ID NO: 7707753 - DNA, 22 bp, Homo sapiens
tggcccaggtctctctgagccc

SEQ ID NO: 7707754 - DNA, 22 bp, Homo sapiens
tggcccaggtctctctgagccc

SEQ ID NO: 7707755 - DNA, 22 bp, Homo sapiens
tggcccaggtctctctgagccc

SEQ ID NO: 7707756 - DNA, 22 bp, Homo sapiens
tggcccaggtctctctgagccc

SEQ ID NO: 7707757 - DNA, 22 bp, Homo sapiens
tggcccaggtctctctgagccc

SEQ ID NO: 7707758 - DNA, 22 bp, Homo sapiens
tggcccaggtctctctgagccc

SEQ ID NO: 7707759 - DNA, 22 bp, Homo sapiens
tggcccagggtctacagcctca

SEQ ID NO: 7707760 - DNA, 22 bp, Homo sapiens
tggcccagggtctacagcctca

SEQ ID NO: 7707761 - DNA, 22 bp, Homo sapiens
tggcccagggtctacagcctca

SEQ ID NO: 7707762 - DNA, 22 bp, Homo sapiens
tggcccagggtctacagcctca

SEQ ID NO: 7707763 - DNA, 22 bp, Homo sapiens
tggcccagggtctacagcctca

SEQ ID NO: 7707764 - DNA, 22 bp, Homo sapiens
tggcccagggtctacagcctca

SEQ ID NO: 7707765 - DNA, 22 bp, Homo sapiens
tggcccaggtctctctgagccc

SEQ ID NO: 7707766 - DNA, 22 bp, Homo sapiens
tggcccagggtctacagcctca

SEQ ID NO: 7707767 - DNA, 22 bp, Homo sapiens
tggcccagggtctacagcctca

SEQ ID NO: 7707768 - DNA, 22 bp, Homo sapiens
tggcccagggtctacagcctca

SEQ ID NO: 7707769 - DNA, 22 bp, Homo sapiens
tggcccaggggctcttggtgtt

SEQ ID NO: 7707770 - DNA, 22 bp, Homo sapiens
tggcccaggggctcttggtgtt

SEQ ID NO: 7707771 - DNA, 22 bp, Homo sapiens
tggcccaggggctcttggtgtt

SEQ ID NO: 7707772 - DNA, 22 bp, Homo sapiens
tggcccaggggctcttggtgtt

SEQ ID NO: 7707773 - DNA, 22 bp, Homo sapiens
tggcccaggggctcttggtgtt

SEQ ID NO: 7707774 - DNA, 22 bp, Homo sapiens
tggcccaggggctcttggtgtt

SEQ ID NO: 7707775 - DNA, 22 bp, Homo sapiens
tggcccaggggctcttggtgtt

SEQ ID NO: 7707776 - DNA, 22 bp, Homo sapiens
tggcccagggcacagcagggag

SEQ ID NO: 7707777 - DNA, 22 bp, Homo sapiens
tggcccagggcacagcagggag

SEQ ID NO: 7707778 - DNA, 22 bp, Homo sapiens
tggcccagggcacagcagggag

SEQ ID NO: 7707779 - DNA, 22 bp, Homo sapiens
tggcccagggcacagcagggag

SEQ ID NO: 7707780 - DNA, 22 bp, Homo sapiens
tggcccagggcacagcagggag

SEQ ID NO: 7707781 - DNA, 22 bp, Homo sapiens
tggcccagggcacagcagggag

SEQ ID NO: 7707782 - DNA, 22 bp, Homo sapiens
tggcccagggcacagcagggag

SEQ ID NO: 7707783 - DNA, 22 bp, Homo sapiens
tggcccagggagttcatggtgt

SEQ ID NO: 7707784 - DNA, 22 bp, Homo sapiens
tggcccagggcacagcagggag

SEQ ID NO: 7707785 - DNA, 22 bp, Homo sapiens
tggccagtgttggctagggaca

SEQ ID NO: 7707786 - DNA, 22 bp, Homo sapiens
tggccagtgttggctagggaca

SEQ ID NO: 7707787 - DNA, 22 bp, Homo sapiens
tggccagtgtcggaggccagga

SEQ ID NO: 7707788 - DNA, 22 bp, Homo sapiens
tggccagtgtcggaggccagga

SEQ ID NO: 7707789 - DNA, 22 bp, Homo sapiens
tggccagtgtgtgctgccggct

SEQ ID NO: 7707790 - DNA, 22 bp, Homo sapiens
tggccagtgtgtgctgccggct

SEQ ID NO: 7707791 - DNA, 22 bp, Homo sapiens
tggccagtggggttgagcagga

SEQ ID NO: 7707792 - DNA, 22 bp, Homo sapiens
tggccagtggggttgagcagga

SEQ ID NO: 7707793 - DNA, 22 bp, Homo sapiens
tggccagtgtcggaggccagga

SEQ ID NO: 7707794 - DNA, 22 bp, Homo sapiens
tggccagtgtcggaggccagga

SEQ ID NO: 7707795 - DNA, 22 bp, Homo sapiens
tggccagtggggttgagcagga

SEQ ID NO: 7707796 - DNA, 22 bp, Homo sapiens
tggccagtggggttgagcagga

SEQ ID NO: 7707797 - DNA, 22 bp, Homo sapiens
tggccagtggggttgagcagga

SEQ ID NO: 7707798 - DNA, 22 bp, Homo sapiens
tggccagtctgtggaagccagg

SEQ ID NO: 7707799 - DNA, 22 bp, Homo sapiens
tggccagtcttagctgtgcctg

SEQ ID NO: 7707800 - DNA, 22 bp, Homo sapiens
tggccagtctgtggaagccagg

SEQ ID NO: 7707801 - DNA, 22 bp, Homo sapiens
tggccagtgattaatgacgctt

SEQ ID NO: 7707802 - DNA, 22 bp, Homo sapiens
tggccagtgcctgccagtgcag

SEQ ID NO: 7707803 - DNA, 22 bp, Homo sapiens
tggccagtgattaatgacgctt

SEQ ID NO: 7707804 - DNA, 22 bp, Homo sapiens
tggccagtggggttgagcagga

SEQ ID NO: 7707805 - DNA, 22 bp, Homo sapiens
tggccagtggggttgagcagga

SEQ ID NO: 7707806 - DNA, 22 bp, Homo sapiens
tggccagtggggttgagcagga

SEQ ID NO: 7707807 - DNA, 22 bp, Homo sapiens
tggccagtggactaagttctga

SEQ ID NO: 7707808 - DNA, 22 bp, Homo sapiens
tggccagtgcctgccagtgcag

SEQ ID NO: 7707809 - DNA, 22 bp, Homo sapiens
tggccatgaaggaggcagcaga

SEQ ID NO: 7707810 - DNA, 22 bp, Homo sapiens
tggccagtttgctcaggcagtc

SEQ ID NO: 7707811 - DNA, 22 bp, Homo sapiens
tggccagtttgctcaggcagtc

SEQ ID NO: 7707812 - DNA, 22 bp, Homo sapiens
tggccatgaaggaggcagcaga

SEQ ID NO: 7707813 - DNA, 22 bp, Homo sapiens
tggccagtgttggctagggaca

SEQ ID NO: 7707814 - DNA, 22 bp, Homo sapiens
tggccagttgaagacaatgctc

SEQ ID NO: 7707815 - DNA, 22 bp, Homo sapiens
tggccagtttgctcaggcagtc

SEQ ID NO: 7707816 - DNA, 22 bp, Homo sapiens
tggccagtttgctcaggcagtc

SEQ ID NO: 7707817 - DNA, 22 bp, Homo sapiens
tggccagtttgctcaggcagtc

SEQ ID NO: 7707818 - DNA, 22 bp, Homo sapiens
tggccagtttgctcaggcagtc

SEQ ID NO: 7707819 - DNA, 22 bp, Homo sapiens
tggccagtttgctcaggcagtc

SEQ ID NO: 7707820 - DNA, 22 bp, Homo sapiens
tggccagtttgctcaggcagtc

SEQ ID NO: 7707821 - DNA, 22 bp, Homo sapiens
tggcccaaagcagcccagcagg

SEQ ID NO: 7707822 - DNA, 22 bp, Homo sapiens
tggccatttactctgtaagagt

SEQ ID NO: 7707823 - DNA, 22 bp, Homo sapiens
tggccatttactctgtaagagt

SEQ ID NO: 7707824 - DNA, 21 bp, Homo sapiens
tggccatttatccttatgaga

SEQ ID NO: 7707825 - DNA, 22 bp, Homo sapiens
tggccatgggatagtgcagggg

SEQ ID NO: 7707826 - DNA, 22 bp, Homo sapiens
tggccatgggatagtgcagggg

SEQ ID NO: 7707827 - DNA, 22 bp, Homo sapiens
tggccatgacatggaggctttg

SEQ ID NO: 7707828 - DNA, 22 bp, Homo sapiens
tggccatgggatagtgcagggg

SEQ ID NO: 7707829 - DNA, 22 bp, Homo sapiens
tggccatgggatagtgcagggg

SEQ ID NO: 7707830 - DNA, 22 bp, Homo sapiens
tggccatgggatagtgcagggg

SEQ ID NO: 7707831 - DNA, 22 bp, Homo sapiens
tggcccagactctgctcttatc

SEQ ID NO: 7707832 - DNA, 22 bp, Homo sapiens
tggcccagactctgctcttatc

SEQ ID NO: 7707833 - DNA, 22 bp, Homo sapiens
tggcccagagcactgctgggca

SEQ ID NO: 7707834 - DNA, 22 bp, Homo sapiens
tggcccagactctgctcttatc

SEQ ID NO: 7707835 - DNA, 22 bp, Homo sapiens
tggcccagccctgctctagggc

SEQ ID NO: 7707836 - DNA, 22 bp, Homo sapiens
tggcccagccctgctctagggc

SEQ ID NO: 7707837 - DNA, 22 bp, Homo sapiens
tggcccagagcactgctgggca

SEQ ID NO: 7707838 - DNA, 22 bp, Homo sapiens
tggcccagagcactgctgggca

SEQ ID NO: 7707839 - DNA, 22 bp, Homo sapiens
tggcccagactctgctcttatc

SEQ ID NO: 7707840 - DNA, 22 bp, Homo sapiens
tggcccaatatgttaacatgat

SEQ ID NO: 7707841 - DNA, 22 bp, Homo sapiens
tggcccagactctgctcttatc

SEQ ID NO: 7707842 - DNA, 22 bp, Homo sapiens
tggcccagactctgctcttatc

SEQ ID NO: 7707843 - DNA, 22 bp, Homo sapiens
tggcccaatatgttaacatgat

SEQ ID NO: 7707844 - DNA, 22 bp, Homo sapiens
tggcccaagacgttacctcctt

SEQ ID NO: 7707845 - DNA, 22 bp, Homo sapiens
tggcccaagcccgggacggcca

SEQ ID NO: 7707846 - DNA, 22 bp, Homo sapiens
tggcccaaggttacatggctag

SEQ ID NO: 7707847 - DNA, 22 bp, Homo sapiens
tggcccaagtctgctagaagag

SEQ ID NO: 7707848 - DNA, 15 bp, Homo sapiens
tggcccacccgttga

SEQ ID NO: 7707849 - DNA, 15 bp, Homo sapiens
tggcccacccgttga

SEQ ID NO: 7707850 - DNA, 15 bp, Homo sapiens
tggcccacccgttga

SEQ ID NO: 7707851 - DNA, 22 bp, Homo sapiens
tggcccaagtctgctagaagag

SEQ ID NO: 7707852 - DNA, 22 bp, Homo sapiens
tggcccaagtctgctagaagag

SEQ ID NO: 7707853 - DNA, 22 bp, Homo sapiens
tggcccaaggttacatggctag

SEQ ID NO: 7707854 - DNA, 22 bp, Homo sapiens
tggcccaagcccgggacggcca

SEQ ID NO: 7707855 - DNA, 22 bp, Homo sapiens
tggcccaagacgttacctcctt

SEQ ID NO: 7707856 - DNA, 22 bp, Homo sapiens
tggcccaaagcagcccagcagg

SEQ ID NO: 7707857 - DNA, 21 bp, Homo sapiens
tggccatttatccttatgaga

SEQ ID NO: 7707858 - DNA, 22 bp, Homo sapiens
tggcccaaagcagcccagcagg

SEQ ID NO: 7707859 - DNA, 22 bp, Homo sapiens
tggcccagccctgctctagggc

SEQ ID NO: 7707860 - DNA, 22 bp, Homo sapiens
tggcccagctcagggtgggcgg

SEQ ID NO: 7707861 - DNA, 22 bp, Homo sapiens
tggcccagctcagggtgggcgg

SEQ ID NO: 7707862 - DNA, 22 bp, Homo sapiens
tggcccagctcagggtgggcgg

SEQ ID NO: 7707863 - DNA, 22 bp, Homo sapiens
tggcccagctcagggtgggcgg

SEQ ID NO: 7707864 - DNA, 22 bp, Homo sapiens
tggcccagccctgctctagggc

SEQ ID NO: 7707865 - DNA, 22 bp, Homo sapiens
tggcccagccctgctctagggc

SEQ ID NO: 7707866 - DNA, 22 bp, Homo sapiens
tggcccagagcactgctgggca

SEQ ID NO: 7707867 - DNA, 22 bp, Homo sapiens
tggcccagccctgctctagggc

SEQ ID NO: 7707868 - DNA, 22 bp, Homo sapiens
tggcccagctcagggtgggcgg

SEQ ID NO: 7707869 - DNA, 22 bp, Homo sapiens
tggcccagctcagggtgggcgg

SEQ ID NO: 7707870 - DNA, 22 bp, Homo sapiens
tggcccagctcagggtgggcgg

SEQ ID NO: 7707871 - DNA, 22 bp, Homo sapiens
tggcccagctcagggtgggcgg

SEQ ID NO: 7707872 - DNA, 22 bp, Homo sapiens
tggcccagctgcagatggtgga

SEQ ID NO: 7707873 - DNA, 22 bp, Homo sapiens
tggcccagctgcagatggtgga

SEQ ID NO: 7707874 - DNA, 22 bp, Homo sapiens
tggcccagctcagggtgggcgg

SEQ ID NO: 7707875 - DNA, 22 bp, Homo sapiens
tggcccagctgcagatggtgga

SEQ ID NO: 7707876 - DNA, 22 bp, Homo sapiens
tggcccagctgcagatggtgga

SEQ ID NO: 7707877 - DNA, 22 bp, Homo sapiens
tggccctgacttggaggcctga

SEQ ID NO: 7707878 - DNA, 22 bp, Homo sapiens
tggccctgacttggaggcctga

SEQ ID NO: 7707879 - DNA, 22 bp, Homo sapiens
tggccctgacttggaggcctga

SEQ ID NO: 7707880 - DNA, 22 bp, Homo sapiens
tggccctgacttggaggcctga

SEQ ID NO: 7707881 - DNA, 22 bp, Homo sapiens
tggccctgacttggaggcctga

SEQ ID NO: 7707882 - DNA, 22 bp, Homo sapiens
tggccctgacttggaggcctga

SEQ ID NO: 7707883 - DNA, 22 bp, Homo sapiens
tggccctgactgatgtggaggg

SEQ ID NO: 7707884 - DNA, 22 bp, Homo sapiens
tggccctgactgatgtggaggg

SEQ ID NO: 7707885 - DNA, 22 bp, Homo sapiens
tggccctgactgatgtggaggg

SEQ ID NO: 7707886 - DNA, 22 bp, Homo sapiens
tggccctgaggacccagtgtgg

SEQ ID NO: 7707887 - DNA, 22 bp, Homo sapiens
tggccctgaggacccagtgtgg

SEQ ID NO: 7707888 - DNA, 22 bp, Homo sapiens
tggccctgaggacccagtgtgg

SEQ ID NO: 7707889 - DNA, 22 bp, Homo sapiens
tggccctgacttggaggcctga

SEQ ID NO: 7707890 - DNA, 22 bp, Homo sapiens
tggccctgaggacccagtgtgg

SEQ ID NO: 7707891 - DNA, 22 bp, Homo sapiens
tggccctgaggacccagtgtgg

SEQ ID NO: 7707892 - DNA, 22 bp, Homo sapiens
tggccctgactgatgtggaggg

SEQ ID NO: 7707893 - DNA, 22 bp, Homo sapiens
tggccctgactgatgtggaggg

SEQ ID NO: 7707894 - DNA, 22 bp, Homo sapiens
tggccctgactgatgtggaggg

SEQ ID NO: 7707895 - DNA, 22 bp, Homo sapiens
tggccctgactgatgtggaggg

SEQ ID NO: 7707896 - DNA, 22 bp, Homo sapiens
tggccctgacaggtcctgggca

SEQ ID NO: 7707897 - DNA, 22 bp, Homo sapiens
tggccctgacaggtcctgggca

SEQ ID NO: 7707898 - DNA, 22 bp, Homo sapiens
tggccctgacaggtcctgggca

SEQ ID NO: 7707899 - DNA, 22 bp, Homo sapiens
tggccctgacaggtcctgggca

SEQ ID NO: 7707900 - DNA, 22 bp, Homo sapiens
tggccctgacaggtcctgggca

SEQ ID NO: 7707901 - DNA, 22 bp, Homo sapiens
tggccctgacaggtcctgggca

SEQ ID NO: 7707902 - DNA, 22 bp, Homo sapiens
tggccctgacacgtggtactgg

SEQ ID NO: 7707903 - DNA, 22 bp, Homo sapiens
tggccctgacaggtcctgggca

SEQ ID NO: 7707904 - DNA, 22 bp, Homo sapiens
tggccctgacacgtggtactgg

SEQ ID NO: 7707905 - DNA, 22 bp, Homo sapiens
tggccctgacacgtggtactgg

SEQ ID NO: 7707906 - DNA, 22 bp, Homo sapiens
tggccctgaggggctgtgcccc

SEQ ID NO: 7707907 - DNA, 22 bp, Homo sapiens
tggccctgaggggctgtgcccc

SEQ ID NO: 7707908 - DNA, 22 bp, Homo sapiens
tggccctgaggggctgtgcccc

SEQ ID NO: 7707909 - DNA, 22 bp, Homo sapiens
tggccctgaggggctgtgcccc

SEQ ID NO: 7707910 - DNA, 22 bp, Homo sapiens
tggccctgaggggctgtgcccc

SEQ ID NO: 7707911 - DNA, 22 bp, Homo sapiens
tggccctgcacccagagcagtt

SEQ ID NO: 7707912 - DNA, 22 bp, Homo sapiens
tggccctgcacccagagcagtt

SEQ ID NO: 7707913 - DNA, 22 bp, Homo sapiens
tggccctgcacccagagcagtt

SEQ ID NO: 7707914 - DNA, 22 bp, Homo sapiens
tggccctgagggctcggagcca

SEQ ID NO: 7707915 - DNA, 22 bp, Homo sapiens
tggccctgaggacccagtgtgg

SEQ ID NO: 7707916 - DNA, 22 bp, Homo sapiens
tggccctgagggctcggagcca

SEQ ID NO: 7707917 - DNA, 22 bp, Homo sapiens
tggccctgagggctcggagcca

SEQ ID NO: 7707918 - DNA, 22 bp, Homo sapiens
tggccctgaggggctgtgcccc

SEQ ID NO: 7707919 - DNA, 22 bp, Homo sapiens
tggccctgagggctcggagcca

SEQ ID NO: 7707920 - DNA, 22 bp, Homo sapiens
tggccctgagggctcggagcca

SEQ ID NO: 7707921 - DNA, 22 bp, Homo sapiens
tggccctgagggctcggagcca

SEQ ID NO: 7707922 - DNA, 22 bp, Homo sapiens
tggccctgcagaactagcctgg

SEQ ID NO: 7707923 - DNA, 22 bp, Homo sapiens
tggccctgcagaactagcctgg

SEQ ID NO: 7707924 - DNA, 22 bp, Homo sapiens
tggccctgcagaactagcctgg

SEQ ID NO: 7707925 - DNA, 22 bp, Homo sapiens
tggccctgcagaactagcctgg

SEQ ID NO: 7707926 - DNA, 22 bp, Homo sapiens
tggccctgccactcactgctga

SEQ ID NO: 7707927 - DNA, 22 bp, Homo sapiens
tggccctgccactcactgctga

SEQ ID NO: 7707928 - DNA, 22 bp, Homo sapiens
tggccctgcagaactagcctgg

SEQ ID NO: 7707929 - DNA, 22 bp, Homo sapiens
tggccctgcacccagagcagtt

SEQ ID NO: 7707930 - DNA, 22 bp, Homo sapiens
tggccctgcacccagagcagtt

SEQ ID NO: 7707931 - DNA, 22 bp, Homo sapiens
tggccctgcacccagagcagtt

SEQ ID NO: 7707932 - DNA, 22 bp, Homo sapiens
tggccctgcacccagagcagtt

SEQ ID NO: 7707933 - DNA, 22 bp, Homo sapiens
tggccctgcacccagagcagtt

SEQ ID NO: 7707934 - DNA, 22 bp, Homo sapiens
tggccctgcacccagagcagtt

SEQ ID NO: 7707935 - DNA, 22 bp, Homo sapiens
tggccctgcacccagagcagtt

SEQ ID NO: 7707936 - DNA, 22 bp, Homo sapiens
tggccctgcagaactagcctgg

SEQ ID NO: 7707937 - DNA, 22 bp, Homo sapiens
tggccctgcagaactagcctgg

SEQ ID NO: 7707938 - DNA, 22 bp, Homo sapiens
tggccctgaaggccttgagcat

SEQ ID NO: 7707939 - DNA, 22 bp, Homo sapiens
tggccctgaaggccttgagcat

SEQ ID NO: 7707940 - DNA, 22 bp, Homo sapiens
tggccctgaaggccttgagcat

SEQ ID NO: 7707941 - DNA, 22 bp, Homo sapiens
tggccctgaaggccttgagcat

SEQ ID NO: 7707942 - DNA, 22 bp, Homo sapiens
tggccctctgcaagattctgga

SEQ ID NO: 7707943 - DNA, 22 bp, Homo sapiens
tggccctctgcaagattctgga

SEQ ID NO: 7707944 - DNA, 22 bp, Homo sapiens
tggccctcgtccgacaggtggg

SEQ ID NO: 7707945 - DNA, 22 bp, Homo sapiens
tggccctcgtccgacaggtggg

SEQ ID NO: 7707946 - DNA, 22 bp, Homo sapiens
tggccctcgtccgacaggtggg

SEQ ID NO: 7707947 - DNA, 22 bp, Homo sapiens
tggccctcgtccgacaggtggg

SEQ ID NO: 7707948 - DNA, 22 bp, Homo sapiens
tggccctcagtcttgctcctgc

SEQ ID NO: 7707949 - DNA, 22 bp, Homo sapiens
tggccctcgtccgacaggtggg

SEQ ID NO: 7707950 - DNA, 22 bp, Homo sapiens
tggccctcgtccgacaggtggg

SEQ ID NO: 7707951 - DNA, 22 bp, Homo sapiens
tggccctatttggaaatagagc

SEQ ID NO: 7707952 - DNA, 23 bp, Homo sapiens
tggcccgggctcagaggcagtgc

SEQ ID NO: 7707953 - DNA, 22 bp, Homo sapiens
tggccctcagcactgagacctt

SEQ ID NO: 7707954 - DNA, 22 bp, Homo sapiens
tggccctcagcactgagacctt

SEQ ID NO: 7707955 - DNA, 17 bp, Homo sapiens
tggccctagactccagc

SEQ ID NO: 7707956 - DNA, 23 bp, Homo sapiens
tggcccgggctcagaggcagtgc

SEQ ID NO: 7707957 - DNA, 22 bp, Homo sapiens
tggccctcagtcttgctcctgc

SEQ ID NO: 7707958 - DNA, 22 bp, Homo sapiens
tggccctcagtcttgctcctgc

SEQ ID NO: 7707959 - DNA, 22 bp, Homo sapiens
tggccctcagcactgagacctt

SEQ ID NO: 7707960 - DNA, 22 bp, Homo sapiens
tggccctcagtcttgctcctgc

SEQ ID NO: 7707961 - DNA, 22 bp, Homo sapiens
tggccctatttggaaatagagc

SEQ ID NO: 7707962 - DNA, 23 bp, Homo sapiens
tggccctgaatctgtcctggagg

SEQ ID NO: 7707963 - DNA, 23 bp, Homo sapiens
tggccctgaatctgtcctggagg

SEQ ID NO: 7707964 - DNA, 23 bp, Homo sapiens
tggccctgaatctgtcctggagg

SEQ ID NO: 7707965 - DNA, 23 bp, Homo sapiens
tggccctgaatctgtcctggagg

SEQ ID NO: 7707966 - DNA, 22 bp, Homo sapiens
tggccctgacacgtggtactgg

SEQ ID NO: 7707967 - DNA, 22 bp, Homo sapiens
tggccctgacacgtggtactgg

SEQ ID NO: 7707968 - DNA, 22 bp, Homo sapiens
tggccctgaatcaaggccagca

SEQ ID NO: 7707969 - DNA, 22 bp, Homo sapiens
tggccctgaatcaaggccagca

SEQ ID NO: 7707970 - DNA, 22 bp, Homo sapiens
tggccctgaatcaaggccagca

SEQ ID NO: 7707971 - DNA, 22 bp, Homo sapiens
tggccctgaatcaaggccagca

SEQ ID NO: 7707972 - DNA, 22 bp, Homo sapiens
tggccctgaatcaaggccagca

SEQ ID NO: 7707973 - DNA, 22 bp, Homo sapiens
tggccctgaatcaaggccagca

SEQ ID NO: 7707974 - DNA, 22 bp, Homo sapiens
tggccctgaatcaaggccagca

SEQ ID NO: 7707975 - DNA, 22 bp, Homo sapiens
tggccctgaatcaaggccagca

SEQ ID NO: 7707976 - DNA, 22 bp, Homo sapiens
tggcccaggtgcacccagaggc

SEQ ID NO: 7707977 - DNA, 22 bp, Homo sapiens
tggcccaggtgcacccagaggc

SEQ ID NO: 7707978 - DNA, 22 bp, Homo sapiens
tggcccaggtgcacccagaggc

SEQ ID NO: 7707979 - DNA, 22 bp, Homo sapiens
tggcccaggtgcacccagaggc

SEQ ID NO: 7707980 - DNA, 22 bp, Homo sapiens
tggcccaggtgcacccagaggc

SEQ ID NO: 7707981 - DNA, 22 bp, Homo sapiens
tggcccagtagaaaagggatcg

SEQ ID NO: 7707982 - DNA, 22 bp, Homo sapiens
tggcccagtagaaaagggatcg

SEQ ID NO: 7707983 - DNA, 22 bp, Homo sapiens
tggcccagtagaaaagggatcg

SEQ ID NO: 7707984 - DNA, 22 bp, Homo sapiens
tggcccagtagaaaagggatcg

SEQ ID NO: 7707985 - DNA, 22 bp, Homo sapiens
tggcccagtagaaaagggatcg

SEQ ID NO: 7707986 - DNA, 22 bp, Homo sapiens
tggcccaggtgcacccagaggc

SEQ ID NO: 7707987 - DNA, 22 bp, Homo sapiens
tggcccaggtgcaagagacaga

SEQ ID NO: 7707988 - DNA, 22 bp, Homo sapiens
tggcccaggtgcaagagacaga

SEQ ID NO: 7707989 - DNA, 22 bp, Homo sapiens
tggcccaggtgcaagagacaga

SEQ ID NO: 7707990 - DNA, 22 bp, Homo sapiens
tggcccaggtgcaagagacaga

SEQ ID NO: 7707991 - DNA, 22 bp, Homo sapiens
tggcccaggtgcaagagacaga

SEQ ID NO: 7707992 - DNA, 22 bp, Homo sapiens
tggcccaggtgcacccagaggc

SEQ ID NO: 7707993 - DNA, 22 bp, Homo sapiens
tggcccaggtgcacccagaggc

SEQ ID NO: 7707994 - DNA, 22 bp, Homo sapiens
tggcccaggtgcacccagaggc

SEQ ID NO: 7707995 - DNA, 22 bp, Homo sapiens
tggcccaggtgcacccagaggc

SEQ ID NO: 7707996 - DNA, 22 bp, Homo sapiens
tggcccaggtgcaagagacaga

SEQ ID NO: 7707997 - DNA, 22 bp, Homo sapiens
tggcccaggtgcaagagacaga

SEQ ID NO: 7707998 - DNA, 22 bp, Homo sapiens
tggcccagtatgtataatctta

SEQ ID NO: 7707999 - DNA, 22 bp, Homo sapiens
tggcccagtatgtataatctta

SEQ ID NO: 7708000 - DNA, 22 bp, Homo sapiens
tggcccagtatgtataatctta

SEQ ID NO: 7708001 - DNA, 22 bp, Homo sapiens
tggcccagtatgtataatctta

SEQ ID NO: 7708002 - DNA, 22 bp, Homo sapiens
tggcccagtcagcaggagaggg

SEQ ID NO: 7708003 - DNA, 22 bp, Homo sapiens
tggcccagtcagcaggagaggg

SEQ ID NO: 7708004 - DNA, 22 bp, Homo sapiens
tggcccagtcagcaggagaggg

SEQ ID NO: 7708005 - DNA, 22 bp, Homo sapiens
tggcccagtcagcaggagaggg

SEQ ID NO: 7708006 - DNA, 22 bp, Homo sapiens
tggcccgggagttttgaagagt

SEQ ID NO: 7708007 - DNA, 23 bp, Homo sapiens
tggcccgggctcagaggcagtgc

SEQ ID NO: 7708008 - DNA, 22 bp, Homo sapiens
tggcccggctctgagctgtgct

SEQ ID NO: 7708009 - DNA, 22 bp, Homo sapiens
tggcccggctctgagctgtgct

SEQ ID NO: 7708010 - DNA, 22 bp, Homo sapiens
tggcccagtgcttatgctctga

SEQ ID NO: 7708011 - DNA, 22 bp, Homo sapiens
tggcccagtcagcaggagaggg

SEQ ID NO: 7708012 - DNA, 22 bp, Homo sapiens
tggcccgccggaagaagatgtc

SEQ ID NO: 7708013 - DNA, 22 bp, Homo sapiens
tggcccagtcagcaggagaggg

SEQ ID NO: 7708014 - DNA, 22 bp, Homo sapiens
tggcccagtcagcaggagaggg

SEQ ID NO: 7708015 - DNA, 22 bp, Homo sapiens
tggcccagtcagcaggagaggg

SEQ ID NO: 7708016 - DNA, 22 bp, Homo sapiens
tggcccagtcagcaggagaggg

SEQ ID NO: 7708017 - DNA, 22 bp, Homo sapiens
tggcccagtcagcaggagaggg

SEQ ID NO: 7708018 - DNA, 22 bp, Homo sapiens
tggcccagtcagcaggagaggg

SEQ ID NO: 7708019 - DNA, 22 bp, Homo sapiens
tgctggtgattaaatcctgaag

SEQ ID NO: 7708020 - DNA, 22 bp, Homo sapiens
tgctggtgaggtccttgctgga

SEQ ID NO: 7708021 - DNA, 22 bp, Homo sapiens
tgctggtgattaaatcctgaag

SEQ ID NO: 7708022 - DNA, 22 bp, Homo sapiens
tgctggtgattaaatcctgaag

SEQ ID NO: 7708023 - DNA, 22 bp, Homo sapiens
tgctggtgaggtccttgctgga

SEQ ID NO: 7708024 - DNA, 22 bp, Homo sapiens
tgctggtgaggtccttgctgga

SEQ ID NO: 7708025 - DNA, 22 bp, Homo sapiens
tgctggtgaggtccttgctgga

SEQ ID NO: 7708026 - DNA, 22 bp, Homo sapiens
tgctggtggagaaagtggaggt

SEQ ID NO: 7708027 - DNA, 22 bp, Homo sapiens
tgctggtggagaaagtggaggt

SEQ ID NO: 7708028 - DNA, 22 bp, Homo sapiens
tgctggtgattaaatcctgaag

SEQ ID NO: 7708029 - DNA, 22 bp, Homo sapiens
tgctggtggagaaagtggaggt

SEQ ID NO: 7708030 - DNA, 22 bp, Homo sapiens
tgctggtggagaaagtggaggt

SEQ ID NO: 7708031 - DNA, 22 bp, Homo sapiens
tgctggtggagaaagtggaggt

SEQ ID NO: 7708032 - DNA, 21 bp, Homo sapiens
tgctggtgagctcatgtggct

SEQ ID NO: 7708033 - DNA, 21 bp, Homo sapiens
tgctggtgagctcatgtggct

SEQ ID NO: 7708034 - DNA, 22 bp, Homo sapiens
tgctggtcctggagctgggttc

SEQ ID NO: 7708035 - DNA, 22 bp, Homo sapiens
tgctggtcccctgcagcctgtg

SEQ ID NO: 7708036 - DNA, 22 bp, Homo sapiens
tgctggtcctggagctgggttc

SEQ ID NO: 7708037 - DNA, 22 bp, Homo sapiens
tgctggtcctggagctgggttc

SEQ ID NO: 7708038 - DNA, 22 bp, Homo sapiens
tgctggtgaggtccttgctgga

SEQ ID NO: 7708039 - DNA, 22 bp, Homo sapiens
tgctggtgaggtccttgctgga

SEQ ID NO: 7708040 - DNA, 22 bp, Homo sapiens
tgctggtgaggtccttgctgga

SEQ ID NO: 7708041 - DNA, 21 bp, Homo sapiens
tgctggtgagctcatgtggct

SEQ ID NO: 7708042 - DNA, 21 bp, Homo sapiens
tgctggtgagctcatgtggct

SEQ ID NO: 7708043 - DNA, 21 bp, Homo sapiens
tgctggtgagctcatgtggct

SEQ ID NO: 7708044 - DNA, 21 bp, Homo sapiens
tgctggtgagctcatgtggct

SEQ ID NO: 7708045 - DNA, 22 bp, Homo sapiens
tgctgggtggttgctcctcccg

SEQ ID NO: 7708046 - DNA, 22 bp, Homo sapiens
tgctgggtggttgctcctcccg

SEQ ID NO: 7708047 - DNA, 22 bp, Homo sapiens
tgctgggtggttgctcctcccg

SEQ ID NO: 7708048 - DNA, 22 bp, Homo sapiens
tgctgggtgttccgcacttgac

SEQ ID NO: 7708049 - DNA, 22 bp, Homo sapiens
tgctgggtggttgctcctcccg

SEQ ID NO: 7708050 - DNA, 22 bp, Homo sapiens
tgctgggtggttgctcctcccg

SEQ ID NO: 7708051 - DNA, 22 bp, Homo sapiens
tgctgggtgttccgcacttgac

SEQ ID NO: 7708052 - DNA, 22 bp, Homo sapiens
tgctgggtgttccgcacttgac

SEQ ID NO: 7708053 - DNA, 22 bp, Homo sapiens
tgctgggtgttccgcacttgac

SEQ ID NO: 7708054 - DNA, 22 bp, Homo sapiens
tgctgggttacctaagcctaaa

SEQ ID NO: 7708055 - DNA, 22 bp, Homo sapiens
tgctgggtcccttgagagctca

SEQ ID NO: 7708056 - DNA, 22 bp, Homo sapiens
tgctgggtcccttgagagctca

SEQ ID NO: 7708057 - DNA, 22 bp, Homo sapiens
tgctgggtcccttgagagctca

SEQ ID NO: 7708058 - DNA, 19 bp, Homo sapiens
tgctgggtcatatggaaac

SEQ ID NO: 7708059 - DNA, 22 bp, Homo sapiens
tgctgggtcccttgagagctca

SEQ ID NO: 7708060 - DNA, 20 bp, Homo sapiens
tgctgggtgggcagctgtaa

SEQ ID NO: 7708061 - DNA, 20 bp, Homo sapiens
tgctgggtgggcagctgtaa

SEQ ID NO: 7708062 - DNA, 22 bp, Homo sapiens
tgctgggtggacttggctctca

SEQ ID NO: 7708063 - DNA, 22 bp, Homo sapiens
tgctgggtggacttggctctca

SEQ ID NO: 7708064 - DNA, 22 bp, Homo sapiens
tgctgggtggacttggctctca

SEQ ID NO: 7708065 - DNA, 21 bp, Homo sapiens
tgctgggtttgcccatcaggc

SEQ ID NO: 7708066 - DNA, 22 bp, Homo sapiens
tgctggtaccgcgcctccgcca

SEQ ID NO: 7708067 - DNA, 21 bp, Homo sapiens
tgctgggtttgcccatcaggc

SEQ ID NO: 7708068 - DNA, 21 bp, Homo sapiens
tgctgggtttgcccatcaggc

SEQ ID NO: 7708069 - DNA, 21 bp, Homo sapiens
tgctgggtttgcccatcaggc

SEQ ID NO: 7708070 - DNA, 21 bp, Homo sapiens
tgctggtcacaggtggcccca

SEQ ID NO: 7708071 - DNA, 22 bp, Homo sapiens
tgctggtccatgaggccagatc

SEQ ID NO: 7708072 - DNA, 22 bp, Homo sapiens
tgctggtaccgcgcctccgcca

SEQ ID NO: 7708073 - DNA, 22 bp, Homo sapiens
tgctggtaccgcgcctccgcca

SEQ ID NO: 7708074 - DNA, 22 bp, Homo sapiens
tgctggtcccctgcagcctgtg

SEQ ID NO: 7708075 - DNA, 22 bp, Homo sapiens
tgctggtcccctgcagcctgtg

SEQ ID NO: 7708076 - DNA, 22 bp, Homo sapiens
tgctggtcccctgcagcctgtg

SEQ ID NO: 7708077 - DNA, 23 bp, Homo sapiens
tgctggtgtttttgggaccaggg

SEQ ID NO: 7708078 - DNA, 23 bp, Homo sapiens
tgctggtgtttttgggaccaggg

SEQ ID NO: 7708079 - DNA, 23 bp, Homo sapiens
tgctggtgtttttgggaccaggg

SEQ ID NO: 7708080 - DNA, 23 bp, Homo sapiens
tgctggtgtttttgggaccaggg

SEQ ID NO: 7708081 - DNA, 23 bp, Homo sapiens
tgctggtgtttttgggaccaggg

SEQ ID NO: 7708082 - DNA, 20 bp, Homo sapiens
tgctggttacaccaccaagg

SEQ ID NO: 7708083 - DNA, 20 bp, Homo sapiens
tgctggttacaccaccaagg

SEQ ID NO: 7708084 - DNA, 23 bp, Homo sapiens
tgctggttcaaaaaggaaggagg

SEQ ID NO: 7708085 - DNA, 22 bp, Homo sapiens
tgctggttcttaagatgcctcc

SEQ ID NO: 7708086 - DNA, 22 bp, Homo sapiens
tgctgtagggagaaagagttga

SEQ ID NO: 7708087 - DNA, 22 bp, Homo sapiens
tgctgtagccctgcacagtgca

SEQ ID NO: 7708088 - DNA, 22 bp, Homo sapiens
tgctgtagggagaaagagttga

SEQ ID NO: 7708089 - DNA, 22 bp, Homo sapiens
tgctgtagggagaaagagttga

SEQ ID NO: 7708090 - DNA, 22 bp, Homo sapiens
tgctgtagtcaaagcaaagctg

SEQ ID NO: 7708091 - DNA, 22 bp, Homo sapiens
tgctgtaatacttaaggttaag

SEQ ID NO: 7708092 - DNA, 20 bp, Homo sapiens
tgctgtaagattagagagct

SEQ ID NO: 7708093 - DNA, 22 bp, Homo sapiens
tgctgtcaaggttacatgcttt

SEQ ID NO: 7708094 - DNA, 22 bp, Homo sapiens
tgctgtcaaggttacatgcttt

SEQ ID NO: 7708095 - DNA, 22 bp, Homo sapiens
tgctgtcaagaaaacaagcaat

SEQ ID NO: 7708096 - DNA, 22 bp, Homo sapiens
tgctgtcaagaaaacaagcaat

SEQ ID NO: 7708097 - DNA, 22 bp, Homo sapiens
tgctgtcaagaaaacaagcaat

SEQ ID NO: 7708098 - DNA, 22 bp, Homo sapiens
tgctgtattacttttacaaact

SEQ ID NO: 7708099 - DNA, 22 bp, Homo sapiens
tgctgtattacttttacaaact

SEQ ID NO: 7708100 - DNA, 22 bp, Homo sapiens
tgctgtatatattttgaagtga

SEQ ID NO: 7708101 - DNA, 22 bp, Homo sapiens
tgctgtatatattttgaagtga

SEQ ID NO: 7708102 - DNA, 23 bp, Homo sapiens
tgctgtccaacagactggccatg

SEQ ID NO: 7708103 - DNA, 23 bp, Homo sapiens
tgctgtccaacagactggccatg

SEQ ID NO: 7708104 - DNA, 22 bp, Homo sapiens
tgctgtcagacagcagtggtaa

SEQ ID NO: 7708105 - DNA, 23 bp, Homo sapiens
tgctgtccaacagactggccatg

SEQ ID NO: 7708106 - DNA, 23 bp, Homo sapiens
tgctgtccaacagactggccatg

SEQ ID NO: 7708107 - DNA, 23 bp, Homo sapiens
tgctgtccaacagactggccatg

SEQ ID NO: 7708108 - DNA, 23 bp, Homo sapiens
tgctgtccaacagactggccatg

SEQ ID NO: 7708109 - DNA, 23 bp, Homo sapiens
tgctgggtaaatagctgagtaac

SEQ ID NO: 7708110 - DNA, 22 bp, Homo sapiens
tgctggggtctctccggtgccc

SEQ ID NO: 7708111 - DNA, 22 bp, Homo sapiens
tgctggggtctctccggtgccc

SEQ ID NO: 7708112 - DNA, 22 bp, Homo sapiens
tgctggggtctctccggtgccc

SEQ ID NO: 7708113 - DNA, 22 bp, Homo sapiens
tgctggggtctctccggtgccc

SEQ ID NO: 7708114 - DNA, 22 bp, Homo sapiens
tgctggggtctctccggtgccc

SEQ ID NO: 7708115 - DNA, 22 bp, Homo sapiens
tgctggggtctctccggtgccc

SEQ ID NO: 7708116 - DNA, 22 bp, Homo sapiens
tgctgggtcagtgagagcaggg

SEQ ID NO: 7708117 - DNA, 22 bp, Homo sapiens
tgctgggtcaggcatctgcaga

SEQ ID NO: 7708118 - DNA, 22 bp, Homo sapiens
tgctgggtcaggcatctgcaga

SEQ ID NO: 7708119 - DNA, 23 bp, Homo sapiens
tgctgggtatcagaatcactgag

SEQ ID NO: 7708120 - DNA, 23 bp, Homo sapiens
tgctgggtatcagaatcactgag

SEQ ID NO: 7708121 - DNA, 23 bp, Homo sapiens
tgctgggtatcagaatcactgag

SEQ ID NO: 7708122 - DNA, 22 bp, Homo sapiens
tgctgggtcagtgagagcaggg

SEQ ID NO: 7708123 - DNA, 22 bp, Homo sapiens
tgctgggtcagtgagagcaggg

SEQ ID NO: 7708124 - DNA, 22 bp, Homo sapiens
tgctgggtcagtgagagcaggg

SEQ ID NO: 7708125 - DNA, 22 bp, Homo sapiens
tgctgggtcccttgagagctca

SEQ ID NO: 7708126 - DNA, 22 bp, Homo sapiens
tgctgggtcccttgagagctca

SEQ ID NO: 7708127 - DNA, 19 bp, Homo sapiens
tgctgggtcatatggaaac

SEQ ID NO: 7708128 - DNA, 18 bp, Homo sapiens
tgctgggtaactgtatgg

SEQ ID NO: 7708129 - DNA, 22 bp, Homo sapiens
tgctgggtagaagtattagtct

SEQ ID NO: 7708130 - DNA, 22 bp, Homo sapiens
tgctgggtagaagtattagtct

SEQ ID NO: 7708131 - DNA, 23 bp, Homo sapiens
tgctgggtaaatagctgagtaac

SEQ ID NO: 7708132 - DNA, 23 bp, Homo sapiens
tgctgggtaaatagctgagtaac

SEQ ID NO: 7708133 - DNA, 23 bp, Homo sapiens
tgctgggtaaatagctgagtaac

SEQ ID NO: 7708134 - DNA, 18 bp, Homo sapiens
tgctgggtaactgtatgg

SEQ ID NO: 7708135 - DNA, 18 bp, Homo sapiens
tgctgggtaactgtatgg

SEQ ID NO: 7708136 - DNA, 22 bp, Homo sapiens
tgctggggtcatggggcgcccg

SEQ ID NO: 7708137 - DNA, 23 bp, Homo sapiens
tgctggggtagtttgtggcacag

SEQ ID NO: 7708138 - DNA, 23 bp, Homo sapiens
tgctggggtagtttgtggcacag

SEQ ID NO: 7708139 - DNA, 22 bp, Homo sapiens
tgctggggctctgaccactcca

SEQ ID NO: 7708140 - DNA, 23 bp, Homo sapiens
tgctggggtagtttgtggcacag

SEQ ID NO: 7708141 - DNA, 23 bp, Homo sapiens
tgctggggtagtttgtggcacag

SEQ ID NO: 7708142 - DNA, 22 bp, Homo sapiens
tgctggggtcatggggcgcccg

SEQ ID NO: 7708143 - DNA, 22 bp, Homo sapiens
tgctggggtcatggggcgcccg

SEQ ID NO: 7708144 - DNA, 22 bp, Homo sapiens
tgctggggtcatggggcgcccg

SEQ ID NO: 7708145 - DNA, 22 bp, Homo sapiens
tgctggggtcatggggcgcccg

SEQ ID NO: 7708146 - DNA, 22 bp, Homo sapiens
tgctggggtcatggggcgcccg

SEQ ID NO: 7708147 - DNA, 22 bp, Homo sapiens
tgctggggtcatggggcgcccg

SEQ ID NO: 7708148 - DNA, 22 bp, Homo sapiens
tgctggggagtgattgaccatc

SEQ ID NO: 7708149 - DNA, 22 bp, Homo sapiens
tgctggggagtgattgaccatc

SEQ ID NO: 7708150 - DNA, 22 bp, Homo sapiens
tgctggggagtgattgaccatc

SEQ ID NO: 7708151 - DNA, 22 bp, Homo sapiens
tgctggggatccgtaccaaccc

SEQ ID NO: 7708152 - DNA, 22 bp, Homo sapiens
tgctggggatccgtaccaaccc

SEQ ID NO: 7708153 - DNA, 20 bp, Homo sapiens
tgctggggacatacagggtg

SEQ ID NO: 7708154 - DNA, 20 bp, Homo sapiens
tgctggggacatacagggtg

SEQ ID NO: 7708155 - DNA, 22 bp, Homo sapiens
tgctgggcttgaaagctgctaa

SEQ ID NO: 7708156 - DNA, 20 bp, Homo sapiens
tgctggggacatacagggtg

SEQ ID NO: 7708157 - DNA, 20 bp, Homo sapiens
tgctggggacatacagggtg

SEQ ID NO: 7708158 - DNA, 20 bp, Homo sapiens
tgctggggacatacagggtg

SEQ ID NO: 7708159 - DNA, 20 bp, Homo sapiens
tgctggggacatacagggtg

SEQ ID NO: 7708160 - DNA, 20 bp, Homo sapiens
tgctggggacatacagggtg

SEQ ID NO: 7708161 - DNA, 20 bp, Homo sapiens
tgctggggacatacagggtg

SEQ ID NO: 7708162 - DNA, 22 bp, Homo sapiens
tgctggggcagaagagccaaga

SEQ ID NO: 7708163 - DNA, 22 bp, Homo sapiens
tgctggggcagaagagccaaga

SEQ ID NO: 7708164 - DNA, 22 bp, Homo sapiens
tgctggggcagaagagccaaga

SEQ ID NO: 7708165 - DNA, 22 bp, Homo sapiens
tgctggggcagaagagccaaga

SEQ ID NO: 7708166 - DNA, 22 bp, Homo sapiens
tgctggggctctgaccactcca

SEQ ID NO: 7708167 - DNA, 16 bp, Homo sapiens
tgctggggcgccgtcc

SEQ ID NO: 7708168 - DNA, 16 bp, Homo sapiens
tgctggggcgccgtcc

SEQ ID NO: 7708169 - DNA, 16 bp, Homo sapiens
tgctggggcgccgtcc

SEQ ID NO: 7708170 - DNA, 22 bp, Homo sapiens
tgctggggatccgtaccaaccc

SEQ ID NO: 7708171 - DNA, 22 bp, Homo sapiens
tgctggggcagaagagccaaga

SEQ ID NO: 7708172 - DNA, 22 bp, Homo sapiens
tgctggggcagaagagccaaga

SEQ ID NO: 7708173 - DNA, 22 bp, Homo sapiens
tgctggggcagaagagccaaga

SEQ ID NO: 7708174 - DNA, 22 bp, Homo sapiens
tgctggggatccgtaccaaccc

SEQ ID NO: 7708175 - DNA, 22 bp, Homo sapiens
tgctggggcagaagagccaaga

SEQ ID NO: 7708176 - DNA, 22 bp, Homo sapiens
tgctggcttcctgtgcacagca

SEQ ID NO: 7708177 - DNA, 22 bp, Homo sapiens
tgctggcttcctgtgcacagca

SEQ ID NO: 7708178 - DNA, 22 bp, Homo sapiens
tgctggcttcctgtgcacagca

SEQ ID NO: 7708179 - DNA, 22 bp, Homo sapiens
tgctggcttcctgtgcacagca

SEQ ID NO: 7708180 - DNA, 22 bp, Homo sapiens
tgctggcttcctgtgcacagca

SEQ ID NO: 7708181 - DNA, 22 bp, Homo sapiens
tgctggcttcctgtgcacagca

SEQ ID NO: 7708182 - DNA, 22 bp, Homo sapiens
tgctggcttcctgtgcacagca

SEQ ID NO: 7708183 - DNA, 22 bp, Homo sapiens
tgctggcttcctgtgcacagca

SEQ ID NO: 7708184 - DNA, 22 bp, Homo sapiens
tgctggcttggaaggaaagcgc

SEQ ID NO: 7708185 - DNA, 22 bp, Homo sapiens
tgctggcttggaaggaaagcgc

SEQ ID NO: 7708186 - DNA, 22 bp, Homo sapiens
tgctggcttggaaggaaagcgc

SEQ ID NO: 7708187 - DNA, 22 bp, Homo sapiens
tgctggcttcctgtgcacagca

SEQ ID NO: 7708188 - DNA, 22 bp, Homo sapiens
tgctgggcactgtctctgggga

SEQ ID NO: 7708189 - DNA, 22 bp, Homo sapiens
tgctgggcactgtctctgggga

SEQ ID NO: 7708190 - DNA, 22 bp, Homo sapiens
tgctgggcactgtctctgggga

SEQ ID NO: 7708191 - DNA, 22 bp, Homo sapiens
tgctgggcactgtctctgggga

SEQ ID NO: 7708192 - DNA, 23 bp, Homo sapiens
tgctgggcagagctggtgctgag

SEQ ID NO: 7708193 - DNA, 23 bp, Homo sapiens
tgctgggcagagctggtgctgag

SEQ ID NO: 7708194 - DNA, 23 bp, Homo sapiens
tgctgggcagagctggtgctgag

SEQ ID NO: 7708195 - DNA, 23 bp, Homo sapiens
tgctgggcagagctggtgctgag

SEQ ID NO: 7708196 - DNA, 23 bp, Homo sapiens
tgctgggcagagctggtgctgag

SEQ ID NO: 7708197 - DNA, 22 bp, Homo sapiens
tgctgggcatcgtaggaggtac

SEQ ID NO: 7708198 - DNA, 22 bp, Homo sapiens
tgctgggcagtgtgccctcgag

SEQ ID NO: 7708199 - DNA, 22 bp, Homo sapiens
tgctgggcagtgtgccctcgag

SEQ ID NO: 7708200 - DNA, 22 bp, Homo sapiens
tgctgggcatcgtaggaggtac

SEQ ID NO: 7708201 - DNA, 22 bp, Homo sapiens
tgctgggcagtgtgccctcgag

SEQ ID NO: 7708202 - DNA, 22 bp, Homo sapiens
tgctgggcagtgtgccctcgag

SEQ ID NO: 7708203 - DNA, 22 bp, Homo sapiens
tgctgggcagtgtgccctcgag

SEQ ID NO: 7708204 - DNA, 23 bp, Homo sapiens
tgctgggcagagctggtgctgag

SEQ ID NO: 7708205 - DNA, 22 bp, Homo sapiens
tgctgggcagtgtgccctcgag

SEQ ID NO: 7708206 - DNA, 23 bp, Homo sapiens
tgctgggcagagctggtgctgag

SEQ ID NO: 7708207 - DNA, 22 bp, Homo sapiens
tgctgggcatcgtaggaggtac

SEQ ID NO: 7708208 - DNA, 22 bp, Homo sapiens
tgctgggcatcgtaggaggtac

SEQ ID NO: 7708209 - DNA, 22 bp, Homo sapiens
tgctgggcatcgtaggaggtac

SEQ ID NO: 7708210 - DNA, 22 bp, Homo sapiens
tgctgggcatcgtaggaggtac

SEQ ID NO: 7708211 - DNA, 22 bp, Homo sapiens
tgctgggcatcgtaggaggtac

SEQ ID NO: 7708212 - DNA, 22 bp, Homo sapiens
tgctgggcatcgtaggaggtac

SEQ ID NO: 7708213 - DNA, 20 bp, Homo sapiens
tgctgggcatgcagtggaaa

SEQ ID NO: 7708214 - DNA, 20 bp, Homo sapiens
tgctgggcatgcagtggaaa

SEQ ID NO: 7708215 - DNA, 20 bp, Homo sapiens
tgctgggcatgcagtggaaa

SEQ ID NO: 7708216 - DNA, 20 bp, Homo sapiens
tgctgggcatgcagtggaaa

SEQ ID NO: 7708217 - DNA, 20 bp, Homo sapiens
tgctgggcatgcagtggaaa

SEQ ID NO: 7708218 - DNA, 20 bp, Homo sapiens
tgctgggcatgcagtggaaa

SEQ ID NO: 7708219 - DNA, 20 bp, Homo sapiens
tgctgggccatcttgcatgc

SEQ ID NO: 7708220 - DNA, 20 bp, Homo sapiens
tgctgggccatcttgcatgc

SEQ ID NO: 7708221 - DNA, 20 bp, Homo sapiens
tgctgggccatcttgcatgc

SEQ ID NO: 7708222 - DNA, 20 bp, Homo sapiens
tgctgggccatcttgcatgc

SEQ ID NO: 7708223 - DNA, 22 bp, Homo sapiens
tgctgggcccagggagcctctg

SEQ ID NO: 7708224 - DNA, 22 bp, Homo sapiens
tgctgggcccagggagcctctg

SEQ ID NO: 7708225 - DNA, 20 bp, Homo sapiens
tgctgggccatcttgcatgc

SEQ ID NO: 7708226 - DNA, 22 bp, Homo sapiens
tgctgggcccccagtgaccttc

SEQ ID NO: 7708227 - DNA, 22 bp, Homo sapiens
tgctgggcccccagtgaccttc

SEQ ID NO: 7708228 - DNA, 22 bp, Homo sapiens
tgctgggcccagggagcctctg

SEQ ID NO: 7708229 - DNA, 22 bp, Homo sapiens
tgctgggcccagggagcctctg

SEQ ID NO: 7708230 - DNA, 22 bp, Homo sapiens
tgctgggcccagggagcctctg

SEQ ID NO: 7708231 - DNA, 22 bp, Homo sapiens
tgctgggcccagggagcctctg

SEQ ID NO: 7708232 - DNA, 22 bp, Homo sapiens
tgctgggcccccagtgaccttc

SEQ ID NO: 7708233 - DNA, 22 bp, Homo sapiens
tgctgggcccagggagcctctg

SEQ ID NO: 7708234 - DNA, 22 bp, Homo sapiens
tgctgggcccccagtgaccttc

SEQ ID NO: 7708235 - DNA, 22 bp, Homo sapiens
tgctgggcccccagtgaccttc

SEQ ID NO: 7708236 - DNA, 22 bp, Homo sapiens
tgctgggcctcttccctggata

SEQ ID NO: 7708237 - DNA, 22 bp, Homo sapiens
tgctgggcctcttccctggata

SEQ ID NO: 7708238 - DNA, 22 bp, Homo sapiens
tgctgggcctgcccctgtcagc

SEQ ID NO: 7708239 - DNA, 22 bp, Homo sapiens
tgctgggcctgcccctgtcagc

SEQ ID NO: 7708240 - DNA, 22 bp, Homo sapiens
tgctgggcctgcccctgtcagc

SEQ ID NO: 7708241 - DNA, 22 bp, Homo sapiens
tgctgggcatttttatggctcc

SEQ ID NO: 7708242 - DNA, 22 bp, Homo sapiens
tgctgggcatttttatggctcc

SEQ ID NO: 7708243 - DNA, 22 bp, Homo sapiens
tgctgggcatttttatggctcc

SEQ ID NO: 7708244 - DNA, 22 bp, Homo sapiens
tgctgggcatttttatggctcc

SEQ ID NO: 7708245 - DNA, 22 bp, Homo sapiens
tgctgggcatttttatggctcc

SEQ ID NO: 7708246 - DNA, 22 bp, Homo sapiens
tgctgggcatttttatggctcc

SEQ ID NO: 7708247 - DNA, 22 bp, Homo sapiens
tgctgggcatttatgcagatgg

SEQ ID NO: 7708248 - DNA, 22 bp, Homo sapiens
tgctgggccaaagcagggtttt

SEQ ID NO: 7708249 - DNA, 22 bp, Homo sapiens
tgctgggccaaagcagggtttt

SEQ ID NO: 7708250 - DNA, 22 bp, Homo sapiens
tgctgggccaaagcagggtttt

SEQ ID NO: 7708251 - DNA, 22 bp, Homo sapiens
tgctgggccaaagcagggtttt

SEQ ID NO: 7708252 - DNA, 22 bp, Homo sapiens
tgctgggccaaagcagggtttt

SEQ ID NO: 7708253 - DNA, 22 bp, Homo sapiens
tgctgggccaaagcagggtttt

SEQ ID NO: 7708254 - DNA, 22 bp, Homo sapiens
tgctgggccaaagcagggtttt

SEQ ID NO: 7708255 - DNA, 18 bp, Homo sapiens
tgctgggcattaggctta

SEQ ID NO: 7708256 - DNA, 18 bp, Homo sapiens
tgctgggcattaggctta

SEQ ID NO: 7708257 - DNA, 20 bp, Homo sapiens
tgctgggcatgcagtggaaa

SEQ ID NO: 7708258 - DNA, 20 bp, Homo sapiens
tgctgggcatgcagtggaaa

SEQ ID NO: 7708259 - DNA, 22 bp, Homo sapiens
tgctgggcatttatgcagatgg

SEQ ID NO: 7708260 - DNA, 22 bp, Homo sapiens
tgctgggcatttatgcagatgg

SEQ ID NO: 7708261 - DNA, 18 bp, Homo sapiens
tgctgggcattaggctta

SEQ ID NO: 7708262 - DNA, 18 bp, Homo sapiens
tgctgggcattaggctta

SEQ ID NO: 7708263 - DNA, 18 bp, Homo sapiens
tgctgggcattaggctta

SEQ ID NO: 7708264 - DNA, 22 bp, Homo sapiens
tgctgggcatttatgcagatgg

SEQ ID NO: 7708265 - DNA, 22 bp, Homo sapiens
tgctgggcatttatgcagatgg

SEQ ID NO: 7708266 - DNA, 22 bp, Homo sapiens
tgctgggcatttatgcagatgg

SEQ ID NO: 7708267 - DNA, 22 bp, Homo sapiens
tgctgggcatttatgcagatgg

SEQ ID NO: 7708268 - DNA, 22 bp, Homo sapiens
tgctgggctagaagctgaggcc

SEQ ID NO: 7708269 - DNA, 22 bp, Homo sapiens
tgctgggctagaagctgaggcc

SEQ ID NO: 7708270 - DNA, 22 bp, Homo sapiens
tgctgggctagaagctgaggcc

SEQ ID NO: 7708271 - DNA, 22 bp, Homo sapiens
tgctgggctagaagctgaggcc

SEQ ID NO: 7708272 - DNA, 22 bp, Homo sapiens
tgctgggctagaagctgaggcc

SEQ ID NO: 7708273 - DNA, 22 bp, Homo sapiens
tgctgggctagaagctgaggcc

SEQ ID NO: 7708274 - DNA, 22 bp, Homo sapiens
tgctgggctagaagctgaggcc

SEQ ID NO: 7708275 - DNA, 22 bp, Homo sapiens
tgctgggctagaagctgaggcc

SEQ ID NO: 7708276 - DNA, 22 bp, Homo sapiens
tgctgggctagaagctgaggcc

SEQ ID NO: 7708277 - DNA, 22 bp, Homo sapiens
tgctgggcctttacctccaggg

SEQ ID NO: 7708278 - DNA, 22 bp, Homo sapiens
tgctgggcctttacctccaggg

SEQ ID NO: 7708279 - DNA, 22 bp, Homo sapiens
tgctgggcctttacctccaggg

SEQ ID NO: 7708280 - DNA, 22 bp, Homo sapiens
tgctgggcctgcccctgtcagc

SEQ ID NO: 7708281 - DNA, 22 bp, Homo sapiens
tgctgggcctttacctccaggg

SEQ ID NO: 7708282 - DNA, 22 bp, Homo sapiens
tgctgggcctttacctccaggg

SEQ ID NO: 7708283 - DNA, 22 bp, Homo sapiens
tgctgggcggtgggctcatccc

SEQ ID NO: 7708284 - DNA, 22 bp, Homo sapiens
tgctgggcggtgggctcatccc

SEQ ID NO: 7708285 - DNA, 22 bp, Homo sapiens
tgctgggcggtgggctcatccc

SEQ ID NO: 7708286 - DNA, 22 bp, Homo sapiens
tgctgggcggtgggctcatccc

SEQ ID NO: 7708287 - DNA, 22 bp, Homo sapiens
tgctgggctagggtggagctct

SEQ ID NO: 7708288 - DNA, 22 bp, Homo sapiens
tgctgggctagggtggagctct

SEQ ID NO: 7708289 - DNA, 22 bp, Homo sapiens
tgctgggctagggtggagctct

SEQ ID NO: 7708290 - DNA, 22 bp, Homo sapiens
tgctgggctagggtggagctct

SEQ ID NO: 7708291 - DNA, 22 bp, Homo sapiens
tgctgggctagggtggagctct

SEQ ID NO: 7708292 - DNA, 22 bp, Homo sapiens
tgctgggctagaagctgaggcc

SEQ ID NO: 7708293 - DNA, 22 bp, Homo sapiens
tgctgggctagaagctgaggcc

SEQ ID NO: 7708294 - DNA, 22 bp, Homo sapiens
tgctgggctagaagctgaggcc

SEQ ID NO: 7708295 - DNA, 22 bp, Homo sapiens
tgctgggctagaagctgaggcc

SEQ ID NO: 7708296 - DNA, 22 bp, Homo sapiens
tgctgggctcaacctccagagc

SEQ ID NO: 7708297 - DNA, 22 bp, Homo sapiens
tgctgggctcaacctccagagc

SEQ ID NO: 7708298 - DNA, 22 bp, Homo sapiens
tgctgggctcaacctccagagc

SEQ ID NO: 7708299 - DNA, 22 bp, Homo sapiens
tgctgggctgcacccccagagt

SEQ ID NO: 7708300 - DNA, 22 bp, Homo sapiens
tgctgggctgcacccccagagt

SEQ ID NO: 7708301 - DNA, 22 bp, Homo sapiens
tgctgggctgcacccccagagt

SEQ ID NO: 7708302 - DNA, 22 bp, Homo sapiens
tgctgggctagggtggagctct

SEQ ID NO: 7708303 - DNA, 22 bp, Homo sapiens
tgctgggctagggtggagctct

SEQ ID NO: 7708304 - DNA, 22 bp, Homo sapiens
tgctgggctgttcctgtccatg

SEQ ID NO: 7708305 - DNA, 22 bp, Homo sapiens
tgctgggctgttcctgtccatg

SEQ ID NO: 7708306 - DNA, 22 bp, Homo sapiens
tgctgggctgttcctgtccatg

SEQ ID NO: 7708307 - DNA, 22 bp, Homo sapiens
tgctgggcttcaactgcctgag

SEQ ID NO: 7708308 - DNA, 22 bp, Homo sapiens
tgctgggcttcaactgcctgag

SEQ ID NO: 7708309 - DNA, 22 bp, Homo sapiens
tgctgggcttcaactgcctgag

SEQ ID NO: 7708310 - DNA, 22 bp, Homo sapiens
tgctgggcttcaactgcctgag

SEQ ID NO: 7708311 - DNA, 22 bp, Homo sapiens
tgctgggcttcaactgcctgag

SEQ ID NO: 7708312 - DNA, 22 bp, Homo sapiens
tgctgggcttcaactgcctgag

SEQ ID NO: 7708313 - DNA, 22 bp, Homo sapiens
tgctgggcttcacccccacagt

SEQ ID NO: 7708314 - DNA, 22 bp, Homo sapiens
tgctgggcttcacccccacagt

SEQ ID NO: 7708315 - DNA, 22 bp, Homo sapiens
tgctgggcttgaaagctgctaa

SEQ ID NO: 7708316 - DNA, 22 bp, Homo sapiens
tgctgggcttgaaagctgctaa

SEQ ID NO: 7708317 - DNA, 22 bp, Homo sapiens
tgctgggcttgaaagctgctaa

SEQ ID NO: 7708318 - DNA, 22 bp, Homo sapiens
tgctgggcttgaaagctgctaa

SEQ ID NO: 7708319 - DNA, 22 bp, Homo sapiens
tgctgggcttgaaagctgctaa

SEQ ID NO: 7708320 - DNA, 22 bp, Homo sapiens
tgctgggcttgaaagctgctaa

SEQ ID NO: 7708321 - DNA, 22 bp, Homo sapiens
tgctgggcttgaaagctgctaa

SEQ ID NO: 7708322 - DNA, 21 bp, Homo sapiens
tgctgggctgcaggggatgca

SEQ ID NO: 7708323 - DNA, 21 bp, Homo sapiens
tgctgggctgcaggggatgca

SEQ ID NO: 7708324 - DNA, 21 bp, Homo sapiens
tgctgggctgcaggggatgca

SEQ ID NO: 7708325 - DNA, 22 bp, Homo sapiens
tgctgggctgcacccccagagt

SEQ ID NO: 7708326 - DNA, 22 bp, Homo sapiens
tgctgggctggagctgccaggg

SEQ ID NO: 7708327 - DNA, 22 bp, Homo sapiens
tgctgggctggagctgccaggg

SEQ ID NO: 7708328 - DNA, 22 bp, Homo sapiens
tgctgggctggagctgccaggg

SEQ ID NO: 7708329 - DNA, 22 bp, Homo sapiens
tgctgggctggagctgccaggg

SEQ ID NO: 7708330 - DNA, 21 bp, Homo sapiens
tgctgggctgcaggggatgca

SEQ ID NO: 7708331 - DNA, 22 bp, Homo sapiens
tgctgggctggagctgccaggg

SEQ ID NO: 7708332 - DNA, 21 bp, Homo sapiens
tgctgggctgcaggggatgca

SEQ ID NO: 7708333 - DNA, 22 bp, Homo sapiens
tgctgggctggggcctcagacc

SEQ ID NO: 7708334 - DNA, 22 bp, Homo sapiens
tgctgggctggagctgccaggg

SEQ ID NO: 7708335 - DNA, 22 bp, Homo sapiens
tgctgggctggagctgccaggg

SEQ ID NO: 7708336 - DNA, 22 bp, Homo sapiens
tgctgggctgttcctgtccatg

SEQ ID NO: 7708337 - DNA, 22 bp, Homo sapiens
tgctgggctgttcctgtccatg

SEQ ID NO: 7708338 - DNA, 22 bp, Homo sapiens
tgctgggctgttcctgtccatg

SEQ ID NO: 7708339 - DNA, 22 bp, Homo sapiens
tgctgggctgttcctgtccatg

SEQ ID NO: 7708340 - DNA, 22 bp, Homo sapiens
tgctgggctggggcctcagacc

SEQ ID NO: 7708341 - DNA, 22 bp, Homo sapiens
tgcttaaacacatacatacata

SEQ ID NO: 7708342 - DNA, 22 bp, Homo sapiens
tgcttaaacacatacatacata

SEQ ID NO: 7708343 - DNA, 22 bp, Homo sapiens
tgcttaaaattttccaaggatt

SEQ ID NO: 7708344 - DNA, 22 bp, Homo sapiens
tgcttaaacacatacatacata

SEQ ID NO: 7708345 - DNA, 22 bp, Homo sapiens
tgcttaaaattttccaaggatt

SEQ ID NO: 7708346 - DNA, 22 bp, Homo sapiens
tgcttaaacacatacatacata

SEQ ID NO: 7708347 - DNA, 22 bp, Homo sapiens
tgcttaaacacatacatacata

SEQ ID NO: 7708348 - DNA, 22 bp, Homo sapiens
tgcttaaacacatacatacata

SEQ ID NO: 7708349 - DNA, 22 bp, Homo sapiens
tgcttaaacatactatttatat

SEQ ID NO: 7708350 - DNA, 22 bp, Homo sapiens
tgcttaaacatactatttatat

SEQ ID NO: 7708351 - DNA, 22 bp, Homo sapiens
tgcttaaacatccagacagtat

SEQ ID NO: 7708352 - DNA, 22 bp, Homo sapiens
tgcttaaacatccagacagtat

SEQ ID NO: 7708353 - DNA, 22 bp, Homo sapiens
tgcttaaaccctgatcatgtgt

SEQ ID NO: 7708354 - DNA, 22 bp, Homo sapiens
tgcttaaaccctgatcatgtgt

SEQ ID NO: 7708355 - DNA, 22 bp, Homo sapiens
tgcttaaaccctgatcatgtgt

SEQ ID NO: 7708356 - DNA, 22 bp, Homo sapiens
tgcttaaacatccagacagtat

SEQ ID NO: 7708357 - DNA, 22 bp, Homo sapiens
tgcttaaagctgctcagttgta

SEQ ID NO: 7708358 - DNA, 22 bp, Homo sapiens
tgcttaaaccctgatcatgtgt

SEQ ID NO: 7708359 - DNA, 22 bp, Homo sapiens
tgcttaaaccctgatcatgtgt

SEQ ID NO: 7708360 - DNA, 22 bp, Homo sapiens
tgcttaaaggatagtttaaact

SEQ ID NO: 7708361 - DNA, 22 bp, Homo sapiens
tgcttaaagtagtggattgtta

SEQ ID NO: 7708362 - DNA, 22 bp, Homo sapiens
tgcttaaaggatagtttaaact

SEQ ID NO: 7708363 - DNA, 22 bp, Homo sapiens
tgcttaaaggatagtttaaact

SEQ ID NO: 7708364 - DNA, 22 bp, Homo sapiens
tgcttaataggagttgaacatt

SEQ ID NO: 7708365 - DNA, 22 bp, Homo sapiens
tgcttaataggagttgaacatt

SEQ ID NO: 7708366 - DNA, 22 bp, Homo sapiens
tgcttaatattgtgatgtaata

SEQ ID NO: 7708367 - DNA, 22 bp, Homo sapiens
tgcttaaatttcagcagcttaa

SEQ ID NO: 7708368 - DNA, 22 bp, Homo sapiens
tgcttaatccaacctggctgac

SEQ ID NO: 7708369 - DNA, 22 bp, Homo sapiens
tgcttaatattgtgatgtaata

SEQ ID NO: 7708370 - DNA, 22 bp, Homo sapiens
tgcttaatcaagaagcctattt

SEQ ID NO: 7708371 - DNA, 19 bp, Homo sapiens
tgcttaattcctagtaggt

SEQ ID NO: 7708372 - DNA, 22 bp, Homo sapiens
tgcttaatgtacgtgagtgtac

SEQ ID NO: 7708373 - DNA, 22 bp, Homo sapiens
tgcttacaactttattgaggaa

SEQ ID NO: 7708374 - DNA, 22 bp, Homo sapiens
tgcttacaactttattgaggaa

SEQ ID NO: 7708375 - DNA, 22 bp, Homo sapiens
tgcttaggatgctagcaggcat

SEQ ID NO: 7708376 - DNA, 22 bp, Homo sapiens
tgcttaggctaacaaaaatagc

SEQ ID NO: 7708377 - DNA, 22 bp, Homo sapiens
tgcttagggctcctccaataga

SEQ ID NO: 7708378 - DNA, 22 bp, Homo sapiens
tgcttaggtgttatgtaatatc

SEQ ID NO: 7708379 - DNA, 22 bp, Homo sapiens
tgcttaggttggtctagaccat

SEQ ID NO: 7708380 - DNA, 22 bp, Homo sapiens
tgcttattaaacatgcatattc

SEQ ID NO: 7708381 - DNA, 22 bp, Homo sapiens
tgcttattaaacatgcatattc

SEQ ID NO: 7708382 - DNA, 22 bp, Homo sapiens
tgcttattaaacatgcatattc

SEQ ID NO: 7708383 - DNA, 22 bp, Homo sapiens
tgcttatcgtttagtacattgc

SEQ ID NO: 7708384 - DNA, 22 bp, Homo sapiens
tgcttataatgttactgacaac

SEQ ID NO: 7708385 - DNA, 22 bp, Homo sapiens
tgcttagaatctggacttgttg

SEQ ID NO: 7708386 - DNA, 18 bp, Homo sapiens
tgcttacaggagttcctg

SEQ ID NO: 7708387 - DNA, 22 bp, Homo sapiens
tgcttacattgcatctgtgcct

SEQ ID NO: 7708388 - DNA, 22 bp, Homo sapiens
tgcttacaactttattgaggaa

SEQ ID NO: 7708389 - DNA, 18 bp, Homo sapiens
tgcttacaggagttcctg

SEQ ID NO: 7708390 - DNA, 22 bp, Homo sapiens
tgcttacattgcatctgtgcct

SEQ ID NO: 7708391 - DNA, 22 bp, Homo sapiens
tgctgtcctgttttggagtaat

SEQ ID NO: 7708392 - DNA, 22 bp, Homo sapiens
tgctgtcctgttttggagtaat

SEQ ID NO: 7708393 - DNA, 22 bp, Homo sapiens
tgctgtcctgctgagggatgtg

SEQ ID NO: 7708394 - DNA, 22 bp, Homo sapiens
tgctgtcctgttttggagtaat

SEQ ID NO: 7708395 - DNA, 22 bp, Homo sapiens
tgctgtcctgttttggagtaat

SEQ ID NO: 7708396 - DNA, 22 bp, Homo sapiens
tgctgtctgattcagggtgatt

SEQ ID NO: 7708397 - DNA, 22 bp, Homo sapiens
tgctgtctgcaacagtactaca

SEQ ID NO: 7708398 - DNA, 22 bp, Homo sapiens
tgctgtctgcaacagtactaca

SEQ ID NO: 7708399 - DNA, 17 bp, Homo sapiens
tgctgtctgcttcccta

SEQ ID NO: 7708400 - DNA, 17 bp, Homo sapiens
tgctgtctgcttcccta

SEQ ID NO: 7708401 - DNA, 22 bp, Homo sapiens
tgctgtcccccgtgtctgggct

SEQ ID NO: 7708402 - DNA, 21 bp, Homo sapiens
tgctgtcctagaaccagggcc

SEQ ID NO: 7708403 - DNA, 22 bp, Homo sapiens
tgctgtcctgctgagggatgtg

SEQ ID NO: 7708404 - DNA, 22 bp, Homo sapiens
tgctgtcctgctgagggatgtg

SEQ ID NO: 7708405 - DNA, 22 bp, Homo sapiens
tgctgtcctgctgagggatgtg

SEQ ID NO: 7708406 - DNA, 22 bp, Homo sapiens
tgctgtcctgctgagggatgtg

SEQ ID NO: 7708407 - DNA, 19 bp, Homo sapiens
tgctgtcctcagagtaagt

SEQ ID NO: 7708408 - DNA, 21 bp, Homo sapiens
tgctgtcctagaaccagggcc

SEQ ID NO: 7708409 - DNA, 21 bp, Homo sapiens
tgctgtcctagaaccagggcc

SEQ ID NO: 7708410 - DNA, 19 bp, Homo sapiens
tgctgtcctcagagtaagt

SEQ ID NO: 7708411 - DNA, 22 bp, Homo sapiens
tgctgtctttcattgtctgcct

SEQ ID NO: 7708412 - DNA, 22 bp, Homo sapiens
tgctgtcttctctgaggtccct

SEQ ID NO: 7708413 - DNA, 22 bp, Homo sapiens
tgctgtctttcattgtctgcct

SEQ ID NO: 7708414 - DNA, 22 bp, Homo sapiens
tgctgtcttctctgaggtccct

SEQ ID NO: 7708415 - DNA, 22 bp, Homo sapiens
tgctgtcttctctgaggtccct

SEQ ID NO: 7708416 - DNA, 22 bp, Homo sapiens
tgctgtcttccaggatggtgaa

SEQ ID NO: 7708417 - DNA, 22 bp, Homo sapiens
tgctgtcttctctgaggtccct

SEQ ID NO: 7708418 - DNA, 22 bp, Homo sapiens
tgctgtcttccaggatggtgaa

SEQ ID NO: 7708419 - DNA, 17 bp, Homo sapiens
tgctgtctgcttcccta

SEQ ID NO: 7708420 - DNA, 17 bp, Homo sapiens
tgctgtctgcttcccta

SEQ ID NO: 7708421 - DNA, 22 bp, Homo sapiens
tgctgtctgtttactggctata

SEQ ID NO: 7708422 - DNA, 22 bp, Homo sapiens
tgctgtctgtttactggctata

SEQ ID NO: 7708423 - DNA, 22 bp, Homo sapiens
tgctgtgacccaaaaaagacct

SEQ ID NO: 7708424 - DNA, 22 bp, Homo sapiens
tgctgtctttttcccttcctaa

SEQ ID NO: 7708425 - DNA, 22 bp, Homo sapiens
tgctgtctttttcccttcctaa

SEQ ID NO: 7708426 - DNA, 22 bp, Homo sapiens
tgctgtctttttcccttcctaa

SEQ ID NO: 7708427 - DNA, 22 bp, Homo sapiens
tgctgtcttttcccaatcctgg

SEQ ID NO: 7708428 - DNA, 22 bp, Homo sapiens
tgctgtcttttcccaatcctgg

SEQ ID NO: 7708429 - DNA, 22 bp, Homo sapiens
tgctgtcttttcccaatcctgg

SEQ ID NO: 7708430 - DNA, 22 bp, Homo sapiens
tgctgtcttttcccaatcctgg

SEQ ID NO: 7708431 - DNA, 22 bp, Homo sapiens
tgcttaaaatgatgattatttt

SEQ ID NO: 7708432 - DNA, 22 bp, Homo sapiens
tgcttaaaatgatgattatttt

SEQ ID NO: 7708433 - DNA, 22 bp, Homo sapiens
tgcttaaaatagttcatttttg

SEQ ID NO: 7708434 - DNA, 22 bp, Homo sapiens
tgcttaaaatagttcatttttg

SEQ ID NO: 7708435 - DNA, 22 bp, Homo sapiens
tgcttaaaaagctccatcaata

SEQ ID NO: 7708436 - DNA, 22 bp, Homo sapiens
tgcttaaaaagtaactgctgat

SEQ ID NO: 7708437 - DNA, 22 bp, Homo sapiens
tgcttaaaaagctccatcaata

SEQ ID NO: 7708438 - DNA, 22 bp, Homo sapiens
tgcttaaaaagctccatcaata

SEQ ID NO: 7708439 - DNA, 23 bp, Homo sapiens
tgctgtgcctttgtctgcctcca

SEQ ID NO: 7708440 - DNA, 23 bp, Homo sapiens
tgctgtgcctttgtctgcctcca

SEQ ID NO: 7708441 - DNA, 22 bp, Homo sapiens
tgcttaaaaacagtatggtagt

SEQ ID NO: 7708442 - DNA, 22 bp, Homo sapiens
tgcttaaaaacagtatggtagt

SEQ ID NO: 7708443 - DNA, 18 bp, Homo sapiens
tgctgtgcacagccctat

SEQ ID NO: 7708444 - DNA, 23 bp, Homo sapiens
tgctgtgcctttgtctgcctcca

SEQ ID NO: 7708445 - DNA, 22 bp, Homo sapiens
tgctgtgaggttgagaaggaag

SEQ ID NO: 7708446 - DNA, 22 bp, Homo sapiens
tgctgtgaggttgagaaggaag

SEQ ID NO: 7708447 - DNA, 22 bp, Homo sapiens
tgctgtgaggttgagaaggaag

SEQ ID NO: 7708448 - DNA, 22 bp, Homo sapiens
tgctgtgaggttgagaaggaag

SEQ ID NO: 7708449 - DNA, 22 bp, Homo sapiens
tgctgtgaggttgagaaggaag

SEQ ID NO: 7708450 - DNA, 22 bp, Homo sapiens
tgctgtgaggttgagaaggaag

SEQ ID NO: 7708451 - DNA, 22 bp, Homo sapiens
tgctgtgacgcctcaggaatcc

SEQ ID NO: 7708452 - DNA, 22 bp, Homo sapiens
tgctgtgaggttgagaaggaag

SEQ ID NO: 7708453 - DNA, 22 bp, Homo sapiens
tgctgtgaggttgagaaggaag

SEQ ID NO: 7708454 - DNA, 22 bp, Homo sapiens
tgctgtgaggttgagaaggaag

SEQ ID NO: 7708455 - DNA, 22 bp, Homo sapiens
tgctgtgcaaaggtgatgtgag

SEQ ID NO: 7708456 - DNA, 22 bp, Homo sapiens
tgctgtgcatcatagtgtttgg

SEQ ID NO: 7708457 - DNA, 18 bp, Homo sapiens
tgctgtgcacagccctat

SEQ ID NO: 7708458 - DNA, 22 bp, Homo sapiens
tgctgtgcaaaggtgatgtgag

SEQ ID NO: 7708459 - DNA, 22 bp, Homo sapiens
tgctgtgatggagaattctgga

SEQ ID NO: 7708460 - DNA, 22 bp, Homo sapiens
tgctgtgaggttgagaaggaag

SEQ ID NO: 7708461 - DNA, 22 bp, Homo sapiens
tgcttccctcacttcacctggc

SEQ ID NO: 7708462 - DNA, 22 bp, Homo sapiens
tgcttcccaaggtttcatgtgc

SEQ ID NO: 7708463 - DNA, 22 bp, Homo sapiens
tgcttccctcacttcacctggc

SEQ ID NO: 7708464 - DNA, 22 bp, Homo sapiens
tgcttccctgaaggcacaggag

SEQ ID NO: 7708465 - DNA, 22 bp, Homo sapiens
tgcttccctgctctgcacacct

SEQ ID NO: 7708466 - DNA, 22 bp, Homo sapiens
tgcttccctgctctgcacacct

SEQ ID NO: 7708467 - DNA, 22 bp, Homo sapiens
tgcttctaatctactgcattag

SEQ ID NO: 7708468 - DNA, 22 bp, Homo sapiens
tgcttctccattgatgctaagt

SEQ ID NO: 7708469 - DNA, 22 bp, Homo sapiens
tgcttctcaaagaagcataatg

SEQ ID NO: 7708470 - DNA, 22 bp, Homo sapiens
tgcttctcagcctgtctggaaa

SEQ ID NO: 7708471 - DNA, 22 bp, Homo sapiens
tgcttctagacactgcaattga

SEQ ID NO: 7708472 - DNA, 22 bp, Homo sapiens
tgcttctcaaaaggaggtaggt

SEQ ID NO: 7708473 - DNA, 22 bp, Homo sapiens
tgcttctcaaagaagcataatg

SEQ ID NO: 7708474 - DNA, 22 bp, Homo sapiens
tgcttctgaaatgcaggtcttc

SEQ ID NO: 7708475 - DNA, 22 bp, Homo sapiens
tgcttctgaaatgcaggtcttc

SEQ ID NO: 7708476 - DNA, 22 bp, Homo sapiens
tgcttctgaaatgcaggtcttc

SEQ ID NO: 7708477 - DNA, 22 bp, Homo sapiens
tgcttctgaaatgcaggtcttc

SEQ ID NO: 7708478 - DNA, 23 bp, Homo sapiens
tgcttctctgcttgacagttctg

SEQ ID NO: 7708479 - DNA, 23 bp, Homo sapiens
tgcttctctgcttgacagttctg

SEQ ID NO: 7708480 - DNA, 22 bp, Homo sapiens
tgcttctctgttctaacccttg

SEQ ID NO: 7708481 - DNA, 22 bp, Homo sapiens
tgcttctctttatttgtaggtt

SEQ ID NO: 7708482 - DNA, 22 bp, Homo sapiens
tgcttctcccaaccagggcctg

SEQ ID NO: 7708483 - DNA, 21 bp, Homo sapiens
tgcttctctagatcaactact

SEQ ID NO: 7708484 - DNA, 22 bp, Homo sapiens
tgcttctcccaaccagggcctg

SEQ ID NO: 7708485 - DNA, 22 bp, Homo sapiens
tgcttctccattgatgctaagt

SEQ ID NO: 7708486 - DNA, 22 bp, Homo sapiens
tgcttctctctaggaagacgct

SEQ ID NO: 7708487 - DNA, 23 bp, Homo sapiens
tgcttctctgcttgacagttctg

SEQ ID NO: 7708488 - DNA, 21 bp, Homo sapiens
tgcttctctagatcaactact

SEQ ID NO: 7708489 - DNA, 22 bp, Homo sapiens
tgcttctgacatgttcttggtt

SEQ ID NO: 7708490 - DNA, 22 bp, Homo sapiens
tgcttctgaagtggatgggtgc

SEQ ID NO: 7708491 - DNA, 22 bp, Homo sapiens
tgcttctgacatgttcttggtt

SEQ ID NO: 7708492 - DNA, 22 bp, Homo sapiens
tgcttctgaactcagcatgtgg

SEQ ID NO: 7708493 - DNA, 22 bp, Homo sapiens
tgcttctgaactcagcatgtgg

SEQ ID NO: 7708494 - DNA, 22 bp, Homo sapiens
tgcttctgaactcagcatgtgg

SEQ ID NO: 7708495 - DNA, 22 bp, Homo sapiens
tgcttctgactgggtcagttga

SEQ ID NO: 7708496 - DNA, 22 bp, Homo sapiens
tgcttctgactgggtcagttga

SEQ ID NO: 7708497 - DNA, 22 bp, Homo sapiens
tgcttctgactgggtcagttga

SEQ ID NO: 7708498 - DNA, 22 bp, Homo sapiens
tgcttctgagttgcaggacttg

SEQ ID NO: 7708499 - DNA, 22 bp, Homo sapiens
tgcttctgagttgcaggacttg

SEQ ID NO: 7708500 - DNA, 22 bp, Homo sapiens
tgcttctgactaagctgcatga

SEQ ID NO: 7708501 - DNA, 22 bp, Homo sapiens
tgcttctgactaagctgcatga

SEQ ID NO: 7708502 - DNA, 22 bp, Homo sapiens
tgcttctgactaagctgcatga

SEQ ID NO: 7708503 - DNA, 22 bp, Homo sapiens
tgcttctgactaagctgcatga

SEQ ID NO: 7708504 - DNA, 22 bp, Homo sapiens
tgcttctgcaggagctcctgat

SEQ ID NO: 7708505 - DNA, 22 bp, Homo sapiens
tgcttctgatgtgagcagcccc

SEQ ID NO: 7708506 - DNA, 22 bp, Homo sapiens
tgcttctgagttgcaggacttg

SEQ ID NO: 7708507 - DNA, 22 bp, Homo sapiens
tgcttctgatgtgagcagcccc

SEQ ID NO: 7708508 - DNA, 22 bp, Homo sapiens
tgcttctgagttgcaggacttg

SEQ ID NO: 7708509 - DNA, 22 bp, Homo sapiens
tgcttctgagttgcaggacttg

SEQ ID NO: 7708510 - DNA, 22 bp, Homo sapiens
tgcttctgatgtgagcagcccc

SEQ ID NO: 7708511 - DNA, 22 bp, Homo sapiens
tgcttctgatgtgagcagcccc

SEQ ID NO: 7708512 - DNA, 22 bp, Homo sapiens
tgcttctgatgtgagcagcccc

SEQ ID NO: 7708513 - DNA, 22 bp, Homo sapiens
tgcttctgctcagcttcctact

SEQ ID NO: 7708514 - DNA, 22 bp, Homo sapiens
tgcttctgctcagcttcctact

SEQ ID NO: 7708515 - DNA, 22 bp, Homo sapiens
tgcttctgcaggagctcctgat

SEQ ID NO: 7708516 - DNA, 22 bp, Homo sapiens
tgcttctgcaggagctcctgat

SEQ ID NO: 7708517 - DNA, 22 bp, Homo sapiens
tgcttctgcaggagctcctgat

SEQ ID NO: 7708518 - DNA, 22 bp, Homo sapiens
tgcttctgcaggagctcctgat

SEQ ID NO: 7708519 - DNA, 22 bp, Homo sapiens
tgcttcagagacatcctactca

SEQ ID NO: 7708520 - DNA, 22 bp, Homo sapiens
tgcttcagagacatcctactca

SEQ ID NO: 7708521 - DNA, 22 bp, Homo sapiens
tgcttcagaggaaaggcaaaag

SEQ ID NO: 7708522 - DNA, 22 bp, Homo sapiens
tgcttcagagaagaatggaaag

SEQ ID NO: 7708523 - DNA, 22 bp, Homo sapiens
tgcttcagagaagaatggaaag

SEQ ID NO: 7708524 - DNA, 22 bp, Homo sapiens
tgcttcagcactttgagagcct

SEQ ID NO: 7708525 - DNA, 22 bp, Homo sapiens
tgcttcagcactttgagagcct

SEQ ID NO: 7708526 - DNA, 22 bp, Homo sapiens
tgcttcaaggacactgactttt

SEQ ID NO: 7708527 - DNA, 22 bp, Homo sapiens
tgcttcaagttgaaatattctt

SEQ ID NO: 7708528 - DNA, 22 bp, Homo sapiens
tgcttcaaggccatgtcaagct

SEQ ID NO: 7708529 - DNA, 22 bp, Homo sapiens
tgcttcaaggccatgtcaagct

SEQ ID NO: 7708530 - DNA, 22 bp, Homo sapiens
tgcttcaaggccatgtcaagct

SEQ ID NO: 7708531 - DNA, 22 bp, Homo sapiens
tgcttcacaagaattcaggacc

SEQ ID NO: 7708532 - DNA, 19 bp, Homo sapiens
tgcttcagaaatagaaagc

SEQ ID NO: 7708533 - DNA, 22 bp, Homo sapiens
tgcttcacaagaattcaggacc

SEQ ID NO: 7708534 - DNA, 22 bp, Homo sapiens
tgcttcaagttgaaatattctt

SEQ ID NO: 7708535 - DNA, 22 bp, Homo sapiens
tgcttatttaggtagatattaa

SEQ ID NO: 7708536 - DNA, 22 bp, Homo sapiens
tgcttatttaggtagatattaa

SEQ ID NO: 7708537 - DNA, 22 bp, Homo sapiens
tgcttattgctttcaagactgt

SEQ ID NO: 7708538 - DNA, 22 bp, Homo sapiens
tgcttatttatagtcaatagag

SEQ ID NO: 7708539 - DNA, 22 bp, Homo sapiens
tgcttatttatagtcaatagag

SEQ ID NO: 7708540 - DNA, 22 bp, Homo sapiens
tgcttatttgaatttattctca

SEQ ID NO: 7708541 - DNA, 22 bp, Homo sapiens
tgcttatttgaatttattctca

SEQ ID NO: 7708542 - DNA, 22 bp, Homo sapiens
tgcttatttgaatttattctca

SEQ ID NO: 7708543 - DNA, 22 bp, Homo sapiens
tgcttcaaaaagttgttagagg

SEQ ID NO: 7708544 - DNA, 22 bp, Homo sapiens
tgcttcaaggacactgactttt

SEQ ID NO: 7708545 - DNA, 22 bp, Homo sapiens
tgcttcaaaaggcagcttaatg

SEQ ID NO: 7708546 - DNA, 22 bp, Homo sapiens
tgcttattctttccacaattca

SEQ ID NO: 7708547 - DNA, 22 bp, Homo sapiens
tgcttattctttccacaattca

SEQ ID NO: 7708548 - DNA, 22 bp, Homo sapiens
tgcttattgctttcaagactgt

SEQ ID NO: 7708549 - DNA, 22 bp, Homo sapiens
tgcttattgctttcaagactgt

SEQ ID NO: 7708550 - DNA, 22 bp, Homo sapiens
tgcttattgctttcaagactgt

SEQ ID NO: 7708551 - DNA, 22 bp, Homo sapiens
tgcttattaacatgtatatctc

SEQ ID NO: 7708552 - DNA, 23 bp, Homo sapiens
tgcttattcaaaaggtgctttca

SEQ ID NO: 7708553 - DNA, 22 bp, Homo sapiens
tgcttattaaacatgcatattc

SEQ ID NO: 7708554 - DNA, 22 bp, Homo sapiens
tgcttcattaaaacaatatttt

SEQ ID NO: 7708555 - DNA, 22 bp, Homo sapiens
tgcttcattaaaacaatatttt

SEQ ID NO: 7708556 - DNA, 22 bp, Homo sapiens
tgcttcattaaaacaatatttt

SEQ ID NO: 7708557 - DNA, 22 bp, Homo sapiens
tgcttcattaaaacaatatttt

SEQ ID NO: 7708558 - DNA, 22 bp, Homo sapiens
tgcttcattaaaacaatatttt

SEQ ID NO: 7708559 - DNA, 20 bp, Homo sapiens
tgcttcattatgtgagatag

SEQ ID NO: 7708560 - DNA, 19 bp, Homo sapiens
tgcttcatttcttttatgt

SEQ ID NO: 7708561 - DNA, 22 bp, Homo sapiens
tgcttcatttccttatattgta

SEQ ID NO: 7708562 - DNA, 22 bp, Homo sapiens
tgcttcatttccttatattgta

SEQ ID NO: 7708563 - DNA, 22 bp, Homo sapiens
tgcttcatttccttatattgta

SEQ ID NO: 7708564 - DNA, 19 bp, Homo sapiens
tgcttcatttcttttatgt

SEQ ID NO: 7708565 - DNA, 22 bp, Homo sapiens
tgcttccagccttcccaatgct

SEQ ID NO: 7708566 - DNA, 22 bp, Homo sapiens
tgcttccaggaatccatctggc

SEQ ID NO: 7708567 - DNA, 22 bp, Homo sapiens
tgcttccagttcctcaccacat

SEQ ID NO: 7708568 - DNA, 22 bp, Homo sapiens
tgcttccagcatccctggcctg

SEQ ID NO: 7708569 - DNA, 22 bp, Homo sapiens
tgcttccagcatccctggcctg

SEQ ID NO: 7708570 - DNA, 22 bp, Homo sapiens
tgcttccactaatgagctgtgt

SEQ ID NO: 7708571 - DNA, 22 bp, Homo sapiens
tgcttccactaatgagctgtgt

SEQ ID NO: 7708572 - DNA, 22 bp, Homo sapiens
tgcttcagtgctctgagcctgt

SEQ ID NO: 7708573 - DNA, 22 bp, Homo sapiens
tgcttcagtcctatgggcaggt

SEQ ID NO: 7708574 - DNA, 22 bp, Homo sapiens
tgcttcagtgctctgagcctgt

SEQ ID NO: 7708575 - DNA, 22 bp, Homo sapiens
tgcttcagtgctctgagcctgt

SEQ ID NO: 7708576 - DNA, 22 bp, Homo sapiens
tgcttcagtcctatgggcaggt

SEQ ID NO: 7708577 - DNA, 22 bp, Homo sapiens
tgcttcagtcctatgggcaggt

SEQ ID NO: 7708578 - DNA, 22 bp, Homo sapiens
tgcttcaggagatgtcaccatg

SEQ ID NO: 7708579 - DNA, 22 bp, Homo sapiens
tgcttcagcactttgagagcct

SEQ ID NO: 7708580 - DNA, 22 bp, Homo sapiens
tgcttcagcagggatcgggggg

SEQ ID NO: 7708581 - DNA, 22 bp, Homo sapiens
tgcttcagcactttgagagcct

SEQ ID NO: 7708582 - DNA, 22 bp, Homo sapiens
tgcttcagcactttgagagcct

SEQ ID NO: 7708583 - DNA, 22 bp, Homo sapiens
tgcttcagtgtgtcattattta

SEQ ID NO: 7708584 - DNA, 17 bp, Homo sapiens
tgcttcatcccgatcct

SEQ ID NO: 7708585 - DNA, 22 bp, Homo sapiens
tgcttcagtgtgtcattattta

SEQ ID NO: 7708586 - DNA, 17 bp, Homo sapiens
tgcttcatcccgatcct

SEQ ID NO: 7708587 - DNA, 22 bp, Homo sapiens
tgcttcatgaggctgagagaag

SEQ ID NO: 7708588 - DNA, 22 bp, Homo sapiens
tgcttcatgcttctgacaatag

SEQ ID NO: 7708589 - DNA, 22 bp, Homo sapiens
tgcttcatgcttctgacaatag

SEQ ID NO: 7708590 - DNA, 22 bp, Homo sapiens
tgctgctgtttcctacatctca

SEQ ID NO: 7708591 - DNA, 22 bp, Homo sapiens
tgctgctgtttcctacatctca

SEQ ID NO: 7708592 - DNA, 22 bp, Homo sapiens
tgctgctgttgacggctgtcca

SEQ ID NO: 7708593 - DNA, 19 bp, Homo sapiens
tgctgcttccagctcactc

SEQ ID NO: 7708594 - DNA, 22 bp, Homo sapiens
tgctgcttcacctgttgtacag

SEQ ID NO: 7708595 - DNA, 22 bp, Homo sapiens
tgctgcttgcatccaccctggg

SEQ ID NO: 7708596 - DNA, 22 bp, Homo sapiens
tgctgcttcctggtagatagga

SEQ ID NO: 7708597 - DNA, 22 bp, Homo sapiens
tgctgctgttgacggctgtcca

SEQ ID NO: 7708598 - DNA, 22 bp, Homo sapiens
tgctgctgttgacggctgtcca

SEQ ID NO: 7708599 - DNA, 22 bp, Homo sapiens
tgctgctgttgacggctgtcca

SEQ ID NO: 7708600 - DNA, 22 bp, Homo sapiens
tgctgctgttgacggctgtcca

SEQ ID NO: 7708601 - DNA, 20 bp, Homo sapiens
tgctgctgtgagcgtccctg

SEQ ID NO: 7708602 - DNA, 20 bp, Homo sapiens
tgctgctgtgagcgtccctg

SEQ ID NO: 7708603 - DNA, 20 bp, Homo sapiens
tgctgctgtgagcgtccctg

SEQ ID NO: 7708604 - DNA, 20 bp, Homo sapiens
tgctgctgtgagcgtccctg

SEQ ID NO: 7708605 - DNA, 20 bp, Homo sapiens
tgctgctgtgagcgtccctg

SEQ ID NO: 7708606 - DNA, 22 bp, Homo sapiens
tgctgctttaaaaagtgctgat

SEQ ID NO: 7708607 - DNA, 22 bp, Homo sapiens
tgctgcttgttttgtaaataaa

SEQ ID NO: 7708608 - DNA, 22 bp, Homo sapiens
tgctgcttgttttgtaaataaa

SEQ ID NO: 7708609 - DNA, 22 bp, Homo sapiens
tgctgcttggaaatggggctga

SEQ ID NO: 7708610 - DNA, 22 bp, Homo sapiens
tgctgctttaaaaagtgctgat

SEQ ID NO: 7708611 - DNA, 22 bp, Homo sapiens
tgctgctttgatgtgtaaatca

SEQ ID NO: 7708612 - DNA, 22 bp, Homo sapiens
tgctgctttgatgtgtaaatca

SEQ ID NO: 7708613 - DNA, 22 bp, Homo sapiens
tgctgctttggaactccacagg

SEQ ID NO: 7708614 - DNA, 22 bp, Homo sapiens
tgctgcttttagttggatagaa

SEQ ID NO: 7708615 - DNA, 22 bp, Homo sapiens
tgctgcttttagttggatagaa

SEQ ID NO: 7708616 - DNA, 20 bp, Homo sapiens
tgctggaaaaagtcactcat

SEQ ID NO: 7708617 - DNA, 22 bp, Homo sapiens
tgctgcttttgtatatcagaga

SEQ ID NO: 7708618 - DNA, 22 bp, Homo sapiens
tgctgctttgatgtgtaaatca

SEQ ID NO: 7708619 - DNA, 22 bp, Homo sapiens
tgctgctttggaactccacagg

SEQ ID NO: 7708620 - DNA, 22 bp, Homo sapiens
tgctgctgatggcacctaggca

SEQ ID NO: 7708621 - DNA, 22 bp, Homo sapiens
tgctgctgatggcacctaggca

SEQ ID NO: 7708622 - DNA, 22 bp, Homo sapiens
tgctgctgatggatgcctggac

SEQ ID NO: 7708623 - DNA, 22 bp, Homo sapiens
tgctgctgatggatgcctggac

SEQ ID NO: 7708624 - DNA, 22 bp, Homo sapiens
tgctgctgatggatgcctggac

SEQ ID NO: 7708625 - DNA, 20 bp, Homo sapiens
tgctgctgcctccgcctctg

SEQ ID NO: 7708626 - DNA, 20 bp, Homo sapiens
tgctgctgcctccgcctctg

SEQ ID NO: 7708627 - DNA, 22 bp, Homo sapiens
tgctgctgatggcacctaggca

SEQ ID NO: 7708628 - DNA, 20 bp, Homo sapiens
tgctgctgcttcacccccat

SEQ ID NO: 7708629 - DNA, 20 bp, Homo sapiens
tgctgctgcctccgcctctg

SEQ ID NO: 7708630 - DNA, 22 bp, Homo sapiens
tgctgctgcttctgtacagcct

SEQ ID NO: 7708631 - DNA, 22 bp, Homo sapiens
tgctgctgcttctgtacagcct

SEQ ID NO: 7708632 - DNA, 22 bp, Homo sapiens
tgctgctggatcttactcatct

SEQ ID NO: 7708633 - DNA, 20 bp, Homo sapiens
tgctgctgcttcacccccat

SEQ ID NO: 7708634 - DNA, 20 bp, Homo sapiens
tgctgctgcttcacccccat

SEQ ID NO: 7708635 - DNA, 22 bp, Homo sapiens
tgctgctggatcttactcatct

SEQ ID NO: 7708636 - DNA, 22 bp, Homo sapiens
tgctgctggatcttactcatct

SEQ ID NO: 7708637 - DNA, 22 bp, Homo sapiens
tgctgctgggtttgacagtcac

SEQ ID NO: 7708638 - DNA, 22 bp, Homo sapiens
tgctgctgcttctgtacagcct

SEQ ID NO: 7708639 - DNA, 22 bp, Homo sapiens
tgctgctgggtttgacagtcac

SEQ ID NO: 7708640 - DNA, 22 bp, Homo sapiens
tgctgctgggtttgacagtcac

SEQ ID NO: 7708641 - DNA, 22 bp, Homo sapiens
tgctgctgggtttgacagtcac

SEQ ID NO: 7708642 - DNA, 22 bp, Homo sapiens
tgctgctgggtttgacagtcac

SEQ ID NO: 7708643 - DNA, 22 bp, Homo sapiens
tgctgctgtatcatgccttcat

SEQ ID NO: 7708644 - DNA, 22 bp, Homo sapiens
tgctgctgtatcatgccttcat

SEQ ID NO: 7708645 - DNA, 22 bp, Homo sapiens
tgctgctgtatcatgccttcat

SEQ ID NO: 7708646 - DNA, 22 bp, Homo sapiens
tgctgctgtatccttagtgtca

SEQ ID NO: 7708647 - DNA, 19 bp, Homo sapiens
tgctgctgtccttgcaggg

SEQ ID NO: 7708648 - DNA, 19 bp, Homo sapiens
tgctgctgtccttgcaggg

SEQ ID NO: 7708649 - DNA, 19 bp, Homo sapiens
tgctgctgtccttgcaggg

SEQ ID NO: 7708650 - DNA, 22 bp, Homo sapiens
tgctgctgtatccttagtgtca

SEQ ID NO: 7708651 - DNA, 19 bp, Homo sapiens
tgctgctgtccttgcaggg

SEQ ID NO: 7708652 - DNA, 19 bp, Homo sapiens
tgctgctgtccttgcaggg

SEQ ID NO: 7708653 - DNA, 19 bp, Homo sapiens
tgctgctgtccttgcaggg

SEQ ID NO: 7708654 - DNA, 19 bp, Homo sapiens
tgctgctgtccttgcaggg

SEQ ID NO: 7708655 - DNA, 22 bp, Homo sapiens
tgctggagaagctcctgggact

SEQ ID NO: 7708656 - DNA, 22 bp, Homo sapiens
tgctggagaagctcctgggact

SEQ ID NO: 7708657 - DNA, 22 bp, Homo sapiens
tgctggagaagctcctgggact

SEQ ID NO: 7708658 - DNA, 22 bp, Homo sapiens
tgctggagaagctcctgggact

SEQ ID NO: 7708659 - DNA, 22 bp, Homo sapiens
tgctggagaagctcctgggact

SEQ ID NO: 7708660 - DNA, 23 bp, Homo sapiens
tgctggagaagcaaagttctgag

SEQ ID NO: 7708661 - DNA, 23 bp, Homo sapiens
tgctggagaagcaaagttctgag

SEQ ID NO: 7708662 - DNA, 23 bp, Homo sapiens
tgctggagaagcaaagttctgag

SEQ ID NO: 7708663 - DNA, 23 bp, Homo sapiens
tgctggagaagcaaagttctgag

SEQ ID NO: 7708664 - DNA, 22 bp, Homo sapiens
tgctggagaactgctctgtgtt

SEQ ID NO: 7708665 - DNA, 22 bp, Homo sapiens
tgctggagaactgctctgtgtt

SEQ ID NO: 7708666 - DNA, 22 bp, Homo sapiens
tgctggagaactgctctgtgtt

SEQ ID NO: 7708667 - DNA, 22 bp, Homo sapiens
tgctggagaactgctctgtgtt

SEQ ID NO: 7708668 - DNA, 22 bp, Homo sapiens
tgctggagaactgctctgtgtt

SEQ ID NO: 7708669 - DNA, 23 bp, Homo sapiens
tgctggagaagcaaagttctgag

SEQ ID NO: 7708670 - DNA, 23 bp, Homo sapiens
tgctggagaagcaaagttctgag

SEQ ID NO: 7708671 - DNA, 22 bp, Homo sapiens
tgctggagaactgctctgtgtt

SEQ ID NO: 7708672 - DNA, 22 bp, Homo sapiens
tgctggagaactgctctgtgtt

SEQ ID NO: 7708673 - DNA, 22 bp, Homo sapiens
tgctggagaactgctctgtgtt

SEQ ID NO: 7708674 - DNA, 22 bp, Homo sapiens
tgctggaggagaaggttgctca

SEQ ID NO: 7708675 - DNA, 22 bp, Homo sapiens
tgctggaggagaaggttgctca

SEQ ID NO: 7708676 - DNA, 22 bp, Homo sapiens
tgctggaggagaaggttgctca

SEQ ID NO: 7708677 - DNA, 22 bp, Homo sapiens
tgctggaggagaaggttgctca

SEQ ID NO: 7708678 - DNA, 22 bp, Homo sapiens
tgctggagctccgggctgtagg

SEQ ID NO: 7708679 - DNA, 22 bp, Homo sapiens
tgctggagctccgggctgtagg

SEQ ID NO: 7708680 - DNA, 22 bp, Homo sapiens
tgctggagctccgggctgtagg

SEQ ID NO: 7708681 - DNA, 21 bp, Homo sapiens
tgctggaggacagggtttcat

SEQ ID NO: 7708682 - DNA, 21 bp, Homo sapiens
tgctggaggacagggtttcat

SEQ ID NO: 7708683 - DNA, 22 bp, Homo sapiens
tgctggagcggaggtgagccag

SEQ ID NO: 7708684 - DNA, 22 bp, Homo sapiens
tgctggagcggaggtgagccag

SEQ ID NO: 7708685 - DNA, 22 bp, Homo sapiens
tgctggagcggaggtgagccag

SEQ ID NO: 7708686 - DNA, 22 bp, Homo sapiens
tgctggagcggaggtgagccag

SEQ ID NO: 7708687 - DNA, 22 bp, Homo sapiens
tgctggagaagctcctgggact

SEQ ID NO: 7708688 - DNA, 23 bp, Homo sapiens
tgctggagacaagtgtgagaagg

SEQ ID NO: 7708689 - DNA, 23 bp, Homo sapiens
tgctggagacaagtgtgagaagg

SEQ ID NO: 7708690 - DNA, 22 bp, Homo sapiens
tgctggagcggaggtgagccag

SEQ ID NO: 7708691 - DNA, 22 bp, Homo sapiens
tgctggagcggaggtgagccag

SEQ ID NO: 7708692 - DNA, 22 bp, Homo sapiens
tgctggaattgacctagaagga

SEQ ID NO: 7708693 - DNA, 22 bp, Homo sapiens
tgctggaattgacctagaagga

SEQ ID NO: 7708694 - DNA, 22 bp, Homo sapiens
tgctggaatttttctaggattt

SEQ ID NO: 7708695 - DNA, 22 bp, Homo sapiens
tgctggacagggcacggcccat

SEQ ID NO: 7708696 - DNA, 22 bp, Homo sapiens
tgctggaatttttctaggattt

SEQ ID NO: 7708697 - DNA, 22 bp, Homo sapiens
tgctggacagggcacggcccat

SEQ ID NO: 7708698 - DNA, 22 bp, Homo sapiens
tgctggagaaagtttttctgaa

SEQ ID NO: 7708699 - DNA, 22 bp, Homo sapiens
tgctggagaaagtttttctgaa

SEQ ID NO: 7708700 - DNA, 22 bp, Homo sapiens
tgctggaataatttcatgttaa

SEQ ID NO: 7708701 - DNA, 22 bp, Homo sapiens
tgctggaataatttcatgttaa

SEQ ID NO: 7708702 - DNA, 23 bp, Homo sapiens
tgctggaaggtccaatttgctca

SEQ ID NO: 7708703 - DNA, 22 bp, Homo sapiens
tgctggaagctcctgcatgtct

SEQ ID NO: 7708704 - DNA, 22 bp, Homo sapiens
tgctggaagctcctgcatgtct

SEQ ID NO: 7708705 - DNA, 22 bp, Homo sapiens
tgctggaagagattggagcctc

SEQ ID NO: 7708706 - DNA, 22 bp, Homo sapiens
tgctggaaataggcattgtagc

SEQ ID NO: 7708707 - DNA, 22 bp, Homo sapiens
tgctggaaagttaaattttgga

SEQ ID NO: 7708708 - DNA, 22 bp, Homo sapiens
tgctggaaagttaaattttgga

SEQ ID NO: 7708709 - DNA, 22 bp, Homo sapiens
tgctggaaagttaaattttgga

SEQ ID NO: 7708710 - DNA, 22 bp, Homo sapiens
tgctggaaagttaaattttgga

SEQ ID NO: 7708711 - DNA, 22 bp, Homo sapiens
tgctggaaagaattttctgtta

SEQ ID NO: 7708712 - DNA, 22 bp, Homo sapiens
tgctggaaaaatcatttgcttt

SEQ ID NO: 7708713 - DNA, 22 bp, Homo sapiens
tgctggaagaattccatgctgg

SEQ ID NO: 7708714 - DNA, 22 bp, Homo sapiens
tgctggaactcagtgaatcatt

SEQ ID NO: 7708715 - DNA, 22 bp, Homo sapiens
tgctggaactcagtgaatcatt

SEQ ID NO: 7708716 - DNA, 22 bp, Homo sapiens
tgctggaaccaggaatttgaag

SEQ ID NO: 7708717 - DNA, 22 bp, Homo sapiens
tgctggaaccaggaatttgaag

SEQ ID NO: 7708718 - DNA, 20 bp, Homo sapiens
tgctggaaattgttctagga

SEQ ID NO: 7708719 - DNA, 19 bp, Homo sapiens
tgctggaacatcagtagct

SEQ ID NO: 7708720 - DNA, 20 bp, Homo sapiens
tgctggaaattgttctagga

SEQ ID NO: 7708721 - DNA, 22 bp, Homo sapiens
tgctgcctcagcttcctgggct

SEQ ID NO: 7708722 - DNA, 22 bp, Homo sapiens
tgctgcctcagcttcctgggct

SEQ ID NO: 7708723 - DNA, 22 bp, Homo sapiens
tgctgcctcaactgtcaggaac

SEQ ID NO: 7708724 - DNA, 22 bp, Homo sapiens
tgctgcctccaactcctgggct

SEQ ID NO: 7708725 - DNA, 22 bp, Homo sapiens
tgctgcctccttcctgccagga

SEQ ID NO: 7708726 - DNA, 22 bp, Homo sapiens
tgctgcctccttcctgccagga

SEQ ID NO: 7708727 - DNA, 22 bp, Homo sapiens
tgctgcctccttcctgccagga

SEQ ID NO: 7708728 - DNA, 22 bp, Homo sapiens
tgctgcctccaactcctgggct

SEQ ID NO: 7708729 - DNA, 22 bp, Homo sapiens
tgctgcctaggaatctgtattt

SEQ ID NO: 7708730 - DNA, 20 bp, Homo sapiens
tgctgcctactaagccctca

SEQ ID NO: 7708731 - DNA, 22 bp, Homo sapiens
tgctgcctcaactgtcaggaac

SEQ ID NO: 7708732 - DNA, 22 bp, Homo sapiens
tgctgcctcaactgtcaggaac

SEQ ID NO: 7708733 - DNA, 22 bp, Homo sapiens
tgctgcctaataagtcgagggt

SEQ ID NO: 7708734 - DNA, 20 bp, Homo sapiens
tgctgcctactaagccctca

SEQ ID NO: 7708735 - DNA, 22 bp, Homo sapiens
tgctgcctaataagtcgagggt

SEQ ID NO: 7708736 - DNA, 22 bp, Homo sapiens
tgctgcctaataagtcgagggt

SEQ ID NO: 7708737 - DNA, 22 bp, Homo sapiens
tgctgcctaacagaactctttc

SEQ ID NO: 7708738 - DNA, 22 bp, Homo sapiens
tgctgcctaataagtcgagggt

SEQ ID NO: 7708739 - DNA, 22 bp, Homo sapiens
tgctgcctaacagaactctttc

SEQ ID NO: 7708740 - DNA, 22 bp, Homo sapiens
tgctgccatctcaactgccctt

SEQ ID NO: 7708741 - DNA, 22 bp, Homo sapiens
tgctgccatctcaactgccctt

SEQ ID NO: 7708742 - DNA, 22 bp, Homo sapiens
tgctgccatctcaactgccctt

SEQ ID NO: 7708743 - DNA, 22 bp, Homo sapiens
tgctgccatgcagagcaacaga

SEQ ID NO: 7708744 - DNA, 22 bp, Homo sapiens
tgctgccatggtcgctggtgtc

SEQ ID NO: 7708745 - DNA, 23 bp, Homo sapiens
tgctgcccactcttccagccctc

SEQ ID NO: 7708746 - DNA, 18 bp, Homo sapiens
tgctgcccaactctcccc

SEQ ID NO: 7708747 - DNA, 18 bp, Homo sapiens
tgctgcccaactctcccc

SEQ ID NO: 7708748 - DNA, 23 bp, Homo sapiens
tgctgcccactcttccagccctc

SEQ ID NO: 7708749 - DNA, 23 bp, Homo sapiens
tgctgcccactcttccagccctc

SEQ ID NO: 7708750 - DNA, 23 bp, Homo sapiens
tgctgcccactcttccagccctc

SEQ ID NO: 7708751 - DNA, 18 bp, Homo sapiens
tgctgcccaactctcccc

SEQ ID NO: 7708752 - DNA, 18 bp, Homo sapiens
tgctgcccaactctcccc

SEQ ID NO: 7708753 - DNA, 18 bp, Homo sapiens
tgctgcccaactctcccc

SEQ ID NO: 7708754 - DNA, 23 bp, Homo sapiens
tgctgccctgccttcagctctcc

SEQ ID NO: 7708755 - DNA, 23 bp, Homo sapiens
tgctgccctgccttcagctctcc

SEQ ID NO: 7708756 - DNA, 23 bp, Homo sapiens
tgctgccctgccttcagctctcc

SEQ ID NO: 7708757 - DNA, 23 bp, Homo sapiens
tgctgccctgccttcagctctcc

SEQ ID NO: 7708758 - DNA, 22 bp, Homo sapiens
tgctgcccgtacctgtgcactt

SEQ ID NO: 7708759 - DNA, 22 bp, Homo sapiens
tgctgcccgtacctgtgcactt

SEQ ID NO: 7708760 - DNA, 23 bp, Homo sapiens
tgctgcccgcttggcacgctccc

SEQ ID NO: 7708761 - DNA, 23 bp, Homo sapiens
tgctgcccgcttggcacgctccc

SEQ ID NO: 7708762 - DNA, 22 bp, Homo sapiens
tgctgcccactgtatttctcca

SEQ ID NO: 7708763 - DNA, 23 bp, Homo sapiens
tgctgcccgcttggcacgctccc

SEQ ID NO: 7708764 - DNA, 23 bp, Homo sapiens
tgctgcccgcttggcacgctccc

SEQ ID NO: 7708765 - DNA, 22 bp, Homo sapiens
tgctgcccactgtatttctcca

SEQ ID NO: 7708766 - DNA, 22 bp, Homo sapiens
tgctgcccactgtatttctcca

SEQ ID NO: 7708767 - DNA, 22 bp, Homo sapiens
tgctgcctctgctgatatggcc

SEQ ID NO: 7708768 - DNA, 22 bp, Homo sapiens
tgctgcctctgctgatatggcc

SEQ ID NO: 7708769 - DNA, 22 bp, Homo sapiens
tgctgcctccttcctgccagga

SEQ ID NO: 7708770 - DNA, 22 bp, Homo sapiens
tgctgctcctgcctggctccca

SEQ ID NO: 7708771 - DNA, 22 bp, Homo sapiens
tgctgctcgccacggcccaggg

SEQ ID NO: 7708772 - DNA, 22 bp, Homo sapiens
tgctgctcctgcctggctccca

SEQ ID NO: 7708773 - DNA, 21 bp, Homo sapiens
tgctgctcctctgggcttcca

SEQ ID NO: 7708774 - DNA, 22 bp, Homo sapiens
tgctgctgaaaaggtgtgctta

SEQ ID NO: 7708775 - DNA, 22 bp, Homo sapiens
tgctgctgaaaaggtgtgctta

SEQ ID NO: 7708776 - DNA, 22 bp, Homo sapiens
tgctgctcttcaccatggcctc

SEQ ID NO: 7708777 - DNA, 22 bp, Homo sapiens
tgctgctcttcaccatggcctc

SEQ ID NO: 7708778 - DNA, 22 bp, Homo sapiens
tgctgctctgtaaagtgatgag

SEQ ID NO: 7708779 - DNA, 22 bp, Homo sapiens
tgctgctctgtaaagtgatgag

SEQ ID NO: 7708780 - DNA, 22 bp, Homo sapiens
tgctgctcgccacggcccaggg

SEQ ID NO: 7708781 - DNA, 22 bp, Homo sapiens
tgctgctcgccacggcccaggg

SEQ ID NO: 7708782 - DNA, 22 bp, Homo sapiens
tgctgctctggccaggaactgc

SEQ ID NO: 7708783 - DNA, 22 bp, Homo sapiens
tgctgctctcagccaccaggaa

SEQ ID NO: 7708784 - DNA, 22 bp, Homo sapiens
tgctgctctggccaggaactgc

SEQ ID NO: 7708785 - DNA, 22 bp, Homo sapiens
tgctgctgacatttggggcttg

SEQ ID NO: 7708786 - DNA, 22 bp, Homo sapiens
tgctgctgacatttggggcttg

SEQ ID NO: 7708787 - DNA, 22 bp, Homo sapiens
tgctgctgatcatttatagtct

SEQ ID NO: 7708788 - DNA, 22 bp, Homo sapiens
tgctgctgaggctaaagtatag

SEQ ID NO: 7708789 - DNA, 22 bp, Homo sapiens
tgctgctgacatttggggcttg

SEQ ID NO: 7708790 - DNA, 22 bp, Homo sapiens
tgctgctgacatttggggcttg

SEQ ID NO: 7708791 - DNA, 22 bp, Homo sapiens
tgctgctgacatttggggcttg

SEQ ID NO: 7708792 - DNA, 22 bp, Homo sapiens
tgctgctgacatttggggcttg

SEQ ID NO: 7708793 - DNA, 22 bp, Homo sapiens
tgctgctgaaaaggtgtgctta

SEQ ID NO: 7708794 - DNA, 21 bp, Homo sapiens
tgctgctgatcggggttggct

SEQ ID NO: 7708795 - DNA, 22 bp, Homo sapiens
tgctgctgaggctaaagtatag

SEQ ID NO: 7708796 - DNA, 21 bp, Homo sapiens
tgctgctgatcggggttggct

SEQ ID NO: 7708797 - DNA, 21 bp, Homo sapiens
tgctgctgatcggggttggct

SEQ ID NO: 7708798 - DNA, 22 bp, Homo sapiens
tgctgctgatgcatagtctgct

SEQ ID NO: 7708799 - DNA, 22 bp, Homo sapiens
tgctgctgatgcatagtctgct

SEQ ID NO: 7708800 - DNA, 22 bp, Homo sapiens
tgctgctgatgcatagtctgct

SEQ ID NO: 7708801 - DNA, 21 bp, Homo sapiens
tgctgccatcatgcagagatg

SEQ ID NO: 7708802 - DNA, 21 bp, Homo sapiens
tgctgccatcatgcagagatg

SEQ ID NO: 7708803 - DNA, 21 bp, Homo sapiens
tgctgccatagacctgaggga

SEQ ID NO: 7708804 - DNA, 21 bp, Homo sapiens
tgctgccatcatgcagagatg

SEQ ID NO: 7708805 - DNA, 22 bp, Homo sapiens
tgctgccatctcaactgccctt

SEQ ID NO: 7708806 - DNA, 21 bp, Homo sapiens
tgctgccatagacctgaggga

SEQ ID NO: 7708807 - DNA, 21 bp, Homo sapiens
tgctgccatagacctgaggga

SEQ ID NO: 7708808 - DNA, 22 bp, Homo sapiens
tgctgccagggctctgcccaca

SEQ ID NO: 7708809 - DNA, 22 bp, Homo sapiens
tgctgccagggctctgcccaca

SEQ ID NO: 7708810 - DNA, 22 bp, Homo sapiens
tgctgccagggctctgcccaca

SEQ ID NO: 7708811 - DNA, 22 bp, Homo sapiens
tgctgccagggctctgcccaca

SEQ ID NO: 7708812 - DNA, 22 bp, Homo sapiens
tgctgccagggctctgcccaca

SEQ ID NO: 7708813 - DNA, 22 bp, Homo sapiens
tgctgccagggctctgcccaca

SEQ ID NO: 7708814 - DNA, 22 bp, Homo sapiens
tgctgccaggtcttgctgtcca

SEQ ID NO: 7708815 - DNA, 22 bp, Homo sapiens
tgctgccaggtcttgctgtcca

SEQ ID NO: 7708816 - DNA, 22 bp, Homo sapiens
tgctgccaggtcttgctgtcca

SEQ ID NO: 7708817 - DNA, 22 bp, Homo sapiens
tgctgccagggctctgcccaca

SEQ ID NO: 7708818 - DNA, 22 bp, Homo sapiens
tgctgccaggtcttgctgtcca

SEQ ID NO: 7708819 - DNA, 22 bp, Homo sapiens
tgctgccactggtagtctcatt

SEQ ID NO: 7708820 - DNA, 22 bp, Homo sapiens
tgctgccactggtagtctcatt

SEQ ID NO: 7708821 - DNA, 22 bp, Homo sapiens
tgctgccacctgtggtagtctg

SEQ ID NO: 7708822 - DNA, 22 bp, Homo sapiens
tgctgccacctggtggctgaag

SEQ ID NO: 7708823 - DNA, 22 bp, Homo sapiens
tgctgccacctgtggtagtctg

SEQ ID NO: 7708824 - DNA, 22 bp, Homo sapiens
tgctgccacctggtggctgaag

SEQ ID NO: 7708825 - DNA, 22 bp, Homo sapiens
tgctgccagagagacagggact

SEQ ID NO: 7708826 - DNA, 22 bp, Homo sapiens
tgctgccagccaggccatggag

SEQ ID NO: 7708827 - DNA, 22 bp, Homo sapiens
tgctgccagccaggccatggag

SEQ ID NO: 7708828 - DNA, 22 bp, Homo sapiens
tgctgccagccaggccatggag

SEQ ID NO: 7708829 - DNA, 22 bp, Homo sapiens
tgctgccagccaggccatggag

SEQ ID NO: 7708830 - DNA, 22 bp, Homo sapiens
tgctgccagccaggccatggag

SEQ ID NO: 7708831 - DNA, 22 bp, Homo sapiens
tgctgccagccaggccatggag

SEQ ID NO: 7708832 - DNA, 22 bp, Homo sapiens
tgctgccacctggtggctgaag

SEQ ID NO: 7708833 - DNA, 22 bp, Homo sapiens
tgctgccacctggtggctgaag

SEQ ID NO: 7708834 - DNA, 22 bp, Homo sapiens
tgctgccacccctcaccagagc

SEQ ID NO: 7708835 - DNA, 22 bp, Homo sapiens
tgctgccacccctcaccagagc

SEQ ID NO: 7708836 - DNA, 22 bp, Homo sapiens
tgctgccacccctcaccagagc

SEQ ID NO: 7708837 - DNA, 22 bp, Homo sapiens
tgctgccacccctcaccagagc

SEQ ID NO: 7708838 - DNA, 22 bp, Homo sapiens
tgctgccacatttaaagagggg

SEQ ID NO: 7708839 - DNA, 22 bp, Homo sapiens
tgctgccacatttaaagagggg

SEQ ID NO: 7708840 - DNA, 17 bp, Homo sapiens
tgctgccaagtcccaac

SEQ ID NO: 7708841 - DNA, 22 bp, Homo sapiens
tgctgccaatttctggtcttga

SEQ ID NO: 7708842 - DNA, 17 bp, Homo sapiens
tgctgccaagtcccaac

SEQ ID NO: 7708843 - DNA, 22 bp, Homo sapiens
tgctgccaatttctggtcttga

SEQ ID NO: 7708844 - DNA, 22 bp, Homo sapiens
tgctgccaatttctggtcttga

SEQ ID NO: 7708845 - DNA, 22 bp, Homo sapiens
tgctgccacaaattcagctgcc

SEQ ID NO: 7708846 - DNA, 22 bp, Homo sapiens
tgctgccacaaattcagctgcc

SEQ ID NO: 7708847 - DNA, 22 bp, Homo sapiens
tgctgccacaaattcagctgcc

SEQ ID NO: 7708848 - DNA, 22 bp, Homo sapiens
tgctgccacaaattcagctgcc

SEQ ID NO: 7708849 - DNA, 22 bp, Homo sapiens
tgctgccacaaattcagctgcc

SEQ ID NO: 7708850 - DNA, 22 bp, Homo sapiens
tgctgccacaaattcagctgcc

SEQ ID NO: 7708851 - DNA, 22 bp, Homo sapiens
tgctgccaagcccgtgctcctg

SEQ ID NO: 7708852 - DNA, 22 bp, Homo sapiens
tgctgccaagcccgtgctcctg

SEQ ID NO: 7708853 - DNA, 22 bp, Homo sapiens
tgctgccaagcccgtgctcctg

SEQ ID NO: 7708854 - DNA, 22 bp, Homo sapiens
tgctgccaagcccgtgctcctg

SEQ ID NO: 7708855 - DNA, 22 bp, Homo sapiens
tgctgccaagcccgtgctcctg

SEQ ID NO: 7708856 - DNA, 17 bp, Homo sapiens
tgctgccaagtcccaac

SEQ ID NO: 7708857 - DNA, 17 bp, Homo sapiens
tgctgccaagtcccaac

SEQ ID NO: 7708858 - DNA, 17 bp, Homo sapiens
tgctgccaagtcccaac

SEQ ID NO: 7708859 - DNA, 23 bp, Homo sapiens
tgctgccaagcacgagttgagtt

SEQ ID NO: 7708860 - DNA, 23 bp, Homo sapiens
tgctgccaagcacgagttgagtt

SEQ ID NO: 7708861 - DNA, 23 bp, Homo sapiens
tgctgccaagcacgagttgagtt

SEQ ID NO: 7708862 - DNA, 22 bp, Homo sapiens
tgctgccaaatgcgagctctgt

SEQ ID NO: 7708863 - DNA, 22 bp, Homo sapiens
tgctgccaaatgcgagctctgt

SEQ ID NO: 7708864 - DNA, 20 bp, Homo sapiens
tgctgcagtttcatgggact

SEQ ID NO: 7708865 - DNA, 22 bp, Homo sapiens
tgctgcatagcagctcctgaaa

SEQ ID NO: 7708866 - DNA, 20 bp, Homo sapiens
tgctgcagtttcatgggact

SEQ ID NO: 7708867 - DNA, 20 bp, Homo sapiens
tgctgcagtttcatgggact

SEQ ID NO: 7708868 - DNA, 22 bp, Homo sapiens
tgctgccaaatgcgagctctgt

SEQ ID NO: 7708869 - DNA, 22 bp, Homo sapiens
tgctgcatttgcagtcctttaa

SEQ ID NO: 7708870 - DNA, 22 bp, Homo sapiens
tgctgcatttatcttctcaaac

SEQ ID NO: 7708871 - DNA, 22 bp, Homo sapiens
tgctgcatttgcagtcctttaa

SEQ ID NO: 7708872 - DNA, 23 bp, Homo sapiens
tgctggctgtgttattgccaaca

SEQ ID NO: 7708873 - DNA, 23 bp, Homo sapiens
tgctggctgtgttattgccaaca

SEQ ID NO: 7708874 - DNA, 23 bp, Homo sapiens
tgctggctgtgttattgccaaca

SEQ ID NO: 7708875 - DNA, 23 bp, Homo sapiens
tgctggctgtgttattgccaaca

SEQ ID NO: 7708876 - DNA, 22 bp, Homo sapiens
tgctggctgttctagggaggcc

SEQ ID NO: 7708877 - DNA, 22 bp, Homo sapiens
tgctggctgttctagggaggcc

SEQ ID NO: 7708878 - DNA, 22 bp, Homo sapiens
tgctggctgttctagggaggcc

SEQ ID NO: 7708879 - DNA, 22 bp, Homo sapiens
tgctggctgttctagggaggcc

SEQ ID NO: 7708880 - DNA, 22 bp, Homo sapiens
tgctggctgtccctacctggct

SEQ ID NO: 7708881 - DNA, 22 bp, Homo sapiens
tgctggctgtccctacctggct

SEQ ID NO: 7708882 - DNA, 22 bp, Homo sapiens
tgctggctgtccctacctggct

SEQ ID NO: 7708883 - DNA, 22 bp, Homo sapiens
tgctggctgtccctacctggct

SEQ ID NO: 7708884 - DNA, 22 bp, Homo sapiens
tgctggctgtccctacctggct

SEQ ID NO: 7708885 - DNA, 22 bp, Homo sapiens
tgctggctgtgtaccatctcaa

SEQ ID NO: 7708886 - DNA, 22 bp, Homo sapiens
tgctggctgtgtaccatctcaa

SEQ ID NO: 7708887 - DNA, 22 bp, Homo sapiens
tgctggctgtccctacctggct

SEQ ID NO: 7708888 - DNA, 22 bp, Homo sapiens
tgctggctgtgtaccatctcaa

SEQ ID NO: 7708889 - DNA, 22 bp, Homo sapiens
tgctggctgtgtaccatctcaa

SEQ ID NO: 7708890 - DNA, 23 bp, Homo sapiens
tgctggcttccagctgctccctc

SEQ ID NO: 7708891 - DNA, 23 bp, Homo sapiens
tgctggcttccagctgctccctc

SEQ ID NO: 7708892 - DNA, 23 bp, Homo sapiens
tgctggcttccagctgctccctc

SEQ ID NO: 7708893 - DNA, 23 bp, Homo sapiens
tgctggcttccagctgctccctc

SEQ ID NO: 7708894 - DNA, 22 bp, Homo sapiens
tgctggcttcctgtgcacagca

SEQ ID NO: 7708895 - DNA, 22 bp, Homo sapiens
tgctggcttatttagtaaatgt

SEQ ID NO: 7708896 - DNA, 22 bp, Homo sapiens
tgctggcttatttagtaaatgt

SEQ ID NO: 7708897 - DNA, 23 bp, Homo sapiens
tgctggcttccagctgctccctc

SEQ ID NO: 7708898 - DNA, 22 bp, Homo sapiens
tgctggcttatttagtaaatgt

SEQ ID NO: 7708899 - DNA, 22 bp, Homo sapiens
tgctggctgttctagggaggcc

SEQ ID NO: 7708900 - DNA, 22 bp, Homo sapiens
tgctggctgttctagggaggcc

SEQ ID NO: 7708901 - DNA, 22 bp, Homo sapiens
tgctggctgttctagggaggcc

SEQ ID NO: 7708902 - DNA, 22 bp, Homo sapiens
tgctggcttagatatcactgcc

SEQ ID NO: 7708903 - DNA, 22 bp, Homo sapiens
tgctggcttagatatcactgcc

SEQ ID NO: 7708904 - DNA, 22 bp, Homo sapiens
tgctggcttagatatcactgcc

SEQ ID NO: 7708905 - DNA, 22 bp, Homo sapiens
tgctggcttagatatcactgcc

SEQ ID NO: 7708906 - DNA, 22 bp, Homo sapiens
tgctggcttatttagtaaatgt

SEQ ID NO: 7708907 - DNA, 22 bp, Homo sapiens
tgctggcttatttagtaaatgt

SEQ ID NO: 7708908 - DNA, 22 bp, Homo sapiens
tgctggctgtatatgtgagagt

SEQ ID NO: 7708909 - DNA, 22 bp, Homo sapiens
tgctggctgtatatgtgagagt

SEQ ID NO: 7708910 - DNA, 22 bp, Homo sapiens
tgctggctgtatatgtgagagt

SEQ ID NO: 7708911 - DNA, 22 bp, Homo sapiens
tgctggctgggctgctggagac

SEQ ID NO: 7708912 - DNA, 22 bp, Homo sapiens
tgctggctgggctgctggagac

SEQ ID NO: 7708913 - DNA, 22 bp, Homo sapiens
tgctggctgggctgctggagac

SEQ ID NO: 7708914 - DNA, 22 bp, Homo sapiens
tgctggctgggctgctggagac

SEQ ID NO: 7708915 - DNA, 22 bp, Homo sapiens
tgctggctgggctgctggagac

SEQ ID NO: 7708916 - DNA, 22 bp, Homo sapiens
tgctggctgtatatgtgagagt

SEQ ID NO: 7708917 - DNA, 22 bp, Homo sapiens
tgctggctgtatatgtgagagt

SEQ ID NO: 7708918 - DNA, 22 bp, Homo sapiens
tgctggctgtatatgtgagagt

SEQ ID NO: 7708919 - DNA, 22 bp, Homo sapiens
tgctggctggcctggcctggac

SEQ ID NO: 7708920 - DNA, 22 bp, Homo sapiens
tgctggctggcctggcctggac

SEQ ID NO: 7708921 - DNA, 22 bp, Homo sapiens
tgctggctgggctgctggagac

SEQ ID NO: 7708922 - DNA, 22 bp, Homo sapiens
tgctggctggcctggcctggac

SEQ ID NO: 7708923 - DNA, 22 bp, Homo sapiens
tgctggctgggctgctggagac

SEQ ID NO: 7708924 - DNA, 22 bp, Homo sapiens
tgctggctggcctggcctggac

SEQ ID NO: 7708925 - DNA, 22 bp, Homo sapiens
tgctggctggcctggcctggac

SEQ ID NO: 7708926 - DNA, 22 bp, Homo sapiens
tgctggctggatcagagattgg

SEQ ID NO: 7708927 - DNA, 22 bp, Homo sapiens
tgctggctggcctggcctggac

SEQ ID NO: 7708928 - DNA, 22 bp, Homo sapiens
tgctggctgccaggttccctgt

SEQ ID NO: 7708929 - DNA, 22 bp, Homo sapiens
tgctggctgccaggttccctgt

SEQ ID NO: 7708930 - DNA, 22 bp, Homo sapiens
tgctggctgcagtgctgtcaaa

SEQ ID NO: 7708931 - DNA, 22 bp, Homo sapiens
tgctggctgcagtgctgtcaaa

SEQ ID NO: 7708932 - DNA, 22 bp, Homo sapiens
tgctggctgccaggttccctgt

SEQ ID NO: 7708933 - DNA, 22 bp, Homo sapiens
tgctggctgcagtgctgtcaaa

SEQ ID NO: 7708934 - DNA, 22 bp, Homo sapiens
tgctggctgcagtgctgtcaaa

SEQ ID NO: 7708935 - DNA, 22 bp, Homo sapiens
tgctggctgcagtgctgtcaaa

SEQ ID NO: 7708936 - DNA, 22 bp, Homo sapiens
tgctggctgcagtgctgtcaaa

SEQ ID NO: 7708937 - DNA, 22 bp, Homo sapiens
tgctggctgcagtgctgtcaaa

SEQ ID NO: 7708938 - DNA, 22 bp, Homo sapiens
tgctggctgccaggttccctgt

SEQ ID NO: 7708939 - DNA, 22 bp, Homo sapiens
tgctggctggagtgcctctgga

SEQ ID NO: 7708940 - DNA, 22 bp, Homo sapiens
tgctggctggagtgcctctgga

SEQ ID NO: 7708941 - DNA, 22 bp, Homo sapiens
tgctggctggagtgcctctgga

SEQ ID NO: 7708942 - DNA, 22 bp, Homo sapiens
tgctggctggagtgcctctgga

SEQ ID NO: 7708943 - DNA, 22 bp, Homo sapiens
tgctggctggagtgcctctgga

SEQ ID NO: 7708944 - DNA, 22 bp, Homo sapiens
tgctggctggagtgcctctgga

SEQ ID NO: 7708945 - DNA, 22 bp, Homo sapiens
tgctggctggatcagagattgg

SEQ ID NO: 7708946 - DNA, 22 bp, Homo sapiens
tgctggctggagtgcctctgga

SEQ ID NO: 7708947 - DNA, 22 bp, Homo sapiens
tgctggctggatcagagattgg

SEQ ID NO: 7708948 - DNA, 22 bp, Homo sapiens
tgctggctggatcagagattgg

SEQ ID NO: 7708949 - DNA, 22 bp, Homo sapiens
tgctggctggatcagagattgg

SEQ ID NO: 7708950 - DNA, 23 bp, Homo sapiens
tgctggctgaaacagccaaagga

SEQ ID NO: 7708951 - DNA, 23 bp, Homo sapiens
tgctggctgaaacagccaaagga

SEQ ID NO: 7708952 - DNA, 23 bp, Homo sapiens
tgctggctgaaacagccaaagga

SEQ ID NO: 7708953 - DNA, 23 bp, Homo sapiens
tgctggctgaaacagccaaagga

SEQ ID NO: 7708954 - DNA, 23 bp, Homo sapiens
tgctggctgaaacagccaaagga

SEQ ID NO: 7708955 - DNA, 21 bp, Homo sapiens
tgctggctgaaaggcacagag

SEQ ID NO: 7708956 - DNA, 21 bp, Homo sapiens
tgctggctgaaaggcacagag

SEQ ID NO: 7708957 - DNA, 21 bp, Homo sapiens
tgctggctgaaaggcacagag

SEQ ID NO: 7708958 - DNA, 21 bp, Homo sapiens
tgctggctgaaaggcacagag

SEQ ID NO: 7708959 - DNA, 21 bp, Homo sapiens
tgctggctgaaaggcacagag

SEQ ID NO: 7708960 - DNA, 21 bp, Homo sapiens
tgctggctgaaaggcacagag

SEQ ID NO: 7708961 - DNA, 22 bp, Homo sapiens
tgctggctgaggcctgagcggg

SEQ ID NO: 7708962 - DNA, 22 bp, Homo sapiens
tgctggctgaggcctgagcggg

SEQ ID NO: 7708963 - DNA, 22 bp, Homo sapiens
tgctggctgaggcctgagcggg

SEQ ID NO: 7708964 - DNA, 22 bp, Homo sapiens
tgctggctgaggcctgagcggg

SEQ ID NO: 7708965 - DNA, 22 bp, Homo sapiens
tgctggctgaggcctgagcggg

SEQ ID NO: 7708966 - DNA, 22 bp, Homo sapiens
tgctggctgaggcctgagcggg

SEQ ID NO: 7708967 - DNA, 22 bp, Homo sapiens
tgctggctgaggcctgagcggg

SEQ ID NO: 7708968 - DNA, 21 bp, Homo sapiens
tgctggctgaaaggcacagag

SEQ ID NO: 7708969 - DNA, 21 bp, Homo sapiens
tgctggctgaaaggcacagag

SEQ ID NO: 7708970 - DNA, 21 bp, Homo sapiens
tgctggctgaaaggcacagag

SEQ ID NO: 7708971 - DNA, 22 bp, Homo sapiens
tgctggctcccaggagccgctg

SEQ ID NO: 7708972 - DNA, 22 bp, Homo sapiens
tgctggctcccaggagccgctg

SEQ ID NO: 7708973 - DNA, 22 bp, Homo sapiens
tgctggctcccaggagccgctg

SEQ ID NO: 7708974 - DNA, 22 bp, Homo sapiens
tgctggctcctcgaggcttcgt

SEQ ID NO: 7708975 - DNA, 22 bp, Homo sapiens
tgctggctcctcgaggcttcgt

SEQ ID NO: 7708976 - DNA, 22 bp, Homo sapiens
tgctggctctaggctgagacag

SEQ ID NO: 7708977 - DNA, 22 bp, Homo sapiens
tgctggctcctcgaggcttcgt

SEQ ID NO: 7708978 - DNA, 22 bp, Homo sapiens
tgctggctcctcgaggcttcgt

SEQ ID NO: 7708979 - DNA, 22 bp, Homo sapiens
tgctggctcctcgaggcttcgt

SEQ ID NO: 7708980 - DNA, 22 bp, Homo sapiens
tgctggctctgggccaagcagg

SEQ ID NO: 7708981 - DNA, 22 bp, Homo sapiens
tgctggctctgggccaagcagg

SEQ ID NO: 7708982 - DNA, 22 bp, Homo sapiens
tgctggctctgggccaagcagg

SEQ ID NO: 7708983 - DNA, 22 bp, Homo sapiens
tgctggctctgggccaagcagg

SEQ ID NO: 7708984 - DNA, 22 bp, Homo sapiens
tgctggctctgggccaagcagg

SEQ ID NO: 7708985 - DNA, 22 bp, Homo sapiens
tgctggctctaggctgagacag

SEQ ID NO: 7708986 - DNA, 22 bp, Homo sapiens
tgctggctctaggctgagacag

SEQ ID NO: 7708987 - DNA, 22 bp, Homo sapiens
tgctggctctaggctgagacag

SEQ ID NO: 7708988 - DNA, 22 bp, Homo sapiens
tgctggctctaggctgagacag

SEQ ID NO: 7708989 - DNA, 22 bp, Homo sapiens
tgctggctctaggctgagacag

SEQ ID NO: 7708990 - DNA, 22 bp, Homo sapiens
tgctggctctaggctgagacag

SEQ ID NO: 7708991 - DNA, 22 bp, Homo sapiens
tgctggctctaggctgagacag

SEQ ID NO: 7708992 - DNA, 22 bp, Homo sapiens
tgctggccaagcagaggtcaat

SEQ ID NO: 7708993 - DNA, 22 bp, Homo sapiens
tgctggccaagcagaggtcaat

SEQ ID NO: 7708994 - DNA, 22 bp, Homo sapiens
tgctggccaagcagaggtcaat

SEQ ID NO: 7708995 - DNA, 22 bp, Homo sapiens
tgctggctactgatggcaggcc

SEQ ID NO: 7708996 - DNA, 22 bp, Homo sapiens
tgctggctactgatggcaggcc

SEQ ID NO: 7708997 - DNA, 22 bp, Homo sapiens
tgctggctactgatggcaggcc

SEQ ID NO: 7708998 - DNA, 22 bp, Homo sapiens
tgctggctactgatggcaggcc

SEQ ID NO: 7708999 - DNA, 22 bp, Homo sapiens
tgctggctactgatggcaggcc

SEQ ID NO: 7709000 - DNA, 22 bp, Homo sapiens
tgctggcattgcataggcagtt

SEQ ID NO: 7709001 - DNA, 22 bp, Homo sapiens
tgctggcattgcataggcagtt

SEQ ID NO: 7709002 - DNA, 22 bp, Homo sapiens
tgctggcatttcaggactcacc

SEQ ID NO: 7709003 - DNA, 22 bp, Homo sapiens
tgctggcatttcaggactcacc

SEQ ID NO: 7709004 - DNA, 22 bp, Homo sapiens
tgctggcatttcaggactcacc

SEQ ID NO: 7709005 - DNA, 22 bp, Homo sapiens
tgctggccaacaaggctccaag

SEQ ID NO: 7709006 - DNA, 22 bp, Homo sapiens
tgctggccaacaaggctccaag

SEQ ID NO: 7709007 - DNA, 22 bp, Homo sapiens
tgctggccaacaaggctccaag

SEQ ID NO: 7709008 - DNA, 22 bp, Homo sapiens
tgctggctcagtttgcagactc

SEQ ID NO: 7709009 - DNA, 22 bp, Homo sapiens
tgctggctcagtttgcagactc

SEQ ID NO: 7709010 - DNA, 22 bp, Homo sapiens
tgctggctatttaaagaagaaa

SEQ ID NO: 7709011 - DNA, 22 bp, Homo sapiens
tgctggctatttaaagaagaaa

SEQ ID NO: 7709012 - DNA, 22 bp, Homo sapiens
tgctggctcagtttgcagactc

SEQ ID NO: 7709013 - DNA, 22 bp, Homo sapiens
tgctggctcagtttgcagactc

SEQ ID NO: 7709014 - DNA, 22 bp, Homo sapiens
tgctggctcagtttgcagactc

SEQ ID NO: 7709015 - DNA, 22 bp, Homo sapiens
tgctggctactgatggcaggcc

SEQ ID NO: 7709016 - DNA, 22 bp, Homo sapiens
tgctggctatttaaagaagaaa

SEQ ID NO: 7709017 - DNA, 22 bp, Homo sapiens
tgctggctccaacctggcatct

SEQ ID NO: 7709018 - DNA, 22 bp, Homo sapiens
tgctggctccaacctggcatct

SEQ ID NO: 7709019 - DNA, 22 bp, Homo sapiens
tgctggctcagtttgcagactc

SEQ ID NO: 7709020 - DNA, 22 bp, Homo sapiens
tgctggctccaacctggcatct

SEQ ID NO: 7709021 - DNA, 22 bp, Homo sapiens
tgctggctccaacctggcatct

SEQ ID NO: 7709022 - DNA, 22 bp, Homo sapiens
tgctggctccaacctggcatct

SEQ ID NO: 7709023 - DNA, 22 bp, Homo sapiens
tgctggctccaacctggcatct

SEQ ID NO: 7709024 - DNA, 22 bp, Homo sapiens
tgctggctcccaggagccgctg

SEQ ID NO: 7709025 - DNA, 22 bp, Homo sapiens
tgctggagtgagtggtttctta

SEQ ID NO: 7709026 - DNA, 22 bp, Homo sapiens
tgctggagtgcagtggcttaac

SEQ ID NO: 7709027 - DNA, 22 bp, Homo sapiens
tgctggagtgagtggtttctta

SEQ ID NO: 7709028 - DNA, 22 bp, Homo sapiens
tgctggagtggcactgtgtggc

SEQ ID NO: 7709029 - DNA, 22 bp, Homo sapiens
tgctggagtgcagtggcttaac

SEQ ID NO: 7709030 - DNA, 22 bp, Homo sapiens
tgctggagtggcactgtgtggc

SEQ ID NO: 7709031 - DNA, 22 bp, Homo sapiens
tgctggagtggcactgtgtggc

SEQ ID NO: 7709032 - DNA, 22 bp, Homo sapiens
tgctggagtggcactgtgtggc

SEQ ID NO: 7709033 - DNA, 22 bp, Homo sapiens
tgctggagtggcactgtgtggc

SEQ ID NO: 7709034 - DNA, 22 bp, Homo sapiens
tgctggagtggcactgtgtggc

SEQ ID NO: 7709035 - DNA, 22 bp, Homo sapiens
tgctggagtggcactgtgtggc

SEQ ID NO: 7709036 - DNA, 22 bp, Homo sapiens
tgctggagtggcactgtgtggc

SEQ ID NO: 7709037 - DNA, 22 bp, Homo sapiens
tgctggagttcgacattgcaaa

SEQ ID NO: 7709038 - DNA, 22 bp, Homo sapiens
tgctggagttcgacattgcaaa

SEQ ID NO: 7709039 - DNA, 22 bp, Homo sapiens
tgctggagttcgacattgcaaa

SEQ ID NO: 7709040 - DNA, 23 bp, Homo sapiens
tgctggagtttactcaggccagc

SEQ ID NO: 7709041 - DNA, 23 bp, Homo sapiens
tgctggagtttactcaggccagc

SEQ ID NO: 7709042 - DNA, 23 bp, Homo sapiens
tgctggagtttactcaggccagc

SEQ ID NO: 7709043 - DNA, 23 bp, Homo sapiens
tgctggagtttactcaggccagc

SEQ ID NO: 7709044 - DNA, 23 bp, Homo sapiens
tgctggagtttactcaggccagc

SEQ ID NO: 7709045 - DNA, 22 bp, Homo sapiens
tgctggatggagtaaaactgga

SEQ ID NO: 7709046 - DNA, 23 bp, Homo sapiens
tgctggagtttactcaggccagc

SEQ ID NO: 7709047 - DNA, 22 bp, Homo sapiens
tgctggcacatagagactggct

SEQ ID NO: 7709048 - DNA, 22 bp, Homo sapiens
tgctggcacatagagactggct

SEQ ID NO: 7709049 - DNA, 22 bp, Homo sapiens
tgctggcaatgctcttgacgtc

SEQ ID NO: 7709050 - DNA, 22 bp, Homo sapiens
tgctggcaatgctcttgacgtc

SEQ ID NO: 7709051 - DNA, 21 bp, Homo sapiens
tgctggcaagactcaggaata

SEQ ID NO: 7709052 - DNA, 17 bp, Homo sapiens
tgctggcaacatacaaa

SEQ ID NO: 7709053 - DNA, 22 bp, Homo sapiens
tgctggcatcttaatgttctgt

SEQ ID NO: 7709054 - DNA, 22 bp, Homo sapiens
tgctggcatcttaatgttctgt

SEQ ID NO: 7709055 - DNA, 20 bp, Homo sapiens
tgctggcatgcaagagggaa

SEQ ID NO: 7709056 - DNA, 22 bp, Homo sapiens
tgctggcatgcatgctgtagga

SEQ ID NO: 7709057 - DNA, 20 bp, Homo sapiens
tgctggcatgcaagagggaa

SEQ ID NO: 7709058 - DNA, 22 bp, Homo sapiens
tgctggcatggtcttggtgaca

SEQ ID NO: 7709059 - DNA, 22 bp, Homo sapiens
tgctggcatggtcttggtgaca

SEQ ID NO: 7709060 - DNA, 22 bp, Homo sapiens
tgctggcataccacctagttca

SEQ ID NO: 7709061 - DNA, 22 bp, Homo sapiens
tgctggcagtggcagtgatggt

SEQ ID NO: 7709062 - DNA, 22 bp, Homo sapiens
tgctggcagtggcagtgatggt

SEQ ID NO: 7709063 - DNA, 22 bp, Homo sapiens
tgctggcagtggcagtgatggt

SEQ ID NO: 7709064 - DNA, 22 bp, Homo sapiens
tgctggcaggcacctcctgggg

SEQ ID NO: 7709065 - DNA, 22 bp, Homo sapiens
tgctggcagcttctttaaatgt

SEQ ID NO: 7709066 - DNA, 22 bp, Homo sapiens
tgctggcaggcacctcctgggg

SEQ ID NO: 7709067 - DNA, 22 bp, Homo sapiens
tgctggcagccatgccttggaa

SEQ ID NO: 7709068 - DNA, 22 bp, Homo sapiens
tgctggcaccagaatgactgca

SEQ ID NO: 7709069 - DNA, 22 bp, Homo sapiens
tgctggatttgaccaagttgga

SEQ ID NO: 7709070 - DNA, 22 bp, Homo sapiens
tgctggcacatagagactggct

SEQ ID NO: 7709071 - DNA, 22 bp, Homo sapiens
tgctggcacatagagactggct

SEQ ID NO: 7709072 - DNA, 20 bp, Homo sapiens
tgctggcacgggtggactcc

SEQ ID NO: 7709073 - DNA, 20 bp, Homo sapiens
tgctggcacgggtggactcc

SEQ ID NO: 7709074 - DNA, 22 bp, Homo sapiens
tgctggcacgaaagggtgtcca

SEQ ID NO: 7709075 - DNA, 22 bp, Homo sapiens
tgctggcaccattttcggacat

SEQ ID NO: 7709076 - DNA, 22 bp, Homo sapiens
tgctggcagaaggctcgtggaa

SEQ ID NO: 7709077 - DNA, 22 bp, Homo sapiens
tgctggcacgtggaccaggaga

SEQ ID NO: 7709078 - DNA, 22 bp, Homo sapiens
tgctggcagccatgccttggaa

SEQ ID NO: 7709079 - DNA, 22 bp, Homo sapiens
tgctggcagaaggctcgtggaa

SEQ ID NO: 7709080 - DNA, 22 bp, Homo sapiens
tgctggcagaaggctcgtggaa

SEQ ID NO: 7709081 - DNA, 22 bp, Homo sapiens
tgctggcacgtgactgggaagt

SEQ ID NO: 7709082 - DNA, 20 bp, Homo sapiens
tgctggcacgggtggactcc

SEQ ID NO: 7709083 - DNA, 22 bp, Homo sapiens
tgctggcacgtgactgggaagt

SEQ ID NO: 7709084 - DNA, 22 bp, Homo sapiens
tgctggcacgtgactgggaagt

SEQ ID NO: 7709085 - DNA, 22 bp, Homo sapiens
tgctggagtaacaagacactca

SEQ ID NO: 7709086 - DNA, 19 bp, Homo sapiens
tgctggaggttgacagggt

SEQ ID NO: 7709087 - DNA, 19 bp, Homo sapiens
tgctggaggttgacagggt

SEQ ID NO: 7709088 - DNA, 19 bp, Homo sapiens
tgctggaggttgacagggt

SEQ ID NO: 7709089 - DNA, 19 bp, Homo sapiens
tgctggaggttgacagggt

SEQ ID NO: 7709090 - DNA, 19 bp, Homo sapiens
tgctggaggttgacagggt

SEQ ID NO: 7709091 - DNA, 19 bp, Homo sapiens
tgctggaggttgacagggt

SEQ ID NO: 7709092 - DNA, 22 bp, Homo sapiens
tgctggagtgagattatgagtt

SEQ ID NO: 7709093 - DNA, 19 bp, Homo sapiens
tgctggagtgacattctga

SEQ ID NO: 7709094 - DNA, 19 bp, Homo sapiens
tgctggagtgacattctga

SEQ ID NO: 7709095 - DNA, 22 bp, Homo sapiens
tgctggagtaacaagacactca

SEQ ID NO: 7709096 - DNA, 22 bp, Homo sapiens
tgctggagtaacaagacactca

SEQ ID NO: 7709097 - DNA, 22 bp, Homo sapiens
tgctggagtaacaagacactca

SEQ ID NO: 7709098 - DNA, 22 bp, Homo sapiens
tgctggagtaacaagacactca

SEQ ID NO: 7709099 - DNA, 22 bp, Homo sapiens
tgctggagtctcttgaccctgg

SEQ ID NO: 7709100 - DNA, 19 bp, Homo sapiens
tgctggagggtagtgagtc

SEQ ID NO: 7709101 - DNA, 22 bp, Homo sapiens
tgctggaggggcctgaccagga

SEQ ID NO: 7709102 - DNA, 22 bp, Homo sapiens
tgctggaggggcctgaccagga

SEQ ID NO: 7709103 - DNA, 22 bp, Homo sapiens
tgctggagggggtaccactcaa

SEQ ID NO: 7709104 - DNA, 22 bp, Homo sapiens
tgctggaggggcctgaccagga

SEQ ID NO: 7709105 - DNA, 22 bp, Homo sapiens
tgctggaggggcctgaccagga

SEQ ID NO: 7709106 - DNA, 22 bp, Homo sapiens
tgctggaggggatgccttcact

SEQ ID NO: 7709107 - DNA, 22 bp, Homo sapiens
tgctggaggggatgccttcact

SEQ ID NO: 7709108 - DNA, 22 bp, Homo sapiens
tgctggaggggatgccttcact

SEQ ID NO: 7709109 - DNA, 17 bp, Homo sapiens
tgctggaggcggggtat

SEQ ID NO: 7709110 - DNA, 17 bp, Homo sapiens
tgctggaggcggggtat

SEQ ID NO: 7709111 - DNA, 17 bp, Homo sapiens
tgctggaggcggggtat

SEQ ID NO: 7709112 - DNA, 22 bp, Homo sapiens
tgctggaggccgagaagcagca

SEQ ID NO: 7709113 - DNA, 22 bp, Homo sapiens
tgctggaggccagaagtctgag

SEQ ID NO: 7709114 - DNA, 22 bp, Homo sapiens
tgctggaggccgagaagcagca

SEQ ID NO: 7709115 - DNA, 22 bp, Homo sapiens
tgctggaggccagaagtctgag

SEQ ID NO: 7709116 - DNA, 22 bp, Homo sapiens
tgctggaggccgagaagcagca

SEQ ID NO: 7709117 - DNA, 22 bp, Homo sapiens
tgctggaggcctgactgtgttt

SEQ ID NO: 7709118 - DNA, 22 bp, Homo sapiens
tgctggaggccgagaagcagca

SEQ ID NO: 7709119 - DNA, 22 bp, Homo sapiens
tgctggaggccgagaagcagca

SEQ ID NO: 7709120 - DNA, 20 bp, Homo sapiens
tgctggaggcgccggcgctc

SEQ ID NO: 7709121 - DNA, 20 bp, Homo sapiens
tgctggaggcgccggcgctc

SEQ ID NO: 7709122 - DNA, 20 bp, Homo sapiens
tgctggaggcgccggcgctc

SEQ ID NO: 7709123 - DNA, 20 bp, Homo sapiens
tgctggaggcgccggcgctc

SEQ ID NO: 7709124 - DNA, 17 bp, Homo sapiens
tgctggaggcggggtat

SEQ ID NO: 7709125 - DNA, 22 bp, Homo sapiens
tgctggaggcctgactgtgttt

SEQ ID NO: 7709126 - DNA, 22 bp, Homo sapiens
tgctggaggccgagaagcagca

SEQ ID NO: 7709127 - DNA, 22 bp, Homo sapiens
tgctggaggcctgactgtgttt

SEQ ID NO: 7709128 - DNA, 22 bp, Homo sapiens
tgctggaggcctgactgtgttt

SEQ ID NO: 7709129 - DNA, 22 bp, Homo sapiens
tgctggaggcctgactgtgttt

SEQ ID NO: 7709130 - DNA, 22 bp, Homo sapiens
tgctggaggccagaagtctgag

SEQ ID NO: 7709131 - DNA, 22 bp, Homo sapiens
tgctggaggccagaagtctgag

SEQ ID NO: 7709132 - DNA, 22 bp, Homo sapiens
tgctggaggccagaagtctgag

SEQ ID NO: 7709133 - DNA, 22 bp, Homo sapiens
tgctggaggcagtggaggtgcc

SEQ ID NO: 7709134 - DNA, 22 bp, Homo sapiens
tgctggaggcagtggaggtgcc

SEQ ID NO: 7709135 - DNA, 22 bp, Homo sapiens
tgctggaggcagtggaggtgcc

SEQ ID NO: 7709136 - DNA, 22 bp, Homo sapiens
tgctggaggcagtggaggtgcc

SEQ ID NO: 7709137 - DNA, 22 bp, Homo sapiens
tgctggaggattaaacaagtca

SEQ ID NO: 7709138 - DNA, 22 bp, Homo sapiens
tgctggaggagtttactgtggc

SEQ ID NO: 7709139 - DNA, 22 bp, Homo sapiens
tgctggaggagtttactgtggc

SEQ ID NO: 7709140 - DNA, 22 bp, Homo sapiens
tgctggaggagtttactgtggc

SEQ ID NO: 7709141 - DNA, 22 bp, Homo sapiens
tgctggaggagtttactgtggc

SEQ ID NO: 7709142 - DNA, 22 bp, Homo sapiens
tgctggaggagaaggttgctca

SEQ ID NO: 7709143 - DNA, 22 bp, Homo sapiens
tgctggaggagtttactgtggc

SEQ ID NO: 7709144 - DNA, 22 bp, Homo sapiens
tgctaaataacttacatagtgg

SEQ ID NO: 7709145 - DNA, 22 bp, Homo sapiens
tgctaaataacttacatagtgg

SEQ ID NO: 7709146 - DNA, 22 bp, Homo sapiens
tgctaaagcaaactgtgctact

SEQ ID NO: 7709147 - DNA, 22 bp, Homo sapiens
tgctaaacaatgtacagtgtat

SEQ ID NO: 7709148 - DNA, 22 bp, Homo sapiens
tgctaaattcattattgattta

SEQ ID NO: 7709149 - DNA, 22 bp, Homo sapiens
tgctaaataagtggaatagaca

SEQ ID NO: 7709150 - DNA, 22 bp, Homo sapiens
tgcgtggctggtccctgtgacc

SEQ ID NO: 7709151 - DNA, 22 bp, Homo sapiens
tgcgtttaggacataaggagaa

SEQ ID NO: 7709152 - DNA, 22 bp, Homo sapiens
tgcgtttagtttcaagacacgt

SEQ ID NO: 7709153 - DNA, 22 bp, Homo sapiens
tgcgtgtgtgtatatacacagg

SEQ ID NO: 7709154 - DNA, 22 bp, Homo sapiens
tgcgttgcgctcctgcagcagg

SEQ ID NO: 7709155 - DNA, 23 bp, Homo sapiens
tgcgtgtgtgctgaggggcgtcc

SEQ ID NO: 7709156 - DNA, 20 bp, Homo sapiens
tgcgtgtgtatttattttct

SEQ ID NO: 7709157 - DNA, 22 bp, Homo sapiens
tgcgtggctggtccctgtgacc

SEQ ID NO: 7709158 - DNA, 22 bp, Homo sapiens
tgcgtggcgcagcgtgtgggat

SEQ ID NO: 7709159 - DNA, 22 bp, Homo sapiens
tgcgtggcgcagcgtgtgggat

SEQ ID NO: 7709160 - DNA, 22 bp, Homo sapiens
tgcgtagtacgaatttgtgcct

SEQ ID NO: 7709161 - DNA, 22 bp, Homo sapiens
tgcgtctggagtggagtttgaa

SEQ ID NO: 7709162 - DNA, 22 bp, Homo sapiens
tgcgtggctggtccctgtgacc

SEQ ID NO: 7709163 - DNA, 21 bp, Homo sapiens
tgcgtgtgcatggccttcggg

SEQ ID NO: 7709164 - DNA, 22 bp, Homo sapiens
tgcgtggctgcgaggacccagc

SEQ ID NO: 7709165 - DNA, 22 bp, Homo sapiens
tgcgtggcgcagcgtgtgggat

SEQ ID NO: 7709166 - DNA, 22 bp, Homo sapiens
tgcgtggctgcgaggacccagc

SEQ ID NO: 7709167 - DNA, 22 bp, Homo sapiens
tgcggggccctcccgtgcactg

SEQ ID NO: 7709168 - DNA, 22 bp, Homo sapiens
tgcgggggaagctgtgggagaa

SEQ ID NO: 7709169 - DNA, 22 bp, Homo sapiens
tgcgggtcccagggtcacaggc

SEQ ID NO: 7709170 - DNA, 22 bp, Homo sapiens
tgcgggtcccagggtcacaggc

SEQ ID NO: 7709171 - DNA, 23 bp, Homo sapiens
tgcgtacggctgccagtgtgact

SEQ ID NO: 7709172 - DNA, 22 bp, Homo sapiens
tgcgggtcccagggtcacaggc

SEQ ID NO: 7709173 - DNA, 22 bp, Homo sapiens
tgcgtactgtttatacatgtgt

SEQ ID NO: 7709174 - DNA, 22 bp, Homo sapiens
tgcgggttggtggcatatgcag

SEQ ID NO: 7709175 - DNA, 16 bp, Homo sapiens
tgcggcaacttgcggc

SEQ ID NO: 7709176 - DNA, 22 bp, Homo sapiens
tgcggcagccaccgcgtggccc

SEQ ID NO: 7709177 - DNA, 22 bp, Homo sapiens
tgcggaggtcggtgctgcgggc

SEQ ID NO: 7709178 - DNA, 22 bp, Homo sapiens
tgcggaggtcggtgctgcgggc

SEQ ID NO: 7709179 - DNA, 22 bp, Homo sapiens
tgcggaaggcagcgcagggtgg

SEQ ID NO: 7709180 - DNA, 22 bp, Homo sapiens
tgcggaaggcagcgcagggtgg

SEQ ID NO: 7709181 - DNA, 22 bp, Homo sapiens
tgcggagggagcagtcggctgt

SEQ ID NO: 7709182 - DNA, 22 bp, Homo sapiens
tgcggagggagcagtcggctgt

SEQ ID NO: 7709183 - DNA, 22 bp, Homo sapiens
tgcggagggagcagtcggctgt

SEQ ID NO: 7709184 - DNA, 22 bp, Homo sapiens
tgcggcaggagaaggtgttatg

SEQ ID NO: 7709185 - DNA, 22 bp, Homo sapiens
tgcggccaggaagtccttgatg

SEQ ID NO: 7709186 - DNA, 22 bp, Homo sapiens
tgcgggagtgcgccgagctctc

SEQ ID NO: 7709187 - DNA, 22 bp, Homo sapiens
tgcggctggtgctgaagctgag

SEQ ID NO: 7709188 - DNA, 22 bp, Homo sapiens
tgcggggagagaggtccaggat

SEQ ID NO: 7709189 - DNA, 22 bp, Homo sapiens
tgcggggccctcccgtgcactg

SEQ ID NO: 7709190 - DNA, 22 bp, Homo sapiens
tgcgcccagccaagtctggcac

SEQ ID NO: 7709191 - DNA, 22 bp, Homo sapiens
tgcgcccagccaagtctggcac

SEQ ID NO: 7709192 - DNA, 22 bp, Homo sapiens
tgcgcccagccaagtctggcac

SEQ ID NO: 7709193 - DNA, 22 bp, Homo sapiens
tgcgccatgtgctctcggccct

SEQ ID NO: 7709194 - DNA, 22 bp, Homo sapiens
tgcgcaggacacttgcagtgac

SEQ ID NO: 7709195 - DNA, 22 bp, Homo sapiens
tgcgcaggagctctgccaggag

SEQ ID NO: 7709196 - DNA, 22 bp, Homo sapiens
tgcgcatgcgtggctctccggc

SEQ ID NO: 7709197 - DNA, 22 bp, Homo sapiens
tgcgcatgagtctgtgcataca

SEQ ID NO: 7709198 - DNA, 22 bp, Homo sapiens
tgcgcatgagtctgtgcataca

SEQ ID NO: 7709199 - DNA, 22 bp, Homo sapiens
tgcgcaggacacttgcagtgac

SEQ ID NO: 7709200 - DNA, 22 bp, Homo sapiens
tgcgcaggagctctgccaggag

SEQ ID NO: 7709201 - DNA, 22 bp, Homo sapiens
tgcgcggctcagtcatctccag

SEQ ID NO: 7709202 - DNA, 22 bp, Homo sapiens
tgcgcctctaatctcgggcgtc

SEQ ID NO: 7709203 - DNA, 22 bp, Homo sapiens
tgcgcctctaatctcgggcgtc

SEQ ID NO: 7709204 - DNA, 22 bp, Homo sapiens
tgcgcctgcgcaaaggtttctg

SEQ ID NO: 7709205 - DNA, 22 bp, Homo sapiens
tgcgcctggggccctggctgtc

SEQ ID NO: 7709206 - DNA, 22 bp, Homo sapiens
tgcgcctgtaagtccagagtcc

SEQ ID NO: 7709207 - DNA, 22 bp, Homo sapiens
tgcgcctgtaagtccagagtcc

SEQ ID NO: 7709208 - DNA, 22 bp, Homo sapiens
tgctattattgtcaccactgta

SEQ ID NO: 7709209 - DNA, 22 bp, Homo sapiens
tgctattagaagccatgctgtt

SEQ ID NO: 7709210 - DNA, 22 bp, Homo sapiens
tgctattagaagccatgctgtt

SEQ ID NO: 7709211 - DNA, 22 bp, Homo sapiens
tgctatttaacttttatgtgta

SEQ ID NO: 7709212 - DNA, 22 bp, Homo sapiens
tgctatttaacttttatgtgta

SEQ ID NO: 7709213 - DNA, 21 bp, Homo sapiens
tgctatttaatttttctgttc

SEQ ID NO: 7709214 - DNA, 22 bp, Homo sapiens
tgctatttaacttttatgtgta

SEQ ID NO: 7709215 - DNA, 21 bp, Homo sapiens
tgctatttaatttttctgttc

SEQ ID NO: 7709216 - DNA, 19 bp, Homo sapiens
tgctatttagaacgcctgg

SEQ ID NO: 7709217 - DNA, 19 bp, Homo sapiens
tgctatttagaacgcctgg

SEQ ID NO: 7709218 - DNA, 22 bp, Homo sapiens
tgctattaaattaaattgatat

SEQ ID NO: 7709219 - DNA, 22 bp, Homo sapiens
tgctattaatgaggctgcattt

SEQ ID NO: 7709220 - DNA, 22 bp, Homo sapiens
tgctattacctgctggacagtc

SEQ ID NO: 7709221 - DNA, 22 bp, Homo sapiens
tgctattacctgctggacagtc

SEQ ID NO: 7709222 - DNA, 22 bp, Homo sapiens
tgctattacctgctggacagtc

SEQ ID NO: 7709223 - DNA, 22 bp, Homo sapiens
tgctatgtcgaaagggccatta

SEQ ID NO: 7709224 - DNA, 22 bp, Homo sapiens
tgctatgtgactgcttcagatt

SEQ ID NO: 7709225 - DNA, 22 bp, Homo sapiens
tgctatgtgactgcttcagatt

SEQ ID NO: 7709226 - DNA, 22 bp, Homo sapiens
tgctatgtatatatctttaagc

SEQ ID NO: 7709227 - DNA, 22 bp, Homo sapiens
tgctatgtccagcacagagtgg

SEQ ID NO: 7709228 - DNA, 22 bp, Homo sapiens
tgctataagaattatattactc

SEQ ID NO: 7709229 - DNA, 22 bp, Homo sapiens
tgctataagaattatattactc

SEQ ID NO: 7709230 - DNA, 22 bp, Homo sapiens
tgctagtgtgtgagatgttcaa

SEQ ID NO: 7709231 - DNA, 22 bp, Homo sapiens
tgctataagctccacgctgtag

SEQ ID NO: 7709232 - DNA, 22 bp, Homo sapiens
tgctataagctccacgctgtag

SEQ ID NO: 7709233 - DNA, 22 bp, Homo sapiens
tgctataagtagacattcaaca

SEQ ID NO: 7709234 - DNA, 22 bp, Homo sapiens
tgctataagtagacattcaaca

SEQ ID NO: 7709235 - DNA, 22 bp, Homo sapiens
tgctataagagtcacttttcct

SEQ ID NO: 7709236 - DNA, 22 bp, Homo sapiens
tgctataagagtcacttttcct

SEQ ID NO: 7709237 - DNA, 22 bp, Homo sapiens
tgctatacatgtacatattagt

SEQ ID NO: 7709238 - DNA, 22 bp, Homo sapiens
tgctataataatacagaggtga

SEQ ID NO: 7709239 - DNA, 22 bp, Homo sapiens
tgctatataatggaatttctaa

SEQ ID NO: 7709240 - DNA, 22 bp, Homo sapiens
tgctatacggagcatcttcagg

SEQ ID NO: 7709241 - DNA, 22 bp, Homo sapiens
tgctatataatggaatttctaa

SEQ ID NO: 7709242 - DNA, 22 bp, Homo sapiens
tgctatttctatctcatttaaa

SEQ ID NO: 7709243 - DNA, 22 bp, Homo sapiens
tgctatttctatctcatttaaa

SEQ ID NO: 7709244 - DNA, 22 bp, Homo sapiens
tgctatttctctgctgtaaaat

SEQ ID NO: 7709245 - DNA, 22 bp, Homo sapiens
tgctatttctctgctgtaaaat

SEQ ID NO: 7709246 - DNA, 22 bp, Homo sapiens
tgctatttctatctcatttaaa

SEQ ID NO: 7709247 - DNA, 19 bp, Homo sapiens
tgctatttgaagaagtgta

SEQ ID NO: 7709248 - DNA, 19 bp, Homo sapiens
tgctatttgaagaagtgta

SEQ ID NO: 7709249 - DNA, 22 bp, Homo sapiens
tgctatttggaaaagcatttgg

SEQ ID NO: 7709250 - DNA, 22 bp, Homo sapiens
tgctatttggaaaagcatttgg

SEQ ID NO: 7709251 - DNA, 22 bp, Homo sapiens
tgctatttggcacttttgacct

SEQ ID NO: 7709252 - DNA, 22 bp, Homo sapiens
tgctatttggcacttttgacct

SEQ ID NO: 7709253 - DNA, 22 bp, Homo sapiens
tgctatttggaaaagcatttgg

SEQ ID NO: 7709254 - DNA, 22 bp, Homo sapiens
tgctatttggcacttttgacct

SEQ ID NO: 7709255 - DNA, 22 bp, Homo sapiens
tgctatttgggggctacatgat

SEQ ID NO: 7709256 - DNA, 22 bp, Homo sapiens
tgctatttgggggctacatgat

SEQ ID NO: 7709257 - DNA, 22 bp, Homo sapiens
tgctatttgggggctacatgat

SEQ ID NO: 7709258 - DNA, 22 bp, Homo sapiens
tgctatttttatcttgatcaaa

SEQ ID NO: 7709259 - DNA, 22 bp, Homo sapiens
tgctattttgttttcagtccat

SEQ ID NO: 7709260 - DNA, 22 bp, Homo sapiens
tgctatttttatcttgatcaaa

SEQ ID NO: 7709261 - DNA, 22 bp, Homo sapiens
tgctatttttatcttgatcaaa

SEQ ID NO: 7709262 - DNA, 22 bp, Homo sapiens
tgctatttttatcttgatcaaa

SEQ ID NO: 7709263 - DNA, 18 bp, Homo sapiens
tgctcaaaagggattgct

SEQ ID NO: 7709264 - DNA, 18 bp, Homo sapiens
tgctcaaaagggattgct

SEQ ID NO: 7709265 - DNA, 22 bp, Homo sapiens
tgctattttggtctacagcact

SEQ ID NO: 7709266 - DNA, 22 bp, Homo sapiens
tgctattttggtctacagcact

SEQ ID NO: 7709267 - DNA, 22 bp, Homo sapiens
tgctattttggtctacagcact

SEQ ID NO: 7709268 - DNA, 22 bp, Homo sapiens
tgctattttgttttcagtccat

SEQ ID NO: 7709269 - DNA, 22 bp, Homo sapiens
tgctattttggtctacagcact

SEQ ID NO: 7709270 - DNA, 22 bp, Homo sapiens
tgctattttagacatactttgt

SEQ ID NO: 7709271 - DNA, 22 bp, Homo sapiens
tgctattttagacatactttgt

SEQ ID NO: 7709272 - DNA, 22 bp, Homo sapiens
tgctattttagacatactttgt

SEQ ID NO: 7709273 - DNA, 22 bp, Homo sapiens
tgctatttgtgagtgtcttcgt

SEQ ID NO: 7709274 - DNA, 22 bp, Homo sapiens
tgctatttgtgtaatggtaaat

SEQ ID NO: 7709275 - DNA, 22 bp, Homo sapiens
tgctatttgtgtaatggtaaat

SEQ ID NO: 7709276 - DNA, 22 bp, Homo sapiens
tgctatttgggggctacatgat

SEQ ID NO: 7709277 - DNA, 22 bp, Homo sapiens
tgctatttgtgagtgtcttcgt

SEQ ID NO: 7709278 - DNA, 22 bp, Homo sapiens
tgctcagacttaagaagatcag

SEQ ID NO: 7709279 - DNA, 22 bp, Homo sapiens
tgctcagagggtgatgtcattt

SEQ ID NO: 7709280 - DNA, 22 bp, Homo sapiens
tgctcagagctctggtgcaggt

SEQ ID NO: 7709281 - DNA, 22 bp, Homo sapiens
tgctcagagctctggtgcaggt

SEQ ID NO: 7709282 - DNA, 22 bp, Homo sapiens
tgctcagagctccagctctcct

SEQ ID NO: 7709283 - DNA, 22 bp, Homo sapiens
tgctcagacttaagaagatcag

SEQ ID NO: 7709284 - DNA, 18 bp, Homo sapiens
tgctcagagaaatcaagg

SEQ ID NO: 7709285 - DNA, 18 bp, Homo sapiens
tgctcagagaaatcaagg

SEQ ID NO: 7709286 - DNA, 22 bp, Homo sapiens
tgctcagacttaagaagatcag

SEQ ID NO: 7709287 - DNA, 22 bp, Homo sapiens
tgctcagacttaagaagatcag

SEQ ID NO: 7709288 - DNA, 22 bp, Homo sapiens
tgctcagacaagctgaacagta

SEQ ID NO: 7709289 - DNA, 22 bp, Homo sapiens
tgctcagacaagctgaacagta

SEQ ID NO: 7709290 - DNA, 22 bp, Homo sapiens
tgctcagactagctccagggaa

SEQ ID NO: 7709291 - DNA, 22 bp, Homo sapiens
tgctcagacaagctgaacagta

SEQ ID NO: 7709292 - DNA, 22 bp, Homo sapiens
tgctcagacaagctgaacagta

SEQ ID NO: 7709293 - DNA, 22 bp, Homo sapiens
tgctcagaattgcgctggtgga

SEQ ID NO: 7709294 - DNA, 22 bp, Homo sapiens
tgctcagaagacttactggtta

SEQ ID NO: 7709295 - DNA, 22 bp, Homo sapiens
tgctcagcagtcaaggtcatag

SEQ ID NO: 7709296 - DNA, 22 bp, Homo sapiens
tgctcagcagatctcaggagat

SEQ ID NO: 7709297 - DNA, 22 bp, Homo sapiens
tgctcagcacagaccaggccag

SEQ ID NO: 7709298 - DNA, 22 bp, Homo sapiens
tgctcagcaaaaagcttgtgag

SEQ ID NO: 7709299 - DNA, 21 bp, Homo sapiens
tgctcagattctccatctgga

SEQ ID NO: 7709300 - DNA, 22 bp, Homo sapiens
tgctcagattacagccccacat

SEQ ID NO: 7709301 - DNA, 21 bp, Homo sapiens
tgctcagattctccatctgga

SEQ ID NO: 7709302 - DNA, 21 bp, Homo sapiens
tgctcagattctccatctgga

SEQ ID NO: 7709303 - DNA, 21 bp, Homo sapiens
tgctcagattctccatctgga

SEQ ID NO: 7709304 - DNA, 19 bp, Homo sapiens
tgctcagctcctgtgagtc

SEQ ID NO: 7709305 - DNA, 19 bp, Homo sapiens
tgctcagctcctgtgagtc

SEQ ID NO: 7709306 - DNA, 22 bp, Homo sapiens
tgctcagccgtgagcagagccg

SEQ ID NO: 7709307 - DNA, 22 bp, Homo sapiens
tgctcagccgtgagcagagccg

SEQ ID NO: 7709308 - DNA, 22 bp, Homo sapiens
tgctcagcgccaaagctgatgg

SEQ ID NO: 7709309 - DNA, 22 bp, Homo sapiens
tgctcacaattatcagaagtat

SEQ ID NO: 7709310 - DNA, 22 bp, Homo sapiens
tgctcaagtgtttgttgaatgg

SEQ ID NO: 7709311 - DNA, 22 bp, Homo sapiens
tgctcaagtgtttgttgaatgg

SEQ ID NO: 7709312 - DNA, 23 bp, Homo sapiens
tgctcaatagaccataatatcca

SEQ ID NO: 7709313 - DNA, 22 bp, Homo sapiens
tgctcaatgtcttatgagactg

SEQ ID NO: 7709314 - DNA, 17 bp, Homo sapiens
tgctcaaatacttttga

SEQ ID NO: 7709315 - DNA, 17 bp, Homo sapiens
tgctcaaatacttttga

SEQ ID NO: 7709316 - DNA, 22 bp, Homo sapiens
tgctcaaatgtggacaactgat

SEQ ID NO: 7709317 - DNA, 17 bp, Homo sapiens
tgctcaaatacttttga

SEQ ID NO: 7709318 - DNA, 17 bp, Homo sapiens
tgctcaaatacttttga

SEQ ID NO: 7709319 - DNA, 22 bp, Homo sapiens
tgctcacactcatgtccacgct

SEQ ID NO: 7709320 - DNA, 18 bp, Homo sapiens
tgctcacactgacctctg

SEQ ID NO: 7709321 - DNA, 18 bp, Homo sapiens
tgctcacactgacctctg

SEQ ID NO: 7709322 - DNA, 22 bp, Homo sapiens
tgctcacaattatcagaagtat

SEQ ID NO: 7709323 - DNA, 21 bp, Homo sapiens
tgctcacagatgtgctcagtg

SEQ ID NO: 7709324 - DNA, 22 bp, Homo sapiens
tgctcacaggtgaccctgggca

SEQ ID NO: 7709325 - DNA, 21 bp, Homo sapiens
tgctcacagatgtgctcagtg

SEQ ID NO: 7709326 - DNA, 22 bp, Homo sapiens
tgctcacagcccagaacataat

SEQ ID NO: 7709327 - DNA, 22 bp, Homo sapiens
tgctcacaggtgaccctgggca

SEQ ID NO: 7709328 - DNA, 22 bp, Homo sapiens
tgctcactctattcacagtgcc

SEQ ID NO: 7709329 - DNA, 22 bp, Homo sapiens
tgctcactctattcacagtgcc

SEQ ID NO: 7709330 - DNA, 22 bp, Homo sapiens
tgctcacattaggcatccatgg

SEQ ID NO: 7709331 - DNA, 22 bp, Homo sapiens
tgctcactctattcacagtgcc

SEQ ID NO: 7709332 - DNA, 22 bp, Homo sapiens
tgctcactgaactcttgctgtc

SEQ ID NO: 7709333 - DNA, 19 bp, Homo sapiens
tgctcactctcagtccctc

SEQ ID NO: 7709334 - DNA, 22 bp, Homo sapiens
tgctcactgaactcttgctgtc

SEQ ID NO: 7709335 - DNA, 22 bp, Homo sapiens
tgctcagaaacgaggtgcagcc

SEQ ID NO: 7709336 - DNA, 22 bp, Homo sapiens
tgctcacttatccagttccact

SEQ ID NO: 7709337 - DNA, 22 bp, Homo sapiens
tgctcagaaacgaggtgcagcc

SEQ ID NO: 7709338 - DNA, 22 bp, Homo sapiens
tgctcagaaagccaccagagcg

SEQ ID NO: 7709339 - DNA, 22 bp, Homo sapiens
tgctcagaacatgattcaggcg

SEQ ID NO: 7709340 - DNA, 22 bp, Homo sapiens
tgctcagaactgtgaatacatg

SEQ ID NO: 7709341 - DNA, 22 bp, Homo sapiens
tgctcagaactgtgaatacatg

SEQ ID NO: 7709342 - DNA, 22 bp, Homo sapiens
tgctccacctcccagctaacat

SEQ ID NO: 7709343 - DNA, 22 bp, Homo sapiens
tgctccactaagccatcccatt

SEQ ID NO: 7709344 - DNA, 22 bp, Homo sapiens
tgctccactaagccatcccatt

SEQ ID NO: 7709345 - DNA, 22 bp, Homo sapiens
tgctccacctcccagctaacat

SEQ ID NO: 7709346 - DNA, 22 bp, Homo sapiens
tgctccactgtgcgtggccata

SEQ ID NO: 7709347 - DNA, 22 bp, Homo sapiens
tgctccactgtgcgtggccata

SEQ ID NO: 7709348 - DNA, 22 bp, Homo sapiens
tgctccactaagccatcccatt

SEQ ID NO: 7709349 - DNA, 22 bp, Homo sapiens
tgctccactcccaattgcatgt

SEQ ID NO: 7709350 - DNA, 22 bp, Homo sapiens
tgctcatttgcccattagcatc

SEQ ID NO: 7709351 - DNA, 22 bp, Homo sapiens
tgctcattggcgatctgaggga

SEQ ID NO: 7709352 - DNA, 22 bp, Homo sapiens
tgctcattggcgatctgaggga

SEQ ID NO: 7709353 - DNA, 22 bp, Homo sapiens
tgctccaccctcacactcttcc

SEQ ID NO: 7709354 - DNA, 22 bp, Homo sapiens
tgctccaccctcacactcttcc

SEQ ID NO: 7709355 - DNA, 22 bp, Homo sapiens
tgctccaccctcacactcttcc

SEQ ID NO: 7709356 - DNA, 22 bp, Homo sapiens
tgctccacctcccagctaacat

SEQ ID NO: 7709357 - DNA, 22 bp, Homo sapiens
tgctcattggcgatctgaggga

SEQ ID NO: 7709358 - DNA, 22 bp, Homo sapiens
tgctcattggcgatctgaggga

SEQ ID NO: 7709359 - DNA, 22 bp, Homo sapiens
tgctcattggcgatctgaggga

SEQ ID NO: 7709360 - DNA, 22 bp, Homo sapiens
tgctcattggcgatctgaggga

SEQ ID NO: 7709361 - DNA, 22 bp, Homo sapiens
tgctcattggcgatctgaggga

SEQ ID NO: 7709362 - DNA, 22 bp, Homo sapiens
tgctcattggcgatctgaggga

SEQ ID NO: 7709363 - DNA, 22 bp, Homo sapiens
tgctcattggcgatctgaggga

SEQ ID NO: 7709364 - DNA, 22 bp, Homo sapiens
tgctcatgctggggacagatgt

SEQ ID NO: 7709365 - DNA, 22 bp, Homo sapiens
tgctcattggcgatctgaggga

SEQ ID NO: 7709366 - DNA, 22 bp, Homo sapiens
tgctccagcaccaagagctcca

SEQ ID NO: 7709367 - DNA, 22 bp, Homo sapiens
tgctccagcaccaagagctcca

SEQ ID NO: 7709368 - DNA, 22 bp, Homo sapiens
tgctccagcaccaagagctcca

SEQ ID NO: 7709369 - DNA, 22 bp, Homo sapiens
tgctccagcaccaagagctcca

SEQ ID NO: 7709370 - DNA, 22 bp, Homo sapiens
tgctccagcaacaggcttagct

SEQ ID NO: 7709371 - DNA, 22 bp, Homo sapiens
tgctccagcaacaggcttagct

SEQ ID NO: 7709372 - DNA, 16 bp, Homo sapiens
tgctccagaggaccca

SEQ ID NO: 7709373 - DNA, 22 bp, Homo sapiens
tgctccagcaacaggcttagct

SEQ ID NO: 7709374 - DNA, 22 bp, Homo sapiens
tgctccagcaacaggcttagct

SEQ ID NO: 7709375 - DNA, 22 bp, Homo sapiens
tgctccagcaacaggcttagct

SEQ ID NO: 7709376 - DNA, 22 bp, Homo sapiens
tgctccagaacctgaccatgct

SEQ ID NO: 7709377 - DNA, 22 bp, Homo sapiens
tgctccagaacctgaccatgct

SEQ ID NO: 7709378 - DNA, 22 bp, Homo sapiens
tgctccagaacctgaccatgct

SEQ ID NO: 7709379 - DNA, 22 bp, Homo sapiens
tgctccagaacctgaccatgct

SEQ ID NO: 7709380 - DNA, 22 bp, Homo sapiens
tgctccagaaaaacttgagact

SEQ ID NO: 7709381 - DNA, 22 bp, Homo sapiens
tgctccacttgggcacccccca

SEQ ID NO: 7709382 - DNA, 22 bp, Homo sapiens
tgctccagaacctgaccatgct

SEQ ID NO: 7709383 - DNA, 22 bp, Homo sapiens
tgctccagaacctgaccatgct

SEQ ID NO: 7709384 - DNA, 22 bp, Homo sapiens
tgctccactgtgcgtggccata

SEQ ID NO: 7709385 - DNA, 22 bp, Homo sapiens
tgctccacttgggcacccccca

SEQ ID NO: 7709386 - DNA, 22 bp, Homo sapiens
tgctccagaaaaacttgagact

SEQ ID NO: 7709387 - DNA, 23 bp, Homo sapiens
tgctcagtctaaagaagaataac

SEQ ID NO: 7709388 - DNA, 23 bp, Homo sapiens
tgctcagtctaaagaagaataac

SEQ ID NO: 7709389 - DNA, 22 bp, Homo sapiens
tgctcagtcctcctgcagtgcc

SEQ ID NO: 7709390 - DNA, 22 bp, Homo sapiens
tgctcagtcctcctgcagtgcc

SEQ ID NO: 7709391 - DNA, 21 bp, Homo sapiens
tgctcagtctgtctccagctt

SEQ ID NO: 7709392 - DNA, 21 bp, Homo sapiens
tgctcagtctgtctccagctt

SEQ ID NO: 7709393 - DNA, 22 bp, Homo sapiens
tgctcagtcctaccttggctcc

SEQ ID NO: 7709394 - DNA, 22 bp, Homo sapiens
tgctcagtatagaaaatgatat

SEQ ID NO: 7709395 - DNA, 22 bp, Homo sapiens
tgctcagtcctcctgcagtgcc

SEQ ID NO: 7709396 - DNA, 22 bp, Homo sapiens
tgctcagtcctaccttggctcc

SEQ ID NO: 7709397 - DNA, 22 bp, Homo sapiens
tgctcagtcctcctgcagtgcc

SEQ ID NO: 7709398 - DNA, 22 bp, Homo sapiens
tgctcagtcctcctgcagtgcc

SEQ ID NO: 7709399 - DNA, 22 bp, Homo sapiens
tgctcagtatagaaaatgatat

SEQ ID NO: 7709400 - DNA, 22 bp, Homo sapiens
tgctcagtagcagtgtgctgct

SEQ ID NO: 7709401 - DNA, 22 bp, Homo sapiens
tgctcagtagcagtgtgctgct

SEQ ID NO: 7709402 - DNA, 22 bp, Homo sapiens
tgctcagcttcagaggatcccc

SEQ ID NO: 7709403 - DNA, 18 bp, Homo sapiens
tgctcagctggtgctgaa

SEQ ID NO: 7709404 - DNA, 22 bp, Homo sapiens
tgctcagctggtgccagggtcc

SEQ ID NO: 7709405 - DNA, 22 bp, Homo sapiens
tgctcattaggactgcaaattc

SEQ ID NO: 7709406 - DNA, 22 bp, Homo sapiens
tgctcatgctggggacagatgt

SEQ ID NO: 7709407 - DNA, 21 bp, Homo sapiens
tgctcatgcaatgcatgtcca

SEQ ID NO: 7709408 - DNA, 22 bp, Homo sapiens
tgctcagtgagtctgtgacagg

SEQ ID NO: 7709409 - DNA, 22 bp, Homo sapiens
tgctcagtgagtctgtgacagg

SEQ ID NO: 7709410 - DNA, 22 bp, Homo sapiens
tgctcagtgagtctgtgacagg

SEQ ID NO: 7709411 - DNA, 19 bp, Homo sapiens
tgctcagtggctaaaagca

SEQ ID NO: 7709412 - DNA, 19 bp, Homo sapiens
tgctcagtggctaaaagca

SEQ ID NO: 7709413 - DNA, 19 bp, Homo sapiens
tgctcagtggctaaaagca

SEQ ID NO: 7709414 - DNA, 22 bp, Homo sapiens
tgctcagttaagcagaggaaat

SEQ ID NO: 7709415 - DNA, 22 bp, Homo sapiens
tgctcagttaagcagaggaaat

SEQ ID NO: 7709416 - DNA, 22 bp, Homo sapiens
tgctcagttcaaggaaggtgga

SEQ ID NO: 7709417 - DNA, 22 bp, Homo sapiens
tgctcagttcaaggaaggtgga

SEQ ID NO: 7709418 - DNA, 22 bp, Homo sapiens
tgctcagttcaaggaaggtgga

SEQ ID NO: 7709419 - DNA, 22 bp, Homo sapiens
tgcctggctgaggtgacaggtt

SEQ ID NO: 7709420 - DNA, 22 bp, Homo sapiens
tgcctggctctatcagtggtgg

SEQ ID NO: 7709421 - DNA, 22 bp, Homo sapiens
tgcctggctgaggtgacaggtt

SEQ ID NO: 7709422 - DNA, 22 bp, Homo sapiens
tgcctggctgaggtgacaggtt

SEQ ID NO: 7709423 - DNA, 22 bp, Homo sapiens
tgcctggctgaggtgacaggtt

SEQ ID NO: 7709424 - DNA, 22 bp, Homo sapiens
tgcctggctgaggtgacaggtt

SEQ ID NO: 7709425 - DNA, 22 bp, Homo sapiens
tgcctggctgggctgctcatgg

SEQ ID NO: 7709426 - DNA, 22 bp, Homo sapiens
tgcctggctgggctgctcatgg

SEQ ID NO: 7709427 - DNA, 22 bp, Homo sapiens
tgcctggctgggctgctcatgg

SEQ ID NO: 7709428 - DNA, 22 bp, Homo sapiens
tgcctggctgggctgctcatgg

SEQ ID NO: 7709429 - DNA, 22 bp, Homo sapiens
tgcctggctgaggtgacaggtt

SEQ ID NO: 7709430 - DNA, 22 bp, Homo sapiens
tgcctggctgaggtgacaggtt

SEQ ID NO: 7709431 - DNA, 22 bp, Homo sapiens
tgcctggctctatcagtggtgg

SEQ ID NO: 7709432 - DNA, 22 bp, Homo sapiens
tgcctggctctatcagtggtgg

SEQ ID NO: 7709433 - DNA, 22 bp, Homo sapiens
tgcctggctctatcagtggtgg

SEQ ID NO: 7709434 - DNA, 22 bp, Homo sapiens
tgcctggctctatcagtggtgg

SEQ ID NO: 7709435 - DNA, 22 bp, Homo sapiens
tgcctggctctatcagtggtgg

SEQ ID NO: 7709436 - DNA, 22 bp, Homo sapiens
tgcctggctctatcagtggtgg

SEQ ID NO: 7709437 - DNA, 22 bp, Homo sapiens
tgcctggctaatttttgtatcc

SEQ ID NO: 7709438 - DNA, 21 bp, Homo sapiens
tgcctggcctttgcttttcct

SEQ ID NO: 7709439 - DNA, 21 bp, Homo sapiens
tgcctggcctttgcttttcct

SEQ ID NO: 7709440 - DNA, 20 bp, Homo sapiens
tgcctggcctttctctgccc

SEQ ID NO: 7709441 - DNA, 20 bp, Homo sapiens
tgcctggcctttctctgccc

SEQ ID NO: 7709442 - DNA, 22 bp, Homo sapiens
tgcctggccctgacagccctgg

SEQ ID NO: 7709443 - DNA, 22 bp, Homo sapiens
tgcctggccctgacagccctgg

SEQ ID NO: 7709444 - DNA, 22 bp, Homo sapiens
tgcctggccctgacagccctgg

SEQ ID NO: 7709445 - DNA, 20 bp, Homo sapiens
tgcctggcctttctctgccc

SEQ ID NO: 7709446 - DNA, 20 bp, Homo sapiens
tgcctggcctttctctgccc

SEQ ID NO: 7709447 - DNA, 20 bp, Homo sapiens
tgcctggcctttctctgccc

SEQ ID NO: 7709448 - DNA, 20 bp, Homo sapiens
tgcctggcctttctctgccc

SEQ ID NO: 7709449 - DNA, 20 bp, Homo sapiens
tgcctggcctttctctgccc

SEQ ID NO: 7709450 - DNA, 21 bp, Homo sapiens
tgcctggcctttgcttttcct

SEQ ID NO: 7709451 - DNA, 22 bp, Homo sapiens
tgcctggccctgacagccctgg

SEQ ID NO: 7709452 - DNA, 22 bp, Homo sapiens
tgcctggccagaccctatagag

SEQ ID NO: 7709453 - DNA, 22 bp, Homo sapiens
tgcctggccagaccctatagag

SEQ ID NO: 7709454 - DNA, 22 bp, Homo sapiens
tgcctggcatgttatagacaca

SEQ ID NO: 7709455 - DNA, 22 bp, Homo sapiens
tgcctggccctgacagccctgg

SEQ ID NO: 7709456 - DNA, 22 bp, Homo sapiens
tgcctggccctgacagccctgg

SEQ ID NO: 7709457 - DNA, 22 bp, Homo sapiens
tgcctggccctgacagccctgg

SEQ ID NO: 7709458 - DNA, 22 bp, Homo sapiens
tgcctggccctgacagccctgg

SEQ ID NO: 7709459 - DNA, 22 bp, Homo sapiens
tgcctggccctgacagccctgg

SEQ ID NO: 7709460 - DNA, 22 bp, Homo sapiens
tgcctggggattgctctgggcc

SEQ ID NO: 7709461 - DNA, 22 bp, Homo sapiens
tgcctgggggactaaggccaaa

SEQ ID NO: 7709462 - DNA, 22 bp, Homo sapiens
tgcctgggggactaaggccaaa

SEQ ID NO: 7709463 - DNA, 22 bp, Homo sapiens
tgcctgggggactaaggccaaa

SEQ ID NO: 7709464 - DNA, 22 bp, Homo sapiens
tgcctgggtccaggccaagcct

SEQ ID NO: 7709465 - DNA, 22 bp, Homo sapiens
tgcctgggtccaggccaagcct

SEQ ID NO: 7709466 - DNA, 22 bp, Homo sapiens
tgcctgggtccaggccaagcct

SEQ ID NO: 7709467 - DNA, 22 bp, Homo sapiens
tgcctggggttggcaaactgct

SEQ ID NO: 7709468 - DNA, 22 bp, Homo sapiens
tgcctggggttggcaaactgct

SEQ ID NO: 7709469 - DNA, 22 bp, Homo sapiens
tgcctgggtccaggccaagcct

SEQ ID NO: 7709470 - DNA, 22 bp, Homo sapiens
tgcctgggtccaggccaagcct

SEQ ID NO: 7709471 - DNA, 22 bp, Homo sapiens
tgcctgggtccaggccaagcct

SEQ ID NO: 7709472 - DNA, 22 bp, Homo sapiens
tgcctgggaaccaatcctggct

SEQ ID NO: 7709473 - DNA, 22 bp, Homo sapiens
tgcctgggaaccaatcctggct

SEQ ID NO: 7709474 - DNA, 22 bp, Homo sapiens
tgcctgggaaccaatcctggct

SEQ ID NO: 7709475 - DNA, 22 bp, Homo sapiens
tgcctgggaaccaatcctggct

SEQ ID NO: 7709476 - DNA, 22 bp, Homo sapiens
tgcctgggaaccaatcctggct

SEQ ID NO: 7709477 - DNA, 22 bp, Homo sapiens
tgcctggctgggctgctcatgg

SEQ ID NO: 7709478 - DNA, 22 bp, Homo sapiens
tgcctgggaaccaatcctggct

SEQ ID NO: 7709479 - DNA, 22 bp, Homo sapiens
tgcctggctgggctgctcatgg

SEQ ID NO: 7709480 - DNA, 22 bp, Homo sapiens
tgcctggctgggctgctcatgg

SEQ ID NO: 7709481 - DNA, 22 bp, Homo sapiens
tgcctggggattgctctgggcc

SEQ ID NO: 7709482 - DNA, 22 bp, Homo sapiens
tgcctggggattgctctgggcc

SEQ ID NO: 7709483 - DNA, 22 bp, Homo sapiens
tgcctggggattgctctgggcc

SEQ ID NO: 7709484 - DNA, 22 bp, Homo sapiens
tgcctggggattgctctgggcc

SEQ ID NO: 7709485 - DNA, 22 bp, Homo sapiens
tgcctgggctcggtagccatcg

SEQ ID NO: 7709486 - DNA, 22 bp, Homo sapiens
tgcctgggctcggtagccatcg

SEQ ID NO: 7709487 - DNA, 22 bp, Homo sapiens
tgcctgggctcggtagccatcg
